United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 34

SEQ ID NO: 1509614 - RNA, 14 nt, Human
acuuggaagcuccg

SEQ ID NO: 1509615 - RNA, 17 nt, Human
ucucaaaacugcacugu

SEQ ID NO: 1509616 - RNA, 16 nt, Human
ucuauuguuucuuuca

SEQ ID NO: 1509617 - RNA, 16 nt, Human
ucucaaaaaaagaaaa

SEQ ID NO: 1509618 - RNA, 22 nt, Human
acuucccuuucugcuuguguua

SEQ ID NO: 1509619 - RNA, 17 nt, Human
acuucgggaggucgagg

SEQ ID NO: 1509620 - RNA, 20 nt, Human
acuucgggaggucgaggcag

SEQ ID NO: 1509621 - RNA, 13 nt, Human
acuucuaaguaaa

SEQ ID NO: 1509622 - RNA, 22 nt, Human
acuucgggaggucgaggcagga

SEQ ID NO: 1509623 - RNA, 18 nt, Human
acuucuaaguaaaaccac

SEQ ID NO: 1509624 - RNA, 19 nt, Human
acuucuaaguaaaaccaca

SEQ ID NO: 1509625 - RNA, 21 nt, Human
acuucuaaguaaaaccacagc

SEQ ID NO: 1509626 - RNA, 22 nt, Human
acugaagaagcaccaaucauga

SEQ ID NO: 1509627 - RNA, 22 nt, Human
acugggcuuggggaccagagcu

SEQ ID NO: 1509628 - RNA, 21 nt, Human
acugggcuuggggaccagagc

SEQ ID NO: 1509629 - RNA, 15 nt, Human
acuggguacuugugg

SEQ ID NO: 1509630 - RNA, 16 nt, Human
ucgcugugccacaggc

SEQ ID NO: 1509631 - RNA, 23 nt, Human
ucgcugugucagcauagaaguaa

SEQ ID NO: 1509632 - RNA, 19 nt, Human
acuguacaugaaaacacau

SEQ ID NO: 1509633 - RNA, 17 nt, Human
acuggguacuuguggac

SEQ ID NO: 1509634 - RNA, 18 nt, Human
acuggguacuuguggaca

SEQ ID NO: 1509635 - RNA, 16 nt, Human
acuguacaaaguagaa

SEQ ID NO: 1509636 - RNA, 22 nt, Human
acuguacaaaguagaagucuua

SEQ ID NO: 1509637 - RNA, 14 nt, Human
acuguaucaugaca

SEQ ID NO: 1509638 - RNA, 21 nt, Human
acuguacaugaaaacacauuu

SEQ ID NO: 1509639 - RNA, 20 nt, Human
acuguacaugaaaacacauu

SEQ ID NO: 1509640 - RNA, 23 nt, Human
acugucagcuccccucggagaag

SEQ ID NO: 1509641 - RNA, 20 nt, Human
acuguaucaugacaaagacu

SEQ ID NO: 1509642 - RNA, 16 nt, Human
acuguaucaugacaaa

SEQ ID NO: 1509643 - RNA, 23 nt, Human
ucgucacugcuuaacuucacaua

SEQ ID NO: 1509644 - RNA, 13 nt, Human
acuguggguagac

SEQ ID NO: 1509645 - RNA, 17 nt, Human
acuguuaauaguucagg

SEQ ID NO: 1509646 - RNA, 21 nt, Human
acuguuaauaguucagguaac

SEQ ID NO: 1509647 - RNA, 17 nt, Human
ucuaccaaaaaucucaa

SEQ ID NO: 1509648 - RNA, 21 nt, Human
ucuacccucuuagaaaaacca

SEQ ID NO: 1509649 - RNA, 14 nt, Human
ucuacccuggcacu

SEQ ID NO: 1509650 - RNA, 21 nt, Human
ucuaagauaguaacaaugaag

SEQ ID NO: 1509651 - RNA, 17 nt, Human
ucuaaagcugccagccg

SEQ ID NO: 1509652 - RNA, 16 nt, Human
ucuaaaggcuaccuuu

SEQ ID NO: 1509653 - RNA, 13 nt, Human
ucuaaaggcuacc

SEQ ID NO: 1509654 - RNA, 14 nt, Human
uauguguaaaaugu

SEQ ID NO: 1509655 - RNA, 17 nt, Human
uauguguaaaaugugaa

SEQ ID NO: 1509656 - RNA, 15 nt, Human
acaucuugcucugcu

SEQ ID NO: 1509657 - RNA, 16 nt, Human
acaucuugcucugcug

SEQ ID NO: 1509658 - RNA, 24 nt, Human
acaucuuuucuugccucugucccc

SEQ ID NO: 1509659 - RNA, 19 nt, Human
acaucuuggucagauuuga

SEQ ID NO: 1509660 - RNA, 17 nt, Human
acaucuugcucugcuga

SEQ ID NO: 1509661 - RNA, 14 nt, Human
uauuuuaaaagaau

SEQ ID NO: 1509662 - RNA, 18 nt, Human
uauuuuaaaagaaugauu

SEQ ID NO: 1509663 - RNA, 16 nt, Human
acaugaaaacacauuu

SEQ ID NO: 1509664 - RNA, 15 nt, Human
acaugaaaacacauu

SEQ ID NO: 1509665 - RNA, 20 nt, Human
uauuuguuaaugguuugaau

SEQ ID NO: 1509666 - RNA, 22 nt, Human
uauuuguuaaugguuugaauau

SEQ ID NO: 1509667 - RNA, 19 nt, Human
uauuuuaauaauguuucaa

SEQ ID NO: 1509668 - RNA, 22 nt, Human
uauuuuaauaauguuucaaaca

SEQ ID NO: 1509669 - RNA, 13 nt, Human
uauuuuacauaaa

SEQ ID NO: 1509670 - RNA, 15 nt, Human
uauuuugcuuuguga

SEQ ID NO: 1509671 - RNA, 13 nt, Human
uauuuugcuuugu

SEQ ID NO: 1509672 - RNA, 20 nt, Human
uauuuugcuuugugauuuuu

SEQ ID NO: 1509673 - RNA, 15 nt, Human
uauuuuguucauaca

SEQ ID NO: 1509674 - RNA, 16 nt, Human
uauuuuguucauacau

SEQ ID NO: 1509675 - RNA, 17 nt, Human
uauuuuuauuuguuugu

SEQ ID NO: 1509676 - RNA, 12 nt, Human
uauuuuucacau

SEQ ID NO: 1509677 - RNA, 13 nt, Human
uauuuuucacaua

SEQ ID NO: 1509678 - RNA, 13 nt, Human
uauuuuuguagca

SEQ ID NO: 1509679 - RNA, 17 nt, Human
uauuuuuguagagccag

SEQ ID NO: 1509680 - RNA, 21 nt, Human
ucaaauacgugggcauucaaa

SEQ ID NO: 1509681 - RNA, 22 nt, Human
ucaaauacgugggcauucaaau

SEQ ID NO: 1509682 - RNA, 23 nt, Human
ucaaauacgugggcauucaaaug

SEQ ID NO: 1509683 - RNA, 23 nt, Human
acaugaaaacacauuuuucuuag

SEQ ID NO: 1509684 - RNA, 13 nt, Human
acaugagcaucag

SEQ ID NO: 1509685 - RNA, 15 nt, Human
uauuuuuguagcacu

SEQ ID NO: 1509686 - RNA, 19 nt, Human
uauuuuuguagcacugaca

SEQ ID NO: 1509687 - RNA, 16 nt, Human
ucaaaagcugggcagg

SEQ ID NO: 1509688 - RNA, 13 nt, Human
ucaaacagucuca

SEQ ID NO: 1509689 - RNA, 20 nt, Human
ucaaacagucucaggaaauc

SEQ ID NO: 1509690 - RNA, 21 nt, Human
ucaaacagucucaggaaauca

SEQ ID NO: 1509691 - RNA, 22 nt, Human
ucaaacagucucaggaaaucaa

SEQ ID NO: 1509692 - RNA, 22 nt, Human
ucaaagauauuuugcuuuguga

SEQ ID NO: 1509693 - RNA, 20 nt, Human
ucaaagauauuuugcuuugu

SEQ ID NO: 1509694 - RNA, 13 nt, Human
ucaaagauauuuu

SEQ ID NO: 1509695 - RNA, 22 nt, Human
acauggcuggagcuagaauuug

SEQ ID NO: 1509696 - RNA, 14 nt, Human
acauggccuuugcu

SEQ ID NO: 1509697 - RNA, 15 nt, Human
acauggaguauaugu

SEQ ID NO: 1509698 - RNA, 19 nt, Human
acauggaguauaugucaag

SEQ ID NO: 1509699 - RNA, 23 nt, Human
acaugagcaucaggccaggcccu

SEQ ID NO: 1509700 - RNA, 16 nt, Human
acaugagguacugaga

SEQ ID NO: 1509701 - RNA, 18 nt, Human
acauggaauaacauguaa

SEQ ID NO: 1509702 - RNA, 20 nt, Human
acauggaauaacauguaauu

SEQ ID NO: 1509703 - RNA, 19 nt, Human
acauguauaauauuuuuaa

SEQ ID NO: 1509704 - RNA, 20 nt, Human
acauguauaauauuuuuaau

SEQ ID NO: 1509705 - RNA, 14 nt, Human
acauguauaauauu

SEQ ID NO: 1509706 - RNA, 21 nt, Human
acaugucuuuucuugcaugag

SEQ ID NO: 1509707 - RNA, 16 nt, Human
acauuggaaacaaguc

SEQ ID NO: 1509708 - RNA, 21 nt, Human
acauugcggacagccacggcc

SEQ ID NO: 1509709 - RNA, 22 nt, Human
acauugcggacagccacggcca

SEQ ID NO: 1509710 - RNA, 19 nt, Human
acauuguacgaagaguauu

SEQ ID NO: 1509711 - RNA, 17 nt, Human
acauuguaaauaguauu

SEQ ID NO: 1509712 - RNA, 19 nt, Human
acauuguaaauaguauuug

SEQ ID NO: 1509713 - RNA, 21 nt, Human
acauuguaaauaguauuugag

SEQ ID NO: 1509714 - RNA, 19 nt, Human
acauuuuuaagugcugcau

SEQ ID NO: 1509715 - RNA, 18 nt, Human
acauuuuuaagugcugca

SEQ ID NO: 1509716 - RNA, 15 nt, Human
acauuuuuaagugcu

SEQ ID NO: 1509717 - RNA, 23 nt, Human
acauuuuucuuagggaaggauac

SEQ ID NO: 1509718 - RNA, 13 nt, Human
acauuuuucuuag

SEQ ID NO: 1509719 - RNA, 17 nt, Human
ucaagagggucugagga

SEQ ID NO: 1509720 - RNA, 23 nt, Human
ucaauauuucagauaaucacaau

SEQ ID NO: 1509721 - RNA, 22 nt, Human
ucaauaggaaaaacugauuuuu

SEQ ID NO: 1509722 - RNA, 17 nt, Human
ucaauauuuuccaugaa

SEQ ID NO: 1509723 - RNA, 18 nt, Human
ucaauauuuuccaugaaa

SEQ ID NO: 1509724 - RNA, 15 nt, Human
ucaauauuuuccaug

SEQ ID NO: 1509725 - RNA, 16 nt, Human
ucaauauuuuccauga

SEQ ID NO: 1509726 - RNA, 16 nt, Human
ucaagugauucuccug

SEQ ID NO: 1509727 - RNA, 17 nt, Human
ucaagugauucuccugc

SEQ ID NO: 1509728 - RNA, 18 nt, Human
ucaagugauucuccugcc

SEQ ID NO: 1509729 - RNA, 18 nt, Human
ucaauaggaaaaacugau

SEQ ID NO: 1509730 - RNA, 19 nt, Human
ucaauaggaaaaacugauu

SEQ ID NO: 1509731 - RNA, 16 nt, Human
ucacagaccuuugaac

SEQ ID NO: 1509732 - RNA, 12 nt, Human
ucaauuuaaaaa

SEQ ID NO: 1509733 - RNA, 13 nt, Human
ucaauuuaaaaaa

SEQ ID NO: 1509734 - RNA, 19 nt, Human
ucacagcuccaagaauuuc

SEQ ID NO: 1509735 - RNA, 17 nt, Human
ucacagccagacuggca

SEQ ID NO: 1509736 - RNA, 23 nt, Human
ucacagccagacuggcacaguuu

SEQ ID NO: 1509737 - RNA, 15 nt, Human
ucacagaugggugcu

SEQ ID NO: 1509738 - RNA, 14 nt, Human
ucacagaugggugc

SEQ ID NO: 1509739 - RNA, 13 nt, Human
ucacauuccugaa

SEQ ID NO: 1509740 - RNA, 17 nt, Human
ucacauuccugaacagg

SEQ ID NO: 1509741 - RNA, 20 nt, Human
ucacauuccugaacaggaua

SEQ ID NO: 1509742 - RNA, 17 nt, Human
ucaccagccccagugcc

SEQ ID NO: 1509743 - RNA, 20 nt, Human
ucacauauugauuuccguua

SEQ ID NO: 1509744 - RNA, 18 nt, Human
ucacauauugauuuccgu

SEQ ID NO: 1509745 - RNA, 16 nt, Human
ucacauauugauuucc

SEQ ID NO: 1509746 - RNA, 14 nt, Human
ucacaggaaguaga

SEQ ID NO: 1509747 - RNA, 23 nt, Human
accaaaaaucucaauauuucaga

SEQ ID NO: 1509748 - RNA, 16 nt, Human
accaaauaaaaauauu

SEQ ID NO: 1509749 - RNA, 18 nt, Human
accaaauaaaaauauugu

SEQ ID NO: 1509750 - RNA, 16 nt, Human
accaaaucagcugcua

SEQ ID NO: 1509751 - RNA, 19 nt, Human
accaaaucagcugcuacua

SEQ ID NO: 1509752 - RNA, 20 nt, Human
accaaccacugcgaccacaa

SEQ ID NO: 1509753 - RNA, 17 nt, Human
accaacauacucccauc

SEQ ID NO: 1509754 - RNA, 16 nt, Human
accaacauacucccau

SEQ ID NO: 1509755 - RNA, 14 nt, Human
accaacacgagcag

SEQ ID NO: 1509756 - RNA, 19 nt, Human
accaacacgagcaggcuac

SEQ ID NO: 1509757 - RNA, 16 nt, Human
accacaagacugcaca

SEQ ID NO: 1509758 - RNA, 17 nt, Human
accacacagaggcugcc

SEQ ID NO: 1509759 - RNA, 15 nt, Human
accacacccagccca

SEQ ID NO: 1509760 - RNA, 16 nt, Human
accacacccagcccac

SEQ ID NO: 1509761 - RNA, 20 nt, Human
accacacccagcccacuucu

SEQ ID NO: 1509762 - RNA, 21 nt, Human
accacacccagcccacuucug

SEQ ID NO: 1509763 - RNA, 23 nt, Human
accacacccagcccacuucugcc

SEQ ID NO: 1509764 - RNA, 23 nt, Human
ucacugagacagcccgggcucug

SEQ ID NO: 1509765 - RNA, 19 nt, Human
ucacauuccugaacaggau

SEQ ID NO: 1509766 - RNA, 22 nt, Human
ucaccagccccagugcccacag

SEQ ID NO: 1509767 - RNA, 21 nt, Human
ucacuauguugcccaggcagg

SEQ ID NO: 1509768 - RNA, 18 nt, Human
ucacugcaaccuccgccu

SEQ ID NO: 1509769 - RNA, 14 nt, Human
ucacuguugcccag

SEQ ID NO: 1509770 - RNA, 15 nt, Human
ucacuguugcccagg

SEQ ID NO: 1509771 - RNA, 16 nt, Human
ucacuguugcccaggc

SEQ ID NO: 1509772 - RNA, 19 nt, Human
accauucuccaccugccag

SEQ ID NO: 1509773 - RNA, 20 nt, Human
accauucuccaccugccagg

SEQ ID NO: 1509774 - RNA, 21 nt, Human
accauucuccaccugccaggg

SEQ ID NO: 1509775 - RNA, 22 nt, Human
accauuuugcugucccuuuucc

SEQ ID NO: 1509776 - RNA, 23 nt, Human
accauuuugcugucccuuuuccu

SEQ ID NO: 1509777 - RNA, 21 nt, Human
accauuuugggguacccacug

SEQ ID NO: 1509778 - RNA, 22 nt, Human
accauuuugggguacccacugc

SEQ ID NO: 1509779 - RNA, 16 nt, Human
acccaaauguucauca

SEQ ID NO: 1509780 - RNA, 20 nt, Human
acccaaauguucaucaauga

SEQ ID NO: 1509781 - RNA, 20 nt, Human
acccacugcuuuuggucugu

SEQ ID NO: 1509782 - RNA, 11 nt, Human
accccagcucu

SEQ ID NO: 1509783 - RNA, 11 nt, Human
acccaggugcu

SEQ ID NO: 1509784 - RNA, 23 nt, Human
acccaggugcuaggaacacuccu

SEQ ID NO: 1509785 - RNA, 13 nt, Human
accccagguuucu

SEQ ID NO: 1509786 - RNA, 13 nt, Human
acccaggagcccc

SEQ ID NO: 1509787 - RNA, 19 nt, Human
acccaggagccccgaggcc

SEQ ID NO: 1509788 - RNA, 15 nt, Human
acccaggagccccga

SEQ ID NO: 1509789 - RNA, 13 nt, Human
acccagcgagccc

SEQ ID NO: 1509790 - RNA, 16 nt, Human
acccagcgagcccugg

SEQ ID NO: 1509791 - RNA, 17 nt, Human
acccagcgagcccuggu

SEQ ID NO: 1509792 - RNA, 15 nt, Human
acccagcccacuucu

SEQ ID NO: 1509793 - RNA, 16 nt, Human
ucagaauucucuaguu

SEQ ID NO: 1509794 - RNA, 20 nt, Human
ucagaauucucagaaucuca

SEQ ID NO: 1509795 - RNA, 10 nt, Human
ucagaauucu

SEQ ID NO: 1509796 - RNA, 12 nt, Human
ucagaauucuca

SEQ ID NO: 1509797 - RNA, 16 nt, Human
ucagagacuccugcag

SEQ ID NO: 1509798 - RNA, 23 nt, Human
ucagagacuccugcaggcagcca

SEQ ID NO: 1509799 - RNA, 16 nt, Human
ucagaucucuaacuuc

SEQ ID NO: 1509800 - RNA, 15 nt, Human
acccgggaggcagag

SEQ ID NO: 1509801 - RNA, 21 nt, Human
acccuccuuucaccacaugug

SEQ ID NO: 1509802 - RNA, 17 nt, Human
acccucauguucuuaau

SEQ ID NO: 1509803 - RNA, 15 nt, Human
acccucauguucuua

SEQ ID NO: 1509804 - RNA, 14 nt, Human
acccucauguucuu

SEQ ID NO: 1509805 - RNA, 22 nt, Human
acccgggaagggggcugggaca

SEQ ID NO: 1509806 - RNA, 19 nt, Human
acccgggaagggggcuggg

SEQ ID NO: 1509807 - RNA, 20 nt, Human
acccgggaagggggcuggga

SEQ ID NO: 1509808 - RNA, 23 nt, Human
acccugaggcccagagggccugc

SEQ ID NO: 1509809 - RNA, 11 nt, Human
acccugaggcc

SEQ ID NO: 1509810 - RNA, 13 nt, Human
acccugaggccca

SEQ ID NO: 1509811 - RNA, 19 nt, Human
acccugaggcccagagggc

SEQ ID NO: 1509812 - RNA, 21 nt, Human
acccugaggcccagagggccu

SEQ ID NO: 1509813 - RNA, 19 nt, Human
acccgcuaagagggaggga

SEQ ID NO: 1509814 - RNA, 23 nt, Human
ucaggguuggccccugcccggcu

SEQ ID NO: 1509815 - RNA, 18 nt, Human
ucaggguuggccccugcc

SEQ ID NO: 1509816 - RNA, 19 nt, Human
ucaggguuggccccugccc

SEQ ID NO: 1509817 - RNA, 20 nt, Human
ucaggccaggcccucugccc

SEQ ID NO: 1509818 - RNA, 19 nt, Human
ucaggccaggcccucugcc

SEQ ID NO: 1509819 - RNA, 17 nt, Human
ucaggccaggcccucug

SEQ ID NO: 1509820 - RNA, 18 nt, Human
ucaggccaggcccucugc

SEQ ID NO: 1509821 - RNA, 12 nt, Human
ucaggggugugc

SEQ ID NO: 1509822 - RNA, 19 nt, Human
ucaggggugugcggccuuu

SEQ ID NO: 1509823 - RNA, 23 nt, Human
ucaggggugugcggccuuuggcu

SEQ ID NO: 1509824 - RNA, 13 nt, Human
ucaggccagcugc

SEQ ID NO: 1509825 - RNA, 14 nt, Human
ucaggccagcugcu

SEQ ID NO: 1509826 - RNA, 13 nt, Human
ucaggccaggccc

SEQ ID NO: 1509827 - RNA, 14 nt, Human
ucaggccaggcccu

SEQ ID NO: 1509828 - RNA, 15 nt, Human
ucaggccaggcccuc

SEQ ID NO: 1509829 - RNA, 16 nt, Human
ucaggccaggcccucu

SEQ ID NO: 1509830 - RNA, 12 nt, Human
acccccagccug

SEQ ID NO: 1509831 - RNA, 14 nt, Human
acccccagccugcu

SEQ ID NO: 1509832 - RNA, 13 nt, Human
acccccagccugc

SEQ ID NO: 1509833 - RNA, 17 nt, Human
ucaggcaggugggaugg

SEQ ID NO: 1509834 - RNA, 18 nt, Human
ucaggcaggugggaugga

SEQ ID NO: 1509835 - RNA, 21 nt, Human
accgaacugauguaaguaaac

SEQ ID NO: 1509836 - RNA, 22 nt, Human
ucagguggggucacucuggcag

SEQ ID NO: 1509837 - RNA, 21 nt, Human
accgaaaacguggcugcuuca

SEQ ID NO: 1509838 - RNA, 22 nt, Human
accgaaaacguggcugcuucaa

SEQ ID NO: 1509839 - RNA, 23 nt, Human
ucagguggggucacucuggcagc

SEQ ID NO: 1509840 - RNA, 15 nt, Human
ucaggugucccugca

SEQ ID NO: 1509841 - RNA, 17 nt, Human
ucaggugucccugcacu

SEQ ID NO: 1509842 - RNA, 18 nt, Human
ucaggugucccugcacuu

SEQ ID NO: 1509843 - RNA, 20 nt, Human
acccuugccgucuaccugag

SEQ ID NO: 1509844 - RNA, 17 nt, Human
acccuggaaaaugaauc

SEQ ID NO: 1509845 - RNA, 15 nt, Human
acccuugugguccca

SEQ ID NO: 1509846 - RNA, 13 nt, Human
ucaguaauaacuc

SEQ ID NO: 1509847 - RNA, 13 nt, Human
ucaguaagccgug

SEQ ID NO: 1509848 - RNA, 22 nt, Human
ucaggugucccugcacuugcag

SEQ ID NO: 1509849 - RNA, 19 nt, Human
ucaguuguuagugugucuu

SEQ ID NO: 1509850 - RNA, 14 nt, Human
ucaguggcagcugc

SEQ ID NO: 1509851 - RNA, 15 nt, Human
ucaguggcagcugcu

SEQ ID NO: 1509852 - RNA, 16 nt, Human
ucaguggcagcugcuu

SEQ ID NO: 1509853 - RNA, 19 nt, Human
ucagugccuuauggaacac

SEQ ID NO: 1509854 - RNA, 20 nt, Human
ucagugccuuauggaacacu

SEQ ID NO: 1509855 - RNA, 22 nt, Human
ucagugccuuauggaacacucu

SEQ ID NO: 1509856 - RNA, 23 nt, Human
ucagugccuuauggaacacucug

SEQ ID NO: 1509857 - RNA, 21 nt, Human
uccugaaaacccuugccaugu

SEQ ID NO: 1509858 - RNA, 22 nt, Human
uccugaaaacccuugccaugug

SEQ ID NO: 1509859 - RNA, 12 nt, Human
uccucugcugcu

SEQ ID NO: 1509860 - RNA, 13 nt, Human
acugaaacuuccc

SEQ ID NO: 1509861 - RNA, 15 nt, Human
uccugaagaauugaa

SEQ ID NO: 1509862 - RNA, 17 nt, Human
uccucuccccaugaugu

SEQ ID NO: 1509863 - RNA, 14 nt, Human
uccucccaccucag

SEQ ID NO: 1509864 - RNA, 15 nt, Human
uccucccaccucagc

SEQ ID NO: 1509865 - RNA, 16 nt, Human
uccucccaccucagcc

SEQ ID NO: 1509866 - RNA, 18 nt, Human
uccucccaccucagccuc

SEQ ID NO: 1509867 - RNA, 20 nt, Human
uccucccaccucagccuccc

SEQ ID NO: 1509868 - RNA, 21 nt, Human
uccucccaccucagccucccg

SEQ ID NO: 1509869 - RNA, 17 nt, Human
acucgcgacaaugcaaa

SEQ ID NO: 1509870 - RNA, 15 nt, Human
acucgcgacaaugca

SEQ ID NO: 1509871 - RNA, 16 nt, Human
acucgcgacaaugcaa

SEQ ID NO: 1509872 - RNA, 21 nt, Human
acucuuauugcccacgcugga

SEQ ID NO: 1509873 - RNA, 19 nt, Human
acucuggcagcucagagag

SEQ ID NO: 1509874 - RNA, 20 nt, Human
acucuggcagcucagagagg

SEQ ID NO: 1509875 - RNA, 16 nt, Human
acucuggcagcucaga

SEQ ID NO: 1509876 - RNA, 17 nt, Human
acucuggcagcucagag

SEQ ID NO: 1509877 - RNA, 14 nt, Human
acuccagaaaguga

SEQ ID NO: 1509878 - RNA, 18 nt, Human
acuccagaaagugacaag

SEQ ID NO: 1509879 - RNA, 13 nt, Human
uccguuaaaauac

SEQ ID NO: 1509880 - RNA, 15 nt, Human
uccguuaaaauacca

SEQ ID NO: 1509881 - RNA, 13 nt, Human
acucgagaacuuu

SEQ ID NO: 1509882 - RNA, 17 nt, Human
acucgagaacuuucauu

SEQ ID NO: 1509883 - RNA, 16 nt, Human
acucgaguuacagaca

SEQ ID NO: 1509884 - RNA, 12 nt, Human
uccuacucugug

SEQ ID NO: 1509885 - RNA, 21 nt, Human
uccuagccugugccucuggga

SEQ ID NO: 1509886 - RNA, 21 nt, Human
acuccaaacugacucuuaaga

SEQ ID NO: 1509887 - RNA, 18 nt, Human
acucauugaccugaggcc

SEQ ID NO: 1509888 - RNA, 22 nt, Human
acucauugaccugaggcccuuc

SEQ ID NO: 1509889 - RNA, 12 nt, Human
acucaucuuagg

SEQ ID NO: 1509890 - RNA, 16 nt, Human
acucauugaccugagg

SEQ ID NO: 1509891 - RNA, 17 nt, Human
acucauugaccugaggc

SEQ ID NO: 1509892 - RNA, 21 nt, Human
acucaccugccccucaacucu

SEQ ID NO: 1509893 - RNA, 14 nt, Human
acucaccugccccu

SEQ ID NO: 1509894 - RNA, 19 nt, Human
acucaccugccccucaacu

SEQ ID NO: 1509895 - RNA, 14 nt, Human
acucagaagacacu

SEQ ID NO: 1509896 - RNA, 15 nt, Human
acucagaagacacug

SEQ ID NO: 1509897 - RNA, 16 nt, Human
acucagaagacacuga

SEQ ID NO: 1509898 - RNA, 17 nt, Human
acucagaagacacugau

SEQ ID NO: 1509899 - RNA, 18 nt, Human
acucagaagacacugaug

SEQ ID NO: 1509900 - RNA, 22 nt, Human
acucagaauucucuaguuugau

SEQ ID NO: 1509901 - RNA, 21 nt, Human
acucagaauucucuaguuuga

SEQ ID NO: 1509902 - RNA, 14 nt, Human
acucagaauucucu

SEQ ID NO: 1509903 - RNA, 14 nt, Human
acucagaauauugc

SEQ ID NO: 1509904 - RNA, 11 nt, Human
ucccucuuucc

SEQ ID NO: 1509905 - RNA, 13 nt, Human
ucccucuuucccu

SEQ ID NO: 1509906 - RNA, 18 nt, Human
ucccucagucuggcccuu

SEQ ID NO: 1509907 - RNA, 12 nt, Human
uccccugacagg

SEQ ID NO: 1509908 - RNA, 15 nt, Human
uccccugacagggcc

SEQ ID NO: 1509909 - RNA, 20 nt, Human
ucccucagucuggcccuucc

SEQ ID NO: 1509910 - RNA, 17 nt, Human
acucaccccagccccaa

SEQ ID NO: 1509911 - RNA, 23 nt, Human
ucccugaaggccccgcccaggcu

SEQ ID NO: 1509912 - RNA, 14 nt, Human
ucccucuuucccuc

SEQ ID NO: 1509913 - RNA, 18 nt, Human
ucccugaaggccccgccc

SEQ ID NO: 1509914 - RNA, 21 nt, Human
ucccugaaggccccgcccagg

SEQ ID NO: 1509915 - RNA, 22 nt, Human
ucccugaaggccccgcccaggc

SEQ ID NO: 1509916 - RNA, 20 nt, Human
acuagaguuuagcuggaaaa

SEQ ID NO: 1509917 - RNA, 18 nt, Human
acuacggaauaguuggcu

SEQ ID NO: 1509918 - RNA, 11 nt, Human
ucccccagccc

SEQ ID NO: 1509919 - RNA, 19 nt, Human
ucccccacccccuccccgc

SEQ ID NO: 1509920 - RNA, 22 nt, Human
uccccacuugagaauuacccuu

SEQ ID NO: 1509921 - RNA, 14 nt, Human
acguacacauuuua

SEQ ID NO: 1509922 - RNA, 13 nt, Human
acguacacauuuu

SEQ ID NO: 1509923 - RNA, 12 nt, Human
acguacacauuu

SEQ ID NO: 1509924 - RNA, 13 nt, Human
acguacacacaca

SEQ ID NO: 1509925 - RNA, 12 nt, Human
acuauguaucaa

SEQ ID NO: 1509926 - RNA, 13 nt, Human
acuauucaaacag

SEQ ID NO: 1509927 - RNA, 14 nt, Human
acuauucaaacagu

SEQ ID NO: 1509928 - RNA, 16 nt, Human
acuauucaaacagucu

SEQ ID NO: 1509929 - RNA, 18 nt, Human
acuauucaaacagucuca

SEQ ID NO: 1509930 - RNA, 21 nt, Human
acuauaauguaagcucuacug

SEQ ID NO: 1509931 - RNA, 12 nt, Human
acuauaauguaa

SEQ ID NO: 1509932 - RNA, 13 nt, Human
acuauaauguaag

SEQ ID NO: 1509933 - RNA, 14 nt, Human
acuauaauguaagc

SEQ ID NO: 1509934 - RNA, 21 nt, Human
acucacauuuauucugcucac

SEQ ID NO: 1509935 - RNA, 20 nt, Human
acucacauggcuauguuuua

SEQ ID NO: 1509936 - RNA, 19 nt, Human
acucacauuuauucugcuc

SEQ ID NO: 1509937 - RNA, 20 nt, Human
acucacauuuauucugcuca

SEQ ID NO: 1509938 - RNA, 12 nt, Human
acucaauauuuu

SEQ ID NO: 1509939 - RNA, 15 nt, Human
acucaauauuuucca

SEQ ID NO: 1509940 - RNA, 18 nt, Human
acucaauauuuuccauga

SEQ ID NO: 1509941 - RNA, 21 nt, Human
acucaauauuuuccaugaaaa

SEQ ID NO: 1509942 - RNA, 22 nt, Human
acucaauauuuuccaugaaaau

SEQ ID NO: 1509943 - RNA, 14 nt, Human
acucaaugcacuga

SEQ ID NO: 1509944 - RNA, 23 nt, Human
acucaauauuuuccaugaaaaug

SEQ ID NO: 1509945 - RNA, 16 nt, Human
acucacauggcuaugu

SEQ ID NO: 1509946 - RNA, 19 nt, Human
acucacauggcuauguuuu

SEQ ID NO: 1509947 - RNA, 14 nt, Human
ucccacaaaggaga

SEQ ID NO: 1509948 - RNA, 21 nt, Human
ucccaaagugcugggauuaca

SEQ ID NO: 1509949 - RNA, 16 nt, Human
ucccaaagugcuggga

SEQ ID NO: 1509950 - RNA, 15 nt, Human
ucccaaagugcuggg

SEQ ID NO: 1509951 - RNA, 15 nt, Human
acggggcucuucuca

SEQ ID NO: 1509952 - RNA, 18 nt, Human
acggggcucuucucauuu

SEQ ID NO: 1509953 - RNA, 11 nt, Human
ucccaccccac

SEQ ID NO: 1509954 - RNA, 14 nt, Human
ucccaccccacaca

SEQ ID NO: 1509955 - RNA, 20 nt, Human
uccagugaggcucugcccuu

SEQ ID NO: 1509956 - RNA, 14 nt, Human
uccagugagacagc

SEQ ID NO: 1509957 - RNA, 18 nt, Human
uccagugaggcucugccc

SEQ ID NO: 1509958 - RNA, 19 nt, Human
uccagugaggcucugcccu

SEQ ID NO: 1509959 - RNA, 15 nt, Human
acggcucacugcagc

SEQ ID NO: 1509960 - RNA, 14 nt, Human
acggcucacugcag

SEQ ID NO: 1509961 - RNA, 15 nt, Human
uccaugaguccccug

SEQ ID NO: 1509962 - RNA, 16 nt, Human
uccaugaguccccugu

SEQ ID NO: 1509963 - RNA, 17 nt, Human
uccaugaguccccuguu

SEQ ID NO: 1509964 - RNA, 11 nt, Human
uccauccugag

SEQ ID NO: 1509965 - RNA, 12 nt, Human
uccaugaaaaug

SEQ ID NO: 1509966 - RNA, 16 nt, Human
acggccaggccagagg

SEQ ID NO: 1509967 - RNA, 21 nt, Human
acggagucccaccuuggcugc

SEQ ID NO: 1509968 - RNA, 19 nt, Human
acggagucccaccuuggcu

SEQ ID NO: 1509969 - RNA, 17 nt, Human
acgcucucuggccuucg

SEQ ID NO: 1509970 - RNA, 14 nt, Human
acgcccccacuggu

SEQ ID NO: 1509971 - RNA, 23 nt, Human
acgcgugcacacaccagagccca

SEQ ID NO: 1509972 - RNA, 15 nt, Human
acgcucucuggccuu

SEQ ID NO: 1509973 - RNA, 16 nt, Human
acgcucucuggccuuc

SEQ ID NO: 1509974 - RNA, 18 nt, Human
acgcuacccgggaagggg

SEQ ID NO: 1509975 - RNA, 13 nt, Human
acgcuacccggga

SEQ ID NO: 1509976 - RNA, 17 nt, Human
acgcuacccgggaaggg

SEQ ID NO: 1509977 - RNA, 15 nt, Human
acgacugcccggcag

SEQ ID NO: 1509978 - RNA, 18 nt, Human
acgccaggggaaaaucag

SEQ ID NO: 1509979 - RNA, 14 nt, Human
acgagggugccgug

SEQ ID NO: 1509980 - RNA, 23 nt, Human
acgccaggggaaaaucagccugc

SEQ ID NO: 1509981 - RNA, 11 nt, Human
acgccauccca

SEQ ID NO: 1509982 - RNA, 14 nt, Human
acgccaucccagcc

SEQ ID NO: 1509983 - RNA, 15 nt, Human
acgccaucccagccc

SEQ ID NO: 1509984 - RNA, 16 nt, Human
acgccaucccagcccc

SEQ ID NO: 1509985 - RNA, 17 nt, Human
acgccaucccagcccca

SEQ ID NO: 1509986 - RNA, 18 nt, Human
acgccaucccagccccaa

SEQ ID NO: 1509987 - RNA, 18 nt, Human
uccaggcugggagagccu

SEQ ID NO: 1509988 - RNA, 14 nt, Human
uccaggcugggaga

SEQ ID NO: 1509989 - RNA, 17 nt, Human
uccaggcugggagagcc

SEQ ID NO: 1509990 - RNA, 14 nt, Human
acgaauauugcuga

SEQ ID NO: 1509991 - RNA, 22 nt, Human
acgaagaguauuuuugacagaa

SEQ ID NO: 1509992 - RNA, 20 nt, Human
acgaagaguauuuuugacag

SEQ ID NO: 1509993 - RNA, 12 nt, Human
uccacccaccuc

SEQ ID NO: 1509994 - RNA, 13 nt, Human
uccacccaccuca

SEQ ID NO: 1509995 - RNA, 17 nt, Human
uccacccaccucagccu

SEQ ID NO: 1509996 - RNA, 20 nt, Human
uccacccaggagccccgagg

SEQ ID NO: 1509997 - RNA, 12 nt, Human
accuggccucug

SEQ ID NO: 1509998 - RNA, 13 nt, Human
accuggccucugc

SEQ ID NO: 1509999 - RNA, 20 nt, Human
uccaaaaagauuuucagaaa

SEQ ID NO: 1510000 - RNA, 18 nt, Human
uccaaggguacuaaggaa

SEQ ID NO: 1510001 - RNA, 21 nt, Human
accuggguaacuagggaagau

SEQ ID NO: 1510002 - RNA, 22 nt, Human
accuggggggcaguggugugga

SEQ ID NO: 1510003 - RNA, 22 nt, Human
accuucuccuucaccuuugucc

SEQ ID NO: 1510004 - RNA, 13 nt, Human
accuuugucccca

SEQ ID NO: 1510005 - RNA, 17 nt, Human
accuuuuuuauacauaa

SEQ ID NO: 1510006 - RNA, 16 nt, Human
accuuuuuuauacaua

SEQ ID NO: 1510007 - RNA, 18 nt, Human
accuuuuuuauacauaaa

SEQ ID NO: 1510008 - RNA, 14 nt, Human
accuuuguccccac

SEQ ID NO: 1510009 - RNA, 15 nt, Human
accuuuguccccacc

SEQ ID NO: 1510010 - RNA, 16 nt, Human
accuuuguccccaccg

SEQ ID NO: 1510011 - RNA, 14 nt, Human
accuuuuuuauaca

SEQ ID NO: 1510012 - RNA, 18 nt, Human
accugccaggaagccagc

SEQ ID NO: 1510013 - RNA, 19 nt, Human
accugccaggaagccagca

SEQ ID NO: 1510014 - RNA, 16 nt, Human
accugccaggaagcca

SEQ ID NO: 1510015 - RNA, 17 nt, Human
accugccaggaagccag

SEQ ID NO: 1510016 - RNA, 14 nt, Human
accugauugugucu

SEQ ID NO: 1510017 - RNA, 16 nt, Human
accugaggggccucuu

SEQ ID NO: 1510018 - RNA, 14 nt, Human
accugaggggccuc

SEQ ID NO: 1510019 - RNA, 16 nt, Human
ucauaauaaguugcau

SEQ ID NO: 1510020 - RNA, 13 nt, Human
ucauaaugacuua

SEQ ID NO: 1510021 - RNA, 12 nt, Human
ucauaaugacuu

SEQ ID NO: 1510022 - RNA, 19 nt, Human
accugaauuuuggcugugu

SEQ ID NO: 1510023 - RNA, 18 nt, Human
accugaagacucauucuu

SEQ ID NO: 1510024 - RNA, 23 nt, Human
accugaggcccuucucuccagcc

SEQ ID NO: 1510025 - RNA, 12 nt, Human
accugagcccca

SEQ ID NO: 1510026 - RNA, 17 nt, Human
accugagccccaaaagg

SEQ ID NO: 1510027 - RNA, 16 nt, Human
ucauuugucacacacu

SEQ ID NO: 1510028 - RNA, 14 nt, Human
ucauuugucacaca

SEQ ID NO: 1510029 - RNA, 19 nt, Human
ucauuuuuaguagagacag

SEQ ID NO: 1510030 - RNA, 18 nt, Human
ucauuuuuuuuaagaaaa

SEQ ID NO: 1510031 - RNA, 19 nt, Human
uccaaaaagauuuucagaa

SEQ ID NO: 1510032 - RNA, 18 nt, Human
accugcggugcuaucucc

SEQ ID NO: 1510033 - RNA, 16 nt, Human
accugcggugcuaucu

SEQ ID NO: 1510034 - RNA, 21 nt, Human
accugcgucucauacucaccu

SEQ ID NO: 1510035 - RNA, 23 nt, Human
accugccuguugggccaggagcc

SEQ ID NO: 1510036 - RNA, 20 nt, Human
accuggaauauauaaccagu

SEQ ID NO: 1510037 - RNA, 15 nt, Human
uagaaacacaacuau

SEQ ID NO: 1510038 - RNA, 16 nt, Human
uagaacucccuuucaa

SEQ ID NO: 1510039 - RNA, 17 nt, Human
uagaaacauguaauccu

SEQ ID NO: 1510040 - RNA, 17 nt, Human
uagaacucccuuucaac

SEQ ID NO: 1510041 - RNA, 18 nt, Human
uagaacucccuuucaaca

SEQ ID NO: 1510042 - RNA, 17 nt, Human
aauuccaauuauaugag

SEQ ID NO: 1510043 - RNA, 22 nt, Human
uagaauuugauaugugaacagu

SEQ ID NO: 1510044 - RNA, 20 nt, Human
uagaauuugauaugugaaca

SEQ ID NO: 1510045 - RNA, 15 nt, Human
uagaagucacacagu

SEQ ID NO: 1510046 - RNA, 13 nt, Human
uagacacacauga

SEQ ID NO: 1510047 - RNA, 18 nt, Human
uagacaauuuauuauggc

SEQ ID NO: 1510048 - RNA, 10 nt, Human
uagacagagu

SEQ ID NO: 1510049 - RNA, 21 nt, Human
uagacagagucucacuguugc

SEQ ID NO: 1510050 - RNA, 17 nt, Human
uagacagucccugccaa

SEQ ID NO: 1510051 - RNA, 21 nt, Human
uagacagucccugccaaugga

SEQ ID NO: 1510052 - RNA, 14 nt, Human
aauuugugauacaa

SEQ ID NO: 1510053 - RNA, 18 nt, Human
aauuugggggaaaauuua

SEQ ID NO: 1510054 - RNA, 16 nt, Human
aauuuggauugcuaau

SEQ ID NO: 1510055 - RNA, 18 nt, Human
aauuugugauacaaugcu

SEQ ID NO: 1510056 - RNA, 17 nt, Human
aauuugugauacaaugc

SEQ ID NO: 1510057 - RNA, 20 nt, Human
aauuugugauacaaugcugu

SEQ ID NO: 1510058 - RNA, 20 nt, Human
aauuuuacauggcuggagcu

SEQ ID NO: 1510059 - RNA, 13 nt, Human
acaaaaacacagc

SEQ ID NO: 1510060 - RNA, 16 nt, Human
acaaaaagcuacuuau

SEQ ID NO: 1510061 - RNA, 16 nt, Human
acaaaaacacagcaag

SEQ ID NO: 1510062 - RNA, 14 nt, Human
acaaaaacacagca

SEQ ID NO: 1510063 - RNA, 15 nt, Human
acaaaaacacagcaa

SEQ ID NO: 1510064 - RNA, 22 nt, Human
uagagcggagaaaggaagggcu

SEQ ID NO: 1510065 - RNA, 14 nt, Human
uagagccagggucu

SEQ ID NO: 1510066 - RNA, 14 nt, Human
uagaggguguguaa

SEQ ID NO: 1510067 - RNA, 16 nt, Human
uagcacagacccugcc

SEQ ID NO: 1510068 - RNA, 15 nt, Human
uagcacagacccugc

SEQ ID NO: 1510069 - RNA, 20 nt, Human
uagcacagacccugcccugu

SEQ ID NO: 1510070 - RNA, 21 nt, Human
uagcacagacccugcccugug

SEQ ID NO: 1510071 - RNA, 14 nt, Human
uagcacagacccug

SEQ ID NO: 1510072 - RNA, 12 nt, Human
uagccaaggcca

SEQ ID NO: 1510073 - RNA, 16 nt, Human
uagcacuuugggaggc

SEQ ID NO: 1510074 - RNA, 22 nt, Human
uagcacagacccugcccugugg

SEQ ID NO: 1510075 - RNA, 24 nt, Human
uagcacagacccugcccugugggc

SEQ ID NO: 1510076 - RNA, 14 nt, Human
uagcacugacagau

SEQ ID NO: 1510077 - RNA, 19 nt, Human
uagcacugacagauuucca

SEQ ID NO: 1510078 - RNA, 14 nt, Human
uagccaaggccaaa

SEQ ID NO: 1510079 - RNA, 13 nt, Human
uagccaaggccaa

SEQ ID NO: 1510080 - RNA, 15 nt, Human
uagcuuggaaacugg

SEQ ID NO: 1510081 - RNA, 20 nt, Human
uagcuuggaaacuggaugag

SEQ ID NO: 1510082 - RNA, 13 nt, Human
uagcuuuuuucuc

SEQ ID NO: 1510083 - RNA, 23 nt, Human
uagcuuuuuucucugauacagaa

SEQ ID NO: 1510084 - RNA, 13 nt, Human
uaggaaaaacuga

SEQ ID NO: 1510085 - RNA, 14 nt, Human
uaggaaaaacugau

SEQ ID NO: 1510086 - RNA, 17 nt, Human
uagcgcccaguugggug

SEQ ID NO: 1510087 - RNA, 21 nt, Human
uagccuuagaagucacacagu

SEQ ID NO: 1510088 - RNA, 14 nt, Human
uagcgcccaguugg

SEQ ID NO: 1510089 - RNA, 20 nt, Human
uagccuuagaagucacacag

SEQ ID NO: 1510090 - RNA, 21 nt, Human
uagggaaggauacaaaagcau

SEQ ID NO: 1510091 - RNA, 13 nt, Human
uagggaagauaau

SEQ ID NO: 1510092 - RNA, 18 nt, Human
uaggcaaccuuuauuuuu

SEQ ID NO: 1510093 - RNA, 13 nt, Human
uaggauguugaaa

SEQ ID NO: 1510094 - RNA, 16 nt, Human
uaggaaaaacugauuu

SEQ ID NO: 1510095 - RNA, 17 nt, Human
uaggaaaaacugauuuu

SEQ ID NO: 1510096 - RNA, 14 nt, Human
uagucacugagaca

SEQ ID NO: 1510097 - RNA, 15 nt, Human
uaguagagacagggu

SEQ ID NO: 1510098 - RNA, 22 nt, Human
uaguagagacaggguuuugcca

SEQ ID NO: 1510099 - RNA, 16 nt, Human
acacaguauuacuucu

SEQ ID NO: 1510100 - RNA, 16 nt, Human
acacaggcccggcucc

SEQ ID NO: 1510101 - RNA, 17 nt, Human
acacaggcccggcucca

SEQ ID NO: 1510102 - RNA, 18 nt, Human
acacaggcccggcuccag

SEQ ID NO: 1510103 - RNA, 23 nt, Human
acacaggcccggcuccaggcucc

SEQ ID NO: 1510104 - RNA, 24 nt, Human
acacaggcccggcuccaggcuccu

SEQ ID NO: 1510105 - RNA, 19 nt, Human
acacaggcccggcuccagg

SEQ ID NO: 1510106 - RNA, 20 nt, Human
acacaggcccggcuccaggc

SEQ ID NO: 1510107 - RNA, 21 nt, Human
acacaggcccggcuccaggcu

SEQ ID NO: 1510108 - RNA, 22 nt, Human
acacaggcccggcuccaggcuc

SEQ ID NO: 1510109 - RNA, 13 nt, Human
acacaacuauauu

SEQ ID NO: 1510110 - RNA, 23 nt, Human
acaaugcaaaccaucauugaaau

SEQ ID NO: 1510111 - RNA, 19 nt, Human
acaaugcaaaccaucauug

SEQ ID NO: 1510112 - RNA, 21 nt, Human
acaaugcaaaccaucauugaa

SEQ ID NO: 1510113 - RNA, 22 nt, Human
acaaugacuuacuguacaugaa

SEQ ID NO: 1510114 - RNA, 20 nt, Human
acaaugacuuacuguacaug

SEQ ID NO: 1510115 - RNA, 11 nt, Human
acaaugcaaac

SEQ ID NO: 1510116 - RNA, 16 nt, Human
acaaugcaaaccauca

SEQ ID NO: 1510117 - RNA, 17 nt, Human
acaaugcaaaccaucau

SEQ ID NO: 1510118 - RNA, 18 nt, Human
acaaugcaaaccaucauu

SEQ ID NO: 1510119 - RNA, 19 nt, Human
uaggguaagugagagaggg

SEQ ID NO: 1510120 - RNA, 17 nt, Human
uaggguuauaauaaugu

SEQ ID NO: 1510121 - RNA, 15 nt, Human
uaggguuauaauaau

SEQ ID NO: 1510122 - RNA, 19 nt, Human
uauccaacaucaacaucuu

SEQ ID NO: 1510123 - RNA, 17 nt, Human
uaucagaauucucagaa

SEQ ID NO: 1510124 - RNA, 14 nt, Human
acagaccuuugaac

SEQ ID NO: 1510125 - RNA, 22 nt, Human
uaucaaagggugaaaauuauuu

SEQ ID NO: 1510126 - RNA, 18 nt, Human
uaucaaagggugaaaauu

SEQ ID NO: 1510127 - RNA, 19 nt, Human
uaucaaagggugaaaauua

SEQ ID NO: 1510128 - RNA, 14 nt, Human
uaucacaaaucuua

SEQ ID NO: 1510129 - RNA, 16 nt, Human
uaucacaaaucuuaac

SEQ ID NO: 1510130 - RNA, 20 nt, Human
uaucacaaaucuuaacuuga

SEQ ID NO: 1510131 - RNA, 22 nt, Human
uaucacccagaagaaaauagug

SEQ ID NO: 1510132 - RNA, 19 nt, Human
uaucacccagaagaaaaua

SEQ ID NO: 1510133 - RNA, 13 nt, Human
acagaaauguaca

SEQ ID NO: 1510134 - RNA, 19 nt, Human
acagacauacuaaccagca

SEQ ID NO: 1510135 - RNA, 18 nt, Human
acagacauacuaaccagc

SEQ ID NO: 1510136 - RNA, 18 nt, Human
acacuuacacuuuaugca

SEQ ID NO: 1510137 - RNA, 21 nt, Human
acacuuacacuuuaugcacaa

SEQ ID NO: 1510138 - RNA, 18 nt, Human
acacuguuucaaacuuua

SEQ ID NO: 1510139 - RNA, 17 nt, Human
acacuguuucaaacuuu

SEQ ID NO: 1510140 - RNA, 17 nt, Human
acacucauugaccugag

SEQ ID NO: 1510141 - RNA, 19 nt, Human
acacucauugaccugaggc

SEQ ID NO: 1510142 - RNA, 23 nt, Human
acacuguuucaaacuuuacuaug

SEQ ID NO: 1510143 - RNA, 20 nt, Human
acacuguuucaaacuuuacu

SEQ ID NO: 1510144 - RNA, 16 nt, Human
acacuuacacuuuaug

SEQ ID NO: 1510145 - RNA, 19 nt, Human
uauauauuuuuuucugaaa

SEQ ID NO: 1510146 - RNA, 14 nt, Human
uauauauuuuaauu

SEQ ID NO: 1510147 - RNA, 20 nt, Human
uauauccuuucuaacaaaaa

SEQ ID NO: 1510148 - RNA, 21 nt, Human
uauaucuauauuuuacauaaa

SEQ ID NO: 1510149 - RNA, 16 nt, Human
acacucaguuguucaa

SEQ ID NO: 1510150 - RNA, 16 nt, Human
acacucauugaccuga

SEQ ID NO: 1510151 - RNA, 16 nt, Human
uauaggugcuacaaaa

SEQ ID NO: 1510152 - RNA, 20 nt, Human
uauaggugcuacaaaaacac

SEQ ID NO: 1510153 - RNA, 23 nt, Human
uauaggaacuuaaauaaugugaa

SEQ ID NO: 1510154 - RNA, 12 nt, Human
uauaggaauuga

SEQ ID NO: 1510155 - RNA, 18 nt, Human
uauagccuaggugacaga

SEQ ID NO: 1510156 - RNA, 15 nt, Human
uauaacucauuuguu

SEQ ID NO: 1510157 - RNA, 18 nt, Human
acacucaaaucaagaaac

SEQ ID NO: 1510158 - RNA, 17 nt, Human
acacucaaaucaagaaa

SEQ ID NO: 1510159 - RNA, 17 nt, Human
uagucacugagacagcc

SEQ ID NO: 1510160 - RNA, 20 nt, Human
uagucacugagacagcccgg

SEQ ID NO: 1510161 - RNA, 15 nt, Human
acacuaaugaggaaa

SEQ ID NO: 1510162 - RNA, 22 nt, Human
acacuaaugaggaaacugcacu

SEQ ID NO: 1510163 - RNA, 21 nt, Human
acacucaaaagcugggcaggu

SEQ ID NO: 1510164 - RNA, 13 nt, Human
acacucaaaucaa

SEQ ID NO: 1510165 - RNA, 15 nt, Human
uauacaggucauauu

SEQ ID NO: 1510166 - RNA, 16 nt, Human
uauacaggucauauua

SEQ ID NO: 1510167 - RNA, 21 nt, Human
uauacaggucauauuaauaua

SEQ ID NO: 1510168 - RNA, 18 nt, Human
uauaauuuaccugaaguc

SEQ ID NO: 1510169 - RNA, 21 nt, Human
uauaauuuaccugaagucuuu

SEQ ID NO: 1510170 - RNA, 22 nt, Human
uauacacuuacacuuuaugcac

SEQ ID NO: 1510171 - RNA, 15 nt, Human
uaugccccauucaac

SEQ ID NO: 1510172 - RNA, 14 nt, Human
uaugcucugcaugu

SEQ ID NO: 1510173 - RNA, 14 nt, Human
uaugaucacggcuc

SEQ ID NO: 1510174 - RNA, 22 nt, Human
uaugcaugaaguaauaugcaca

SEQ ID NO: 1510175 - RNA, 22 nt, Human
uauggcccuggccuagcauacg

SEQ ID NO: 1510176 - RNA, 21 nt, Human
uauggcccuggccuagcauac

SEQ ID NO: 1510177 - RNA, 20 nt, Human
uauggcccuggccuagcaua

SEQ ID NO: 1510178 - RNA, 16 nt, Human
uauggcagugucuuuc

SEQ ID NO: 1510179 - RNA, 13 nt, Human
uauggcagugucu

SEQ ID NO: 1510180 - RNA, 16 nt, Human
uaugggacucaaugca

SEQ ID NO: 1510181 - RNA, 23 nt, Human
uaugggacucaaugcacugacau

SEQ ID NO: 1510182 - RNA, 10 nt, Human
uaugggagag

SEQ ID NO: 1510183 - RNA, 15 nt, Human
uaucuauauuuuaca

SEQ ID NO: 1510184 - RNA, 16 nt, Human
acagcaagucaggguu

SEQ ID NO: 1510185 - RNA, 12 nt, Human
acagcaagucag

SEQ ID NO: 1510186 - RNA, 15 nt, Human
acagcccgggcucug

SEQ ID NO: 1510187 - RNA, 16 nt, Human
acagcccgggcucugc

SEQ ID NO: 1510188 - RNA, 19 nt, Human
acagcccuucuuuccacag

SEQ ID NO: 1510189 - RNA, 23 nt, Human
uaugaggcauuuguuugaacuga

SEQ ID NO: 1510190 - RNA, 21 nt, Human
uaugaggcauuuguuugaacu

SEQ ID NO: 1510191 - RNA, 15 nt, Human
uaugaggcauuuguu

SEQ ID NO: 1510192 - RNA, 14 nt, Human
uaugaggcauuugu

SEQ ID NO: 1510193 - RNA, 14 nt, Human
acagcuguaugauu

SEQ ID NO: 1510194 - RNA, 19 nt, Human
acagcuguaugauucccag

SEQ ID NO: 1510195 - RNA, 20 nt, Human
acagcuguaugauucccagc

SEQ ID NO: 1510196 - RNA, 23 nt, Human
acagcuguaugauucccagccag

SEQ ID NO: 1510197 - RNA, 15 nt, Human
acagcuaaugggaca

SEQ ID NO: 1510198 - RNA, 16 nt, Human
acagcuaaugggacac

SEQ ID NO: 1510199 - RNA, 17 nt, Human
acagcuaaugggacacu

SEQ ID NO: 1510200 - RNA, 19 nt, Human
acagcuaaugggacacuaa

SEQ ID NO: 1510201 - RNA, 22 nt, Human
acagcuugaccgugaggccaga

SEQ ID NO: 1510202 - RNA, 23 nt, Human
acagcuugaccgugaggccagag

SEQ ID NO: 1510203 - RNA, 19 nt, Human
acaggaaaagcugcugaca

SEQ ID NO: 1510204 - RNA, 20 nt, Human
acaggaaaagcugcugacag

SEQ ID NO: 1510205 - RNA, 21 nt, Human
acaggaaaagcugcugacagu

SEQ ID NO: 1510206 - RNA, 17 nt, Human
acagcuugaccgugagg

SEQ ID NO: 1510207 - RNA, 20 nt, Human
acagcuugaccgugaggcca

SEQ ID NO: 1510208 - RNA, 21 nt, Human
acagcuugaccgugaggccag

SEQ ID NO: 1510209 - RNA, 17 nt, Human
acagcuucauuuccugu

SEQ ID NO: 1510210 - RNA, 19 nt, Human
acagcuucauuuccugugu

SEQ ID NO: 1510211 - RNA, 21 nt, Human
acagcuucauuuccugugucu

SEQ ID NO: 1510212 - RNA, 22 nt, Human
acaggaaccacaagacugcaca

SEQ ID NO: 1510213 - RNA, 20 nt, Human
acaggaaaauuuuaaaaaua

SEQ ID NO: 1510214 - RNA, 15 nt, Human
acaggcagauacagg

SEQ ID NO: 1510215 - RNA, 13 nt, Human
acaggcaggucca

SEQ ID NO: 1510216 - RNA, 16 nt, Human
acaggcccggcuccag

SEQ ID NO: 1510217 - RNA, 17 nt, Human
acaggcccggcuccagg

SEQ ID NO: 1510218 - RNA, 15 nt, Human
acaggccugagauuu

SEQ ID NO: 1510219 - RNA, 17 nt, Human
acaggccugagauuuca

SEQ ID NO: 1510220 - RNA, 21 nt, Human
acaggccugagauuucaucug

SEQ ID NO: 1510221 - RNA, 18 nt, Human
acaggcccggcuccaggc

SEQ ID NO: 1510222 - RNA, 20 nt, Human
acaggcccggcuccaggcuc

SEQ ID NO: 1510223 - RNA, 21 nt, Human
acaggcccggcuccaggcucc

SEQ ID NO: 1510224 - RNA, 22 nt, Human
acaggcccggcuccaggcuccu

SEQ ID NO: 1510225 - RNA, 18 nt, Human
uaauuuuuauauuugaaa

SEQ ID NO: 1510226 - RNA, 16 nt, Human
uaauuuauacagguca

SEQ ID NO: 1510227 - RNA, 19 nt, Human
uaauuuuuauauuugaaau

SEQ ID NO: 1510228 - RNA, 21 nt, Human
uaauuuuuauauuugaaauau

SEQ ID NO: 1510229 - RNA, 22 nt, Human
uaauuccguagguuauuuucag

SEQ ID NO: 1510230 - RNA, 14 nt, Human
aaugcaaaccauca

SEQ ID NO: 1510231 - RNA, 12 nt, Human
aaugcaaaccau

SEQ ID NO: 1510232 - RNA, 16 nt, Human
aaugauuucauucaau

SEQ ID NO: 1510233 - RNA, 11 nt, Human
aaugcaaacca

SEQ ID NO: 1510234 - RNA, 13 nt, Human
aaugcaccuggaa

SEQ ID NO: 1510235 - RNA, 22 nt, Human
aaugagagacacacugaagaag

SEQ ID NO: 1510236 - RNA, 11 nt, Human
aaugagccugg

SEQ ID NO: 1510237 - RNA, 21 nt, Human
aaugaccuuucaauaggaaaa

SEQ ID NO: 1510238 - RNA, 20 nt, Human
aaugacucagaauauugcuu

SEQ ID NO: 1510239 - RNA, 16 nt, Human
aaugaggucagagccu

SEQ ID NO: 1510240 - RNA, 18 nt, Human
aaugaggucagagccugc

SEQ ID NO: 1510241 - RNA, 14 nt, Human
aaugagccuggcaa

SEQ ID NO: 1510242 - RNA, 12 nt, Human
aaugagccuggc

SEQ ID NO: 1510243 - RNA, 13 nt, Human
aaugagccuggca

SEQ ID NO: 1510244 - RNA, 13 nt, Human
uacagacaaagcg

SEQ ID NO: 1510245 - RNA, 14 nt, Human
uacagacaaagcgu

SEQ ID NO: 1510246 - RNA, 15 nt, Human
uacagacaaagcgug

SEQ ID NO: 1510247 - RNA, 19 nt, Human
uacagacaaagcguggugg

SEQ ID NO: 1510248 - RNA, 17 nt, Human
uacagagacagaaagca

SEQ ID NO: 1510249 - RNA, 23 nt, Human
uacagagcagacaguuaagagaa

SEQ ID NO: 1510250 - RNA, 19 nt, Human
uacagagcccacgccccca

SEQ ID NO: 1510251 - RNA, 22 nt, Human
uacagagcccacgcccccacug

SEQ ID NO: 1510252 - RNA, 18 nt, Human
aauggaagacagcucuua

SEQ ID NO: 1510253 - RNA, 16 nt, Human
aauggaagacagcucu

SEQ ID NO: 1510254 - RNA, 14 nt, Human
aaugguuuucaaaa

SEQ ID NO: 1510255 - RNA, 18 nt, Human
aaugguuugcaaggaagc

SEQ ID NO: 1510256 - RNA, 19 nt, Human
aaugguuugcaaggaagcc

SEQ ID NO: 1510257 - RNA, 20 nt, Human
aauguaagggaaacugccag

SEQ ID NO: 1510258 - RNA, 16 nt, Human
aaugguuuucaaaaua

SEQ ID NO: 1510259 - RNA, 16 nt, Human
aaugguuuucuugugu

SEQ ID NO: 1510260 - RNA, 22 nt, Human
aaugcuguauuuuaaaagaaug

SEQ ID NO: 1510261 - RNA, 13 nt, Human
aauggaagacagc

SEQ ID NO: 1510262 - RNA, 20 nt, Human
aaugcuguauuuuaaaagaa

SEQ ID NO: 1510263 - RNA, 21 nt, Human
aaugcuguauuuuaaaagaau

SEQ ID NO: 1510264 - RNA, 22 nt, Human
aaugcuggcuguuggcuggggg

SEQ ID NO: 1510265 - RNA, 18 nt, Human
uaauuuuuuugagacaga

SEQ ID NO: 1510266 - RNA, 21 nt, Human
uacaaaaaaaaaaaaaaauua

SEQ ID NO: 1510267 - RNA, 16 nt, Human
uacaaugcugugcccu

SEQ ID NO: 1510268 - RNA, 14 nt, Human
uacaaugcugugcc

SEQ ID NO: 1510269 - RNA, 13 nt, Human
uacaaugcugugc

SEQ ID NO: 1510270 - RNA, 23 nt, Human
uacccgggaagggggcugggaca

SEQ ID NO: 1510271 - RNA, 23 nt, Human
uaccucuugagccuugaacuuug

SEQ ID NO: 1510272 - RNA, 22 nt, Human
uaccucuugagccuugaacuuu

SEQ ID NO: 1510273 - RNA, 15 nt, Human
uacccucauguucuu

SEQ ID NO: 1510274 - RNA, 13 nt, Human
uaccugaagucuu

SEQ ID NO: 1510275 - RNA, 14 nt, Human
uaccugaagucuuu

SEQ ID NO: 1510276 - RNA, 16 nt, Human
uaccugaagucuuugu

SEQ ID NO: 1510277 - RNA, 13 nt, Human
uaccugaggggcc

SEQ ID NO: 1510278 - RNA, 15 nt, Human
uaccugaggggccuc

SEQ ID NO: 1510279 - RNA, 13 nt, Human
aauuacauuugua

SEQ ID NO: 1510280 - RNA, 14 nt, Human
aauuacauuuguau

SEQ ID NO: 1510281 - RNA, 17 nt, Human
aauuacaggaaguacug

SEQ ID NO: 1510282 - RNA, 19 nt, Human
aauuacaggaaguacugga

SEQ ID NO: 1510283 - RNA, 20 nt, Human
aauuacaggaaguacuggag

SEQ ID NO: 1510284 - RNA, 16 nt, Human
uaccugccaggaagcc

SEQ ID NO: 1510285 - RNA, 16 nt, Human
uaccugaggggccucu

SEQ ID NO: 1510286 - RNA, 20 nt, Human
aauuacuuacguauguuugu

SEQ ID NO: 1510287 - RNA, 21 nt, Human
aauuauuuauuaaaugcccag

SEQ ID NO: 1510288 - RNA, 12 nt, Human
aauucaagaaaa

SEQ ID NO: 1510289 - RNA, 20 nt, Human
aauucaagaaaacaacuuca

SEQ ID NO: 1510290 - RNA, 22 nt, Human
aauuauuuauuaaaugcccagc

SEQ ID NO: 1510291 - RNA, 11 nt, Human
aauucaguugu

SEQ ID NO: 1510292 - RNA, 21 nt, Human
aauucagaaggaucuucaucu

SEQ ID NO: 1510293 - RNA, 17 nt, Human
aauucaguuguuagugu

SEQ ID NO: 1510294 - RNA, 22 nt, Human
aauucaguuguuagugugucuu

SEQ ID NO: 1510295 - RNA, 13 nt, Human
aauguucaucaau

SEQ ID NO: 1510296 - RNA, 21 nt, Human
aaugugcugaaugguuuucaa

SEQ ID NO: 1510297 - RNA, 23 nt, Human
uacagagcccacgcccccacugg

SEQ ID NO: 1510298 - RNA, 16 nt, Human
aauguucaucaaugaa

SEQ ID NO: 1510299 - RNA, 20 nt, Human
aauguucaucaaugaaugaa

SEQ ID NO: 1510300 - RNA, 21 nt, Human
aauguucucucuucuccaccu

SEQ ID NO: 1510301 - RNA, 16 nt, Human
aauuaacuuuuauaaa

SEQ ID NO: 1510302 - RNA, 15 nt, Human
aauuaacuuuuauaa

SEQ ID NO: 1510303 - RNA, 16 nt, Human
aauuaaguacuaugua

SEQ ID NO: 1510304 - RNA, 17 nt, Human
aauuaaguacuauguau

SEQ ID NO: 1510305 - RNA, 13 nt, Human
aauuaacuuuuau

SEQ ID NO: 1510306 - RNA, 12 nt, Human
aauuaacuuuua

SEQ ID NO: 1510307 - RNA, 12 nt, Human
uacauucuguua

SEQ ID NO: 1510308 - RNA, 22 nt, Human
aauuaaguuagggaauggcaca

SEQ ID NO: 1510309 - RNA, 18 nt, Human
uaccagccaguaaauggg

SEQ ID NO: 1510310 - RNA, 22 nt, Human
uaccagcagagcaccuuagaca

SEQ ID NO: 1510311 - RNA, 13 nt, Human
uaccagcagagca

SEQ ID NO: 1510312 - RNA, 14 nt, Human
uaccagcagagcac

SEQ ID NO: 1510313 - RNA, 12 nt, Human
uaccagcagagc

SEQ ID NO: 1510314 - RNA, 19 nt, Human
uaccagggacugaggggag

SEQ ID NO: 1510315 - RNA, 18 nt, Human
uaccauuauuuuuaggau

SEQ ID NO: 1510316 - RNA, 23 nt, Human
uaagacaaaaagcuacuuauugu

SEQ ID NO: 1510317 - RNA, 18 nt, Human
uaagaagugaaaaucuac

SEQ ID NO: 1510318 - RNA, 13 nt, Human
uaagaagugaaaa

SEQ ID NO: 1510319 - RNA, 21 nt, Human
uaacuuccuuggacucauuuu

SEQ ID NO: 1510320 - RNA, 16 nt, Human
uaacuugucuuuggac

SEQ ID NO: 1510321 - RNA, 20 nt, Human
uaacuugucuuuggacccug

SEQ ID NO: 1510322 - RNA, 14 nt, Human
uaacuaaaagguau

SEQ ID NO: 1510323 - RNA, 15 nt, Human
uaacuagcuuggaaa

SEQ ID NO: 1510324 - RNA, 13 nt, Human
uaacuucacauau

SEQ ID NO: 1510325 - RNA, 19 nt, Human
uaacauguaauuaaguacu

SEQ ID NO: 1510326 - RNA, 14 nt, Human
aauauauuuaauga

SEQ ID NO: 1510327 - RNA, 21 nt, Human
aauaguucagguaacaggcag

SEQ ID NO: 1510328 - RNA, 23 nt, Human
aauaccacaggaaccacaagacu

SEQ ID NO: 1510329 - RNA, 12 nt, Human
aauaccaaggaa

SEQ ID NO: 1510330 - RNA, 19 nt, Human
aauaccagccaguaaaugg

SEQ ID NO: 1510331 - RNA, 18 nt, Human
aauaccaugccauuuaaa

SEQ ID NO: 1510332 - RNA, 17 nt, Human
aauaccagccaguaaau

SEQ ID NO: 1510333 - RNA, 23 nt, Human
aauacaucccuuaccugggaaag

SEQ ID NO: 1510334 - RNA, 20 nt, Human
aauagagcaaaauugaugug

SEQ ID NO: 1510335 - RNA, 22 nt, Human
aauagagcaaaauugauguguu

SEQ ID NO: 1510336 - RNA, 21 nt, Human
aauaccugucccccugacaac

SEQ ID NO: 1510337 - RNA, 19 nt, Human
aauaccugucccccugaca

SEQ ID NO: 1510338 - RNA, 15 nt, Human
aauaccugucccccu

SEQ ID NO: 1510339 - RNA, 18 nt, Human
aauaccugucccccugac

SEQ ID NO: 1510340 - RNA, 13 nt, Human
uaacaaugcugua

SEQ ID NO: 1510341 - RNA, 21 nt, Human
aauacaccagguagaacacaa

SEQ ID NO: 1510342 - RNA, 13 nt, Human
aauacagaggcaa

SEQ ID NO: 1510343 - RNA, 17 nt, Human
uaacaaugaagauaaaa

SEQ ID NO: 1510344 - RNA, 22 nt, Human
uaaauuaacuuuuauaaacuuu

SEQ ID NO: 1510345 - RNA, 21 nt, Human
uaaauuaacuuuuauaaacuu

SEQ ID NO: 1510346 - RNA, 20 nt, Human
uaaauuaacuuuuauaaacu

SEQ ID NO: 1510347 - RNA, 19 nt, Human
uaaauuaacuuuuauaaac

SEQ ID NO: 1510348 - RNA, 18 nt, Human
uaaaugaaaaucgugaca

SEQ ID NO: 1510349 - RNA, 21 nt, Human
aaguguauuuuuuuacuaaua

SEQ ID NO: 1510350 - RNA, 18 nt, Human
aaguguauuuuuuuacua

SEQ ID NO: 1510351 - RNA, 13 nt, Human
aaucucaaauaac

SEQ ID NO: 1510352 - RNA, 12 nt, Human
aaucuaaaugga

SEQ ID NO: 1510353 - RNA, 17 nt, Human
aaucagugugucuaaau

SEQ ID NO: 1510354 - RNA, 18 nt, Human
aaucagugugucuaaauu

SEQ ID NO: 1510355 - RNA, 22 nt, Human
aaucagugugucuaaauuugaa

SEQ ID NO: 1510356 - RNA, 17 nt, Human
aaucccauuuaaaaaaa

SEQ ID NO: 1510357 - RNA, 16 nt, Human
uaaguaauucaagaaa

SEQ ID NO: 1510358 - RNA, 20 nt, Human
uaaguaaugauaacuggaaa

SEQ ID NO: 1510359 - RNA, 16 nt, Human
uaaguaaaaccacagc

SEQ ID NO: 1510360 - RNA, 17 nt, Human
uaaguaaaaccacagca

SEQ ID NO: 1510361 - RNA, 18 nt, Human
uaaguaaaaccacagcag

SEQ ID NO: 1510362 - RNA, 19 nt, Human
uaaguaaaaccacagcagu

SEQ ID NO: 1510363 - RNA, 18 nt, Human
uaaggaugcuuguacaua

SEQ ID NO: 1510364 - RNA, 13 nt, Human
uaaguaaaaccac

SEQ ID NO: 1510365 - RNA, 15 nt, Human
uaaguaaaaccacag

SEQ ID NO: 1510366 - RNA, 17 nt, Human
uaaggaauaccuguccc

SEQ ID NO: 1510367 - RNA, 18 nt, Human
uaaggaauaccugucccc

SEQ ID NO: 1510368 - RNA, 13 nt, Human
uaaggaagacaau

SEQ ID NO: 1510369 - RNA, 9 nt, Human
uaaggaaua

SEQ ID NO: 1510370 - RNA, 21 nt, Human
uaagcuauucaguaauaacuc

SEQ ID NO: 1510371 - RNA, 14 nt, Human
aaucagugugucua

SEQ ID NO: 1510372 - RNA, 15 nt, Human
uaagcaaaaugugau

SEQ ID NO: 1510373 - RNA, 21 nt, Human
uaagcaaaaugugauauguac

SEQ ID NO: 1510374 - RNA, 14 nt, Human
uaagcaaaauguga

SEQ ID NO: 1510375 - RNA, 14 nt, Human
uaagauucauauuu

SEQ ID NO: 1510376 - RNA, 15 nt, Human
aauauuuauuuuaau

SEQ ID NO: 1510377 - RNA, 16 nt, Human
aaucagccuaguugau

SEQ ID NO: 1510378 - RNA, 11 nt, Human
aaucagccugc

SEQ ID NO: 1510379 - RNA, 19 nt, Human
aaucagccugcuccagcug

SEQ ID NO: 1510380 - RNA, 13 nt, Human
aaucagccugcuc

SEQ ID NO: 1510381 - RNA, 18 nt, Human
aaucagccugcuccagcu

SEQ ID NO: 1510382 - RNA, 14 nt, Human
aagguacuucaaau

SEQ ID NO: 1510383 - RNA, 20 nt, Human
aagguagaaauaucugaaaa

SEQ ID NO: 1510384 - RNA, 15 nt, Human
aagggugaaaauuau

SEQ ID NO: 1510385 - RNA, 19 nt, Human
aagggugaugggaaagcau

SEQ ID NO: 1510386 - RNA, 16 nt, Human
aagggugaaaauuauu

SEQ ID NO: 1510387 - RNA, 22 nt, Human
aaggggcccaaauucuuucagu

SEQ ID NO: 1510388 - RNA, 18 nt, Human
aagguauuuaauagguuu

SEQ ID NO: 1510389 - RNA, 12 nt, Human
aaggucauuuuu

SEQ ID NO: 1510390 - RNA, 19 nt, Human
guuucuauguguagggcgg

SEQ ID NO: 1510391 - RNA, 21 nt, Human
guuucugaaaauuaacacugc

SEQ ID NO: 1510392 - RNA, 20 nt, Human
guuucugaaaauuaacacug

SEQ ID NO: 1510393 - RNA, 18 nt, Human
guuucugaaagggacgcu

SEQ ID NO: 1510394 - RNA, 22 nt, Human
aaggcucgagcaugccuggaug

SEQ ID NO: 1510395 - RNA, 19 nt, Human
aaggcucgagcaugccugg

SEQ ID NO: 1510396 - RNA, 20 nt, Human
aaggcucgagcaugccugga

SEQ ID NO: 1510397 - RNA, 19 nt, Human
aaggcuccaggagcagcca

SEQ ID NO: 1510398 - RNA, 22 nt, Human
aaggcuccaggagcagccacau

SEQ ID NO: 1510399 - RNA, 16 nt, Human
aaggcucgagcaugcc

SEQ ID NO: 1510400 - RNA, 18 nt, Human
aaggcucgagcaugccug

SEQ ID NO: 1510401 - RNA, 13 nt, Human
guuucaaacuuua

SEQ ID NO: 1510402 - RNA, 16 nt, Human
guuucaaacuuuacua

SEQ ID NO: 1510403 - RNA, 14 nt, Human
guuucaaacuuuac

SEQ ID NO: 1510404 - RNA, 17 nt, Human
guuucaaacuuuacuau

SEQ ID NO: 1510405 - RNA, 12 nt, Human
guuucaaacuuu

SEQ ID NO: 1510406 - RNA, 15 nt, Human
aaggcuccaggagca

SEQ ID NO: 1510407 - RNA, 16 nt, Human
aaggcuccaggagcag

SEQ ID NO: 1510408 - RNA, 18 nt, Human
aaggcuccaggagcagcc

SEQ ID NO: 1510409 - RNA, 13 nt, Human
guuuauugucaaa

SEQ ID NO: 1510410 - RNA, 15 nt, Human
guugggcugguguca

SEQ ID NO: 1510411 - RNA, 13 nt, Human
guugggcuggugu

SEQ ID NO: 1510412 - RNA, 15 nt, Human
guugggccaggagcc

SEQ ID NO: 1510413 - RNA, 17 nt, Human
guugggccaggagccuc

SEQ ID NO: 1510414 - RNA, 15 nt, Human
aaggaaagagggagg

SEQ ID NO: 1510415 - RNA, 17 nt, Human
aaggaauaccugucccc

SEQ ID NO: 1510416 - RNA, 22 nt, Human
aaggaagccacagcugguggua

SEQ ID NO: 1510417 - RNA, 16 nt, Human
aaggaagcacaugccu

SEQ ID NO: 1510418 - RNA, 14 nt, Human
aaggaagacuucau

SEQ ID NO: 1510419 - RNA, 15 nt, Human
aaggaagacuucauc

SEQ ID NO: 1510420 - RNA, 13 nt, Human
aaggaagcacaug

SEQ ID NO: 1510421 - RNA, 20 nt, Human
aaggaggggauagagagaga

SEQ ID NO: 1510422 - RNA, 18 nt, Human
aaggaggaagagaaaaaa

SEQ ID NO: 1510423 - RNA, 11 nt, Human
aaggagagcua

SEQ ID NO: 1510424 - RNA, 18 nt, Human
aaggaauaccuguccccc

SEQ ID NO: 1510425 - RNA, 14 nt, Human
aaggagauuuacaa

SEQ ID NO: 1510426 - RNA, 17 nt, Human
aaggagauuuacaacug

SEQ ID NO: 1510427 - RNA, 21 nt, Human
aaggauacaaaagcaugugag

SEQ ID NO: 1510428 - RNA, 13 nt, Human
aaggauacaaaag

SEQ ID NO: 1510429 - RNA, 16 nt, Human
aaggccaaaggaagca

SEQ ID NO: 1510430 - RNA, 14 nt, Human
guugcccaggcugg

SEQ ID NO: 1510431 - RNA, 23 nt, Human
guugcccaggcaggucuugaacu

SEQ ID NO: 1510432 - RNA, 12 nt, Human
guugcccaggcu

SEQ ID NO: 1510433 - RNA, 13 nt, Human
guugcccaggcug

SEQ ID NO: 1510434 - RNA, 12 nt, Human
uaaaagaaugau

SEQ ID NO: 1510435 - RNA, 23 nt, Human
uaaaagaauauuuuaacuuccuu

SEQ ID NO: 1510436 - RNA, 20 nt, Human
uaaaacuugauguguuaucu

SEQ ID NO: 1510437 - RNA, 22 nt, Human
uaaaacuugauguguuaucucu

SEQ ID NO: 1510438 - RNA, 21 nt, Human
uaaaaaucucaaauuucuaaa

SEQ ID NO: 1510439 - RNA, 20 nt, Human
uaaaaaucucaaauuucuaa

SEQ ID NO: 1510440 - RNA, 19 nt, Human
uaaaaaucucaaauuucua

SEQ ID NO: 1510441 - RNA, 17 nt, Human
uaaaaaucucaaauuuc

SEQ ID NO: 1510442 - RNA, 16 nt, Human
uaaaaaucucaaauuu

SEQ ID NO: 1510443 - RNA, 15 nt, Human
uaaaaaucucaaauu

SEQ ID NO: 1510444 - RNA, 15 nt, Human
uaaaaaguggaaaaa

SEQ ID NO: 1510445 - RNA, 15 nt, Human
guuuuucuucucccu

SEQ ID NO: 1510446 - RNA, 20 nt, Human
uaaaagacagugaaagaaaa

SEQ ID NO: 1510447 - RNA, 20 nt, Human
uaaaauaauuuuuauauuug

SEQ ID NO: 1510448 - RNA, 22 nt, Human
uaaaauaccagccaguaaaugg

SEQ ID NO: 1510449 - RNA, 16 nt, Human
aagugaggaugaaaaa

SEQ ID NO: 1510450 - RNA, 20 nt, Human
aagugauucuccugccucag

SEQ ID NO: 1510451 - RNA, 19 nt, Human
aagugauucuccugccuca

SEQ ID NO: 1510452 - RNA, 15 nt, Human
aagugauucuccugc

SEQ ID NO: 1510453 - RNA, 16 nt, Human
aagugauucuccugcc

SEQ ID NO: 1510454 - RNA, 17 nt, Human
aagugauucuccugccu

SEQ ID NO: 1510455 - RNA, 18 nt, Human
aagugauucuccugccuc

SEQ ID NO: 1510456 - RNA, 13 nt, Human
aaguauuagaaua

SEQ ID NO: 1510457 - RNA, 20 nt, Human
aaguacacuguuucaaacuu

SEQ ID NO: 1510458 - RNA, 19 nt, Human
aaguacacuguuucaaacu

SEQ ID NO: 1510459 - RNA, 23 nt, Human
aaguacacuguuucaaacuuuac

SEQ ID NO: 1510460 - RNA, 14 nt, Human
aaguaaugauaacu

SEQ ID NO: 1510461 - RNA, 19 nt, Human
aaguaaugauaacuggaaa

SEQ ID NO: 1510462 - RNA, 18 nt, Human
aaguacacuguuucaaac

SEQ ID NO: 1510463 - RNA, 13 nt, Human
aaguacacuguuu

SEQ ID NO: 1510464 - RNA, 14 nt, Human
guuucugccgcagc

SEQ ID NO: 1510465 - RNA, 18 nt, Human
guuucugccgcagcccug

SEQ ID NO: 1510466 - RNA, 15 nt, Human
guuucugccgcagcc

SEQ ID NO: 1510467 - RNA, 16 nt, Human
guuuugccauguuggc

SEQ ID NO: 1510468 - RNA, 20 nt, Human
guuuugccauguuggccagg

SEQ ID NO: 1510469 - RNA, 21 nt, Human
guuuugccauguuggccaggc

SEQ ID NO: 1510470 - RNA, 22 nt, Human
guuuugccauguuggccaggcu

SEQ ID NO: 1510471 - RNA, 16 nt, Human
aagucuuucacauuua

SEQ ID NO: 1510472 - RNA, 15 nt, Human
aagugagagcugggu

SEQ ID NO: 1510473 - RNA, 12 nt, Human
aagugagagagg

SEQ ID NO: 1510474 - RNA, 14 nt, Human
aagugagagcuggg

SEQ ID NO: 1510475 - RNA, 19 nt, Human
aagugaagacaaugacuua

SEQ ID NO: 1510476 - RNA, 17 nt, Human
aagugaagacaaugacu

SEQ ID NO: 1510477 - RNA, 21 nt, Human
aagugaaaaaggaggaagaga

SEQ ID NO: 1510478 - RNA, 16 nt, Human
aagcauuuagauguau

SEQ ID NO: 1510479 - RNA, 18 nt, Human
aagcauuguaaaugugcu

SEQ ID NO: 1510480 - RNA, 13 nt, Human
aagcauuguaaau

SEQ ID NO: 1510481 - RNA, 14 nt, Human
aagcagugcaugcu

SEQ ID NO: 1510482 - RNA, 15 nt, Human
aagcagugcaugcug

SEQ ID NO: 1510483 - RNA, 20 nt, Human
aagcagugcaugcugucccu

SEQ ID NO: 1510484 - RNA, 12 nt, Human
aagcagugcaug

SEQ ID NO: 1510485 - RNA, 21 nt, Human
gugugugcgccuacaggagug

SEQ ID NO: 1510486 - RNA, 19 nt, Human
aagcccaggaaaggcucca

SEQ ID NO: 1510487 - RNA, 22 nt, Human
aagcccaggaaaggcuccagga

SEQ ID NO: 1510488 - RNA, 15 nt, Human
aagcccaggggccgg

SEQ ID NO: 1510489 - RNA, 22 nt, Human
aagccaaagcuaggccuggcca

SEQ ID NO: 1510490 - RNA, 14 nt, Human
aagcccaggaaagg

SEQ ID NO: 1510491 - RNA, 17 nt, Human
aagcccaggaaaggcuc

SEQ ID NO: 1510492 - RNA, 19 nt, Human
aagcccugagcuuucugcu

SEQ ID NO: 1510493 - RNA, 20 nt, Human
aagccgcuggggccaguugg

SEQ ID NO: 1510494 - RNA, 19 nt, Human
guuaggcauugugggaagg

SEQ ID NO: 1510495 - RNA, 20 nt, Human
guuaggcauugugggaaggg

SEQ ID NO: 1510496 - RNA, 18 nt, Human
guuaagagaaaugagcuu

SEQ ID NO: 1510497 - RNA, 11 nt, Human
guuaagagaaa

SEQ ID NO: 1510498 - RNA, 12 nt, Human
guuaagagaaau

SEQ ID NO: 1510499 - RNA, 13 nt, Human
guuagggaauggc

SEQ ID NO: 1510500 - RNA, 18 nt, Human
guuauugauaaguucaua

SEQ ID NO: 1510501 - RNA, 23 nt, Human
guuauuuuuauuuauuuaaauuu

SEQ ID NO: 1510502 - RNA, 18 nt, Human
guucaagcgauucuucug

SEQ ID NO: 1510503 - RNA, 22 nt, Human
guucaaagauauuuugcuuugu

SEQ ID NO: 1510504 - RNA, 21 nt, Human
guucaaagauauuuugcuuug

SEQ ID NO: 1510505 - RNA, 20 nt, Human
guucaaagauauuuugcuuu

SEQ ID NO: 1510506 - RNA, 13 nt, Human
aagcuccagguag

SEQ ID NO: 1510507 - RNA, 14 nt, Human
aagcuccagguaga

SEQ ID NO: 1510508 - RNA, 17 nt, Human
aagcuccaagcucccag

SEQ ID NO: 1510509 - RNA, 18 nt, Human
aagcuccaagcucccagg

SEQ ID NO: 1510510 - RNA, 20 nt, Human
aagcucagggccuggcucag

SEQ ID NO: 1510511 - RNA, 18 nt, Human
aagcucagggccuggcuc

SEQ ID NO: 1510512 - RNA, 19 nt, Human
aagcucagggccuggcuca

SEQ ID NO: 1510513 - RNA, 20 nt, Human
aagcucacagaccuuugaac

SEQ ID NO: 1510514 - RNA, 12 nt, Human
aagcucagggcc

SEQ ID NO: 1510515 - RNA, 13 nt, Human
aagcucagggccu

SEQ ID NO: 1510516 - RNA, 16 nt, Human
aagcucagggccuggc

SEQ ID NO: 1510517 - RNA, 17 nt, Human
aagcucagggccuggcu

SEQ ID NO: 1510518 - RNA, 12 nt, Human
aagcuaggccug

SEQ ID NO: 1510519 - RNA, 16 nt, Human
aagcuaggccuggcca

SEQ ID NO: 1510520 - RNA, 17 nt, Human
aagccugcaauuucaua

SEQ ID NO: 1510521 - RNA, 22 nt, Human
aagccugcaauuucauaugcug

SEQ ID NO: 1510522 - RNA, 20 nt, Human
aagccugaguuugcuuucaa

SEQ ID NO: 1510523 - RNA, 15 nt, Human
guucagcuccagcuc

SEQ ID NO: 1510524 - RNA, 13 nt, Human
guucagcuccagc

SEQ ID NO: 1510525 - RNA, 23 nt, Human
aagaggaaugaaguacucauaca

SEQ ID NO: 1510526 - RNA, 21 nt, Human
guggccucccaacucacccca

SEQ ID NO: 1510527 - RNA, 22 nt, Human
guggccucccaacucaccccag

SEQ ID NO: 1510528 - RNA, 22 nt, Human
guggggccaugccuccucagga

SEQ ID NO: 1510529 - RNA, 22 nt, Human
gugggacacccugugauggggc

SEQ ID NO: 1510530 - RNA, 21 nt, Human
guggggccaugccuccucagg

SEQ ID NO: 1510531 - RNA, 23 nt, Human
gugggaggaucucuugagccugg

SEQ ID NO: 1510532 - RNA, 15 nt, Human
gugggagcugccugu

SEQ ID NO: 1510533 - RNA, 18 nt, Human
gugggagcugccuguuca

SEQ ID NO: 1510534 - RNA, 15 nt, Human
guggggucacucugg

SEQ ID NO: 1510535 - RNA, 22 nt, Human
guggcgcagcauauucaggaag

SEQ ID NO: 1510536 - RNA, 17 nt, Human
guggccuuccccagcau

SEQ ID NO: 1510537 - RNA, 18 nt, Human
guggccuuccccagcaug

SEQ ID NO: 1510538 - RNA, 21 nt, Human
guggccuuccccagcaugcac

SEQ ID NO: 1510539 - RNA, 19 nt, Human
guggccuuccccagcaugc

SEQ ID NO: 1510540 - RNA, 13 nt, Human
gugggacacccug

SEQ ID NO: 1510541 - RNA, 14 nt, Human
gugggagcugccug

SEQ ID NO: 1510542 - RNA, 15 nt, Human
gugggacacccugug

SEQ ID NO: 1510543 - RNA, 16 nt, Human
aagacugcacaucaaa

SEQ ID NO: 1510544 - RNA, 17 nt, Human
aagacugcauuauauuu

SEQ ID NO: 1510545 - RNA, 23 nt, Human
aagacugaguacguugugcauuu

SEQ ID NO: 1510546 - RNA, 20 nt, Human
aagacgcugugcugcccugc

SEQ ID NO: 1510547 - RNA, 16 nt, Human
aagacuuuggaaagac

SEQ ID NO: 1510548 - RNA, 15 nt, Human
aagaccuucuccuuc

SEQ ID NO: 1510549 - RNA, 18 nt, Human
aagaccuucuccuucacc

SEQ ID NO: 1510550 - RNA, 19 nt, Human
aagaccuucuccuucaccu

SEQ ID NO: 1510551 - RNA, 11 nt, Human
gugccuuaugg

SEQ ID NO: 1510552 - RNA, 13 nt, Human
aagacgcugugcu

SEQ ID NO: 1510553 - RNA, 23 nt, Human
aagaccuugcuuaugauugcaga

SEQ ID NO: 1510554 - RNA, 21 nt, Human
aagaccuuuggagcaaagcug

SEQ ID NO: 1510555 - RNA, 15 nt, Human
aagacgcugugcugc

SEQ ID NO: 1510556 - RNA, 17 nt, Human
aagacgcugugcugccc

SEQ ID NO: 1510557 - RNA, 18 nt, Human
aagacgcugugcugcccu

SEQ ID NO: 1510558 - RNA, 19 nt, Human
aagacgcugugcugcccug

SEQ ID NO: 1510559 - RNA, 13 nt, Human
aagaugaaaauau

SEQ ID NO: 1510560 - RNA, 14 nt, Human
aagaugaaaauauu

SEQ ID NO: 1510561 - RNA, 13 nt, Human
aagaguaggaaga

SEQ ID NO: 1510562 - RNA, 14 nt, Human
aagaguaggaagac

SEQ ID NO: 1510563 - RNA, 19 nt, Human
aagaugcuucucacugcca

SEQ ID NO: 1510564 - RNA, 17 nt, Human
aagaugcuucucacugc

SEQ ID NO: 1510565 - RNA, 16 nt, Human
aagaugcuucucacug

SEQ ID NO: 1510566 - RNA, 12 nt, Human
aagaguaggaag

SEQ ID NO: 1510567 - RNA, 22 nt, Human
aagagggucugaggaauccaga

SEQ ID NO: 1510568 - RNA, 23 nt, Human
aagagggagggagggcuccagac

SEQ ID NO: 1510569 - RNA, 17 nt, Human
guggggucacucuggca

SEQ ID NO: 1510570 - RNA, 20 nt, Human
guggggucacucuggcagcu

SEQ ID NO: 1510571 - RNA, 21 nt, Human
guggggucacucuggcagcuc

SEQ ID NO: 1510572 - RNA, 22 nt, Human
guggggucacucuggcagcuca

SEQ ID NO: 1510573 - RNA, 16 nt, Human
gugucagcauagaagu

SEQ ID NO: 1510574 - RNA, 23 nt, Human
guguauuuuuuuacuaauagaca

SEQ ID NO: 1510575 - RNA, 17 nt, Human
guguauuuuuuuacuaa

SEQ ID NO: 1510576 - RNA, 20 nt, Human
gugucaagagggucugagga

SEQ ID NO: 1510577 - RNA, 19 nt, Human
aagauguagaggagaaacu

SEQ ID NO: 1510578 - RNA, 14 nt, Human
guguauuucauuua

SEQ ID NO: 1510579 - RNA, 13 nt, Human
aagauguagagga

SEQ ID NO: 1510580 - RNA, 22 nt, Human
gugugacaaggauugcuacugu

SEQ ID NO: 1510581 - RNA, 21 nt, Human
gugugaccacugcagaagaca

SEQ ID NO: 1510582 - RNA, 16 nt, Human
gugugguagagugugc

SEQ ID NO: 1510583 - RNA, 23 nt, Human
guguggggccaugccuccucagg

SEQ ID NO: 1510584 - RNA, 11 nt, Human
aaauuguguua

SEQ ID NO: 1510585 - RNA, 22 nt, Human
guauuuuguuuuugucuuaaaa

SEQ ID NO: 1510586 - RNA, 16 nt, Human
guauuuuugacagaau

SEQ ID NO: 1510587 - RNA, 12 nt, Human
guauuuuugaca

SEQ ID NO: 1510588 - RNA, 15 nt, Human
guauuuuugacagaa

SEQ ID NO: 1510589 - RNA, 18 nt, Human
gucaaaguggugagaggc

SEQ ID NO: 1510590 - RNA, 18 nt, Human
guauguacuucaugcugu

SEQ ID NO: 1510591 - RNA, 15 nt, Human
aaauguauuacagug

SEQ ID NO: 1510592 - RNA, 19 nt, Human
aaaugucuaguuguaacac

SEQ ID NO: 1510593 - RNA, 24 nt, Human
aaaugucuaguuguaacaccauga

SEQ ID NO: 1510594 - RNA, 15 nt, Human
guauaaaauaauuuu

SEQ ID NO: 1510595 - RNA, 21 nt, Human
guauaaaauaauuuuuauauu

SEQ ID NO: 1510596 - RNA, 12 nt, Human
guauaauauuuu

SEQ ID NO: 1510597 - RNA, 15 nt, Human
guauaauauuuuuaa

SEQ ID NO: 1510598 - RNA, 16 nt, Human
guaucaggugcugcca

SEQ ID NO: 1510599 - RNA, 18 nt, Human
guaucaggugcugccauc

SEQ ID NO: 1510600 - RNA, 16 nt, Human
guauauuuuauaucaa

SEQ ID NO: 1510601 - RNA, 19 nt, Human
guaucccaugagccucagc

SEQ ID NO: 1510602 - RNA, 22 nt, Human
guaucaggugcugccauccagg

SEQ ID NO: 1510603 - RNA, 21 nt, Human
guaucccaugagccucagcau

SEQ ID NO: 1510604 - RNA, 15 nt, Human
guaugguggcugggu

SEQ ID NO: 1510605 - RNA, 16 nt, Human
guaugguggcuggguu

SEQ ID NO: 1510606 - RNA, 14 nt, Human
guaugguggcuggg

SEQ ID NO: 1510607 - RNA, 20 nt, Human
guaguguuggagaagaacug

SEQ ID NO: 1510608 - RNA, 16 nt, Human
aaauguaagggaaacu

SEQ ID NO: 1510609 - RNA, 22 nt, Human
guaacaggaaaauuuuaaaaau

SEQ ID NO: 1510610 - RNA, 12 nt, Human
guaacaggcaga

SEQ ID NO: 1510611 - RNA, 18 nt, Human
aaauuuguuauaaugaau

SEQ ID NO: 1510612 - RNA, 22 nt, Human
gucacacaguauuacuucugcu

SEQ ID NO: 1510613 - RNA, 20 nt, Human
aaauuuuuucucuaggaaau

SEQ ID NO: 1510614 - RNA, 23 nt, Human
aaauuuugauguuuuaaggaugc

SEQ ID NO: 1510615 - RNA, 18 nt, Human
aaauuuugauguuuuaag

SEQ ID NO: 1510616 - RNA, 19 nt, Human
aacaagaugguucuagcau

SEQ ID NO: 1510617 - RNA, 16 nt, Human
aacaaggcaaggcugu

SEQ ID NO: 1510618 - RNA, 17 nt, Human
aacaaugcuguauuuua

SEQ ID NO: 1510619 - RNA, 22 nt, Human
aacaaugcuguauuuuaaaaga

SEQ ID NO: 1510620 - RNA, 15 nt, Human
aacacaacuauauug

SEQ ID NO: 1510621 - RNA, 16 nt, Human
aacacaacuauauugu

SEQ ID NO: 1510622 - RNA, 12 nt, Human
aacaauaaaaga

SEQ ID NO: 1510623 - RNA, 15 nt, Human
aacaaugcuguauuu

SEQ ID NO: 1510624 - RNA, 18 nt, Human
aacaaggcaaggcuguca

SEQ ID NO: 1510625 - RNA, 21 nt, Human
aacaaggcaaggcugucaauu

SEQ ID NO: 1510626 - RNA, 23 nt, Human
aacaaggcaaggcugucaauuac

SEQ ID NO: 1510627 - RNA, 13 nt, Human
guccauagagagc

SEQ ID NO: 1510628 - RNA, 14 nt, Human
guccauagagagca

SEQ ID NO: 1510629 - RNA, 21 nt, Human
gucccaccccacacacgccag

SEQ ID NO: 1510630 - RNA, 14 nt, Human
gucccaccuuggcu

SEQ ID NO: 1510631 - RNA, 15 nt, Human
gucccaccuuggcug

SEQ ID NO: 1510632 - RNA, 16 nt, Human
gucccaccuuggcugc

SEQ ID NO: 1510633 - RNA, 17 nt, Human
aacacaacuauauuguu

SEQ ID NO: 1510634 - RNA, 15 nt, Human
aacacagcaagggug

SEQ ID NO: 1510635 - RNA, 18 nt, Human
aacacagcaagggugaug

SEQ ID NO: 1510636 - RNA, 21 nt, Human
gucauuuuuuuuaagaaaaag

SEQ ID NO: 1510637 - RNA, 19 nt, Human
gucauuuuuuuuaagaaaa

SEQ ID NO: 1510638 - RNA, 13 nt, Human
guccaagaagccc

SEQ ID NO: 1510639 - RNA, 15 nt, Human
guccaagaagcccag

SEQ ID NO: 1510640 - RNA, 16 nt, Human
guccaagaagcccagg

SEQ ID NO: 1510641 - RNA, 20 nt, Human
guccaagaagcccaggaaag

SEQ ID NO: 1510642 - RNA, 17 nt, Human
guccaagaagcccagga

SEQ ID NO: 1510643 - RNA, 18 nt, Human
guccaagaagcccaggaa

SEQ ID NO: 1510644 - RNA, 15 nt, Human
aacagugauuaccag

SEQ ID NO: 1510645 - RNA, 22 nt, Human
aacagugauuaccagggacuga

SEQ ID NO: 1510646 - RNA, 13 nt, Human
guccuacucugug

SEQ ID NO: 1510647 - RNA, 13 nt, Human
aacagauaaucag

SEQ ID NO: 1510648 - RNA, 15 nt, Human
aacagaaauguacag

SEQ ID NO: 1510649 - RNA, 14 nt, Human
aacagaaauguaca

SEQ ID NO: 1510650 - RNA, 13 nt, Human
aacagaaauguac

SEQ ID NO: 1510651 - RNA, 12 nt, Human
aacagaaaugua

SEQ ID NO: 1510652 - RNA, 16 nt, Human
guccuacccacccucc

SEQ ID NO: 1510653 - RNA, 12 nt, Human
guccuacucugu

SEQ ID NO: 1510654 - RNA, 14 nt, Human
gucccccuuccaug

SEQ ID NO: 1510655 - RNA, 16 nt, Human
gucccccuuccaugga

SEQ ID NO: 1510656 - RNA, 18 nt, Human
gucccccuuccauggacu

SEQ ID NO: 1510657 - RNA, 20 nt, Human
aaccugagccccaaaaggua

SEQ ID NO: 1510658 - RNA, 14 nt, Human
gucuggcccuuccu

SEQ ID NO: 1510659 - RNA, 16 nt, Human
gucuuucacauuuaaa

SEQ ID NO: 1510660 - RNA, 16 nt, Human
gucuuuuuucacuaca

SEQ ID NO: 1510661 - RNA, 21 nt, Human
aacuagaguuuagcuggaaaa

SEQ ID NO: 1510662 - RNA, 18 nt, Human
aaccuugaaaacuuuaug

SEQ ID NO: 1510663 - RNA, 12 nt, Human
aaccugugucuc

SEQ ID NO: 1510664 - RNA, 17 nt, Human
aacucuccucugcugcu

SEQ ID NO: 1510665 - RNA, 16 nt, Human
aacucuccucugcugc

SEQ ID NO: 1510666 - RNA, 15 nt, Human
aacucuccuccagag

SEQ ID NO: 1510667 - RNA, 18 nt, Human
aacucuccuccagaguca

SEQ ID NO: 1510668 - RNA, 22 nt, Human
gugaaccaccacacccagccca

SEQ ID NO: 1510669 - RNA, 23 nt, Human
gugaaccaccacacccagcccac

SEQ ID NO: 1510670 - RNA, 19 nt, Human
aaccaccacacccagccca

SEQ ID NO: 1510671 - RNA, 15 nt, Human
aaccaagucaaguga

SEQ ID NO: 1510672 - RNA, 17 nt, Human
aaccaucauugaaaucu

SEQ ID NO: 1510673 - RNA, 18 nt, Human
aaccaucauugaaaucuu

SEQ ID NO: 1510674 - RNA, 12 nt, Human
aaccaucauuga

SEQ ID NO: 1510675 - RNA, 21 nt, Human
aaccaccacacccagcccacu

SEQ ID NO: 1510676 - RNA, 18 nt, Human
aacccaaguccaagcaua

SEQ ID NO: 1510677 - RNA, 23 nt, Human
aaccauuuugcugucccuuuucc

SEQ ID NO: 1510678 - RNA, 22 nt, Human
aacccaaauuacguguacuaca

SEQ ID NO: 1510679 - RNA, 23 nt, Human
aacccaaauguucaucaaugaau

SEQ ID NO: 1510680 - RNA, 16 nt, Human
aacccgggaggcagag

SEQ ID NO: 1510681 - RNA, 12 nt, Human
aaccucuaaauu

SEQ ID NO: 1510682 - RNA, 24 nt, Human
aaccucuaaauucuuucauuuuag

SEQ ID NO: 1510683 - RNA, 18 nt, Human
aaccugagccccaaaagg

SEQ ID NO: 1510684 - RNA, 10 nt, Human
aacccagcuc

SEQ ID NO: 1510685 - RNA, 11 nt, Human
aaccccccagc

SEQ ID NO: 1510686 - RNA, 14 nt, Human
aaccccccagcacu

SEQ ID NO: 1510687 - RNA, 18 nt, Human
aaccccccagcacugagg

SEQ ID NO: 1510688 - RNA, 19 nt, Human
aaccccccagcacugagga

SEQ ID NO: 1510689 - RNA, 12 nt, Human
aacugaaaucau

SEQ ID NO: 1510690 - RNA, 13 nt, Human
aacugaaaucaua

SEQ ID NO: 1510691 - RNA, 21 nt, Human
aacucuucaaucucuugcacu

SEQ ID NO: 1510692 - RNA, 22 nt, Human
gugagucgaggacagggaggug

SEQ ID NO: 1510693 - RNA, 24 nt, Human
gugaggguccugcagccugcagga

SEQ ID NO: 1510694 - RNA, 23 nt, Human
gugaggguccugcagccugcagg

SEQ ID NO: 1510695 - RNA, 21 nt, Human
gugagaugcuagaacucccuu

SEQ ID NO: 1510696 - RNA, 17 nt, Human
gugaacuugggccacug

SEQ ID NO: 1510697 - RNA, 19 nt, Human
gugaacuugggccacugug

SEQ ID NO: 1510698 - RNA, 14 nt, Human
gugaggguccugca

SEQ ID NO: 1510699 - RNA, 15 nt, Human
gugaggguccugcag

SEQ ID NO: 1510700 - RNA, 15 nt, Human
gugagcaauccugca

SEQ ID NO: 1510701 - RNA, 17 nt, Human
gugaggccagagacaca

SEQ ID NO: 1510702 - RNA, 22 nt, Human
gugaggccagagacacaagccu

SEQ ID NO: 1510703 - RNA, 17 nt, Human
aacugggacaggggaga

SEQ ID NO: 1510704 - RNA, 22 nt, Human
aacugggggagggugaagugaa

SEQ ID NO: 1510705 - RNA, 21 nt, Human
aacugggggagggugaaguga

SEQ ID NO: 1510706 - RNA, 16 nt, Human
aacuggguacuugugg

SEQ ID NO: 1510707 - RNA, 21 nt, Human
aacuggguacuuguggacaca

SEQ ID NO: 1510708 - RNA, 11 nt, Human
aacuggcugca

SEQ ID NO: 1510709 - RNA, 16 nt, Human
aacuggauuaaacuua

SEQ ID NO: 1510710 - RNA, 15 nt, Human
aacuggauuaaacuu

SEQ ID NO: 1510711 - RNA, 19 nt, Human
aacuggacugguucaaaug

SEQ ID NO: 1510712 - RNA, 15 nt, Human
aacugcugacuguuu

SEQ ID NO: 1510713 - RNA, 19 nt, Human
aacugcacugucaagauga

SEQ ID NO: 1510714 - RNA, 23 nt, Human
aacugcugacuguuuucucuuga

SEQ ID NO: 1510715 - RNA, 20 nt, Human
aacugcugacuguuuucucu

SEQ ID NO: 1510716 - RNA, 21 nt, Human
aacugcugacuguuuucucuu

SEQ ID NO: 1510717 - RNA, 18 nt, Human
aacuuccagauccuggaa

SEQ ID NO: 1510718 - RNA, 18 nt, Human
aacuucccagugaauucu

SEQ ID NO: 1510719 - RNA, 22 nt, Human
aacuuccuuggacucauuuuaa

SEQ ID NO: 1510720 - RNA, 13 nt, Human
aacuuccaauuua

SEQ ID NO: 1510721 - RNA, 13 nt, Human
aacugguauuuua

SEQ ID NO: 1510722 - RNA, 22 nt, Human
aacugguauuuuaucuuugauu

SEQ ID NO: 1510723 - RNA, 14 nt, Human
gugaugagaggaaa

SEQ ID NO: 1510724 - RNA, 16 nt, Human
gugaugagaggaaauc

SEQ ID NO: 1510725 - RNA, 17 nt, Human
gugaugggaaagcauug

SEQ ID NO: 1510726 - RNA, 22 nt, Human
gugaugcgcaugucacggaggg

SEQ ID NO: 1510727 - RNA, 22 nt, Human
gugaugcuaaagguuguauugc

SEQ ID NO: 1510728 - RNA, 14 nt, Human
gugauggggcccug

SEQ ID NO: 1510729 - RNA, 16 nt, Human
gugauggggcccugcc

SEQ ID NO: 1510730 - RNA, 17 nt, Human
gugauggggcccugccu

SEQ ID NO: 1510731 - RNA, 18 nt, Human
gugauggggcccugccuc

SEQ ID NO: 1510732 - RNA, 19 nt, Human
gugauggggcccugccucc

SEQ ID NO: 1510733 - RNA, 21 nt, Human
gugcacacaccagagcccacc

SEQ ID NO: 1510734 - RNA, 23 nt, Human
gugcauuaucuagauacuguauc

SEQ ID NO: 1510735 - RNA, 18 nt, Human
gugccaccccgagggcug

SEQ ID NO: 1510736 - RNA, 19 nt, Human
gugcauuaucuagauacug

SEQ ID NO: 1510737 - RNA, 15 nt, Human
gugcauuaucuagau

SEQ ID NO: 1510738 - RNA, 19 nt, Human
gugcauguguguucaugca

SEQ ID NO: 1510739 - RNA, 22 nt, Human
accaucugaaagugguacuuga

SEQ ID NO: 1510740 - RNA, 16 nt, Human
accaucccugaaggcc

SEQ ID NO: 1510741 - RNA, 23 nt, Human
accaucauugaaaucuuuuugcu

SEQ ID NO: 1510742 - RNA, 15 nt, Human
accaucauugaaauc

SEQ ID NO: 1510743 - RNA, 15 nt, Human
accaucaagccacca

SEQ ID NO: 1510744 - RNA, 14 nt, Human
accaucaagccacc

SEQ ID NO: 1510745 - RNA, 17 nt, Human
acccacccccacccaag

SEQ ID NO: 1510746 - RNA, 15 nt, Human
acccacccccaccca

SEQ ID NO: 1510747 - RNA, 13 nt, Human
acccaugcugccc

SEQ ID NO: 1510748 - RNA, 15 nt, Human
acccacccuccuuuc

SEQ ID NO: 1510749 - RNA, 14 nt, Human
acauuuauucugcu

SEQ ID NO: 1510750 - RNA, 23 nt, Human
acaugucuuuucuugcaugaggc

SEQ ID NO: 1510751 - RNA, 19 nt, Human
acaugccucucucaggcca

SEQ ID NO: 1510752 - RNA, 20 nt, Human
acaugccucucucaggccaa

SEQ ID NO: 1510753 - RNA, 19 nt, Human
accaaggcugauuaaacca

SEQ ID NO: 1510754 - RNA, 20 nt, Human
accaaggcugauuaaaccaa

SEQ ID NO: 1510755 - RNA, 14 nt, Human
accagcagaaaugc

SEQ ID NO: 1510756 - RNA, 12 nt, Human
accagcagagca

SEQ ID NO: 1510757 - RNA, 13 nt, Human
accagcagagcac

SEQ ID NO: 1510758 - RNA, 13 nt, Human
accagcagccugg

SEQ ID NO: 1510759 - RNA, 16 nt, Human
accagccccagugccc

SEQ ID NO: 1510760 - RNA, 17 nt, Human
accagccccagugccca

SEQ ID NO: 1510761 - RNA, 18 nt, Human
accagccccagugcccac

SEQ ID NO: 1510762 - RNA, 19 nt, Human
accagccccagugcccaca

SEQ ID NO: 1510763 - RNA, 20 nt, Human
accagccccagugcccacag

SEQ ID NO: 1510764 - RNA, 15 nt, Human
acaguggggaaugaa

SEQ ID NO: 1510765 - RNA, 19 nt, Human
acaguggggaaugaagaua

SEQ ID NO: 1510766 - RNA, 21 nt, Human
acagugauuaccagggacuga

SEQ ID NO: 1510767 - RNA, 23 nt, Human
acagugagucgaggacagggagg

SEQ ID NO: 1510768 - RNA, 14 nt, Human
acaggcaaugcugg

SEQ ID NO: 1510769 - RNA, 17 nt, Human
acagggccagugcaguu

SEQ ID NO: 1510770 - RNA, 22 nt, Human
acagugagucgaggacagggag

SEQ ID NO: 1510771 - RNA, 19 nt, Human
acaggugugaaccaccaca

SEQ ID NO: 1510772 - RNA, 22 nt, Human
acaggugugagucaccaagccc

SEQ ID NO: 1510773 - RNA, 23 nt, Human
acaggugugagucaccaagccca

SEQ ID NO: 1510774 - RNA, 13 nt, Human
acagcugccuggg

SEQ ID NO: 1510775 - RNA, 20 nt, Human
acaggcaagcaccuccugcc

SEQ ID NO: 1510776 - RNA, 23 nt, Human
acaggcaagcaccuccugccucg

SEQ ID NO: 1510777 - RNA, 16 nt, Human
acagcucuguccuggg

SEQ ID NO: 1510778 - RNA, 17 nt, Human
acagcucuguccuggga

SEQ ID NO: 1510779 - RNA, 17 nt, Human
acagaggggguggccuc

SEQ ID NO: 1510780 - RNA, 18 nt, Human
acagaggggguggccucc

SEQ ID NO: 1510781 - RNA, 19 nt, Human
acagaggggguggccuccc

SEQ ID NO: 1510782 - RNA, 21 nt, Human
acagaggggguggccucccaa

SEQ ID NO: 1510783 - RNA, 16 nt, Human
acagcuccuucugucc

SEQ ID NO: 1510784 - RNA, 18 nt, Human
acagcuccuucuguccua

SEQ ID NO: 1510785 - RNA, 23 nt, Human
acagcuccuucuguccuacucug

SEQ ID NO: 1510786 - RNA, 14 nt, Human
acagcucuguccug

SEQ ID NO: 1510787 - RNA, 16 nt, Human
acaugcaaggucauuu

SEQ ID NO: 1510788 - RNA, 17 nt, Human
acaugcaaggucauuuu

SEQ ID NO: 1510789 - RNA, 18 nt, Human
acaugcaaggucauuuuu

SEQ ID NO: 1510790 - RNA, 15 nt, Human
acaugccucucucag

SEQ ID NO: 1510791 - RNA, 16 nt, Human
acaugccucucucagg

SEQ ID NO: 1510792 - RNA, 17 nt, Human
acaugccucucucaggc

SEQ ID NO: 1510793 - RNA, 18 nt, Human
acaugccucucucaggcc

SEQ ID NO: 1510794 - RNA, 20 nt, Human
acauaaguaauucaagaaaa

SEQ ID NO: 1510795 - RNA, 15 nt, Human
acauaaguaauucaa

SEQ ID NO: 1510796 - RNA, 19 nt, Human
acauaauuaaauuuugagu

SEQ ID NO: 1510797 - RNA, 16 nt, Human
acauaagauaaaugug

SEQ ID NO: 1510798 - RNA, 18 nt, Human
aauuuccugggagcuuuu

SEQ ID NO: 1510799 - RNA, 21 nt, Human
aauuuccugggagcuuuugua

SEQ ID NO: 1510800 - RNA, 22 nt, Human
aauuucauaccuaucaucuuaa

SEQ ID NO: 1510801 - RNA, 12 nt, Human
aauuguaaggaa

SEQ ID NO: 1510802 - RNA, 16 nt, Human
aauuguaaggaaugau

SEQ ID NO: 1510803 - RNA, 16 nt, Human
aaugucacaggcaggu

SEQ ID NO: 1510804 - RNA, 19 nt, Human
aaugucacaggcaggucca

SEQ ID NO: 1510805 - RNA, 20 nt, Human
aauuuauuuaugggauccug

SEQ ID NO: 1510806 - RNA, 21 nt, Human
acaaggaugaauuaaguuuuu

SEQ ID NO: 1510807 - RNA, 22 nt, Human
acaagaaaugaaagcagggacu

SEQ ID NO: 1510808 - RNA, 15 nt, Human
acaagaaaugaaagc

SEQ ID NO: 1510809 - RNA, 16 nt, Human
acaagaaaugaaagca

SEQ ID NO: 1510810 - RNA, 13 nt, Human
acaaaauggaaua

SEQ ID NO: 1510811 - RNA, 14 nt, Human
acaaaauggaauac

SEQ ID NO: 1510812 - RNA, 13 nt, Human
acaaaaugaaacg

SEQ ID NO: 1510813 - RNA, 22 nt, Human
acaaaaugaaacgcaaccacca

SEQ ID NO: 1510814 - RNA, 17 nt, Human
aauuuugugaagcaaaa

SEQ ID NO: 1510815 - RNA, 18 nt, Human
aauuuugugaagcaaaau

SEQ ID NO: 1510816 - RNA, 16 nt, Human
aauuuugugcccccau

SEQ ID NO: 1510817 - RNA, 14 nt, Human
aauuuugauguuuu

SEQ ID NO: 1510818 - RNA, 16 nt, Human
acagaagcuccaggua

SEQ ID NO: 1510819 - RNA, 14 nt, Human
acagacaaagcgug

SEQ ID NO: 1510820 - RNA, 13 nt, Human
acagaggcagccc

SEQ ID NO: 1510821 - RNA, 14 nt, Human
acagaggcagcccc

SEQ ID NO: 1510822 - RNA, 17 nt, Human
acagaggccaugggccu

SEQ ID NO: 1510823 - RNA, 21 nt, Human
acagaggccaugggccuccug

SEQ ID NO: 1510824 - RNA, 23 nt, Human
acagaggccaugggccuccugug

SEQ ID NO: 1510825 - RNA, 22 nt, Human
acacugugcugagucugaaggc

SEQ ID NO: 1510826 - RNA, 19 nt, Human
acacaaaaguuucucuuuu

SEQ ID NO: 1510827 - RNA, 14 nt, Human
acacauuuuuuaaa

SEQ ID NO: 1510828 - RNA, 22 nt, Human
acacagcucuucuccaggcugu

SEQ ID NO: 1510829 - RNA, 20 nt, Human
acacagcucuucuccaggcu

SEQ ID NO: 1510830 - RNA, 21 nt, Human
acacagcucuucuccaggcug

SEQ ID NO: 1510831 - RNA, 20 nt, Human
acaccacuacauucuguuaa

SEQ ID NO: 1510832 - RNA, 17 nt, Human
acaccacuacauucugu

SEQ ID NO: 1510833 - RNA, 14 nt, Human
acacgaauauugcu

SEQ ID NO: 1510834 - RNA, 15 nt, Human
acaccacuacauucu

SEQ ID NO: 1510835 - RNA, 19 nt, Human
acacauuuuuuaaaugcac

SEQ ID NO: 1510836 - RNA, 18 nt, Human
acacauuuuuuaaaugca

SEQ ID NO: 1510837 - RNA, 16 nt, Human
acacauuuuuuaaaug

SEQ ID NO: 1510838 - RNA, 21 nt, Human
acaccacuacauucuguuaau

SEQ ID NO: 1510839 - RNA, 14 nt, Human
acacgagcaggcua

SEQ ID NO: 1510840 - RNA, 15 nt, Human
acacgaauauugcug

SEQ ID NO: 1510841 - RNA, 21 nt, Human
acacgaauauugcugauggug

SEQ ID NO: 1510842 - RNA, 13 nt, Human
acaauuuaaagca

SEQ ID NO: 1510843 - RNA, 14 nt, Human
acaauuuaaagcaa

SEQ ID NO: 1510844 - RNA, 20 nt, Human
acaauuuaaagcaaaggagu

SEQ ID NO: 1510845 - RNA, 13 nt, Human
acaauuuauuaug

SEQ ID NO: 1510846 - RNA, 14 nt, Human
acaauuuauuaugg

SEQ ID NO: 1510847 - RNA, 20 nt, Human
acaaggaugaucuaggaaga

SEQ ID NO: 1510848 - RNA, 16 nt, Human
acaaggauugcuacug

SEQ ID NO: 1510849 - RNA, 19 nt, Human
acuaguauuucuaugaaau

SEQ ID NO: 1510850 - RNA, 18 nt, Human
acuaguauuucuaugaaa

SEQ ID NO: 1510851 - RNA, 16 nt, Human
acuauuguuagucucu

SEQ ID NO: 1510852 - RNA, 17 nt, Human
acuagggaagauaauau

SEQ ID NO: 1510853 - RNA, 19 nt, Human
acgcuggagugcagugagc

SEQ ID NO: 1510854 - RNA, 15 nt, Human
acggaauaguuggcu

SEQ ID NO: 1510855 - RNA, 19 nt, Human
acggacgaaccuugaaaac

SEQ ID NO: 1510856 - RNA, 15 nt, Human
acggaagagccuugc

SEQ ID NO: 1510857 - RNA, 16 nt, Human
acggaagagccuugcg

SEQ ID NO: 1510858 - RNA, 23 nt, Human
acgucugacaggcaaugcuggcu

SEQ ID NO: 1510859 - RNA, 12 nt, Human
acgucugugcca

SEQ ID NO: 1510860 - RNA, 15 nt, Human
acuaauagacaauuu

SEQ ID NO: 1510861 - RNA, 11 nt, Human
acguggcugcu

SEQ ID NO: 1510862 - RNA, 11 nt, Human
accugugucuc

SEQ ID NO: 1510863 - RNA, 17 nt, Human
accucugccucagaaaa

SEQ ID NO: 1510864 - RNA, 18 nt, Human
accucugccucagaaaac

SEQ ID NO: 1510865 - RNA, 21 nt, Human
accucuugagccuugaacuuu

SEQ ID NO: 1510866 - RNA, 20 nt, Human
accucuugagccuugaacuu

SEQ ID NO: 1510867 - RNA, 19 nt, Human
accucuugagccuugaacu

SEQ ID NO: 1510868 - RNA, 17 nt, Human
accucuugagccuugaa

SEQ ID NO: 1510869 - RNA, 20 nt, Human
accucugccucagaaaacaa

SEQ ID NO: 1510870 - RNA, 11 nt, Human
accugccaggg

SEQ ID NO: 1510871 - RNA, 12 nt, Human
accugccaggga

SEQ ID NO: 1510872 - RNA, 13 nt, Human
accugccagggac

SEQ ID NO: 1510873 - RNA, 15 nt, Human
accugccagggacag

SEQ ID NO: 1510874 - RNA, 16 nt, Human
accugccagggacaga

SEQ ID NO: 1510875 - RNA, 18 nt, Human
accugccagggacagagg

SEQ ID NO: 1510876 - RNA, 14 nt, Human
accggcuggccugg

SEQ ID NO: 1510877 - RNA, 15 nt, Human
accggcuggccuggc

SEQ ID NO: 1510878 - RNA, 17 nt, Human
accggcuggccuggccc

SEQ ID NO: 1510879 - RNA, 18 nt, Human
accggcuggccuggcccc

SEQ ID NO: 1510880 - RNA, 19 nt, Human
accggcuggccuggccccu

SEQ ID NO: 1510881 - RNA, 20 nt, Human
accgggccacagagaaagua

SEQ ID NO: 1510882 - RNA, 15 nt, Human
accgggccacagaga

SEQ ID NO: 1510883 - RNA, 19 nt, Human
accgggccacagagaaagu

SEQ ID NO: 1510884 - RNA, 14 nt, Human
accgugaggccaga

SEQ ID NO: 1510885 - RNA, 17 nt, Human
acccuguuaccauuuug

SEQ ID NO: 1510886 - RNA, 16 nt, Human
acccaugcugcccugu

SEQ ID NO: 1510887 - RNA, 14 nt, Human
acccaugcugcccu

SEQ ID NO: 1510888 - RNA, 15 nt, Human
acccaugcugcccug

SEQ ID NO: 1510889 - RNA, 22 nt, Human
acccugugauggggcccugccu

SEQ ID NO: 1510890 - RNA, 16 nt, Human
accccacacacgccag

SEQ ID NO: 1510891 - RNA, 18 nt, Human
accucaggugagaagcag

SEQ ID NO: 1510892 - RNA, 14 nt, Human
accucaggccuggg

SEQ ID NO: 1510893 - RNA, 22 nt, Human
accucaggccugggggcugggc

SEQ ID NO: 1510894 - RNA, 16 nt, Human
accgugaggccagaga

SEQ ID NO: 1510895 - RNA, 17 nt, Human
accgugaggccagagac

SEQ ID NO: 1510896 - RNA, 12 nt, Human
accucaggccug

SEQ ID NO: 1510897 - RNA, 13 nt, Human
accucaggccugg

SEQ ID NO: 1510898 - RNA, 20 nt, Human
acuucaaauccuugaagauu

SEQ ID NO: 1510899 - RNA, 18 nt, Human
acuucagcgguuuauaua

SEQ ID NO: 1510900 - RNA, 19 nt, Human
acuucagcgguuuauauaa

SEQ ID NO: 1510901 - RNA, 20 nt, Human
acuucugccauauucuguug

SEQ ID NO: 1510902 - RNA, 17 nt, Human
acuucuuauacauuuga

SEQ ID NO: 1510903 - RNA, 18 nt, Human
acuucuuauacauuugau

SEQ ID NO: 1510904 - RNA, 15 nt, Human
acuuaaauaauguga

SEQ ID NO: 1510905 - RNA, 14 nt, Human
acuuaaauaaugug

SEQ ID NO: 1510906 - RNA, 21 nt, Human
acuuaaaaaugguuuaaaugg

SEQ ID NO: 1510907 - RNA, 13 nt, Human
acuuaaaaauggu

SEQ ID NO: 1510908 - RNA, 14 nt, Human
acuuaaaaaugguu

SEQ ID NO: 1510909 - RNA, 12 nt, Human
acuuuaugcuaa

SEQ ID NO: 1510910 - RNA, 17 nt, Human
acuuuaugcuaagugaa

SEQ ID NO: 1510911 - RNA, 22 nt, Human
acuugggaggcugagaugggag

SEQ ID NO: 1510912 - RNA, 14 nt, Human
acucuuaagaagac

SEQ ID NO: 1510913 - RNA, 15 nt, Human
acucuuaagaagacu

SEQ ID NO: 1510914 - RNA, 20 nt, Human
acucuuaagaagacugcauu

SEQ ID NO: 1510915 - RNA, 19 nt, Human
acucugucucaaaaaaaca

SEQ ID NO: 1510916 - RNA, 15 nt, Human
acucugucucagucc

SEQ ID NO: 1510917 - RNA, 17 nt, Human
acucugucucaguccau

SEQ ID NO: 1510918 - RNA, 21 nt, Human
acucugugucagguggggcag

SEQ ID NO: 1510919 - RNA, 23 nt, Human
acugaugggcaacccccagccug

SEQ ID NO: 1510920 - RNA, 23 nt, Human
acugauuuuuuuuuccuucagug

SEQ ID NO: 1510921 - RNA, 21 nt, Human
acugauuuuuuuuuccuucag

SEQ ID NO: 1510922 - RNA, 22 nt, Human
acugauuuuuuuuuccuucagu

SEQ ID NO: 1510923 - RNA, 23 nt, Human
acugacauuguuggccaaagcca

SEQ ID NO: 1510924 - RNA, 13 nt, Human
acugaucucucgu

SEQ ID NO: 1510925 - RNA, 22 nt, Human
acugauggcuaauguacugcau

SEQ ID NO: 1510926 - RNA, 12 nt, Human
acugaugggcaa

SEQ ID NO: 1510927 - RNA, 22 nt, Human
acugaugggcaacccccagccu

SEQ ID NO: 1510928 - RNA, 15 nt, Human
acugcccggcagggu

SEQ ID NO: 1510929 - RNA, 16 nt, Human
acugcuuuuggucugu

SEQ ID NO: 1510930 - RNA, 20 nt, Human
acugcuuuuggucuguguga

SEQ ID NO: 1510931 - RNA, 22 nt, Human
acugcccggcaggguccuagaa

SEQ ID NO: 1510932 - RNA, 14 nt, Human
acugccaugccagc

SEQ ID NO: 1510933 - RNA, 15 nt, Human
acugcuuuuggucug

SEQ ID NO: 1510934 - RNA, 15 nt, Human
aagagaacuuccaga

SEQ ID NO: 1510935 - RNA, 17 nt, Human
aagacuuuuccaacccu

SEQ ID NO: 1510936 - RNA, 21 nt, Human
aacuuacuugcauaccaaguu

SEQ ID NO: 1510937 - RNA, 23 nt, Human
aagacagugaaagaaaauaacaa

SEQ ID NO: 1510938 - RNA, 21 nt, Human
aagacauucuuccaaaaagau

SEQ ID NO: 1510939 - RNA, 16 nt, Human
aagacuuuggaaagag

SEQ ID NO: 1510940 - RNA, 16 nt, Human
aagauacugaaauaaa

SEQ ID NO: 1510941 - RNA, 20 nt, Human
aagauacugaaauaaacguc

SEQ ID NO: 1510942 - RNA, 14 nt, Human
aagauagcagggca

SEQ ID NO: 1510943 - RNA, 20 nt, Human
aagauucaaugccccugaau

SEQ ID NO: 1510944 - RNA, 21 nt, Human
aagauucaaugccccugaauu

SEQ ID NO: 1510945 - RNA, 20 nt, Human
aagauucauauuuacuucuu

SEQ ID NO: 1510946 - RNA, 19 nt, Human
aagauuuugaaauuuuuau

SEQ ID NO: 1510947 - RNA, 19 nt, Human
aagccaccaacauacuccc

SEQ ID NO: 1510948 - RNA, 15 nt, Human
aagcagggacuugaa

SEQ ID NO: 1510949 - RNA, 12 nt, Human
aaguagaggagg

SEQ ID NO: 1510950 - RNA, 20 nt, Human
aagggacuuggaagcuccgc

SEQ ID NO: 1510951 - RNA, 14 nt, Human
aagggauggcaaga

SEQ ID NO: 1510952 - RNA, 17 nt, Human
aagggauggcaagaugu

SEQ ID NO: 1510953 - RNA, 16 nt, Human
aagcugcugacagugu

SEQ ID NO: 1510954 - RNA, 23 nt, Human
aaggaaugauuaauuaaaacaca

SEQ ID NO: 1510955 - RNA, 21 nt, Human
aagcgugagccacugcaccgg

SEQ ID NO: 1510956 - RNA, 17 nt, Human
aagcgugagccacugca

SEQ ID NO: 1510957 - RNA, 20 nt, Human
aagcgugagccacugcaccg

SEQ ID NO: 1510958 - RNA, 11 nt, Human
aagcugccagc

SEQ ID NO: 1510959 - RNA, 12 nt, Human
aagcugccagcc

SEQ ID NO: 1510960 - RNA, 14 nt, Human
aagcugcugacagu

SEQ ID NO: 1510961 - RNA, 22 nt, Human
aagcugccagccgagauagcca

SEQ ID NO: 1510962 - RNA, 13 nt, Human
aaggacacuagaa

SEQ ID NO: 1510963 - RNA, 15 nt, Human
aagccagcaggcucu

SEQ ID NO: 1510964 - RNA, 19 nt, Human
aagccagcaggcucucagg

SEQ ID NO: 1510965 - RNA, 18 nt, Human
aagccagcaggcucucag

SEQ ID NO: 1510966 - RNA, 21 nt, Human
aagccaccaacauacucccau

SEQ ID NO: 1510967 - RNA, 15 nt, Human
aagcgauucuucugc

SEQ ID NO: 1510968 - RNA, 14 nt, Human
aagcgauucuucug

SEQ ID NO: 1510969 - RNA, 16 nt, Human
aagcgauucuucugcu

SEQ ID NO: 1510970 - RNA, 17 nt, Human
aagcgauucuucugcuu

SEQ ID NO: 1510971 - RNA, 14 nt, Human
aauaauguuucaaa

SEQ ID NO: 1510972 - RNA, 19 nt, Human
aauaauguuucaaacauau

SEQ ID NO: 1510973 - RNA, 12 nt, Human
aauaauguuuca

SEQ ID NO: 1510974 - RNA, 17 nt, Human
aauaaaccucaaaaugu

SEQ ID NO: 1510975 - RNA, 10 nt, Human
aauaaaccau

SEQ ID NO: 1510976 - RNA, 14 nt, Human
aauaauaaauauuu

SEQ ID NO: 1510977 - RNA, 15 nt, Human
aauaaacgucuuaaa

SEQ ID NO: 1510978 - RNA, 20 nt, Human
aauaaaccucaaaaugucua

SEQ ID NO: 1510979 - RNA, 22 nt, Human
aaguugauaugccuuuucccaa

SEQ ID NO: 1510980 - RNA, 13 nt, Human
aagugcugcauuu

SEQ ID NO: 1510981 - RNA, 14 nt, Human
aagugcugcauuua

SEQ ID NO: 1510982 - RNA, 19 nt, Human
aauacgugggcauucaaau

SEQ ID NO: 1510983 - RNA, 20 nt, Human
aauacgugggcauucaaaug

SEQ ID NO: 1510984 - RNA, 16 nt, Human
aauauaggaacuuaaa

SEQ ID NO: 1510985 - RNA, 13 nt, Human
aauauaaacacua

SEQ ID NO: 1510986 - RNA, 14 nt, Human
aauauaaacacuau

SEQ ID NO: 1510987 - RNA, 16 nt, Human
aauccauacauuugug

SEQ ID NO: 1510988 - RNA, 17 nt, Human
aauccauacauuugugu

SEQ ID NO: 1510989 - RNA, 17 nt, Human
aauccagacccggcugc

SEQ ID NO: 1510990 - RNA, 14 nt, Human
aaugauaacuggaa

SEQ ID NO: 1510991 - RNA, 15 nt, Human
aaugauaacuggaaa

SEQ ID NO: 1510992 - RNA, 16 nt, Human
aaugauaacuggaaac

SEQ ID NO: 1510993 - RNA, 15 nt, Human
aaugauagcuacugu

SEQ ID NO: 1510994 - RNA, 16 nt, Human
aaugauuaauuaaaac

SEQ ID NO: 1510995 - RNA, 12 nt, Human
aaugauuaauua

SEQ ID NO: 1510996 - RNA, 13 nt, Human
aaugauuaauuaa

SEQ ID NO: 1510997 - RNA, 22 nt, Human
aaucaaauaugcaaagcacuga

SEQ ID NO: 1510998 - RNA, 15 nt, Human
aaucaaauaugcaaa

SEQ ID NO: 1510999 - RNA, 16 nt, Human
aaucaaauaugcaaag

SEQ ID NO: 1511000 - RNA, 17 nt, Human
aaugggggugcauuuga

SEQ ID NO: 1511001 - RNA, 15 nt, Human
aaugggggugcauuu

SEQ ID NO: 1511002 - RNA, 23 nt, Human
aaugcucuuuacuucauggacuu

SEQ ID NO: 1511003 - RNA, 13 nt, Human
aaugggacacuaa

SEQ ID NO: 1511004 - RNA, 14 nt, Human
aaugggagcucaug

SEQ ID NO: 1511005 - RNA, 23 nt, Human
aaugcgugcauaccacuuuuguu

SEQ ID NO: 1511006 - RNA, 21 nt, Human
aaugcgugcauaccacuuuug

SEQ ID NO: 1511007 - RNA, 15 nt, Human
aaauaaacgucuuaa

SEQ ID NO: 1511008 - RNA, 16 nt, Human
aaauaaacgucuuaaa

SEQ ID NO: 1511009 - RNA, 19 nt, Human
aaauaaaccucaaaauguc

SEQ ID NO: 1511010 - RNA, 20 nt, Human
aaauaaaaauauuguguugu

SEQ ID NO: 1511011 - RNA, 17 nt, Human
aaauaaacgucuuaaau

SEQ ID NO: 1511012 - RNA, 11 nt, Human
aaauaaauuau

SEQ ID NO: 1511013 - RNA, 15 nt, Human
aaagcccagagacag

SEQ ID NO: 1511014 - RNA, 21 nt, Human
aaaggcuccaggagcagccac

SEQ ID NO: 1511015 - RNA, 22 nt, Human
aaaggcuccaggagcagccaca

SEQ ID NO: 1511016 - RNA, 14 nt, Human
aaaggcuccaggag

SEQ ID NO: 1511017 - RNA, 14 nt, Human
aaaggcuaccuuug

SEQ ID NO: 1511018 - RNA, 17 nt, Human
aaaggcuaccuuuguau

SEQ ID NO: 1511019 - RNA, 15 nt, Human
aaagccaaagcuagg

SEQ ID NO: 1511020 - RNA, 20 nt, Human
aaagcauuguaaaugugcuu

SEQ ID NO: 1511021 - RNA, 13 nt, Human
aaagaaacauuug

SEQ ID NO: 1511022 - RNA, 22 nt, Human
aaacugauuuuuuuuuccuuca

SEQ ID NO: 1511023 - RNA, 20 nt, Human
aaacugauuuuuuuuuccuu

SEQ ID NO: 1511024 - RNA, 13 nt, Human
aaacugauuuuuu

SEQ ID NO: 1511025 - RNA, 19 nt, Human
aaacugauuuuuuuuuccu

SEQ ID NO: 1511026 - RNA, 19 nt, Human
aaacccuugccaugugcua

SEQ ID NO: 1511027 - RNA, 14 nt, Human
aaacccuucagugc

SEQ ID NO: 1511028 - RNA, 17 nt, Human
aaacucuugaccucagg

SEQ ID NO: 1511029 - RNA, 17 nt, Human
aaaccucaaaaugucua

SEQ ID NO: 1511030 - RNA, 22 nt, Human
aaaccucaaaaugucuaagaua

SEQ ID NO: 1511031 - RNA, 17 nt, Human
aaaccccaucucuacaa

SEQ ID NO: 1511032 - RNA, 21 nt, Human
aaacccugucucuacuaaaaa

SEQ ID NO: 1511033 - RNA, 15 nt, Human
aaagauacaguuacu

SEQ ID NO: 1511034 - RNA, 11 nt, Human
aaagagguuuu

SEQ ID NO: 1511035 - RNA, 17 nt, Human
aaacagcuaaugggaca

SEQ ID NO: 1511036 - RNA, 21 nt, Human
aaaauuauuuuguucauacau

SEQ ID NO: 1511037 - RNA, 20 nt, Human
aaaauuauuuuguucauaca

SEQ ID NO: 1511038 - RNA, 16 nt, Human
aaaauuauuuuguuca

SEQ ID NO: 1511039 - RNA, 18 nt, Human
aaaauuauuuuguucaua

SEQ ID NO: 1511040 - RNA, 15 nt, Human
aaaauuagccaagug

SEQ ID NO: 1511041 - RNA, 19 nt, Human
aaaauccauacauuugugu

SEQ ID NO: 1511042 - RNA, 22 nt, Human
aaaaucccuuaccucggugccu

SEQ ID NO: 1511043 - RNA, 14 nt, Human
aaaauuaacacugc

SEQ ID NO: 1511044 - RNA, 16 nt, Human
aacagcuaaugggaca

SEQ ID NO: 1511045 - RNA, 14 nt, Human
aacacuauauggca

SEQ ID NO: 1511046 - RNA, 18 nt, Human
aacacuauauggcagugu

SEQ ID NO: 1511047 - RNA, 20 nt, Human
aacacuauauggcagugucu

SEQ ID NO: 1511048 - RNA, 21 nt, Human
aacacuauauggcagugucuu

SEQ ID NO: 1511049 - RNA, 15 nt, Human
aacauggaaguacua

SEQ ID NO: 1511050 - RNA, 13 nt, Human
aacccuucagugc

SEQ ID NO: 1511051 - RNA, 19 nt, Human
aaccaguguuguggauuua

SEQ ID NO: 1511052 - RNA, 15 nt, Human
aacucauauuuucau

SEQ ID NO: 1511053 - RNA, 16 nt, Human
aacucauauuuucaug

SEQ ID NO: 1511054 - RNA, 18 nt, Human
aacucauauuuucaugcu

SEQ ID NO: 1511055 - RNA, 13 nt, Human
aacgucugugcca

SEQ ID NO: 1511056 - RNA, 16 nt, Human
aacggggcucuucuca

SEQ ID NO: 1511057 - RNA, 18 nt, Human
aacggggcucuucucauu

SEQ ID NO: 1511058 - RNA, 17 nt, Human
aacucaaacucuuaaaa

SEQ ID NO: 1511059 - RNA, 16 nt, Human
aacucaccccagcccc

SEQ ID NO: 1511060 - RNA, 17 nt, Human
aacucaccccagcccca

SEQ ID NO: 1511061 - RNA, 18 nt, Human
aacucaccccagccccaa

SEQ ID NO: 1511062 - RNA, 20 nt, Human
aaauguucaucaaugaauga

SEQ ID NO: 1511063 - RNA, 14 nt, Human
aaauugauguguuu

SEQ ID NO: 1511064 - RNA, 21 nt, Human
aaauugauguguuuauuuaua

SEQ ID NO: 1511065 - RNA, 13 nt, Human
aacaaaauuucua

SEQ ID NO: 1511066 - RNA, 15 nt, Human
aacaaaauuucuauu

SEQ ID NO: 1511067 - RNA, 12 nt, Human
aaauuaacuuuu

SEQ ID NO: 1511068 - RNA, 19 nt, Human
aaauuaacuuuuauaaacu

SEQ ID NO: 1511069 - RNA, 14 nt, Human
aaauuaacuuuuau

SEQ ID NO: 1511070 - RNA, 13 nt, Human
aaauuaacuuuua

SEQ ID NO: 1511071 - RNA, 12 nt, Human
aacacaucagcu

SEQ ID NO: 1511072 - RNA, 19 nt, Human
aacaccucugcacaagcug

SEQ ID NO: 1511073 - RNA, 22 nt, Human
aacaaaccuguuucugcagcca

SEQ ID NO: 1511074 - RNA, 21 nt, Human
aacacauacaggaagguagaa

SEQ ID NO: 1511075 - RNA, 18 nt, Human
aaaucugcuuuuuaaaga

SEQ ID NO: 1511076 - RNA, 14 nt, Human
aaaucuuaacuuga

SEQ ID NO: 1511077 - RNA, 20 nt, Human
aaaugcuagguuaauuccaa

SEQ ID NO: 1511078 - RNA, 22 nt, Human
aaaucuccaaaauaaaacuuuu

SEQ ID NO: 1511079 - RNA, 14 nt, Human
aaauggacguguua

SEQ ID NO: 1511080 - RNA, 17 nt, Human
aaauggaauacucuuau

SEQ ID NO: 1511081 - RNA, 15 nt, Human
aaauggacguguuau

SEQ ID NO: 1511082 - RNA, 17 nt, Human
aaauggacguguuauga

SEQ ID NO: 1511083 - RNA, 21 nt, Human
agaggacuuuucuuuguggcu

SEQ ID NO: 1511084 - RNA, 22 nt, Human
agaggacuuuucuuuguggcuu

SEQ ID NO: 1511085 - RNA, 23 nt, Human
agaggagggcagcagaagggggu

SEQ ID NO: 1511086 - RNA, 23 nt, Human
agaggacuuuucuuuguggcuuc

SEQ ID NO: 1511087 - RNA, 13 nt, Human
agagggccugcaa

SEQ ID NO: 1511088 - RNA, 16 nt, Human
agagggccugcaaggg

SEQ ID NO: 1511089 - RNA, 17 nt, Human
agaggggguggccuccc

SEQ ID NO: 1511090 - RNA, 19 nt, Human
agaggggguggccucccaa

SEQ ID NO: 1511091 - RNA, 13 nt, Human
agaggaaugaagu

SEQ ID NO: 1511092 - RNA, 13 nt, Human
agagcccaccuug

SEQ ID NO: 1511093 - RNA, 13 nt, Human
agagccagggucu

SEQ ID NO: 1511094 - RNA, 16 nt, Human
agacuggaagcacagc

SEQ ID NO: 1511095 - RNA, 16 nt, Human
agagagaccacuuuuc

SEQ ID NO: 1511096 - RNA, 23 nt, Human
agacugaguacguugugcauuug

SEQ ID NO: 1511097 - RNA, 22 nt, Human
agacugaguacguugugcauuu

SEQ ID NO: 1511098 - RNA, 20 nt, Human
agacugaguacguugugcau

SEQ ID NO: 1511099 - RNA, 18 nt, Human
agacucugucucagucca

SEQ ID NO: 1511100 - RNA, 18 nt, Human
agacucugucucaaaaaa

SEQ ID NO: 1511101 - RNA, 16 nt, Human
agacgcugugcugccc

SEQ ID NO: 1511102 - RNA, 13 nt, Human
agaaggggguggu

SEQ ID NO: 1511103 - RNA, 20 nt, Human
agaaggggguggugucucca

SEQ ID NO: 1511104 - RNA, 13 nt, Human
agaagauagcagg

SEQ ID NO: 1511105 - RNA, 18 nt, Human
agaagucacauuccugaa

SEQ ID NO: 1511106 - RNA, 20 nt, Human
agaagucacauuccugaaca

SEQ ID NO: 1511107 - RNA, 21 nt, Human
agaagucacauuccugaacag

SEQ ID NO: 1511108 - RNA, 14 nt, Human
agaaguaacuuacu

SEQ ID NO: 1511109 - RNA, 18 nt, Human
agaagacugcauuauauu

SEQ ID NO: 1511110 - RNA, 21 nt, Human
agaagagauugugguuucauu

SEQ ID NO: 1511111 - RNA, 22 nt, Human
agaagagaguccauauuucaau

SEQ ID NO: 1511112 - RNA, 22 nt, Human
agaagagcuguucacagccaga

SEQ ID NO: 1511113 - RNA, 13 nt, Human
agaagacacugau

SEQ ID NO: 1511114 - RNA, 21 nt, Human
agaagacacugaugggcaacc

SEQ ID NO: 1511115 - RNA, 21 nt, Human
acuuuccucuuuggucuacac

SEQ ID NO: 1511116 - RNA, 22 nt, Human
agaagucacauuccugaacagg

SEQ ID NO: 1511117 - RNA, 21 nt, Human
agaagugaaaaucuacacucc

SEQ ID NO: 1511118 - RNA, 18 nt, Human
agaaugaaagggcccaga

SEQ ID NO: 1511119 - RNA, 17 nt, Human
agaaugagagacacacu

SEQ ID NO: 1511120 - RNA, 22 nt, Human
agaaugagagacacacugaaga

SEQ ID NO: 1511121 - RNA, 17 nt, Human
agaaugauuaugaauua

SEQ ID NO: 1511122 - RNA, 19 nt, Human
agaaugcacaaacagaggc

SEQ ID NO: 1511123 - RNA, 22 nt, Human
agaaugcacaaacagaggccgc

SEQ ID NO: 1511124 - RNA, 23 nt, Human
agacagagucucacuguugccca

SEQ ID NO: 1511125 - RNA, 21 nt, Human
agacagagucucacuguugcc

SEQ ID NO: 1511126 - RNA, 19 nt, Human
agacccaaaaggcagaagc

SEQ ID NO: 1511127 - RNA, 20 nt, Human
agacaaugacuuacuguaca

SEQ ID NO: 1511128 - RNA, 23 nt, Human
agacaaugacuuacuguacauga

SEQ ID NO: 1511129 - RNA, 15 nt, Human
agacagagcuacaca

SEQ ID NO: 1511130 - RNA, 22 nt, Human
agacaaugacuuacuguacaug

SEQ ID NO: 1511131 - RNA, 21 nt, Human
agacaaugacuuacuguacau

SEQ ID NO: 1511132 - RNA, 11 nt, Human
agacagagucu

SEQ ID NO: 1511133 - RNA, 12 nt, Human
agacagagcugg

SEQ ID NO: 1511134 - RNA, 19 nt, Human
agacagagucucacuguug

SEQ ID NO: 1511135 - RNA, 20 nt, Human
agacagagucucacuguugc

SEQ ID NO: 1511136 - RNA, 19 nt, Human
agauguagaggagaaacug

SEQ ID NO: 1511137 - RNA, 14 nt, Human
agaugguucuagca

SEQ ID NO: 1511138 - RNA, 19 nt, Human
agaugaugaugaucuuuaa

SEQ ID NO: 1511139 - RNA, 14 nt, Human
agaugagugagcau

SEQ ID NO: 1511140 - RNA, 23 nt, Human
agaggggguggccucccaacuca

SEQ ID NO: 1511141 - RNA, 24 nt, Human
agcaaaauuuuuucucuaggaaau

SEQ ID NO: 1511142 - RNA, 18 nt, Human
agcaaaagaugcuucuca

SEQ ID NO: 1511143 - RNA, 19 nt, Human
agauucuuuccugaggcug

SEQ ID NO: 1511144 - RNA, 21 nt, Human
agauucuuuccugaggcuggg

SEQ ID NO: 1511145 - RNA, 23 nt, Human
agauugcaacaggcugggcuuca

SEQ ID NO: 1511146 - RNA, 20 nt, Human
agauugcaacaggcugggcu

SEQ ID NO: 1511147 - RNA, 21 nt, Human
agauugcaacaggcugggcuu

SEQ ID NO: 1511148 - RNA, 23 nt, Human
agcaaaggaguagaaagacagag

SEQ ID NO: 1511149 - RNA, 23 nt, Human
agcaaagcugaugacaacuuccc

SEQ ID NO: 1511150 - RNA, 21 nt, Human
agcaaagcugaugacaacuuc

SEQ ID NO: 1511151 - RNA, 20 nt, Human
agcaaaggagauuggaagga

SEQ ID NO: 1511152 - RNA, 14 nt, Human
agcacagacccugc

SEQ ID NO: 1511153 - RNA, 15 nt, Human
agcacagacccugcc

SEQ ID NO: 1511154 - RNA, 15 nt, Human
agcaaugccugccca

SEQ ID NO: 1511155 - RNA, 21 nt, Human
agcacgauuucuguuuagaua

SEQ ID NO: 1511156 - RNA, 19 nt, Human
agcacgauuucuguuuaga

SEQ ID NO: 1511157 - RNA, 17 nt, Human
agcacgauuucuguuua

SEQ ID NO: 1511158 - RNA, 16 nt, Human
agcacagacccugccc

SEQ ID NO: 1511159 - RNA, 17 nt, Human
agcacagacccugcccu

SEQ ID NO: 1511160 - RNA, 14 nt, Human
agccagcaggcucu

SEQ ID NO: 1511161 - RNA, 17 nt, Human
agccagaggagagagga

SEQ ID NO: 1511162 - RNA, 18 nt, Human
agccagaggagagaggac

SEQ ID NO: 1511163 - RNA, 20 nt, Human
agccaaggccaaaggaagca

SEQ ID NO: 1511164 - RNA, 13 nt, Human
agccagaggagag

SEQ ID NO: 1511165 - RNA, 15 nt, Human
agccagaggagagag

SEQ ID NO: 1511166 - RNA, 18 nt, Human
agcauccuggcacccggc

SEQ ID NO: 1511167 - RNA, 14 nt, Human
agcauccuggcacc

SEQ ID NO: 1511168 - RNA, 17 nt, Human
agcauccuggcacccgg

SEQ ID NO: 1511169 - RNA, 16 nt, Human
agccaaagcuaggccu

SEQ ID NO: 1511170 - RNA, 18 nt, Human
agccaaagcuaggccugg

SEQ ID NO: 1511171 - RNA, 15 nt, Human
agcccaccccucaac

SEQ ID NO: 1511172 - RNA, 16 nt, Human
agcccaccuuggcuca

SEQ ID NO: 1511173 - RNA, 16 nt, Human
agccagcaggcucuca

SEQ ID NO: 1511174 - RNA, 17 nt, Human
agccagcaggcucucag

SEQ ID NO: 1511175 - RNA, 23 nt, Human
agcccacgcccccacuggugaca

SEQ ID NO: 1511176 - RNA, 14 nt, Human
agcccacgccccca

SEQ ID NO: 1511177 - RNA, 15 nt, Human
agcccacgcccccac

SEQ ID NO: 1511178 - RNA, 13 nt, Human
agcauccuggcac

SEQ ID NO: 1511179 - RNA, 17 nt, Human
agccccauucugccugc

SEQ ID NO: 1511180 - RNA, 18 nt, Human
agccccauucugccugcc

SEQ ID NO: 1511181 - RNA, 19 nt, Human
agccccauucugccugccc

SEQ ID NO: 1511182 - RNA, 15 nt, Human
agccccauccucugu

SEQ ID NO: 1511183 - RNA, 17 nt, Human
agccccauccucuguac

SEQ ID NO: 1511184 - RNA, 23 nt, Human
agccccauccucuguacagagcc

SEQ ID NO: 1511185 - RNA, 20 nt, Human
agccccauucugccugccca

SEQ ID NO: 1511186 - RNA, 17 nt, Human
agcccgggcucugccuc

SEQ ID NO: 1511187 - RNA, 18 nt, Human
agcccgggcucugccucc

SEQ ID NO: 1511188 - RNA, 20 nt, Human
agcccgggcucugccuccca

SEQ ID NO: 1511189 - RNA, 21 nt, Human
agcccgggcucugccucccau

SEQ ID NO: 1511190 - RNA, 12 nt, Human
aggaacaaggca

SEQ ID NO: 1511191 - RNA, 13 nt, Human
aggaacaaggcaa

SEQ ID NO: 1511192 - RNA, 16 nt, Human
aggaacaaggcaaggc

SEQ ID NO: 1511193 - RNA, 17 nt, Human
aggaacaaggcaaggcu

SEQ ID NO: 1511194 - RNA, 19 nt, Human
aggaacaaggcaaggcugu

SEQ ID NO: 1511195 - RNA, 21 nt, Human
aggaacuuaaauaaugugaaa

SEQ ID NO: 1511196 - RNA, 20 nt, Human
aggaacaaggcaaggcuguc

SEQ ID NO: 1511197 - RNA, 23 nt, Human
aggaacaaggcaaggcugucaau

SEQ ID NO: 1511198 - RNA, 22 nt, Human
aggaauaccugucccccugaca

SEQ ID NO: 1511199 - RNA, 15 nt, Human
aggaauaccuguccc

SEQ ID NO: 1511200 - RNA, 18 nt, Human
aggaauaccugucccccu

SEQ ID NO: 1511201 - RNA, 23 nt, Human
aggaacuuaaauaaugugaaacu

SEQ ID NO: 1511202 - RNA, 18 nt, Human
agcuucacuguaaaauaa

SEQ ID NO: 1511203 - RNA, 18 nt, Human
agcuucauuuccuguguc

SEQ ID NO: 1511204 - RNA, 23 nt, Human
agcuuuguuuguugucagcugaa

SEQ ID NO: 1511205 - RNA, 19 nt, Human
agcuucauuuccugugucu

SEQ ID NO: 1511206 - RNA, 12 nt, Human
agcuacaaaugc

SEQ ID NO: 1511207 - RNA, 23 nt, Human
agcuaauguaauaacugugaagu

SEQ ID NO: 1511208 - RNA, 16 nt, Human
agcucaccagccccag

SEQ ID NO: 1511209 - RNA, 12 nt, Human
agcucagagagg

SEQ ID NO: 1511210 - RNA, 18 nt, Human
agcucagagaggguggga

SEQ ID NO: 1511211 - RNA, 14 nt, Human
agcucagagagggu

SEQ ID NO: 1511212 - RNA, 12 nt, Human
agcucaccucuc

SEQ ID NO: 1511213 - RNA, 19 nt, Human
agcucaccagccccagugc

SEQ ID NO: 1511214 - RNA, 20 nt, Human
agcucaccagccccagugcc

SEQ ID NO: 1511215 - RNA, 15 nt, Human
agcucaccucucccu

SEQ ID NO: 1511216 - RNA, 18 nt, Human
agcucaccucucccuugg

SEQ ID NO: 1511217 - RNA, 19 nt, Human
agcucaccucucccuugga

SEQ ID NO: 1511218 - RNA, 12 nt, Human
agccugggaggu

SEQ ID NO: 1511219 - RNA, 20 nt, Human
agccugggaggucaaggcug

SEQ ID NO: 1511220 - RNA, 13 nt, Human
agcgagcccuggu

SEQ ID NO: 1511221 - RNA, 19 nt, Human
agcgagcccugguggcagu

SEQ ID NO: 1511222 - RNA, 22 nt, Human
agcuccccucggagaagagcug

SEQ ID NO: 1511223 - RNA, 20 nt, Human
agcuccccucggagaagagc

SEQ ID NO: 1511224 - RNA, 17 nt, Human
agcuccccucggagaag

SEQ ID NO: 1511225 - RNA, 19 nt, Human
agcuccccucggagaagag

SEQ ID NO: 1511226 - RNA, 15 nt, Human
agcugaaccugggua

SEQ ID NO: 1511227 - RNA, 17 nt, Human
agcugaggcaauucuaa

SEQ ID NO: 1511228 - RNA, 22 nt, Human
agcugguuuuuagcggagacgg

SEQ ID NO: 1511229 - RNA, 18 nt, Human
agcuggucccacucaguc

SEQ ID NO: 1511230 - RNA, 19 nt, Human
agcuggucccacucagucc

SEQ ID NO: 1511231 - RNA, 13 nt, Human
agcugcugacagu

SEQ ID NO: 1511232 - RNA, 14 nt, Human
agcugcugacagug

SEQ ID NO: 1511233 - RNA, 17 nt, Human
agcuggucccacucagu

SEQ ID NO: 1511234 - RNA, 21 nt, Human
agcugcgguccacccaggagc

SEQ ID NO: 1511235 - RNA, 12 nt, Human
agcugcugacag

SEQ ID NO: 1511236 - RNA, 19 nt, Human
agcugcgguccacccagga

SEQ ID NO: 1511237 - RNA, 20 nt, Human
agcugcgguccacccaggag

SEQ ID NO: 1511238 - RNA, 13 nt, Human
agcugcgguccac

SEQ ID NO: 1511239 - RNA, 16 nt, Human
agcugcgguccaccca

SEQ ID NO: 1511240 - RNA, 17 nt, Human
agcugcgguccacccag

SEQ ID NO: 1511241 - RNA, 18 nt, Human
agcugcgguccacccagg

SEQ ID NO: 1511242 - RNA, 21 nt, Human
aggcuaaagcccagagacagc

SEQ ID NO: 1511243 - RNA, 15 nt, Human
agggacccuccacca

SEQ ID NO: 1511244 - RNA, 15 nt, Human
agggacugaggggag

SEQ ID NO: 1511245 - RNA, 18 nt, Human
aggcuuagucacugagac

SEQ ID NO: 1511246 - RNA, 21 nt, Human
aggcuuagucacugagacagc

SEQ ID NO: 1511247 - RNA, 23 nt, Human
aggcuuagggacaggaccccagc

SEQ ID NO: 1511248 - RNA, 20 nt, Human
aggcuguaucccaugagccu

SEQ ID NO: 1511249 - RNA, 21 nt, Human
aggcuguaucccaugagccuc

SEQ ID NO: 1511250 - RNA, 22 nt, Human
aggcuguaucccaugagccuca

SEQ ID NO: 1511251 - RNA, 23 nt, Human
aggcuguaucccaugagccucag

SEQ ID NO: 1511252 - RNA, 17 nt, Human
aggcuuagucacugaga

SEQ ID NO: 1511253 - RNA, 14 nt, Human
aggcuaccuuugua

SEQ ID NO: 1511254 - RNA, 13 nt, Human
aggcuaccuuugu

SEQ ID NO: 1511255 - RNA, 15 nt, Human
aggcuaccuuuguau

SEQ ID NO: 1511256 - RNA, 18 nt, Human
aggcuggguucugauccu

SEQ ID NO: 1511257 - RNA, 14 nt, Human
aggagaggggcaca

SEQ ID NO: 1511258 - RNA, 17 nt, Human
aggcaugugaugagagg

SEQ ID NO: 1511259 - RNA, 15 nt, Human
aggcaugguggccca

SEQ ID NO: 1511260 - RNA, 19 nt, Human
aggcaugugaugagaggaa

SEQ ID NO: 1511261 - RNA, 20 nt, Human
aggcaugugaugagaggaaa

SEQ ID NO: 1511262 - RNA, 21 nt, Human
aggcaugugaugagaggaaau

SEQ ID NO: 1511263 - RNA, 17 nt, Human
aggcauguucucugagg

SEQ ID NO: 1511264 - RNA, 18 nt, Human
aggcauguucucugagga

SEQ ID NO: 1511265 - RNA, 19 nt, Human
aggcauguucucugaggac

SEQ ID NO: 1511266 - RNA, 18 nt, Human
aggcauuccccaggaggc

SEQ ID NO: 1511267 - RNA, 21 nt, Human
aggccaugggcacugugggua

SEQ ID NO: 1511268 - RNA, 23 nt, Human
aggccaugggcacuguggguaga

SEQ ID NO: 1511269 - RNA, 22 nt, Human
aggcccucugcccacucccugc

SEQ ID NO: 1511270 - RNA, 23 nt, Human
aggcccucugcccacucccugca

SEQ ID NO: 1511271 - RNA, 12 nt, Human
aggcccuucucu

SEQ ID NO: 1511272 - RNA, 15 nt, Human
aggcccuucucucca

SEQ ID NO: 1511273 - RNA, 19 nt, Human
aggcccuucucuccagccc

SEQ ID NO: 1511274 - RNA, 19 nt, Human
aggcauuccccaggaggcc

SEQ ID NO: 1511275 - RNA, 20 nt, Human
aggcauuccccaggaggcca

SEQ ID NO: 1511276 - RNA, 13 nt, Human
aggccaggcccuc

SEQ ID NO: 1511277 - RNA, 14 nt, Human
aggccaggcccucu

SEQ ID NO: 1511278 - RNA, 16 nt, Human
aggccaggcccucugc

SEQ ID NO: 1511279 - RNA, 15 nt, Human
aggccaggcccucug

SEQ ID NO: 1511280 - RNA, 14 nt, Human
agggccuggccuga

SEQ ID NO: 1511281 - RNA, 22 nt, Human
aggggcccaaauucuuucagug

SEQ ID NO: 1511282 - RNA, 12 nt, Human
agggucccuggu

SEQ ID NO: 1511283 - RNA, 14 nt, Human
agggucccuggugg

SEQ ID NO: 1511284 - RNA, 21 nt, Human
aggguaucuggugacuuuccu

SEQ ID NO: 1511285 - RNA, 13 nt, Human
aggguauuccaga

SEQ ID NO: 1511286 - RNA, 16 nt, Human
aggguccugcagccug

SEQ ID NO: 1511287 - RNA, 17 nt, Human
aggguccugcagccugc

SEQ ID NO: 1511288 - RNA, 19 nt, Human
aggguccugcagccugcag

SEQ ID NO: 1511289 - RNA, 21 nt, Human
aggguccugcagccugcagga

SEQ ID NO: 1511290 - RNA, 16 nt, Human
agggucccugguggca

SEQ ID NO: 1511291 - RNA, 17 nt, Human
agggucccugguggcag

SEQ ID NO: 1511292 - RNA, 20 nt, Human
agggucccugguggcagcuc

SEQ ID NO: 1511293 - RNA, 22 nt, Human
agggucccugguggcagcucac

SEQ ID NO: 1511294 - RNA, 13 nt, Human
agggacuuagcaa

SEQ ID NO: 1511295 - RNA, 15 nt, Human
agggccugcaaggga

SEQ ID NO: 1511296 - RNA, 12 nt, Human
agggccuggccu

SEQ ID NO: 1511297 - RNA, 13 nt, Human
agggccuggccug

SEQ ID NO: 1511298 - RNA, 14 nt, Human
agggccugcaaggg

SEQ ID NO: 1511299 - RNA, 20 nt, Human
agggauuagggagagaagau

SEQ ID NO: 1511300 - RNA, 15 nt, Human
agggauuagggagag

SEQ ID NO: 1511301 - RNA, 22 nt, Human
aggguuuugccauguuggccag

SEQ ID NO: 1511302 - RNA, 23 nt, Human
aggguuuugccauguuggccagg

SEQ ID NO: 1511303 - RNA, 13 nt, Human
agguacucuccug

SEQ ID NO: 1511304 - RNA, 14 nt, Human
agguacucuccugg

SEQ ID NO: 1511305 - RNA, 16 nt, Human
agguaacaggcagaua

SEQ ID NO: 1511306 - RNA, 13 nt, Human
agguaacaggcag

SEQ ID NO: 1511307 - RNA, 14 nt, Human
agguaacaggcaga

SEQ ID NO: 1511308 - RNA, 20 nt, Human
agggucucacuauguugccc

SEQ ID NO: 1511309 - RNA, 18 nt, Human
augcacaaacagaggccg

SEQ ID NO: 1511310 - RNA, 23 nt, Human
augaugaaaugaggucagagccu

SEQ ID NO: 1511311 - RNA, 18 nt, Human
augaugaaaugaggucag

SEQ ID NO: 1511312 - RNA, 15 nt, Human
augaucuuuucaagu

SEQ ID NO: 1511313 - RNA, 15 nt, Human
augaugauccuaggc

SEQ ID NO: 1511314 - RNA, 18 nt, Human
augaugaucuuuaaaaua

SEQ ID NO: 1511315 - RNA, 21 nt, Human
augaugaucuuuaaaauacac

SEQ ID NO: 1511316 - RNA, 17 nt, Human
augaucuuugcagacag

SEQ ID NO: 1511317 - RNA, 16 nt, Human
augaucuuuaaaauac

SEQ ID NO: 1511318 - RNA, 18 nt, Human
augaucuuugcagacagg

SEQ ID NO: 1511319 - RNA, 19 nt, Human
augaucuuugcagacaggc

SEQ ID NO: 1511320 - RNA, 21 nt, Human
augaucuuugcagacaggcaa

SEQ ID NO: 1511321 - RNA, 19 nt, Human
augccuggauggggcugca

SEQ ID NO: 1511322 - RNA, 20 nt, Human
augccuggauggggcugcac

SEQ ID NO: 1511323 - RNA, 23 nt, Human
augcacagaguuguuacauuuuu

SEQ ID NO: 1511324 - RNA, 22 nt, Human
augcacagaguuguuacauuuu

SEQ ID NO: 1511325 - RNA, 21 nt, Human
augcacagaguuguuacauuu

SEQ ID NO: 1511326 - RNA, 19 nt, Human
augcacagaguuguuacau

SEQ ID NO: 1511327 - RNA, 15 nt, Human
augcacacauuuuuu

SEQ ID NO: 1511328 - RNA, 14 nt, Human
augcacacauuuuu

SEQ ID NO: 1511329 - RNA, 13 nt, Human
augcacacauuuu

SEQ ID NO: 1511330 - RNA, 16 nt, Human
augcuuguacauaaug

SEQ ID NO: 1511331 - RNA, 18 nt, Human
auggcuuuugugcauuau

SEQ ID NO: 1511332 - RNA, 17 nt, Human
auggcuuuugugcauua

SEQ ID NO: 1511333 - RNA, 16 nt, Human
auggcuuuugugcauu

SEQ ID NO: 1511334 - RNA, 16 nt, Human
augcugcccugugagu

SEQ ID NO: 1511335 - RNA, 13 nt, Human
augcugcccugug

SEQ ID NO: 1511336 - RNA, 14 nt, Human
augcugcccuguga

SEQ ID NO: 1511337 - RNA, 15 nt, Human
augcugcccugugag

SEQ ID NO: 1511338 - RNA, 17 nt, Human
auguguaagacaaaaag

SEQ ID NO: 1511339 - RNA, 15 nt, Human
auguguaaaauguga

SEQ ID NO: 1511340 - RNA, 19 nt, Human
auguguaagacaaaaagcu

SEQ ID NO: 1511341 - RNA, 15 nt, Human
auguuccuagugaaa

SEQ ID NO: 1511342 - RNA, 16 nt, Human
auguuccuagugaaag

SEQ ID NO: 1511343 - RNA, 13 nt, Human
auguguaaguauu

SEQ ID NO: 1511344 - RNA, 14 nt, Human
auguguaaguauuc

SEQ ID NO: 1511345 - RNA, 15 nt, Human
auguucugggacaca

SEQ ID NO: 1511346 - RNA, 17 nt, Human
auguucucugaggacac

SEQ ID NO: 1511347 - RNA, 14 nt, Human
auguucugggacac

SEQ ID NO: 1511348 - RNA, 17 nt, Human
auguucucucuucucca

SEQ ID NO: 1511349 - RNA, 13 nt, Human
auguucucugagg

SEQ ID NO: 1511350 - RNA, 17 nt, Human
auguuccuagugaaaga

SEQ ID NO: 1511351 - RNA, 14 nt, Human
auguucuuaauucu

SEQ ID NO: 1511352 - RNA, 15 nt, Human
auguuugccucugcc

SEQ ID NO: 1511353 - RNA, 17 nt, Human
auguuugccucugccuc

SEQ ID NO: 1511354 - RNA, 15 nt, Human
augugaacacaucag

SEQ ID NO: 1511355 - RNA, 14 nt, Human
augucacaggcagg

SEQ ID NO: 1511356 - RNA, 19 nt, Human
augucacaggcagguccag

SEQ ID NO: 1511357 - RNA, 21 nt, Human
augucaaucagccuaguugau

SEQ ID NO: 1511358 - RNA, 13 nt, Human
augucacaggcag

SEQ ID NO: 1511359 - RNA, 21 nt, Human
augggugcuuggaggaaggaa

SEQ ID NO: 1511360 - RNA, 23 nt, Human
augggugcuuggaggaaggaaac

SEQ ID NO: 1511361 - RNA, 19 nt, Human
auccucaguuuuugugaaa

SEQ ID NO: 1511362 - RNA, 19 nt, Human
aucccaugagccucagcau

SEQ ID NO: 1511363 - RNA, 19 nt, Human
auccagacccggcugcgug

SEQ ID NO: 1511364 - RNA, 17 nt, Human
auccucauacccacccc

SEQ ID NO: 1511365 - RNA, 20 nt, Human
aucaaagagguuuuaaaaaa

SEQ ID NO: 1511366 - RNA, 23 nt, Human
aucaaagagguuuuaaaaaaauc

SEQ ID NO: 1511367 - RNA, 23 nt, Human
aucacccgcuaagagggagggag

SEQ ID NO: 1511368 - RNA, 13 nt, Human
aucaccagacagg

SEQ ID NO: 1511369 - RNA, 14 nt, Human
aucaaauaugcaaa

SEQ ID NO: 1511370 - RNA, 15 nt, Human
aucaaauaugcaaag

SEQ ID NO: 1511371 - RNA, 13 nt, Human
aucacagccucug

SEQ ID NO: 1511372 - RNA, 13 nt, Human
aucagcuuauugu

SEQ ID NO: 1511373 - RNA, 22 nt, Human
aucagcuugcccuguuaaaaga

SEQ ID NO: 1511374 - RNA, 17 nt, Human
aucaugaauuaguuuua

SEQ ID NO: 1511375 - RNA, 14 nt, Human
aucaugucuggcua

SEQ ID NO: 1511376 - RNA, 19 nt, Human
aucuaguaugaaauuauau

SEQ ID NO: 1511377 - RNA, 15 nt, Human
aucuaguaugaaauu

SEQ ID NO: 1511378 - RNA, 16 nt, Human
aucuaguaugaaauua

SEQ ID NO: 1511379 - RNA, 17 nt, Human
aucuaguaugaaauuau

SEQ ID NO: 1511380 - RNA, 18 nt, Human
aucuaguaugaaauuaua

SEQ ID NO: 1511381 - RNA, 14 nt, Human
aucuaguaugaaau

SEQ ID NO: 1511382 - RNA, 14 nt, Human
aucuauauuuuaca

SEQ ID NO: 1511383 - RNA, 20 nt, Human
aucuccgucaacucauauuu

SEQ ID NO: 1511384 - RNA, 17 nt, Human
aucuggguucacugcaa

SEQ ID NO: 1511385 - RNA, 20 nt, Human
augaaguccaagcauuuaga

SEQ ID NO: 1511386 - RNA, 23 nt, Human
augaaguccaagcauuuagaugu

SEQ ID NO: 1511387 - RNA, 21 nt, Human
augaaguacucauacauguua

SEQ ID NO: 1511388 - RNA, 20 nt, Human
augaaaaugcaacaacaugu

SEQ ID NO: 1511389 - RNA, 22 nt, Human
augaggcauuuguuugaacuga

SEQ ID NO: 1511390 - RNA, 21 nt, Human
augaggcauuuguuugaacug

SEQ ID NO: 1511391 - RNA, 14 nt, Human
augaggcauuuguu

SEQ ID NO: 1511392 - RNA, 13 nt, Human
augaggcauuugu

SEQ ID NO: 1511393 - RNA, 15 nt, Human
augaaaacacauuuu

SEQ ID NO: 1511394 - RNA, 14 nt, Human
augaaaacacauuu

SEQ ID NO: 1511395 - RNA, 16 nt, Human
augaaaacacauuuuu

SEQ ID NO: 1511396 - RNA, 20 nt, Human
agugaauucuugaaggaaaa

SEQ ID NO: 1511397 - RNA, 19 nt, Human
aguccucuuuucugagagg

SEQ ID NO: 1511398 - RNA, 11 nt, Human
aguccaagcau

SEQ ID NO: 1511399 - RNA, 22 nt, Human
aguccucuuuucugagaggacu

SEQ ID NO: 1511400 - RNA, 20 nt, Human
aguccuuaccagcagagcac

SEQ ID NO: 1511401 - RNA, 17 nt, Human
aguauuuuguuucagug

SEQ ID NO: 1511402 - RNA, 13 nt, Human
aguauuuuugaca

SEQ ID NO: 1511403 - RNA, 14 nt, Human
aguauuuuguuuca

SEQ ID NO: 1511404 - RNA, 23 nt, Human
aguaugaggcauuuguuugaacu

SEQ ID NO: 1511405 - RNA, 18 nt, Human
aguauuuuugacagaaua

SEQ ID NO: 1511406 - RNA, 16 nt, Human
aguauuuuugacagaa

SEQ ID NO: 1511407 - RNA, 17 nt, Human
aguauuuuugacagaau

SEQ ID NO: 1511408 - RNA, 21 nt, Human
aguaugaggcauuuguuugaa

SEQ ID NO: 1511409 - RNA, 20 nt, Human
aguaugaggcauuuguuuga

SEQ ID NO: 1511410 - RNA, 15 nt, Human
aguaucucagggccu

SEQ ID NO: 1511411 - RNA, 23 nt, Human
agucacacaguauuacuucugcu

SEQ ID NO: 1511412 - RNA, 22 nt, Human
agucacacaguauuacuucugc

SEQ ID NO: 1511413 - RNA, 17 nt, Human
aguacuucuccacccug

SEQ ID NO: 1511414 - RNA, 19 nt, Human
aguacuucuccacccugcu

SEQ ID NO: 1511415 - RNA, 12 nt, Human
aguacuucuuuu

SEQ ID NO: 1511416 - RNA, 13 nt, Human
aguacucauacau

SEQ ID NO: 1511417 - RNA, 12 nt, Human
aguacuauguau

SEQ ID NO: 1511418 - RNA, 14 nt, Human
aguacuauguauca

SEQ ID NO: 1511419 - RNA, 20 nt, Human
aguaagccgugauuuucauu

SEQ ID NO: 1511420 - RNA, 14 nt, Human
aguacuauaauuua

SEQ ID NO: 1511421 - RNA, 19 nt, Human
aguacuacaguccucccau

SEQ ID NO: 1511422 - RNA, 22 nt, Human
aguacuacaguccucccaucuc

SEQ ID NO: 1511423 - RNA, 18 nt, Human
aguacguugugcauuugg

SEQ ID NO: 1511424 - RNA, 17 nt, Human
aguacguugugcauuug

SEQ ID NO: 1511425 - RNA, 16 nt, Human
aguacguugugcauuu

SEQ ID NO: 1511426 - RNA, 15 nt, Human
aguacguugugcauu

SEQ ID NO: 1511427 - RNA, 16 nt, Human
aggucuguucuuucca

SEQ ID NO: 1511428 - RNA, 15 nt, Human
aggucuguucuuucc

SEQ ID NO: 1511429 - RNA, 13 nt, Human
aggucuguucuuu

SEQ ID NO: 1511430 - RNA, 18 nt, Human
aguaaaugggggugcauu

SEQ ID NO: 1511431 - RNA, 19 nt, Human
aguaacaaugaagauaaaa

SEQ ID NO: 1511432 - RNA, 23 nt, Human
aguaaaugcuagguuaauuccaa

SEQ ID NO: 1511433 - RNA, 11 nt, Human
aguaaaugcua

SEQ ID NO: 1511434 - RNA, 22 nt, Human
aguaaaugcuagguuaauucca

SEQ ID NO: 1511435 - RNA, 16 nt, Human
agugccuuauggaaca

SEQ ID NO: 1511436 - RNA, 18 nt, Human
agugccuuauggaacacu

SEQ ID NO: 1511437 - RNA, 10 nt, Human
agugccuuau

SEQ ID NO: 1511438 - RNA, 13 nt, Human
agugccuuaugga

SEQ ID NO: 1511439 - RNA, 14 nt, Human
agugccuuauggaa

SEQ ID NO: 1511440 - RNA, 15 nt, Human
agugccuuauggaac

SEQ ID NO: 1511441 - RNA, 14 nt, Human
agugauucuccugc

SEQ ID NO: 1511442 - RNA, 15 nt, Human
agugauucuccugcc

SEQ ID NO: 1511443 - RNA, 17 nt, Human
agugauucuccugccuc

SEQ ID NO: 1511444 - RNA, 18 nt, Human
agugccuuacacaauggu

SEQ ID NO: 1511445 - RNA, 14 nt, Human
agugauccucccac

SEQ ID NO: 1511446 - RNA, 15 nt, Human
agugauccucccacc

SEQ ID NO: 1511447 - RNA, 18 nt, Human
agugauccucccaccuca

SEQ ID NO: 1511448 - RNA, 19 nt, Human
agugauccucccaccucag

SEQ ID NO: 1511449 - RNA, 24 nt, Human
agugauccucccaccucagccucc

SEQ ID NO: 1511450 - RNA, 17 nt, Human
aguggcuuuaaugaaua

SEQ ID NO: 1511451 - RNA, 18 nt, Human
aguggccuuccccagcau

SEQ ID NO: 1511452 - RNA, 17 nt, Human
aguggccuuccccagca

SEQ ID NO: 1511453 - RNA, 19 nt, Human
agugucaaugcagccccca

SEQ ID NO: 1511454 - RNA, 22 nt, Human
agugggcccaaugcacuuuguu

SEQ ID NO: 1511455 - RNA, 22 nt, Human
aguugacuugacagaacacugu

SEQ ID NO: 1511456 - RNA, 21 nt, Human
aguugaaaagacuccaaagaa

SEQ ID NO: 1511457 - RNA, 22 nt, Human
aguucaucuugaauuguaagga

SEQ ID NO: 1511458 - RNA, 18 nt, Human
aguugaaaagacuccaaa

SEQ ID NO: 1511459 - RNA, 19 nt, Human
aguugaaaagacuccaaag

SEQ ID NO: 1511460 - RNA, 20 nt, Human
aguugaaaagacuccaaaga

SEQ ID NO: 1511461 - RNA, 14 nt, Human
aguugauagcacag

SEQ ID NO: 1511462 - RNA, 23 nt, Human
aguugauacuugaauaaccaucu

SEQ ID NO: 1511463 - RNA, 16 nt, Human
aguugauacuacaguu

SEQ ID NO: 1511464 - RNA, 18 nt, Human
aguucagguaacaggcag

SEQ ID NO: 1511465 - RNA, 13 nt, Human
aguucaucuugaa

SEQ ID NO: 1511466 - RNA, 15 nt, Human
aguucaucuugaauu

SEQ ID NO: 1511467 - RNA, 19 nt, Human
aguucaucuugaauuguaa

SEQ ID NO: 1511468 - RNA, 24 nt, Human
auagguuuggacaaaauggaauac

SEQ ID NO: 1511469 - RNA, 15 nt, Human
auagccuaggugaca

SEQ ID NO: 1511470 - RNA, 17 nt, Human
auagccuaggugacaga

SEQ ID NO: 1511471 - RNA, 17 nt, Human
auagcacagacccugcc

SEQ ID NO: 1511472 - RNA, 18 nt, Human
auagcacagacccugccc

SEQ ID NO: 1511473 - RNA, 18 nt, Human
auagcagcuuauucacaa

SEQ ID NO: 1511474 - RNA, 15 nt, Human
auagcagcuuauuca

SEQ ID NO: 1511475 - RNA, 18 nt, Human
auauauuuuuuucugaaa

SEQ ID NO: 1511476 - RNA, 14 nt, Human
auauuauguuaaaa

SEQ ID NO: 1511477 - RNA, 16 nt, Human
auauuauguuaaaacu

SEQ ID NO: 1511478 - RNA, 19 nt, Human
auauucaggaagcucaggg

SEQ ID NO: 1511479 - RNA, 13 nt, Human
auauuauguuaaa

SEQ ID NO: 1511480 - RNA, 17 nt, Human
auauuauguguuuccau

SEQ ID NO: 1511481 - RNA, 20 nt, Human
auaugcucugcauguuacau

SEQ ID NO: 1511482 - RNA, 17 nt, Human
auaugcucugcauguua

SEQ ID NO: 1511483 - RNA, 13 nt, Human
auacagaaaaguu

SEQ ID NO: 1511484 - RNA, 17 nt, Human
auacccagaaaguuauu

SEQ ID NO: 1511485 - RNA, 17 nt, Human
auacccacccccaccca

SEQ ID NO: 1511486 - RNA, 13 nt, Human
auacccaccccca

SEQ ID NO: 1511487 - RNA, 14 nt, Human
auacccacccccac

SEQ ID NO: 1511488 - RNA, 16 nt, Human
auacccacccccaccc

SEQ ID NO: 1511489 - RNA, 18 nt, Human
auaauguuucaaacauau

SEQ ID NO: 1511490 - RNA, 17 nt, Human
auacaaugcugugcccu

SEQ ID NO: 1511491 - RNA, 14 nt, Human
auacaaugcugugc

SEQ ID NO: 1511492 - RNA, 13 nt, Human
auacacuuacacu

SEQ ID NO: 1511493 - RNA, 22 nt, Human
auacacuuacacuuuaugcaca

SEQ ID NO: 1511494 - RNA, 14 nt, Human
auaccugucccccu

SEQ ID NO: 1511495 - RNA, 15 nt, Human
auaccugucccccug

SEQ ID NO: 1511496 - RNA, 16 nt, Human
auaccugucccccuga

SEQ ID NO: 1511497 - RNA, 17 nt, Human
auaccugucccccugac

SEQ ID NO: 1511498 - RNA, 18 nt, Human
auaaggguaucuggugac

SEQ ID NO: 1511499 - RNA, 13 nt, Human
auaauguuucaaa

SEQ ID NO: 1511500 - RNA, 19 nt, Human
auaauguaaacaauaucag

SEQ ID NO: 1511501 - RNA, 14 nt, Human
auaauguaagcucu

SEQ ID NO: 1511502 - RNA, 21 nt, Human
auaagccagacaucaacagau

SEQ ID NO: 1511503 - RNA, 22 nt, Human
auaagccagacaucaacagaua

SEQ ID NO: 1511504 - RNA, 22 nt, Human
auaaaaagccugcaauuucaua

SEQ ID NO: 1511505 - RNA, 20 nt, Human
auaaaaagccugcaauuuca

SEQ ID NO: 1511506 - RNA, 23 nt, Human
aguuugauuaaauucuugcaaag

SEQ ID NO: 1511507 - RNA, 22 nt, Human
aguuguuacauuuuuaagugcu

SEQ ID NO: 1511508 - RNA, 20 nt, Human
aguuguuacauuuuuaagug

SEQ ID NO: 1511509 - RNA, 22 nt, Human
aguuugauuaaauucuugcaaa

SEQ ID NO: 1511510 - RNA, 20 nt, Human
aguuugauuaaauucuugca

SEQ ID NO: 1511511 - RNA, 18 nt, Human
aguuugauuaaauucuug

SEQ ID NO: 1511512 - RNA, 17 nt, Human
aguuugauuaaauucuu

SEQ ID NO: 1511513 - RNA, 20 nt, Human
aguuugagaucagccugggc

SEQ ID NO: 1511514 - RNA, 18 nt, Human
aguuugagaucagccugg

SEQ ID NO: 1511515 - RNA, 19 nt, Human
aguuugagaucagccuggg

SEQ ID NO: 1511516 - RNA, 14 nt, Human
auaacaaugaaagu

SEQ ID NO: 1511517 - RNA, 15 nt, Human
auaacaaugcuguau

SEQ ID NO: 1511518 - RNA, 17 nt, Human
auaacaaugcuguauuu

SEQ ID NO: 1511519 - RNA, 19 nt, Human
auaacaaugcuguauuuua

SEQ ID NO: 1511520 - RNA, 20 nt, Human
auaacaaugcuguauuuuaa

SEQ ID NO: 1511521 - RNA, 21 nt, Human
auaacaaugcuguauuuuaaa

SEQ ID NO: 1511522 - RNA, 12 nt, Human
auaacauguaau

SEQ ID NO: 1511523 - RNA, 13 nt, Human
auaacauguaauu

SEQ ID NO: 1511524 - RNA, 18 nt, Human
auaacauguaauuaagua

SEQ ID NO: 1511525 - RNA, 20 nt, Human
auaacauguaauuaaguacu

SEQ ID NO: 1511526 - RNA, 20 nt, Human
caaggaaaaaauaacaauga

SEQ ID NO: 1511527 - RNA, 18 nt, Human
caaggaaaaaauaacaau

SEQ ID NO: 1511528 - RNA, 22 nt, Human
caagcuggucccacucagucca

SEQ ID NO: 1511529 - RNA, 23 nt, Human
caagcuggucccacucaguccau

SEQ ID NO: 1511530 - RNA, 16 nt, Human
caaggagauuuacaac

SEQ ID NO: 1511531 - RNA, 18 nt, Human
caaggauccugagccaga

SEQ ID NO: 1511532 - RNA, 19 nt, Human
caaggauccugagccagau

SEQ ID NO: 1511533 - RNA, 22 nt, Human
caaggauccugagccagauuuc

SEQ ID NO: 1511534 - RNA, 20 nt, Human
caaggauccugagccagauu

SEQ ID NO: 1511535 - RNA, 17 nt, Human
caaggcugcagugagcc

SEQ ID NO: 1511536 - RNA, 22 nt, Human
caaggcugcagugagccgagau

SEQ ID NO: 1511537 - RNA, 19 nt, Human
caagagucgcugugccaca

SEQ ID NO: 1511538 - RNA, 22 nt, Human
caagagucgcugugccacaggc

SEQ ID NO: 1511539 - RNA, 22 nt, Human
caagcugcacccucaggcaggu

SEQ ID NO: 1511540 - RNA, 21 nt, Human
caagcuggucccacucagucc

SEQ ID NO: 1511541 - RNA, 15 nt, Human
caagcgauucuucug

SEQ ID NO: 1511542 - RNA, 17 nt, Human
caagcgauucuucugcu

SEQ ID NO: 1511543 - RNA, 18 nt, Human
caagcgauucuucugcuu

SEQ ID NO: 1511544 - RNA, 21 nt, Human
caagcugcacccucaggcagg

SEQ ID NO: 1511545 - RNA, 23 nt, Human
caagggugaugggaaagcauugu

SEQ ID NO: 1511546 - RNA, 21 nt, Human
caagggugaugggaaagcauu

SEQ ID NO: 1511547 - RNA, 18 nt, Human
caaggcugggggaagaag

SEQ ID NO: 1511548 - RNA, 19 nt, Human
caauaauaaauauuuuugc

SEQ ID NO: 1511549 - RNA, 17 nt, Human
caauagucaaauugugu

SEQ ID NO: 1511550 - RNA, 19 nt, Human
caauagucaaauuguguga

SEQ ID NO: 1511551 - RNA, 15 nt, Human
caauaggaaaaacug

SEQ ID NO: 1511552 - RNA, 16 nt, Human
caauaggaaaaacuga

SEQ ID NO: 1511553 - RNA, 17 nt, Human
caauaggaaaaacugau

SEQ ID NO: 1511554 - RNA, 18 nt, Human
caauaggaaaaacugauu

SEQ ID NO: 1511555 - RNA, 17 nt, Human
cacaaagguagcuuuuc

SEQ ID NO: 1511556 - RNA, 20 nt, Human
cacaagaaaugaaagcaggg

SEQ ID NO: 1511557 - RNA, 21 nt, Human
cacaagaaaugaaagcaggga

SEQ ID NO: 1511558 - RNA, 13 nt, Human
cacaaaggagagc

SEQ ID NO: 1511559 - RNA, 17 nt, Human
cacacacgcgugcacac

SEQ ID NO: 1511560 - RNA, 22 nt, Human
caaugugacuuaaugccacuaa

SEQ ID NO: 1511561 - RNA, 22 nt, Human
caaugugaaaagaaaaaugagc

SEQ ID NO: 1511562 - RNA, 21 nt, Human
caauaucuuuuuuuuaauaaa

SEQ ID NO: 1511563 - RNA, 22 nt, Human
caauuuuucuuauuucauuucu

SEQ ID NO: 1511564 - RNA, 13 nt, Human
cacaaacagaggc

SEQ ID NO: 1511565 - RNA, 15 nt, Human
cacaaacagaggccg

SEQ ID NO: 1511566 - RNA, 14 nt, Human
cacaaacagaggcc

SEQ ID NO: 1511567 - RNA, 18 nt, Human
caauuacaggaaguacug

SEQ ID NO: 1511568 - RNA, 17 nt, Human
cacagccagacuggcac

SEQ ID NO: 1511569 - RNA, 18 nt, Human
cacagccagacuggcaca

SEQ ID NO: 1511570 - RNA, 21 nt, Human
cacagcaguugaaaagacucc

SEQ ID NO: 1511571 - RNA, 22 nt, Human
cacagcaguugaaaagacucca

SEQ ID NO: 1511572 - RNA, 19 nt, Human
cacagcaguugaaaagacu

SEQ ID NO: 1511573 - RNA, 13 nt, Human
cacacugaagaag

SEQ ID NO: 1511574 - RNA, 14 nt, Human
cacacugaagaagc

SEQ ID NO: 1511575 - RNA, 19 nt, Human
cacagagaaaguacuucuc

SEQ ID NO: 1511576 - RNA, 20 nt, Human
cacagagaaaguacuucucc

SEQ ID NO: 1511577 - RNA, 21 nt, Human
cacagagaaaguacuucucca

SEQ ID NO: 1511578 - RNA, 22 nt, Human
cacagaguuguuacauuuuuaa

SEQ ID NO: 1511579 - RNA, 13 nt, Human
cacagaggcugcc

SEQ ID NO: 1511580 - RNA, 20 nt, Human
caacauacucccaucuguga

SEQ ID NO: 1511581 - RNA, 20 nt, Human
caaccuggggggcaguggug

SEQ ID NO: 1511582 - RNA, 12 nt, Human
caacaggcuggg

SEQ ID NO: 1511583 - RNA, 17 nt, Human
caacauacucccaucug

SEQ ID NO: 1511584 - RNA, 19 nt, Human
caacauacucccaucugug

SEQ ID NO: 1511585 - RNA, 22 nt, Human
caaauuucuaaaucuccaaaau

SEQ ID NO: 1511586 - RNA, 15 nt, Human
caaauuucuaaaucu

SEQ ID NO: 1511587 - RNA, 14 nt, Human
caaauaugcaaagc

SEQ ID NO: 1511588 - RNA, 13 nt, Human
caaauaugcaaag

SEQ ID NO: 1511589 - RNA, 12 nt, Human
caaauaugcaaa

SEQ ID NO: 1511590 - RNA, 23 nt, Human
caaauggaaaugggcagagcaga

SEQ ID NO: 1511591 - RNA, 20 nt, Human
caaauguucaucaaugaaug

SEQ ID NO: 1511592 - RNA, 18 nt, Human
caaauguucaucaaugaa

SEQ ID NO: 1511593 - RNA, 14 nt, Human
caaauguucaucaa

SEQ ID NO: 1511594 - RNA, 16 nt, Human
caaagagagaaaauaa

SEQ ID NO: 1511595 - RNA, 19 nt, Human
caaagaaggaaaaggcagg

SEQ ID NO: 1511596 - RNA, 19 nt, Human
caaagagagaaaauaaaga

SEQ ID NO: 1511597 - RNA, 19 nt, Human
caaagugcugggauuacaa

SEQ ID NO: 1511598 - RNA, 23 nt, Human
caaagugcugggauuacaagcgu

SEQ ID NO: 1511599 - RNA, 16 nt, Human
caaauaaaaauauugu

SEQ ID NO: 1511600 - RNA, 18 nt, Human
caaauaaaaauauugugu

SEQ ID NO: 1511601 - RNA, 21 nt, Human
caagaccuucuccuucaccuu

SEQ ID NO: 1511602 - RNA, 23 nt, Human
caagaccuucuccuucaccuuug

SEQ ID NO: 1511603 - RNA, 13 nt, Human
caagacgcugugc

SEQ ID NO: 1511604 - RNA, 15 nt, Human
caagacgcugugcug

SEQ ID NO: 1511605 - RNA, 12 nt, Human
caagagcugagg

SEQ ID NO: 1511606 - RNA, 13 nt, Human
caagagcccaggc

SEQ ID NO: 1511607 - RNA, 14 nt, Human
caagaagcccagga

SEQ ID NO: 1511608 - RNA, 13 nt, Human
caagaagcccagg

SEQ ID NO: 1511609 - RNA, 17 nt, Human
caagaaaugaaagcagg

SEQ ID NO: 1511610 - RNA, 19 nt, Human
caagaaaugaaagcaggga

SEQ ID NO: 1511611 - RNA, 21 nt, Human
caaaaucgaugcagugcuucc

SEQ ID NO: 1511612 - RNA, 20 nt, Human
caaaauaaaacuuuuuaaaa

SEQ ID NO: 1511613 - RNA, 16 nt, Human
caaaauaaaacuuuuu

SEQ ID NO: 1511614 - RNA, 18 nt, Human
caaaauaauuuuaagaaa

SEQ ID NO: 1511615 - RNA, 22 nt, Human
caaaauaauuuuaagaaaucaa

SEQ ID NO: 1511616 - RNA, 14 nt, Human
caaaaguuucucuu

SEQ ID NO: 1511617 - RNA, 19 nt, Human
caaaacucuccucugcugc

SEQ ID NO: 1511618 - RNA, 14 nt, Human
caaaacugcacugu

SEQ ID NO: 1511619 - RNA, 17 nt, Human
caaaacugcacugucaa

SEQ ID NO: 1511620 - RNA, 18 nt, Human
caaaacugcacugucaag

SEQ ID NO: 1511621 - RNA, 18 nt, Human
auuuuauuuuauuaugca

SEQ ID NO: 1511622 - RNA, 15 nt, Human
caaaacgguuuuacu

SEQ ID NO: 1511623 - RNA, 21 nt, Human
caaaacgguuuuacugcagcu

SEQ ID NO: 1511624 - RNA, 15 nt, Human
caaaacucuccucug

SEQ ID NO: 1511625 - RNA, 16 nt, Human
caaaacucuccucugc

SEQ ID NO: 1511626 - RNA, 17 nt, Human
caaacugacucuuaaga

SEQ ID NO: 1511627 - RNA, 21 nt, Human
caaacugacucuuaagaagac

SEQ ID NO: 1511628 - RNA, 16 nt, Human
caaacugacucuuaag

SEQ ID NO: 1511629 - RNA, 21 nt, Human
caaacucuugaccucagguga

SEQ ID NO: 1511630 - RNA, 17 nt, Human
caaacucuugaccucag

SEQ ID NO: 1511631 - RNA, 19 nt, Human
caaacucuugaccucaggu

SEQ ID NO: 1511632 - RNA, 20 nt, Human
caaacucuugaccucaggug

SEQ ID NO: 1511633 - RNA, 13 nt, Human
caaacagaggccg

SEQ ID NO: 1511634 - RNA, 15 nt, Human
caaacagaggccgcc

SEQ ID NO: 1511635 - RNA, 14 nt, Human
caaacaaaauuucu

SEQ ID NO: 1511636 - RNA, 15 nt, Human
caaacaaaauuucua

SEQ ID NO: 1511637 - RNA, 18 nt, Human
caaacaaaauuucuauua

SEQ ID NO: 1511638 - RNA, 11 nt, Human
caaaaugaaac

SEQ ID NO: 1511639 - RNA, 22 nt, Human
caaaaugaaacgcaaccaccac

SEQ ID NO: 1511640 - RNA, 14 nt, Human
caaaauuucuauua

SEQ ID NO: 1511641 - RNA, 13 nt, Human
caacaggcugggc

SEQ ID NO: 1511642 - RNA, 17 nt, Human
cacaguucaauucucau

SEQ ID NO: 1511643 - RNA, 21 nt, Human
ugugugaaagguacuucaaau

SEQ ID NO: 1511644 - RNA, 22 nt, Human
ugugugaaagguacuucaaauc

SEQ ID NO: 1511645 - RNA, 19 nt, Human
ugugugcacguacacacac

SEQ ID NO: 1511646 - RNA, 13 nt, Human
uguguuuugcaag

SEQ ID NO: 1511647 - RNA, 19 nt, Human
uguguuuugcaagccagau

SEQ ID NO: 1511648 - RNA, 13 nt, Human
uguguuugaagca

SEQ ID NO: 1511649 - RNA, 16 nt, Human
uguguuuauugucaaa

SEQ ID NO: 1511650 - RNA, 14 nt, Human
uguucagcuccagc

SEQ ID NO: 1511651 - RNA, 12 nt, Human
uguucauacaua

SEQ ID NO: 1511652 - RNA, 14 nt, Human
uguucauacauauu

SEQ ID NO: 1511653 - RNA, 23 nt, Human
uguucauacauauuuuuguagca

SEQ ID NO: 1511654 - RNA, 20 nt, Human
uguucagcuccagcucacca

SEQ ID NO: 1511655 - RNA, 21 nt, Human
uguucagcuccagcucaccag

SEQ ID NO: 1511656 - RNA, 22 nt, Human
uguucagcuccagcucaccagc

SEQ ID NO: 1511657 - RNA, 14 nt, Human
uguuagugcaaauu

SEQ ID NO: 1511658 - RNA, 20 nt, Human
uguuaguaugaggcauuugu

SEQ ID NO: 1511659 - RNA, 19 nt, Human
uguuaguaugaggcauuug

SEQ ID NO: 1511660 - RNA, 17 nt, Human
uguuaguaugaggcauu

SEQ ID NO: 1511661 - RNA, 14 nt, Human
uguuacuaaguuuu

SEQ ID NO: 1511662 - RNA, 21 nt, Human
uguuaaaagaugaaaauauuu

SEQ ID NO: 1511663 - RNA, 20 nt, Human
uguugacaugggacauuugc

SEQ ID NO: 1511664 - RNA, 14 nt, Human
uguugacaugugcu

SEQ ID NO: 1511665 - RNA, 23 nt, Human
uguucuuucuggcuaugcauuug

SEQ ID NO: 1511666 - RNA, 12 nt, Human
uguucugggaca

SEQ ID NO: 1511667 - RNA, 21 nt, Human
uguucuggcucuuccaggcug

SEQ ID NO: 1511668 - RNA, 17 nt, Human
uguucuggcucuuccag

SEQ ID NO: 1511669 - RNA, 20 nt, Human
uguucuggcucuuccaggcu

SEQ ID NO: 1511670 - RNA, 13 nt, Human
uguucaugaaaga

SEQ ID NO: 1511671 - RNA, 14 nt, Human
uguucaugaaagau

SEQ ID NO: 1511672 - RNA, 19 nt, Human
uguucaucauccuaagcua

SEQ ID NO: 1511673 - RNA, 15 nt, Human
uguucucucuucucc

SEQ ID NO: 1511674 - RNA, 16 nt, Human
uguucucucuucucca

SEQ ID NO: 1511675 - RNA, 13 nt, Human
uguucucugcccu

SEQ ID NO: 1511676 - RNA, 14 nt, Human
uguucucugcccuc

SEQ ID NO: 1511677 - RNA, 15 nt, Human
uguucucugcccucc

SEQ ID NO: 1511678 - RNA, 16 nt, Human
uguucucugcccucca

SEQ ID NO: 1511679 - RNA, 13 nt, Human
uguucucugagga

SEQ ID NO: 1511680 - RNA, 12 nt, Human
uguucuggcucu

SEQ ID NO: 1511681 - RNA, 13 nt, Human
uguucuggcucuu

SEQ ID NO: 1511682 - RNA, 16 nt, Human
uguucuggcucuucca

SEQ ID NO: 1511683 - RNA, 19 nt, Human
uguuggcugggggccucag

SEQ ID NO: 1511684 - RNA, 17 nt, Human
uguuuaaaaucauuucu

SEQ ID NO: 1511685 - RNA, 18 nt, Human
uguuuaaaaucauuucug

SEQ ID NO: 1511686 - RNA, 17 nt, Human
uguuggcugggggccuc

SEQ ID NO: 1511687 - RNA, 14 nt, Human
uguuggagaagaac

SEQ ID NO: 1511688 - RNA, 16 nt, Human
uguuggagaagaacug

SEQ ID NO: 1511689 - RNA, 17 nt, Human
uguuggagaagaacuga

SEQ ID NO: 1511690 - RNA, 19 nt, Human
uguuggagaagaacugaaa

SEQ ID NO: 1511691 - RNA, 20 nt, Human
uguuggagaagaacugaaau

SEQ ID NO: 1511692 - RNA, 15 nt, Human
uguuggccaaagcca

SEQ ID NO: 1511693 - RNA, 15 nt, Human
uguuggccaggcugg

SEQ ID NO: 1511694 - RNA, 16 nt, Human
uguuggccaggcuggu

SEQ ID NO: 1511695 - RNA, 16 nt, Human
uuaauaauguuucaaa

SEQ ID NO: 1511696 - RNA, 15 nt, Human
uuaagcaaguuaagu

SEQ ID NO: 1511697 - RNA, 14 nt, Human
uuaacuuuuauaaa

SEQ ID NO: 1511698 - RNA, 13 nt, Human
uuaacuuuuauaa

SEQ ID NO: 1511699 - RNA, 12 nt, Human
uuaacuuuuaua

SEQ ID NO: 1511700 - RNA, 17 nt, Human
uuaaaugcccagccccu

SEQ ID NO: 1511701 - RNA, 17 nt, Human
uuaaugauaaguaaaug

SEQ ID NO: 1511702 - RNA, 16 nt, Human
uuaaugauaaguaaau

SEQ ID NO: 1511703 - RNA, 22 nt, Human
uuaauuaaaacacaacaucuuu

SEQ ID NO: 1511704 - RNA, 20 nt, Human
uuacauuuguauaaaauaau

SEQ ID NO: 1511705 - RNA, 17 nt, Human
uuacauuuuuaagugcu

SEQ ID NO: 1511706 - RNA, 12 nt, Human
uuacauuuuuaa

SEQ ID NO: 1511707 - RNA, 20 nt, Human
uuacagagacagaaagcaga

SEQ ID NO: 1511708 - RNA, 12 nt, Human
uuacauuguaaa

SEQ ID NO: 1511709 - RNA, 13 nt, Human
uuacauuguaaau

SEQ ID NO: 1511710 - RNA, 13 nt, Human
uuacacuuuaugc

SEQ ID NO: 1511711 - RNA, 20 nt, Human
uuacacuuuaugcacaaaau

SEQ ID NO: 1511712 - RNA, 18 nt, Human
uuaaaauacacacucaaa

SEQ ID NO: 1511713 - RNA, 19 nt, Human
uuaaaauacacacucaaau

SEQ ID NO: 1511714 - RNA, 20 nt, Human
uuaaacuaaggcccucuuga

SEQ ID NO: 1511715 - RNA, 11 nt, Human
uuaaaugcacc

SEQ ID NO: 1511716 - RNA, 14 nt, Human
uuaaaugcccagcc

SEQ ID NO: 1511717 - RNA, 15 nt, Human
uuaaaugcccagccc

SEQ ID NO: 1511718 - RNA, 16 nt, Human
uuaaaugcccagcccc

SEQ ID NO: 1511719 - RNA, 13 nt, Human
uuaaauauuuagu

SEQ ID NO: 1511720 - RNA, 12 nt, Human
uguuuuuaacuc

SEQ ID NO: 1511721 - RNA, 23 nt, Human
uguuuuaaggaugcuuguacaua

SEQ ID NO: 1511722 - RNA, 22 nt, Human
uguuuuaaggaugcuuguacau

SEQ ID NO: 1511723 - RNA, 17 nt, Human
uguuuuaagaggcaggg

SEQ ID NO: 1511724 - RNA, 20 nt, Human
uguuuuaagaggcagggucu

SEQ ID NO: 1511725 - RNA, 22 nt, Human
uuaaaaaaaaaccugagcccca

SEQ ID NO: 1511726 - RNA, 19 nt, Human
uguuuccauauuuuauagg

SEQ ID NO: 1511727 - RNA, 15 nt, Human
uguuuccuggcacug

SEQ ID NO: 1511728 - RNA, 16 nt, Human
uguuuguugucagcug

SEQ ID NO: 1511729 - RNA, 16 nt, Human
uguuuuaagaggcagg

SEQ ID NO: 1511730 - RNA, 18 nt, Human
uguggacacagcucuucu

SEQ ID NO: 1511731 - RNA, 13 nt, Human
uguggacacagcu

SEQ ID NO: 1511732 - RNA, 19 nt, Human
uguggacacagcucuucuc

SEQ ID NO: 1511733 - RNA, 23 nt, Human
uguggcgcagcauauucaggaag

SEQ ID NO: 1511734 - RNA, 22 nt, Human
ugugggcuaguugggcuuccuc

SEQ ID NO: 1511735 - RNA, 16 nt, Human
uguguagggcgggagg

SEQ ID NO: 1511736 - RNA, 12 nt, Human
uguguagggcgg

SEQ ID NO: 1511737 - RNA, 19 nt, Human
ugugcuaguaauuggaaag

SEQ ID NO: 1511738 - RNA, 19 nt, Human
ugugcgccuacaggaguga

SEQ ID NO: 1511739 - RNA, 14 nt, Human
ugugcgccuacagg

SEQ ID NO: 1511740 - RNA, 23 nt, Human
ugugcauuuggugguuucagaaa

SEQ ID NO: 1511741 - RNA, 23 nt, Human
ugugcauuaucuagauacuguau

SEQ ID NO: 1511742 - RNA, 21 nt, Human
ugugcauuaucuagauacugu

SEQ ID NO: 1511743 - RNA, 20 nt, Human
ugugcauuaucuagauacug

SEQ ID NO: 1511744 - RNA, 16 nt, Human
ugugcacaugcacgug

SEQ ID NO: 1511745 - RNA, 19 nt, Human
ugugcauuaucuagauacu

SEQ ID NO: 1511746 - RNA, 16 nt, Human
ugugcauuaucuagau

SEQ ID NO: 1511747 - RNA, 14 nt, Human
ugugcauuaucuag

SEQ ID NO: 1511748 - RNA, 17 nt, Human
ugugagucaccaagccc

SEQ ID NO: 1511749 - RNA, 19 nt, Human
ugugagucaccaagcccag

SEQ ID NO: 1511750 - RNA, 21 nt, Human
ugugagucaccaagcccaguu

SEQ ID NO: 1511751 - RNA, 13 nt, Human
ugugaggaagccg

SEQ ID NO: 1511752 - RNA, 18 nt, Human
ugugaggaagccgcuggg

SEQ ID NO: 1511753 - RNA, 20 nt, Human
ugugaggaagccgcuggggc

SEQ ID NO: 1511754 - RNA, 18 nt, Human
ugugaagugaaugaaaca

SEQ ID NO: 1511755 - RNA, 14 nt, Human
ugugaaguuuacau

SEQ ID NO: 1511756 - RNA, 21 nt, Human
ugugaauguugugauguauuc

SEQ ID NO: 1511757 - RNA, 21 nt, Human
uguccuccgccuuaccaggag

SEQ ID NO: 1511758 - RNA, 16 nt, Human
ugucuuuuuucacuac

SEQ ID NO: 1511759 - RNA, 23 nt, Human
ugugaaaagaaaaaugagccugg

SEQ ID NO: 1511760 - RNA, 23 nt, Human
ugucuuuucuugcaugaggcuag

SEQ ID NO: 1511761 - RNA, 17 nt, Human
ugucuuuggacccugag

SEQ ID NO: 1511762 - RNA, 14 nt, Human
ugucuuuggacccu

SEQ ID NO: 1511763 - RNA, 16 nt, Human
ugucuuuggacccuga

SEQ ID NO: 1511764 - RNA, 21 nt, Human
ugucuuuucuugcaugaggcu

SEQ ID NO: 1511765 - RNA, 22 nt, Human
uguaguguuggagaagaacuga

SEQ ID NO: 1511766 - RNA, 14 nt, Human
uguagcauccugga

SEQ ID NO: 1511767 - RNA, 16 nt, Human
uguagcauccuggaau

SEQ ID NO: 1511768 - RNA, 17 nt, Human
uguagcauccuggaaua

SEQ ID NO: 1511769 - RNA, 18 nt, Human
uguagcauccuggaauau

SEQ ID NO: 1511770 - RNA, 16 nt, Human
uguacgucugacaggc

SEQ ID NO: 1511771 - RNA, 22 nt, Human
uguacgaagaguauuuuugaca

SEQ ID NO: 1511772 - RNA, 15 nt, Human
uguacgucugacagg

SEQ ID NO: 1511773 - RNA, 14 nt, Human
uguacgaagaguau

SEQ ID NO: 1511774 - RNA, 14 nt, Human
uguaaucacagcua

SEQ ID NO: 1511775 - RNA, 17 nt, Human
uggucacaggaaguaga

SEQ ID NO: 1511776 - RNA, 16 nt, Human
uguaccgcaaugugac

SEQ ID NO: 1511777 - RNA, 18 nt, Human
uguacagagcccacgccc

SEQ ID NO: 1511778 - RNA, 21 nt, Human
uguacagagcccacgccccca

SEQ ID NO: 1511779 - RNA, 17 nt, Human
uguaauuaaguacuaug

SEQ ID NO: 1511780 - RNA, 16 nt, Human
uguacagagcccacgc

SEQ ID NO: 1511781 - RNA, 17 nt, Human
uguacagagcccacgcc

SEQ ID NO: 1511782 - RNA, 13 nt, Human
ugucacaggcagg

SEQ ID NO: 1511783 - RNA, 12 nt, Human
ugucacaggcag

SEQ ID NO: 1511784 - RNA, 17 nt, Human
ugucacacacuuuggcu

SEQ ID NO: 1511785 - RNA, 15 nt, Human
uguaugauucccagc

SEQ ID NO: 1511786 - RNA, 16 nt, Human
uguaugauucccagcc

SEQ ID NO: 1511787 - RNA, 22 nt, Human
uguauucucuccuguaccucuu

SEQ ID NO: 1511788 - RNA, 13 nt, Human
ugucaccugaaga

SEQ ID NO: 1511789 - RNA, 19 nt, Human
ugucauuugagcagggcuc

SEQ ID NO: 1511790 - RNA, 16 nt, Human
ugucauuugagcaggg

SEQ ID NO: 1511791 - RNA, 12 nt, Human
uguccuacucug

SEQ ID NO: 1511792 - RNA, 17 nt, Human
uguccuacucuguguca

SEQ ID NO: 1511793 - RNA, 16 nt, Human
uguccccgacccuugc

SEQ ID NO: 1511794 - RNA, 17 nt, Human
uguccccgacccuugcc

SEQ ID NO: 1511795 - RNA, 20 nt, Human
uguccuacccacccuccuuu

SEQ ID NO: 1511796 - RNA, 18 nt, Human
uguccccaccgcagacag

SEQ ID NO: 1511797 - RNA, 19 nt, Human
uguccccaccgcagacagg

SEQ ID NO: 1511798 - RNA, 22 nt, Human
uguccccaccgcagacaggacc

SEQ ID NO: 1511799 - RNA, 22 nt, Human
uggguucuacccaggugcuagg

SEQ ID NO: 1511800 - RNA, 16 nt, Human
uggguucuacccaggu

SEQ ID NO: 1511801 - RNA, 19 nt, Human
ugggguuuaucagaauucu

SEQ ID NO: 1511802 - RNA, 16 nt, Human
uggguaacuagggaag

SEQ ID NO: 1511803 - RNA, 23 nt, Human
ugguauuggcuagagguucaaag

SEQ ID NO: 1511804 - RNA, 18 nt, Human
ugguaugaucacggcuca

SEQ ID NO: 1511805 - RNA, 21 nt, Human
uggguuucuaaagcugccagc

SEQ ID NO: 1511806 - RNA, 17 nt, Human
uggguuucuaaagcugc

SEQ ID NO: 1511807 - RNA, 18 nt, Human
uggguuucuaaagcugcc

SEQ ID NO: 1511808 - RNA, 16 nt, Human
ugggcagaggaaagca

SEQ ID NO: 1511809 - RNA, 22 nt, Human
ugggcuaagugauccucccacc

SEQ ID NO: 1511810 - RNA, 16 nt, Human
ugggcuaguugggcuu

SEQ ID NO: 1511811 - RNA, 17 nt, Human
ugggcuggugucaccug

SEQ ID NO: 1511812 - RNA, 15 nt, Human
ugggcuucaguggca

SEQ ID NO: 1511813 - RNA, 17 nt, Human
ugggcuucaguggcagc

SEQ ID NO: 1511814 - RNA, 20 nt, Human
ugggggaucacagccucuga

SEQ ID NO: 1511815 - RNA, 21 nt, Human
ugggggaucacagccucugaa

SEQ ID NO: 1511816 - RNA, 15 nt, Human
ugggggugcauuuga

SEQ ID NO: 1511817 - RNA, 12 nt, Human
ugggggugcauu

SEQ ID NO: 1511818 - RNA, 19 nt, Human
ugggggcugggcagaggaa

SEQ ID NO: 1511819 - RNA, 21 nt, Human
ugggggcggggugggaaagau

SEQ ID NO: 1511820 - RNA, 17 nt, Human
ugggggcugggcagagg

SEQ ID NO: 1511821 - RNA, 18 nt, Human
ugggggcugggcagagga

SEQ ID NO: 1511822 - RNA, 21 nt, Human
uggcugggggccucagugcca

SEQ ID NO: 1511823 - RNA, 21 nt, Human
uggcugcuucaaggauccuga

SEQ ID NO: 1511824 - RNA, 16 nt, Human
uggcuuccuggcaaua

SEQ ID NO: 1511825 - RNA, 21 nt, Human
uggcuugaguuuaaauuguaa

SEQ ID NO: 1511826 - RNA, 14 nt, Human
uggcuuuugugcau

SEQ ID NO: 1511827 - RNA, 15 nt, Human
ugggagugagcuggu

SEQ ID NO: 1511828 - RNA, 15 nt, Human
ugggauccuccaggu

SEQ ID NO: 1511829 - RNA, 17 nt, Human
ugggagcugccuguuca

SEQ ID NO: 1511830 - RNA, 21 nt, Human
ugggagcugccuguucagcuc

SEQ ID NO: 1511831 - RNA, 22 nt, Human
ugggagcugccuguucagcucc

SEQ ID NO: 1511832 - RNA, 23 nt, Human
ugggagcugccuguucagcucca

SEQ ID NO: 1511833 - RNA, 15 nt, Human
ugggcagaggaaagc

SEQ ID NO: 1511834 - RNA, 18 nt, Human
ugggauccuccaggugca

SEQ ID NO: 1511835 - RNA, 13 nt, Human
ugggauccuggag

SEQ ID NO: 1511836 - RNA, 16 nt, Human
ugggauuacaggugug

SEQ ID NO: 1511837 - RNA, 12 nt, Human
ugggacacccug

SEQ ID NO: 1511838 - RNA, 15 nt, Human
uggcuuuugugcauu

SEQ ID NO: 1511839 - RNA, 13 nt, Human
ugggacacccugu

SEQ ID NO: 1511840 - RNA, 13 nt, Human
ugggagcaaaaga

SEQ ID NO: 1511841 - RNA, 12 nt, Human
ugggagcugccu

SEQ ID NO: 1511842 - RNA, 13 nt, Human
ugggagcugccug

SEQ ID NO: 1511843 - RNA, 14 nt, Human
ugggagcugccugu

SEQ ID NO: 1511844 - RNA, 16 nt, Human
uggaauaucuccguca

SEQ ID NO: 1511845 - RNA, 16 nt, Human
uggaauauauaaccag

SEQ ID NO: 1511846 - RNA, 15 nt, Human
uggaauauauaacca

SEQ ID NO: 1511847 - RNA, 22 nt, Human
uggaauaauccuaaacauauga

SEQ ID NO: 1511848 - RNA, 17 nt, Human
uggaauaaggagaauga

SEQ ID NO: 1511849 - RNA, 14 nt, Human
uggaauaacaugua

SEQ ID NO: 1511850 - RNA, 15 nt, Human
uggaauaacauguaa

SEQ ID NO: 1511851 - RNA, 19 nt, Human
uggaauaacauguaauuaa

SEQ ID NO: 1511852 - RNA, 16 nt, Human
uggaaugcuguguuaa

SEQ ID NO: 1511853 - RNA, 12 nt, Human
uggacagaagaa

SEQ ID NO: 1511854 - RNA, 13 nt, Human
uggacaugcacag

SEQ ID NO: 1511855 - RNA, 19 nt, Human
uggacaugcacagcuaaca

SEQ ID NO: 1511856 - RNA, 17 nt, Human
uggaaacaagucaguca

SEQ ID NO: 1511857 - RNA, 23 nt, Human
uggaaacuucagcgguuuauaua

SEQ ID NO: 1511858 - RNA, 21 nt, Human
uggaaagacuuuuccaacccu

SEQ ID NO: 1511859 - RNA, 20 nt, Human
uggaaagaguaggaagacuu

SEQ ID NO: 1511860 - RNA, 20 nt, Human
uggaacauaaaauacaaugu

SEQ ID NO: 1511861 - RNA, 21 nt, Human
uggaacauaaaauacaauguu

SEQ ID NO: 1511862 - RNA, 20 nt, Human
uggaaaaauagccugccucu

SEQ ID NO: 1511863 - RNA, 13 nt, Human
uggcagugggagc

SEQ ID NO: 1511864 - RNA, 13 nt, Human
uggcagcugcuuu

SEQ ID NO: 1511865 - RNA, 21 nt, Human
uggcacccggccccugcuggu

SEQ ID NO: 1511866 - RNA, 21 nt, Human
uggccagaugcaccagcccuu

SEQ ID NO: 1511867 - RNA, 11 nt, Human
uggagggaagc

SEQ ID NO: 1511868 - RNA, 19 nt, Human
uggaggagcucaggacacu

SEQ ID NO: 1511869 - RNA, 20 nt, Human
uggaggaaggaaacccagcu

SEQ ID NO: 1511870 - RNA, 12 nt, Human
uggaggaaggaa

SEQ ID NO: 1511871 - RNA, 18 nt, Human
uggaggaaggaaacccag

SEQ ID NO: 1511872 - RNA, 22 nt, Human
uggauuuugguuuuguuccccu

SEQ ID NO: 1511873 - RNA, 24 nt, Human
uggauuuaacagaaauguacagca

SEQ ID NO: 1511874 - RNA, 20 nt, Human
uggauuuaacagaaauguac

SEQ ID NO: 1511875 - RNA, 20 nt, Human
ugccacccuggggagaaagu

SEQ ID NO: 1511876 - RNA, 22 nt, Human
ugccacuacggaauaguuggcu

SEQ ID NO: 1511877 - RNA, 19 nt, Human
ugccacccuggggagaaag

SEQ ID NO: 1511878 - RNA, 10 nt, Human
ugccaggcau

SEQ ID NO: 1511879 - RNA, 18 nt, Human
ugccagguuuuuggucug

SEQ ID NO: 1511880 - RNA, 19 nt, Human
ugccagguuuuuggucuga

SEQ ID NO: 1511881 - RNA, 22 nt, Human
ugccagguuuuuggucugaccc

SEQ ID NO: 1511882 - RNA, 18 nt, Human
ugccaaauauaaauaaaa

SEQ ID NO: 1511883 - RNA, 17 nt, Human
ugccaaauauaaauaaa

SEQ ID NO: 1511884 - RNA, 22 nt, Human
ugccaaauauaaauaaaaauaa

SEQ ID NO: 1511885 - RNA, 19 nt, Human
ugccaaauauaaauaaaaa

SEQ ID NO: 1511886 - RNA, 19 nt, Human
ugcaucaagaugugacaug

SEQ ID NO: 1511887 - RNA, 14 nt, Human
ugcaucaagaugug

SEQ ID NO: 1511888 - RNA, 23 nt, Human
ugccccucaacucuccuccagag

SEQ ID NO: 1511889 - RNA, 13 nt, Human
ugcccaccuggcc

SEQ ID NO: 1511890 - RNA, 14 nt, Human
ugcccaccuggccu

SEQ ID NO: 1511891 - RNA, 24 nt, Human
ugccagguuuuuggucugacccac

SEQ ID NO: 1511892 - RNA, 21 nt, Human
ugccauccagguucagcuugu

SEQ ID NO: 1511893 - RNA, 14 nt, Human
ugcccacucccugc

SEQ ID NO: 1511894 - RNA, 15 nt, Human
ugcccacucccugca

SEQ ID NO: 1511895 - RNA, 16 nt, Human
ugcccacucccugcaa

SEQ ID NO: 1511896 - RNA, 11 nt, Human
ugcccaggcug

SEQ ID NO: 1511897 - RNA, 21 nt, Human
ugcccacucccugcaaccuga

SEQ ID NO: 1511898 - RNA, 13 nt, Human
ugcccaggcuggc

SEQ ID NO: 1511899 - RNA, 16 nt, Human
ugcacugucaagauga

SEQ ID NO: 1511900 - RNA, 12 nt, Human
ugcacuuuguuc

SEQ ID NO: 1511901 - RNA, 14 nt, Human
ugcacuuuguucug

SEQ ID NO: 1511902 - RNA, 23 nt, Human
ugcagcaauaaagcagcguuucu

SEQ ID NO: 1511903 - RNA, 20 nt, Human
ugaguccccuguuuguuucu

SEQ ID NO: 1511904 - RNA, 17 nt, Human
ugcaccgggccacagag

SEQ ID NO: 1511905 - RNA, 22 nt, Human
ugcaccgggccacagagaaagu

SEQ ID NO: 1511906 - RNA, 19 nt, Human
ugaguccccuguuuguuuc

SEQ ID NO: 1511907 - RNA, 23 nt, Human
ugcaccggcuggccuggccccuc

SEQ ID NO: 1511908 - RNA, 14 nt, Human
ugcaccgggccaca

SEQ ID NO: 1511909 - RNA, 15 nt, Human
ugcaccgggccacag

SEQ ID NO: 1511910 - RNA, 15 nt, Human
ugcaguucugaagaa

SEQ ID NO: 1511911 - RNA, 16 nt, Human
ugcaguucugaagaag

SEQ ID NO: 1511912 - RNA, 17 nt, Human
ugcaguucugaagaaga

SEQ ID NO: 1511913 - RNA, 18 nt, Human
ugcaguucugaagaagau

SEQ ID NO: 1511914 - RNA, 22 nt, Human
ugcagugguaugaucacggcuc

SEQ ID NO: 1511915 - RNA, 20 nt, Human
ugcaguggugcgaucugggu

SEQ ID NO: 1511916 - RNA, 19 nt, Human
ugcaguucugaagaagaug

SEQ ID NO: 1511917 - RNA, 22 nt, Human
ugcaguucugaagaagauggua

SEQ ID NO: 1511918 - RNA, 13 nt, Human
ugcaguugccagu

SEQ ID NO: 1511919 - RNA, 14 nt, Human
ugcaguugccaguc

SEQ ID NO: 1511920 - RNA, 15 nt, Human
ugcaguugccaguca

SEQ ID NO: 1511921 - RNA, 17 nt, Human
ugcauauauacauauau

SEQ ID NO: 1511922 - RNA, 15 nt, Human
ugcaggcagccaggc

SEQ ID NO: 1511923 - RNA, 13 nt, Human
ugcaggcagccag

SEQ ID NO: 1511924 - RNA, 14 nt, Human
ugcaggcagccagg

SEQ ID NO: 1511925 - RNA, 16 nt, Human
ugcagugcuuccaagg

SEQ ID NO: 1511926 - RNA, 15 nt, Human
ugcuaagcauuccaa

SEQ ID NO: 1511927 - RNA, 19 nt, Human
ugcuaagcauuccaacuau

SEQ ID NO: 1511928 - RNA, 17 nt, Human
ugcucacauaucuguca

SEQ ID NO: 1511929 - RNA, 15 nt, Human
ugcucacauaucugu

SEQ ID NO: 1511930 - RNA, 16 nt, Human
ugcucacauaucuguc

SEQ ID NO: 1511931 - RNA, 14 nt, Human
ugcuccucucccca

SEQ ID NO: 1511932 - RNA, 18 nt, Human
ugcucuccuuccuggagc

SEQ ID NO: 1511933 - RNA, 23 nt, Human
ugcucuccuuccuggagcccaga

SEQ ID NO: 1511934 - RNA, 12 nt, Human
ugcucuccuucc

SEQ ID NO: 1511935 - RNA, 17 nt, Human
ugcucuccuuccuggag

SEQ ID NO: 1511936 - RNA, 18 nt, Human
ugcuccuuucuuguuuua

SEQ ID NO: 1511937 - RNA, 17 nt, Human
ugcuccucuccccagca

SEQ ID NO: 1511938 - RNA, 18 nt, Human
ugcuccucuccccagcaa

SEQ ID NO: 1511939 - RNA, 13 nt, Human
ugcugcuggcugg

SEQ ID NO: 1511940 - RNA, 23 nt, Human
ugcugcaguugccagucaccccg

SEQ ID NO: 1511941 - RNA, 18 nt, Human
ugcugcaguugccaguca

SEQ ID NO: 1511942 - RNA, 14 nt, Human
ugcugcauuuaaaa

SEQ ID NO: 1511943 - RNA, 18 nt, Human
ugcugauggugcaaugac

SEQ ID NO: 1511944 - RNA, 13 nt, Human
ugcugauggugca

SEQ ID NO: 1511945 - RNA, 15 nt, Human
ugcugauggugcaau

SEQ ID NO: 1511946 - RNA, 17 nt, Human
ugcugauggugcaauga

SEQ ID NO: 1511947 - RNA, 12 nt, Human
ugcugaaggcuc

SEQ ID NO: 1511948 - RNA, 13 nt, Human
ugcugaaggcucg

SEQ ID NO: 1511949 - RNA, 21 nt, Human
ugcugaaggcucgagcaugcc

SEQ ID NO: 1511950 - RNA, 22 nt, Human
ugcugacagacacaggcccggc

SEQ ID NO: 1511951 - RNA, 23 nt, Human
ugcugacagacacaggcccggcu

SEQ ID NO: 1511952 - RNA, 15 nt, Human
ugccuucucaacucc

SEQ ID NO: 1511953 - RNA, 17 nt, Human
ugccuucucaacuccaa

SEQ ID NO: 1511954 - RNA, 14 nt, Human
ugcgaucuggguuc

SEQ ID NO: 1511955 - RNA, 15 nt, Human
ugcgaucuggguuca

SEQ ID NO: 1511956 - RNA, 19 nt, Human
ugcgaucuggguucacugc

SEQ ID NO: 1511957 - RNA, 20 nt, Human
ugcgaucuggguucacugca

SEQ ID NO: 1511958 - RNA, 21 nt, Human
ugcgaucuggguucacugcaa

SEQ ID NO: 1511959 - RNA, 17 nt, Human
ugcuaaaggagcaucua

SEQ ID NO: 1511960 - RNA, 15 nt, Human
ugcuaaaugugaaug

SEQ ID NO: 1511961 - RNA, 16 nt, Human
ugcgucgguccuggug

SEQ ID NO: 1511962 - RNA, 14 nt, Human
ugcgccuacaggag

SEQ ID NO: 1511963 - RNA, 16 nt, Human
ugcgccuacaggagug

SEQ ID NO: 1511964 - RNA, 22 nt, Human
ugcgccuacaggagugagcacu

SEQ ID NO: 1511965 - RNA, 17 nt, Human
ugccugaagucacacag

SEQ ID NO: 1511966 - RNA, 18 nt, Human
ugccccuggcagccccug

SEQ ID NO: 1511967 - RNA, 20 nt, Human
ugccucgaacuggcugcaaa

SEQ ID NO: 1511968 - RNA, 18 nt, Human
ugccucgaacuggcugca

SEQ ID NO: 1511969 - RNA, 19 nt, Human
ugccucgaacuggcugcaa

SEQ ID NO: 1511970 - RNA, 21 nt, Human
ugccugggaucccucauccuc

SEQ ID NO: 1511971 - RNA, 18 nt, Human
ugccugggcagaaggaag

SEQ ID NO: 1511972 - RNA, 18 nt, Human
ugccuguaaucacagcua

SEQ ID NO: 1511973 - RNA, 16 nt, Human
ugccugguggcagcug

SEQ ID NO: 1511974 - RNA, 14 nt, Human
ugccugguggcagc

SEQ ID NO: 1511975 - RNA, 15 nt, Human
ugccugguggcagcu

SEQ ID NO: 1511976 - RNA, 20 nt, Human
ugaagagguuuuaaagcuuc

SEQ ID NO: 1511977 - RNA, 21 nt, Human
ugaagagguuuuaaagcuucc

SEQ ID NO: 1511978 - RNA, 19 nt, Human
ugaagagguuuuaaagcuu

SEQ ID NO: 1511979 - RNA, 18 nt, Human
ugaaggccccgcccaggc

SEQ ID NO: 1511980 - RNA, 15 nt, Human
ugaaggaaaaugaua

SEQ ID NO: 1511981 - RNA, 19 nt, Human
ugaaggccccgcccaggcu

SEQ ID NO: 1511982 - RNA, 20 nt, Human
ugaaggccccgcccaggcuu

SEQ ID NO: 1511983 - RNA, 19 nt, Human
ugaagacucauucuucugu

SEQ ID NO: 1511984 - RNA, 20 nt, Human
ugaagacucauucuucugua

SEQ ID NO: 1511985 - RNA, 15 nt, Human
ugaaugaauggcuaa

SEQ ID NO: 1511986 - RNA, 20 nt, Human
ugaaugaauggcuaagcaaa

SEQ ID NO: 1511987 - RNA, 13 nt, Human
ugaaucucauaau

SEQ ID NO: 1511988 - RNA, 20 nt, Human
ugaaucucauaauuuauaca

SEQ ID NO: 1511989 - RNA, 14 nt, Human
ugaaguuuacauug

SEQ ID NO: 1511990 - RNA, 20 nt, Human
ugaaggcuggguucugaucc

SEQ ID NO: 1511991 - RNA, 21 nt, Human
ugaaggcuggguucugauccu

SEQ ID NO: 1511992 - RNA, 16 nt, Human
ugaaguuuacauugua

SEQ ID NO: 1511993 - RNA, 20 nt, Human
ugaaguuuacauuguaaaua

SEQ ID NO: 1511994 - RNA, 16 nt, Human
ugaauuuaaauagcuu

SEQ ID NO: 1511995 - RNA, 13 nt, Human
ugacaacacucau

SEQ ID NO: 1511996 - RNA, 23 nt, Human
ugacaacacucauugaccugagg

SEQ ID NO: 1511997 - RNA, 14 nt, Human
ugaauuaaguuuuu

SEQ ID NO: 1511998 - RNA, 13 nt, Human
ugaauuacauuug

SEQ ID NO: 1511999 - RNA, 14 nt, Human
ugaauuacauuugu

SEQ ID NO: 1512000 - RNA, 13 nt, Human
ugaauuguaagga

SEQ ID NO: 1512001 - RNA, 21 nt, Human
ugaauuguaaggaaugauuaa

SEQ ID NO: 1512002 - RNA, 22 nt, Human
ugacaacuucccagugaauucu

SEQ ID NO: 1512003 - RNA, 23 nt, Human
ugacaaggauugcuacuguccua

SEQ ID NO: 1512004 - RNA, 14 nt, Human
ugacacacagcucu

SEQ ID NO: 1512005 - RNA, 15 nt, Human
ugacacacagcucug

SEQ ID NO: 1512006 - RNA, 13 nt, Human
ugacagacacagg

SEQ ID NO: 1512007 - RNA, 21 nt, Human
ugacagaauauguuucaaacu

SEQ ID NO: 1512008 - RNA, 22 nt, Human
ugacagaauauguuucaaacuu

SEQ ID NO: 1512009 - RNA, 14 nt, Human
ugacagacacaggc

SEQ ID NO: 1512010 - RNA, 16 nt, Human
ugacagacacaggccc

SEQ ID NO: 1512011 - RNA, 13 nt, Human
ugacagaggcagc

SEQ ID NO: 1512012 - RNA, 17 nt, Human
ugacagacacaggcccg

SEQ ID NO: 1512013 - RNA, 18 nt, Human
ugacagacacaggcccgg

SEQ ID NO: 1512014 - RNA, 23 nt, Human
ugacagaauauguuucaaacuuu

SEQ ID NO: 1512015 - RNA, 22 nt, Human
ugacagagcaagugagacccug

SEQ ID NO: 1512016 - RNA, 23 nt, Human
ugacaucaacugcaucaagaugu

SEQ ID NO: 1512017 - RNA, 16 nt, Human
ugaccacugcagaaga

SEQ ID NO: 1512018 - RNA, 17 nt, Human
ugaccacugcagaagac

SEQ ID NO: 1512019 - RNA, 18 nt, Human
ugaccacugcagaagaca

SEQ ID NO: 1512020 - RNA, 13 nt, Human
ugacauguuuuau

SEQ ID NO: 1512021 - RNA, 16 nt, Human
ugacuuuccucuuugg

SEQ ID NO: 1512022 - RNA, 21 nt, Human
ugacucuuucuauuguuucuu

SEQ ID NO: 1512023 - RNA, 14 nt, Human
ugacucuuaagaag

SEQ ID NO: 1512024 - RNA, 15 nt, Human
ugacucuuaagaaga

SEQ ID NO: 1512025 - RNA, 16 nt, Human
ugacucuuaagaagac

SEQ ID NO: 1512026 - RNA, 14 nt, Human
ugaccauucuccac

SEQ ID NO: 1512027 - RNA, 13 nt, Human
ugaccauucucca

SEQ ID NO: 1512028 - RNA, 22 nt, Human
ugacuuuucuguccgagcuuug

SEQ ID NO: 1512029 - RNA, 15 nt, Human
ugagaaauaaaguuu

SEQ ID NO: 1512030 - RNA, 15 nt, Human
ugagaaagacuauuc

SEQ ID NO: 1512031 - RNA, 14 nt, Human
ugagaccaaccugg

SEQ ID NO: 1512032 - RNA, 19 nt, Human
ugagaggggaacagacugg

SEQ ID NO: 1512033 - RNA, 18 nt, Human
ugagaggggaacagacug

SEQ ID NO: 1512034 - RNA, 14 nt, Human
ugagaggggaacag

SEQ ID NO: 1512035 - RNA, 12 nt, Human
ugagcagggcuc

SEQ ID NO: 1512036 - RNA, 20 nt, Human
ugagcaggauuuuaaucuuu

SEQ ID NO: 1512037 - RNA, 15 nt, Human
ugagcaggauuuuaa

SEQ ID NO: 1512038 - RNA, 16 nt, Human
ugaggcucugcccuug

SEQ ID NO: 1512039 - RNA, 18 nt, Human
ugaggcucugcccuuggu

SEQ ID NO: 1512040 - RNA, 15 nt, Human
ugaggcugggcuccc

SEQ ID NO: 1512041 - RNA, 16 nt, Human
ugaggcugggcucccu

SEQ ID NO: 1512042 - RNA, 15 nt, Human
ugaggugcuauguuc

SEQ ID NO: 1512043 - RNA, 21 nt, Human
ugaggcugggcucccuuccca

SEQ ID NO: 1512044 - RNA, 18 nt, Human
ugaggucagagccugcag

SEQ ID NO: 1512045 - RNA, 19 nt, Human
ugaggucagagccugcagu

SEQ ID NO: 1512046 - RNA, 18 nt, Human
ugaggucauagcagugcu

SEQ ID NO: 1512047 - RNA, 22 nt, Human
ugaggaugaaaaaauaacacug

SEQ ID NO: 1512048 - RNA, 23 nt, Human
ugagccgagaucacgccacugca

SEQ ID NO: 1512049 - RNA, 20 nt, Human
ugagcagggcucagcgggga

SEQ ID NO: 1512050 - RNA, 22 nt, Human
ugagcagggcucagcggggaca

SEQ ID NO: 1512051 - RNA, 23 nt, Human
ugagcagggcucagcggggacag

SEQ ID NO: 1512052 - RNA, 22 nt, Human
ugagccgagaucacgccacugc

SEQ ID NO: 1512053 - RNA, 11 nt, Human
ugagcucagga

SEQ ID NO: 1512054 - RNA, 19 nt, Human
ugagcucaggaguuugaga

SEQ ID NO: 1512055 - RNA, 14 nt, Human
ucuuauaauuuaaa

SEQ ID NO: 1512056 - RNA, 13 nt, Human
ucuuauaauuuaa

SEQ ID NO: 1512057 - RNA, 20 nt, Human
ucuuagguuggcaaaaaggc

SEQ ID NO: 1512058 - RNA, 23 nt, Human
ucuuagguuggcaaaaaggcagg

SEQ ID NO: 1512059 - RNA, 22 nt, Human
ucugugucagguggggcagcuu

SEQ ID NO: 1512060 - RNA, 17 nt, Human
ucugugucagguggggc

SEQ ID NO: 1512061 - RNA, 20 nt, Human
ucugugucagguggggcagc

SEQ ID NO: 1512062 - RNA, 15 nt, Human
ucuuagauguauaua

SEQ ID NO: 1512063 - RNA, 15 nt, Human
ucuucagaucucuaa

SEQ ID NO: 1512064 - RNA, 14 nt, Human
ucuucagaucucua

SEQ ID NO: 1512065 - RNA, 21 nt, Human
ucuucagagacuccugcaggc

SEQ ID NO: 1512066 - RNA, 13 nt, Human
ucuuagcuccccu

SEQ ID NO: 1512067 - RNA, 14 nt, Human
ucuuagcuccccuc

SEQ ID NO: 1512068 - RNA, 16 nt, Human
ucuuagcuccccucca

SEQ ID NO: 1512069 - RNA, 14 nt, Human
ucuuauacauuuga

SEQ ID NO: 1512070 - RNA, 22 nt, Human
ucuuauccaacaucaacaucuu

SEQ ID NO: 1512071 - RNA, 19 nt, Human
ucuugccaaauauaaauaa

SEQ ID NO: 1512072 - RNA, 19 nt, Human
ucuugaaggaaaaugauac

SEQ ID NO: 1512073 - RNA, 14 nt, Human
ucuugcucugcuga

SEQ ID NO: 1512074 - RNA, 15 nt, Human
ucuugcucugcugac

SEQ ID NO: 1512075 - RNA, 23 nt, Human
ucuugcucugcugacagacacag

SEQ ID NO: 1512076 - RNA, 18 nt, Human
ucuuguagcuuuaucaaa

SEQ ID NO: 1512077 - RNA, 16 nt, Human
ucuucuuggucucagu

SEQ ID NO: 1512078 - RNA, 13 nt, Human
ucuugaagacuuu

SEQ ID NO: 1512079 - RNA, 22 nt, Human
ucuugaagacuuuucuuucagc

SEQ ID NO: 1512080 - RNA, 21 nt, Human
ucuugaaauauaggaacuuaa

SEQ ID NO: 1512081 - RNA, 20 nt, Human
ucuugaaauauaggaacuua

SEQ ID NO: 1512082 - RNA, 17 nt, Human
ucuuuccacagaagcuc

SEQ ID NO: 1512083 - RNA, 12 nt, Human
ucuuucccuccc

SEQ ID NO: 1512084 - RNA, 13 nt, Human
ucuuucccucccu

SEQ ID NO: 1512085 - RNA, 23 nt, Human
ucuuucccucccuuccucuuucc

SEQ ID NO: 1512086 - RNA, 23 nt, Human
ucuuuccaaaguacacuguuuca

SEQ ID NO: 1512087 - RNA, 13 nt, Human
ucuuguguguuua

SEQ ID NO: 1512088 - RNA, 14 nt, Human
ucuuugcagacagg

SEQ ID NO: 1512089 - RNA, 17 nt, Human
ucuuugcagacaggcaa

SEQ ID NO: 1512090 - RNA, 23 nt, Human
ucuuugagugaagcugggagaac

SEQ ID NO: 1512091 - RNA, 13 nt, Human
ucuuugcagacag

SEQ ID NO: 1512092 - RNA, 16 nt, Human
ucuuuggacccugagg

SEQ ID NO: 1512093 - RNA, 14 nt, Human
ucuuuggacccuga

SEQ ID NO: 1512094 - RNA, 15 nt, Human
ucuuuggacccugag

SEQ ID NO: 1512095 - RNA, 13 nt, Human
ucuuuggacccug

SEQ ID NO: 1512096 - RNA, 23 nt, Human
ugaaacacucaguuguucaauaa

SEQ ID NO: 1512097 - RNA, 12 nt, Human
ugaaaauuuuga

SEQ ID NO: 1512098 - RNA, 14 nt, Human
ugaaaauucagugg

SEQ ID NO: 1512099 - RNA, 22 nt, Human
ugaaaauuauuuuguucauaca

SEQ ID NO: 1512100 - RNA, 23 nt, Human
ugaaaauuauuuuguucauacau

SEQ ID NO: 1512101 - RNA, 19 nt, Human
ugaaaagaaaaaugagccu

SEQ ID NO: 1512102 - RNA, 19 nt, Human
ugaaaauuauuuuguucau

SEQ ID NO: 1512103 - RNA, 20 nt, Human
ugaaaagaaaaaugagccug

SEQ ID NO: 1512104 - RNA, 22 nt, Human
ugaaaagaaaaaugagccuggc

SEQ ID NO: 1512105 - RNA, 21 nt, Human
ugaaaacacauuuuucuuagg

SEQ ID NO: 1512106 - RNA, 17 nt, Human
ugaaaacacuguucucu

SEQ ID NO: 1512107 - RNA, 20 nt, Human
ugaaaacacuguucucugcc

SEQ ID NO: 1512108 - RNA, 21 nt, Human
ugaaaacacuguucucugccc

SEQ ID NO: 1512109 - RNA, 22 nt, Human
ugaaaacacuguucucugcccu

SEQ ID NO: 1512110 - RNA, 23 nt, Human
ugaaaacacuguucucugcccuc

SEQ ID NO: 1512111 - RNA, 16 nt, Human
ucuggugacuuuccuc

SEQ ID NO: 1512112 - RNA, 13 nt, Human
ucugucuaggaau

SEQ ID NO: 1512113 - RNA, 21 nt, Human
ucuguccugggagugagcugg

SEQ ID NO: 1512114 - RNA, 14 nt, Human
ucugucucagucca

SEQ ID NO: 1512115 - RNA, 14 nt, Human
ucuguacagagccc

SEQ ID NO: 1512116 - RNA, 23 nt, Human
ucuguacagagcccacgccccca

SEQ ID NO: 1512117 - RNA, 15 nt, Human
ucuguacagagccca

SEQ ID NO: 1512118 - RNA, 12 nt, Human
ucuguccuggga

SEQ ID NO: 1512119 - RNA, 17 nt, Human
ucugucgcccagucugg

SEQ ID NO: 1512120 - RNA, 17 nt, Human
ucugcugcuggcugguu

SEQ ID NO: 1512121 - RNA, 14 nt, Human
ucugcugcuggcug

SEQ ID NO: 1512122 - RNA, 15 nt, Human
ucugcugcuggcugg

SEQ ID NO: 1512123 - RNA, 17 nt, Human
ucugcugacagacacag

SEQ ID NO: 1512124 - RNA, 11 nt, Human
ucugcugcugg

SEQ ID NO: 1512125 - RNA, 13 nt, Human
ucugcugcuggcu

SEQ ID NO: 1512126 - RNA, 13 nt, Human
ucugccugcccag

SEQ ID NO: 1512127 - RNA, 17 nt, Human
ucugccugcccaggccc

SEQ ID NO: 1512128 - RNA, 18 nt, Human
ucugccugcccaggcccc

SEQ ID NO: 1512129 - RNA, 20 nt, Human
ucugccugcccaggccccug

SEQ ID NO: 1512130 - RNA, 12 nt, Human
ucugcucuccuu

SEQ ID NO: 1512131 - RNA, 13 nt, Human
ucugcucuccuuc

SEQ ID NO: 1512132 - RNA, 14 nt, Human
ucugcucuccuucc

SEQ ID NO: 1512133 - RNA, 15 nt, Human
ucugcucuccuuccu

SEQ ID NO: 1512134 - RNA, 19 nt, Human
ucugcucuccuuccuggag

SEQ ID NO: 1512135 - RNA, 20 nt, Human
ucugcucuccuuccuggagc

SEQ ID NO: 1512136 - RNA, 14 nt, Human
ucugcaucagcugc

SEQ ID NO: 1512137 - RNA, 12 nt, Human
ucugcccacucc

SEQ ID NO: 1512138 - RNA, 22 nt, Human
ucugccauauucuguuggccag

SEQ ID NO: 1512139 - RNA, 23 nt, Human
ucugccauauucuguuggccagu

SEQ ID NO: 1512140 - RNA, 12 nt, Human
ucugccucccau

SEQ ID NO: 1512141 - RNA, 13 nt, Human
ucugccucccauc

SEQ ID NO: 1512142 - RNA, 15 nt, Human
ucugccucccaucac

SEQ ID NO: 1512143 - RNA, 16 nt, Human
ucugcccacucccugc

SEQ ID NO: 1512144 - RNA, 13 nt, Human
ucugcccacuccc

SEQ ID NO: 1512145 - RNA, 14 nt, Human
ucugcccacucccu

SEQ ID NO: 1512146 - RNA, 15 nt, Human
ucugccucugacaca

SEQ ID NO: 1512147 - RNA, 18 nt, Human
ucugccucugacacacag

SEQ ID NO: 1512148 - RNA, 16 nt, Human
ucugccucccaucacc

SEQ ID NO: 1512149 - RNA, 17 nt, Human
ucugccucccaucaccc

SEQ ID NO: 1512150 - RNA, 20 nt, Human
ucugccucccaucacccgcu

SEQ ID NO: 1512151 - RNA, 21 nt, Human
ucugccucccaucacccgcua

SEQ ID NO: 1512152 - RNA, 23 nt, Human
ucugccucugacacacagcucug

SEQ ID NO: 1512153 - RNA, 21 nt, Human
ucugccucugacacacagcuc

SEQ ID NO: 1512154 - RNA, 22 nt, Human
ucugccucugacacacagcucu

SEQ ID NO: 1512155 - RNA, 19 nt, Human
ucugccugaagucacacag

SEQ ID NO: 1512156 - RNA, 20 nt, Human
ucugccugaagucacacagu

SEQ ID NO: 1512157 - RNA, 13 nt, Human
ucugcacuccccu

SEQ ID NO: 1512158 - RNA, 23 nt, Human
ucugaggaauccagacccggcug

SEQ ID NO: 1512159 - RNA, 22 nt, Human
ucugaggaauccagacccggcu

SEQ ID NO: 1512160 - RNA, 18 nt, Human
ucugaggaauccagaccc

SEQ ID NO: 1512161 - RNA, 21 nt, Human
ucugaggaauccagacccggc

SEQ ID NO: 1512162 - RNA, 18 nt, Human
ucugagaggacuuuucuu

SEQ ID NO: 1512163 - RNA, 24 nt, Human
ucugagaucaaaacgguuuuacug

SEQ ID NO: 1512164 - RNA, 23 nt, Human
ucucauaauuuauacaggucaua

SEQ ID NO: 1512165 - RNA, 20 nt, Human
ucugacccaugcugcccugu

SEQ ID NO: 1512166 - RNA, 22 nt, Human
ucugacccaugcugcccuguga

SEQ ID NO: 1512167 - RNA, 23 nt, Human
ucugacccaugcugcccugugag

SEQ ID NO: 1512168 - RNA, 13 nt, Human
ucuauauuuuaca

SEQ ID NO: 1512169 - RNA, 12 nt, Human
ucuagggaaaaa

SEQ ID NO: 1512170 - RNA, 19 nt, Human
ucuagggaaaaaccagcgu

SEQ ID NO: 1512171 - RNA, 18 nt, Human
ucuacucuagggaaaaac

SEQ ID NO: 1512172 - RNA, 20 nt, Human
ucuacucgaguuacagacaa

SEQ ID NO: 1512173 - RNA, 21 nt, Human
ucuacucgaguuacagacaaa

SEQ ID NO: 1512174 - RNA, 15 nt, Human
ucuacuaaaaauaca

SEQ ID NO: 1512175 - RNA, 19 nt, Human
ucuacuaaaaauacaaaaa

SEQ ID NO: 1512176 - RNA, 16 nt, Human
ucucauaauuuauaca

SEQ ID NO: 1512177 - RNA, 22 nt, Human
ucucauaauuuauacaggucau

SEQ ID NO: 1512178 - RNA, 17 nt, Human
ucucacuguugcccagg

SEQ ID NO: 1512179 - RNA, 14 nt, Human
ucucacuguugccc

SEQ ID NO: 1512180 - RNA, 15 nt, Human
ucucacuguugccca

SEQ ID NO: 1512181 - RNA, 13 nt, Human
ucuaugaaauauu

SEQ ID NO: 1512182 - RNA, 18 nt, Human
ucucaaauuucuaaaucu

SEQ ID NO: 1512183 - RNA, 16 nt, Human
ucucacacaugagcau

SEQ ID NO: 1512184 - RNA, 23 nt, Human
ucucacacaugagcaucaggcca

SEQ ID NO: 1512185 - RNA, 20 nt, Human
ucucacugccaugccagcuu

SEQ ID NO: 1512186 - RNA, 21 nt, Human
ucucacacaugagcaucaggc

SEQ ID NO: 1512187 - RNA, 23 nt, Human
ucucacucugucgcccagucugg

SEQ ID NO: 1512188 - RNA, 16 nt, Human
ucucaaauuucuaaau

SEQ ID NO: 1512189 - RNA, 14 nt, Human
ucucaaauuucuaa

SEQ ID NO: 1512190 - RNA, 13 nt, Human
ucucaaauuucua

SEQ ID NO: 1512191 - RNA, 15 nt, Human
ucggccuccauccug

SEQ ID NO: 1512192 - RNA, 16 nt, Human
ucggccuccauccuga

SEQ ID NO: 1512193 - RNA, 17 nt, Human
ucggccuccauccugag

SEQ ID NO: 1512194 - RNA, 14 nt, Human
ucgcccagucugga

SEQ ID NO: 1512195 - RNA, 19 nt, Human
ucgcccagucuggaaugca

SEQ ID NO: 1512196 - RNA, 23 nt, Human
ucgcccagucuggaaugcagugg

SEQ ID NO: 1512197 - RNA, 18 nt, Human
ucggaaaacaugcuacac

SEQ ID NO: 1512198 - RNA, 15 nt, Human
ucggaaaacaugcua

SEQ ID NO: 1512199 - RNA, 17 nt, Human
ucgcaggauucuuccuc

SEQ ID NO: 1512200 - RNA, 21 nt, Human
ucgcaggauucuuccucccuc

SEQ ID NO: 1512201 - RNA, 23 nt, Human
ucgcaggauucuuccucccuccc

SEQ ID NO: 1512202 - RNA, 22 nt, Human
uccuuuucgcaggauucuuccu

SEQ ID NO: 1512203 - RNA, 22 nt, Human
uccuuggugucgggcaugacac

SEQ ID NO: 1512204 - RNA, 17 nt, Human
uccuuugugaggaagcc

SEQ ID NO: 1512205 - RNA, 18 nt, Human
uccuuugugaggaagccg

SEQ ID NO: 1512206 - RNA, 22 nt, Human
uccuuugugaggaagccgcugg

SEQ ID NO: 1512207 - RNA, 18 nt, Human
uccuuggugucgggcaug

SEQ ID NO: 1512208 - RNA, 21 nt, Human
uccuuggugucgggcaugaca

SEQ ID NO: 1512209 - RNA, 17 nt, Human
uccuugcaucaauuuuu

SEQ ID NO: 1512210 - RNA, 22 nt, Human
uccuugaaaacacuguucucug

SEQ ID NO: 1512211 - RNA, 23 nt, Human
uccuugaaaacacuguucucugc

SEQ ID NO: 1512212 - RNA, 21 nt, Human
uccuuaccagcagagcaccuu

SEQ ID NO: 1512213 - RNA, 17 nt, Human
ucccaugagccucagca

SEQ ID NO: 1512214 - RNA, 22 nt, Human
ucccaugagccucagcauccug

SEQ ID NO: 1512215 - RNA, 18 nt, Human
ucccucccuuccucuuuc

SEQ ID NO: 1512216 - RNA, 14 nt, Human
ucccugccaaugga

SEQ ID NO: 1512217 - RNA, 16 nt, Human
ucccugccaauggacu

SEQ ID NO: 1512218 - RNA, 17 nt, Human
ucccucuggggcuguuc

SEQ ID NO: 1512219 - RNA, 13 nt, Human
ucccucuggggcu

SEQ ID NO: 1512220 - RNA, 22 nt, Human
uccgaaagggacuuggaagcuc

SEQ ID NO: 1512221 - RNA, 21 nt, Human
uccgaaagggacuuggaagcu

SEQ ID NO: 1512222 - RNA, 21 nt, Human
uccgcuuucuacccagcgagc

SEQ ID NO: 1512223 - RNA, 16 nt, Human
ucccuucccaccucuc

SEQ ID NO: 1512224 - RNA, 17 nt, Human
ucccuucccaccucucu

SEQ ID NO: 1512225 - RNA, 21 nt, Human
ucccuucccacuggaggcaug

SEQ ID NO: 1512226 - RNA, 21 nt, Human
uccucuaggaggucucuaaga

SEQ ID NO: 1512227 - RNA, 21 nt, Human
uccuccuuuucacaguucucu

SEQ ID NO: 1512228 - RNA, 15 nt, Human
uccucuggccugugu

SEQ ID NO: 1512229 - RNA, 15 nt, Human
uccucuguacagagc

SEQ ID NO: 1512230 - RNA, 13 nt, Human
uccucuguacaga

SEQ ID NO: 1512231 - RNA, 17 nt, Human
uccugagccagauuuca

SEQ ID NO: 1512232 - RNA, 23 nt, Human
uccucuguacagagcccacgccc

SEQ ID NO: 1512233 - RNA, 15 nt, Human
uccugaggcuccacu

SEQ ID NO: 1512234 - RNA, 21 nt, Human
uccugagccagauuucacucu

SEQ ID NO: 1512235 - RNA, 18 nt, Human
uccugagccagauuucac

SEQ ID NO: 1512236 - RNA, 19 nt, Human
uccugagccagauuucacu

SEQ ID NO: 1512237 - RNA, 12 nt, Human
uccugaggcugg

SEQ ID NO: 1512238 - RNA, 16 nt, Human
uccugaggcuccacuu

SEQ ID NO: 1512239 - RNA, 17 nt, Human
uccugaggcuccacuug

SEQ ID NO: 1512240 - RNA, 15 nt, Human
uccugaggcugggcu

SEQ ID NO: 1512241 - RNA, 16 nt, Human
uccugaggcugggcuc

SEQ ID NO: 1512242 - RNA, 17 nt, Human
uccugaggcugggcucc

SEQ ID NO: 1512243 - RNA, 19 nt, Human
uccugaggcugggcucccu

SEQ ID NO: 1512244 - RNA, 18 nt, Human
uccuccgccuuaccagga

SEQ ID NO: 1512245 - RNA, 12 nt, Human
uccuccucagau

SEQ ID NO: 1512246 - RNA, 20 nt, Human
uccucaaaacuucagacaua

SEQ ID NO: 1512247 - RNA, 12 nt, Human
uccuccaggugc

SEQ ID NO: 1512248 - RNA, 13 nt, Human
uccuccaggugca

SEQ ID NO: 1512249 - RNA, 14 nt, Human
uccuccaggugcac

SEQ ID NO: 1512250 - RNA, 18 nt, Human
uccuccaggugcacaagc

SEQ ID NO: 1512251 - RNA, 20 nt, Human
uccuccaggugcacaagcuc

SEQ ID NO: 1512252 - RNA, 22 nt, Human
uccuccaggugcacaagcucca

SEQ ID NO: 1512253 - RNA, 22 nt, Human
uccuaguuccaccaucaagcca

SEQ ID NO: 1512254 - RNA, 21 nt, Human
uccuaguuccaccaucaagcc

SEQ ID NO: 1512255 - RNA, 16 nt, Human
uccuaagcuauucagu

SEQ ID NO: 1512256 - RNA, 18 nt, Human
uccuaagcuauucaguaa

SEQ ID NO: 1512257 - RNA, 14 nt, Human
uccuaguuccacca

SEQ ID NO: 1512258 - RNA, 17 nt, Human
uccuaguuccaccauca

SEQ ID NO: 1512259 - RNA, 12 nt, Human
uccauacauuug

SEQ ID NO: 1512260 - RNA, 17 nt, Human
uccauagagagcaagac

SEQ ID NO: 1512261 - RNA, 21 nt, Human
uccagggcuggacugaggccu

SEQ ID NO: 1512262 - RNA, 22 nt, Human
uccagggcuggacugaggccug

SEQ ID NO: 1512263 - RNA, 23 nt, Human
uccagggcuggacugaggccuga

SEQ ID NO: 1512264 - RNA, 14 nt, Human
uccagggcuggacu

SEQ ID NO: 1512265 - RNA, 17 nt, Human
uccagggcuggacugag

SEQ ID NO: 1512266 - RNA, 19 nt, Human
uccagggcuggacugaggc

SEQ ID NO: 1512267 - RNA, 20 nt, Human
uccauagagagcaagacgcu

SEQ ID NO: 1512268 - RNA, 13 nt, Human
ucccaacucaccc

SEQ ID NO: 1512269 - RNA, 17 nt, Human
ucccaacucaccccagc

SEQ ID NO: 1512270 - RNA, 18 nt, Human
ucccaacucaccccagcc

SEQ ID NO: 1512271 - RNA, 19 nt, Human
ucccaacucaccccagccc

SEQ ID NO: 1512272 - RNA, 21 nt, Human
ucccaacucaccccagcccca

SEQ ID NO: 1512273 - RNA, 14 nt, Human
ucccaccucucuca

SEQ ID NO: 1512274 - RNA, 17 nt, Human
ucccaccucucucacuc

SEQ ID NO: 1512275 - RNA, 18 nt, Human
ucccaccucucucacucc

SEQ ID NO: 1512276 - RNA, 18 nt, Human
ucccaccucagccucccg

SEQ ID NO: 1512277 - RNA, 18 nt, Human
ucccacgagggugccgug

SEQ ID NO: 1512278 - RNA, 14 nt, Human
ucccacucagucca

SEQ ID NO: 1512279 - RNA, 20 nt, Human
ucccaccucucucacuccuu

SEQ ID NO: 1512280 - RNA, 19 nt, Human
ucccaccuuggcugcaggg

SEQ ID NO: 1512281 - RNA, 21 nt, Human
ucccaccuuggcugcagggag

SEQ ID NO: 1512282 - RNA, 17 nt, Human
ucccaggcauuccccag

SEQ ID NO: 1512283 - RNA, 18 nt, Human
ucccaggcauuccccagg

SEQ ID NO: 1512284 - RNA, 19 nt, Human
ucccaggcauuccccagga

SEQ ID NO: 1512285 - RNA, 15 nt, Human
ucccaugagccucag

SEQ ID NO: 1512286 - RNA, 16 nt, Human
ucccaugagccucagc

SEQ ID NO: 1512287 - RNA, 19 nt, Human
uccacuuucuagccagagg

SEQ ID NO: 1512288 - RNA, 18 nt, Human
uccacuuucagugaaagc

SEQ ID NO: 1512289 - RNA, 14 nt, Human
uccacuuucuagcc

SEQ ID NO: 1512290 - RNA, 22 nt, Human
uccacugugccaugugccaggu

SEQ ID NO: 1512291 - RNA, 21 nt, Human
uccacccugcucuccgaccag

SEQ ID NO: 1512292 - RNA, 14 nt, Human
uccacccugcucuc

SEQ ID NO: 1512293 - RNA, 18 nt, Human
uccagcaaaucaagcuga

SEQ ID NO: 1512294 - RNA, 14 nt, Human
uccaagcaggacau

SEQ ID NO: 1512295 - RNA, 22 nt, Human
uccaagcaggacauggacaagg

SEQ ID NO: 1512296 - RNA, 12 nt, Human
uccaagagcuga

SEQ ID NO: 1512297 - RNA, 19 nt, Human
uccaagaagcccaggaaag

SEQ ID NO: 1512298 - RNA, 20 nt, Human
uccaagaccuucuccuucac

SEQ ID NO: 1512299 - RNA, 14 nt, Human
uccaagaagcccag

SEQ ID NO: 1512300 - RNA, 15 nt, Human
uccaagaagcccagg

SEQ ID NO: 1512301 - RNA, 16 nt, Human
uccaagaagcccagga

SEQ ID NO: 1512302 - RNA, 21 nt, Human
uccacaagagcccaggccucc

SEQ ID NO: 1512303 - RNA, 20 nt, Human
uccacaagagcccaggccuc

SEQ ID NO: 1512304 - RNA, 17 nt, Human
ucagauaugauucaaau

SEQ ID NO: 1512305 - RNA, 16 nt, Human
ucagauaugauucaaa

SEQ ID NO: 1512306 - RNA, 18 nt, Human
ucagauaugauucaaaug

SEQ ID NO: 1512307 - RNA, 15 nt, Human
ucagaucucuaacuu

SEQ ID NO: 1512308 - RNA, 18 nt, Human
ucagcacgauuucuguuu

SEQ ID NO: 1512309 - RNA, 17 nt, Human
ucagcacgauuucuguu

SEQ ID NO: 1512310 - RNA, 16 nt, Human
ucagcacgauuucugu

SEQ ID NO: 1512311 - RNA, 15 nt, Human
ucagcacgauuucug

SEQ ID NO: 1512312 - RNA, 12 nt, Human
ucagccucccaa

SEQ ID NO: 1512313 - RNA, 13 nt, Human
ucagccucccaaa

SEQ ID NO: 1512314 - RNA, 15 nt, Human
ucagcauccuggcac

SEQ ID NO: 1512315 - RNA, 16 nt, Human
ucagcauccuggcacc

SEQ ID NO: 1512316 - RNA, 17 nt, Human
ucagcauccuggcaccc

SEQ ID NO: 1512317 - RNA, 18 nt, Human
ucagcauccuggcacccg

SEQ ID NO: 1512318 - RNA, 15 nt, Human
ucagcugcuacuacu

SEQ ID NO: 1512319 - RNA, 16 nt, Human
ucagcugcugaaacaa

SEQ ID NO: 1512320 - RNA, 22 nt, Human
ucaggagaguagaacagauaau

SEQ ID NO: 1512321 - RNA, 22 nt, Human
ucagccucccaaagugcuggga

SEQ ID NO: 1512322 - RNA, 12 nt, Human
ucagccucccga

SEQ ID NO: 1512323 - RNA, 20 nt, Human
ucagccucccgaauagcugg

SEQ ID NO: 1512324 - RNA, 16 nt, Human
ucagccugcuccagcu

SEQ ID NO: 1512325 - RNA, 22 nt, Human
ucagcuccccucggagaagagc

SEQ ID NO: 1512326 - RNA, 18 nt, Human
ucagcuccagcucaccag

SEQ ID NO: 1512327 - RNA, 21 nt, Human
ucagcuccagcucaccagccc

SEQ ID NO: 1512328 - RNA, 22 nt, Human
ucagcuccagcucaccagcccc

SEQ ID NO: 1512329 - RNA, 21 nt, Human
ucauggaauuggagcucgugg

SEQ ID NO: 1512330 - RNA, 15 nt, Human
ucaugaaagauucaa

SEQ ID NO: 1512331 - RNA, 13 nt, Human
ucaugaaagauuc

SEQ ID NO: 1512332 - RNA, 19 nt, Human
ucauggaauuggagcucgu

SEQ ID NO: 1512333 - RNA, 13 nt, Human
ucaucuuucuuga

SEQ ID NO: 1512334 - RNA, 22 nt, Human
ucaucuuucuugaucaacaucu

SEQ ID NO: 1512335 - RNA, 14 nt, Human
ucaucauccuaagc

SEQ ID NO: 1512336 - RNA, 17 nt, Human
ucagucugauucccaag

SEQ ID NO: 1512337 - RNA, 19 nt, Human
ucagucugauucccaagcu

SEQ ID NO: 1512338 - RNA, 18 nt, Human
ucagugugacugaucucu

SEQ ID NO: 1512339 - RNA, 19 nt, Human
ucagugugucuaaauuuga

SEQ ID NO: 1512340 - RNA, 18 nt, Human
ucaguccaugaagaugua

SEQ ID NO: 1512341 - RNA, 15 nt, Human
ucaguccauagcaga

SEQ ID NO: 1512342 - RNA, 21 nt, Human
ucagguggggucacucuggca

SEQ ID NO: 1512343 - RNA, 17 nt, Human
ucagguggggucacucu

SEQ ID NO: 1512344 - RNA, 20 nt, Human
ucagguggggucacucuggc

SEQ ID NO: 1512345 - RNA, 14 nt, Human
ucagguggggcagc

SEQ ID NO: 1512346 - RNA, 18 nt, Human
ucaggugcugccauccag

SEQ ID NO: 1512347 - RNA, 20 nt, Human
ucaggugcugccauccaggu

SEQ ID NO: 1512348 - RNA, 15 nt, Human
ucagguggggcagcu

SEQ ID NO: 1512349 - RNA, 16 nt, Human
ucagguggggcagcuu

SEQ ID NO: 1512350 - RNA, 17 nt, Human
ucagguggggcagcuug

SEQ ID NO: 1512351 - RNA, 17 nt, Human
uauauaacaaugcugua

SEQ ID NO: 1512352 - RNA, 19 nt, Human
uauauaacaaugcuguauu

SEQ ID NO: 1512353 - RNA, 14 nt, Human
uauaucuuguagcu

SEQ ID NO: 1512354 - RNA, 18 nt, Human
uauauaaguauucuaaau

SEQ ID NO: 1512355 - RNA, 16 nt, Human
uauauuuuuuucugaa

SEQ ID NO: 1512356 - RNA, 19 nt, Human
uauauuuuuuucugaaauu

SEQ ID NO: 1512357 - RNA, 20 nt, Human
uauauuuuuuucugaaauuu

SEQ ID NO: 1512358 - RNA, 21 nt, Human
uauauuuuuuguuaaaugauu

SEQ ID NO: 1512359 - RNA, 14 nt, Human
uauaugcuucuguu

SEQ ID NO: 1512360 - RNA, 16 nt, Human
uauaugcuucuguuuu

SEQ ID NO: 1512361 - RNA, 20 nt, Human
uaucaggugcugccauccag

SEQ ID NO: 1512362 - RNA, 14 nt, Human
uaucaaaagaaaga

SEQ ID NO: 1512363 - RNA, 19 nt, Human
uaucaggugcugccaucca

SEQ ID NO: 1512364 - RNA, 18 nt, Human
uauaaaccgaacugaugu

SEQ ID NO: 1512365 - RNA, 11 nt, Human
uauaaacuuua

SEQ ID NO: 1512366 - RNA, 14 nt, Human
uauaaacuuuaccu

SEQ ID NO: 1512367 - RNA, 13 nt, Human
uauaaacuuuacc

SEQ ID NO: 1512368 - RNA, 18 nt, Human
uauaaacuuuaccuuuuu

SEQ ID NO: 1512369 - RNA, 17 nt, Human
uauaaacuuuaccuuuu

SEQ ID NO: 1512370 - RNA, 16 nt, Human
uauaaacuuuaccuuu

SEQ ID NO: 1512371 - RNA, 15 nt, Human
uauaaacuuuaccuu

SEQ ID NO: 1512372 - RNA, 15 nt, Human
uaguuugauuaaauu

SEQ ID NO: 1512373 - RNA, 21 nt, Human
uaguuugauuaaauucuugca

SEQ ID NO: 1512374 - RNA, 16 nt, Human
uaguuugauuaaauuc

SEQ ID NO: 1512375 - RNA, 14 nt, Human
uauaaacacuauau

SEQ ID NO: 1512376 - RNA, 17 nt, Human
uaguauuguccaggucu

SEQ ID NO: 1512377 - RNA, 16 nt, Human
uaguaugguggcuggg

SEQ ID NO: 1512378 - RNA, 20 nt, Human
uaguggcuuaaaacaacacu

SEQ ID NO: 1512379 - RNA, 20 nt, Human
uaguuguuugauucagacag

SEQ ID NO: 1512380 - RNA, 21 nt, Human
uaguuguuugauucagacagc

SEQ ID NO: 1512381 - RNA, 22 nt, Human
uaguuguuugauucagacagcu

SEQ ID NO: 1512382 - RNA, 18 nt, Human
uaguaugaggcauuuguu

SEQ ID NO: 1512383 - RNA, 17 nt, Human
uaguaugaggcauuugu

SEQ ID NO: 1512384 - RNA, 22 nt, Human
uagguuaauuccaauuauauga

SEQ ID NO: 1512385 - RNA, 13 nt, Human
uagguguggggga

SEQ ID NO: 1512386 - RNA, 17 nt, Human
uaggugugggggaagca

SEQ ID NO: 1512387 - RNA, 23 nt, Human
uaggugugacugaauuucuuuug

SEQ ID NO: 1512388 - RNA, 21 nt, Human
uaggugugacugaauuucuuu

SEQ ID NO: 1512389 - RNA, 19 nt, Human
uaggugugacugaauuucu

SEQ ID NO: 1512390 - RNA, 23 nt, Human
uaggugcuacaaaaacacagcaa

SEQ ID NO: 1512391 - RNA, 20 nt, Human
uaggugcuacaaaaacacag

SEQ ID NO: 1512392 - RNA, 22 nt, Human
uaggugcuacaaaaacacagca

SEQ ID NO: 1512393 - RNA, 11 nt, Human
uagggaaaaac

SEQ ID NO: 1512394 - RNA, 11 nt, Human
uaggugacaga

SEQ ID NO: 1512395 - RNA, 16 nt, Human
uaggugacagagugag

SEQ ID NO: 1512396 - RNA, 22 nt, Human
uagcuggucuuauuuguaaagc

SEQ ID NO: 1512397 - RNA, 13 nt, Human
uagcauccuggaa

SEQ ID NO: 1512398 - RNA, 15 nt, Human
uagcauccuggaaua

SEQ ID NO: 1512399 - RNA, 16 nt, Human
uagcauccuggaauau

SEQ ID NO: 1512400 - RNA, 18 nt, Human
uagcauccuggaauaucu

SEQ ID NO: 1512401 - RNA, 19 nt, Human
uagcauacguacacauuuu

SEQ ID NO: 1512402 - RNA, 18 nt, Human
uagcauacguacacauuu

SEQ ID NO: 1512403 - RNA, 17 nt, Human
uagcauacguacacauu

SEQ ID NO: 1512404 - RNA, 16 nt, Human
uagcauacguacacau

SEQ ID NO: 1512405 - RNA, 11 nt, Human
uagcagggaaa

SEQ ID NO: 1512406 - RNA, 14 nt, Human
uagauaggccaugg

SEQ ID NO: 1512407 - RNA, 16 nt, Human
uagauacuguaucaug

SEQ ID NO: 1512408 - RNA, 16 nt, Human
uagccuaggugacaga

SEQ ID NO: 1512409 - RNA, 21 nt, Human
uagcauggcauauuuuucaca

SEQ ID NO: 1512410 - RNA, 15 nt, Human
uagcauggcauauuu

SEQ ID NO: 1512411 - RNA, 17 nt, Human
uagcauggcauauuuuu

SEQ ID NO: 1512412 - RNA, 18 nt, Human
uagcauggcauauuuuuc

SEQ ID NO: 1512413 - RNA, 18 nt, Human
uagccugugccucuggga

SEQ ID NO: 1512414 - RNA, 20 nt, Human
uagccugugccucugggacu

SEQ ID NO: 1512415 - RNA, 12 nt, Human
uagcucauucuc

SEQ ID NO: 1512416 - RNA, 20 nt, Human
uagcucaggugucccugcac

SEQ ID NO: 1512417 - RNA, 21 nt, Human
uagcucaggugucccugcacu

SEQ ID NO: 1512418 - RNA, 15 nt, Human
uagcugggacuacag

SEQ ID NO: 1512419 - RNA, 17 nt, Human
uagcugggacuacaggc

SEQ ID NO: 1512420 - RNA, 19 nt, Human
uagcugggacuacaggcac

SEQ ID NO: 1512421 - RNA, 23 nt, Human
uagaauaccacaggaaccacaag

SEQ ID NO: 1512422 - RNA, 14 nt, Human
uacuuguggacaca

SEQ ID NO: 1512423 - RNA, 15 nt, Human
uagaauuaacacaug

SEQ ID NO: 1512424 - RNA, 16 nt, Human
uagaauuaacacauga

SEQ ID NO: 1512425 - RNA, 18 nt, Human
uagaauuaacacaugauc

SEQ ID NO: 1512426 - RNA, 23 nt, Human
uagaauuaguggcacuugcuuuu

SEQ ID NO: 1512427 - RNA, 11 nt, Human
uagagacaggg

SEQ ID NO: 1512428 - RNA, 15 nt, Human
uagagguucaaagau

SEQ ID NO: 1512429 - RNA, 14 nt, Human
uagagguucaaaga

SEQ ID NO: 1512430 - RNA, 12 nt, Human
uagagugggagc

SEQ ID NO: 1512431 - RNA, 17 nt, Human
uagaguugauacuacag

SEQ ID NO: 1512432 - RNA, 14 nt, Human
uagaguugauacua

SEQ ID NO: 1512433 - RNA, 21 nt, Human
uacauggcuggagcuagaauu

SEQ ID NO: 1512434 - RNA, 14 nt, Human
uacauuuuuaagug

SEQ ID NO: 1512435 - RNA, 22 nt, Human
uacauuuuuaagugcugcauuu

SEQ ID NO: 1512436 - RNA, 19 nt, Human
uacauuuuuaagugcugca

SEQ ID NO: 1512437 - RNA, 14 nt, Human
uacauggaauaaca

SEQ ID NO: 1512438 - RNA, 18 nt, Human
uacauggaauaacaugua

SEQ ID NO: 1512439 - RNA, 19 nt, Human
uacauggaauaacauguaa

SEQ ID NO: 1512440 - RNA, 22 nt, Human
uacauggaauaacauguaauua

SEQ ID NO: 1512441 - RNA, 16 nt, Human
uacauaaacaaguccu

SEQ ID NO: 1512442 - RNA, 21 nt, Human
uacaguuuguuaguaugaggc

SEQ ID NO: 1512443 - RNA, 19 nt, Human
uacaguuuguuaguaugag

SEQ ID NO: 1512444 - RNA, 23 nt, Human
uacaugaaaacacauuuuucuua

SEQ ID NO: 1512445 - RNA, 19 nt, Human
uacaugaaaacacauuuuu

SEQ ID NO: 1512446 - RNA, 18 nt, Human
uacaugaaaacacauuuu

SEQ ID NO: 1512447 - RNA, 17 nt, Human
uacaugaaaacacauuu

SEQ ID NO: 1512448 - RNA, 16 nt, Human
uacaugaaaacacauu

SEQ ID NO: 1512449 - RNA, 16 nt, Human
uacauaagauaaaugu

SEQ ID NO: 1512450 - RNA, 17 nt, Human
uacauaagauaaaugug

SEQ ID NO: 1512451 - RNA, 23 nt, Human
uacaguucggugagcuacaaaug

SEQ ID NO: 1512452 - RNA, 14 nt, Human
uacaggauuugaaa

SEQ ID NO: 1512453 - RNA, 14 nt, Human
uacaggaaguacug

SEQ ID NO: 1512454 - RNA, 15 nt, Human
uacaggaaguacugg

SEQ ID NO: 1512455 - RNA, 22 nt, Human
uacaggaaguacuggagaaaau

SEQ ID NO: 1512456 - RNA, 15 nt, Human
uacaggagugagcac

SEQ ID NO: 1512457 - RNA, 18 nt, Human
uacaguuuguuaguauga

SEQ ID NO: 1512458 - RNA, 20 nt, Human
uacaguugaaaaacagcuga

SEQ ID NO: 1512459 - RNA, 21 nt, Human
uacagcuugaccgugaggcca

SEQ ID NO: 1512460 - RNA, 17 nt, Human
uacaguugaaaaacagc

SEQ ID NO: 1512461 - RNA, 19 nt, Human
uacaguugaaaaacagcug

SEQ ID NO: 1512462 - RNA, 20 nt, Human
uacagcuccuuugaaaacuc

SEQ ID NO: 1512463 - RNA, 14 nt, Human
uacagcuccuuuga

SEQ ID NO: 1512464 - RNA, 20 nt, Human
uacagcuugaccgugaggcc

SEQ ID NO: 1512465 - RNA, 18 nt, Human
uacaggaagguagaaaua

SEQ ID NO: 1512466 - RNA, 13 nt, Human
uacaggaaguacu

SEQ ID NO: 1512467 - RNA, 22 nt, Human
uacacuguuucaaacuuuacua

SEQ ID NO: 1512468 - RNA, 16 nt, Human
uacacuuacacuuuau

SEQ ID NO: 1512469 - RNA, 20 nt, Human
uacacuguuucaaacuuuac

SEQ ID NO: 1512470 - RNA, 22 nt, Human
uacacugugcugagucugaagg

SEQ ID NO: 1512471 - RNA, 23 nt, Human
uacacugugcugagucugaaggc

SEQ ID NO: 1512472 - RNA, 11 nt, Human
uacacacacac

SEQ ID NO: 1512473 - RNA, 21 nt, Human
uacacugugcugagucugaag

SEQ ID NO: 1512474 - RNA, 15 nt, Human
uacacacugcauguu

SEQ ID NO: 1512475 - RNA, 17 nt, Human
uacacacucaaaucaag

SEQ ID NO: 1512476 - RNA, 17 nt, Human
uacacacugcauguuug

SEQ ID NO: 1512477 - RNA, 16 nt, Human
uacacacucaaaucaa

SEQ ID NO: 1512478 - RNA, 18 nt, Human
uaauuuugugaagcaaaa

SEQ ID NO: 1512479 - RNA, 12 nt, Human
uaauuuuuauau

SEQ ID NO: 1512480 - RNA, 16 nt, Human
uaauuuuuauauuuga

SEQ ID NO: 1512481 - RNA, 17 nt, Human
uaauuuuuauauuugaa

SEQ ID NO: 1512482 - RNA, 18 nt, Human
uacaaacaaaauuucuau

SEQ ID NO: 1512483 - RNA, 17 nt, Human
uacaaacaugugguuaa

SEQ ID NO: 1512484 - RNA, 14 nt, Human
uacaaaguagaagu

SEQ ID NO: 1512485 - RNA, 18 nt, Human
uacaaaguagaagucuua

SEQ ID NO: 1512486 - RNA, 22 nt, Human
uaccaaaaaucucaauauuuca

SEQ ID NO: 1512487 - RNA, 14 nt, Human
uacccagaaaguua

SEQ ID NO: 1512488 - RNA, 23 nt, Human
uacauuuuuaagugcugcauuua

SEQ ID NO: 1512489 - RNA, 22 nt, Human
uaccuaacgaaguauccuucag

SEQ ID NO: 1512490 - RNA, 16 nt, Human
uacccagcgagcccug

SEQ ID NO: 1512491 - RNA, 16 nt, Human
uaccuaucaucuuaag

SEQ ID NO: 1512492 - RNA, 15 nt, Human
uaccuacauacaauu

SEQ ID NO: 1512493 - RNA, 18 nt, Human
uaccucggugccuuccuc

SEQ ID NO: 1512494 - RNA, 21 nt, Human
uaccucuugagccuugaacuu

SEQ ID NO: 1512495 - RNA, 22 nt, Human
uaccuuuuuuagaguugauacu

SEQ ID NO: 1512496 - RNA, 19 nt, Human
uaccuuuuuuagaguugau

SEQ ID NO: 1512497 - RNA, 13 nt, Human
uaccuuuuuuaga

SEQ ID NO: 1512498 - RNA, 17 nt, Human
uaccuuuuuuauacaua

SEQ ID NO: 1512499 - RNA, 16 nt, Human
uaccuuuuuuauacau

SEQ ID NO: 1512500 - RNA, 13 nt, Human
uaccuuuuuuaua

SEQ ID NO: 1512501 - RNA, 18 nt, Human
uacgaaaagaggggaaga

SEQ ID NO: 1512502 - RNA, 21 nt, Human
uacgaaaagaggggaagagac

SEQ ID NO: 1512503 - RNA, 14 nt, Human
uacuaaggaaucuu

SEQ ID NO: 1512504 - RNA, 21 nt, Human
uacuaauagacaauuuauuau

SEQ ID NO: 1512505 - RNA, 22 nt, Human
uacuaauaaaauuuaaaagucu

SEQ ID NO: 1512506 - RNA, 17 nt, Human
uacuaaccagcagaaau

SEQ ID NO: 1512507 - RNA, 16 nt, Human
uacuguccuacccacc

SEQ ID NO: 1512508 - RNA, 23 nt, Human
uacugucagcuccccucggagaa

SEQ ID NO: 1512509 - RNA, 21 nt, Human
uacugucuucaguaagccgug

SEQ ID NO: 1512510 - RNA, 13 nt, Human
uacuuguggacac

SEQ ID NO: 1512511 - RNA, 13 nt, Human
uacuuaacuauuc

SEQ ID NO: 1512512 - RNA, 16 nt, Human
uacucuacccucuuag

SEQ ID NO: 1512513 - RNA, 12 nt, Human
uacucccaucug

SEQ ID NO: 1512514 - RNA, 22 nt, Human
uacucgaguuacagacaaagcg

SEQ ID NO: 1512515 - RNA, 18 nt, Human
uacucgaguuacagacaa

SEQ ID NO: 1512516 - RNA, 20 nt, Human
uacuacaguuuguuaguaug

SEQ ID NO: 1512517 - RNA, 14 nt, Human
uacuacaguuuguu

SEQ ID NO: 1512518 - RNA, 13 nt, Human
uacuacaguuugu

SEQ ID NO: 1512519 - RNA, 22 nt, Human
uacuacaguccucccaucucac

SEQ ID NO: 1512520 - RNA, 18 nt, Human
uaagucauucauaaaccu

SEQ ID NO: 1512521 - RNA, 13 nt, Human
uaagugaaauaag

SEQ ID NO: 1512522 - RNA, 12 nt, Human
uaagugagagag

SEQ ID NO: 1512523 - RNA, 23 nt, Human
uaagugaggaugaaaaaauaaca

SEQ ID NO: 1512524 - RNA, 14 nt, Human
uaagugcugcauuu

SEQ ID NO: 1512525 - RNA, 19 nt, Human
uaauaaauauuuuugccau

SEQ ID NO: 1512526 - RNA, 21 nt, Human
uaauaacugugaaguuuacau

SEQ ID NO: 1512527 - RNA, 22 nt, Human
uaagugcugcauuuaaaagaua

SEQ ID NO: 1512528 - RNA, 18 nt, Human
uaagugcugcauuuaaaa

SEQ ID NO: 1512529 - RNA, 16 nt, Human
uaagugcugcauuuaa

SEQ ID NO: 1512530 - RNA, 15 nt, Human
uaagugcugcauuua

SEQ ID NO: 1512531 - RNA, 22 nt, Human
uaagugguucuuugguuccagu

SEQ ID NO: 1512532 - RNA, 14 nt, Human
uaagcuauucagua

SEQ ID NO: 1512533 - RNA, 22 nt, Human
uaagaggcagggucucacucug

SEQ ID NO: 1512534 - RNA, 12 nt, Human
uaagaggcaggg

SEQ ID NO: 1512535 - RNA, 15 nt, Human
uaagaggcagggucu

SEQ ID NO: 1512536 - RNA, 17 nt, Human
uaaggguaucuggugac

SEQ ID NO: 1512537 - RNA, 18 nt, Human
uaagguuaccuuuguucc

SEQ ID NO: 1512538 - RNA, 15 nt, Human
uaaggugugcucuga

SEQ ID NO: 1512539 - RNA, 20 nt, Human
uaagguggguacgggagggu

SEQ ID NO: 1512540 - RNA, 14 nt, Human
uaauaauguuucaa

SEQ ID NO: 1512541 - RNA, 18 nt, Human
uaauaugcacacauuuuu

SEQ ID NO: 1512542 - RNA, 17 nt, Human
uaauaugcacacauuuu

SEQ ID NO: 1512543 - RNA, 16 nt, Human
uaauaugcacacauuu

SEQ ID NO: 1512544 - RNA, 15 nt, Human
uaauaugcacacauu

SEQ ID NO: 1512545 - RNA, 19 nt, Human
uaauaugcacacauuuuuu

SEQ ID NO: 1512546 - RNA, 13 nt, Human
uaaucuaaaugga

SEQ ID NO: 1512547 - RNA, 20 nt, Human
uaauccucuaggaggucucu

SEQ ID NO: 1512548 - RNA, 20 nt, Human
uaauauuaaggaagacaaug

SEQ ID NO: 1512549 - RNA, 17 nt, Human
uaaugauaacuggaaac

SEQ ID NO: 1512550 - RNA, 22 nt, Human
uaaugauaacuggaaacuucag

SEQ ID NO: 1512551 - RNA, 23 nt, Human
uaaugauaacuggaaacuucagc

SEQ ID NO: 1512552 - RNA, 15 nt, Human
uaaugcgugcauacc

SEQ ID NO: 1512553 - RNA, 23 nt, Human
uaaugcgugcauaccacuuuugu

SEQ ID NO: 1512554 - RNA, 22 nt, Human
uaaugcgugcauaccacuuuug

SEQ ID NO: 1512555 - RNA, 19 nt, Human
uaaugcgugcauaccacuu

SEQ ID NO: 1512556 - RNA, 15 nt, Human
uaauggggcggugag

SEQ ID NO: 1512557 - RNA, 22 nt, Human
uaauguuucaaacauauauaac

SEQ ID NO: 1512558 - RNA, 14 nt, Human
uaauuaaguacuau

SEQ ID NO: 1512559 - RNA, 17 nt, Human
uaauuaaguacuaugua

SEQ ID NO: 1512560 - RNA, 20 nt, Human
uaauuaaguacuauguauca

SEQ ID NO: 1512561 - RNA, 13 nt, Human
uaaauucuuucau

SEQ ID NO: 1512562 - RNA, 20 nt, Human
uaaauugacacuuaaaaaug

SEQ ID NO: 1512563 - RNA, 23 nt, Human
uaaauugacacuuaaaaaugguu

SEQ ID NO: 1512564 - RNA, 22 nt, Human
uaaauuuaguauuuuguuucag

SEQ ID NO: 1512565 - RNA, 22 nt, Human
uaaauuugaauguuaagcagau

SEQ ID NO: 1512566 - RNA, 14 nt, Human
uaaauuugaauguu

SEQ ID NO: 1512567 - RNA, 18 nt, Human
uaacaccaugauuaacca

SEQ ID NO: 1512568 - RNA, 16 nt, Human
uaaauucuugcaaagu

SEQ ID NO: 1512569 - RNA, 22 nt, Human
uaaauucuugcaaaguaucccu

SEQ ID NO: 1512570 - RNA, 18 nt, Human
uaaauucuugcaaaguau

SEQ ID NO: 1512571 - RNA, 17 nt, Human
uaaauucuugcaaagua

SEQ ID NO: 1512572 - RNA, 16 nt, Human
uaaaugugccuucauu

SEQ ID NO: 1512573 - RNA, 16 nt, Human
uaaaugugcuuuuaaa

SEQ ID NO: 1512574 - RNA, 11 nt, Human
uaaauuauuuu

SEQ ID NO: 1512575 - RNA, 20 nt, Human
uaaaugucuaguuguaacac

SEQ ID NO: 1512576 - RNA, 22 nt, Human
uaaaugucucuuuaaugucaca

SEQ ID NO: 1512577 - RNA, 20 nt, Human
uaaauggcuuccuggcaaua

SEQ ID NO: 1512578 - RNA, 17 nt, Human
uaaaugggggugcauuu

SEQ ID NO: 1512579 - RNA, 14 nt, Human
uaaaugggggugca

SEQ ID NO: 1512580 - RNA, 19 nt, Human
uaaaugggggugcauuuga

SEQ ID NO: 1512581 - RNA, 18 nt, Human
uaaaugggggugcauuug

SEQ ID NO: 1512582 - RNA, 13 nt, Human
uaaaugcccagcc

SEQ ID NO: 1512583 - RNA, 16 nt, Human
uaaauggaaccacucu

SEQ ID NO: 1512584 - RNA, 14 nt, Human
uaaaugcccagccc

SEQ ID NO: 1512585 - RNA, 15 nt, Human
uaaaugcccagcccc

SEQ ID NO: 1512586 - RNA, 16 nt, Human
uaaaugcccagccccu

SEQ ID NO: 1512587 - RNA, 17 nt, Human
uaaaugcccagccccuu

SEQ ID NO: 1512588 - RNA, 14 nt, Human
uaagagagaaugag

SEQ ID NO: 1512589 - RNA, 23 nt, Human
uaagagagaaugagagacacacu

SEQ ID NO: 1512590 - RNA, 22 nt, Human
uaagaaccuuuugagugccuua

SEQ ID NO: 1512591 - RNA, 13 nt, Human
uaagagagaauga

SEQ ID NO: 1512592 - RNA, 19 nt, Human
uaagaaccuuuugagugcc

SEQ ID NO: 1512593 - RNA, 21 nt, Human
uaagaaaauaucacuugucaa

SEQ ID NO: 1512594 - RNA, 24 nt, Human
uaagaaagacuaucuaaauguuga

SEQ ID NO: 1512595 - RNA, 15 nt, Human
uaacuggaaacuuca

SEQ ID NO: 1512596 - RNA, 17 nt, Human
uaacugugaaguuuaca

SEQ ID NO: 1512597 - RNA, 18 nt, Human
uaacugugaaguuuacau

SEQ ID NO: 1512598 - RNA, 18 nt, Human
uaagaaaaaggaugcaca

SEQ ID NO: 1512599 - RNA, 16 nt, Human
uaagaaaaaggaugca

SEQ ID NO: 1512600 - RNA, 23 nt, Human
uaagaaaaaggaugcacagaguu

SEQ ID NO: 1512601 - RNA, 19 nt, Human
uaagaaaaaggaugcacag

SEQ ID NO: 1512602 - RNA, 14 nt, Human
uaacucaauauuuu

SEQ ID NO: 1512603 - RNA, 22 nt, Human
uaacucaauauuuuccaugaaa

SEQ ID NO: 1512604 - RNA, 16 nt, Human
uaaccacuucagcuga

SEQ ID NO: 1512605 - RNA, 23 nt, Human
uaaccaguguuguggauuuaaca

SEQ ID NO: 1512606 - RNA, 12 nt, Human
uaacagaaaugu

SEQ ID NO: 1512607 - RNA, 11 nt, Human
uaacagaaaug

SEQ ID NO: 1512608 - RNA, 20 nt, Human
guuuagcuggaaaaguaugu

SEQ ID NO: 1512609 - RNA, 21 nt, Human
guuuagcuggaaaaguauguu

SEQ ID NO: 1512610 - RNA, 20 nt, Human
guuuaggauguugaaaaagu

SEQ ID NO: 1512611 - RNA, 20 nt, Human
guuuauauaagcuuguauuc

SEQ ID NO: 1512612 - RNA, 15 nt, Human
guuuagauaauacac

SEQ ID NO: 1512613 - RNA, 14 nt, Human
guuuagauaauaca

SEQ ID NO: 1512614 - RNA, 15 nt, Human
guuguuacauuuuua

SEQ ID NO: 1512615 - RNA, 14 nt, Human
guuguuacauuuuu

SEQ ID NO: 1512616 - RNA, 20 nt, Human
guuguuugauucagacagcu

SEQ ID NO: 1512617 - RNA, 19 nt, Human
guugucugcaacucugaag

SEQ ID NO: 1512618 - RNA, 14 nt, Human
guugugaauguugu

SEQ ID NO: 1512619 - RNA, 22 nt, Human
guuguggauuuaacagaaaugu

SEQ ID NO: 1512620 - RNA, 14 nt, Human
guugugguuaaucu

SEQ ID NO: 1512621 - RNA, 12 nt, Human
guugucagcuga

SEQ ID NO: 1512622 - RNA, 23 nt, Human
guuggcugggggccucagugcca

SEQ ID NO: 1512623 - RNA, 19 nt, Human
guuggcugggggccucagu

SEQ ID NO: 1512624 - RNA, 12 nt, Human
guuggcuggggg

SEQ ID NO: 1512625 - RNA, 20 nt, Human
guuggccccugcccggcugc

SEQ ID NO: 1512626 - RNA, 13 nt, Human
guuggccccugcc

SEQ ID NO: 1512627 - RNA, 14 nt, Human
guuggccccugccc

SEQ ID NO: 1512628 - RNA, 17 nt, Human
guuuucaaaauaaaaau

SEQ ID NO: 1512629 - RNA, 11 nt, Human
guuuucacucu

SEQ ID NO: 1512630 - RNA, 12 nt, Human
guuuucacucuu

SEQ ID NO: 1512631 - RNA, 20 nt, Human
guuuguuucugaaagggacg

SEQ ID NO: 1512632 - RNA, 14 nt, Human
guuuuguuccccuc

SEQ ID NO: 1512633 - RNA, 15 nt, Human
guuuuguuccccucc

SEQ ID NO: 1512634 - RNA, 16 nt, Human
guuuuguuccccuccu

SEQ ID NO: 1512635 - RNA, 17 nt, Human
guuuuguuccccuccuc

SEQ ID NO: 1512636 - RNA, 22 nt, Human
guuuuguuccccuccuccacuc

SEQ ID NO: 1512637 - RNA, 20 nt, Human
guuuuguuccccuccuccac

SEQ ID NO: 1512638 - RNA, 21 nt, Human
guuuuguuccccuccuccacu

SEQ ID NO: 1512639 - RNA, 13 nt, Human
guuuuccugaaga

SEQ ID NO: 1512640 - RNA, 19 nt, Human
guuuuccaugaguccccug

SEQ ID NO: 1512641 - RNA, 20 nt, Human
guuuuccaugaguccccugu

SEQ ID NO: 1512642 - RNA, 17 nt, Human
guuugagaucagccugg

SEQ ID NO: 1512643 - RNA, 23 nt, Human
guuugauuaaauucuugcaaagu

SEQ ID NO: 1512644 - RNA, 18 nt, Human
guuugagaucagccuggg

SEQ ID NO: 1512645 - RNA, 16 nt, Human
guuugauucagacagc

SEQ ID NO: 1512646 - RNA, 20 nt, Human
guuugauucagacagcugcc

SEQ ID NO: 1512647 - RNA, 21 nt, Human
guuugauucagacagcugccu

SEQ ID NO: 1512648 - RNA, 15 nt, Human
uaaaauccauacauu

SEQ ID NO: 1512649 - RNA, 17 nt, Human
uaaaauccauacauuug

SEQ ID NO: 1512650 - RNA, 18 nt, Human
uaaaaucauuucugcauc

SEQ ID NO: 1512651 - RNA, 22 nt, Human
uaaaaucauuucugcaucagcu

SEQ ID NO: 1512652 - RNA, 19 nt, Human
uaaaaggugaccaaugaug

SEQ ID NO: 1512653 - RNA, 12 nt, Human
uaaaaggugacc

SEQ ID NO: 1512654 - RNA, 10 nt, Human
uaaaaucauu

SEQ ID NO: 1512655 - RNA, 13 nt, Human
uaaaaucauuucu

SEQ ID NO: 1512656 - RNA, 12 nt, Human
uaaaaggagcca

SEQ ID NO: 1512657 - RNA, 21 nt, Human
uaaaagguaugcaaucaaauc

SEQ ID NO: 1512658 - RNA, 13 nt, Human
uaaaaccacagca

SEQ ID NO: 1512659 - RNA, 21 nt, Human
uaaaagauacaguuacucaga

SEQ ID NO: 1512660 - RNA, 14 nt, Human
uaaaagauacaguu

SEQ ID NO: 1512661 - RNA, 20 nt, Human
uaaaagauacaguuacucag

SEQ ID NO: 1512662 - RNA, 17 nt, Human
uaaaagauacaguuacu

SEQ ID NO: 1512663 - RNA, 13 nt, Human
uaaaaacaacuuu

SEQ ID NO: 1512664 - RNA, 18 nt, Human
uaaaaacaacuuuauacc

SEQ ID NO: 1512665 - RNA, 19 nt, Human
uaaaaacaacuuuauaccc

SEQ ID NO: 1512666 - RNA, 21 nt, Human
uaaaaagacauucuuccaaaa

SEQ ID NO: 1512667 - RNA, 18 nt, Human
uaaaaaugguuuaaaugg

SEQ ID NO: 1512668 - RNA, 19 nt, Human
uaaaaagccugcaauuuca

SEQ ID NO: 1512669 - RNA, 19 nt, Human
uaaaaaugguuuaaauggu

SEQ ID NO: 1512670 - RNA, 22 nt, Human
uaaaacaagcacuaaacaaaga

SEQ ID NO: 1512671 - RNA, 15 nt, Human
uaaaacaacacucac

SEQ ID NO: 1512672 - RNA, 17 nt, Human
uaaaacacaacaucuuu

SEQ ID NO: 1512673 - RNA, 22 nt, Human
uaaaacacaacaucuuuuucua

SEQ ID NO: 1512674 - RNA, 23 nt, Human
uaaaacacaacaucuuuuucuac

SEQ ID NO: 1512675 - RNA, 14 nt, Human
uaaaggaauuuaaa

SEQ ID NO: 1512676 - RNA, 15 nt, Human
uaaaggcuaccuuug

SEQ ID NO: 1512677 - RNA, 20 nt, Human
uaaagccugaguuugcuuuc

SEQ ID NO: 1512678 - RNA, 14 nt, Human
uaaaguguuugaaa

SEQ ID NO: 1512679 - RNA, 17 nt, Human
uaaaggcuaccuuugua

SEQ ID NO: 1512680 - RNA, 15 nt, Human
uaaaguuaguaaaga

SEQ ID NO: 1512681 - RNA, 19 nt, Human
uaaagcagcguuucuauga

SEQ ID NO: 1512682 - RNA, 17 nt, Human
uaaagcagcguuucuau

SEQ ID NO: 1512683 - RNA, 16 nt, Human
uaaagcagcguuucua

SEQ ID NO: 1512684 - RNA, 12 nt, Human
uaaagaaaacug

SEQ ID NO: 1512685 - RNA, 18 nt, Human
uaaagaaaaucucuguga

SEQ ID NO: 1512686 - RNA, 21 nt, Human
uaaagaaaaguuuaccaucug

SEQ ID NO: 1512687 - RNA, 20 nt, Human
uaaacaagaccacguuucua

SEQ ID NO: 1512688 - RNA, 22 nt, Human
uaaacaagaccacguuucuaaa

SEQ ID NO: 1512689 - RNA, 21 nt, Human
uaaacaagaccacguuucuaa

SEQ ID NO: 1512690 - RNA, 19 nt, Human
uaaaccaaggcuagaacca

SEQ ID NO: 1512691 - RNA, 13 nt, Human
uaaacuuaaucua

SEQ ID NO: 1512692 - RNA, 22 nt, Human
uaaacuugguuuuuaaaaaacu

SEQ ID NO: 1512693 - RNA, 18 nt, Human
guucggauuuggggugga

SEQ ID NO: 1512694 - RNA, 12 nt, Human
guucugaagaag

SEQ ID NO: 1512695 - RNA, 13 nt, Human
guucugaagaaga

SEQ ID NO: 1512696 - RNA, 14 nt, Human
guucugaagaagau

SEQ ID NO: 1512697 - RNA, 15 nt, Human
guucugaagaagaug

SEQ ID NO: 1512698 - RNA, 19 nt, Human
guucugauccuaguuccac

SEQ ID NO: 1512699 - RNA, 23 nt, Human
guugaaaagacuccaaagaaaug

SEQ ID NO: 1512700 - RNA, 17 nt, Human
guugaaaagacuccaaa

SEQ ID NO: 1512701 - RNA, 22 nt, Human
guugaaaagacuccaaagaaau

SEQ ID NO: 1512702 - RNA, 17 nt, Human
guugaaaaacagcugag

SEQ ID NO: 1512703 - RNA, 20 nt, Human
guucuuuccaaaguacacug

SEQ ID NO: 1512704 - RNA, 18 nt, Human
guucuuuccaaaguacac

SEQ ID NO: 1512705 - RNA, 14 nt, Human
guucuuuccaaagu

SEQ ID NO: 1512706 - RNA, 13 nt, Human
guucuuuccaaag

SEQ ID NO: 1512707 - RNA, 23 nt, Human
guucuggcagaguugaagacaga

SEQ ID NO: 1512708 - RNA, 12 nt, Human
guucuggcucuu

SEQ ID NO: 1512709 - RNA, 16 nt, Human
guucuggcucuuccag

SEQ ID NO: 1512710 - RNA, 20 nt, Human
guucuggcucuuccaggcug

SEQ ID NO: 1512711 - RNA, 11 nt, Human
guucugggaca

SEQ ID NO: 1512712 - RNA, 12 nt, Human
guucugggacac

SEQ ID NO: 1512713 - RNA, 14 nt, Human
guucugggacacag

SEQ ID NO: 1512714 - RNA, 15 nt, Human
guucugggacacagu

SEQ ID NO: 1512715 - RNA, 16 nt, Human
guucugggacacaguu

SEQ ID NO: 1512716 - RNA, 23 nt, Human
guucugggacacaguucaauucu

SEQ ID NO: 1512717 - RNA, 18 nt, Human
guucuuucacccuuuucu

SEQ ID NO: 1512718 - RNA, 20 nt, Human
guugauggugguauguuuuc

SEQ ID NO: 1512719 - RNA, 21 nt, Human
guugauggugguauguuuuca

SEQ ID NO: 1512720 - RNA, 18 nt, Human
guugaagagguuuuaaag

SEQ ID NO: 1512721 - RNA, 16 nt, Human
guugaagacagagcua

SEQ ID NO: 1512722 - RNA, 15 nt, Human
guugcaggaccucag

SEQ ID NO: 1512723 - RNA, 12 nt, Human
guugcccaggca

SEQ ID NO: 1512724 - RNA, 15 nt, Human
guugcccaggcaggu

SEQ ID NO: 1512725 - RNA, 14 nt, Human
guugcccaggcagg

SEQ ID NO: 1512726 - RNA, 13 nt, Human
guugccagucacc

SEQ ID NO: 1512727 - RNA, 14 nt, Human
guugccagucaccc

SEQ ID NO: 1512728 - RNA, 16 nt, Human
guugccagucaccccg

SEQ ID NO: 1512729 - RNA, 17 nt, Human
guugccagucaccccgg

SEQ ID NO: 1512730 - RNA, 18 nt, Human
guugccagucaccccggc

SEQ ID NO: 1512731 - RNA, 23 nt, Human
guugccagucaccccggccaccu

SEQ ID NO: 1512732 - RNA, 13 nt, Human
guuggccaggcug

SEQ ID NO: 1512733 - RNA, 15 nt, Human
guuggccaggcuggu

SEQ ID NO: 1512734 - RNA, 14 nt, Human
guuggccaggcugg

SEQ ID NO: 1512735 - RNA, 17 nt, Human
guuggccaggcuggucu

SEQ ID NO: 1512736 - RNA, 19 nt, Human
guuggccaggcuggucuca

SEQ ID NO: 1512737 - RNA, 14 nt, Human
guuggccaguguga

SEQ ID NO: 1512738 - RNA, 23 nt, Human
guuggccaaagccaaagcuaggc

SEQ ID NO: 1512739 - RNA, 14 nt, Human
guuggcaaaaaggc

SEQ ID NO: 1512740 - RNA, 18 nt, Human
guuggcaaaaaggcagga

SEQ ID NO: 1512741 - RNA, 23 nt, Human
guuaccucugccucagaaaacaa

SEQ ID NO: 1512742 - RNA, 16 nt, Human
guuacccaaauuaaga

SEQ ID NO: 1512743 - RNA, 23 nt, Human
guuaccauuuugggguacccacu

SEQ ID NO: 1512744 - RNA, 21 nt, Human
guuacauuuuuaagugcugca

SEQ ID NO: 1512745 - RNA, 20 nt, Human
guuacauauuauauguucua

SEQ ID NO: 1512746 - RNA, 18 nt, Human
guuacauaagauaaaugu

SEQ ID NO: 1512747 - RNA, 19 nt, Human
guuacauaagauaaaugug

SEQ ID NO: 1512748 - RNA, 15 nt, Human
guuacagacaaagcg

SEQ ID NO: 1512749 - RNA, 17 nt, Human
guuacagacaaagcgug

SEQ ID NO: 1512750 - RNA, 22 nt, Human
guuacuaaguuuuuauggcuuu

SEQ ID NO: 1512751 - RNA, 15 nt, Human
guuacucagaauucu

SEQ ID NO: 1512752 - RNA, 22 nt, Human
guuaguuucuccaagcaggaca

SEQ ID NO: 1512753 - RNA, 16 nt, Human
guuaguuucuccaagc

SEQ ID NO: 1512754 - RNA, 19 nt, Human
guuaguuucuccaagcagg

SEQ ID NO: 1512755 - RNA, 21 nt, Human
guuaugacuccagaauuuccc

SEQ ID NO: 1512756 - RNA, 17 nt, Human
guuauuauauuuacaaa

SEQ ID NO: 1512757 - RNA, 19 nt, Human
guucaagcgauucuucugc

SEQ ID NO: 1512758 - RNA, 19 nt, Human
guuauuaaaaaucucaaau

SEQ ID NO: 1512759 - RNA, 18 nt, Human
guucaauaauaaauauuu

SEQ ID NO: 1512760 - RNA, 20 nt, Human
guucaagcgauucuucugcu

SEQ ID NO: 1512761 - RNA, 23 nt, Human
guucaauucucauuugucacaca

SEQ ID NO: 1512762 - RNA, 16 nt, Human
guucaauucucauuug

SEQ ID NO: 1512763 - RNA, 12 nt, Human
guucaugaaaga

SEQ ID NO: 1512764 - RNA, 18 nt, Human
guucaucuugaauuguaa

SEQ ID NO: 1512765 - RNA, 12 nt, Human
guucaucuugaa

SEQ ID NO: 1512766 - RNA, 13 nt, Human
guucaucuugaau

SEQ ID NO: 1512767 - RNA, 16 nt, Human
guucaucaaugaauga

SEQ ID NO: 1512768 - RNA, 17 nt, Human
guucaucauccuaagcu

SEQ ID NO: 1512769 - RNA, 19 nt, Human
guucacugcaaccuccgcc

SEQ ID NO: 1512770 - RNA, 17 nt, Human
guuccaccaucaagcca

SEQ ID NO: 1512771 - RNA, 20 nt, Human
guuccaccaucaagccacca

SEQ ID NO: 1512772 - RNA, 22 nt, Human
guuccucauuagcauuuugcua

SEQ ID NO: 1512773 - RNA, 14 nt, Human
guuccuaauccucu

SEQ ID NO: 1512774 - RNA, 21 nt, Human
guguggggccaugccuccuca

SEQ ID NO: 1512775 - RNA, 23 nt, Human
guguggagaagccacaggccuga

SEQ ID NO: 1512776 - RNA, 22 nt, Human
guguggagaagccacaggccug

SEQ ID NO: 1512777 - RNA, 21 nt, Human
guguggagaagcggcuggcag

SEQ ID NO: 1512778 - RNA, 13 nt, Human
guguggagaagcg

SEQ ID NO: 1512779 - RNA, 12 nt, Human
gugugcucugau

SEQ ID NO: 1512780 - RNA, 15 nt, Human
gugugcucugaucau

SEQ ID NO: 1512781 - RNA, 22 nt, Human
gugugcucugaucauccacugu

SEQ ID NO: 1512782 - RNA, 22 nt, Human
gugucucuugguccugcugcag

SEQ ID NO: 1512783 - RNA, 18 nt, Human
gugucucuugguccugcu

SEQ ID NO: 1512784 - RNA, 19 nt, Human
gugucucuugguccugcug

SEQ ID NO: 1512785 - RNA, 20 nt, Human
gugucucuugguccugcugc

SEQ ID NO: 1512786 - RNA, 21 nt, Human
gugucucuugguccugcugca

SEQ ID NO: 1512787 - RNA, 15 nt, Human
gugucgggcaugaca

SEQ ID NO: 1512788 - RNA, 18 nt, Human
guguccccugacagggcc

SEQ ID NO: 1512789 - RNA, 23 nt, Human
gugucccugcacuugcagacucu

SEQ ID NO: 1512790 - RNA, 14 nt, Human
guguccggucccug

SEQ ID NO: 1512791 - RNA, 13 nt, Human
gugucuccaaccc

SEQ ID NO: 1512792 - RNA, 17 nt, Human
gugucuccaacccccca

SEQ ID NO: 1512793 - RNA, 17 nt, Human
gugucucccuucauccu

SEQ ID NO: 1512794 - RNA, 14 nt, Human
gugucucuuggucc

SEQ ID NO: 1512795 - RNA, 18 nt, Human
gugucuccaaccccccag

SEQ ID NO: 1512796 - RNA, 19 nt, Human
gugucuccaaccccccagc

SEQ ID NO: 1512797 - RNA, 21 nt, Human
gugucuccaaccccccagcac

SEQ ID NO: 1512798 - RNA, 13 nt, Human
guuacagacaaag

SEQ ID NO: 1512799 - RNA, 15 nt, Human
guuacacuaaaaggu

SEQ ID NO: 1512800 - RNA, 16 nt, Human
guuacacuaaaaggug

SEQ ID NO: 1512801 - RNA, 22 nt, Human
guuaaaauaccagccaguaaau

SEQ ID NO: 1512802 - RNA, 20 nt, Human
guuaaaagaugaaaauauuu

SEQ ID NO: 1512803 - RNA, 14 nt, Human
guuaaaagaugaaa

SEQ ID NO: 1512804 - RNA, 16 nt, Human
guuaaaagaugaaaau

SEQ ID NO: 1512805 - RNA, 15 nt, Human
guguuuuuaacucaa

SEQ ID NO: 1512806 - RNA, 12 nt, Human
guguuacuaagu

SEQ ID NO: 1512807 - RNA, 14 nt, Human
guguuacuaaguuu

SEQ ID NO: 1512808 - RNA, 23 nt, Human
guguuacuagccucaaaauacau

SEQ ID NO: 1512809 - RNA, 18 nt, Human
guguuaugacuccagaau

SEQ ID NO: 1512810 - RNA, 13 nt, Human
gugucccugcacu

SEQ ID NO: 1512811 - RNA, 16 nt, Human
gugucccugcacuugc

SEQ ID NO: 1512812 - RNA, 18 nt, Human
gugucccugcacuugcag

SEQ ID NO: 1512813 - RNA, 17 nt, Human
guguacauggaauaaca

SEQ ID NO: 1512814 - RNA, 22 nt, Human
guguacauggaauaacauguaa

SEQ ID NO: 1512815 - RNA, 15 nt, Human
guguacuuaacuauu

SEQ ID NO: 1512816 - RNA, 17 nt, Human
guguaagacaaaaagcu

SEQ ID NO: 1512817 - RNA, 19 nt, Human
guggugcgaucuggguuca

SEQ ID NO: 1512818 - RNA, 18 nt, Human
guggugaccccaggaggg

SEQ ID NO: 1512819 - RNA, 21 nt, Human
guguaaguagauaggccaugg

SEQ ID NO: 1512820 - RNA, 21 nt, Human
guguaaguauucuuauuuaau

SEQ ID NO: 1512821 - RNA, 16 nt, Human
guggugaccccaggag

SEQ ID NO: 1512822 - RNA, 21 nt, Human
guggugagaggcauccaguau

SEQ ID NO: 1512823 - RNA, 14 nt, Human
guggugaccucugc

SEQ ID NO: 1512824 - RNA, 17 nt, Human
guggugaccucugccug

SEQ ID NO: 1512825 - RNA, 17 nt, Human
gugguagagugugccug

SEQ ID NO: 1512826 - RNA, 14 nt, Human
gugguacuugauca

SEQ ID NO: 1512827 - RNA, 19 nt, Human
gugguaugaucacggcuca

SEQ ID NO: 1512828 - RNA, 14 nt, Human
guggucccacccca

SEQ ID NO: 1512829 - RNA, 15 nt, Human
guggucccaccccac

SEQ ID NO: 1512830 - RNA, 16 nt, Human
guggucccaccccaca

SEQ ID NO: 1512831 - RNA, 17 nt, Human
guggucccaccccacac

SEQ ID NO: 1512832 - RNA, 18 nt, Human
gugguccuaaucuucuga

SEQ ID NO: 1512833 - RNA, 15 nt, Human
gugggcauucaaaug

SEQ ID NO: 1512834 - RNA, 17 nt, Human
gugggcccaaugcacuu

SEQ ID NO: 1512835 - RNA, 15 nt, Human
gugggcuaguugggc

SEQ ID NO: 1512836 - RNA, 15 nt, Human
guggggaccucaggc

SEQ ID NO: 1512837 - RNA, 18 nt, Human
guggggaccucaggccug

SEQ ID NO: 1512838 - RNA, 23 nt, Human
guggguuucuaaagcugccagcc

SEQ ID NO: 1512839 - RNA, 13 nt, Human
guggggcagcuug

SEQ ID NO: 1512840 - RNA, 17 nt, Human
guggggcagcuugaggg

SEQ ID NO: 1512841 - RNA, 15 nt, Human
gugcuacaaaaacac

SEQ ID NO: 1512842 - RNA, 20 nt, Human
gugcuacaaaaacacagcaa

SEQ ID NO: 1512843 - RNA, 21 nt, Human
gugcuacaaaaacacagcaag

SEQ ID NO: 1512844 - RNA, 14 nt, Human
guggcucacgccug

SEQ ID NO: 1512845 - RNA, 12 nt, Human
guggcugcuuca

SEQ ID NO: 1512846 - RNA, 14 nt, Human
guggcugcuucaag

SEQ ID NO: 1512847 - RNA, 19 nt, Human
guggcuggguuggagggug

SEQ ID NO: 1512848 - RNA, 23 nt, Human
guggcugcuucaaggauccugag

SEQ ID NO: 1512849 - RNA, 15 nt, Human
guggcugcuucaagg

SEQ ID NO: 1512850 - RNA, 16 nt, Human
guggcugcuucaagga

SEQ ID NO: 1512851 - RNA, 19 nt, Human
guggcugcuucaaggaucc

SEQ ID NO: 1512852 - RNA, 22 nt, Human
guggcugcuucaaggauccuga

SEQ ID NO: 1512853 - RNA, 22 nt, Human
guggcuuaaaacaacacucaca

SEQ ID NO: 1512854 - RNA, 23 nt, Human
gugauccacccaccucagccucc

SEQ ID NO: 1512855 - RNA, 24 nt, Human
gugauccacccaccucagccuccc

SEQ ID NO: 1512856 - RNA, 18 nt, Human
gugauuuuuguaauuuuu

SEQ ID NO: 1512857 - RNA, 13 nt, Human
gugauuuuuguaa

SEQ ID NO: 1512858 - RNA, 12 nt, Human
gugauuuucauu

SEQ ID NO: 1512859 - RNA, 20 nt, Human
gugcaguggugcgaucuggg

SEQ ID NO: 1512860 - RNA, 23 nt, Human
gugcaguggugcgaucuggguuc

SEQ ID NO: 1512861 - RNA, 21 nt, Human
gugcaguuugguguguccucc

SEQ ID NO: 1512862 - RNA, 22 nt, Human
gugcauaccacuuuuguucuug

SEQ ID NO: 1512863 - RNA, 20 nt, Human
gugccagguuuuuggucuga

SEQ ID NO: 1512864 - RNA, 14 nt, Human
gugccaugugccag

SEQ ID NO: 1512865 - RNA, 16 nt, Human
gugccaugugccaggu

SEQ ID NO: 1512866 - RNA, 21 nt, Human
gugcgaucuggguucacugca

SEQ ID NO: 1512867 - RNA, 18 nt, Human
gugcggcggucccagcuc

SEQ ID NO: 1512868 - RNA, 19 nt, Human
gugcggcggucccagcucc

SEQ ID NO: 1512869 - RNA, 22 nt, Human
gugcggcggucccagcucccug

SEQ ID NO: 1512870 - RNA, 14 nt, Human
gugcggccuuuggc

SEQ ID NO: 1512871 - RNA, 14 nt, Human
gugcgccuacagga

SEQ ID NO: 1512872 - RNA, 17 nt, Human
gugaggaugaaaaaaua

SEQ ID NO: 1512873 - RNA, 14 nt, Human
gugagcuacaaaug

SEQ ID NO: 1512874 - RNA, 19 nt, Human
gugagccgagaucacgcca

SEQ ID NO: 1512875 - RNA, 15 nt, Human
gugagccacugcacc

SEQ ID NO: 1512876 - RNA, 20 nt, Human
gugagccacugcaccgggcc

SEQ ID NO: 1512877 - RNA, 14 nt, Human
gugauauuuuucuu

SEQ ID NO: 1512878 - RNA, 17 nt, Human
gugauacaaugcugugc

SEQ ID NO: 1512879 - RNA, 15 nt, Human
gugauacaaugcugu

SEQ ID NO: 1512880 - RNA, 17 nt, Human
gugaguugauagcacag

SEQ ID NO: 1512881 - RNA, 12 nt, Human
gugacagaggca

SEQ ID NO: 1512882 - RNA, 13 nt, Human
gugacagaggcag

SEQ ID NO: 1512883 - RNA, 14 nt, Human
gugacagaggcagc

SEQ ID NO: 1512884 - RNA, 15 nt, Human
gugacagaggcagcc

SEQ ID NO: 1512885 - RNA, 13 nt, Human
gugaccucugccu

SEQ ID NO: 1512886 - RNA, 14 nt, Human
gugaccucugccug

SEQ ID NO: 1512887 - RNA, 15 nt, Human
gugaccucugccuga

SEQ ID NO: 1512888 - RNA, 22 nt, Human
gugaauucuugaaggaaaauga

SEQ ID NO: 1512889 - RNA, 20 nt, Human
gugacaaggauugcuacugu

SEQ ID NO: 1512890 - RNA, 21 nt, Human
gugaaugaugauccuaggcau

SEQ ID NO: 1512891 - RNA, 18 nt, Human
gugaauucuugaaggaaa

SEQ ID NO: 1512892 - RNA, 21 nt, Human
gugaacaaauuuacagagaca

SEQ ID NO: 1512893 - RNA, 15 nt, Human
gugaacacaucagcu

SEQ ID NO: 1512894 - RNA, 13 nt, Human
gugaacacaucag

SEQ ID NO: 1512895 - RNA, 18 nt, Human
gucgucaaagcugaaaug

SEQ ID NO: 1512896 - RNA, 15 nt, Human
gucgguccuggugcc

SEQ ID NO: 1512897 - RNA, 17 nt, Human
gucgguccuggugcccu

SEQ ID NO: 1512898 - RNA, 18 nt, Human
gucgguccuggugcccug

SEQ ID NO: 1512899 - RNA, 23 nt, Human
gucuaagauaguaacaaugaaga

SEQ ID NO: 1512900 - RNA, 21 nt, Human
gucuaagauaguaacaaugaa

SEQ ID NO: 1512901 - RNA, 13 nt, Human
gucuaaauuugaa

SEQ ID NO: 1512902 - RNA, 18 nt, Human
gucucacuauguugccca

SEQ ID NO: 1512903 - RNA, 19 nt, Human
gucucacuauguugcccag

SEQ ID NO: 1512904 - RNA, 15 nt, Human
gucccugccaaugga

SEQ ID NO: 1512905 - RNA, 11 nt, Human
gucccugccaa

SEQ ID NO: 1512906 - RNA, 14 nt, Human
gucccugccaaugg

SEQ ID NO: 1512907 - RNA, 21 nt, Human
guccuuaccagcagagcaccu

SEQ ID NO: 1512908 - RNA, 19 nt, Human
guccuuaccagcagagcac

SEQ ID NO: 1512909 - RNA, 21 nt, Human
gucggaaaacaugcuacacac

SEQ ID NO: 1512910 - RNA, 16 nt, Human
gucgggcaugacacga

SEQ ID NO: 1512911 - RNA, 23 nt, Human
gucggguuuuauuguuuaaaauc

SEQ ID NO: 1512912 - RNA, 13 nt, Human
gucucacuguugc

SEQ ID NO: 1512913 - RNA, 22 nt, Human
gucucacucugucgcccagucu

SEQ ID NO: 1512914 - RNA, 15 nt, Human
gucucacucugucgc

SEQ ID NO: 1512915 - RNA, 16 nt, Human
gucucacucugucgcc

SEQ ID NO: 1512916 - RNA, 18 nt, Human
gucucacucugucgccca

SEQ ID NO: 1512917 - RNA, 19 nt, Human
gucucacucugucgcccag

SEQ ID NO: 1512918 - RNA, 13 nt, Human
gucucuugguccu

SEQ ID NO: 1512919 - RNA, 17 nt, Human
gucuguucuuuccaaag

SEQ ID NO: 1512920 - RNA, 14 nt, Human
gucuguucuuucca

SEQ ID NO: 1512921 - RNA, 18 nt, Human
gucugugccauuuuguau

SEQ ID NO: 1512922 - RNA, 22 nt, Human
gucugugagaugcuagaacucc

SEQ ID NO: 1512923 - RNA, 23 nt, Human
gucugugagaugcuagaacuccc

SEQ ID NO: 1512924 - RNA, 15 nt, Human
gucugugagaugcua

SEQ ID NO: 1512925 - RNA, 16 nt, Human
gucugugagaugcuag

SEQ ID NO: 1512926 - RNA, 17 nt, Human
gucugugagaugcuaga

SEQ ID NO: 1512927 - RNA, 21 nt, Human
gucugugagaugcuagaacuc

SEQ ID NO: 1512928 - RNA, 21 nt, Human
gucuugaacuccuggccucaa

SEQ ID NO: 1512929 - RNA, 18 nt, Human
gucuugaacuccuggccu

SEQ ID NO: 1512930 - RNA, 20 nt, Human
gucuugaacuccuggccuca

SEQ ID NO: 1512931 - RNA, 16 nt, Human
gucuugcaauggcagc

SEQ ID NO: 1512932 - RNA, 17 nt, Human
gucuugcaauggcagcc

SEQ ID NO: 1512933 - RNA, 18 nt, Human
gucuugcaauggcagccu

SEQ ID NO: 1512934 - RNA, 19 nt, Human
gucuugcaauggcagccuu

SEQ ID NO: 1512935 - RNA, 21 nt, Human
gucuuaaaaaguggaaaaaua

SEQ ID NO: 1512936 - RNA, 16 nt, Human
gucuugaacuccuggc

SEQ ID NO: 1512937 - RNA, 17 nt, Human
gucuugaacuccuggcc

SEQ ID NO: 1512938 - RNA, 23 nt, Human
gucuugcaauggcagccuuggca

SEQ ID NO: 1512939 - RNA, 20 nt, Human
gucuugcaauggcagccuug

SEQ ID NO: 1512940 - RNA, 21 nt, Human
gucuugcaauggcagccuugg

SEQ ID NO: 1512941 - RNA, 16 nt, Human
gucccugcacuugcag

SEQ ID NO: 1512942 - RNA, 19 nt, Human
gucccugcacuugcagacu

SEQ ID NO: 1512943 - RNA, 21 nt, Human
gucccugcacuugcagacucu

SEQ ID NO: 1512944 - RNA, 17 nt, Human
guccccaccgcagacag

SEQ ID NO: 1512945 - RNA, 23 nt, Human
gucccaccuuggcugcagggagu

SEQ ID NO: 1512946 - RNA, 21 nt, Human
gucauucagauaugauucaaa

SEQ ID NO: 1512947 - RNA, 13 nt, Human
gucaggaaagaga

SEQ ID NO: 1512948 - RNA, 21 nt, Human
gucagcuccccucggagaaga

SEQ ID NO: 1512949 - RNA, 22 nt, Human
gucagcuccccucggagaagag

SEQ ID NO: 1512950 - RNA, 23 nt, Human
gucagcuccccucggagaagagc

SEQ ID NO: 1512951 - RNA, 13 nt, Human
guccacccaggag

SEQ ID NO: 1512952 - RNA, 12 nt, Human
guccacccagga

SEQ ID NO: 1512953 - RNA, 23 nt, Human
guccacccaggagccccgaggcc

SEQ ID NO: 1512954 - RNA, 21 nt, Human
gucccaccuuggcugcaggga

SEQ ID NO: 1512955 - RNA, 20 nt, Human
guauuuuaaaagaaugauua

SEQ ID NO: 1512956 - RNA, 13 nt, Human
guauuuuaaucac

SEQ ID NO: 1512957 - RNA, 22 nt, Human
guauuuuaucuuugauucuccu

SEQ ID NO: 1512958 - RNA, 23 nt, Human
guauuuuaucuuugauucuccuu

SEQ ID NO: 1512959 - RNA, 14 nt, Human
guauuuuacuaaua

SEQ ID NO: 1512960 - RNA, 17 nt, Human
gucaccagacggggcug

SEQ ID NO: 1512961 - RNA, 16 nt, Human
gucaccagacggggcu

SEQ ID NO: 1512962 - RNA, 15 nt, Human
gucaaugcagccccc

SEQ ID NO: 1512963 - RNA, 23 nt, Human
gucaauaaaauccauacauuugu

SEQ ID NO: 1512964 - RNA, 22 nt, Human
gucaauaaaauccauacauuug

SEQ ID NO: 1512965 - RNA, 15 nt, Human
gucaagugaaaaagg

SEQ ID NO: 1512966 - RNA, 19 nt, Human
guauuuuguuuuugucuua

SEQ ID NO: 1512967 - RNA, 22 nt, Human
gucaccccggccaccugcggug

SEQ ID NO: 1512968 - RNA, 17 nt, Human
gucaccccggccaccug

SEQ ID NO: 1512969 - RNA, 18 nt, Human
gucaccccggccaccugc

SEQ ID NO: 1512970 - RNA, 22 nt, Human
gucacucuggcagcucagagag

SEQ ID NO: 1512971 - RNA, 17 nt, Human
gucacucuggcagcuca

SEQ ID NO: 1512972 - RNA, 19 nt, Human
gucacucuggcagcucaga

SEQ ID NO: 1512973 - RNA, 12 nt, Human
gucacucuggca

SEQ ID NO: 1512974 - RNA, 13 nt, Human
gucacucuggcag

SEQ ID NO: 1512975 - RNA, 14 nt, Human
gucacucuggcagc

SEQ ID NO: 1512976 - RNA, 16 nt, Human
gucacucuggcagcuc

SEQ ID NO: 1512977 - RNA, 19 nt, Human
gucagcuccccucggagaa

SEQ ID NO: 1512978 - RNA, 15 nt, Human
gucagagccugcagu

SEQ ID NO: 1512979 - RNA, 16 nt, Human
gucagagccugcaguu

SEQ ID NO: 1512980 - RNA, 14 nt, Human
gucagagccugcag

SEQ ID NO: 1512981 - RNA, 14 nt, Human
guaguguuggagaa

SEQ ID NO: 1512982 - RNA, 15 nt, Human
guaguguuggagaag

SEQ ID NO: 1512983 - RNA, 17 nt, Human
guaguguuggagaagaa

SEQ ID NO: 1512984 - RNA, 14 nt, Human
guagucaggugccu

SEQ ID NO: 1512985 - RNA, 16 nt, Human
guaggguuauaauaau

SEQ ID NO: 1512986 - RNA, 19 nt, Human
gcuauaggugcuacaaaaa

SEQ ID NO: 1512987 - RNA, 18 nt, Human
gcuauaggugcuacaaaa

SEQ ID NO: 1512988 - RNA, 15 nt, Human
guagagugugccuga

SEQ ID NO: 1512989 - RNA, 16 nt, Human
guagcauccuggaaua

SEQ ID NO: 1512990 - RNA, 14 nt, Human
guagcacugacaga

SEQ ID NO: 1512991 - RNA, 15 nt, Human
guagcacugacagau

SEQ ID NO: 1512992 - RNA, 21 nt, Human
guagcauuuguguugaagagg

SEQ ID NO: 1512993 - RNA, 23 nt, Human
guagggcgggaggauguucuggg

SEQ ID NO: 1512994 - RNA, 21 nt, Human
guagggcgggaggauguucug

SEQ ID NO: 1512995 - RNA, 22 nt, Human
guagggcgggaggauguucugg

SEQ ID NO: 1512996 - RNA, 16 nt, Human
guagggcgggaggaug

SEQ ID NO: 1512997 - RNA, 17 nt, Human
guauguuagugcaaauu

SEQ ID NO: 1512998 - RNA, 22 nt, Human
guaugaucacggcucacugcag

SEQ ID NO: 1512999 - RNA, 21 nt, Human
guaugaucacggcucacugca

SEQ ID NO: 1513000 - RNA, 20 nt, Human
guaugaggcauuuguuugaa

SEQ ID NO: 1513001 - RNA, 17 nt, Human
guaugaggcauuuguuu

SEQ ID NO: 1513002 - RNA, 20 nt, Human
guaugaucacggcucacugc

SEQ ID NO: 1513003 - RNA, 19 nt, Human
guauguuuuuguguauuug

SEQ ID NO: 1513004 - RNA, 23 nt, Human
guauguuuuuguguauuuguuaa

SEQ ID NO: 1513005 - RNA, 15 nt, Human
guauguuuguacuug

SEQ ID NO: 1513006 - RNA, 13 nt, Human
guaugaaauuaua

SEQ ID NO: 1513007 - RNA, 23 nt, Human
guaugaaauuauauaaguauucu

SEQ ID NO: 1513008 - RNA, 15 nt, Human
guaugaggcauuugu

SEQ ID NO: 1513009 - RNA, 13 nt, Human
guaugaggcauuu

SEQ ID NO: 1513010 - RNA, 12 nt, Human
guaucugagcag

SEQ ID NO: 1513011 - RNA, 12 nt, Human
guaucuggugac

SEQ ID NO: 1513012 - RNA, 19 nt, Human
guaucuggugacuuuccuc

SEQ ID NO: 1513013 - RNA, 22 nt, Human
guauaugucaagccauaauugu

SEQ ID NO: 1513014 - RNA, 15 nt, Human
uuucucugauacaga

SEQ ID NO: 1513015 - RNA, 16 nt, Human
uuucucugauacagaa

SEQ ID NO: 1513016 - RNA, 17 nt, Human
uuucucugauacagaaa

SEQ ID NO: 1513017 - RNA, 18 nt, Human
uuucucugauacagaaaa

SEQ ID NO: 1513018 - RNA, 21 nt, Human
uuucugaaauuuccugggagc

SEQ ID NO: 1513019 - RNA, 20 nt, Human
uuucuguucuuucuggcuau

SEQ ID NO: 1513020 - RNA, 15 nt, Human
uuucugagaaagacu

SEQ ID NO: 1513021 - RNA, 13 nt, Human
uuucugagaaaga

SEQ ID NO: 1513022 - RNA, 21 nt, Human
uuucuaaaggcuaccuuugua

SEQ ID NO: 1513023 - RNA, 20 nt, Human
uuucuaaaggcuaccuuugu

SEQ ID NO: 1513024 - RNA, 17 nt, Human
uuaccacagacauacua

SEQ ID NO: 1513025 - RNA, 14 nt, Human
uuaccacagacaua

SEQ ID NO: 1513026 - RNA, 16 nt, Human
uuuccugaggcugggc

SEQ ID NO: 1513027 - RNA, 18 nt, Human
uuugaaucaucaagucuu

SEQ ID NO: 1513028 - RNA, 13 nt, Human
uuugaauaugaaa

SEQ ID NO: 1513029 - RNA, 22 nt, Human
uuugaagaugccgcauuuggau

SEQ ID NO: 1513030 - RNA, 21 nt, Human
uuugaaucucauaauuuauac

SEQ ID NO: 1513031 - RNA, 22 nt, Human
uuugaaucucauaauuuauaca

SEQ ID NO: 1513032 - RNA, 16 nt, Human
uuugaaucucauaauu

SEQ ID NO: 1513033 - RNA, 19 nt, Human
uuugaaucucauaauuuau

SEQ ID NO: 1513034 - RNA, 20 nt, Human
uuugaaucucauaauuuaua

SEQ ID NO: 1513035 - RNA, 12 nt, Human
uuucuugccucu

SEQ ID NO: 1513036 - RNA, 19 nt, Human
uuugaacugauaaagauga

SEQ ID NO: 1513037 - RNA, 17 nt, Human
uuugaacugauaaagau

SEQ ID NO: 1513038 - RNA, 15 nt, Human
uuugaacugauaaag

SEQ ID NO: 1513039 - RNA, 14 nt, Human
uuugaacucuucaa

SEQ ID NO: 1513040 - RNA, 21 nt, Human
uuucuugaucaacaucuuuuc

SEQ ID NO: 1513041 - RNA, 16 nt, Human
uuucuuaaacaaaugu

SEQ ID NO: 1513042 - RNA, 23 nt, Human
uuucuuagggaaggauacaaaag

SEQ ID NO: 1513043 - RNA, 18 nt, Human
uuucuuagggaaggauac

SEQ ID NO: 1513044 - RNA, 17 nt, Human
uuucuuauuucauuucu

SEQ ID NO: 1513045 - RNA, 13 nt, Human
uuucuucucccuc

SEQ ID NO: 1513046 - RNA, 12 nt, Human
uuucuucucccu

SEQ ID NO: 1513047 - RNA, 19 nt, Human
uuuggacaaaauggaauac

SEQ ID NO: 1513048 - RNA, 21 nt, Human
uuuggaauuuugugcccccau

SEQ ID NO: 1513049 - RNA, 13 nt, Human
uuuguauaaaaua

SEQ ID NO: 1513050 - RNA, 16 nt, Human
uuugguuuuguucccc

SEQ ID NO: 1513051 - RNA, 19 nt, Human
uuugguuuuguuccccucc

SEQ ID NO: 1513052 - RNA, 21 nt, Human
uuugguuuuguuccccuccuc

SEQ ID NO: 1513053 - RNA, 14 nt, Human
uuuguauaaaauaa

SEQ ID NO: 1513054 - RNA, 16 nt, Human
uuuguauaaaauaauu

SEQ ID NO: 1513055 - RNA, 19 nt, Human
uuugguuuucacauuggaa

SEQ ID NO: 1513056 - RNA, 14 nt, Human
uuugguuuuguucc

SEQ ID NO: 1513057 - RNA, 15 nt, Human
uuugguuuuguuccc

SEQ ID NO: 1513058 - RNA, 19 nt, Human
uuuggugguuucagaaaug

SEQ ID NO: 1513059 - RNA, 12 nt, Human
uuuggaaaauaa

SEQ ID NO: 1513060 - RNA, 14 nt, Human
uuuggaauuuugug

SEQ ID NO: 1513061 - RNA, 16 nt, Human
uuugcuuugugauuuu

SEQ ID NO: 1513062 - RNA, 15 nt, Human
uuugcuuugugauuu

SEQ ID NO: 1513063 - RNA, 21 nt, Human
uuuuaaaagaaugauuaugaa

SEQ ID NO: 1513064 - RNA, 17 nt, Human
uuuuaaagaaugcucuu

SEQ ID NO: 1513065 - RNA, 21 nt, Human
uuuguucuggcucuuccaggc

SEQ ID NO: 1513066 - RNA, 19 nt, Human
uuuguuccccuccuccacu

SEQ ID NO: 1513067 - RNA, 21 nt, Human
uuuuaaaugcaccuggaauau

SEQ ID NO: 1513068 - RNA, 12 nt, Human
uuuuaaaugcac

SEQ ID NO: 1513069 - RNA, 11 nt, Human
uuuuaaaugca

SEQ ID NO: 1513070 - RNA, 13 nt, Human
uuuuaauuaaaua

SEQ ID NO: 1513071 - RNA, 15 nt, Human
uuuuugaagcuguau

SEQ ID NO: 1513072 - RNA, 13 nt, Human
uuuuuugauauau

SEQ ID NO: 1513073 - RNA, 19 nt, Human
uuuuucucuaggaaauauu

SEQ ID NO: 1513074 - RNA, 23 nt, Human
uuuuucucugauacagaaaaguu

SEQ ID NO: 1513075 - RNA, 19 nt, Human
uuuuuccuucagugccuua

SEQ ID NO: 1513076 - RNA, 11 nt, Human
uuuuuccuuca

SEQ ID NO: 1513077 - RNA, 11 nt, Human
uuuuuaaaugc

SEQ ID NO: 1513078 - RNA, 18 nt, Human
uuuuuaaaaaagaaacau

SEQ ID NO: 1513079 - RNA, 16 nt, Human
uuuugucauauaagau

SEQ ID NO: 1513080 - RNA, 14 nt, Human
uuuugguuuuguuc

SEQ ID NO: 1513081 - RNA, 20 nt, Human
uuuugguuuuguuccccucc

SEQ ID NO: 1513082 - RNA, 16 nt, Human
uuuugguuuuguuccc

SEQ ID NO: 1513083 - RNA, 19 nt, Human
uuuuguagagccagggucu

SEQ ID NO: 1513084 - RNA, 19 nt, Human
uuuuguagcacugacagau

SEQ ID NO: 1513085 - RNA, 18 nt, Human
uuuuguagcacugacaga

SEQ ID NO: 1513086 - RNA, 15 nt, Human
uuuucuaaauuuauc

SEQ ID NO: 1513087 - RNA, 14 nt, Human
uuuuccugaaaacc

SEQ ID NO: 1513088 - RNA, 18 nt, Human
uuuuggucuggagggaag

SEQ ID NO: 1513089 - RNA, 15 nt, Human
uuuuggucuguguga

SEQ ID NO: 1513090 - RNA, 14 nt, Human
uuuuggcugcugaa

SEQ ID NO: 1513091 - RNA, 20 nt, Human
uuuugaaucucauaauuuau

SEQ ID NO: 1513092 - RNA, 20 nt, Human
uuuugacaaggggcaguggu

SEQ ID NO: 1513093 - RNA, 18 nt, Human
uuuuggaugguguuacau

SEQ ID NO: 1513094 - RNA, 11 nt, Human
uuuugacagaa

SEQ ID NO: 1513095 - RNA, 18 nt, Human
gcgccuacaggagugagc

SEQ ID NO: 1513096 - RNA, 15 nt, Human
gcgccuacaggagug

SEQ ID NO: 1513097 - RNA, 22 nt, Human
gcgacagugagacucugucuca

SEQ ID NO: 1513098 - RNA, 12 nt, Human
gcgacagugaga

SEQ ID NO: 1513099 - RNA, 11 nt, Human
gcggacagcca

SEQ ID NO: 1513100 - RNA, 13 nt, Human
gcggacagccacg

SEQ ID NO: 1513101 - RNA, 15 nt, Human
gcgucgguccuggug

SEQ ID NO: 1513102 - RNA, 19 nt, Human
gcgucucauacucaccuca

SEQ ID NO: 1513103 - RNA, 16 nt, Human
gcggacagccacggcc

SEQ ID NO: 1513104 - RNA, 15 nt, Human
gcggacagccacggc

SEQ ID NO: 1513105 - RNA, 20 nt, Human
gcuaccuuuguauucucucc

SEQ ID NO: 1513106 - RNA, 16 nt, Human
gcuaccuuuguauucu

SEQ ID NO: 1513107 - RNA, 19 nt, Human
gcuagaacucccuuucaac

SEQ ID NO: 1513108 - RNA, 15 nt, Human
gcuaggaacacuccu

SEQ ID NO: 1513109 - RNA, 16 nt, Human
gcuaggaacacuccuu

SEQ ID NO: 1513110 - RNA, 13 nt, Human
gcuauaggugcua

SEQ ID NO: 1513111 - RNA, 21 nt, Human
gcuaagagggagggagggcuc

SEQ ID NO: 1513112 - RNA, 20 nt, Human
gcuaagagggagggagggcu

SEQ ID NO: 1513113 - RNA, 20 nt, Human
gcuacacacugcauguuugu

SEQ ID NO: 1513114 - RNA, 13 nt, Human
gcuacacacugca

SEQ ID NO: 1513115 - RNA, 22 nt, Human
gcuacacaggggaaaagaggag

SEQ ID NO: 1513116 - RNA, 14 nt, Human
gcuacacaggggaa

SEQ ID NO: 1513117 - RNA, 15 nt, Human
gcuaaagcccagaga

SEQ ID NO: 1513118 - RNA, 13 nt, Human
gcuaagagggagg

SEQ ID NO: 1513119 - RNA, 16 nt, Human
gccuuuggcagaguuc

SEQ ID NO: 1513120 - RNA, 13 nt, Human
gccuuuggcuuca

SEQ ID NO: 1513121 - RNA, 23 nt, Human
gcgacaaugcaaaccaucauuga

SEQ ID NO: 1513122 - RNA, 15 nt, Human
gccuuccaggggugg

SEQ ID NO: 1513123 - RNA, 16 nt, Human
gccuuccagggguggg

SEQ ID NO: 1513124 - RNA, 21 nt, Human
gccuuccaggggugggacacc

SEQ ID NO: 1513125 - RNA, 12 nt, Human
gccuuccagggg

SEQ ID NO: 1513126 - RNA, 16 nt, Human
gccuuauggaacacuc

SEQ ID NO: 1513127 - RNA, 18 nt, Human
gccuuauggaacacucug

SEQ ID NO: 1513128 - RNA, 19 nt, Human
gccuuauggaacacucuga

SEQ ID NO: 1513129 - RNA, 20 nt, Human
gccuuauggaacacucugag

SEQ ID NO: 1513130 - RNA, 18 nt, Human
gccuuacccucauguucu

SEQ ID NO: 1513131 - RNA, 21 nt, Human
gccuuacacaaugguuuucuu

SEQ ID NO: 1513132 - RNA, 20 nt, Human
gccuuacacaaugguuuucu

SEQ ID NO: 1513133 - RNA, 19 nt, Human
gccuuacccucauguucuu

SEQ ID NO: 1513134 - RNA, 20 nt, Human
gccuuagaagucacacagua

SEQ ID NO: 1513135 - RNA, 19 nt, Human
gccuuagaagucacacagu

SEQ ID NO: 1513136 - RNA, 17 nt, Human
gccuuagaagucacaca

SEQ ID NO: 1513137 - RNA, 18 nt, Human
gccuuagaagucacacag

SEQ ID NO: 1513138 - RNA, 10 nt, Human
gccuuaugga

SEQ ID NO: 1513139 - RNA, 14 nt, Human
gccuuauggaacac

SEQ ID NO: 1513140 - RNA, 22 nt, Human
gccugggggcugggcagaggaa

SEQ ID NO: 1513141 - RNA, 15 nt, Human
gccugcaauuucaua

SEQ ID NO: 1513142 - RNA, 13 nt, Human
gccugguggcagc

SEQ ID NO: 1513143 - RNA, 14 nt, Human
gccugguggcagcu

SEQ ID NO: 1513144 - RNA, 18 nt, Human
gccugguggcagcugcgg

SEQ ID NO: 1513145 - RNA, 19 nt, Human
gccugguggcagcugcggu

SEQ ID NO: 1513146 - RNA, 21 nt, Human
gccugguggcagcugcggucc

SEQ ID NO: 1513147 - RNA, 15 nt, Human
gccuccucaggagcc

SEQ ID NO: 1513148 - RNA, 12 nt, Human
gccuccucagga

SEQ ID NO: 1513149 - RNA, 20 nt, Human
gccucccgaguagcugggac

SEQ ID NO: 1513150 - RNA, 18 nt, Human
gccucccgaguagcuggg

SEQ ID NO: 1513151 - RNA, 19 nt, Human
gccucccgaguagcuggga

SEQ ID NO: 1513152 - RNA, 17 nt, Human
gccucccaucacccgcu

SEQ ID NO: 1513153 - RNA, 21 nt, Human
gccucacaguccuuaccagca

SEQ ID NO: 1513154 - RNA, 18 nt, Human
gccucacaguccuuacca

SEQ ID NO: 1513155 - RNA, 15 nt, Human
gccucagcauccugg

SEQ ID NO: 1513156 - RNA, 16 nt, Human
gccucagcauccuggc

SEQ ID NO: 1513157 - RNA, 17 nt, Human
gccucagcauccuggca

SEQ ID NO: 1513158 - RNA, 18 nt, Human
gccucccaaagugcuggg

SEQ ID NO: 1513159 - RNA, 19 nt, Human
gccucccaaagugcuggga

SEQ ID NO: 1513160 - RNA, 13 nt, Human
gccucccaacuca

SEQ ID NO: 1513161 - RNA, 21 nt, Human
gccucccaacucaccccagcc

SEQ ID NO: 1513162 - RNA, 14 nt, Human
gccucccaucaccc

SEQ ID NO: 1513163 - RNA, 16 nt, Human
gccucccaucacccgc

SEQ ID NO: 1513164 - RNA, 16 nt, Human
gccucccaacucaccc

SEQ ID NO: 1513165 - RNA, 17 nt, Human
gccucccaacucacccc

SEQ ID NO: 1513166 - RNA, 18 nt, Human
gccucccaacucacccca

SEQ ID NO: 1513167 - RNA, 19 nt, Human
gccucccaacucaccccag

SEQ ID NO: 1513168 - RNA, 13 nt, Human
gccucucucaggc

SEQ ID NO: 1513169 - RNA, 14 nt, Human
gccucucucaggcc

SEQ ID NO: 1513170 - RNA, 16 nt, Human
gccucucucaggccaa

SEQ ID NO: 1513171 - RNA, 17 nt, Human
gccucugacacacagcu

SEQ ID NO: 1513172 - RNA, 18 nt, Human
gccucugacacacagcuc

SEQ ID NO: 1513173 - RNA, 14 nt, Human
gccucugcacuccc

SEQ ID NO: 1513174 - RNA, 19 nt, Human
gccucugacacacagcucu

SEQ ID NO: 1513175 - RNA, 20 nt, Human
gccucugacacacagcucug

SEQ ID NO: 1513176 - RNA, 21 nt, Human
gccucugacacacagcucugu

SEQ ID NO: 1513177 - RNA, 18 nt, Human
gccucugccucugacaca

SEQ ID NO: 1513178 - RNA, 15 nt, Human
gccucugcacucccc

SEQ ID NO: 1513179 - RNA, 12 nt, Human
gccucugccucu

SEQ ID NO: 1513180 - RNA, 13 nt, Human
gccucugccucug

SEQ ID NO: 1513181 - RNA, 13 nt, Human
gccugcaagggag

SEQ ID NO: 1513182 - RNA, 15 nt, Human
gccugcaagggagug

SEQ ID NO: 1513183 - RNA, 14 nt, Human
gcccuucucuccag

SEQ ID NO: 1513184 - RNA, 16 nt, Human
gcccuucucuccagcc

SEQ ID NO: 1513185 - RNA, 17 nt, Human
gcccuucucuccagccc

SEQ ID NO: 1513186 - RNA, 18 nt, Human
gcccuucucuccagcccc

SEQ ID NO: 1513187 - RNA, 13 nt, Human
gccgaagcccagg

SEQ ID NO: 1513188 - RNA, 21 nt, Human
gccgggcgcgguggcucacgc

SEQ ID NO: 1513189 - RNA, 20 nt, Human
gccgggcgugguggugagug

SEQ ID NO: 1513190 - RNA, 22 nt, Human
gccgagaucacgccacugcacu

SEQ ID NO: 1513191 - RNA, 20 nt, Human
gccgagaucacgccacugca

SEQ ID NO: 1513192 - RNA, 21 nt, Human
gccgagaucacgccacugcac

SEQ ID NO: 1513193 - RNA, 11 nt, Human
gccgcagcccu

SEQ ID NO: 1513194 - RNA, 12 nt, Human
gccgcagcccug

SEQ ID NO: 1513195 - RNA, 13 nt, Human
gccgcagcccugc

SEQ ID NO: 1513196 - RNA, 12 nt, Human
gccgcagagcug

SEQ ID NO: 1513197 - RNA, 15 nt, Human
gccgucuaccugagg

SEQ ID NO: 1513198 - RNA, 16 nt, Human
gccgucuaccugaggg

SEQ ID NO: 1513199 - RNA, 17 nt, Human
gccgucuaccugagggg

SEQ ID NO: 1513200 - RNA, 18 nt, Human
gccgucuaccugaggggc

SEQ ID NO: 1513201 - RNA, 20 nt, Human
gccguguaaccauggaccca

SEQ ID NO: 1513202 - RNA, 18 nt, Human
gccucaaccuccugggcu

SEQ ID NO: 1513203 - RNA, 19 nt, Human
gccucaaccuccugggcua

SEQ ID NO: 1513204 - RNA, 13 nt, Human
gccucacaguccu

SEQ ID NO: 1513205 - RNA, 17 nt, Human
gccucacaguccuuacc

SEQ ID NO: 1513206 - RNA, 18 nt, Human
gccguguccccugacagg

SEQ ID NO: 1513207 - RNA, 13 nt, Human
gccaggcuggucu

SEQ ID NO: 1513208 - RNA, 15 nt, Human
gccaggcuggucuca

SEQ ID NO: 1513209 - RNA, 23 nt, Human
gccaguaaaugggggugcauuug

SEQ ID NO: 1513210 - RNA, 15 nt, Human
gccaugccuccucag

SEQ ID NO: 1513211 - RNA, 14 nt, Human
gccaugcuccuggc

SEQ ID NO: 1513212 - RNA, 14 nt, Human
gccauccagguuca

SEQ ID NO: 1513213 - RNA, 24 nt, Human
gccaugcuccuggcccacugcauc

SEQ ID NO: 1513214 - RNA, 15 nt, Human
gccaugggccuccug

SEQ ID NO: 1513215 - RNA, 16 nt, Human
gccaugggccuccugu

SEQ ID NO: 1513216 - RNA, 15 nt, Human
gcccaccuggccucu

SEQ ID NO: 1513217 - RNA, 16 nt, Human
gcccaccuggccucug

SEQ ID NO: 1513218 - RNA, 17 nt, Human
gcccaccuggccucugc

SEQ ID NO: 1513219 - RNA, 20 nt, Human
gcccaccuggccucugcacu

SEQ ID NO: 1513220 - RNA, 21 nt, Human
gcccaccuggccucugcacuc

SEQ ID NO: 1513221 - RNA, 24 nt, Human
gcccaccuggccucugcacucccc

SEQ ID NO: 1513222 - RNA, 14 nt, Human
gcccacuucugcca

SEQ ID NO: 1513223 - RNA, 13 nt, Human
gcccaccuuggcu

SEQ ID NO: 1513224 - RNA, 15 nt, Human
gcccaccuuggcuca

SEQ ID NO: 1513225 - RNA, 16 nt, Human
gcccaccuuggcucaa

SEQ ID NO: 1513226 - RNA, 17 nt, Human
gcccaccuuggcucaag

SEQ ID NO: 1513227 - RNA, 19 nt, Human
gccaggagccuccugcccu

SEQ ID NO: 1513228 - RNA, 20 nt, Human
gccaggagccuccugcccuu

SEQ ID NO: 1513229 - RNA, 14 nt, Human
gccaggagccuccu

SEQ ID NO: 1513230 - RNA, 16 nt, Human
gccaggagccuccugc

SEQ ID NO: 1513231 - RNA, 15 nt, Human
gccaggaagccagca

SEQ ID NO: 1513232 - RNA, 17 nt, Human
gccagcugcuugggcuu

SEQ ID NO: 1513233 - RNA, 18 nt, Human
gccagcugcuugggcuuc

SEQ ID NO: 1513234 - RNA, 20 nt, Human
gccagcugcuugggcuucau

SEQ ID NO: 1513235 - RNA, 12 nt, Human
gccaggaagcca

SEQ ID NO: 1513236 - RNA, 13 nt, Human
gccaggaagccag

SEQ ID NO: 1513237 - RNA, 14 nt, Human
gccaggaagccagc

SEQ ID NO: 1513238 - RNA, 14 nt, Human
gccagaugcaccag

SEQ ID NO: 1513239 - RNA, 17 nt, Human
gccagagggagugacag

SEQ ID NO: 1513240 - RNA, 22 nt, Human
gccagccgagauagccaaggcc

SEQ ID NO: 1513241 - RNA, 15 nt, Human
gccagaugcaccagc

SEQ ID NO: 1513242 - RNA, 20 nt, Human
gccagauucuuuccugaggc

SEQ ID NO: 1513243 - RNA, 24 nt, Human
gccagauucuuuccugaggcuggg

SEQ ID NO: 1513244 - RNA, 13 nt, Human
gccagauuucacu

SEQ ID NO: 1513245 - RNA, 20 nt, Human
gccaaggccaaaggaagcac

SEQ ID NO: 1513246 - RNA, 24 nt, Human
gccaaggccaaaggaagcacaugc

SEQ ID NO: 1513247 - RNA, 20 nt, Human
gccacugcaccgggccacag

SEQ ID NO: 1513248 - RNA, 21 nt, Human
gccacugcaccgggccacaga

SEQ ID NO: 1513249 - RNA, 22 nt, Human
gccagagacacaagccuucggc

SEQ ID NO: 1513250 - RNA, 22 nt, Human
gccacugcaccgggccacagag

SEQ ID NO: 1513251 - RNA, 21 nt, Human
gccagagacacaagccuucgg

SEQ ID NO: 1513252 - RNA, 17 nt, Human
gccccuguucuggcaga

SEQ ID NO: 1513253 - RNA, 16 nt, Human
gccccucagggucccu

SEQ ID NO: 1513254 - RNA, 18 nt, Human
gccccucagggucccugg

SEQ ID NO: 1513255 - RNA, 15 nt, Human
gccccgaggccuucu

SEQ ID NO: 1513256 - RNA, 14 nt, Human
gccccucagggucc

SEQ ID NO: 1513257 - RNA, 18 nt, Human
gccccgaggccuucucug

SEQ ID NO: 1513258 - RNA, 22 nt, Human
gccccgaggccuucucugaagg

SEQ ID NO: 1513259 - RNA, 12 nt, Human
gcccgggcucug

SEQ ID NO: 1513260 - RNA, 19 nt, Human
gcccuccaagaccuucucc

SEQ ID NO: 1513261 - RNA, 21 nt, Human
gcccuccaagaccuucuccuu

SEQ ID NO: 1513262 - RNA, 22 nt, Human
gcccuccaagaccuucuccuuc

SEQ ID NO: 1513263 - RNA, 23 nt, Human
gcccuccaagaccuucuccuuca

SEQ ID NO: 1513264 - RNA, 13 nt, Human
gcccucugcccac

SEQ ID NO: 1513265 - RNA, 16 nt, Human
gcccucugcccacucc

SEQ ID NO: 1513266 - RNA, 18 nt, Human
gcccucugcccacucccu

SEQ ID NO: 1513267 - RNA, 19 nt, Human
gcccucugcccacucccug

SEQ ID NO: 1513268 - RNA, 14 nt, Human
gcccugagcuuucu

SEQ ID NO: 1513269 - RNA, 16 nt, Human
gcccugcagagggcac

SEQ ID NO: 1513270 - RNA, 15 nt, Human
gcccugcagagggca

SEQ ID NO: 1513271 - RNA, 13 nt, Human
gcccugcagaggg

SEQ ID NO: 1513272 - RNA, 14 nt, Human
gcccugcagagggc

SEQ ID NO: 1513273 - RNA, 15 nt, Human
gccccauucugccug

SEQ ID NO: 1513274 - RNA, 14 nt, Human
gccccauucugccu

SEQ ID NO: 1513275 - RNA, 13 nt, Human
gccccauccucug

SEQ ID NO: 1513276 - RNA, 14 nt, Human
gccccauccucugu

SEQ ID NO: 1513277 - RNA, 22 nt, Human
gccccauccucuguacagagcc

SEQ ID NO: 1513278 - RNA, 15 nt, Human
gccccagugcccaca

SEQ ID NO: 1513279 - RNA, 13 nt, Human
gccccagugccca

SEQ ID NO: 1513280 - RNA, 14 nt, Human
gccccagugcccac

SEQ ID NO: 1513281 - RNA, 18 nt, Human
gccccaucccaaacccuu

SEQ ID NO: 1513282 - RNA, 12 nt, Human
gccccagugccc

SEQ ID NO: 1513283 - RNA, 13 nt, Human
gcccaggccuccu

SEQ ID NO: 1513284 - RNA, 21 nt, Human
gcccagagaggguggugaccu

SEQ ID NO: 1513285 - RNA, 23 nt, Human
gcccaggccccugccacccuggg

SEQ ID NO: 1513286 - RNA, 12 nt, Human
gcccaggcuggc

SEQ ID NO: 1513287 - RNA, 19 nt, Human
gcauucaaauguauuacag

SEQ ID NO: 1513288 - RNA, 19 nt, Human
gcauuaucuagauacugua

SEQ ID NO: 1513289 - RNA, 17 nt, Human
gcauuaucuagauacug

SEQ ID NO: 1513290 - RNA, 16 nt, Human
gcauuuguguugaaga

SEQ ID NO: 1513291 - RNA, 16 nt, Human
gcauuuguuugaacug

SEQ ID NO: 1513292 - RNA, 14 nt, Human
gcauuugcugaaua

SEQ ID NO: 1513293 - RNA, 17 nt, Human
gcauuugcugaauacag

SEQ ID NO: 1513294 - RNA, 13 nt, Human
gcauuugcugaau

SEQ ID NO: 1513295 - RNA, 18 nt, Human
gcauuuguuugaacugau

SEQ ID NO: 1513296 - RNA, 14 nt, Human
gccaaacucaccug

SEQ ID NO: 1513297 - RNA, 16 nt, Human
gccaaacucaccugcc

SEQ ID NO: 1513298 - RNA, 19 nt, Human
gccaaacucaccugccccu

SEQ ID NO: 1513299 - RNA, 20 nt, Human
gccaaagccaaagcuaggcc

SEQ ID NO: 1513300 - RNA, 16 nt, Human
gccaaagccuccucca

SEQ ID NO: 1513301 - RNA, 19 nt, Human
gccaaagccuccuccagcc

SEQ ID NO: 1513302 - RNA, 16 nt, Human
gccaaagcuaggccug

SEQ ID NO: 1513303 - RNA, 22 nt, Human
gccaaagcuaggccuggccaga

SEQ ID NO: 1513304 - RNA, 12 nt, Human
gccaaaggaagc

SEQ ID NO: 1513305 - RNA, 12 nt, Human
gcaucagcugcu

SEQ ID NO: 1513306 - RNA, 18 nt, Human
gcaugaaguaauaugcac

SEQ ID NO: 1513307 - RNA, 13 nt, Human
gcaugaagguuuc

SEQ ID NO: 1513308 - RNA, 13 nt, Human
gcauuauauuuau

SEQ ID NO: 1513309 - RNA, 22 nt, Human
gcauguucucugaggacacuaa

SEQ ID NO: 1513310 - RNA, 15 nt, Human
gcauguucucugagg

SEQ ID NO: 1513311 - RNA, 21 nt, Human
gcauguucucugaggacacua

SEQ ID NO: 1513312 - RNA, 18 nt, Human
gcaugcgggcuuccuccu

SEQ ID NO: 1513313 - RNA, 15 nt, Human
gcagugcaugcuguc

SEQ ID NO: 1513314 - RNA, 16 nt, Human
gcagugcaugcugucc

SEQ ID NO: 1513315 - RNA, 22 nt, Human
gcagguccaggguuugaguuca

SEQ ID NO: 1513316 - RNA, 19 nt, Human
gcaggucuugaacuccugg

SEQ ID NO: 1513317 - RNA, 20 nt, Human
gcaggucuugaacuccuggc

SEQ ID NO: 1513318 - RNA, 22 nt, Human
gcagggcucagcggggacagcu

SEQ ID NO: 1513319 - RNA, 18 nt, Human
gcagggucucacucuguc

SEQ ID NO: 1513320 - RNA, 17 nt, Human
gcaggcagccaggccac

SEQ ID NO: 1513321 - RNA, 15 nt, Human
gcaggcagccaggcc

SEQ ID NO: 1513322 - RNA, 16 nt, Human
gcaggcagccaggcca

SEQ ID NO: 1513323 - RNA, 19 nt, Human
gcagggcucagcggggaca

SEQ ID NO: 1513324 - RNA, 21 nt, Human
gcagggcucagcggggacagc

SEQ ID NO: 1513325 - RNA, 17 nt, Human
gcauagguuuaauaauu

SEQ ID NO: 1513326 - RNA, 15 nt, Human
gcaguugaaaagacu

SEQ ID NO: 1513327 - RNA, 18 nt, Human
gcauagauucccugagca

SEQ ID NO: 1513328 - RNA, 20 nt, Human
gcauauuuuucacauaucua

SEQ ID NO: 1513329 - RNA, 14 nt, Human
gcauauuuuucaca

SEQ ID NO: 1513330 - RNA, 15 nt, Human
gcauauuuuucacau

SEQ ID NO: 1513331 - RNA, 16 nt, Human
gcauauuuuucacaua

SEQ ID NO: 1513332 - RNA, 19 nt, Human
gcauauuuuucacauaucu

SEQ ID NO: 1513333 - RNA, 23 nt, Human
gcaguggugguuuucuguucuuu

SEQ ID NO: 1513334 - RNA, 18 nt, Human
gcagugguguggagaagc

SEQ ID NO: 1513335 - RNA, 13 nt, Human
gcagugggagcug

SEQ ID NO: 1513336 - RNA, 14 nt, Human
gcagugggagcugc

SEQ ID NO: 1513337 - RNA, 15 nt, Human
gcagugggagcugcc

SEQ ID NO: 1513338 - RNA, 13 nt, Human
gcauagaaguaaa

SEQ ID NO: 1513339 - RNA, 17 nt, Human
gcaguucugaagaagau

SEQ ID NO: 1513340 - RNA, 15 nt, Human
gcaguucugaagaag

SEQ ID NO: 1513341 - RNA, 17 nt, Human
gcaguuauuaacacuaa

SEQ ID NO: 1513342 - RNA, 17 nt, Human
gcagacaguuaagagaa

SEQ ID NO: 1513343 - RNA, 21 nt, Human
gcagaguugaagacagagcua

SEQ ID NO: 1513344 - RNA, 18 nt, Human
gcagauaaacaguaguga

SEQ ID NO: 1513345 - RNA, 22 nt, Human
gcagauacaggaaaagcugcug

SEQ ID NO: 1513346 - RNA, 17 nt, Human
gcagccccauucugccu

SEQ ID NO: 1513347 - RNA, 23 nt, Human
gcagcaauaaagcagcguuucua

SEQ ID NO: 1513348 - RNA, 16 nt, Human
gcagcaauaaagcagc

SEQ ID NO: 1513349 - RNA, 18 nt, Human
gcagccccauucugccug

SEQ ID NO: 1513350 - RNA, 19 nt, Human
gcagccccauucugccugc

SEQ ID NO: 1513351 - RNA, 21 nt, Human
gcagccccauucugccugccc

SEQ ID NO: 1513352 - RNA, 24 nt, Human
gcagccccauucugccugcccagg

SEQ ID NO: 1513353 - RNA, 20 nt, Human
gcagccccgugggguuccuc

SEQ ID NO: 1513354 - RNA, 20 nt, Human
gcagccccuguucuggcaga

SEQ ID NO: 1513355 - RNA, 21 nt, Human
gcagccccuguucuggcagag

SEQ ID NO: 1513356 - RNA, 13 nt, Human
gcagcccugcaga

SEQ ID NO: 1513357 - RNA, 14 nt, Human
gcagcccugcagag

SEQ ID NO: 1513358 - RNA, 15 nt, Human
gcagcccugcagagg

SEQ ID NO: 1513359 - RNA, 16 nt, Human
gcagcccugcagaggg

SEQ ID NO: 1513360 - RNA, 17 nt, Human
gcagcccugcagagggc

SEQ ID NO: 1513361 - RNA, 15 nt, Human
gcagcucaccucucc

SEQ ID NO: 1513362 - RNA, 15 nt, Human
gcagccuuggcaaac

SEQ ID NO: 1513363 - RNA, 14 nt, Human
gcagcucaccucuc

SEQ ID NO: 1513364 - RNA, 23 nt, Human
gcaggaggaucacuugaguccag

SEQ ID NO: 1513365 - RNA, 12 nt, Human
gcaggcagccag

SEQ ID NO: 1513366 - RNA, 13 nt, Human
gcaggcagccagg

SEQ ID NO: 1513367 - RNA, 14 nt, Human
gcaggcagccaggc

SEQ ID NO: 1513368 - RNA, 12 nt, Human
gcacgauuucug

SEQ ID NO: 1513369 - RNA, 19 nt, Human
gcaccuuagacagucccug

SEQ ID NO: 1513370 - RNA, 18 nt, Human
gcaccuuagacagucccu

SEQ ID NO: 1513371 - RNA, 21 nt, Human
gcaccuggaauauauaaccag

SEQ ID NO: 1513372 - RNA, 18 nt, Human
gcaccuggaauauauaac

SEQ ID NO: 1513373 - RNA, 15 nt, Human
gcacccucaggcagg

SEQ ID NO: 1513374 - RNA, 22 nt, Human
gcaccuggaauauauaaccagu

SEQ ID NO: 1513375 - RNA, 14 nt, Human
gcaccuuagacagu

SEQ ID NO: 1513376 - RNA, 17 nt, Human
gcaccuuagacaguccc

SEQ ID NO: 1513377 - RNA, 16 nt, Human
gcaccagcagccugga

SEQ ID NO: 1513378 - RNA, 22 nt, Human
gcacccaccaucaugucuggcu

SEQ ID NO: 1513379 - RNA, 19 nt, Human
gcacccggccccugcuggu

SEQ ID NO: 1513380 - RNA, 15 nt, Human
gcaccagcagccugg

SEQ ID NO: 1513381 - RNA, 21 nt, Human
gcaccacugcacuccagccug

SEQ ID NO: 1513382 - RNA, 22 nt, Human
gcaccacugcacuccagccugg

SEQ ID NO: 1513383 - RNA, 12 nt, Human
gcaauggcagcc

SEQ ID NO: 1513384 - RNA, 13 nt, Human
gcaauggcagccu

SEQ ID NO: 1513385 - RNA, 14 nt, Human
gcaauggcagccuu

SEQ ID NO: 1513386 - RNA, 23 nt, Human
gcagacaggcaagcaccuccugc

SEQ ID NO: 1513387 - RNA, 18 nt, Human
gcagacaggaccagggau

SEQ ID NO: 1513388 - RNA, 19 nt, Human
gcagacaggcaagcaccuc

SEQ ID NO: 1513389 - RNA, 12 nt, Human
gcagacaggacc

SEQ ID NO: 1513390 - RNA, 13 nt, Human
gcagacaggacca

SEQ ID NO: 1513391 - RNA, 15 nt, Human
gcagacaggaccagg

SEQ ID NO: 1513392 - RNA, 16 nt, Human
gcacugcuuccaguga

SEQ ID NO: 1513393 - RNA, 18 nt, Human
gcacugcuuccagugagg

SEQ ID NO: 1513394 - RNA, 22 nt, Human
gcacugcuuccagugaggcucu

SEQ ID NO: 1513395 - RNA, 20 nt, Human
gcacugcuuccagugaggcu

SEQ ID NO: 1513396 - RNA, 18 nt, Human
gauuuccguuaaaauacc

SEQ ID NO: 1513397 - RNA, 15 nt, Human
gauuuccguuaaaau

SEQ ID NO: 1513398 - RNA, 13 nt, Human
gauuuggggugga

SEQ ID NO: 1513399 - RNA, 19 nt, Human
gauuucuguuuagauaaua

SEQ ID NO: 1513400 - RNA, 11 nt, Human
gauuucuguuu

SEQ ID NO: 1513401 - RNA, 21 nt, Human
gauuucuguuuagauaauaca

SEQ ID NO: 1513402 - RNA, 15 nt, Human
gauuuuccugaaaac

SEQ ID NO: 1513403 - RNA, 19 nt, Human
gauuuguuaaugauagcua

SEQ ID NO: 1513404 - RNA, 17 nt, Human
gauucauauuuacuucu

SEQ ID NO: 1513405 - RNA, 18 nt, Human
gauucauauuuacuucuu

SEQ ID NO: 1513406 - RNA, 19 nt, Human
gauucauauuuacuucuua

SEQ ID NO: 1513407 - RNA, 19 nt, Human
gauucagacagcugccugg

SEQ ID NO: 1513408 - RNA, 13 nt, Human
gauucagcucugc

SEQ ID NO: 1513409 - RNA, 15 nt, Human
gauucagcucugcaa

SEQ ID NO: 1513410 - RNA, 23 nt, Human
gauggggcugcaccggcuggccu

SEQ ID NO: 1513411 - RNA, 21 nt, Human
gauucccaagcucugcuccuc

SEQ ID NO: 1513412 - RNA, 19 nt, Human
gauucccaagcucugcucc

SEQ ID NO: 1513413 - RNA, 20 nt, Human
gauucccaagcucugcuccu

SEQ ID NO: 1513414 - RNA, 21 nt, Human
gauugcaacaggcugggcuuc

SEQ ID NO: 1513415 - RNA, 16 nt, Human
gauugcaccacugcac

SEQ ID NO: 1513416 - RNA, 23 nt, Human
gauugcaccacugcacuccagcc

SEQ ID NO: 1513417 - RNA, 16 nt, Human
gauucuuuccugaggc

SEQ ID NO: 1513418 - RNA, 17 nt, Human
gauucuuuccugaggcu

SEQ ID NO: 1513419 - RNA, 18 nt, Human
gauucuuuccugaggcug

SEQ ID NO: 1513420 - RNA, 20 nt, Human
gauugcaacaggcugggcuu

SEQ ID NO: 1513421 - RNA, 16 nt, Human
gcaaaguaucccuacu

SEQ ID NO: 1513422 - RNA, 17 nt, Human
gcaagaauugaagcagg

SEQ ID NO: 1513423 - RNA, 23 nt, Human
gcaagacgcugugcugcccugcc

SEQ ID NO: 1513424 - RNA, 14 nt, Human
gcaagacgcugugc

SEQ ID NO: 1513425 - RNA, 20 nt, Human
gcaagacgcugugcugcccu

SEQ ID NO: 1513426 - RNA, 21 nt, Human
gcaagacgcugugcugcccug

SEQ ID NO: 1513427 - RNA, 22 nt, Human
gcaagacgcugugcugcccugc

SEQ ID NO: 1513428 - RNA, 11 nt, Human
gcaaggcuguc

SEQ ID NO: 1513429 - RNA, 13 nt, Human
gcaaggcugucaa

SEQ ID NO: 1513430 - RNA, 14 nt, Human
gcaagggugauggg

SEQ ID NO: 1513431 - RNA, 10 nt, Human
gcaagccaga

SEQ ID NO: 1513432 - RNA, 18 nt, Human
gcaaggagauuuacaacu

SEQ ID NO: 1513433 - RNA, 14 nt, Human
gcaaggucauuuuu

SEQ ID NO: 1513434 - RNA, 15 nt, Human
gcaaucaaaucugcu

SEQ ID NO: 1513435 - RNA, 17 nt, Human
gcaaucaaaucugcuuu

SEQ ID NO: 1513436 - RNA, 17 nt, Human
gcaaugaccuuucaaua

SEQ ID NO: 1513437 - RNA, 20 nt, Human
gcaaugaccuuucaauagga

SEQ ID NO: 1513438 - RNA, 22 nt, Human
gcaaugaccuuucaauaggaaa

SEQ ID NO: 1513439 - RNA, 23 nt, Human
gcaaugaccuuucaauaggaaaa

SEQ ID NO: 1513440 - RNA, 13 nt, Human
gcaaugcuggcug

SEQ ID NO: 1513441 - RNA, 14 nt, Human
gcaaugcuggcugu

SEQ ID NO: 1513442 - RNA, 22 nt, Human
gcaaugcuggcuguuggcuggg

SEQ ID NO: 1513443 - RNA, 23 nt, Human
gcaaugcuggcuguuggcugggg

SEQ ID NO: 1513444 - RNA, 13 nt, Human
gauccuggaaauc

SEQ ID NO: 1513445 - RNA, 22 nt, Human
gauccugagccagauuucacuc

SEQ ID NO: 1513446 - RNA, 15 nt, Human
gaucccucauccuca

SEQ ID NO: 1513447 - RNA, 16 nt, Human
gaucccucauccucau

SEQ ID NO: 1513448 - RNA, 16 nt, Human
gaucuuuucaaguuaa

SEQ ID NO: 1513449 - RNA, 14 nt, Human
gaugaaaauauuug

SEQ ID NO: 1513450 - RNA, 18 nt, Human
gaucuuugcagacaggca

SEQ ID NO: 1513451 - RNA, 22 nt, Human
gauggauuuccagccaaagccu

SEQ ID NO: 1513452 - RNA, 20 nt, Human
gaugccugguggcagcugcg

SEQ ID NO: 1513453 - RNA, 18 nt, Human
gaugccugguggcagcug

SEQ ID NO: 1513454 - RNA, 19 nt, Human
gaugccugguggcagcugc

SEQ ID NO: 1513455 - RNA, 21 nt, Human
gauggcuaguaucaaaagaaa

SEQ ID NO: 1513456 - RNA, 13 nt, Human
gauggggcccugc

SEQ ID NO: 1513457 - RNA, 14 nt, Human
gauggggcccugcc

SEQ ID NO: 1513458 - RNA, 22 nt, Human
gauggggcccugccuccuuugu

SEQ ID NO: 1513459 - RNA, 19 nt, Human
gaugcagccucacaguccu

SEQ ID NO: 1513460 - RNA, 14 nt, Human
gaugcagccucaca

SEQ ID NO: 1513461 - RNA, 12 nt, Human
gaugcagccuca

SEQ ID NO: 1513462 - RNA, 16 nt, Human
gaugcagcauuaugau

SEQ ID NO: 1513463 - RNA, 14 nt, Human
gaugcaccagcccu

SEQ ID NO: 1513464 - RNA, 13 nt, Human
gaugcaccagccc

SEQ ID NO: 1513465 - RNA, 22 nt, Human
gaugcacagaguuguuacauuu

SEQ ID NO: 1513466 - RNA, 17 nt, Human
gaugacaacuucccagu

SEQ ID NO: 1513467 - RNA, 11 nt, Human
gauacagaaaa

SEQ ID NO: 1513468 - RNA, 23 nt, Human
gauagauaggucagugcaaauac

SEQ ID NO: 1513469 - RNA, 22 nt, Human
gauaauacaccacuacauucug

SEQ ID NO: 1513470 - RNA, 21 nt, Human
gauaauacaccacuacauucu

SEQ ID NO: 1513471 - RNA, 18 nt, Human
gauaauacaccacuacau

SEQ ID NO: 1513472 - RNA, 18 nt, Human
gauacaggaaaagcugcu

SEQ ID NO: 1513473 - RNA, 19 nt, Human
gauacaggaaaagcugcug

SEQ ID NO: 1513474 - RNA, 21 nt, Human
gauagcacagacccugcccug

SEQ ID NO: 1513475 - RNA, 22 nt, Human
gauagcacagacccugcccugu

SEQ ID NO: 1513476 - RNA, 13 nt, Human
gauagcagggcau

SEQ ID NO: 1513477 - RNA, 13 nt, Human
gaggaaggaaacc

SEQ ID NO: 1513478 - RNA, 19 nt, Human
gaggaaggaaacccagcuc

SEQ ID NO: 1513479 - RNA, 20 nt, Human
gaggaaggaaacccagcucu

SEQ ID NO: 1513480 - RNA, 21 nt, Human
gaggaaggaaacccagcucug

SEQ ID NO: 1513481 - RNA, 12 nt, Human
gauaaguucaua

SEQ ID NO: 1513482 - RNA, 14 nt, Human
gauaaguucauaca

SEQ ID NO: 1513483 - RNA, 16 nt, Human
gauaaguucauacauu

SEQ ID NO: 1513484 - RNA, 22 nt, Human
gauaaauaguuuaugauuccac

SEQ ID NO: 1513485 - RNA, 17 nt, Human
gaucauccacugugcca

SEQ ID NO: 1513486 - RNA, 19 nt, Human
gaucauccacugugccaug

SEQ ID NO: 1513487 - RNA, 21 nt, Human
gaucauccacugugccaugug

SEQ ID NO: 1513488 - RNA, 21 nt, Human
gaucaaguuauuuuuaauuug

SEQ ID NO: 1513489 - RNA, 18 nt, Human
gaucacgccacugcacua

SEQ ID NO: 1513490 - RNA, 22 nt, Human
gauagucuuucaguuaaggaga

SEQ ID NO: 1513491 - RNA, 15 nt, Human
gauaguaacaaugaa

SEQ ID NO: 1513492 - RNA, 16 nt, Human
gauaguauugugcaua

SEQ ID NO: 1513493 - RNA, 14 nt, Human
gauagucuuucagu

SEQ ID NO: 1513494 - RNA, 12 nt, Human
gaucacggcuca

SEQ ID NO: 1513495 - RNA, 22 nt, Human
gaucagucugauucccaagcuc

SEQ ID NO: 1513496 - RNA, 12 nt, Human
gaucagccuggg

SEQ ID NO: 1513497 - RNA, 15 nt, Human
gaucagccugggcaa

SEQ ID NO: 1513498 - RNA, 16 nt, Human
gagcucgugggacagu

SEQ ID NO: 1513499 - RNA, 17 nt, Human
gagcugaggcaauucua

SEQ ID NO: 1513500 - RNA, 15 nt, Human
gagcugaguggggga

SEQ ID NO: 1513501 - RNA, 15 nt, Human
gagccugcaguuauu

SEQ ID NO: 1513502 - RNA, 15 nt, Human
gagcuagcagcaggg

SEQ ID NO: 1513503 - RNA, 17 nt, Human
gagcuagcagcagggag

SEQ ID NO: 1513504 - RNA, 14 nt, Human
gagcuuuuguagaa

SEQ ID NO: 1513505 - RNA, 16 nt, Human
gaggaaagcaaaggag

SEQ ID NO: 1513506 - RNA, 17 nt, Human
gaggaaagcaaaggaga

SEQ ID NO: 1513507 - RNA, 20 nt, Human
gagcuuugaaaauucagugg

SEQ ID NO: 1513508 - RNA, 22 nt, Human
gagcuuucugcuaucaaagagg

SEQ ID NO: 1513509 - RNA, 17 nt, Human
gaggaagagaaaaaaua

SEQ ID NO: 1513510 - RNA, 13 nt, Human
gaggaagccgcug

SEQ ID NO: 1513511 - RNA, 18 nt, Human
gaggaagccgcuggggcc

SEQ ID NO: 1513512 - RNA, 14 nt, Human
gaggaagccgcugg

SEQ ID NO: 1513513 - RNA, 17 nt, Human
gaggaagccgcuggggc

SEQ ID NO: 1513514 - RNA, 14 nt, Human
gaggaacaaggcaa

SEQ ID NO: 1513515 - RNA, 16 nt, Human
gaggaacaaggcaagg

SEQ ID NO: 1513516 - RNA, 19 nt, Human
gaggaagaacggggcucuu

SEQ ID NO: 1513517 - RNA, 23 nt, Human
gaggaagaacggggcucuucuca

SEQ ID NO: 1513518 - RNA, 14 nt, Human
gagccgaagcccag

SEQ ID NO: 1513519 - RNA, 15 nt, Human
gagccgaagcccagg

SEQ ID NO: 1513520 - RNA, 19 nt, Human
gagccgagaucacgccacu

SEQ ID NO: 1513521 - RNA, 20 nt, Human
gagccgagaucacgccacug

SEQ ID NO: 1513522 - RNA, 11 nt, Human
gagcccacgcc

SEQ ID NO: 1513523 - RNA, 21 nt, Human
gagccgagaucacgccacugc

SEQ ID NO: 1513524 - RNA, 22 nt, Human
gagccgagaucacgccacugca

SEQ ID NO: 1513525 - RNA, 12 nt, Human
gagccugcaguu

SEQ ID NO: 1513526 - RNA, 13 nt, Human
gagccuccugccc

SEQ ID NO: 1513527 - RNA, 13 nt, Human
gagccucagcauc

SEQ ID NO: 1513528 - RNA, 17 nt, Human
gagccucagcauccugg

SEQ ID NO: 1513529 - RNA, 14 nt, Human
gagccucagcaucc

SEQ ID NO: 1513530 - RNA, 15 nt, Human
gagccucagcauccu

SEQ ID NO: 1513531 - RNA, 20 nt, Human
gagccagauuucacucuccu

SEQ ID NO: 1513532 - RNA, 13 nt, Human
gagcccaccuugg

SEQ ID NO: 1513533 - RNA, 15 nt, Human
gagcccaccuuggcu

SEQ ID NO: 1513534 - RNA, 17 nt, Human
gagcccaccuuggcuca

SEQ ID NO: 1513535 - RNA, 18 nt, Human
gagccacugcaccgggcc

SEQ ID NO: 1513536 - RNA, 19 nt, Human
gagccacugcaccgggcca

SEQ ID NO: 1513537 - RNA, 20 nt, Human
gagccacugcaccgggccac

SEQ ID NO: 1513538 - RNA, 15 nt, Human
gagccagauuucacu

SEQ ID NO: 1513539 - RNA, 18 nt, Human
gagccagauuucacucuc

SEQ ID NO: 1513540 - RNA, 19 nt, Human
gagccagauuucacucucc

SEQ ID NO: 1513541 - RNA, 22 nt, Human
gagcagccacauuccugaugcu

SEQ ID NO: 1513542 - RNA, 23 nt, Human
gagcagagaccaucccugaaggc

SEQ ID NO: 1513543 - RNA, 19 nt, Human
gagcagagaccaucccuga

SEQ ID NO: 1513544 - RNA, 21 nt, Human
gagcagagaccaucccugaag

SEQ ID NO: 1513545 - RNA, 20 nt, Human
gagauagccaaggccaaagg

SEQ ID NO: 1513546 - RNA, 21 nt, Human
gagauagccaaggccaaagga

SEQ ID NO: 1513547 - RNA, 17 nt, Human
gagcagagaccaucccu

SEQ ID NO: 1513548 - RNA, 18 nt, Human
gagcagagaccaucccug

SEQ ID NO: 1513549 - RNA, 16 nt, Human
gagcagagaccauccc

SEQ ID NO: 1513550 - RNA, 14 nt, Human
gagaagaacugaaa

SEQ ID NO: 1513551 - RNA, 16 nt, Human
gagaagaacugaaauc

SEQ ID NO: 1513552 - RNA, 15 nt, Human
gagaagagcuguuca

SEQ ID NO: 1513553 - RNA, 22 nt, Human
gagaagagcuguucacagccag

SEQ ID NO: 1513554 - RNA, 22 nt, Human
gagaaugcacaaacagaggccg

SEQ ID NO: 1513555 - RNA, 20 nt, Human
gagaaugcacaaacagaggc

SEQ ID NO: 1513556 - RNA, 21 nt, Human
gagaaugcacaaacagaggcc

SEQ ID NO: 1513557 - RNA, 12 nt, Human
gagacagcccgg

SEQ ID NO: 1513558 - RNA, 19 nt, Human
gagacagaguuuucacucu

SEQ ID NO: 1513559 - RNA, 18 nt, Human
gagacacacugaagaagc

SEQ ID NO: 1513560 - RNA, 15 nt, Human
gagacacaagccuuc

SEQ ID NO: 1513561 - RNA, 17 nt, Human
gagacacaagccuucgg

SEQ ID NO: 1513562 - RNA, 23 nt, Human
gagaaaguacuucuccacccugc

SEQ ID NO: 1513563 - RNA, 13 nt, Human
gagaaagacuauu

SEQ ID NO: 1513564 - RNA, 15 nt, Human
gagaaagacuauuca

SEQ ID NO: 1513565 - RNA, 17 nt, Human
gagaaagacuauucaaa

SEQ ID NO: 1513566 - RNA, 18 nt, Human
gagaaagacuauucaaac

SEQ ID NO: 1513567 - RNA, 21 nt, Human
gagaaaauggacguguuauga

SEQ ID NO: 1513568 - RNA, 14 nt, Human
gacuuggaagcucc

SEQ ID NO: 1513569 - RNA, 15 nt, Human
gacuuggaagcuccg

SEQ ID NO: 1513570 - RNA, 16 nt, Human
gacuuggaagcuccgc

SEQ ID NO: 1513571 - RNA, 19 nt, Human
gacucgcgacaaugcaaac

SEQ ID NO: 1513572 - RNA, 17 nt, Human
gacuccugcaggcagcc

SEQ ID NO: 1513573 - RNA, 18 nt, Human
gacucgcgacaaugcaaa

SEQ ID NO: 1513574 - RNA, 19 nt, Human
gagagacacacugaagaag

SEQ ID NO: 1513575 - RNA, 17 nt, Human
gagagaagagaaugcac

SEQ ID NO: 1513576 - RNA, 17 nt, Human
gagauacagaauuuuau

SEQ ID NO: 1513577 - RNA, 19 nt, Human
gagagugaacaaauuuaca

SEQ ID NO: 1513578 - RNA, 15 nt, Human
gagagugaacaaauu

SEQ ID NO: 1513579 - RNA, 21 nt, Human
gagagggugggagugggccca

SEQ ID NO: 1513580 - RNA, 13 nt, Human
gagaggggaacag

SEQ ID NO: 1513581 - RNA, 18 nt, Human
gagaggggaacagacugg

SEQ ID NO: 1513582 - RNA, 13 nt, Human
gagagccuuccag

SEQ ID NO: 1513583 - RNA, 14 nt, Human
gagagccuuccagg

SEQ ID NO: 1513584 - RNA, 15 nt, Human
gagacagcucugcau

SEQ ID NO: 1513585 - RNA, 18 nt, Human
gagacagcucugcauacu

SEQ ID NO: 1513586 - RNA, 13 nt, Human
gagacagcucugc

SEQ ID NO: 1513587 - RNA, 24 nt, Human
gagacagcccgggcucugccuccc

SEQ ID NO: 1513588 - RNA, 14 nt, Human
gagacagcccgggc

SEQ ID NO: 1513589 - RNA, 17 nt, Human
gagacagcccgggcucu

SEQ ID NO: 1513590 - RNA, 18 nt, Human
gagacagcccgggcucug

SEQ ID NO: 1513591 - RNA, 19 nt, Human
gagacagcccgggcucugc

SEQ ID NO: 1513592 - RNA, 20 nt, Human
gagacagcccgggcucugcc

SEQ ID NO: 1513593 - RNA, 21 nt, Human
gagacagcccgggcucugccu

SEQ ID NO: 1513594 - RNA, 22 nt, Human
gagacagcccgggcucugccuc

SEQ ID NO: 1513595 - RNA, 23 nt, Human
gagacagcccgggcucugccucc

SEQ ID NO: 1513596 - RNA, 12 nt, Human
gagaccaucccu

SEQ ID NO: 1513597 - RNA, 16 nt, Human
gagacucgcgacaaug

SEQ ID NO: 1513598 - RNA, 18 nt, Human
gagacucgcgacaaugca

SEQ ID NO: 1513599 - RNA, 14 nt, Human
gagacucgagaacu

SEQ ID NO: 1513600 - RNA, 15 nt, Human
gagacucgagaacuu

SEQ ID NO: 1513601 - RNA, 16 nt, Human
gagacucgagaacuuu

SEQ ID NO: 1513602 - RNA, 17 nt, Human
gagacucgagaacuuuc

SEQ ID NO: 1513603 - RNA, 20 nt, Human
gagacucgagaacuuucauu

SEQ ID NO: 1513604 - RNA, 14 nt, Human
gagacucugucuca

SEQ ID NO: 1513605 - RNA, 23 nt, Human
gacggagucccaccuuggcugca

SEQ ID NO: 1513606 - RNA, 21 nt, Human
gacggagucccaccuuggcug

SEQ ID NO: 1513607 - RNA, 18 nt, Human
gacggagucccaccuugg

SEQ ID NO: 1513608 - RNA, 17 nt, Human
gacguguuaugacucca

SEQ ID NO: 1513609 - RNA, 20 nt, Human
gacguguuaugacuccagaa

SEQ ID NO: 1513610 - RNA, 23 nt, Human
gaccuugaacuggguacuugugg

SEQ ID NO: 1513611 - RNA, 22 nt, Human
gaccuuuaagagaaaugagcug

SEQ ID NO: 1513612 - RNA, 21 nt, Human
gaccuuucaauaggaaaaacu

SEQ ID NO: 1513613 - RNA, 12 nt, Human
gacuacaggcac

SEQ ID NO: 1513614 - RNA, 17 nt, Human
gacuacucccccaggug

SEQ ID NO: 1513615 - RNA, 22 nt, Human
gacguguuaugacuccagaauu

SEQ ID NO: 1513616 - RNA, 15 nt, Human
gacuccugcaggcag

SEQ ID NO: 1513617 - RNA, 16 nt, Human
gacuccugcaggcagc

SEQ ID NO: 1513618 - RNA, 14 nt, Human
gaccgugaggccag

SEQ ID NO: 1513619 - RNA, 15 nt, Human
gaccgugaggccaga

SEQ ID NO: 1513620 - RNA, 17 nt, Human
gacccugcccugugggc

SEQ ID NO: 1513621 - RNA, 23 nt, Human
gaccugauuucugagcauuuaau

SEQ ID NO: 1513622 - RNA, 18 nt, Human
gaccugaggcccuucucu

SEQ ID NO: 1513623 - RNA, 21 nt, Human
gaccugaggcccuucucucca

SEQ ID NO: 1513624 - RNA, 11 nt, Human
gaccucaggcc

SEQ ID NO: 1513625 - RNA, 12 nt, Human
gaccucaggccu

SEQ ID NO: 1513626 - RNA, 13 nt, Human
gaccucaggccug

SEQ ID NO: 1513627 - RNA, 15 nt, Human
gaccugaggcccuuc

SEQ ID NO: 1513628 - RNA, 14 nt, Human
gacccaugcugccc

SEQ ID NO: 1513629 - RNA, 15 nt, Human
gacccaugcugcccu

SEQ ID NO: 1513630 - RNA, 16 nt, Human
gacccaugcugcccug

SEQ ID NO: 1513631 - RNA, 17 nt, Human
gacccaugcugcccugu

SEQ ID NO: 1513632 - RNA, 12 nt, Human
gaccccagcucu

SEQ ID NO: 1513633 - RNA, 11 nt, Human
gacccacugcu

SEQ ID NO: 1513634 - RNA, 12 nt, Human
gacccacugcuu

SEQ ID NO: 1513635 - RNA, 14 nt, Human
gaccccagcucugc

SEQ ID NO: 1513636 - RNA, 13 nt, Human
gaccccuccaugu

SEQ ID NO: 1513637 - RNA, 19 nt, Human
gacccugaggcccagaggg

SEQ ID NO: 1513638 - RNA, 20 nt, Human
gacccugaggcccagagggc

SEQ ID NO: 1513639 - RNA, 21 nt, Human
gacccugaggcccagagggcc

SEQ ID NO: 1513640 - RNA, 13 nt, Human
gacccugcccugu

SEQ ID NO: 1513641 - RNA, 15 nt, Human
gacccugcccugugg

SEQ ID NO: 1513642 - RNA, 16 nt, Human
gacccugcccuguggg

SEQ ID NO: 1513643 - RNA, 23 nt, Human
gacccugucucaaaaaaagaaaa

SEQ ID NO: 1513644 - RNA, 22 nt, Human
gacacccugugauggggcccug

SEQ ID NO: 1513645 - RNA, 23 nt, Human
gacacccugugauggggcccugc

SEQ ID NO: 1513646 - RNA, 12 nt, Human
gacacccuguga

SEQ ID NO: 1513647 - RNA, 13 nt, Human
gacacccugugau

SEQ ID NO: 1513648 - RNA, 18 nt, Human
gacacaggcccggcucca

SEQ ID NO: 1513649 - RNA, 15 nt, Human
gacacgaauauugcu

SEQ ID NO: 1513650 - RNA, 18 nt, Human
gacaccuugacagggcac

SEQ ID NO: 1513651 - RNA, 20 nt, Human
gacaccuugacagggcacac

SEQ ID NO: 1513652 - RNA, 15 nt, Human
gacaccuugacaggg

SEQ ID NO: 1513653 - RNA, 17 nt, Human
gacaccuugacagggca

SEQ ID NO: 1513654 - RNA, 19 nt, Human
gacacgaauauugcugaug

SEQ ID NO: 1513655 - RNA, 17 nt, Human
gacacgaauauugcuga

SEQ ID NO: 1513656 - RNA, 18 nt, Human
gacacgaauauugcugau

SEQ ID NO: 1513657 - RNA, 15 nt, Human
gacacuaaccacgcu

SEQ ID NO: 1513658 - RNA, 16 nt, Human
gacacuaaccacgcug

SEQ ID NO: 1513659 - RNA, 17 nt, Human
gacacuaaccacgcugg

SEQ ID NO: 1513660 - RNA, 18 nt, Human
gacacuaaccacgcugga

SEQ ID NO: 1513661 - RNA, 15 nt, Human
gacaagcucacagac

SEQ ID NO: 1513662 - RNA, 22 nt, Human
gacaaggauugcuacuguccua

SEQ ID NO: 1513663 - RNA, 14 nt, Human
gaagucuuuguaca

SEQ ID NO: 1513664 - RNA, 16 nt, Human
gaagucuuuguacaga

SEQ ID NO: 1513665 - RNA, 16 nt, Human
gacaaugacccagugg

SEQ ID NO: 1513666 - RNA, 12 nt, Human
gacaauuuauua

SEQ ID NO: 1513667 - RNA, 16 nt, Human
gacaaugcaaaccauc

SEQ ID NO: 1513668 - RNA, 18 nt, Human
gacaaugcaaaccaucau

SEQ ID NO: 1513669 - RNA, 21 nt, Human
gacaaugacuuacuguacaug

SEQ ID NO: 1513670 - RNA, 12 nt, Human
gacaaugcaaac

SEQ ID NO: 1513671 - RNA, 20 nt, Human
gacaaugacuuacuguacau

SEQ ID NO: 1513672 - RNA, 17 nt, Human
gacaaugacuuacugua

SEQ ID NO: 1513673 - RNA, 19 nt, Human
gacaauuuauuauggcaca

SEQ ID NO: 1513674 - RNA, 13 nt, Human
gacaauuuauuau

SEQ ID NO: 1513675 - RNA, 13 nt, Human
gacacacagcucu

SEQ ID NO: 1513676 - RNA, 15 nt, Human
gacacaggcccggcu

SEQ ID NO: 1513677 - RNA, 17 nt, Human
gacacaggcccggcucc

SEQ ID NO: 1513678 - RNA, 22 nt, Human
gacaugggacauuugcucaugg

SEQ ID NO: 1513679 - RNA, 20 nt, Human
gacaugggugaacuuacuug

SEQ ID NO: 1513680 - RNA, 21 nt, Human
gacaugucuuuucuugcauga

SEQ ID NO: 1513681 - RNA, 17 nt, Human
gacaugucuuuucuugc

SEQ ID NO: 1513682 - RNA, 23 nt, Human
gacauacuaaccagcagaaaugc

SEQ ID NO: 1513683 - RNA, 14 nt, Human
gacaucaacagaua

SEQ ID NO: 1513684 - RNA, 20 nt, Human
gacaggcauguucucugagg

SEQ ID NO: 1513685 - RNA, 16 nt, Human
gacauacuaaccagca

SEQ ID NO: 1513686 - RNA, 15 nt, Human
gacauacuaaccagc

SEQ ID NO: 1513687 - RNA, 14 nt, Human
gacaggcaaugcug

SEQ ID NO: 1513688 - RNA, 16 nt, Human
gacaggcaaugcuggc

SEQ ID NO: 1513689 - RNA, 17 nt, Human
gacaggcaaugcuggcu

SEQ ID NO: 1513690 - RNA, 18 nt, Human
gacaggcaaugcuggcug

SEQ ID NO: 1513691 - RNA, 18 nt, Human
gacaggcauguucucuga

SEQ ID NO: 1513692 - RNA, 19 nt, Human
gacaggcauguucucugag

SEQ ID NO: 1513693 - RNA, 14 nt, Human
gacagcugccuggg

SEQ ID NO: 1513694 - RNA, 15 nt, Human
gacagcugccuggga

SEQ ID NO: 1513695 - RNA, 13 nt, Human
gacagccacggcc

SEQ ID NO: 1513696 - RNA, 12 nt, Human
gacagcugccug

SEQ ID NO: 1513697 - RNA, 13 nt, Human
gacagcugccugg

SEQ ID NO: 1513698 - RNA, 14 nt, Human
gacagacacaggcc

SEQ ID NO: 1513699 - RNA, 20 nt, Human
gacacuaaccacgcuggacc

SEQ ID NO: 1513700 - RNA, 21 nt, Human
gacacuaaccacgcuggaccu

SEQ ID NO: 1513701 - RNA, 15 nt, Human
gacagacacaggccc

SEQ ID NO: 1513702 - RNA, 16 nt, Human
gacagacacaggcccg

SEQ ID NO: 1513703 - RNA, 23 nt, Human
gaagauuuugaaauuuuuauuaa

SEQ ID NO: 1513704 - RNA, 17 nt, Human
gaagauguagaggagaa

SEQ ID NO: 1513705 - RNA, 20 nt, Human
gaagaguauuuuugacagaa

SEQ ID NO: 1513706 - RNA, 23 nt, Human
gaagagcuguucacagccagacu

SEQ ID NO: 1513707 - RNA, 13 nt, Human
gaagagcuguuca

SEQ ID NO: 1513708 - RNA, 15 nt, Human
gaagagcuguucaca

SEQ ID NO: 1513709 - RNA, 20 nt, Human
gaagagcuguucacagccag

SEQ ID NO: 1513710 - RNA, 15 nt, Human
gaagacuucaucccu

SEQ ID NO: 1513711 - RNA, 16 nt, Human
gaagacuucaucccuc

SEQ ID NO: 1513712 - RNA, 12 nt, Human
gaagagccuugc

SEQ ID NO: 1513713 - RNA, 17 nt, Human
gaagacuucaucccucu

SEQ ID NO: 1513714 - RNA, 19 nt, Human
gaagacuucaucccucugg

SEQ ID NO: 1513715 - RNA, 14 nt, Human
gaaccacaagacug

SEQ ID NO: 1513716 - RNA, 15 nt, Human
gaaccacaagacugc

SEQ ID NO: 1513717 - RNA, 20 nt, Human
gaaccacaucuugcucugcu

SEQ ID NO: 1513718 - RNA, 18 nt, Human
gaaccacaucuugcucug

SEQ ID NO: 1513719 - RNA, 16 nt, Human
gaacucccuuucaaca

SEQ ID NO: 1513720 - RNA, 17 nt, Human
gaacuuaaauaauguga

SEQ ID NO: 1513721 - RNA, 14 nt, Human
gaacuuaaauaaug

SEQ ID NO: 1513722 - RNA, 22 nt, Human
gaacuuugaccucugcagcaau

SEQ ID NO: 1513723 - RNA, 16 nt, Human
gaacuuugaccucugc

SEQ ID NO: 1513724 - RNA, 14 nt, Human
gaacuuucauuuuu

SEQ ID NO: 1513725 - RNA, 23 nt, Human
gaacuuucauuuuuuuccaggcu

SEQ ID NO: 1513726 - RNA, 17 nt, Human
gaacuuuccaggaaggc

SEQ ID NO: 1513727 - RNA, 12 nt, Human
gaacuugguucc

SEQ ID NO: 1513728 - RNA, 12 nt, Human
gaacuuucauuu

SEQ ID NO: 1513729 - RNA, 13 nt, Human
gaacuuucauuuu

SEQ ID NO: 1513730 - RNA, 18 nt, Human
gaacuuggcgcugccccu

SEQ ID NO: 1513731 - RNA, 17 nt, Human
gaacuugggccacugug

SEQ ID NO: 1513732 - RNA, 23 nt, Human
gaaguccaagcauuuagauguau

SEQ ID NO: 1513733 - RNA, 21 nt, Human
gaagucacauuccugaacagg

SEQ ID NO: 1513734 - RNA, 16 nt, Human
gaagucacauuccuga

SEQ ID NO: 1513735 - RNA, 20 nt, Human
gaagucacauuccugaacag

SEQ ID NO: 1513736 - RNA, 16 nt, Human
gaaggugauuuauucu

SEQ ID NO: 1513737 - RNA, 20 nt, Human
gaaguaauaugcacacauuu

SEQ ID NO: 1513738 - RNA, 19 nt, Human
gaaguaauaugcacacauu

SEQ ID NO: 1513739 - RNA, 21 nt, Human
gaaguaauaugcacacauuuu

SEQ ID NO: 1513740 - RNA, 13 nt, Human
gaagucacacagu

SEQ ID NO: 1513741 - RNA, 13 nt, Human
gaagggggcuggg

SEQ ID NO: 1513742 - RNA, 15 nt, Human
gaagggggcugggac

SEQ ID NO: 1513743 - RNA, 19 nt, Human
gaaggaagacuucaucccu

SEQ ID NO: 1513744 - RNA, 21 nt, Human
gaaggaaacccagcucugguc

SEQ ID NO: 1513745 - RNA, 22 nt, Human
gaaggaaacccagcucuggucc

SEQ ID NO: 1513746 - RNA, 15 nt, Human
gaaggaacguccccu

SEQ ID NO: 1513747 - RNA, 19 nt, Human
gaaggacauugcggacagc

SEQ ID NO: 1513748 - RNA, 20 nt, Human
gaaggacauugcggacagcc

SEQ ID NO: 1513749 - RNA, 21 nt, Human
gaaggacauugcggacagcca

SEQ ID NO: 1513750 - RNA, 20 nt, Human
gaaggaaacccagcucuggu

SEQ ID NO: 1513751 - RNA, 14 nt, Human
gaagccgcuggggc

SEQ ID NO: 1513752 - RNA, 18 nt, Human
gaagccgcuggggccagu

SEQ ID NO: 1513753 - RNA, 20 nt, Human
gaagccgcuggggccaguug

SEQ ID NO: 1513754 - RNA, 21 nt, Human
gaagccgcuggggccaguugg

SEQ ID NO: 1513755 - RNA, 14 nt, Human
gaaauaaacgucuu

SEQ ID NO: 1513756 - RNA, 16 nt, Human
gaaauaaacgucuuaa

SEQ ID NO: 1513757 - RNA, 17 nt, Human
gaaauaaacgucuuaaa

SEQ ID NO: 1513758 - RNA, 18 nt, Human
gaaauaaacgucuuaaau

SEQ ID NO: 1513759 - RNA, 21 nt, Human
gaaauaaacgucuuaaauauu

SEQ ID NO: 1513760 - RNA, 15 nt, Human
gaaauauuuauuuua

SEQ ID NO: 1513761 - RNA, 16 nt, Human
gaaauauuuauuuuaa

SEQ ID NO: 1513762 - RNA, 13 nt, Human
gaaauauuuauuu

SEQ ID NO: 1513763 - RNA, 20 nt, Human
gaaauaucugaaaauguaug

SEQ ID NO: 1513764 - RNA, 18 nt, Human
gaaauaucugaaaaugua

SEQ ID NO: 1513765 - RNA, 19 nt, Human
gaaauaucugaaaauguau

SEQ ID NO: 1513766 - RNA, 20 nt, Human
gaaauuacuaauuuuacuuc

SEQ ID NO: 1513767 - RNA, 17 nt, Human
gaaauguacagcaagga

SEQ ID NO: 1513768 - RNA, 17 nt, Human
gaaaugggcagagcaga

SEQ ID NO: 1513769 - RNA, 19 nt, Human
gaaaugggcagagcagaga

SEQ ID NO: 1513770 - RNA, 11 nt, Human
gaaaugagcug

SEQ ID NO: 1513771 - RNA, 18 nt, Human
gaaaugaggucagagccu

SEQ ID NO: 1513772 - RNA, 16 nt, Human
gaaaugggcagagcag

SEQ ID NO: 1513773 - RNA, 15 nt, Human
gaaaugggcagagca

SEQ ID NO: 1513774 - RNA, 20 nt, Human
gaaauuuccuaauuuauucu

SEQ ID NO: 1513775 - RNA, 19 nt, Human
gaaauuacuaauuuuacuu

SEQ ID NO: 1513776 - RNA, 17 nt, Human
gaaauuauauaaguauu

SEQ ID NO: 1513777 - RNA, 23 nt, Human
gaaauuauauaaguauucuaaau

SEQ ID NO: 1513778 - RNA, 21 nt, Human
gaaauuuccugggagcuuuug

SEQ ID NO: 1513779 - RNA, 15 nt, Human
gaacacuccuucaca

SEQ ID NO: 1513780 - RNA, 16 nt, Human
gaacacuccuucacag

SEQ ID NO: 1513781 - RNA, 17 nt, Human
gaacacuccuucacaga

SEQ ID NO: 1513782 - RNA, 20 nt, Human
gaacagacuggaagcacagc

SEQ ID NO: 1513783 - RNA, 22 nt, Human
gaacaguuguguuugaagcaca

SEQ ID NO: 1513784 - RNA, 24 nt, Human
gaacaguuaccucugccucagaaa

SEQ ID NO: 1513785 - RNA, 20 nt, Human
gaacaguuguguuugaagca

SEQ ID NO: 1513786 - RNA, 17 nt, Human
gaacaggauauucucac

SEQ ID NO: 1513787 - RNA, 18 nt, Human
gaacagauaaucagugug

SEQ ID NO: 1513788 - RNA, 22 nt, Human
gaacagacuggaagcacagcuu

SEQ ID NO: 1513789 - RNA, 11 nt, Human
gaaaggaaaga

SEQ ID NO: 1513790 - RNA, 16 nt, Human
gaaaggaaagaggcuc

SEQ ID NO: 1513791 - RNA, 23 nt, Human
gaaaguuauugauaaguucauac

SEQ ID NO: 1513792 - RNA, 13 nt, Human
gaaacugccagca

SEQ ID NO: 1513793 - RNA, 15 nt, Human
gaaacugccagcaac

SEQ ID NO: 1513794 - RNA, 16 nt, Human
gaaaaaugagccuggc

SEQ ID NO: 1513795 - RNA, 19 nt, Human
gaaagacuauucaaacagu

SEQ ID NO: 1513796 - RNA, 22 nt, Human
gaaagacuauucaaacagucuc

SEQ ID NO: 1513797 - RNA, 23 nt, Human
gaaagacuauucaaacagucuca

SEQ ID NO: 1513798 - RNA, 17 nt, Human
gaaagacuguacaaagu

SEQ ID NO: 1513799 - RNA, 16 nt, Human
gaaagaucaaaagguu

SEQ ID NO: 1513800 - RNA, 13 nt, Human
gaaagcagaacag

SEQ ID NO: 1513801 - RNA, 14 nt, Human
gaaagcagaacagu

SEQ ID NO: 1513802 - RNA, 16 nt, Human
cuuuggaacaagaugg

SEQ ID NO: 1513803 - RNA, 22 nt, Human
cuuuucauuuaggugaggaagc

SEQ ID NO: 1513804 - RNA, 13 nt, Human
cuuuuccaacccu

SEQ ID NO: 1513805 - RNA, 23 nt, Human
cuuuuccaacccucaucaccaac

SEQ ID NO: 1513806 - RNA, 20 nt, Human
cuuuucgcaggauucuuccu

SEQ ID NO: 1513807 - RNA, 21 nt, Human
cuuuucgcaggauucuuccuc

SEQ ID NO: 1513808 - RNA, 15 nt, Human
cuuuuuucacuacau

SEQ ID NO: 1513809 - RNA, 11 nt, Human
gaaaaagaaaa

SEQ ID NO: 1513810 - RNA, 16 nt, Human
gaaaaagaaaaaauau

SEQ ID NO: 1513811 - RNA, 18 nt, Human
cuuuuuuauacauaaaca

SEQ ID NO: 1513812 - RNA, 15 nt, Human
cuuuuuuauacauaa

SEQ ID NO: 1513813 - RNA, 17 nt, Human
cuuuuuuauacauaaac

SEQ ID NO: 1513814 - RNA, 16 nt, Human
cuuuuuuauacauaaa

SEQ ID NO: 1513815 - RNA, 22 nt, Human
cuuuuuaauauugauaugcuua

SEQ ID NO: 1513816 - RNA, 13 nt, Human
cuuuucuuuucuu

SEQ ID NO: 1513817 - RNA, 17 nt, Human
cuuuucuuucagccaag

SEQ ID NO: 1513818 - RNA, 17 nt, Human
cuuuccugaggcugggc

SEQ ID NO: 1513819 - RNA, 16 nt, Human
cuuuccugaggcuggg

SEQ ID NO: 1513820 - RNA, 20 nt, Human
cuuuccugaggcugggcucc

SEQ ID NO: 1513821 - RNA, 21 nt, Human
cuuuccugaggcugggcuccc

SEQ ID NO: 1513822 - RNA, 16 nt, Human
cuuugcagacaggcaa

SEQ ID NO: 1513823 - RNA, 19 nt, Human
cuuuggaaagaguaggaag

SEQ ID NO: 1513824 - RNA, 23 nt, Human
cuuuggaaagaguaggaagacuu

SEQ ID NO: 1513825 - RNA, 14 nt, Human
cuuugcagacaggc

SEQ ID NO: 1513826 - RNA, 15 nt, Human
cuuugcagacaggca

SEQ ID NO: 1513827 - RNA, 20 nt, Human
cuuguguguuuauugucaaa

SEQ ID NO: 1513828 - RNA, 21 nt, Human
cuuguggacacagcucuucuc

SEQ ID NO: 1513829 - RNA, 15 nt, Human
cuuuccaggaaggcu

SEQ ID NO: 1513830 - RNA, 19 nt, Human
cuuuccucaaaacuucaga

SEQ ID NO: 1513831 - RNA, 22 nt, Human
cuuuccaaaguacacuguuuca

SEQ ID NO: 1513832 - RNA, 16 nt, Human
cuuuccaaaugcccag

SEQ ID NO: 1513833 - RNA, 16 nt, Human
cuuuccaaaguacacu

SEQ ID NO: 1513834 - RNA, 14 nt, Human
cuuuccaggaaggc

SEQ ID NO: 1513835 - RNA, 17 nt, Human
cuuguggacacagcucu

SEQ ID NO: 1513836 - RNA, 18 nt, Human
cuuguggacacagcucuu

SEQ ID NO: 1513837 - RNA, 18 nt, Human
cuuguaaaggaauuuaaa

SEQ ID NO: 1513838 - RNA, 20 nt, Human
cuuggggaccagagcugcca

SEQ ID NO: 1513839 - RNA, 14 nt, Human
cuuggcugcaggga

SEQ ID NO: 1513840 - RNA, 17 nt, Human
cuuggggaccagagcug

SEQ ID NO: 1513841 - RNA, 18 nt, Human
cuuggggaccagagcugc

SEQ ID NO: 1513842 - RNA, 19 nt, Human
cuuggggaccagagcugcc

SEQ ID NO: 1513843 - RNA, 17 nt, Human
cuugccaaauauaaaua

SEQ ID NO: 1513844 - RNA, 14 nt, Human
cuugcauugcagag

SEQ ID NO: 1513845 - RNA, 13 nt, Human
cuugcuugcuuuu

SEQ ID NO: 1513846 - RNA, 23 nt, Human
cuuggcucaaguccucuuuucug

SEQ ID NO: 1513847 - RNA, 13 nt, Human
cuuggauuguccc

SEQ ID NO: 1513848 - RNA, 14 nt, Human
cuuggauugucccc

SEQ ID NO: 1513849 - RNA, 12 nt, Human
cuuggcugcagg

SEQ ID NO: 1513850 - RNA, 13 nt, Human
cuuggcugcaggg

SEQ ID NO: 1513851 - RNA, 13 nt, Human
cuucuuuccacag

SEQ ID NO: 1513852 - RNA, 19 nt, Human
cuucuuuccacagaagcuc

SEQ ID NO: 1513853 - RNA, 19 nt, Human
cuugaaauauaggaacuua

SEQ ID NO: 1513854 - RNA, 19 nt, Human
cuugaacuccuggccucaa

SEQ ID NO: 1513855 - RNA, 16 nt, Human
cuugaacuggguacuu

SEQ ID NO: 1513856 - RNA, 15 nt, Human
cuugaacuuugaccu

SEQ ID NO: 1513857 - RNA, 18 nt, Human
cuugaacuggguacuugu

SEQ ID NO: 1513858 - RNA, 20 nt, Human
cuugaacuggguacuugugg

SEQ ID NO: 1513859 - RNA, 19 nt, Human
cuugaacccgggaggcaga

SEQ ID NO: 1513860 - RNA, 20 nt, Human
cuugaacccgggaggcagag

SEQ ID NO: 1513861 - RNA, 14 nt, Human
cuugaacuccuggc

SEQ ID NO: 1513862 - RNA, 15 nt, Human
cuugaacuccuggcc

SEQ ID NO: 1513863 - RNA, 17 nt, Human
cuugaacuccuggccuc

SEQ ID NO: 1513864 - RNA, 18 nt, Human
cuugaacuccuggccuca

SEQ ID NO: 1513865 - RNA, 13 nt, Human
cuugagcucagga

SEQ ID NO: 1513866 - RNA, 22 nt, Human
cuugagccuugaacuuugaccu

SEQ ID NO: 1513867 - RNA, 20 nt, Human
cuugagccuugaacuuugac

SEQ ID NO: 1513868 - RNA, 19 nt, Human
cuugagccuugaacuuuga

SEQ ID NO: 1513869 - RNA, 17 nt, Human
cuugaccauucuccacc

SEQ ID NO: 1513870 - RNA, 20 nt, Human
cuugaccauucuccaccugc

SEQ ID NO: 1513871 - RNA, 14 nt, Human
cuugagagggugga

SEQ ID NO: 1513872 - RNA, 21 nt, Human
cuugaccauucuccaccugcc

SEQ ID NO: 1513873 - RNA, 21 nt, Human
cuugcaugguuuagaaagcuu

SEQ ID NO: 1513874 - RNA, 21 nt, Human
cuugcaugaggcuaguguggu

SEQ ID NO: 1513875 - RNA, 23 nt, Human
cuugcaucaauuuuucuuauuuc

SEQ ID NO: 1513876 - RNA, 20 nt, Human
cuugcagacucuacagaggc

SEQ ID NO: 1513877 - RNA, 18 nt, Human
cuugcagacucuacagag

SEQ ID NO: 1513878 - RNA, 22 nt, Human
cuugcaaaguaucccuacugua

SEQ ID NO: 1513879 - RNA, 18 nt, Human
cuugaguugauucagcuc

SEQ ID NO: 1513880 - RNA, 14 nt, Human
cuugcaauggcagc

SEQ ID NO: 1513881 - RNA, 15 nt, Human
cuguaugauucccag

SEQ ID NO: 1513882 - RNA, 18 nt, Human
cuguaucccaugagccuc

SEQ ID NO: 1513883 - RNA, 19 nt, Human
cuguaucccaugagccuca

SEQ ID NO: 1513884 - RNA, 22 nt, Human
cuguaccucuugagccuugaac

SEQ ID NO: 1513885 - RNA, 15 nt, Human
cuguaucccaugagc

SEQ ID NO: 1513886 - RNA, 13 nt, Human
cuguauuuuaaaa

SEQ ID NO: 1513887 - RNA, 16 nt, Human
cuguauuuuaaaagaa

SEQ ID NO: 1513888 - RNA, 19 nt, Human
cuguauuuuaaaagaauga

SEQ ID NO: 1513889 - RNA, 22 nt, Human
cugucccagugccgagaaggaa

SEQ ID NO: 1513890 - RNA, 18 nt, Human
cugucucuacuaaaaaua

SEQ ID NO: 1513891 - RNA, 14 nt, Human
cuguccgagcuuug

SEQ ID NO: 1513892 - RNA, 21 nt, Human
cuguccuacucugugucaggu

SEQ ID NO: 1513893 - RNA, 22 nt, Human
cugucucaaaaaaagaaaaaga

SEQ ID NO: 1513894 - RNA, 13 nt, Human
cugucccccugac

SEQ ID NO: 1513895 - RNA, 14 nt, Human
cugucccccugaca

SEQ ID NO: 1513896 - RNA, 17 nt, Human
cuguccccgcacugggc

SEQ ID NO: 1513897 - RNA, 16 nt, Human
cuguccuacucugugu

SEQ ID NO: 1513898 - RNA, 17 nt, Human
cuguccuacucuguguc

SEQ ID NO: 1513899 - RNA, 18 nt, Human
cuguccuacucuguguca

SEQ ID NO: 1513900 - RNA, 20 nt, Human
cuguccuacucugugucagg

SEQ ID NO: 1513901 - RNA, 15 nt, Human
cuggguuggagggug

SEQ ID NO: 1513902 - RNA, 20 nt, Human
cugggcucccuucccaccuc

SEQ ID NO: 1513903 - RNA, 21 nt, Human
cugggcucccuucccaccucu

SEQ ID NO: 1513904 - RNA, 22 nt, Human
cugggcucccuucccaccucuc

SEQ ID NO: 1513905 - RNA, 19 nt, Human
cuggguacuuguggacaca

SEQ ID NO: 1513906 - RNA, 18 nt, Human
cuggguacuuguggacac

SEQ ID NO: 1513907 - RNA, 16 nt, Human
cuggguacuuguggac

SEQ ID NO: 1513908 - RNA, 13 nt, Human
cuggucccacuca

SEQ ID NO: 1513909 - RNA, 14 nt, Human
cuggucccacgagg

SEQ ID NO: 1513910 - RNA, 14 nt, Human
cuggucccacucag

SEQ ID NO: 1513911 - RNA, 17 nt, Human
cuggucccacgagggug

SEQ ID NO: 1513912 - RNA, 19 nt, Human
cuggucccacgagggugcc

SEQ ID NO: 1513913 - RNA, 23 nt, Human
cuggucucaaacucuugaccuca

SEQ ID NO: 1513914 - RNA, 16 nt, Human
cugguuccauggccuc

SEQ ID NO: 1513915 - RNA, 20 nt, Human
cugguucaggguuggccccu

SEQ ID NO: 1513916 - RNA, 12 nt, Human
cugguggcagcu

SEQ ID NO: 1513917 - RNA, 16 nt, Human
cugguggcagcucacc

SEQ ID NO: 1513918 - RNA, 13 nt, Human
cugguggcagcuc

SEQ ID NO: 1513919 - RNA, 14 nt, Human
cugguggcagcuca

SEQ ID NO: 1513920 - RNA, 17 nt, Human
cuguaauuugugauaca

SEQ ID NO: 1513921 - RNA, 18 nt, Human
cuguaauuugugauacaa

SEQ ID NO: 1513922 - RNA, 22 nt, Human
cuguaauuugugauacaaugcu

SEQ ID NO: 1513923 - RNA, 21 nt, Human
cuguaauuugugauacaaugc

SEQ ID NO: 1513924 - RNA, 23 nt, Human
cuguacagagcccacgcccccac

SEQ ID NO: 1513925 - RNA, 23 nt, Human
cuguacaugaaaacacauuuuuc

SEQ ID NO: 1513926 - RNA, 22 nt, Human
cuguacaugaaaacacauuuuu

SEQ ID NO: 1513927 - RNA, 21 nt, Human
cuguaccucuugagccuugaa

SEQ ID NO: 1513928 - RNA, 19 nt, Human
cugggaggucaaggcugca

SEQ ID NO: 1513929 - RNA, 21 nt, Human
cugggaggucaaggcugcagu

SEQ ID NO: 1513930 - RNA, 12 nt, Human
cugggagugagc

SEQ ID NO: 1513931 - RNA, 20 nt, Human
cugggaucccucauccucau

SEQ ID NO: 1513932 - RNA, 18 nt, Human
cugggaugauuggagggg

SEQ ID NO: 1513933 - RNA, 20 nt, Human
cugggauuacaggugugaac

SEQ ID NO: 1513934 - RNA, 17 nt, Human
cugggauuacaggugug

SEQ ID NO: 1513935 - RNA, 16 nt, Human
cuggcuguuggcuggg

SEQ ID NO: 1513936 - RNA, 17 nt, Human
cuggcuguuggcugggg

SEQ ID NO: 1513937 - RNA, 20 nt, Human
cuggcugguuagagguuccc

SEQ ID NO: 1513938 - RNA, 18 nt, Human
cuggcuguuggcuggggg

SEQ ID NO: 1513939 - RNA, 17 nt, Human
cugggagagccuuccag

SEQ ID NO: 1513940 - RNA, 18 nt, Human
cugggagagccuuccagg

SEQ ID NO: 1513941 - RNA, 21 nt, Human
cugggagagccuuccaggggu

SEQ ID NO: 1513942 - RNA, 19 nt, Human
cugggagagccuuccaggg

SEQ ID NO: 1513943 - RNA, 20 nt, Human
cugggagagccuuccagggg

SEQ ID NO: 1513944 - RNA, 18 nt, Human
cuggaauauauaaccagu

SEQ ID NO: 1513945 - RNA, 14 nt, Human
cuggcaagaaugug

SEQ ID NO: 1513946 - RNA, 14 nt, Human
cuggaaugcagugg

SEQ ID NO: 1513947 - RNA, 16 nt, Human
cuggcacccggccccu

SEQ ID NO: 1513948 - RNA, 17 nt, Human
cuggcacccggccccug

SEQ ID NO: 1513949 - RNA, 18 nt, Human
cuggcacccggccccugc

SEQ ID NO: 1513950 - RNA, 19 nt, Human
cuggcacccggccccugcu

SEQ ID NO: 1513951 - RNA, 24 nt, Human
cuggcaugggaaugaaugucagug

SEQ ID NO: 1513952 - RNA, 15 nt, Human
cuggcacuauaaugu

SEQ ID NO: 1513953 - RNA, 16 nt, Human
cuggcacuauaaugua

SEQ ID NO: 1513954 - RNA, 22 nt, Human
cuggcacuauaauguaagcucu

SEQ ID NO: 1513955 - RNA, 16 nt, Human
cuggcaugggaaugaa

SEQ ID NO: 1513956 - RNA, 18 nt, Human
cuggcaugggaaugaaug

SEQ ID NO: 1513957 - RNA, 19 nt, Human
cuggcaugggaaugaaugu

SEQ ID NO: 1513958 - RNA, 22 nt, Human
cuggcaugggaaugaaugucag

SEQ ID NO: 1513959 - RNA, 12 nt, Human
cuggccucugca

SEQ ID NO: 1513960 - RNA, 23 nt, Human
cuggccucaagugauucuccugc

SEQ ID NO: 1513961 - RNA, 14 nt, Human
cuggccuggccccu

SEQ ID NO: 1513962 - RNA, 18 nt, Human
cuggccugagcugggaug

SEQ ID NO: 1513963 - RNA, 13 nt, Human
cuggccucugcac

SEQ ID NO: 1513964 - RNA, 14 nt, Human
cuggccucugcacu

SEQ ID NO: 1513965 - RNA, 16 nt, Human
cuggccucugcacucc

SEQ ID NO: 1513966 - RNA, 16 nt, Human
cuggccugagcuggga

SEQ ID NO: 1513967 - RNA, 16 nt, Human
cuggccuucggccucc

SEQ ID NO: 1513968 - RNA, 17 nt, Human
cuggccuucggccucca

SEQ ID NO: 1513969 - RNA, 18 nt, Human
cuggccuucggccuccau

SEQ ID NO: 1513970 - RNA, 21 nt, Human
cuggccuucggccuccauccu

SEQ ID NO: 1513971 - RNA, 15 nt, Human
cuggccuucggccuc

SEQ ID NO: 1513972 - RNA, 19 nt, Human
cuggccuggccccucaggg

SEQ ID NO: 1513973 - RNA, 16 nt, Human
cuggccuggccccuca

SEQ ID NO: 1513974 - RNA, 17 nt, Human
cuggccuggccccucag

SEQ ID NO: 1513975 - RNA, 17 nt, Human
cugcaguugccagucac

SEQ ID NO: 1513976 - RNA, 13 nt, Human
cugcaguugccag

SEQ ID NO: 1513977 - RNA, 16 nt, Human
cugcaguugccaguca

SEQ ID NO: 1513978 - RNA, 17 nt, Human
cugcagcaauaaagcag

SEQ ID NO: 1513979 - RNA, 10 nt, Human
cugcagaggg

SEQ ID NO: 1513980 - RNA, 16 nt, Human
cugcagcaauaaagca

SEQ ID NO: 1513981 - RNA, 15 nt, Human
cugcagcaauaaagc

SEQ ID NO: 1513982 - RNA, 13 nt, Human
cugcagagggcac

SEQ ID NO: 1513983 - RNA, 12 nt, Human
cugcacugucaa

SEQ ID NO: 1513984 - RNA, 21 nt, Human
cugcacuccccugcugggugu

SEQ ID NO: 1513985 - RNA, 24 nt, Human
cugaggcccuucucuccagccccu

SEQ ID NO: 1513986 - RNA, 14 nt, Human
cugcaccggcuggc

SEQ ID NO: 1513987 - RNA, 22 nt, Human
cugaggcccuucucuccagccc

SEQ ID NO: 1513988 - RNA, 23 nt, Human
cugaggcccuucucuccagcccc

SEQ ID NO: 1513989 - RNA, 15 nt, Human
cugcaccggcuggcc

SEQ ID NO: 1513990 - RNA, 16 nt, Human
cugcaccggcuggccu

SEQ ID NO: 1513991 - RNA, 15 nt, Human
cugcaccgggccaca

SEQ ID NO: 1513992 - RNA, 20 nt, Human
cugcacuccagccuggguga

SEQ ID NO: 1513993 - RNA, 18 nt, Human
cugcaccgggccacagag

SEQ ID NO: 1513994 - RNA, 20 nt, Human
cugcaccgggccacagagaa

SEQ ID NO: 1513995 - RNA, 14 nt, Human
cugcacuccccugc

SEQ ID NO: 1513996 - RNA, 13 nt, Human
cugcacuccccug

SEQ ID NO: 1513997 - RNA, 19 nt, Human
cugcacuccccugcugggu

SEQ ID NO: 1513998 - RNA, 20 nt, Human
cugcacuccccugcugggug

SEQ ID NO: 1513999 - RNA, 22 nt, Human
cugccaggaagccagcaggcuc

SEQ ID NO: 1514000 - RNA, 21 nt, Human
cugccauccagguucagcuug

SEQ ID NO: 1514001 - RNA, 15 nt, Human
cugccauccucccaa

SEQ ID NO: 1514002 - RNA, 15 nt, Human
cugccagcaacgcag

SEQ ID NO: 1514003 - RNA, 13 nt, Human
cugccaggaagcc

SEQ ID NO: 1514004 - RNA, 14 nt, Human
cugccaggaagcca

SEQ ID NO: 1514005 - RNA, 20 nt, Human
cugccaggaagccagcaggc

SEQ ID NO: 1514006 - RNA, 21 nt, Human
cugccaggaagccagcaggcu

SEQ ID NO: 1514007 - RNA, 15 nt, Human
cugcauaugaaagga

SEQ ID NO: 1514008 - RNA, 20 nt, Human
cugcaucaagaugugacaug

SEQ ID NO: 1514009 - RNA, 20 nt, Human
cugcaucagcugcugaaaca

SEQ ID NO: 1514010 - RNA, 21 nt, Human
cugccacccuggggagaaagu

SEQ ID NO: 1514011 - RNA, 12 nt, Human
cugccacccugg

SEQ ID NO: 1514012 - RNA, 14 nt, Human
cugccacccugggg

SEQ ID NO: 1514013 - RNA, 19 nt, Human
cugccccuggcagccccug

SEQ ID NO: 1514014 - RNA, 18 nt, Human
cugccccuggcagccccu

SEQ ID NO: 1514015 - RNA, 13 nt, Human
cugcccggcaggg

SEQ ID NO: 1514016 - RNA, 20 nt, Human
cugcccggcaggguccuaga

SEQ ID NO: 1514017 - RNA, 15 nt, Human
cugccauuucugaga

SEQ ID NO: 1514018 - RNA, 12 nt, Human
cugcccaccugg

SEQ ID NO: 1514019 - RNA, 13 nt, Human
cugcccaccuggc

SEQ ID NO: 1514020 - RNA, 14 nt, Human
cugcccaggccccu

SEQ ID NO: 1514021 - RNA, 15 nt, Human
cugcccaggccccug

SEQ ID NO: 1514022 - RNA, 16 nt, Human
cugcccaggccccugc

SEQ ID NO: 1514023 - RNA, 18 nt, Human
cugcccaggccccugcca

SEQ ID NO: 1514024 - RNA, 19 nt, Human
cugcccaggccccugccac

SEQ ID NO: 1514025 - RNA, 20 nt, Human
cugcccaggccccugccacc

SEQ ID NO: 1514026 - RNA, 15 nt, Human
cugcugcaguugcca

SEQ ID NO: 1514027 - RNA, 14 nt, Human
cugcugcaguugcc

SEQ ID NO: 1514028 - RNA, 10 nt, Human
cugcugcagu

SEQ ID NO: 1514029 - RNA, 13 nt, Human
cugcugcaguugc

SEQ ID NO: 1514030 - RNA, 12 nt, Human
cugcucugguua

SEQ ID NO: 1514031 - RNA, 20 nt, Human
cugcggugcuaucuccccca

SEQ ID NO: 1514032 - RNA, 21 nt, Human
cugcggugcuaucucccccag

SEQ ID NO: 1514033 - RNA, 22 nt, Human
cugcggugcuaucucccccagc

SEQ ID NO: 1514034 - RNA, 23 nt, Human
cugcggugcuaucucccccagcc

SEQ ID NO: 1514035 - RNA, 23 nt, Human
cugcuccucuccccagcaaguga

SEQ ID NO: 1514036 - RNA, 19 nt, Human
cugcuccucuccccagcaa

SEQ ID NO: 1514037 - RNA, 20 nt, Human
cugcuccucuccccagcaag

SEQ ID NO: 1514038 - RNA, 15 nt, Human
cugcucuccgaccag

SEQ ID NO: 1514039 - RNA, 19 nt, Human
cugcucuccgaccagacac

SEQ ID NO: 1514040 - RNA, 23 nt, Human
cugcgguccacccaggagccccg

SEQ ID NO: 1514041 - RNA, 18 nt, Human
cugcggugcuaucucccc

SEQ ID NO: 1514042 - RNA, 19 nt, Human
cugcggugcuaucuccccc

SEQ ID NO: 1514043 - RNA, 21 nt, Human
cugcccugcccaccuggccuc

SEQ ID NO: 1514044 - RNA, 18 nt, Human
cugccugaagucacacag

SEQ ID NO: 1514045 - RNA, 16 nt, Human
cugccugaagucacac

SEQ ID NO: 1514046 - RNA, 20 nt, Human
cugcccugcccaccuggccu

SEQ ID NO: 1514047 - RNA, 23 nt, Human
cugccugaagucacacagugagu

SEQ ID NO: 1514048 - RNA, 19 nt, Human
cugccugaagucacacagu

SEQ ID NO: 1514049 - RNA, 19 nt, Human
cugcuuuugucuaugggac

SEQ ID NO: 1514050 - RNA, 17 nt, Human
cugcuuuuggucugugu

SEQ ID NO: 1514051 - RNA, 15 nt, Human
cugcuuuuggucugu

SEQ ID NO: 1514052 - RNA, 19 nt, Human
cugcuugggcuucauccuc

SEQ ID NO: 1514053 - RNA, 19 nt, Human
cugcuugugaaaggaaaga

SEQ ID NO: 1514054 - RNA, 13 nt, Human
cugcuugggcuuc

SEQ ID NO: 1514055 - RNA, 15 nt, Human
cugcuugggcuucau

SEQ ID NO: 1514056 - RNA, 17 nt, Human
cugcuugggcuucaucc

SEQ ID NO: 1514057 - RNA, 18 nt, Human
cugcuugggcuucauccu

SEQ ID NO: 1514058 - RNA, 22 nt, Human
cugcuugaggcaacucaucuua

SEQ ID NO: 1514059 - RNA, 20 nt, Human
cugcuugcuugcuuuuuaau

SEQ ID NO: 1514060 - RNA, 13 nt, Human
cugcuugaggcaa

SEQ ID NO: 1514061 - RNA, 20 nt, Human
cugcuugaggcaacucaucu

SEQ ID NO: 1514062 - RNA, 21 nt, Human
cugcuugaggcaacucaucuu

SEQ ID NO: 1514063 - RNA, 12 nt, Human
cugcugcuggcu

SEQ ID NO: 1514064 - RNA, 13 nt, Human
cugcugcuggcug

SEQ ID NO: 1514065 - RNA, 14 nt, Human
cugcugcuggcugg

SEQ ID NO: 1514066 - RNA, 14 nt, Human
cugcuggguguggc

SEQ ID NO: 1514067 - RNA, 15 nt, Human
cugcuggguguggcg

SEQ ID NO: 1514068 - RNA, 17 nt, Human
cugcuggguguggcgca

SEQ ID NO: 1514069 - RNA, 18 nt, Human
cucuuuaaugucacaggc

SEQ ID NO: 1514070 - RNA, 13 nt, Human
cucuugguccugc

SEQ ID NO: 1514071 - RNA, 15 nt, Human
cucuugguccugcug

SEQ ID NO: 1514072 - RNA, 16 nt, Human
cucuugguccugcugc

SEQ ID NO: 1514073 - RNA, 17 nt, Human
cucuugguccugcugca

SEQ ID NO: 1514074 - RNA, 17 nt, Human
cucuuucccucccuucc

SEQ ID NO: 1514075 - RNA, 20 nt, Human
cucuuuaaugucacaggcag

SEQ ID NO: 1514076 - RNA, 21 nt, Human
cucuuuaaugucacaggcagg

SEQ ID NO: 1514077 - RNA, 22 nt, Human
cucuuuaaugucacaggcaggu

SEQ ID NO: 1514078 - RNA, 23 nt, Human
cucuuuaaugucacaggcagguc

SEQ ID NO: 1514079 - RNA, 21 nt, Human
cucuuggguucaagcgauucu

SEQ ID NO: 1514080 - RNA, 19 nt, Human
cucuuggguucaagcgauu

SEQ ID NO: 1514081 - RNA, 22 nt, Human
cucuugaaauauaggaacuuaa

SEQ ID NO: 1514082 - RNA, 22 nt, Human
cucuucuuuaaagggauggcaa

SEQ ID NO: 1514083 - RNA, 21 nt, Human
cugaaauaaacgucuuaaaua

SEQ ID NO: 1514084 - RNA, 23 nt, Human
cugaaagcccugagcuuucugcu

SEQ ID NO: 1514085 - RNA, 16 nt, Human
cugaaagcccugagcu

SEQ ID NO: 1514086 - RNA, 17 nt, Human
cugaaagcccugagcuu

SEQ ID NO: 1514087 - RNA, 18 nt, Human
cugaaagcccugagcuuu

SEQ ID NO: 1514088 - RNA, 19 nt, Human
cugaaagcccugagcuuuc

SEQ ID NO: 1514089 - RNA, 17 nt, Human
cucuuucuauuguuucu

SEQ ID NO: 1514090 - RNA, 15 nt, Human
cugaaagcccugagc

SEQ ID NO: 1514091 - RNA, 13 nt, Human
cugaaauuuccug

SEQ ID NO: 1514092 - RNA, 23 nt, Human
cugaaauuuccugggagcuuuug

SEQ ID NO: 1514093 - RNA, 16 nt, Human
cugaaauuuccuggga

SEQ ID NO: 1514094 - RNA, 23 nt, Human
cugaagaagcaccaaucaugaau

SEQ ID NO: 1514095 - RNA, 19 nt, Human
cugaagaauugaaaaacca

SEQ ID NO: 1514096 - RNA, 13 nt, Human
cucugugagacuc

SEQ ID NO: 1514097 - RNA, 17 nt, Human
cucugugagacucgaga

SEQ ID NO: 1514098 - RNA, 18 nt, Human
cucugugagacucgagaa

SEQ ID NO: 1514099 - RNA, 19 nt, Human
cucugugucagguggggca

SEQ ID NO: 1514100 - RNA, 15 nt, Human
cucugugucaggugg

SEQ ID NO: 1514101 - RNA, 13 nt, Human
cucuuagaaaaac

SEQ ID NO: 1514102 - RNA, 15 nt, Human
cucuuagaaaaacca

SEQ ID NO: 1514103 - RNA, 13 nt, Human
cucuuccaggcug

SEQ ID NO: 1514104 - RNA, 14 nt, Human
cucuuccaggcugg

SEQ ID NO: 1514105 - RNA, 15 nt, Human
cucuuccaggcuggg

SEQ ID NO: 1514106 - RNA, 12 nt, Human
cucuggccuucg

SEQ ID NO: 1514107 - RNA, 15 nt, Human
cucuggcagcucaga

SEQ ID NO: 1514108 - RNA, 16 nt, Human
cucuggcagcucagag

SEQ ID NO: 1514109 - RNA, 19 nt, Human
cucuggccuucggccucca

SEQ ID NO: 1514110 - RNA, 16 nt, Human
cucuggacaggcaugu

SEQ ID NO: 1514111 - RNA, 22 nt, Human
cucuggacaggcauguucucug

SEQ ID NO: 1514112 - RNA, 12 nt, Human
cucuggcagcuc

SEQ ID NO: 1514113 - RNA, 14 nt, Human
cucuggcagcucag

SEQ ID NO: 1514114 - RNA, 13 nt, Human
cucucuccucccu

SEQ ID NO: 1514115 - RNA, 21 nt, Human
cucugccugaagucacacagu

SEQ ID NO: 1514116 - RNA, 22 nt, Human
cucugccugaagucacacagug

SEQ ID NO: 1514117 - RNA, 15 nt, Human
cucuggacaggcaug

SEQ ID NO: 1514118 - RNA, 12 nt, Human
cugaggcccaga

SEQ ID NO: 1514119 - RNA, 13 nt, Human
cugaggcccagag

SEQ ID NO: 1514120 - RNA, 14 nt, Human
cugaggcccagagg

SEQ ID NO: 1514121 - RNA, 15 nt, Human
cugaggcccagaggg

SEQ ID NO: 1514122 - RNA, 16 nt, Human
cugaggcccagagggc

SEQ ID NO: 1514123 - RNA, 17 nt, Human
cugaggcccagagggcc

SEQ ID NO: 1514124 - RNA, 18 nt, Human
cugaggcccagagggccu

SEQ ID NO: 1514125 - RNA, 19 nt, Human
cugaggcccagagggccug

SEQ ID NO: 1514126 - RNA, 21 nt, Human
cugaggcccagagggccugca

SEQ ID NO: 1514127 - RNA, 23 nt, Human
cugaggcccagagggccugcaag

SEQ ID NO: 1514128 - RNA, 14 nt, Human
cugaggcccuucuc

SEQ ID NO: 1514129 - RNA, 15 nt, Human
cugaggcccuucucu

SEQ ID NO: 1514130 - RNA, 18 nt, Human
cugaggcccuucucucca

SEQ ID NO: 1514131 - RNA, 19 nt, Human
cugaggcccuucucuccag

SEQ ID NO: 1514132 - RNA, 20 nt, Human
cugaggcccuucucuccagc

SEQ ID NO: 1514133 - RNA, 14 nt, Human
cugagcgcuccugc

SEQ ID NO: 1514134 - RNA, 12 nt, Human
cugagccugguc

SEQ ID NO: 1514135 - RNA, 16 nt, Human
cugagcgacagugaga

SEQ ID NO: 1514136 - RNA, 20 nt, Human
cugagcgacagugagacucu

SEQ ID NO: 1514137 - RNA, 19 nt, Human
cugagacagcccgggcucu

SEQ ID NO: 1514138 - RNA, 16 nt, Human
cugagacagcccgggc

SEQ ID NO: 1514139 - RNA, 17 nt, Human
cugagacagcccgggcu

SEQ ID NO: 1514140 - RNA, 18 nt, Human
cugagacagcccgggcuc

SEQ ID NO: 1514141 - RNA, 17 nt, Human
cugagccagauuucacu

SEQ ID NO: 1514142 - RNA, 18 nt, Human
cugagccagauuucacuc

SEQ ID NO: 1514143 - RNA, 19 nt, Human
cugagccagauuucacucu

SEQ ID NO: 1514144 - RNA, 20 nt, Human
cugagccagauuucacucuc

SEQ ID NO: 1514145 - RNA, 21 nt, Human
cugagccagauuucacucucc

SEQ ID NO: 1514146 - RNA, 23 nt, Human
cugagaaagacuauucaaacagu

SEQ ID NO: 1514147 - RNA, 17 nt, Human
cugagaauguaagaacu

SEQ ID NO: 1514148 - RNA, 19 nt, Human
cugagaauguaagaacuac

SEQ ID NO: 1514149 - RNA, 14 nt, Human
cugagacagcccgg

SEQ ID NO: 1514150 - RNA, 15 nt, Human
cugagacagcccggg

SEQ ID NO: 1514151 - RNA, 17 nt, Human
cugacucuuaagaagac

SEQ ID NO: 1514152 - RNA, 16 nt, Human
cugacuguuuucucuu

SEQ ID NO: 1514153 - RNA, 15 nt, Human
cugacuaugacauaa

SEQ ID NO: 1514154 - RNA, 16 nt, Human
cugacuucuaaguaaa

SEQ ID NO: 1514155 - RNA, 18 nt, Human
cugacuguuuucucuuga

SEQ ID NO: 1514156 - RNA, 13 nt, Human
cugacuucuaagu

SEQ ID NO: 1514157 - RNA, 15 nt, Human
cugacuucuaaguaa

SEQ ID NO: 1514158 - RNA, 16 nt, Human
cugacccaugcugccc

SEQ ID NO: 1514159 - RNA, 14 nt, Human
cugacccaugcugc

SEQ ID NO: 1514160 - RNA, 15 nt, Human
cugacccaugcugcc

SEQ ID NO: 1514161 - RNA, 13 nt, Human
cugacccacugcu

SEQ ID NO: 1514162 - RNA, 14 nt, Human
cugacccacugcuu

SEQ ID NO: 1514163 - RNA, 22 nt, Human
cugacauuguuggccaaagcca

SEQ ID NO: 1514164 - RNA, 17 nt, Human
cugacagggccagugca

SEQ ID NO: 1514165 - RNA, 12 nt, Human
cugacagggcca

SEQ ID NO: 1514166 - RNA, 11 nt, Human
cugacagauuu

SEQ ID NO: 1514167 - RNA, 15 nt, Human
cugacagauuuccau

SEQ ID NO: 1514168 - RNA, 19 nt, Human
cugaagacucauucuucug

SEQ ID NO: 1514169 - RNA, 14 nt, Human
cucucucacuccuu

SEQ ID NO: 1514170 - RNA, 12 nt, Human
cucucucacucc

SEQ ID NO: 1514171 - RNA, 16 nt, Human
cucuccuuccuggagc

SEQ ID NO: 1514172 - RNA, 19 nt, Human
cucuccagccccuggaugc

SEQ ID NO: 1514173 - RNA, 14 nt, Human
cucuccccagcaag

SEQ ID NO: 1514174 - RNA, 22 nt, Human
cucuccccagcaagugagagcu

SEQ ID NO: 1514175 - RNA, 12 nt, Human
cucuccucugcu

SEQ ID NO: 1514176 - RNA, 24 nt, Human
cucuccccagcaagugagagcugg

SEQ ID NO: 1514177 - RNA, 21 nt, Human
cucuccugauagucuuucagu

SEQ ID NO: 1514178 - RNA, 13 nt, Human
cucuccucugcug

SEQ ID NO: 1514179 - RNA, 14 nt, Human
cucuccucugcugc

SEQ ID NO: 1514180 - RNA, 15 nt, Human
cucuccucugcugcu

SEQ ID NO: 1514181 - RNA, 18 nt, Human
cucuccucugcugcuggc

SEQ ID NO: 1514182 - RNA, 22 nt, Human
cucucaggccagcugcuugggc

SEQ ID NO: 1514183 - RNA, 17 nt, Human
cucucaggccagcugcu

SEQ ID NO: 1514184 - RNA, 18 nt, Human
cucucaggccagcugcuu

SEQ ID NO: 1514185 - RNA, 19 nt, Human
cucucaggccagcugcuug

SEQ ID NO: 1514186 - RNA, 21 nt, Human
cucucaggccagcugcuuggg

SEQ ID NO: 1514187 - RNA, 14 nt, Human
cucuccagccccug

SEQ ID NO: 1514188 - RNA, 15 nt, Human
cucuccagccccugg

SEQ ID NO: 1514189 - RNA, 16 nt, Human
cucuccagccccugga

SEQ ID NO: 1514190 - RNA, 17 nt, Human
cucuccagccccuggau

SEQ ID NO: 1514191 - RNA, 18 nt, Human
cucuccagccccuggaug

SEQ ID NO: 1514192 - RNA, 12 nt, Human
cucucaggccaa

SEQ ID NO: 1514193 - RNA, 20 nt, Human
cucucaggccaaacucaccu

SEQ ID NO: 1514194 - RNA, 21 nt, Human
cucucaggccaaacucaccug

SEQ ID NO: 1514195 - RNA, 22 nt, Human
cucucaggccaaacucaccugc

SEQ ID NO: 1514196 - RNA, 23 nt, Human
cucucaggccaaacucaccugcc

SEQ ID NO: 1514197 - RNA, 13 nt, Human
cucucaggccagc

SEQ ID NO: 1514198 - RNA, 15 nt, Human
cucucaggccagcug

SEQ ID NO: 1514199 - RNA, 15 nt, Human
cucuaguuugauuaa

SEQ ID NO: 1514200 - RNA, 20 nt, Human
cucuaguuugauuaaauucu

SEQ ID NO: 1514201 - RNA, 19 nt, Human
cucuaguuugauuaaauuc

SEQ ID NO: 1514202 - RNA, 21 nt, Human
cucuaguuugauuaaauucuu

SEQ ID NO: 1514203 - RNA, 15 nt, Human
cucuaggaaauauuu

SEQ ID NO: 1514204 - RNA, 17 nt, Human
cucuaggaaauauuuau

SEQ ID NO: 1514205 - RNA, 23 nt, Human
cucuagggaaaaaccagcgugug

SEQ ID NO: 1514206 - RNA, 20 nt, Human
cucuaccauccccuguagag

SEQ ID NO: 1514207 - RNA, 13 nt, Human
cucuacccuggca

SEQ ID NO: 1514208 - RNA, 13 nt, Human
cucuacaaaaagc

SEQ ID NO: 1514209 - RNA, 13 nt, Human
cucuacagaggcc

SEQ ID NO: 1514210 - RNA, 19 nt, Human
cucuacagaggccaugggc

SEQ ID NO: 1514211 - RNA, 14 nt, Human
cucuacagaggcca

SEQ ID NO: 1514212 - RNA, 16 nt, Human
cucuacagaggccaug

SEQ ID NO: 1514213 - RNA, 13 nt, Human
cuccuucaccuuu

SEQ ID NO: 1514214 - RNA, 19 nt, Human
cuccuucacagaugggugc

SEQ ID NO: 1514215 - RNA, 20 nt, Human
cuccugugugugcgccuaca

SEQ ID NO: 1514216 - RNA, 16 nt, Human
cuccuucacagauggg

SEQ ID NO: 1514217 - RNA, 17 nt, Human
cuccuucacagaugggu

SEQ ID NO: 1514218 - RNA, 16 nt, Human
cuccuccacucucccc

SEQ ID NO: 1514219 - RNA, 15 nt, Human
cuccgaccagacacc

SEQ ID NO: 1514220 - RNA, 14 nt, Human
cuccugccgcagag

SEQ ID NO: 1514221 - RNA, 16 nt, Human
cuccugccucagccuc

SEQ ID NO: 1514222 - RNA, 15 nt, Human
cuccugccucagccu

SEQ ID NO: 1514223 - RNA, 16 nt, Human
cuccugugugugcgcc

SEQ ID NO: 1514224 - RNA, 19 nt, Human
cuccugugugugcgccuac

SEQ ID NO: 1514225 - RNA, 11 nt, Human
cuccugcaggc

SEQ ID NO: 1514226 - RNA, 12 nt, Human
cuccugcaggca

SEQ ID NO: 1514227 - RNA, 17 nt, Human
cuccugcaggcagccag

SEQ ID NO: 1514228 - RNA, 18 nt, Human
cuccugcaggcagccagg

SEQ ID NO: 1514229 - RNA, 20 nt, Human
cuccugcaggcagccaggcc

SEQ ID NO: 1514230 - RNA, 13 nt, Human
cuccugccucagc

SEQ ID NO: 1514231 - RNA, 14 nt, Human
cuccugccucagcc

SEQ ID NO: 1514232 - RNA, 11 nt, Human
cuccugcccuu

SEQ ID NO: 1514233 - RNA, 17 nt, Human
cucccaaagugcuggga

SEQ ID NO: 1514234 - RNA, 13 nt, Human
cuccaugugggcu

SEQ ID NO: 1514235 - RNA, 18 nt, Human
cucacuauguugcccagg

SEQ ID NO: 1514236 - RNA, 11 nt, Human
cuccauccuga

SEQ ID NO: 1514237 - RNA, 16 nt, Human
cuccauccugaggcuc

SEQ ID NO: 1514238 - RNA, 18 nt, Human
cuccauccugaggcucca

SEQ ID NO: 1514239 - RNA, 20 nt, Human
cuccauccugaggcuccacu

SEQ ID NO: 1514240 - RNA, 22 nt, Human
cucccaacucaccccagcccca

SEQ ID NO: 1514241 - RNA, 18 nt, Human
cucccaaagugcugggau

SEQ ID NO: 1514242 - RNA, 14 nt, Human
cuccaugugggcua

SEQ ID NO: 1514243 - RNA, 17 nt, Human
cucccaacucaccccag

SEQ ID NO: 1514244 - RNA, 11 nt, Human
cucccaucugu

SEQ ID NO: 1514245 - RNA, 14 nt, Human
cucccaucugugaa

SEQ ID NO: 1514246 - RNA, 15 nt, Human
cucccaucugugaaa

SEQ ID NO: 1514247 - RNA, 18 nt, Human
cucccaucugugaaagga

SEQ ID NO: 1514248 - RNA, 23 nt, Human
cucccaucugugaaaggaaagag

SEQ ID NO: 1514249 - RNA, 19 nt, Human
cucccgaauagcugggacu

SEQ ID NO: 1514250 - RNA, 18 nt, Human
cucccgaguagcugggac

SEQ ID NO: 1514251 - RNA, 13 nt, Human
cuccccugcuggg

SEQ ID NO: 1514252 - RNA, 14 nt, Human
cuccccugcugggu

SEQ ID NO: 1514253 - RNA, 17 nt, Human
cucccgaauagcuggga

SEQ ID NO: 1514254 - RNA, 18 nt, Human
cucccgaauagcugggac

SEQ ID NO: 1514255 - RNA, 16 nt, Human
cucccgaguagcuggg

SEQ ID NO: 1514256 - RNA, 17 nt, Human
cucccgaguagcuggga

SEQ ID NO: 1514257 - RNA, 12 nt, Human
cuccccagcaag

SEQ ID NO: 1514258 - RNA, 20 nt, Human
cuccccagcaagugagagcu

SEQ ID NO: 1514259 - RNA, 21 nt, Human
cuccccagcaagugagagcug

SEQ ID NO: 1514260 - RNA, 12 nt, Human
cuccccugcugg

SEQ ID NO: 1514261 - RNA, 17 nt, Human
cuacagaggccaugggc

SEQ ID NO: 1514262 - RNA, 18 nt, Human
cuaccauccccuguagag

SEQ ID NO: 1514263 - RNA, 17 nt, Human
cuacccacccuccuuuc

SEQ ID NO: 1514264 - RNA, 22 nt, Human
cuacccacccuccuuucaccac

SEQ ID NO: 1514265 - RNA, 12 nt, Human
cuacccaggugc

SEQ ID NO: 1514266 - RNA, 15 nt, Human
cuacccgcagaguuc

SEQ ID NO: 1514267 - RNA, 20 nt, Human
cuacccagcgagcccuggug

SEQ ID NO: 1514268 - RNA, 15 nt, Human
cuacagaggccaugg

SEQ ID NO: 1514269 - RNA, 15 nt, Human
cuacacacugcaugu

SEQ ID NO: 1514270 - RNA, 13 nt, Human
cuacacacugcau

SEQ ID NO: 1514271 - RNA, 16 nt, Human
cuacaauuuaaagcaa

SEQ ID NO: 1514272 - RNA, 21 nt, Human
cuacacacugcauguuuguga

SEQ ID NO: 1514273 - RNA, 16 nt, Human
cuacacuccagugaga

SEQ ID NO: 1514274 - RNA, 17 nt, Human
cuacacuccagugagac

SEQ ID NO: 1514275 - RNA, 19 nt, Human
cuaauguaauaacugugaa

SEQ ID NO: 1514276 - RNA, 14 nt, Human
cuaauguacugcau

SEQ ID NO: 1514277 - RNA, 16 nt, Human
cuaauguacugcauau

SEQ ID NO: 1514278 - RNA, 21 nt, Human
cuaauaaaauuuaaaagucuu

SEQ ID NO: 1514279 - RNA, 16 nt, Human
cuaaggugugcucuga

SEQ ID NO: 1514280 - RNA, 15 nt, Human
cuaagcaaaauguga

SEQ ID NO: 1514281 - RNA, 18 nt, Human
cuaagcaaaaugugauau

SEQ ID NO: 1514282 - RNA, 16 nt, Human
cuaaccagcagaaaug

SEQ ID NO: 1514283 - RNA, 17 nt, Human
cuaaccacgcuggaccu

SEQ ID NO: 1514284 - RNA, 17 nt, Human
cuaaccagcagaaaugc

SEQ ID NO: 1514285 - RNA, 14 nt, Human
cuaagcaaaaugug

SEQ ID NO: 1514286 - RNA, 15 nt, Human
cuaaggugugcucug

SEQ ID NO: 1514287 - RNA, 19 nt, Human
cuaagcuauucaguaauaa

SEQ ID NO: 1514288 - RNA, 21 nt, Human
cuaagcuauucaguaauaacu

SEQ ID NO: 1514289 - RNA, 15 nt, Human
cuacuugggaggcug

SEQ ID NO: 1514290 - RNA, 18 nt, Human
cuacuugggaggcugaga

SEQ ID NO: 1514291 - RNA, 19 nt, Human
cuacuugggaggcugagau

SEQ ID NO: 1514292 - RNA, 22 nt, Human
cuacuuauuguagcauccugga

SEQ ID NO: 1514293 - RNA, 16 nt, Human
cuacuguaauuuguga

SEQ ID NO: 1514294 - RNA, 17 nt, Human
cuacuguaauuugugau

SEQ ID NO: 1514295 - RNA, 14 nt, Human
cuacugaggugcua

SEQ ID NO: 1514296 - RNA, 16 nt, Human
cuacucugugucaggu

SEQ ID NO: 1514297 - RNA, 21 nt, Human
cuacucugugucagguggggc

SEQ ID NO: 1514298 - RNA, 14 nt, Human
cuacccgggaaggg

SEQ ID NO: 1514299 - RNA, 15 nt, Human
cuacccgggaagggg

SEQ ID NO: 1514300 - RNA, 20 nt, Human
cuacccgggaagggggcugg

SEQ ID NO: 1514301 - RNA, 21 nt, Human
cuacccgggaagggggcuggg

SEQ ID NO: 1514302 - RNA, 17 nt, Human
cuagcacuuugggaggc

SEQ ID NO: 1514303 - RNA, 17 nt, Human
cuagagugaacuugggc

SEQ ID NO: 1514304 - RNA, 21 nt, Human
cuagagugaacuugggccacu

SEQ ID NO: 1514305 - RNA, 15 nt, Human
cuagagguucaaaga

SEQ ID NO: 1514306 - RNA, 20 nt, Human
cuagacgagcaggcuucuuc

SEQ ID NO: 1514307 - RNA, 21 nt, Human
cuagacgagcaggcuucuucc

SEQ ID NO: 1514308 - RNA, 21 nt, Human
cuacuguaauuugugauacaa

SEQ ID NO: 1514309 - RNA, 22 nt, Human
cuaggacugaauuaugaaacuu

SEQ ID NO: 1514310 - RNA, 22 nt, Human
cuaggaccccuccaugugggcu

SEQ ID NO: 1514311 - RNA, 17 nt, Human
cuaggaggucucuaaga

SEQ ID NO: 1514312 - RNA, 21 nt, Human
cuaggaagacuuuggaaagag

SEQ ID NO: 1514313 - RNA, 13 nt, Human
cuaggaacacucc

SEQ ID NO: 1514314 - RNA, 15 nt, Human
cuaggaacacuccuu

SEQ ID NO: 1514315 - RNA, 12 nt, Human
cuagcagcaggg

SEQ ID NO: 1514316 - RNA, 22 nt, Human
cuaguauuucuaugaaauauua

SEQ ID NO: 1514317 - RNA, 19 nt, Human
cuaguauuucuaugaaaua

SEQ ID NO: 1514318 - RNA, 20 nt, Human
cuaguauuucuaugaaauau

SEQ ID NO: 1514319 - RNA, 16 nt, Human
cuaguaugaaauuaua

SEQ ID NO: 1514320 - RNA, 23 nt, Human
cuaguaucaaaagaaagaaaauc

SEQ ID NO: 1514321 - RNA, 15 nt, Human
cuaguaucaaaagaa

SEQ ID NO: 1514322 - RNA, 17 nt, Human
cuaguaucaaaagaaag

SEQ ID NO: 1514323 - RNA, 21 nt, Human
cuaggcauuugcugaauacag

SEQ ID NO: 1514324 - RNA, 19 nt, Human
cuagugugguguuuccugg

SEQ ID NO: 1514325 - RNA, 23 nt, Human
cuagugugguguuuccuggcacu

SEQ ID NO: 1514326 - RNA, 21 nt, Human
cuagugugguguuuccuggca

SEQ ID NO: 1514327 - RNA, 22 nt, Human
cuagugugguguuuccuggcac

SEQ ID NO: 1514328 - RNA, 13 nt, Human
cuaugaaauauua

SEQ ID NO: 1514329 - RNA, 18 nt, Human
cuaugaaauauuauguua

SEQ ID NO: 1514330 - RNA, 14 nt, Human
cuaugacacaugca

SEQ ID NO: 1514331 - RNA, 18 nt, Human
cuaugacauaaaaacaac

SEQ ID NO: 1514332 - RNA, 20 nt, Human
cuaucaaguauuauaccuuu

SEQ ID NO: 1514333 - RNA, 22 nt, Human
cuauauuuuuuguuaaaugauu

SEQ ID NO: 1514334 - RNA, 19 nt, Human
cuauauuguuugcuaagca

SEQ ID NO: 1514335 - RNA, 22 nt, Human
cuauauuguuuucaguguacau

SEQ ID NO: 1514336 - RNA, 20 nt, Human
cuauauuuuuuguuaaauga

SEQ ID NO: 1514337 - RNA, 23 nt, Human
cuauauuguuuucaguguacaug

SEQ ID NO: 1514338 - RNA, 14 nt, Human
cuaguuccaccauc

SEQ ID NO: 1514339 - RNA, 13 nt, Human
cucacauuuauau

SEQ ID NO: 1514340 - RNA, 19 nt, Human
cucaccagccccagugccc

SEQ ID NO: 1514341 - RNA, 20 nt, Human
cucaccagccccagugccca

SEQ ID NO: 1514342 - RNA, 21 nt, Human
cucaccagccccagugcccac

SEQ ID NO: 1514343 - RNA, 18 nt, Human
cucaagugauucuccugc

SEQ ID NO: 1514344 - RNA, 19 nt, Human
cucaagugauucuccugcc

SEQ ID NO: 1514345 - RNA, 20 nt, Human
cucaagugauucuccugccu

SEQ ID NO: 1514346 - RNA, 21 nt, Human
cucaagugauucuccugccuc

SEQ ID NO: 1514347 - RNA, 14 nt, Human
cucaccccagcccc

SEQ ID NO: 1514348 - RNA, 12 nt, Human
cucaccccagcc

SEQ ID NO: 1514349 - RNA, 13 nt, Human
cucaccccagccc

SEQ ID NO: 1514350 - RNA, 14 nt, Human
cucaccccugguuc

SEQ ID NO: 1514351 - RNA, 17 nt, Human
cucaccccugguucuca

SEQ ID NO: 1514352 - RNA, 16 nt, Human
cucacuauguugccca

SEQ ID NO: 1514353 - RNA, 17 nt, Human
cucacuauguugcccag

SEQ ID NO: 1514354 - RNA, 17 nt, Human
cucaccccuugccauaa

SEQ ID NO: 1514355 - RNA, 19 nt, Human
cucaccccugguucucauc

SEQ ID NO: 1514356 - RNA, 20 nt, Human
cucaccccugguucucaucu

SEQ ID NO: 1514357 - RNA, 21 nt, Human
cucaccccugguucucaucuu

SEQ ID NO: 1514358 - RNA, 23 nt, Human
cucaccccugguucucaucuuuc

SEQ ID NO: 1514359 - RNA, 14 nt, Human
cuaugcauuugaaa

SEQ ID NO: 1514360 - RNA, 18 nt, Human
cucaacuagcagauacag

SEQ ID NO: 1514361 - RNA, 13 nt, Human
cucaaauuucuaa

SEQ ID NO: 1514362 - RNA, 20 nt, Human
cucaacucuccuccagaguc

SEQ ID NO: 1514363 - RNA, 21 nt, Human
cucaacucuccuccagaguca

SEQ ID NO: 1514364 - RNA, 21 nt, Human
cuaugacauaaaaacaacuuu

SEQ ID NO: 1514365 - RNA, 12 nt, Human
cuaugcauuuga

SEQ ID NO: 1514366 - RNA, 11 nt, Human
cuaugcauuug

SEQ ID NO: 1514367 - RNA, 21 nt, Human
cuaugcauuugaaaauuuuga

SEQ ID NO: 1514368 - RNA, 15 nt, Human
cuaacauggaaguac

SEQ ID NO: 1514369 - RNA, 17 nt, Human
cuaacauggaaguacua

SEQ ID NO: 1514370 - RNA, 23 nt, Human
cuaaauuugaauguuaagcagau

SEQ ID NO: 1514371 - RNA, 16 nt, Human
cuaaauguugaaagau

SEQ ID NO: 1514372 - RNA, 16 nt, Human
cuaaauucaugcugcu

SEQ ID NO: 1514373 - RNA, 23 nt, Human
cuaaauugacacuuaaaaauggu

SEQ ID NO: 1514374 - RNA, 20 nt, Human
cuaaaucuccaaaauaaaac

SEQ ID NO: 1514375 - RNA, 15 nt, Human
cuaaauggaaccacu

SEQ ID NO: 1514376 - RNA, 17 nt, Human
cuaaauggaaccacucu

SEQ ID NO: 1514377 - RNA, 16 nt, Human
cuaaauggaaccacuc

SEQ ID NO: 1514378 - RNA, 18 nt, Human
cuaaauggaaccacucua

SEQ ID NO: 1514379 - RNA, 15 nt, Human
cgugccaccccgagg

SEQ ID NO: 1514380 - RNA, 22 nt, Human
cgugccaccccgagggcugagc

SEQ ID NO: 1514381 - RNA, 19 nt, Human
cgugccaccccgagggcug

SEQ ID NO: 1514382 - RNA, 16 nt, Human
cgucucauacucaccu

SEQ ID NO: 1514383 - RNA, 16 nt, Human
cgucuaccugaggggc

SEQ ID NO: 1514384 - RNA, 18 nt, Human
cggugcuaucucccccag

SEQ ID NO: 1514385 - RNA, 20 nt, Human
cggugcuaucucccccagcc

SEQ ID NO: 1514386 - RNA, 21 nt, Human
cggugcuaucucccccagccc

SEQ ID NO: 1514387 - RNA, 22 nt, Human
cggugcuaucucccccagcccc

SEQ ID NO: 1514388 - RNA, 16 nt, Human
cgugcacacaccagag

SEQ ID NO: 1514389 - RNA, 20 nt, Human
cgucugacaggcaaugcugg

SEQ ID NO: 1514390 - RNA, 21 nt, Human
cgucugacaggcaaugcuggc

SEQ ID NO: 1514391 - RNA, 22 nt, Human
cgucugacaggcaaugcuggcu

SEQ ID NO: 1514392 - RNA, 21 nt, Human
cgugcaguggugcgaucuggg

SEQ ID NO: 1514393 - RNA, 22 nt, Human
cgugcaguggugcgaucugggu

SEQ ID NO: 1514394 - RNA, 18 nt, Human
cgugcacacaccagagcc

SEQ ID NO: 1514395 - RNA, 19 nt, Human
cgugcacacaccagagccc

SEQ ID NO: 1514396 - RNA, 17 nt, Human
cggugagcuacaaaugc

SEQ ID NO: 1514397 - RNA, 20 nt, Human
cggugagaggggaacagacu

SEQ ID NO: 1514398 - RNA, 21 nt, Human
cggugagaggggaacagacug

SEQ ID NO: 1514399 - RNA, 13 nt, Human
cgguccuggugcc

SEQ ID NO: 1514400 - RNA, 13 nt, Human
cggucccagcucc

SEQ ID NO: 1514401 - RNA, 12 nt, Human
cggucccagcuc

SEQ ID NO: 1514402 - RNA, 22 nt, Human
cggucggguuuuauuguuuaaa

SEQ ID NO: 1514403 - RNA, 21 nt, Human
cggguuuuauuguuuaaaauc

SEQ ID NO: 1514404 - RNA, 14 nt, Human
cgguccacccagga

SEQ ID NO: 1514405 - RNA, 15 nt, Human
cgguccacccaggag

SEQ ID NO: 1514406 - RNA, 16 nt, Human
cgguccacccaggagc

SEQ ID NO: 1514407 - RNA, 20 nt, Human
cgguccacccaggagccccg

SEQ ID NO: 1514408 - RNA, 23 nt, Human
cggggacagcuccuucuguccua

SEQ ID NO: 1514409 - RNA, 16 nt, Human
cggggcucuucucauu

SEQ ID NO: 1514410 - RNA, 17 nt, Human
cggggcucuucucauuu

SEQ ID NO: 1514411 - RNA, 23 nt, Human
cggggcucuucucauuucacccc

SEQ ID NO: 1514412 - RNA, 15 nt, Human
cgggggcagagaggg

SEQ ID NO: 1514413 - RNA, 23 nt, Human
cggcuggccuggccccucagggu

SEQ ID NO: 1514414 - RNA, 14 nt, Human
cggcuggcagccca

SEQ ID NO: 1514415 - RNA, 22 nt, Human
cggcuggccuggccccucaggg

SEQ ID NO: 1514416 - RNA, 18 nt, Human
cgggaggucgaggcagga

SEQ ID NO: 1514417 - RNA, 20 nt, Human
cgggaggucgaggcaggagg

SEQ ID NO: 1514418 - RNA, 14 nt, Human
cgggcacucagaag

SEQ ID NO: 1514419 - RNA, 22 nt, Human
cgggcacucagaagacacugau

SEQ ID NO: 1514420 - RNA, 22 nt, Human
cggccaguggccuuccccagca

SEQ ID NO: 1514421 - RNA, 24 nt, Human
cggccaggccagagggagugacag

SEQ ID NO: 1514422 - RNA, 13 nt, Human
cggccccugcugg

SEQ ID NO: 1514423 - RNA, 18 nt, Human
cggccccugcugguucag

SEQ ID NO: 1514424 - RNA, 19 nt, Human
cggccccugcugguucagg

SEQ ID NO: 1514425 - RNA, 12 nt, Human
cggccuccaucc

SEQ ID NO: 1514426 - RNA, 14 nt, Human
cggccuccauccug

SEQ ID NO: 1514427 - RNA, 13 nt, Human
cggaagagccuug

SEQ ID NO: 1514428 - RNA, 14 nt, Human
cggaauaguuggcu

SEQ ID NO: 1514429 - RNA, 11 nt, Human
cggccaccugc

SEQ ID NO: 1514430 - RNA, 15 nt, Human
cggccaccugcggug

SEQ ID NO: 1514431 - RNA, 16 nt, Human
cggccaccugcggugc

SEQ ID NO: 1514432 - RNA, 17 nt, Human
cggccaccugcggugcu

SEQ ID NO: 1514433 - RNA, 19 nt, Human
cgcgccaaauaaugucucu

SEQ ID NO: 1514434 - RNA, 21 nt, Human
cgcgccaaauaaugucucugu

SEQ ID NO: 1514435 - RNA, 23 nt, Human
cgcgccaaauaaugucucuguga

SEQ ID NO: 1514436 - RNA, 12 nt, Human
cgcccagucugg

SEQ ID NO: 1514437 - RNA, 22 nt, Human
cgcccaggcuuagucacugaga

SEQ ID NO: 1514438 - RNA, 17 nt, Human
ccucugcccacucccug

SEQ ID NO: 1514439 - RNA, 19 nt, Human
ccucugcccacucccugca

SEQ ID NO: 1514440 - RNA, 20 nt, Human
ccucugcccacucccugcaa

SEQ ID NO: 1514441 - RNA, 23 nt, Human
cgccaggggaaaaucagccugcu

SEQ ID NO: 1514442 - RNA, 14 nt, Human
cgccaucccagccc

SEQ ID NO: 1514443 - RNA, 16 nt, Human
cgccaucccagcccca

SEQ ID NO: 1514444 - RNA, 17 nt, Human
cgccaucccagccccaa

SEQ ID NO: 1514445 - RNA, 22 nt, Human
cgcuaagagggagggagggcuc

SEQ ID NO: 1514446 - RNA, 16 nt, Human
cgcuacccgggaaggg

SEQ ID NO: 1514447 - RNA, 17 nt, Human
cgcuacccgggaagggg

SEQ ID NO: 1514448 - RNA, 14 nt, Human
cgcucucuggccuu

SEQ ID NO: 1514449 - RNA, 15 nt, Human
cgcucucuggccuuc

SEQ ID NO: 1514450 - RNA, 15 nt, Human
cgcugugcugcccug

SEQ ID NO: 1514451 - RNA, 16 nt, Human
cgcugugcugcccugc

SEQ ID NO: 1514452 - RNA, 17 nt, Human
cgcugugcugcccugcc

SEQ ID NO: 1514453 - RNA, 22 nt, Human
cgcugucagccauuccuguucc

SEQ ID NO: 1514454 - RNA, 18 nt, Human
cgcucucuggccuucggc

SEQ ID NO: 1514455 - RNA, 18 nt, Human
cgcugugcugcccugccc

SEQ ID NO: 1514456 - RNA, 20 nt, Human
cggaaaacaugcuacacacu

SEQ ID NO: 1514457 - RNA, 15 nt, Human
cggaaaacaugcuac

SEQ ID NO: 1514458 - RNA, 18 nt, Human
caguggccuuccccagca

SEQ ID NO: 1514459 - RNA, 17 nt, Human
caguggccuuccccagc

SEQ ID NO: 1514460 - RNA, 19 nt, Human
caguggccuuccccagcau

SEQ ID NO: 1514461 - RNA, 22 nt, Human
cagugguuccuaauccucuagg

SEQ ID NO: 1514462 - RNA, 12 nt, Human
caguggcagcug

SEQ ID NO: 1514463 - RNA, 13 nt, Human
caguggcagcugc

SEQ ID NO: 1514464 - RNA, 14 nt, Human
caguggcagcugcu

SEQ ID NO: 1514465 - RNA, 15 nt, Human
caguggcagcugcuu

SEQ ID NO: 1514466 - RNA, 16 nt, Human
caguggcagcugcuuu

SEQ ID NO: 1514467 - RNA, 23 nt, Human
cagugugucuaaauuugaauguu

SEQ ID NO: 1514468 - RNA, 14 nt, Human
cagugugucuaaau

SEQ ID NO: 1514469 - RNA, 14 nt, Human
cagugugacaagga

SEQ ID NO: 1514470 - RNA, 12 nt, Human
cagugugacuga

SEQ ID NO: 1514471 - RNA, 14 nt, Human
cagugucaaugcag

SEQ ID NO: 1514472 - RNA, 16 nt, Human
caguguacauggaaua

SEQ ID NO: 1514473 - RNA, 20 nt, Human
caguguacauggaauaacau

SEQ ID NO: 1514474 - RNA, 23 nt, Human
caguguacauggaauaacaugua

SEQ ID NO: 1514475 - RNA, 22 nt, Human
caguguuguggauuuaacagaa

SEQ ID NO: 1514476 - RNA, 20 nt, Human
caguguuguggauuuaacag

SEQ ID NO: 1514477 - RNA, 19 nt, Human
caguguuguggauuuaaca

SEQ ID NO: 1514478 - RNA, 21 nt, Human
caguuaccucugccucagaaa

SEQ ID NO: 1514479 - RNA, 14 nt, Human
caguuacucagaau

SEQ ID NO: 1514480 - RNA, 13 nt, Human
caguuaagagaaa

SEQ ID NO: 1514481 - RNA, 14 nt, Human
caguuaagagaaau

SEQ ID NO: 1514482 - RNA, 15 nt, Human
caguucugaagaaga

SEQ ID NO: 1514483 - RNA, 16 nt, Human
caguucugaagaagau

SEQ ID NO: 1514484 - RNA, 22 nt, Human
caguucugaagaagaugguacc

SEQ ID NO: 1514485 - RNA, 13 nt, Human
caguucugaagaa

SEQ ID NO: 1514486 - RNA, 14 nt, Human
caguucugaagaag

SEQ ID NO: 1514487 - RNA, 12 nt, Human
caguucugaaga

SEQ ID NO: 1514488 - RNA, 22 nt, Human
caguucucuccuucuucccccc

SEQ ID NO: 1514489 - RNA, 22 nt, Human
caguucggugagcuacaaaugc

SEQ ID NO: 1514490 - RNA, 15 nt, Human
caguuccuuucaaug

SEQ ID NO: 1514491 - RNA, 13 nt, Human
caguucucuccuu

SEQ ID NO: 1514492 - RNA, 14 nt, Human
caguucucuccuuc

SEQ ID NO: 1514493 - RNA, 15 nt, Human
caguucucuccuucu

SEQ ID NO: 1514494 - RNA, 12 nt, Human
caguugaaaaac

SEQ ID NO: 1514495 - RNA, 18 nt, Human
caguugaaaaacagcuga

SEQ ID NO: 1514496 - RNA, 19 nt, Human
caguugaaaaacagcugag

SEQ ID NO: 1514497 - RNA, 17 nt, Human
cauaccaacacgagcag

SEQ ID NO: 1514498 - RNA, 15 nt, Human
cauacauuguacgaa

SEQ ID NO: 1514499 - RNA, 12 nt, Human
cauacauauuuu

SEQ ID NO: 1514500 - RNA, 19 nt, Human
cauacauauuuuuguagca

SEQ ID NO: 1514501 - RNA, 19 nt, Human
cauaccacuuuuguucuug

SEQ ID NO: 1514502 - RNA, 11 nt, Human
cauacccaccc

SEQ ID NO: 1514503 - RNA, 12 nt, Human
cauacccacccc

SEQ ID NO: 1514504 - RNA, 18 nt, Human
cauaccacuuuuguucuu

SEQ ID NO: 1514505 - RNA, 15 nt, Human
cauaccacuuuuguu

SEQ ID NO: 1514506 - RNA, 14 nt, Human
cauaccacuuuugu

SEQ ID NO: 1514507 - RNA, 13 nt, Human
cauaccacuuuug

SEQ ID NO: 1514508 - RNA, 16 nt, Human
cauaaguaauucaaga

SEQ ID NO: 1514509 - RNA, 17 nt, Human
cauaaguaauucaagaa

SEQ ID NO: 1514510 - RNA, 18 nt, Human
cauaaguaauucaagaaa

SEQ ID NO: 1514511 - RNA, 22 nt, Human
cauaaguaauucaagaaaacaa

SEQ ID NO: 1514512 - RNA, 14 nt, Human
cauaagauaaaugu

SEQ ID NO: 1514513 - RNA, 19 nt, Human
cauaaauuuaguauuuugu

SEQ ID NO: 1514514 - RNA, 20 nt, Human
cauaaauuuaguauuuuguu

SEQ ID NO: 1514515 - RNA, 16 nt, Human
cauaaccuagccuuag

SEQ ID NO: 1514516 - RNA, 21 nt, Human
cauaaacaagaccacguuucu

SEQ ID NO: 1514517 - RNA, 20 nt, Human
cauaaacaagaccacguuuc

SEQ ID NO: 1514518 - RNA, 22 nt, Human
cauaaacaagaccacguuucua

SEQ ID NO: 1514519 - RNA, 23 nt, Human
cauaaaaagccugcaauuucaua

SEQ ID NO: 1514520 - RNA, 17 nt, Human
cauaaaaacaacuuuau

SEQ ID NO: 1514521 - RNA, 20 nt, Human
cauaaaaacaacuuuauacc

SEQ ID NO: 1514522 - RNA, 21 nt, Human
cauaaaaacaacuuuauaccc

SEQ ID NO: 1514523 - RNA, 23 nt, Human
cauaaaaacaacuuuauacccag

SEQ ID NO: 1514524 - RNA, 21 nt, Human
cauaaaaauuagccaagugug

SEQ ID NO: 1514525 - RNA, 23 nt, Human
caguugaaaagacuccaaagaaa

SEQ ID NO: 1514526 - RNA, 21 nt, Human
caguugaaaagacuccaaaga

SEQ ID NO: 1514527 - RNA, 22 nt, Human
caguugaaaagacuccaaagaa

SEQ ID NO: 1514528 - RNA, 18 nt, Human
caguugaaaagacuccaa

SEQ ID NO: 1514529 - RNA, 14 nt, Human
caguugaaaagacu

SEQ ID NO: 1514530 - RNA, 16 nt, Human
caguuggguggaugcc

SEQ ID NO: 1514531 - RNA, 23 nt, Human
caguugccagucaccccggccac

SEQ ID NO: 1514532 - RNA, 18 nt, Human
caguuggguggaugccug

SEQ ID NO: 1514533 - RNA, 19 nt, Human
caguuggguggaugccugg

SEQ ID NO: 1514534 - RNA, 18 nt, Human
caguuggucccccuucca

SEQ ID NO: 1514535 - RNA, 19 nt, Human
caguuggucccccuuccau

SEQ ID NO: 1514536 - RNA, 20 nt, Human
caguuggucccccuuccaug

SEQ ID NO: 1514537 - RNA, 21 nt, Human
caguuggucccccuuccaugg

SEQ ID NO: 1514538 - RNA, 22 nt, Human
caguuggucccccuuccaugga

SEQ ID NO: 1514539 - RNA, 17 nt, Human
caguuguuagugugucu

SEQ ID NO: 1514540 - RNA, 14 nt, Human
caguuuucugagaa

SEQ ID NO: 1514541 - RNA, 15 nt, Human
caguuuucugagaaa

SEQ ID NO: 1514542 - RNA, 15 nt, Human
cauaaaaacaacuuu

SEQ ID NO: 1514543 - RNA, 18 nt, Human
caguuguuagugugucuu

SEQ ID NO: 1514544 - RNA, 19 nt, Human
caguuuucugagaaagacu

SEQ ID NO: 1514545 - RNA, 20 nt, Human
caguuuucugagaaagacua

SEQ ID NO: 1514546 - RNA, 21 nt, Human
cauacuaaccagcagaaaugc

SEQ ID NO: 1514547 - RNA, 14 nt, Human
cauacuaaccagca

SEQ ID NO: 1514548 - RNA, 18 nt, Human
cauacguacacauuuuau

SEQ ID NO: 1514549 - RNA, 17 nt, Human
cauacguacacauuuua

SEQ ID NO: 1514550 - RNA, 16 nt, Human
cauacguacacauuuu

SEQ ID NO: 1514551 - RNA, 15 nt, Human
cauacguacacauuu

SEQ ID NO: 1514552 - RNA, 13 nt, Human
cauacguacacau

SEQ ID NO: 1514553 - RNA, 14 nt, Human
cauacccaccccca

SEQ ID NO: 1514554 - RNA, 17 nt, Human
cauacccacccccaccc

SEQ ID NO: 1514555 - RNA, 18 nt, Human
cauacccacccccaccca

SEQ ID NO: 1514556 - RNA, 21 nt, Human
cauacccacccccacccaagg

SEQ ID NO: 1514557 - RNA, 12 nt, Human
cauauuuucaug

SEQ ID NO: 1514558 - RNA, 14 nt, Human
cauauuuuucacau

SEQ ID NO: 1514559 - RNA, 21 nt, Human
cauauuuuucacauaucuagu

SEQ ID NO: 1514560 - RNA, 22 nt, Human
caucaagucuuucacauuuaaa

SEQ ID NO: 1514561 - RNA, 14 nt, Human
caucaagaugugac

SEQ ID NO: 1514562 - RNA, 18 nt, Human
caucaaugaaugaaugaa

SEQ ID NO: 1514563 - RNA, 12 nt, Human
cauauuucaauu

SEQ ID NO: 1514564 - RNA, 20 nt, Human
cauauuuacuucuuauacau

SEQ ID NO: 1514565 - RNA, 16 nt, Human
cauauuuacuucuuau

SEQ ID NO: 1514566 - RNA, 17 nt, Human
cauauuuacuucuuaua

SEQ ID NO: 1514567 - RNA, 13 nt, Human
cauaugccugggc

SEQ ID NO: 1514568 - RNA, 14 nt, Human
cauauuuacuucuu

SEQ ID NO: 1514569 - RNA, 18 nt, Human
cauauuuuucacauaucu

SEQ ID NO: 1514570 - RNA, 23 nt, Human
cauagagagcaagacgcugugcu

SEQ ID NO: 1514571 - RNA, 19 nt, Human
cauagagagcaagacgcug

SEQ ID NO: 1514572 - RNA, 21 nt, Human
cauagagagcaagacgcugug

SEQ ID NO: 1514573 - RNA, 19 nt, Human
cauagaaaacacuacagug

SEQ ID NO: 1514574 - RNA, 11 nt, Human
cauacucugcu

SEQ ID NO: 1514575 - RNA, 16 nt, Human
cauacucccaucugug

SEQ ID NO: 1514576 - RNA, 15 nt, Human
cauacucccaucugu

SEQ ID NO: 1514577 - RNA, 18 nt, Human
cauacucccaucugugaa

SEQ ID NO: 1514578 - RNA, 20 nt, Human
cauacucccaucugugaaag

SEQ ID NO: 1514579 - RNA, 23 nt, Human
cauauauauguuuuaagaggcag

SEQ ID NO: 1514580 - RNA, 22 nt, Human
cauauauauguuuuaagaggca

SEQ ID NO: 1514581 - RNA, 22 nt, Human
cauaguggcuuaaaacaacacu

SEQ ID NO: 1514582 - RNA, 20 nt, Human
cauaguaugguggcuggguu

SEQ ID NO: 1514583 - RNA, 18 nt, Human
cauaguaugguggcuggg

SEQ ID NO: 1514584 - RNA, 19 nt, Human
cauaguaugguggcugggu

SEQ ID NO: 1514585 - RNA, 22 nt, Human
caucuuccaaggguacuaagga

SEQ ID NO: 1514586 - RNA, 16 nt, Human
caucucuuagcucccc

SEQ ID NO: 1514587 - RNA, 17 nt, Human
caucucuuagcuccccu

SEQ ID NO: 1514588 - RNA, 18 nt, Human
caucucuuagcuccccuc

SEQ ID NO: 1514589 - RNA, 19 nt, Human
caucucuuagcuccccucc

SEQ ID NO: 1514590 - RNA, 21 nt, Human
caucucuuagcuccccuccaa

SEQ ID NO: 1514591 - RNA, 23 nt, Human
caucucuuagcuccccuccaacc

SEQ ID NO: 1514592 - RNA, 13 nt, Human
caucuugcucugc

SEQ ID NO: 1514593 - RNA, 15 nt, Human
caucuugcucugcug

SEQ ID NO: 1514594 - RNA, 14 nt, Human
caucuugcucugcu

SEQ ID NO: 1514595 - RNA, 20 nt, Human
caucuugcucugcugacaga

SEQ ID NO: 1514596 - RNA, 14 nt, Human
caucuagugagcag

SEQ ID NO: 1514597 - RNA, 15 nt, Human
caucuacccuccgau

SEQ ID NO: 1514598 - RNA, 21 nt, Human
cauccucuguacagagcccac

SEQ ID NO: 1514599 - RNA, 19 nt, Human
cauccucuguacagagccc

SEQ ID NO: 1514600 - RNA, 15 nt, Human
cauccucuguacaga

SEQ ID NO: 1514601 - RNA, 18 nt, Human
cauccucuguacagagcc

SEQ ID NO: 1514602 - RNA, 22 nt, Human
caucuagugagcagucaggaaa

SEQ ID NO: 1514603 - RNA, 16 nt, Human
caucucacacaugagc

SEQ ID NO: 1514604 - RNA, 17 nt, Human
caucucacacaugagca

SEQ ID NO: 1514605 - RNA, 20 nt, Human
caucucacacaugagcauca

SEQ ID NO: 1514606 - RNA, 15 nt, Human
cauccucauacccac

SEQ ID NO: 1514607 - RNA, 16 nt, Human
cauccucauacccacc

SEQ ID NO: 1514608 - RNA, 13 nt, Human
cauccucccaagg

SEQ ID NO: 1514609 - RNA, 17 nt, Human
cauccucauacccaccc

SEQ ID NO: 1514610 - RNA, 18 nt, Human
cauccucauacccacccc

SEQ ID NO: 1514611 - RNA, 21 nt, Human
cauccucauacccacccccac

SEQ ID NO: 1514612 - RNA, 22 nt, Human
cauccucauacccacccccacc

SEQ ID NO: 1514613 - RNA, 11 nt, Human
cauccuccuca

SEQ ID NO: 1514614 - RNA, 12 nt, Human
cauccuccucag

SEQ ID NO: 1514615 - RNA, 15 nt, Human
cauccuccucagauc

SEQ ID NO: 1514616 - RNA, 16 nt, Human
cauccuccucagaucu

SEQ ID NO: 1514617 - RNA, 18 nt, Human
cauccuccucagaucuuc

SEQ ID NO: 1514618 - RNA, 19 nt, Human
cauccuccucagaucuucu

SEQ ID NO: 1514619 - RNA, 15 nt, Human
cauccagguucagcu

SEQ ID NO: 1514620 - RNA, 17 nt, Human
cauccagguucagcuug

SEQ ID NO: 1514621 - RNA, 19 nt, Human
caucccucuggggcuguuc

SEQ ID NO: 1514622 - RNA, 11 nt, Human
caucccugaag

SEQ ID NO: 1514623 - RNA, 13 nt, Human
caucccugaaggc

SEQ ID NO: 1514624 - RNA, 20 nt, Human
caucaccaacgucugugcca

SEQ ID NO: 1514625 - RNA, 13 nt, Human
caucauugaaauc

SEQ ID NO: 1514626 - RNA, 15 nt, Human
caucaccaacgucug

SEQ ID NO: 1514627 - RNA, 14 nt, Human
caucauugaaaucu

SEQ ID NO: 1514628 - RNA, 15 nt, Human
caucauugaaaucuu

SEQ ID NO: 1514629 - RNA, 20 nt, Human
caucauugaaaucuuuuugc

SEQ ID NO: 1514630 - RNA, 21 nt, Human
caucauugaaaucuuuuugcu

SEQ ID NO: 1514631 - RNA, 22 nt, Human
caucccugaaggccccgcccag

SEQ ID NO: 1514632 - RNA, 17 nt, Human
caucccugaaggccccg

SEQ ID NO: 1514633 - RNA, 18 nt, Human
caucccugaaggccccgc

SEQ ID NO: 1514634 - RNA, 19 nt, Human
caucccugaaggccccgcc

SEQ ID NO: 1514635 - RNA, 21 nt, Human
caucccugaaggccccgccca

SEQ ID NO: 1514636 - RNA, 14 nt, Human
caugucuuuucuug

SEQ ID NO: 1514637 - RNA, 19 nt, Human
caugucuuuucuugcauga

SEQ ID NO: 1514638 - RNA, 21 nt, Human
caugucuuuucuugcaugagg

SEQ ID NO: 1514639 - RNA, 23 nt, Human
caugucuuuucuugcaugaggcu

SEQ ID NO: 1514640 - RNA, 18 nt, Human
cauguaauuaaguacuau

SEQ ID NO: 1514641 - RNA, 21 nt, Human
cauguaauuaaguacuaugua

SEQ ID NO: 1514642 - RNA, 16 nt, Human
cauggucggaaaacau

SEQ ID NO: 1514643 - RNA, 23 nt, Human
cauguuugauguaucugagcagg

SEQ ID NO: 1514644 - RNA, 15 nt, Human
caugugcacaugcac

SEQ ID NO: 1514645 - RNA, 21 nt, Human
caugugccagguuuuuggucu

SEQ ID NO: 1514646 - RNA, 22 nt, Human
caugugccagguuuuuggucug

SEQ ID NO: 1514647 - RNA, 17 nt, Human
caugugguuaaugccau

SEQ ID NO: 1514648 - RNA, 22 nt, Human
caugugguuaaugccauggaca

SEQ ID NO: 1514649 - RNA, 21 nt, Human
cauuaaagccugaguuugcuu

SEQ ID NO: 1514650 - RNA, 15 nt, Human
cauguuuuguuuacg

SEQ ID NO: 1514651 - RNA, 18 nt, Human
cauguuuuucuucucccu

SEQ ID NO: 1514652 - RNA, 16 nt, Human
cauggaauaacaugua

SEQ ID NO: 1514653 - RNA, 15 nt, Human
cauggacagaagaag

SEQ ID NO: 1514654 - RNA, 21 nt, Human
cauggacagaagaaggcagca

SEQ ID NO: 1514655 - RNA, 18 nt, Human
cauggacaugaucuucuu

SEQ ID NO: 1514656 - RNA, 20 nt, Human
cauggaaguacuauaauuua

SEQ ID NO: 1514657 - RNA, 22 nt, Human
cauggaaguacuauaauuuacc

SEQ ID NO: 1514658 - RNA, 23 nt, Human
caugcugucuacacuaagagaga

SEQ ID NO: 1514659 - RNA, 22 nt, Human
caugcugucccuuacgugaguc

SEQ ID NO: 1514660 - RNA, 20 nt, Human
caugcuguucaugaaagauu

SEQ ID NO: 1514661 - RNA, 18 nt, Human
caugccuggauggggcug

SEQ ID NO: 1514662 - RNA, 21 nt, Human
caugccuggauggggcugcac

SEQ ID NO: 1514663 - RNA, 23 nt, Human
caugccuggauggggcugcaccg

SEQ ID NO: 1514664 - RNA, 16 nt, Human
cauggaguauauguca

SEQ ID NO: 1514665 - RNA, 18 nt, Human
caugggaaugaaugucag

SEQ ID NO: 1514666 - RNA, 11 nt, Human
cauggacuuug

SEQ ID NO: 1514667 - RNA, 13 nt, Human
cauggacuuuguu

SEQ ID NO: 1514668 - RNA, 17 nt, Human
cauggagguuugaagau

SEQ ID NO: 1514669 - RNA, 16 nt, Human
caugggccuccugugu

SEQ ID NO: 1514670 - RNA, 17 nt, Human
caugggccuccugugug

SEQ ID NO: 1514671 - RNA, 23 nt, Human
caugggacagggaggacgcucuc

SEQ ID NO: 1514672 - RNA, 15 nt, Human
caugggccuccugug

SEQ ID NO: 1514673 - RNA, 17 nt, Human
caugggacagggaggac

SEQ ID NO: 1514674 - RNA, 22 nt, Human
caugggaaugaaugucagugug

SEQ ID NO: 1514675 - RNA, 14 nt, Human
caugccucucucag

SEQ ID NO: 1514676 - RNA, 15 nt, Human
caugccucucucagg

SEQ ID NO: 1514677 - RNA, 13 nt, Human
caugccuggaugg

SEQ ID NO: 1514678 - RNA, 15 nt, Human
caugccuccucagga

SEQ ID NO: 1514679 - RNA, 16 nt, Human
caugccucucucaggc

SEQ ID NO: 1514680 - RNA, 17 nt, Human
caugccucucucaggcc

SEQ ID NO: 1514681 - RNA, 18 nt, Human
caugccucucucaggcca

SEQ ID NO: 1514682 - RNA, 19 nt, Human
caugccucucucaggccaa

SEQ ID NO: 1514683 - RNA, 19 nt, Human
caugccagcuuaucucagg

SEQ ID NO: 1514684 - RNA, 20 nt, Human
caugccagcuuaucucaggg

SEQ ID NO: 1514685 - RNA, 13 nt, Human
caugccccugaac

SEQ ID NO: 1514686 - RNA, 14 nt, Human
cauugaccugaggc

SEQ ID NO: 1514687 - RNA, 13 nt, Human
cauugaccugagg

SEQ ID NO: 1514688 - RNA, 22 nt, Human
cauugaccugaggcccuucucu

SEQ ID NO: 1514689 - RNA, 19 nt, Human
cauugaaaucuuuuugcuu

SEQ ID NO: 1514690 - RNA, 21 nt, Human
cauuucuuccacaagagccca

SEQ ID NO: 1514691 - RNA, 23 nt, Human
cauuucugcaucagcugcugaaa

SEQ ID NO: 1514692 - RNA, 19 nt, Human
cauuuaaagcuuauuaaaa

SEQ ID NO: 1514693 - RNA, 17 nt, Human
cauuuacuuuguguuca

SEQ ID NO: 1514694 - RNA, 21 nt, Human
cauuuacuuuguguucaccuu

SEQ ID NO: 1514695 - RNA, 15 nt, Human
cauuugcucauggaa

SEQ ID NO: 1514696 - RNA, 14 nt, Human
cauuugcucaugga

SEQ ID NO: 1514697 - RNA, 16 nt, Human
cauuugcucauggaau

SEQ ID NO: 1514698 - RNA, 18 nt, Human
cauuugcucauggaauug

SEQ ID NO: 1514699 - RNA, 22 nt, Human
cauuugaggucuguucuuucca

SEQ ID NO: 1514700 - RNA, 19 nt, Human
cauuuuauuuuauuaugca

SEQ ID NO: 1514701 - RNA, 21 nt, Human
cauuuuauuuuauuaugcaug

SEQ ID NO: 1514702 - RNA, 22 nt, Human
cauuuuauuuuauuaugcauga

SEQ ID NO: 1514703 - RNA, 23 nt, Human
cauuuugggguacccacugcucu

SEQ ID NO: 1514704 - RNA, 19 nt, Human
cauuuuuaguagagacagg

SEQ ID NO: 1514705 - RNA, 20 nt, Human
cauuuuuaagugcugcauuu

SEQ ID NO: 1514706 - RNA, 15 nt, Human
cauuuuuaagugcug

SEQ ID NO: 1514707 - RNA, 20 nt, Human
cauuuugggguacccacugc

SEQ ID NO: 1514708 - RNA, 21 nt, Human
cauuuugggguacccacugcu

SEQ ID NO: 1514709 - RNA, 22 nt, Human
cauuuugggguacccacugcuc

SEQ ID NO: 1514710 - RNA, 18 nt, Human
cauuuugcuaaaugugaa

SEQ ID NO: 1514711 - RNA, 21 nt, Human
cauuuugcuaaaugugaauga

SEQ ID NO: 1514712 - RNA, 24 nt, Human
cauuuugcuaaaugugaaugauga

SEQ ID NO: 1514713 - RNA, 17 nt, Human
ccaaacucaccugcccc

SEQ ID NO: 1514714 - RNA, 17 nt, Human
ccaaagaaauguaaggg

SEQ ID NO: 1514715 - RNA, 20 nt, Human
cauuuuuaguagagacaggg

SEQ ID NO: 1514716 - RNA, 21 nt, Human
ccaaaauaaaacuuuuuaaaa

SEQ ID NO: 1514717 - RNA, 18 nt, Human
ccaaaauaaaacuuuuua

SEQ ID NO: 1514718 - RNA, 19 nt, Human
cauuugaggucuguucuuu

SEQ ID NO: 1514719 - RNA, 18 nt, Human
cauuugaggucuguucuu

SEQ ID NO: 1514720 - RNA, 17 nt, Human
cauuugaggucuguucu

SEQ ID NO: 1514721 - RNA, 16 nt, Human
cauuugagcagggcuc

SEQ ID NO: 1514722 - RNA, 14 nt, Human
cauuugagcagggc

SEQ ID NO: 1514723 - RNA, 23 nt, Human
cauuucuuccacaagagcccagg

SEQ ID NO: 1514724 - RNA, 16 nt, Human
ccaacaucaacaucuu

SEQ ID NO: 1514725 - RNA, 16 nt, Human
ccaacauacucccauc

SEQ ID NO: 1514726 - RNA, 14 nt, Human
ccaacauacuccca

SEQ ID NO: 1514727 - RNA, 21 nt, Human
ccaacacgagcaggcuacugu

SEQ ID NO: 1514728 - RNA, 15 nt, Human
ccaaauucuuucagu

SEQ ID NO: 1514729 - RNA, 22 nt, Human
ccaaauucuuucaguggcuacc

SEQ ID NO: 1514730 - RNA, 23 nt, Human
ccaaauuucauaccuaucaucuu

SEQ ID NO: 1514731 - RNA, 19 nt, Human
ccaaagcagugcaugcugu

SEQ ID NO: 1514732 - RNA, 14 nt, Human
ccaacacgagcagg

SEQ ID NO: 1514733 - RNA, 15 nt, Human
ccaagaccuucuccu

SEQ ID NO: 1514734 - RNA, 14 nt, Human
ccaaccuggggggc

SEQ ID NO: 1514735 - RNA, 13 nt, Human
ccaacccucauca

SEQ ID NO: 1514736 - RNA, 15 nt, Human
ccaacccucaucacc

SEQ ID NO: 1514737 - RNA, 13 nt, Human
ccaaagaugcagc

SEQ ID NO: 1514738 - RNA, 14 nt, Human
ccaaagaugcagcc

SEQ ID NO: 1514739 - RNA, 22 nt, Human
ccaagagcugaggcaauucuaa

SEQ ID NO: 1514740 - RNA, 14 nt, Human
ccaagcaggacaug

SEQ ID NO: 1514741 - RNA, 12 nt, Human
ccaagcucccag

SEQ ID NO: 1514742 - RNA, 13 nt, Human
ccaagcucccagg

SEQ ID NO: 1514743 - RNA, 18 nt, Human
ccaaggcuagaaccaccu

SEQ ID NO: 1514744 - RNA, 18 nt, Human
ccaauucuuacaaacaug

SEQ ID NO: 1514745 - RNA, 19 nt, Human
ccaauucuuacaaacaugu

SEQ ID NO: 1514746 - RNA, 18 nt, Human
ccacaaaggagagcuagc

SEQ ID NO: 1514747 - RNA, 16 nt, Human
ccacaagaaaugaaag

SEQ ID NO: 1514748 - RNA, 22 nt, Human
ccacaagaaaugaaagcaggga

SEQ ID NO: 1514749 - RNA, 16 nt, Human
ccacaagacccuugug

SEQ ID NO: 1514750 - RNA, 13 nt, Human
ccacaagagccca

SEQ ID NO: 1514751 - RNA, 19 nt, Human
ccaaggcugauuaaaccaa

SEQ ID NO: 1514752 - RNA, 14 nt, Human
ccaaggcuggggga

SEQ ID NO: 1514753 - RNA, 20 nt, Human
ccaauauucauagcagcuua

SEQ ID NO: 1514754 - RNA, 20 nt, Human
ccacaagagcccaggccucc

SEQ ID NO: 1514755 - RNA, 21 nt, Human
ccacaagagcccaggccuccu

SEQ ID NO: 1514756 - RNA, 16 nt, Human
ccacaagagcccaggc

SEQ ID NO: 1514757 - RNA, 17 nt, Human
ccacaagagcccaggcc

SEQ ID NO: 1514758 - RNA, 18 nt, Human
ccacaagagcccaggccu

SEQ ID NO: 1514759 - RNA, 19 nt, Human
ccacaagagcccaggccuc

SEQ ID NO: 1514760 - RNA, 15 nt, Human
ccacaaguuaaauaa

SEQ ID NO: 1514761 - RNA, 20 nt, Human
ccacaaguuaaauaaaucau

SEQ ID NO: 1514762 - RNA, 14 nt, Human
ccaucaugucuggc

SEQ ID NO: 1514763 - RNA, 16 nt, Human
ccaucaugucuggcua

SEQ ID NO: 1514764 - RNA, 16 nt, Human
ccauccugaggcucca

SEQ ID NO: 1514765 - RNA, 15 nt, Human
ccauccugaggcucc

SEQ ID NO: 1514766 - RNA, 21 nt, Human
ccauccucuguacagagccca

SEQ ID NO: 1514767 - RNA, 12 nt, Human
ccaucaagccac

SEQ ID NO: 1514768 - RNA, 12 nt, Human
ccaucacccgcu

SEQ ID NO: 1514769 - RNA, 22 nt, Human
ccagugguuccuaauccucuag

SEQ ID NO: 1514770 - RNA, 23 nt, Human
ccauagagagcaagacgcugugc

SEQ ID NO: 1514771 - RNA, 15 nt, Human
ccauauucuguuggc

SEQ ID NO: 1514772 - RNA, 18 nt, Human
ccauauucuguuggccag

SEQ ID NO: 1514773 - RNA, 19 nt, Human
ccauauucuguuggccagu

SEQ ID NO: 1514774 - RNA, 17 nt, Human
ccagugcuuuauguugu

SEQ ID NO: 1514775 - RNA, 23 nt, Human
ccagggacagaggggguggccuc

SEQ ID NO: 1514776 - RNA, 20 nt, Human
ccaggaagccagcaggcucu

SEQ ID NO: 1514777 - RNA, 22 nt, Human
ccagcugugcucuggacaggca

SEQ ID NO: 1514778 - RNA, 23 nt, Human
ccagcugugcucuggacaggcau

SEQ ID NO: 1514779 - RNA, 16 nt, Human
ccagcuguucagcugg

SEQ ID NO: 1514780 - RNA, 15 nt, Human
ccaggaagccagcag

SEQ ID NO: 1514781 - RNA, 17 nt, Human
ccaggaagccagcaggc

SEQ ID NO: 1514782 - RNA, 19 nt, Human
ccaggaagccagcaggcuc

SEQ ID NO: 1514783 - RNA, 12 nt, Human
ccaggagcagcc

SEQ ID NO: 1514784 - RNA, 13 nt, Human
ccaggagcagcca

SEQ ID NO: 1514785 - RNA, 14 nt, Human
ccaggacugggcca

SEQ ID NO: 1514786 - RNA, 17 nt, Human
ccaggacugggccacuu

SEQ ID NO: 1514787 - RNA, 12 nt, Human
ccaggacugggc

SEQ ID NO: 1514788 - RNA, 13 nt, Human
ccaggacugggcc

SEQ ID NO: 1514789 - RNA, 15 nt, Human
ccaggagcagccaca

SEQ ID NO: 1514790 - RNA, 14 nt, Human
ccaggagcagccac

SEQ ID NO: 1514791 - RNA, 14 nt, Human
ccaggccagaggga

SEQ ID NO: 1514792 - RNA, 21 nt, Human
ccaggccagagggagugacag

SEQ ID NO: 1514793 - RNA, 21 nt, Human
ccaggccccugccacccuggg

SEQ ID NO: 1514794 - RNA, 23 nt, Human
ccaggccccugccacccugggga

SEQ ID NO: 1514795 - RNA, 17 nt, Human
ccaggcccucugcccac

SEQ ID NO: 1514796 - RNA, 18 nt, Human
ccaggcccucugcccacu

SEQ ID NO: 1514797 - RNA, 19 nt, Human
ccaggcccucugcccacuc

SEQ ID NO: 1514798 - RNA, 20 nt, Human
ccaggcccucugcccacucc

SEQ ID NO: 1514799 - RNA, 13 nt, Human
ccaggccuccuac

SEQ ID NO: 1514800 - RNA, 18 nt, Human
ccaggccuccuacagcuu

SEQ ID NO: 1514801 - RNA, 19 nt, Human
ccaggccuccuacagcuug

SEQ ID NO: 1514802 - RNA, 20 nt, Human
ccagcugcuugggcuucauc

SEQ ID NO: 1514803 - RNA, 16 nt, Human
ccagcugcuugggcuu

SEQ ID NO: 1514804 - RNA, 18 nt, Human
ccagcugcuugggcuuca

SEQ ID NO: 1514805 - RNA, 15 nt, Human
ccagcugcuugggcu

SEQ ID NO: 1514806 - RNA, 18 nt, Human
ccagcugugcucuggaca

SEQ ID NO: 1514807 - RNA, 20 nt, Human
ccagcugugcucuggacagg

SEQ ID NO: 1514808 - RNA, 21 nt, Human
ccagcugugcucuggacaggc

SEQ ID NO: 1514809 - RNA, 19 nt, Human
ccagccugagcgacaguga

SEQ ID NO: 1514810 - RNA, 22 nt, Human
ccagcucugcgucgguccuggu

SEQ ID NO: 1514811 - RNA, 11 nt, Human
cccagcucugc

SEQ ID NO: 1514812 - RNA, 18 nt, Human
cccagcucugguccauag

SEQ ID NO: 1514813 - RNA, 15 nt, Human
cccagcucuggucca

SEQ ID NO: 1514814 - RNA, 16 nt, Human
cccagcucugguccau

SEQ ID NO: 1514815 - RNA, 12 nt, Human
cccagcucugcg

SEQ ID NO: 1514816 - RNA, 12 nt, Human
cccagcucuggu

SEQ ID NO: 1514817 - RNA, 13 nt, Human
cccagcucugguc

SEQ ID NO: 1514818 - RNA, 14 nt, Human
cccagcucuggucc

SEQ ID NO: 1514819 - RNA, 15 nt, Human
cccagcgagcccugg

SEQ ID NO: 1514820 - RNA, 14 nt, Human
cccagcgagcccug

SEQ ID NO: 1514821 - RNA, 12 nt, Human
cccaggacuggg

SEQ ID NO: 1514822 - RNA, 13 nt, Human
cccaggacugggc

SEQ ID NO: 1514823 - RNA, 14 nt, Human
cccaggacugggcc

SEQ ID NO: 1514824 - RNA, 15 nt, Human
cccaggacugggcca

SEQ ID NO: 1514825 - RNA, 13 nt, Human
cccaggagccccg

SEQ ID NO: 1514826 - RNA, 14 nt, Human
cccaggagccccga

SEQ ID NO: 1514827 - RNA, 18 nt, Human
cccaggagccccgaggcc

SEQ ID NO: 1514828 - RNA, 14 nt, Human
cccaggaggccagc

SEQ ID NO: 1514829 - RNA, 15 nt, Human
cccagaggagggcag

SEQ ID NO: 1514830 - RNA, 16 nt, Human
cccagcaagugagagc

SEQ ID NO: 1514831 - RNA, 13 nt, Human
cccagccccaaug

SEQ ID NO: 1514832 - RNA, 17 nt, Human
cccagauuggcucacac

SEQ ID NO: 1514833 - RNA, 19 nt, Human
cccagauuggcucacacug

SEQ ID NO: 1514834 - RNA, 20 nt, Human
cccagauuggcucacacuga

SEQ ID NO: 1514835 - RNA, 21 nt, Human
cccagauuggcucacacugag

SEQ ID NO: 1514836 - RNA, 22 nt, Human
cccagauuggcucacacugaga

SEQ ID NO: 1514837 - RNA, 17 nt, Human
cccagccccaaugaaca

SEQ ID NO: 1514838 - RNA, 11 nt, Human
cccagccccau

SEQ ID NO: 1514839 - RNA, 12 nt, Human
cccagccccauc

SEQ ID NO: 1514840 - RNA, 18 nt, Human
cccagccccauccucugu

SEQ ID NO: 1514841 - RNA, 19 nt, Human
cccagccccauccucugua

SEQ ID NO: 1514842 - RNA, 13 nt, Human
cccagccccaucc

SEQ ID NO: 1514843 - RNA, 14 nt, Human
cccagccccauccc

SEQ ID NO: 1514844 - RNA, 14 nt, Human
cccagccccauccu

SEQ ID NO: 1514845 - RNA, 15 nt, Human
cccagccccauccuc

SEQ ID NO: 1514846 - RNA, 18 nt, Human
cccaggaggccagccuug

SEQ ID NO: 1514847 - RNA, 16 nt, Human
ccauguuggccaggcu

SEQ ID NO: 1514848 - RNA, 15 nt, Human
ccauguuggccaggc

SEQ ID NO: 1514849 - RNA, 19 nt, Human
ccauguuggccaggcuggu

SEQ ID NO: 1514850 - RNA, 21 nt, Human
ccauguuggccaggcuggucu

SEQ ID NO: 1514851 - RNA, 12 nt, Human
cccaccuggccu

SEQ ID NO: 1514852 - RNA, 15 nt, Human
cccaccuggccucug

SEQ ID NO: 1514853 - RNA, 16 nt, Human
cccaccuggccucugc

SEQ ID NO: 1514854 - RNA, 17 nt, Human
cccaccuuggcugcagg

SEQ ID NO: 1514855 - RNA, 19 nt, Human
cccaccuuggcugcaggga

SEQ ID NO: 1514856 - RNA, 20 nt, Human
cccaccuuggcugcagggag

SEQ ID NO: 1514857 - RNA, 15 nt, Human
cccacgcccccacug

SEQ ID NO: 1514858 - RNA, 17 nt, Human
cccacgagggugccgug

SEQ ID NO: 1514859 - RNA, 13 nt, Human
cccacgcccccac

SEQ ID NO: 1514860 - RNA, 14 nt, Human
cccacgcccccacu

SEQ ID NO: 1514861 - RNA, 13 nt, Human
ccaugugccaggu

SEQ ID NO: 1514862 - RNA, 23 nt, Human
ccauggcacucuauguucuaaga

SEQ ID NO: 1514863 - RNA, 13 nt, Human
ccauguuggccag

SEQ ID NO: 1514864 - RNA, 14 nt, Human
ccauguuggccagg

SEQ ID NO: 1514865 - RNA, 16 nt, Human
ccaugcugcccuguga

SEQ ID NO: 1514866 - RNA, 17 nt, Human
ccaugcugcccugugag

SEQ ID NO: 1514867 - RNA, 15 nt, Human
ccaugcuccuggccc

SEQ ID NO: 1514868 - RNA, 18 nt, Human
ccaugcuccuggcccacu

SEQ ID NO: 1514869 - RNA, 16 nt, Human
ccaugccuccucagga

SEQ ID NO: 1514870 - RNA, 22 nt, Human
ccaugaaaaugcaacaacaugu

SEQ ID NO: 1514871 - RNA, 13 nt, Human
cccagguuucuau

SEQ ID NO: 1514872 - RNA, 17 nt, Human
cccaggcauuccccagg

SEQ ID NO: 1514873 - RNA, 18 nt, Human
cccaggcauuccccagga

SEQ ID NO: 1514874 - RNA, 15 nt, Human
cccaggaggccagcc

SEQ ID NO: 1514875 - RNA, 16 nt, Human
cccaggaggccagccu

SEQ ID NO: 1514876 - RNA, 23 nt, Human
cccaggcaggucuugaacuccug

SEQ ID NO: 1514877 - RNA, 15 nt, Human
cccaggcauucccca

SEQ ID NO: 1514878 - RNA, 15 nt, Human
cccagugccgagaag

SEQ ID NO: 1514879 - RNA, 21 nt, Human
cccagugcccacaggaucagu

SEQ ID NO: 1514880 - RNA, 10 nt, Human
cccagucugg

SEQ ID NO: 1514881 - RNA, 18 nt, Human
cccagucuggaaugcagu

SEQ ID NO: 1514882 - RNA, 19 nt, Human
cccagucuggaaugcagug

SEQ ID NO: 1514883 - RNA, 17 nt, Human
cccagugccgagaagga

SEQ ID NO: 1514884 - RNA, 20 nt, Human
cccagugguuccuaauccuc

SEQ ID NO: 1514885 - RNA, 14 nt, Human
cccaguuagcucuc

SEQ ID NO: 1514886 - RNA, 18 nt, Human
cccaucucacacaugagc

SEQ ID NO: 1514887 - RNA, 13 nt, Human
cccaucucacaca

SEQ ID NO: 1514888 - RNA, 20 nt, Human
cccaucugugaaaggaaaga

SEQ ID NO: 1514889 - RNA, 14 nt, Human
cccaugcugcccug

SEQ ID NO: 1514890 - RNA, 12 nt, Human
cccaugcugccc

SEQ ID NO: 1514891 - RNA, 13 nt, Human
cccaugcugcccu

SEQ ID NO: 1514892 - RNA, 15 nt, Human
cccaugagccucagc

SEQ ID NO: 1514893 - RNA, 16 nt, Human
cccaugagccucagca

SEQ ID NO: 1514894 - RNA, 20 nt, Human
cccaugagccucagcauccu

SEQ ID NO: 1514895 - RNA, 21 nt, Human
ccccaaauggaaaugggcaga

SEQ ID NO: 1514896 - RNA, 22 nt, Human
cccaugagccucagcauccugg

SEQ ID NO: 1514897 - RNA, 17 nt, Human
ccuccaggugcacaagc

SEQ ID NO: 1514898 - RNA, 11 nt, Human
ccuccaggugc

SEQ ID NO: 1514899 - RNA, 12 nt, Human
ccuccaggugca

SEQ ID NO: 1514900 - RNA, 14 nt, Human
ccuccauccugagg

SEQ ID NO: 1514901 - RNA, 12 nt, Human
ccuccauccuga

SEQ ID NO: 1514902 - RNA, 13 nt, Human
ccuccauccugag

SEQ ID NO: 1514903 - RNA, 12 nt, Human
ccuccauguggg

SEQ ID NO: 1514904 - RNA, 15 nt, Human
ccuccaugugggcua

SEQ ID NO: 1514905 - RNA, 17 nt, Human
ccucccaaagugcuggg

SEQ ID NO: 1514906 - RNA, 14 nt, Human
ccucccaacucacc

SEQ ID NO: 1514907 - RNA, 19 nt, Human
ccuccacucucccccaccc

SEQ ID NO: 1514908 - RNA, 22 nt, Human
ccuccacucucccccacccccu

SEQ ID NO: 1514909 - RNA, 23 nt, Human
ccuccagggcuggacugaggccu

SEQ ID NO: 1514910 - RNA, 14 nt, Human
ccuccacucucccc

SEQ ID NO: 1514911 - RNA, 17 nt, Human
ccuccacucucccccac

SEQ ID NO: 1514912 - RNA, 12 nt, Human
ccucauacccac

SEQ ID NO: 1514913 - RNA, 18 nt, Human
ccucaggugagaagcaga

SEQ ID NO: 1514914 - RNA, 20 nt, Human
ccucaggugagaagcagagg

SEQ ID NO: 1514915 - RNA, 19 nt, Human
ccucccgaguagcugggac

SEQ ID NO: 1514916 - RNA, 17 nt, Human
ccucccgaguagcuggg

SEQ ID NO: 1514917 - RNA, 18 nt, Human
ccucccgaguagcuggga

SEQ ID NO: 1514918 - RNA, 19 nt, Human
ccucccgaauagcugggac

SEQ ID NO: 1514919 - RNA, 20 nt, Human
ccucccgaauagcugggacu

SEQ ID NO: 1514920 - RNA, 13 nt, Human
ccucccucuuucc

SEQ ID NO: 1514921 - RNA, 11 nt, Human
ccuccucagau

SEQ ID NO: 1514922 - RNA, 12 nt, Human
ccuccuccagcc

SEQ ID NO: 1514923 - RNA, 14 nt, Human
ccuccucagaucuu

SEQ ID NO: 1514924 - RNA, 16 nt, Human
ccuccccgcccuuuuu

SEQ ID NO: 1514925 - RNA, 15 nt, Human
ccucccaacucaccc

SEQ ID NO: 1514926 - RNA, 18 nt, Human
ccucccgaauagcuggga

SEQ ID NO: 1514927 - RNA, 21 nt, Human
ccucccgaauagcugggacua

SEQ ID NO: 1514928 - RNA, 21 nt, Human
ccuccuccagccgccaugcuc

SEQ ID NO: 1514929 - RNA, 20 nt, Human
ccucuccccagcaagugaga

SEQ ID NO: 1514930 - RNA, 13 nt, Human
ccucucccuugga

SEQ ID NO: 1514931 - RNA, 22 nt, Human
ccucucccuuggauuguccccg

SEQ ID NO: 1514932 - RNA, 15 nt, Human
ccucuccccagcaag

SEQ ID NO: 1514933 - RNA, 21 nt, Human
ccucugacacacagcucuguc

SEQ ID NO: 1514934 - RNA, 13 nt, Human
ccucugacacaca

SEQ ID NO: 1514935 - RNA, 15 nt, Human
ccucugacacacagc

SEQ ID NO: 1514936 - RNA, 14 nt, Human
ccucugacacacag

SEQ ID NO: 1514937 - RNA, 19 nt, Human
ccucugacacacagcucug

SEQ ID NO: 1514938 - RNA, 20 nt, Human
ccucugacacacagcucugu

SEQ ID NO: 1514939 - RNA, 19 nt, Human
ccucugcagcaauaaagca

SEQ ID NO: 1514940 - RNA, 19 nt, Human
ccucugcacuccccugcug

SEQ ID NO: 1514941 - RNA, 13 nt, Human
ccucugcccacuc

SEQ ID NO: 1514942 - RNA, 16 nt, Human
ccucugcccacucccu

SEQ ID NO: 1514943 - RNA, 18 nt, Human
ccucugcagcaauaaagc

SEQ ID NO: 1514944 - RNA, 14 nt, Human
ccucugcagcaaua

SEQ ID NO: 1514945 - RNA, 23 nt, Human
ccucugcacuccccugcugggug

SEQ ID NO: 1514946 - RNA, 18 nt, Human
ccucugcacuccccugcu

SEQ ID NO: 1514947 - RNA, 11 nt, Human
ccucugcacaa

SEQ ID NO: 1514948 - RNA, 16 nt, Human
ccucugcacuccccug

SEQ ID NO: 1514949 - RNA, 17 nt, Human
ccucugcacuccccugc

SEQ ID NO: 1514950 - RNA, 14 nt, Human
ccucagcauccugg

SEQ ID NO: 1514951 - RNA, 16 nt, Human
ccucagaucuucugug

SEQ ID NO: 1514952 - RNA, 16 nt, Human
ccucagggucccuggu

SEQ ID NO: 1514953 - RNA, 17 nt, Human
ccucagggucccuggug

SEQ ID NO: 1514954 - RNA, 20 nt, Human
ccucagggucccugguggca

SEQ ID NO: 1514955 - RNA, 22 nt, Human
ccucagggucccugguggcagc

SEQ ID NO: 1514956 - RNA, 17 nt, Human
ccuauuagagaagagau

SEQ ID NO: 1514957 - RNA, 16 nt, Human
ccuauuagagaagaga

SEQ ID NO: 1514958 - RNA, 11 nt, Human
ccucacacagc

SEQ ID NO: 1514959 - RNA, 24 nt, Human
ccucacaguccuuaccagcagagc

SEQ ID NO: 1514960 - RNA, 23 nt, Human
ccucacaguccuuaccagcagag

SEQ ID NO: 1514961 - RNA, 18 nt, Human
ccuaggugacagagugag

SEQ ID NO: 1514962 - RNA, 15 nt, Human
ccuaggugacagagu

SEQ ID NO: 1514963 - RNA, 22 nt, Human
ccucaggugagaagcagaggaa

SEQ ID NO: 1514964 - RNA, 17 nt, Human
ccgggaagggggcuggg

SEQ ID NO: 1514965 - RNA, 22 nt, Human
ccgggaggcagagguugcagug

SEQ ID NO: 1514966 - RNA, 20 nt, Human
ccgggaagggggcugggaca

SEQ ID NO: 1514967 - RNA, 14 nt, Human
cccugguucucauc

SEQ ID NO: 1514968 - RNA, 12 nt, Human
cccuucccaccu

SEQ ID NO: 1514969 - RNA, 13 nt, Human
cccuucccaccuc

SEQ ID NO: 1514970 - RNA, 22 nt, Human
cccuuguggucccaccccacac

SEQ ID NO: 1514971 - RNA, 22 nt, Human
cccuugguuaggcauuguggga

SEQ ID NO: 1514972 - RNA, 23 nt, Human
cccuugguuaggcauugugggaa

SEQ ID NO: 1514973 - RNA, 17 nt, Human
cccuuggauuguccccg

SEQ ID NO: 1514974 - RNA, 13 nt, Human
ccuaaacauauga

SEQ ID NO: 1514975 - RNA, 16 nt, Human
ccuaaaauucagugga

SEQ ID NO: 1514976 - RNA, 22 nt, Human
ccuacaguugaaaaacagcuga

SEQ ID NO: 1514977 - RNA, 19 nt, Human
ccuacagcuugaccgugag

SEQ ID NO: 1514978 - RNA, 13 nt, Human
ccuaggugacaga

SEQ ID NO: 1514979 - RNA, 21 nt, Human
ccuagaaauuccccacccuga

SEQ ID NO: 1514980 - RNA, 19 nt, Human
ccuacuguaauuugugaua

SEQ ID NO: 1514981 - RNA, 18 nt, Human
ccuacccacccuccuuuc

SEQ ID NO: 1514982 - RNA, 18 nt, Human
ccuacaggagugagcacu

SEQ ID NO: 1514983 - RNA, 13 nt, Human
ccuacccacccuc

SEQ ID NO: 1514984 - RNA, 12 nt, Human
ccguuauuaaaa

SEQ ID NO: 1514985 - RNA, 16 nt, Human
cccugccuccuuugug

SEQ ID NO: 1514986 - RNA, 23 nt, Human
cccugccuccuuugugaggaagc

SEQ ID NO: 1514987 - RNA, 13 nt, Human
cccugcccaccug

SEQ ID NO: 1514988 - RNA, 17 nt, Human
cccugccacccugggga

SEQ ID NO: 1514989 - RNA, 18 nt, Human
cccugccacccuggggag

SEQ ID NO: 1514990 - RNA, 12 nt, Human
cccugccacccu

SEQ ID NO: 1514991 - RNA, 14 nt, Human
cccugccacccugg

SEQ ID NO: 1514992 - RNA, 15 nt, Human
cccugccacccuggg

SEQ ID NO: 1514993 - RNA, 22 nt, Human
cccugcaaccugauugugucuc

SEQ ID NO: 1514994 - RNA, 16 nt, Human
cccugcaaccugauug

SEQ ID NO: 1514995 - RNA, 12 nt, Human
cccugcagaggg

SEQ ID NO: 1514996 - RNA, 20 nt, Human
cccugcagagggcacagaaa

SEQ ID NO: 1514997 - RNA, 18 nt, Human
cccugcagagggcacaga

SEQ ID NO: 1514998 - RNA, 13 nt, Human
cccugcugguuca

SEQ ID NO: 1514999 - RNA, 19 nt, Human
cccugcugguucaggguug

SEQ ID NO: 1515000 - RNA, 20 nt, Human
cccugcugguucaggguugg

SEQ ID NO: 1515001 - RNA, 22 nt, Human
cccugguggcagugggagcugc

SEQ ID NO: 1515002 - RNA, 14 nt, Human
cccugguggcagcu

SEQ ID NO: 1515003 - RNA, 22 nt, Human
cccucauccucauacccacccc

SEQ ID NO: 1515004 - RNA, 21 nt, Human
cccuccaagaccuucuccuuc

SEQ ID NO: 1515005 - RNA, 21 nt, Human
cccucagggucccugguggca

SEQ ID NO: 1515006 - RNA, 20 nt, Human
cccucagucuggcccuuccu

SEQ ID NO: 1515007 - RNA, 22 nt, Human
cccucaucaccaacgucugugc

SEQ ID NO: 1515008 - RNA, 17 nt, Human
cccucauccucauaccc

SEQ ID NO: 1515009 - RNA, 20 nt, Human
cccucauccucauacccacc

SEQ ID NO: 1515010 - RNA, 13 nt, Human
cccucccucuuuc

SEQ ID NO: 1515011 - RNA, 16 nt, Human
cccucccuuucucccc

SEQ ID NO: 1515012 - RNA, 13 nt, Human
cccucccuuucuc

SEQ ID NO: 1515013 - RNA, 14 nt, Human
cccucccuuucucc

SEQ ID NO: 1515014 - RNA, 16 nt, Human
cccuccccgcccuuuu

SEQ ID NO: 1515015 - RNA, 17 nt, Human
cccuccccgcccuuuuu

SEQ ID NO: 1515016 - RNA, 17 nt, Human
cccuccaugugggcuag

SEQ ID NO: 1515017 - RNA, 15 nt, Human
cccucagggucccug

SEQ ID NO: 1515018 - RNA, 16 nt, Human
cccucagggucccugg

SEQ ID NO: 1515019 - RNA, 17 nt, Human
cccucagggucccuggu

SEQ ID NO: 1515020 - RNA, 18 nt, Human
cccucagggucccuggug

SEQ ID NO: 1515021 - RNA, 19 nt, Human
cccucagggucccuggugg

SEQ ID NO: 1515022 - RNA, 22 nt, Human
cccuaaaguguauuuuuuuacu

SEQ ID NO: 1515023 - RNA, 17 nt, Human
cccuaaaguguauuuuu

SEQ ID NO: 1515024 - RNA, 16 nt, Human
cccggcaggguccuag

SEQ ID NO: 1515025 - RNA, 13 nt, Human
ccccagccugcua

SEQ ID NO: 1515026 - RNA, 15 nt, Human
ccccagccccauccu

SEQ ID NO: 1515027 - RNA, 12 nt, Human
ccccaggaggcc

SEQ ID NO: 1515028 - RNA, 13 nt, Human
ccccaggacuggg

SEQ ID NO: 1515029 - RNA, 14 nt, Human
ccccaggacugggc

SEQ ID NO: 1515030 - RNA, 16 nt, Human
ccccaggacugggcca

SEQ ID NO: 1515031 - RNA, 22 nt, Human
ccccaggacugggccacuucug

SEQ ID NO: 1515032 - RNA, 15 nt, Human
ccccuggcagccccu

SEQ ID NO: 1515033 - RNA, 12 nt, Human
ccccuggcagcc

SEQ ID NO: 1515034 - RNA, 14 nt, Human
ccccuggcagcccc

SEQ ID NO: 1515035 - RNA, 22 nt, Human
ccccaggugguuauggagaggg

SEQ ID NO: 1515036 - RNA, 14 nt, Human
ccccaggugccagu

SEQ ID NO: 1515037 - RNA, 22 nt, Human
cccgcuaagagggagggagggc

SEQ ID NO: 1515038 - RNA, 21 nt, Human
cccgaggccuucucugaagga

SEQ ID NO: 1515039 - RNA, 20 nt, Human
cccgaggccuucucugaagg

SEQ ID NO: 1515040 - RNA, 15 nt, Human
cccgaggccuucucu

SEQ ID NO: 1515041 - RNA, 18 nt, Human
ccccugguucucaucuuu

SEQ ID NO: 1515042 - RNA, 15 nt, Human
ccccugguucucauc

SEQ ID NO: 1515043 - RNA, 22 nt, Human
ccccuguccccgcacugggcuu

SEQ ID NO: 1515044 - RNA, 17 nt, Human
cugaucucucgugauug

SEQ ID NO: 1515045 - RNA, 18 nt, Human
cugaucucucgugauuga

SEQ ID NO: 1515046 - RNA, 19 nt, Human
cugacccugcuucaaauau

SEQ ID NO: 1515047 - RNA, 23 nt, Human
cugacccugcuucaaauauuucc

SEQ ID NO: 1515048 - RNA, 12 nt, Human
cugagcugggau

SEQ ID NO: 1515049 - RNA, 22 nt, Human
cugagcugggaugauuggaggg

SEQ ID NO: 1515050 - RNA, 15 nt, Human
cugaggaagaacggg

SEQ ID NO: 1515051 - RNA, 18 nt, Human
cugaggaagaacggggcu

SEQ ID NO: 1515052 - RNA, 14 nt, Human
cugaggaauccaga

SEQ ID NO: 1515053 - RNA, 23 nt, Human
cugaggaagaacggggcucuucu

SEQ ID NO: 1515054 - RNA, 13 nt, Human
cugaggugggagg

SEQ ID NO: 1515055 - RNA, 22 nt, Human
cugaggugggaggaucucuuga

SEQ ID NO: 1515056 - RNA, 14 nt, Human
cugaggggccucuu

SEQ ID NO: 1515057 - RNA, 23 nt, Human
cugaggaauccagacccggcugc

SEQ ID NO: 1515058 - RNA, 13 nt, Human
cugaaagaggaau

SEQ ID NO: 1515059 - RNA, 17 nt, Human
cugaaagaggaaugaag

SEQ ID NO: 1515060 - RNA, 24 nt, Human
cucuugauucauaaugacuuaagc

SEQ ID NO: 1515061 - RNA, 22 nt, Human
cucuugauucauaaugacuuaa

SEQ ID NO: 1515062 - RNA, 15 nt, Human
cucuugagccuggga

SEQ ID NO: 1515063 - RNA, 16 nt, Human
cucuugagccugggag

SEQ ID NO: 1515064 - RNA, 14 nt, Human
cucuugagccuggg

SEQ ID NO: 1515065 - RNA, 17 nt, Human
cucugcacaagcugcac

SEQ ID NO: 1515066 - RNA, 18 nt, Human
cucugcacaagcugcacc

SEQ ID NO: 1515067 - RNA, 19 nt, Human
cucugcacaagcugcaccc

SEQ ID NO: 1515068 - RNA, 14 nt, Human
cugaaaauguaugu

SEQ ID NO: 1515069 - RNA, 13 nt, Human
cugacacacagcu

SEQ ID NO: 1515070 - RNA, 15 nt, Human
cugacacacagcucu

SEQ ID NO: 1515071 - RNA, 16 nt, Human
cugacacacagcucug

SEQ ID NO: 1515072 - RNA, 17 nt, Human
cugacacacagcucugu

SEQ ID NO: 1515073 - RNA, 18 nt, Human
cugacacacagcucuguc

SEQ ID NO: 1515074 - RNA, 19 nt, Human
cugacacacagcucugucc

SEQ ID NO: 1515075 - RNA, 20 nt, Human
cugacacacagcucuguccu

SEQ ID NO: 1515076 - RNA, 21 nt, Human
cugacacacagcucuguccug

SEQ ID NO: 1515077 - RNA, 22 nt, Human
cugacacacagcucuguccugg

SEQ ID NO: 1515078 - RNA, 23 nt, Human
cugacacacagcucuguccuggg

SEQ ID NO: 1515079 - RNA, 14 nt, Human
cuccgucaacucau

SEQ ID NO: 1515080 - RNA, 23 nt, Human
cuccgcuuucuacccagcgagcc

SEQ ID NO: 1515081 - RNA, 22 nt, Human
cuccgcuuucuacccagcgagc

SEQ ID NO: 1515082 - RNA, 21 nt, Human
cuccgcuuucuacccagcgag

SEQ ID NO: 1515083 - RNA, 19 nt, Human
cuccccaugauguuuagaa

SEQ ID NO: 1515084 - RNA, 16 nt, Human
cucccucccucuuucc

SEQ ID NO: 1515085 - RNA, 15 nt, Human
cucccucuuucccuc

SEQ ID NO: 1515086 - RNA, 19 nt, Human
cucccucuuucccucccuu

SEQ ID NO: 1515087 - RNA, 14 nt, Human
cucccaccucagcc

SEQ ID NO: 1515088 - RNA, 16 nt, Human
cucccaccucagccuc

SEQ ID NO: 1515089 - RNA, 17 nt, Human
cucccaccucagccucc

SEQ ID NO: 1515090 - RNA, 18 nt, Human
cuccaggugcacaagcuc

SEQ ID NO: 1515091 - RNA, 19 nt, Human
cuccaggugcacaagcucc

SEQ ID NO: 1515092 - RNA, 20 nt, Human
cuccaggugcacaagcucca

SEQ ID NO: 1515093 - RNA, 22 nt, Human
cuccaggugcacaagcuccaag

SEQ ID NO: 1515094 - RNA, 23 nt, Human
cuccaggcuguaucccaugagcc

SEQ ID NO: 1515095 - RNA, 16 nt, Human
cuccagacacaugucc

SEQ ID NO: 1515096 - RNA, 22 nt, Human
cuccagaauuucccaaagcagu

SEQ ID NO: 1515097 - RNA, 11 nt, Human
cuccagacaca

SEQ ID NO: 1515098 - RNA, 16 nt, Human
cucagaaucucaaaua

SEQ ID NO: 1515099 - RNA, 17 nt, Human
cucagaaucucaaauaa

SEQ ID NO: 1515100 - RNA, 11 nt, Human
cucggugccuu

SEQ ID NO: 1515101 - RNA, 22 nt, Human
cuccuuuagcgcccaguugggu

SEQ ID NO: 1515102 - RNA, 22 nt, Human
cuccuagccugugccucuggga

SEQ ID NO: 1515103 - RNA, 16 nt, Human
cuccuuuagcgcccag

SEQ ID NO: 1515104 - RNA, 17 nt, Human
cuccuuuagcgcccagu

SEQ ID NO: 1515105 - RNA, 24 nt, Human
cuccuuuucacaguucucuccuuc

SEQ ID NO: 1515106 - RNA, 13 nt, Human
cucucccuuggau

SEQ ID NO: 1515107 - RNA, 21 nt, Human
cucuccgaccagacaccuuga

SEQ ID NO: 1515108 - RNA, 16 nt, Human
cucuccgaccagacac

SEQ ID NO: 1515109 - RNA, 13 nt, Human
cucuccuccuuuu

SEQ ID NO: 1515110 - RNA, 20 nt, Human
cucuccuccuuuucacaguu

SEQ ID NO: 1515111 - RNA, 19 nt, Human
cucucuggccuucggccuc

SEQ ID NO: 1515112 - RNA, 22 nt, Human
cucucuggccuucggccuccau

SEQ ID NO: 1515113 - RNA, 17 nt, Human
cucucuggccuucggcc

SEQ ID NO: 1515114 - RNA, 10 nt, Human
cucuccucug

SEQ ID NO: 1515115 - RNA, 15 nt, Human
cgguuuauauaagcu

SEQ ID NO: 1515116 - RNA, 13 nt, Human
cgguguggagaag

SEQ ID NO: 1515117 - RNA, 16 nt, Human
cguacacauuuuauuu

SEQ ID NO: 1515118 - RNA, 13 nt, Human
cguacacauuuua

SEQ ID NO: 1515119 - RNA, 15 nt, Human
cggagacggaguccc

SEQ ID NO: 1515120 - RNA, 23 nt, Human
cggagaagagcuguucacagcca

SEQ ID NO: 1515121 - RNA, 24 nt, Human
cggagaagagcuguucacagccag

SEQ ID NO: 1515122 - RNA, 15 nt, Human
cuaaagcugccagcc

SEQ ID NO: 1515123 - RNA, 16 nt, Human
cuaaaggcuaccuuug

SEQ ID NO: 1515124 - RNA, 15 nt, Human
cuaaaggcuaccuuu

SEQ ID NO: 1515125 - RNA, 14 nt, Human
cuaaagcugccagc

SEQ ID NO: 1515126 - RNA, 19 nt, Human
cuaaaggcuaccuuuguau

SEQ ID NO: 1515127 - RNA, 17 nt, Human
cuaaaggcuaccuuugu

SEQ ID NO: 1515128 - RNA, 22 nt, Human
cuaaaguguauuuuuuuacuaa

SEQ ID NO: 1515129 - RNA, 19 nt, Human
cguguccccugacagggcc

SEQ ID NO: 1515130 - RNA, 16 nt, Human
cguguccccugacagg

SEQ ID NO: 1515131 - RNA, 18 nt, Human
cguguccccugacagggc

SEQ ID NO: 1515132 - RNA, 13 nt, Human
cguuaaaauacca

SEQ ID NO: 1515133 - RNA, 14 nt, Human
cuaacuggacuggu

SEQ ID NO: 1515134 - RNA, 13 nt, Human
cgaguagcuggga

SEQ ID NO: 1515135 - RNA, 17 nt, Human
cgcuggggccaguuggu

SEQ ID NO: 1515136 - RNA, 20 nt, Human
cgcuggggccaguugguccc

SEQ ID NO: 1515137 - RNA, 16 nt, Human
cgccuuaaggauguuc

SEQ ID NO: 1515138 - RNA, 18 nt, Human
cgcugccccuggcagccc

SEQ ID NO: 1515139 - RNA, 19 nt, Human
cgcuggaccuugaacuggg

SEQ ID NO: 1515140 - RNA, 23 nt, Human
cgcuggaccuugaacuggguacu

SEQ ID NO: 1515141 - RNA, 16 nt, Human
cgcugccccuggcagc

SEQ ID NO: 1515142 - RNA, 17 nt, Human
cgcugccccuggcagcc

SEQ ID NO: 1515143 - RNA, 16 nt, Human
cuaccugaggggccuc

SEQ ID NO: 1515144 - RNA, 19 nt, Human
cuaccugaggggccucuua

SEQ ID NO: 1515145 - RNA, 23 nt, Human
cuaccugaggggccucuuauggg

SEQ ID NO: 1515146 - RNA, 14 nt, Human
cuagggaagauaau

SEQ ID NO: 1515147 - RNA, 19 nt, Human
cuaguuugauuaaauucuu

SEQ ID NO: 1515148 - RNA, 17 nt, Human
cuaguuugauuaaauuc

SEQ ID NO: 1515149 - RNA, 21 nt, Human
cuaguuugauuaaauucuugc

SEQ ID NO: 1515150 - RNA, 20 nt, Human
cuaguuugauuaaauucuug

SEQ ID NO: 1515151 - RNA, 12 nt, Human
cuaggccugggg

SEQ ID NO: 1515152 - RNA, 13 nt, Human
cuaggccugggga

SEQ ID NO: 1515153 - RNA, 14 nt, Human
cuaggccuggccag

SEQ ID NO: 1515154 - RNA, 15 nt, Human
cuaggccuggccaga

SEQ ID NO: 1515155 - RNA, 18 nt, Human
cuaggccuggccagaugc

SEQ ID NO: 1515156 - RNA, 19 nt, Human
cuaggccuggccagaugca

SEQ ID NO: 1515157 - RNA, 19 nt, Human
cuagccagaggagagagga

SEQ ID NO: 1515158 - RNA, 17 nt, Human
cuagccagaggagagag

SEQ ID NO: 1515159 - RNA, 13 nt, Human
cuaggccuggcca

SEQ ID NO: 1515160 - RNA, 20 nt, Human
cuagcauacguacacauuuu

SEQ ID NO: 1515161 - RNA, 19 nt, Human
cuagcauacguacacauuu

SEQ ID NO: 1515162 - RNA, 18 nt, Human
cuagcauacguacacauu

SEQ ID NO: 1515163 - RNA, 16 nt, Human
cuagcauacguacaca

SEQ ID NO: 1515164 - RNA, 19 nt, Human
cucagaaaacaaggaugaa

SEQ ID NO: 1515165 - RNA, 23 nt, Human
cucagaaaacaaggaugaauuaa

SEQ ID NO: 1515166 - RNA, 12 nt, Human
cucagaauauug

SEQ ID NO: 1515167 - RNA, 18 nt, Human
cucacuuguuuuauuuaa

SEQ ID NO: 1515168 - RNA, 13 nt, Human
cucaccugccccu

SEQ ID NO: 1515169 - RNA, 18 nt, Human
cucaccugccccucaacu

SEQ ID NO: 1515170 - RNA, 14 nt, Human
cucaccugccccuc

SEQ ID NO: 1515171 - RNA, 16 nt, Human
cucaccugccccucaa

SEQ ID NO: 1515172 - RNA, 13 nt, Human
cucaccucucccu

SEQ ID NO: 1515173 - RNA, 14 nt, Human
cucaccucucccuu

SEQ ID NO: 1515174 - RNA, 15 nt, Human
cucaccucucccuug

SEQ ID NO: 1515175 - RNA, 16 nt, Human
cucaccucucccuugg

SEQ ID NO: 1515176 - RNA, 17 nt, Human
cucaccucucccuugga

SEQ ID NO: 1515177 - RNA, 17 nt, Human
cucaaaacugcacuguc

SEQ ID NO: 1515178 - RNA, 13 nt, Human
cucaaaacugcac

SEQ ID NO: 1515179 - RNA, 18 nt, Human
cucaaaaaaagaaaaaga

SEQ ID NO: 1515180 - RNA, 16 nt, Human
cuauguugcccaggca

SEQ ID NO: 1515181 - RNA, 17 nt, Human
cuauguugcccaggcag

SEQ ID NO: 1515182 - RNA, 22 nt, Human
cuauguguagggcgggaggaug

SEQ ID NO: 1515183 - RNA, 15 nt, Human
cuauguugcccaggc

SEQ ID NO: 1515184 - RNA, 23 nt, Human
cuaugucauuugcuggagcucug

SEQ ID NO: 1515185 - RNA, 19 nt, Human
cuauguaucaaugaguaac

SEQ ID NO: 1515186 - RNA, 20 nt, Human
cuaucucccccagccccauc

SEQ ID NO: 1515187 - RNA, 14 nt, Human
cucacaaaggaugc

SEQ ID NO: 1515188 - RNA, 12 nt, Human
cucaaauaacua

SEQ ID NO: 1515189 - RNA, 14 nt, Human
cucacacaugagca

SEQ ID NO: 1515190 - RNA, 21 nt, Human
cucacacaugagcaucaggcc

SEQ ID NO: 1515191 - RNA, 16 nt, Human
ccugccucagccuccc

SEQ ID NO: 1515192 - RNA, 15 nt, Human
ccugccucagccucc

SEQ ID NO: 1515193 - RNA, 21 nt, Human
ccugcccaggccccugccacc

SEQ ID NO: 1515194 - RNA, 22 nt, Human
ccugcccaggccccugccaccc

SEQ ID NO: 1515195 - RNA, 18 nt, Human
ccugcccaccuggccucu

SEQ ID NO: 1515196 - RNA, 19 nt, Human
ccugcccaccuggccucug

SEQ ID NO: 1515197 - RNA, 19 nt, Human
ccugcccaggccccugcca

SEQ ID NO: 1515198 - RNA, 15 nt, Human
ccugcccaccuggcc

SEQ ID NO: 1515199 - RNA, 17 nt, Human
ccugcccaccuggccuc

SEQ ID NO: 1515200 - RNA, 16 nt, Human
ccucuuugagugaagc

SEQ ID NO: 1515201 - RNA, 15 nt, Human
ccucuuugagugaag

SEQ ID NO: 1515202 - RNA, 19 nt, Human
ccucuuucccucccuuccu

SEQ ID NO: 1515203 - RNA, 11 nt, Human
ccugagauuuc

SEQ ID NO: 1515204 - RNA, 15 nt, Human
ccugagauuucaucu

SEQ ID NO: 1515205 - RNA, 16 nt, Human
ccugagauuucaucug

SEQ ID NO: 1515206 - RNA, 17 nt, Human
ccugagauuucaucugc

SEQ ID NO: 1515207 - RNA, 18 nt, Human
ccugagauuucaucugcu

SEQ ID NO: 1515208 - RNA, 22 nt, Human
ccugagauuucaucugcucucc

SEQ ID NO: 1515209 - RNA, 23 nt, Human
ccugagauuucaucugcucuccu

SEQ ID NO: 1515210 - RNA, 15 nt, Human
ccugcaggcagccag

SEQ ID NO: 1515211 - RNA, 14 nt, Human
ccugcaggcagcca

SEQ ID NO: 1515212 - RNA, 12 nt, Human
ccugcaggcagc

SEQ ID NO: 1515213 - RNA, 13 nt, Human
ccugcaggcagcc

SEQ ID NO: 1515214 - RNA, 13 nt, Human
ccugguucucauc

SEQ ID NO: 1515215 - RNA, 17 nt, Human
ccugucucuacuaaaaa

SEQ ID NO: 1515216 - RNA, 20 nt, Human
ccugguggcagugggagcug

SEQ ID NO: 1515217 - RNA, 18 nt, Human
ccugguggcagugggagc

SEQ ID NO: 1515218 - RNA, 19 nt, Human
ccugguggcagugggagcu

SEQ ID NO: 1515219 - RNA, 13 nt, Human
ccugguguggaag

SEQ ID NO: 1515220 - RNA, 15 nt, Human
ccuggggagaaagua

SEQ ID NO: 1515221 - RNA, 17 nt, Human
ccuggauggggcugcac

SEQ ID NO: 1515222 - RNA, 18 nt, Human
ccuggauggggcugcacc

SEQ ID NO: 1515223 - RNA, 15 nt, Human
ccuggauggggcugc

SEQ ID NO: 1515224 - RNA, 14 nt, Human
ccuggaugcccagg

SEQ ID NO: 1515225 - RNA, 20 nt, Human
ccuggccccucagggucccu

SEQ ID NO: 1515226 - RNA, 21 nt, Human
ccuggccccucagggucccug

SEQ ID NO: 1515227 - RNA, 18 nt, Human
ccuggccccucagggucc

SEQ ID NO: 1515228 - RNA, 16 nt, Human
ccucaacaccucugca

SEQ ID NO: 1515229 - RNA, 15 nt, Human
ccucaaccuccuggg

SEQ ID NO: 1515230 - RNA, 21 nt, Human
ccucaacucuccuccagaguc

SEQ ID NO: 1515231 - RNA, 23 nt, Human
ccucaacucuccuccagagucag

SEQ ID NO: 1515232 - RNA, 23 nt, Human
ccucaagugauucuccugccuca

SEQ ID NO: 1515233 - RNA, 16 nt, Human
ccucaaccuccugggc

SEQ ID NO: 1515234 - RNA, 20 nt, Human
ccucaagugauucuccugcc

SEQ ID NO: 1515235 - RNA, 10 nt, Human
ccucaggccu

SEQ ID NO: 1515236 - RNA, 12 nt, Human
ccucaggcaggu

SEQ ID NO: 1515237 - RNA, 18 nt, Human
ccucaggcaggugggaug

SEQ ID NO: 1515238 - RNA, 17 nt, Human
ccucccaucacccgcua

SEQ ID NO: 1515239 - RNA, 20 nt, Human
ccuccaagaccuucuccuuc

SEQ ID NO: 1515240 - RNA, 12 nt, Human
ccucccaucacc

SEQ ID NO: 1515241 - RNA, 16 nt, Human
ccuccaagaccuucuc

SEQ ID NO: 1515242 - RNA, 17 nt, Human
ccuccaagaccuucucc

SEQ ID NO: 1515243 - RNA, 19 nt, Human
ccuccaagaccuucuccuu

SEQ ID NO: 1515244 - RNA, 12 nt, Human
ccucggagaaga

SEQ ID NO: 1515245 - RNA, 14 nt, Human
ccucggagaagagc

SEQ ID NO: 1515246 - RNA, 23 nt, Human
ccuccuuugugaggaagccgcug

SEQ ID NO: 1515247 - RNA, 18 nt, Human
ccuccuuuucacaguucu

SEQ ID NO: 1515248 - RNA, 16 nt, Human
ccucccuucucuucac

SEQ ID NO: 1515249 - RNA, 14 nt, Human
ccuccgccucuugg

SEQ ID NO: 1515250 - RNA, 12 nt, Human
ccucccuuucuc

SEQ ID NO: 1515251 - RNA, 13 nt, Human
ccucccuuucucc

SEQ ID NO: 1515252 - RNA, 14 nt, Human
ccucccuuucuccc

SEQ ID NO: 1515253 - RNA, 15 nt, Human
ccucccuuucucccc

SEQ ID NO: 1515254 - RNA, 22 nt, Human
ccuagccuuagaagucacacag

SEQ ID NO: 1515255 - RNA, 23 nt, Human
ccuagccugugccucugggacug

SEQ ID NO: 1515256 - RNA, 19 nt, Human
ccuagccuuagaagucaca

SEQ ID NO: 1515257 - RNA, 17 nt, Human
ccggccaccugcggugc

SEQ ID NO: 1515258 - RNA, 18 nt, Human
ccggcaggguccuagaaa

SEQ ID NO: 1515259 - RNA, 18 nt, Human
ccggccaccugcggugcu

SEQ ID NO: 1515260 - RNA, 15 nt, Human
cccugugggccccca

SEQ ID NO: 1515261 - RNA, 14 nt, Human
cccuccuuucacca

SEQ ID NO: 1515262 - RNA, 21 nt, Human
cccugugaguacuacaguccu

SEQ ID NO: 1515263 - RNA, 23 nt, Human
cccugugaguacuacaguccucc

SEQ ID NO: 1515264 - RNA, 15 nt, Human
cccugugauggggcc

SEQ ID NO: 1515265 - RNA, 14 nt, Human
cccuucucuccagc

SEQ ID NO: 1515266 - RNA, 19 nt, Human
cccuucucuccagccccug

SEQ ID NO: 1515267 - RNA, 21 nt, Human
cccuuuuuuggcugcugaagg

SEQ ID NO: 1515268 - RNA, 22 nt, Human
cccuuuuuuggcugcugaaggc

SEQ ID NO: 1515269 - RNA, 23 nt, Human
cccuuuuuuggcugcugaaggcu

SEQ ID NO: 1515270 - RNA, 15 nt, Human
cccuucucucaucuc

SEQ ID NO: 1515271 - RNA, 15 nt, Human
ccgaagcccaggggc

SEQ ID NO: 1515272 - RNA, 16 nt, Human
ccgaagcccaggggcc

SEQ ID NO: 1515273 - RNA, 17 nt, Human
ccgaagcccaggggccg

SEQ ID NO: 1515274 - RNA, 15 nt, Human
ccgcagagcuggccg

SEQ ID NO: 1515275 - RNA, 13 nt, Human
ccgcagagcuggc

SEQ ID NO: 1515276 - RNA, 14 nt, Human
ccgcagcccugcag

SEQ ID NO: 1515277 - RNA, 18 nt, Human
ccgcagcccugcagaggg

SEQ ID NO: 1515278 - RNA, 23 nt, Human
ccgcagcccugcagagggcacag

SEQ ID NO: 1515279 - RNA, 13 nt, Human
cccaacuccagaa

SEQ ID NO: 1515280 - RNA, 17 nt, Human
cccaacucaccccagcc

SEQ ID NO: 1515281 - RNA, 20 nt, Human
cccaacucaccccagcccca

SEQ ID NO: 1515282 - RNA, 13 nt, Human
cccaagcucugcu

SEQ ID NO: 1515283 - RNA, 14 nt, Human
cccaagcucugcuc

SEQ ID NO: 1515284 - RNA, 15 nt, Human
cccaagcucugcucc

SEQ ID NO: 1515285 - RNA, 12 nt, Human
cccacccccacc

SEQ ID NO: 1515286 - RNA, 13 nt, Human
cccacucccugca

SEQ ID NO: 1515287 - RNA, 23 nt, Human
cccacugcuuuuggucuguguga

SEQ ID NO: 1515288 - RNA, 15 nt, Human
cccaacucaccccag

SEQ ID NO: 1515289 - RNA, 16 nt, Human
cccaacucaccccagc

SEQ ID NO: 1515290 - RNA, 18 nt, Human
ccaguuggucccccuucc

SEQ ID NO: 1515291 - RNA, 20 nt, Human
ccaguuggucccccuuccau

SEQ ID NO: 1515292 - RNA, 19 nt, Human
ccauccagguucagcuugu

SEQ ID NO: 1515293 - RNA, 20 nt, Human
ccaucccaaacccuucagug

SEQ ID NO: 1515294 - RNA, 19 nt, Human
ccaucccauaugccugggc

SEQ ID NO: 1515295 - RNA, 20 nt, Human
ccaucccauaugccugggca

SEQ ID NO: 1515296 - RNA, 21 nt, Human
ccaucccauaugccugggcag

SEQ ID NO: 1515297 - RNA, 13 nt, Human
ccaguuggucccc

SEQ ID NO: 1515298 - RNA, 13 nt, Human
ccaugaguccccu

SEQ ID NO: 1515299 - RNA, 18 nt, Human
ccaugaguccccuguuug

SEQ ID NO: 1515300 - RNA, 20 nt, Human
ccaugaggaacaaggcaagg

SEQ ID NO: 1515301 - RNA, 23 nt, Human
ccaugaggaacaaggcaaggcug

SEQ ID NO: 1515302 - RNA, 23 nt, Human
ccaggcaggucuugaacuccugg

SEQ ID NO: 1515303 - RNA, 12 nt, Human
ccaggcaggucu

SEQ ID NO: 1515304 - RNA, 14 nt, Human
ccaggcaggucuug

SEQ ID NO: 1515305 - RNA, 12 nt, Human
ccaggcuggcgu

SEQ ID NO: 1515306 - RNA, 16 nt, Human
ccaggcuggcgugcag

SEQ ID NO: 1515307 - RNA, 23 nt, Human
ccagccccuucugacccaugcug

SEQ ID NO: 1515308 - RNA, 24 nt, Human
ccagccccuucugacccaugcugc

SEQ ID NO: 1515309 - RNA, 12 nt, Human
ccagcagaaaug

SEQ ID NO: 1515310 - RNA, 18 nt, Human
ccagccccauccucugua

SEQ ID NO: 1515311 - RNA, 15 nt, Human
ccagccccauccucu

SEQ ID NO: 1515312 - RNA, 17 nt, Human
ccagccccauccucugu

SEQ ID NO: 1515313 - RNA, 12 nt, Human
ccagcagagcac

SEQ ID NO: 1515314 - RNA, 13 nt, Human
ccagcagagcacc

SEQ ID NO: 1515315 - RNA, 14 nt, Human
ccagcagagcaccu

SEQ ID NO: 1515316 - RNA, 17 nt, Human
ccagccccagugcccac

SEQ ID NO: 1515317 - RNA, 17 nt, Human
ccccugaauuuaaauag

SEQ ID NO: 1515318 - RNA, 16 nt, Human
ccccugacagggccag

SEQ ID NO: 1515319 - RNA, 13 nt, Human
ccccugcacucca

SEQ ID NO: 1515320 - RNA, 13 nt, Human
ccccugaauuuaa

SEQ ID NO: 1515321 - RNA, 15 nt, Human
ccccugacaacacuc

SEQ ID NO: 1515322 - RNA, 14 nt, Human
ccccugccacccug

SEQ ID NO: 1515323 - RNA, 16 nt, Human
ccccugccacccuggg

SEQ ID NO: 1515324 - RNA, 16 nt, Human
ccccugcccccaggac

SEQ ID NO: 1515325 - RNA, 17 nt, Human
ccccugcccccaggacu

SEQ ID NO: 1515326 - RNA, 23 nt, Human
ccccugcccccaggacugggcca

SEQ ID NO: 1515327 - RNA, 18 nt, Human
ccccugcccccaggacug

SEQ ID NO: 1515328 - RNA, 19 nt, Human
ccccugcccccaggacugg

SEQ ID NO: 1515329 - RNA, 16 nt, Human
cccucaacucuccucc

SEQ ID NO: 1515330 - RNA, 20 nt, Human
cccucaacucuccuccagag

SEQ ID NO: 1515331 - RNA, 22 nt, Human
cccgggaagggggcugggacau

SEQ ID NO: 1515332 - RNA, 16 nt, Human
cccucaacaccucugc

SEQ ID NO: 1515333 - RNA, 18 nt, Human
cccgggaagggggcuggg

SEQ ID NO: 1515334 - RNA, 21 nt, Human
cccgggaagggggcugggaca

SEQ ID NO: 1515335 - RNA, 13 nt, Human
ccccuucugaccc

SEQ ID NO: 1515336 - RNA, 14 nt, Human
ccccuucugaccca

SEQ ID NO: 1515337 - RNA, 16 nt, Human
ccccuucugacccaug

SEQ ID NO: 1515338 - RNA, 17 nt, Human
cccgaauagcugggacu

SEQ ID NO: 1515339 - RNA, 18 nt, Human
cccgaauagcugggacua

SEQ ID NO: 1515340 - RNA, 22 nt, Human
cccgaauagcugggacuacagg

SEQ ID NO: 1515341 - RNA, 11 nt, Human
cccggcuccag

SEQ ID NO: 1515342 - RNA, 15 nt, Human
cccgggaagggggcu

SEQ ID NO: 1515343 - RNA, 15 nt, Human
cccggccccugcugg

SEQ ID NO: 1515344 - RNA, 16 nt, Human
cccggccccugcuggu

SEQ ID NO: 1515345 - RNA, 12 nt, Human
cccuccuccacu

SEQ ID NO: 1515346 - RNA, 13 nt, Human
cccuccuccacuc

SEQ ID NO: 1515347 - RNA, 14 nt, Human
cccuccuccacucu

SEQ ID NO: 1515348 - RNA, 16 nt, Human
cccaggaaaggcucca

SEQ ID NO: 1515349 - RNA, 13 nt, Human
cccagcacugagg

SEQ ID NO: 1515350 - RNA, 14 nt, Human
cccagcacugagga

SEQ ID NO: 1515351 - RNA, 15 nt, Human
cccagggaaguuuug

SEQ ID NO: 1515352 - RNA, 22 nt, Human
cccaggcuuagucacugagaca

SEQ ID NO: 1515353 - RNA, 17 nt, Human
cccaggaaaggcuccag

SEQ ID NO: 1515354 - RNA, 18 nt, Human
cccaggaaaggcuccagg

SEQ ID NO: 1515355 - RNA, 21 nt, Human
cccauccucuguacagagccc

SEQ ID NO: 1515356 - RNA, 22 nt, Human
cccauccucuguacagagccca

SEQ ID NO: 1515357 - RNA, 15 nt, Human
ccccagauugcaaca

SEQ ID NO: 1515358 - RNA, 20 nt, Human
ccccagauugcaacaggcug

SEQ ID NO: 1515359 - RNA, 21 nt, Human
ccccagauugcaacaggcugg

SEQ ID NO: 1515360 - RNA, 10 nt, Human
ccccagcccc

SEQ ID NO: 1515361 - RNA, 15 nt, Human
cccauuugcuccuuu

SEQ ID NO: 1515362 - RNA, 20 nt, Human
cccauucugccugcccaggc

SEQ ID NO: 1515363 - RNA, 19 nt, Human
cccauucugccugcccagg

SEQ ID NO: 1515364 - RNA, 14 nt, Human
cccauucugccugc

SEQ ID NO: 1515365 - RNA, 15 nt, Human
cccauucugccugcc

SEQ ID NO: 1515366 - RNA, 19 nt, Human
ccccgagggcugagccugg

SEQ ID NO: 1515367 - RNA, 21 nt, Human
ccccgagggcugagccugguc

SEQ ID NO: 1515368 - RNA, 14 nt, Human
ccccgcacugggcu

SEQ ID NO: 1515369 - RNA, 14 nt, Human
ccccgagggcugag

SEQ ID NO: 1515370 - RNA, 23 nt, Human
ccccgacccuugccgucuaccug

SEQ ID NO: 1515371 - RNA, 23 nt, Human
cacuccagccugagcgacaguga

SEQ ID NO: 1515372 - RNA, 13 nt, Human
cacuccagccugg

SEQ ID NO: 1515373 - RNA, 14 nt, Human
cacuccagccuggg

SEQ ID NO: 1515374 - RNA, 17 nt, Human
cacuacauucuguuaau

SEQ ID NO: 1515375 - RNA, 16 nt, Human
cacuacauucuguuaa

SEQ ID NO: 1515376 - RNA, 21 nt, Human
cacuacauuauaaaugucucu

SEQ ID NO: 1515377 - RNA, 21 nt, Human
cacuacauucuguuaaucauu

SEQ ID NO: 1515378 - RNA, 13 nt, Human
cacuccagccuga

SEQ ID NO: 1515379 - RNA, 12 nt, Human
cacuccagccug

SEQ ID NO: 1515380 - RNA, 15 nt, Human
cacggcucacugcag

SEQ ID NO: 1515381 - RNA, 14 nt, Human
cacggcucacugca

SEQ ID NO: 1515382 - RNA, 12 nt, Human
cacggccaggcc

SEQ ID NO: 1515383 - RNA, 13 nt, Human
cacggccaggcca

SEQ ID NO: 1515384 - RNA, 20 nt, Human
cacucuuauugcccacgcug

SEQ ID NO: 1515385 - RNA, 21 nt, Human
cacucuuauugcccacgcugg

SEQ ID NO: 1515386 - RNA, 22 nt, Human
cacucuuauugcccacgcugga

SEQ ID NO: 1515387 - RNA, 12 nt, Human
caccucagccuc

SEQ ID NO: 1515388 - RNA, 14 nt, Human
caccuuugaagaag

SEQ ID NO: 1515389 - RNA, 14 nt, Human
caccuuucccaucu

SEQ ID NO: 1515390 - RNA, 18 nt, Human
caccuuggcugcagggag

SEQ ID NO: 1515391 - RNA, 15 nt, Human
caccuuggcugcagg

SEQ ID NO: 1515392 - RNA, 16 nt, Human
caccuuggcugcaggg

SEQ ID NO: 1515393 - RNA, 13 nt, Human
cacuuucuagcca

SEQ ID NO: 1515394 - RNA, 18 nt, Human
cacuuucuagccagagga

SEQ ID NO: 1515395 - RNA, 16 nt, Human
cacuuucuagccagag

SEQ ID NO: 1515396 - RNA, 17 nt, Human
cacuuucuagccagagg

SEQ ID NO: 1515397 - RNA, 17 nt, Human
cacuuguguuuugcaag

SEQ ID NO: 1515398 - RNA, 18 nt, Human
cacuuguguuaugaagca

SEQ ID NO: 1515399 - RNA, 20 nt, Human
cacugggcuuggggaccaga

SEQ ID NO: 1515400 - RNA, 15 nt, Human
cacuuaaaaaugguu

SEQ ID NO: 1515401 - RNA, 22 nt, Human
cacuguuuugaaucucauaauu

SEQ ID NO: 1515402 - RNA, 18 nt, Human
cacuguugcccaggcugg

SEQ ID NO: 1515403 - RNA, 19 nt, Human
cacuguugcccaggcuggc

SEQ ID NO: 1515404 - RNA, 23 nt, Human
cacuguugcccaggcuggcgugc

SEQ ID NO: 1515405 - RNA, 17 nt, Human
cacugccaugccagcuu

SEQ ID NO: 1515406 - RNA, 20 nt, Human
cacugcagccucaaccuccu

SEQ ID NO: 1515407 - RNA, 21 nt, Human
cacugcagccucaaccuccug

SEQ ID NO: 1515408 - RNA, 22 nt, Human
cacugcagccucaaccuccugg

SEQ ID NO: 1515409 - RNA, 23 nt, Human
cacugcagccucaaccuccuggg

SEQ ID NO: 1515410 - RNA, 19 nt, Human
cacugcagccucaaccucc

SEQ ID NO: 1515411 - RNA, 14 nt, Human
cacugcagccucaa

SEQ ID NO: 1515412 - RNA, 11 nt, Human
cagaaaguuau

SEQ ID NO: 1515413 - RNA, 16 nt, Human
cagaaaguuauugaua

SEQ ID NO: 1515414 - RNA, 17 nt, Human
cagaaauguguuaucac

SEQ ID NO: 1515415 - RNA, 16 nt, Human
cagaaauguacagcaa

SEQ ID NO: 1515416 - RNA, 11 nt, Human
cagaacaguga

SEQ ID NO: 1515417 - RNA, 12 nt, Human
cagaacagugau

SEQ ID NO: 1515418 - RNA, 17 nt, Human
cagaacagugauuacca

SEQ ID NO: 1515419 - RNA, 18 nt, Human
cagaacagugauuaccag

SEQ ID NO: 1515420 - RNA, 14 nt, Human
cagaaguuucugcc

SEQ ID NO: 1515421 - RNA, 16 nt, Human
cagaaguuucugccgc

SEQ ID NO: 1515422 - RNA, 20 nt, Human
caauaaaauccauacauuug

SEQ ID NO: 1515423 - RNA, 23 nt, Human
caauaaaauccauacauuugugu

SEQ ID NO: 1515424 - RNA, 21 nt, Human
caagucagucauucagauaug

SEQ ID NO: 1515425 - RNA, 17 nt, Human
caaggcaaggcugucaa

SEQ ID NO: 1515426 - RNA, 18 nt, Human
caaggcaaggcugucaau

SEQ ID NO: 1515427 - RNA, 21 nt, Human
caaggccaaaggaagcacaug

SEQ ID NO: 1515428 - RNA, 19 nt, Human
caaggccaaaggaagcaca

SEQ ID NO: 1515429 - RNA, 20 nt, Human
caaggccaaaggaagcacau

SEQ ID NO: 1515430 - RNA, 18 nt, Human
caauggcuuacuccagga

SEQ ID NO: 1515431 - RNA, 15 nt, Human
caaugggagcucaug

SEQ ID NO: 1515432 - RNA, 18 nt, Human
cacaagagcccaggccuc

SEQ ID NO: 1515433 - RNA, 19 nt, Human
cacaagagcccaggccucc

SEQ ID NO: 1515434 - RNA, 20 nt, Human
cacaagagcccaggccuccu

SEQ ID NO: 1515435 - RNA, 18 nt, Human
cacaagcuccaagcuccc

SEQ ID NO: 1515436 - RNA, 19 nt, Human
cacaagcuccaagcuccca

SEQ ID NO: 1515437 - RNA, 13 nt, Human
caaugcuggcugu

SEQ ID NO: 1515438 - RNA, 20 nt, Human
caaugcuggcuguuggcugg

SEQ ID NO: 1515439 - RNA, 21 nt, Human
caaugcuggcuguuggcuggg

SEQ ID NO: 1515440 - RNA, 20 nt, Human
cacaagcuccaagcucccag

SEQ ID NO: 1515441 - RNA, 21 nt, Human
cacaagcuccaagcucccagg

SEQ ID NO: 1515442 - RNA, 11 nt, Human
cacacauuuuu

SEQ ID NO: 1515443 - RNA, 10 nt, Human
cacacauuuu

SEQ ID NO: 1515444 - RNA, 20 nt, Human
cacacauuuuuuaaaugcac

SEQ ID NO: 1515445 - RNA, 19 nt, Human
cacacauuuuuuaaaugca

SEQ ID NO: 1515446 - RNA, 16 nt, Human
cacacauuuuuuaaau

SEQ ID NO: 1515447 - RNA, 12 nt, Human
cacacauuuuuu

SEQ ID NO: 1515448 - RNA, 18 nt, Human
cacagcucuucuccaggc

SEQ ID NO: 1515449 - RNA, 17 nt, Human
cacagcucuucuccagg

SEQ ID NO: 1515450 - RNA, 14 nt, Human
cacagcucuucucc

SEQ ID NO: 1515451 - RNA, 15 nt, Human
cacagcucuucucca

SEQ ID NO: 1515452 - RNA, 15 nt, Human
cacagcucuguccug

SEQ ID NO: 1515453 - RNA, 16 nt, Human
cacagcucuguccugg

SEQ ID NO: 1515454 - RNA, 18 nt, Human
cacagcucuguccuggga

SEQ ID NO: 1515455 - RNA, 19 nt, Human
cacagcucuguccugggag

SEQ ID NO: 1515456 - RNA, 18 nt, Human
cacagacccugcccugug

SEQ ID NO: 1515457 - RNA, 11 nt, Human
cacagcucugu

SEQ ID NO: 1515458 - RNA, 14 nt, Human
cacagcucuguccu

SEQ ID NO: 1515459 - RNA, 14 nt, Human
cacagacccugccc

SEQ ID NO: 1515460 - RNA, 16 nt, Human
cacagacccugcccug

SEQ ID NO: 1515461 - RNA, 17 nt, Human
cacagacccugcccugu

SEQ ID NO: 1515462 - RNA, 19 nt, Human
cacaggcuuagggacagga

SEQ ID NO: 1515463 - RNA, 22 nt, Human
cacaggcuuagggacaggaccc

SEQ ID NO: 1515464 - RNA, 18 nt, Human
cacaggcuuagggacagg

SEQ ID NO: 1515465 - RNA, 21 nt, Human
cacauuuuauuuuauuaugca

SEQ ID NO: 1515466 - RNA, 20 nt, Human
cacauuuuauuuuauuaugc

SEQ ID NO: 1515467 - RNA, 19 nt, Human
cacauuuuauuuuauuaug

SEQ ID NO: 1515468 - RNA, 17 nt, Human
cacauuuuauuuuauua

SEQ ID NO: 1515469 - RNA, 17 nt, Human
caccaacauacucccau

SEQ ID NO: 1515470 - RNA, 16 nt, Human
caccaacgucugugcc

SEQ ID NO: 1515471 - RNA, 14 nt, Human
caccaacgucugug

SEQ ID NO: 1515472 - RNA, 17 nt, Human
cacccaccucagccucc

SEQ ID NO: 1515473 - RNA, 13 nt, Human
caccagccccagu

SEQ ID NO: 1515474 - RNA, 16 nt, Human
caccagccccagugcc

SEQ ID NO: 1515475 - RNA, 18 nt, Human
cacccaccucagccuccc

SEQ ID NO: 1515476 - RNA, 16 nt, Human
cacccaggagccccga

SEQ ID NO: 1515477 - RNA, 16 nt, Human
auucaaaugucuauaa

SEQ ID NO: 1515478 - RNA, 18 nt, Human
auucaacagguuuuccug

SEQ ID NO: 1515479 - RNA, 19 nt, Human
auuaugaauuacauuugua

SEQ ID NO: 1515480 - RNA, 20 nt, Human
auuaugaauuacauuuguau

SEQ ID NO: 1515481 - RNA, 22 nt, Human
auuaugaauuacauuuguauaa

SEQ ID NO: 1515482 - RNA, 11 nt, Human
auuaaauuaug

SEQ ID NO: 1515483 - RNA, 17 nt, Human
auuaaaugcccagcccc

SEQ ID NO: 1515484 - RNA, 19 nt, Human
auuaaaugcccagccccuu

SEQ ID NO: 1515485 - RNA, 18 nt, Human
auucucuaguuugauuaa

SEQ ID NO: 1515486 - RNA, 17 nt, Human
auucucuaguuugauua

SEQ ID NO: 1515487 - RNA, 22 nt, Human
auucuccuuguguuacuaaguu

SEQ ID NO: 1515488 - RNA, 21 nt, Human
auucuccuuguguuacuaagu

SEQ ID NO: 1515489 - RNA, 19 nt, Human
auucuccuuguguuacuaa

SEQ ID NO: 1515490 - RNA, 18 nt, Human
auucuccuuguguuacua

SEQ ID NO: 1515491 - RNA, 19 nt, Human
auucucuaguuugauuaaa

SEQ ID NO: 1515492 - RNA, 19 nt, Human
auucuucugcuucagccuc

SEQ ID NO: 1515493 - RNA, 20 nt, Human
auucuucugcuucagccucc

SEQ ID NO: 1515494 - RNA, 22 nt, Human
auucuucuguacgucugacagg

SEQ ID NO: 1515495 - RNA, 14 nt, Human
auucuugcaaagua

SEQ ID NO: 1515496 - RNA, 16 nt, Human
auucuugcaaaguauc

SEQ ID NO: 1515497 - RNA, 15 nt, Human
auucuugcaaaguau

SEQ ID NO: 1515498 - RNA, 14 nt, Human
auuguguugugaau

SEQ ID NO: 1515499 - RNA, 16 nt, Human
auuguugucugcaacu

SEQ ID NO: 1515500 - RNA, 17 nt, Human
auuguguugugaauguu

SEQ ID NO: 1515501 - RNA, 15 nt, Human
auuguuuaaaaucau

SEQ ID NO: 1515502 - RNA, 14 nt, Human
auuucuaugaaaua

SEQ ID NO: 1515503 - RNA, 16 nt, Human
auuucauaugcuguau

SEQ ID NO: 1515504 - RNA, 20 nt, Human
auuucauaccuaucaucuua

SEQ ID NO: 1515505 - RNA, 16 nt, Human
auuuaauaaaugugcc

SEQ ID NO: 1515506 - RNA, 16 nt, Human
auuuaaugaaagacug

SEQ ID NO: 1515507 - RNA, 20 nt, Human
auuuaaugaaagacuguaca

SEQ ID NO: 1515508 - RNA, 21 nt, Human
auuuaaugaaagacuguacaa

SEQ ID NO: 1515509 - RNA, 17 nt, Human
caacucauauuuucaug

SEQ ID NO: 1515510 - RNA, 18 nt, Human
caacucaccccagcccca

SEQ ID NO: 1515511 - RNA, 19 nt, Human
caaccccccagcacugagg

SEQ ID NO: 1515512 - RNA, 20 nt, Human
caaccccccagcacugagga

SEQ ID NO: 1515513 - RNA, 14 nt, Human
caaccccccagcac

SEQ ID NO: 1515514 - RNA, 15 nt, Human
caaccccccagcacu

SEQ ID NO: 1515515 - RNA, 16 nt, Human
caaccccccagcacug

SEQ ID NO: 1515516 - RNA, 18 nt, Human
caaccccccagcacugag

SEQ ID NO: 1515517 - RNA, 13 nt, Human
caagaugguucua

SEQ ID NO: 1515518 - RNA, 16 nt, Human
caagaugguucuagca

SEQ ID NO: 1515519 - RNA, 20 nt, Human
caagaauuucuaggacugaa

SEQ ID NO: 1515520 - RNA, 19 nt, Human
caagacccaaaaggcagaa

SEQ ID NO: 1515521 - RNA, 18 nt, Human
caagaccacguuucuaaa

SEQ ID NO: 1515522 - RNA, 17 nt, Human
caagaccacguuucuaa

SEQ ID NO: 1515523 - RNA, 22 nt, Human
caagaauugaagcaggacuaaa

SEQ ID NO: 1515524 - RNA, 14 nt, Human
caacucuccuccag

SEQ ID NO: 1515525 - RNA, 21 nt, Human
caacaacauguauaauauuuu

SEQ ID NO: 1515526 - RNA, 22 nt, Human
caacaacauguauaauauuuuu

SEQ ID NO: 1515527 - RNA, 22 nt, Human
caaaguagaagucuuagaugua

SEQ ID NO: 1515528 - RNA, 21 nt, Human
caaaguaucccuacuguaauu

SEQ ID NO: 1515529 - RNA, 19 nt, Human
caaaguaucccuacuguaa

SEQ ID NO: 1515530 - RNA, 18 nt, Human
caaagggugaaaauuauu

SEQ ID NO: 1515531 - RNA, 18 nt, Human
caaagauauuuugcuuug

SEQ ID NO: 1515532 - RNA, 22 nt, Human
caaagcagugcaugcugucccu

SEQ ID NO: 1515533 - RNA, 16 nt, Human
caaagauauuuugcuu

SEQ ID NO: 1515534 - RNA, 14 nt, Human
caaagauauuuugc

SEQ ID NO: 1515535 - RNA, 18 nt, Human
caaagcagugcaugcugu

SEQ ID NO: 1515536 - RNA, 21 nt, Human
caaagcagugcaugcuguccc

SEQ ID NO: 1515537 - RNA, 21 nt, Human
caaaucuuaacuugaaggagu

SEQ ID NO: 1515538 - RNA, 23 nt, Human
caaaugcuguaacuuucugaaau

SEQ ID NO: 1515539 - RNA, 14 nt, Human
auuuuauaucuugu

SEQ ID NO: 1515540 - RNA, 16 nt, Human
auuuuauaucuuguag

SEQ ID NO: 1515541 - RNA, 19 nt, Human
auuuuagggguagcauuug

SEQ ID NO: 1515542 - RNA, 21 nt, Human
auuuuauaucaauuuaaaaaa

SEQ ID NO: 1515543 - RNA, 12 nt, Human
auuuuauaucuu

SEQ ID NO: 1515544 - RNA, 14 nt, Human
auuuuuagacagag

SEQ ID NO: 1515545 - RNA, 19 nt, Human
auuuuuaagugcugcauuu

SEQ ID NO: 1515546 - RNA, 18 nt, Human
auuuuuaagugcugcauu

SEQ ID NO: 1515547 - RNA, 16 nt, Human
auuuuuaagugcugca

SEQ ID NO: 1515548 - RNA, 15 nt, Human
auuuuuauauuugaa

SEQ ID NO: 1515549 - RNA, 16 nt, Human
auuuuuauauuugaaa

SEQ ID NO: 1515550 - RNA, 18 nt, Human
auuuuuuuuuccuucagu

SEQ ID NO: 1515551 - RNA, 16 nt, Human
auuuuuuugagacaga

SEQ ID NO: 1515552 - RNA, 23 nt, Human
auuuuuuuuuccuucagugccuu

SEQ ID NO: 1515553 - RNA, 20 nt, Human
auuuuuuuuuccuucagugc

SEQ ID NO: 1515554 - RNA, 22 nt, Human
auuuuuuuuuccuucagugccu

SEQ ID NO: 1515555 - RNA, 21 nt, Human
caaaaggauaaugaauacuuu

SEQ ID NO: 1515556 - RNA, 17 nt, Human
caaacauauauaacaau

SEQ ID NO: 1515557 - RNA, 16 nt, Human
caaacagucucaggaa

SEQ ID NO: 1515558 - RNA, 17 nt, Human
caaacagucucaggaaa

SEQ ID NO: 1515559 - RNA, 14 nt, Human
caaacccuucagug

SEQ ID NO: 1515560 - RNA, 14 nt, Human
caaaccaaauaaaa

SEQ ID NO: 1515561 - RNA, 15 nt, Human
caaaccaaauaaaaa

SEQ ID NO: 1515562 - RNA, 13 nt, Human
caucugcucuccu

SEQ ID NO: 1515563 - RNA, 14 nt, Human
caucugcucuccuu

SEQ ID NO: 1515564 - RNA, 15 nt, Human
caucugcucuccuuc

SEQ ID NO: 1515565 - RNA, 21 nt, Human
cauccccuguagagugggagc

SEQ ID NO: 1515566 - RNA, 14 nt, Human
cauccccuguagag

SEQ ID NO: 1515567 - RNA, 19 nt, Human
caucccauaugccugggca

SEQ ID NO: 1515568 - RNA, 20 nt, Human
caucaggccaggcccucugc

SEQ ID NO: 1515569 - RNA, 16 nt, Human
caucaggccaggcccu

SEQ ID NO: 1515570 - RNA, 19 nt, Human
caucaggccaggcccucug

SEQ ID NO: 1515571 - RNA, 15 nt, Human
caucaggccaggccc

SEQ ID NO: 1515572 - RNA, 19 nt, Human
cauagcagagaaugaaagg

SEQ ID NO: 1515573 - RNA, 22 nt, Human
cauagcagagaaugaaagggcc

SEQ ID NO: 1515574 - RNA, 23 nt, Human
cauagcagagaaugaaagggccc

SEQ ID NO: 1515575 - RNA, 13 nt, Human
cauaauuuauaca

SEQ ID NO: 1515576 - RNA, 20 nt, Human
cauaauuuauacaggucaua

SEQ ID NO: 1515577 - RNA, 15 nt, Human
cagugggagcugccu

SEQ ID NO: 1515578 - RNA, 22 nt, Human
cauaugccugggcagaaggaag

SEQ ID NO: 1515579 - RNA, 15 nt, Human
cauaugccugggcag

SEQ ID NO: 1515580 - RNA, 20 nt, Human
cauaugccugggcagaagga

SEQ ID NO: 1515581 - RNA, 22 nt, Human
cauauucaggaagcucagggcc

SEQ ID NO: 1515582 - RNA, 20 nt, Human
cauauucaggaagcucaggg

SEQ ID NO: 1515583 - RNA, 14 nt, Human
cauauucaggaagc

SEQ ID NO: 1515584 - RNA, 15 nt, Human
cauauucaggaagcu

SEQ ID NO: 1515585 - RNA, 24 nt, Human
caugauuaaccacuucagcugacu

SEQ ID NO: 1515586 - RNA, 22 nt, Human
caugauuaaccacuucagcuga

SEQ ID NO: 1515587 - RNA, 23 nt, Human
caugauuaaccacuucagcugac

SEQ ID NO: 1515588 - RNA, 14 nt, Human
caugcaccacgggc

SEQ ID NO: 1515589 - RNA, 16 nt, Human
caugcacgugugugca

SEQ ID NO: 1515590 - RNA, 13 nt, Human
caugcuccuggcc

SEQ ID NO: 1515591 - RNA, 12 nt, Human
caugcugcccug

SEQ ID NO: 1515592 - RNA, 13 nt, Human
caugcugcccugu

SEQ ID NO: 1515593 - RNA, 15 nt, Human
caugaagguuucuga

SEQ ID NO: 1515594 - RNA, 18 nt, Human
caugaagguuucugaaaa

SEQ ID NO: 1515595 - RNA, 21 nt, Human
caugacacgaauauugcugau

SEQ ID NO: 1515596 - RNA, 23 nt, Human
caugacacgaauauugcugaugg

SEQ ID NO: 1515597 - RNA, 23 nt, Human
caugaaguaauaugcacacauuu

SEQ ID NO: 1515598 - RNA, 22 nt, Human
caugaaguaauaugcacacauu

SEQ ID NO: 1515599 - RNA, 19 nt, Human
caugaaguaauaugcacac

SEQ ID NO: 1515600 - RNA, 15 nt, Human
caugaaguaauaugc

SEQ ID NO: 1515601 - RNA, 14 nt, Human
caugcugcccugug

SEQ ID NO: 1515602 - RNA, 15 nt, Human
caugcugcccuguga

SEQ ID NO: 1515603 - RNA, 19 nt, Human
caugucaagagucgcugug

SEQ ID NO: 1515604 - RNA, 21 nt, Human
caugucaagagucgcugugcc

SEQ ID NO: 1515605 - RNA, 15 nt, Human
cauguauaauauuuu

SEQ ID NO: 1515606 - RNA, 18 nt, Human
cauguauaauauuuuuaa

SEQ ID NO: 1515607 - RNA, 20 nt, Human
cauguauaauauuuuuaauu

SEQ ID NO: 1515608 - RNA, 22 nt, Human
cauuaggugugacugaauuucu

SEQ ID NO: 1515609 - RNA, 23 nt, Human
cauuaucuagauacuguaucaug

SEQ ID NO: 1515610 - RNA, 12 nt, Human
cauuaucucaaa

SEQ ID NO: 1515611 - RNA, 13 nt, Human
cauuaucucaaaa

SEQ ID NO: 1515612 - RNA, 18 nt, Human
cauguccaagaagcccag

SEQ ID NO: 1515613 - RNA, 19 nt, Human
cauguccaagaagcccagg

SEQ ID NO: 1515614 - RNA, 20 nt, Human
cauguccaagaagcccagga

SEQ ID NO: 1515615 - RNA, 12 nt, Human
cauguuggccag

SEQ ID NO: 1515616 - RNA, 13 nt, Human
cauguuggccagg

SEQ ID NO: 1515617 - RNA, 21 nt, Human
cauuaugaugugggucaagga

SEQ ID NO: 1515618 - RNA, 12 nt, Human
cauuccuguucc

SEQ ID NO: 1515619 - RNA, 14 nt, Human
cauuuauucugcuc

SEQ ID NO: 1515620 - RNA, 15 nt, Human
cauuuauucugcuca

SEQ ID NO: 1515621 - RNA, 15 nt, Human
cauuuggauuggaug

SEQ ID NO: 1515622 - RNA, 21 nt, Human
cauuuggagacacaacuauuu

SEQ ID NO: 1515623 - RNA, 17 nt, Human
cauuugucacacacuuu

SEQ ID NO: 1515624 - RNA, 21 nt, Human
cauuguaaaugugcuuuuaaa

SEQ ID NO: 1515625 - RNA, 19 nt, Human
cauuguaaauaguauuuga

SEQ ID NO: 1515626 - RNA, 16 nt, Human
cauuuuuuaaaugcac

SEQ ID NO: 1515627 - RNA, 15 nt, Human
cauuuuuuaaaugca

SEQ ID NO: 1515628 - RNA, 19 nt, Human
cauuuuuuaaaugcaccug

SEQ ID NO: 1515629 - RNA, 15 nt, Human
ccaaggccaaaggaa

SEQ ID NO: 1515630 - RNA, 20 nt, Human
ccaagcuggucccacucagu

SEQ ID NO: 1515631 - RNA, 15 nt, Human
ccaagaagcccagga

SEQ ID NO: 1515632 - RNA, 14 nt, Human
ccaagaagcccagg

SEQ ID NO: 1515633 - RNA, 12 nt, Human
ccaagcuggucc

SEQ ID NO: 1515634 - RNA, 19 nt, Human
ccaagcuggucccacucag

SEQ ID NO: 1515635 - RNA, 22 nt, Human
ccaaauggaaaugggcagagca

SEQ ID NO: 1515636 - RNA, 13 nt, Human
ccaacgucugugc

SEQ ID NO: 1515637 - RNA, 15 nt, Human
ccaacgucugugcca

SEQ ID NO: 1515638 - RNA, 24 nt, Human
ccaacggcaagggaacaaguacuu

SEQ ID NO: 1515639 - RNA, 16 nt, Human
ccaacgucugugccau

SEQ ID NO: 1515640 - RNA, 13 nt, Human
ccaagaagcccag

SEQ ID NO: 1515641 - RNA, 15 nt, Human
ccaaauaaugucucu

SEQ ID NO: 1515642 - RNA, 16 nt, Human
ccaaauaaugucucug

SEQ ID NO: 1515643 - RNA, 17 nt, Human
ccaaauaaugucucugu

SEQ ID NO: 1515644 - RNA, 16 nt, Human
ccaaggccaaaggaag

SEQ ID NO: 1515645 - RNA, 16 nt, Human
ccacagaagcuccagg

SEQ ID NO: 1515646 - RNA, 18 nt, Human
ccaccagucugacuguuu

SEQ ID NO: 1515647 - RNA, 18 nt, Human
ccacagaagcuccaggua

SEQ ID NO: 1515648 - RNA, 22 nt, Human
ccacagagaaaguacuucucca

SEQ ID NO: 1515649 - RNA, 13 nt, Human
ccacgcccccacu

SEQ ID NO: 1515650 - RNA, 16 nt, Human
ccacgagggugccgug

SEQ ID NO: 1515651 - RNA, 18 nt, Human
ccaccuuggcugcaggga

SEQ ID NO: 1515652 - RNA, 19 nt, Human
ccaccuuggcugcagggag

SEQ ID NO: 1515653 - RNA, 13 nt, Human
ccacgcuggagug

SEQ ID NO: 1515654 - RNA, 18 nt, Human
ccacgcuggaccuugaac

SEQ ID NO: 1515655 - RNA, 18 nt, Human
ccaccaucaugucuggcu

SEQ ID NO: 1515656 - RNA, 19 nt, Human
ccaccaucaugucuggcua

SEQ ID NO: 1515657 - RNA, 12 nt, Human
ccaccuuggcug

SEQ ID NO: 1515658 - RNA, 14 nt, Human
ccaccuuggcugca

SEQ ID NO: 1515659 - RNA, 15 nt, Human
ccaccuuggcugcag

SEQ ID NO: 1515660 - RNA, 16 nt, Human
ccaccuuggcugcagg

SEQ ID NO: 1515661 - RNA, 22 nt, Human
cagugcacuaauguguaagaca

SEQ ID NO: 1515662 - RNA, 19 nt, Human
cagucugauucccaagcuc

SEQ ID NO: 1515663 - RNA, 20 nt, Human
cagucugauucccaagcucu

SEQ ID NO: 1515664 - RNA, 19 nt, Human
cagugcaugcugucccuua

SEQ ID NO: 1515665 - RNA, 22 nt, Human
cagugcaugcugucccuuacgu

SEQ ID NO: 1515666 - RNA, 23 nt, Human
cagugcaugcugucccuuacgug

SEQ ID NO: 1515667 - RNA, 11 nt, Human
cagugggagcu

SEQ ID NO: 1515668 - RNA, 12 nt, Human
cagugcccacag

SEQ ID NO: 1515669 - RNA, 22 nt, Human
cagugcaguuugguguguccuc

SEQ ID NO: 1515670 - RNA, 15 nt, Human
cagugccaaaaacaa

SEQ ID NO: 1515671 - RNA, 15 nt, Human
cagucucaggaaauc

SEQ ID NO: 1515672 - RNA, 15 nt, Human
cagucaccucaugga

SEQ ID NO: 1515673 - RNA, 22 nt, Human
cagucaccccggccaccugcgg

SEQ ID NO: 1515674 - RNA, 20 nt, Human
cagucaccccggccaccugc

SEQ ID NO: 1515675 - RNA, 19 nt, Human
cagucaccccggccaccug

SEQ ID NO: 1515676 - RNA, 18 nt, Human
cagguuuaagcuguuacu

SEQ ID NO: 1515677 - RNA, 21 nt, Human
cagguuggugggggccucggu

SEQ ID NO: 1515678 - RNA, 16 nt, Human
cagguuuaagcuguua

SEQ ID NO: 1515679 - RNA, 14 nt, Human
caggugcgaaagga

SEQ ID NO: 1515680 - RNA, 18 nt, Human
caggugcuaggaacacuc

SEQ ID NO: 1515681 - RNA, 20 nt, Human
caggugcuaggaacacuccu

SEQ ID NO: 1515682 - RNA, 14 nt, Human
cagguugguggggg

SEQ ID NO: 1515683 - RNA, 20 nt, Human
caggugauccacccaccuca

SEQ ID NO: 1515684 - RNA, 14 nt, Human
caggguuggccccu

SEQ ID NO: 1515685 - RNA, 12 nt, Human
caggguuggccc

SEQ ID NO: 1515686 - RNA, 16 nt, Human
caggugauccacccac

SEQ ID NO: 1515687 - RNA, 17 nt, Human
caggugauccacccacc

SEQ ID NO: 1515688 - RNA, 22 nt, Human
cagggucucacucugucgccca

SEQ ID NO: 1515689 - RNA, 21 nt, Human
cagggucucacucugucgccc

SEQ ID NO: 1515690 - RNA, 18 nt, Human
cagggucucacucugucg

SEQ ID NO: 1515691 - RNA, 16 nt, Human
caggguguggggccau

SEQ ID NO: 1515692 - RNA, 17 nt, Human
caggguguggggccaug

SEQ ID NO: 1515693 - RNA, 22 nt, Human
caggguguggggccaugccucc

SEQ ID NO: 1515694 - RNA, 12 nt, Human
caggccuccuac

SEQ ID NO: 1515695 - RNA, 14 nt, Human
caggccugagauuu

SEQ ID NO: 1515696 - RNA, 16 nt, Human
caggccugagauuuca

SEQ ID NO: 1515697 - RNA, 18 nt, Human
caggccugagauuucauc

SEQ ID NO: 1515698 - RNA, 19 nt, Human
caggccugagauuucaucu

SEQ ID NO: 1515699 - RNA, 21 nt, Human
caggccugagauuucaucugc

SEQ ID NO: 1515700 - RNA, 23 nt, Human
caggccugagauuucaucugcuc

SEQ ID NO: 1515701 - RNA, 19 nt, Human
cagggaggacgcucucugg

SEQ ID NO: 1515702 - RNA, 17 nt, Human
cagggaggacgcucucu

SEQ ID NO: 1515703 - RNA, 18 nt, Human
cagggaggacgcucucug

SEQ ID NO: 1515704 - RNA, 17 nt, Human
caggcugggcuucagug

SEQ ID NO: 1515705 - RNA, 19 nt, Human
caggcugggcuucaguggc

SEQ ID NO: 1515706 - RNA, 15 nt, Human
caggcuggcgugcag

SEQ ID NO: 1515707 - RNA, 16 nt, Human
caggcugggcuucagu

SEQ ID NO: 1515708 - RNA, 22 nt, Human
cagggaguccgaaagggacuug

SEQ ID NO: 1515709 - RNA, 18 nt, Human
cagggaggugaccccagg

SEQ ID NO: 1515710 - RNA, 18 nt, Human
caggcacccaccaucaug

SEQ ID NO: 1515711 - RNA, 22 nt, Human
caggcacccaccaucaugucug

SEQ ID NO: 1515712 - RNA, 23 nt, Human
caggcacccaccaucaugucugg

SEQ ID NO: 1515713 - RNA, 18 nt, Human
caggaggccagccuugac

SEQ ID NO: 1515714 - RNA, 17 nt, Human
caggaggccagccuuga

SEQ ID NO: 1515715 - RNA, 15 nt, Human
caggagggaggcagg

SEQ ID NO: 1515716 - RNA, 21 nt, Human
caggagggaggcaggggaggg

SEQ ID NO: 1515717 - RNA, 15 nt, Human
caggaggccagccuu

SEQ ID NO: 1515718 - RNA, 16 nt, Human
caggaggccagccuug

SEQ ID NO: 1515719 - RNA, 18 nt, Human
caggaccccagcucugcg

SEQ ID NO: 1515720 - RNA, 16 nt, Human
caggaccccagcucug

SEQ ID NO: 1515721 - RNA, 17 nt, Human
caggaccccagcucugc

SEQ ID NO: 1515722 - RNA, 23 nt, Human
caggccagagggagugacagagg

SEQ ID NO: 1515723 - RNA, 19 nt, Human
caggccagagggagugaca

SEQ ID NO: 1515724 - RNA, 21 nt, Human
caggccagagggagugacaga

SEQ ID NO: 1515725 - RNA, 16 nt, Human
cagcuccaagaauuuc

SEQ ID NO: 1515726 - RNA, 19 nt, Human
cagcuccaagaauuucuag

SEQ ID NO: 1515727 - RNA, 13 nt, Human
cagcuccagcuca

SEQ ID NO: 1515728 - RNA, 14 nt, Human
cagcuccagcucac

SEQ ID NO: 1515729 - RNA, 15 nt, Human
cagcuccagcucacc

SEQ ID NO: 1515730 - RNA, 22 nt, Human
cagcuccagcucaccagcccca

SEQ ID NO: 1515731 - RNA, 16 nt, Human
cagcuccagcucacca

SEQ ID NO: 1515732 - RNA, 17 nt, Human
cagcuccagcucaccag

SEQ ID NO: 1515733 - RNA, 18 nt, Human
cagcuccagcucaccagc

SEQ ID NO: 1515734 - RNA, 20 nt, Human
cagcuccagcucaccagccc

SEQ ID NO: 1515735 - RNA, 16 nt, Human
cagcuccccucggaga

SEQ ID NO: 1515736 - RNA, 17 nt, Human
cagcuccccucggagaa

SEQ ID NO: 1515737 - RNA, 18 nt, Human
cagcuccccucggagaag

SEQ ID NO: 1515738 - RNA, 20 nt, Human
cagcuccccucggagaagag

SEQ ID NO: 1515739 - RNA, 14 nt, Human
caggaaaggcucca

SEQ ID NO: 1515740 - RNA, 15 nt, Human
caggaaaggcuccag

SEQ ID NO: 1515741 - RNA, 23 nt, Human
caggaaaucaaauaugcaaagca

SEQ ID NO: 1515742 - RNA, 19 nt, Human
cagcugugcucuggacagg

SEQ ID NO: 1515743 - RNA, 18 nt, Human
cagcugugcucuggacag

SEQ ID NO: 1515744 - RNA, 15 nt, Human
cagcuucauuuccug

SEQ ID NO: 1515745 - RNA, 18 nt, Human
cagcuucauuuccugugu

SEQ ID NO: 1515746 - RNA, 19 nt, Human
cagcuucauuuccuguguc

SEQ ID NO: 1515747 - RNA, 15 nt, Human
cagcccuucuuucca

SEQ ID NO: 1515748 - RNA, 19 nt, Human
cagcccuucuuuccacaga

SEQ ID NO: 1515749 - RNA, 20 nt, Human
cagcccuucuuuccacagaa

SEQ ID NO: 1515750 - RNA, 21 nt, Human
cagccgagauagccaaggcca

SEQ ID NO: 1515751 - RNA, 12 nt, Human
cagccccuggau

SEQ ID NO: 1515752 - RNA, 13 nt, Human
cagccccuggaug

SEQ ID NO: 1515753 - RNA, 14 nt, Human
cagccccuggaugc

SEQ ID NO: 1515754 - RNA, 22 nt, Human
cagccccuggaugcagccucac

SEQ ID NO: 1515755 - RNA, 16 nt, Human
cagcccuuagcaggga

SEQ ID NO: 1515756 - RNA, 21 nt, Human
cagcccuuagcagggaaacag

SEQ ID NO: 1515757 - RNA, 17 nt, Human
cagccccuggaugcagc

SEQ ID NO: 1515758 - RNA, 18 nt, Human
cagccccuggaugcagcc

SEQ ID NO: 1515759 - RNA, 19 nt, Human
cagccccuggaugcagccu

SEQ ID NO: 1515760 - RNA, 21 nt, Human
cagccccuggaugcagccuca

SEQ ID NO: 1515761 - RNA, 15 nt, Human
cagcggggacagcuc

SEQ ID NO: 1515762 - RNA, 16 nt, Human
cagcggggacagcucc

SEQ ID NO: 1515763 - RNA, 17 nt, Human
cagcggggacagcuccu

SEQ ID NO: 1515764 - RNA, 18 nt, Human
cagccugagcgacaguga

SEQ ID NO: 1515765 - RNA, 19 nt, Human
cagccugagcgacagugag

SEQ ID NO: 1515766 - RNA, 22 nt, Human
cagccugagcgacagugagacu

SEQ ID NO: 1515767 - RNA, 22 nt, Human
cagcacagccucuuagaugcag

SEQ ID NO: 1515768 - RNA, 22 nt, Human
cagccaggccacaagacccuug

SEQ ID NO: 1515769 - RNA, 12 nt, Human
cagccaggccac

SEQ ID NO: 1515770 - RNA, 13 nt, Human
cagccaggccaca

SEQ ID NO: 1515771 - RNA, 19 nt, Human
cagcauauucaggaagcuc

SEQ ID NO: 1515772 - RNA, 22 nt, Human
cagcauauucaggaagcucagg

SEQ ID NO: 1515773 - RNA, 23 nt, Human
cagcauauucaggaagcucaggg

SEQ ID NO: 1515774 - RNA, 22 nt, Human
cagcaguugaaaagacuccaaa

SEQ ID NO: 1515775 - RNA, 17 nt, Human
cagcaguugaaaagacu

SEQ ID NO: 1515776 - RNA, 20 nt, Human
cagcaguugaaaagacucca

SEQ ID NO: 1515777 - RNA, 21 nt, Human
cagcaguugaaaagacuccaa

SEQ ID NO: 1515778 - RNA, 15 nt, Human
cagauaugauucaaa

SEQ ID NO: 1515779 - RNA, 16 nt, Human
cagauaugauucaaau

SEQ ID NO: 1515780 - RNA, 17 nt, Human
cagauaugauucaaaug

SEQ ID NO: 1515781 - RNA, 19 nt, Human
cagauaugauucaaauguc

SEQ ID NO: 1515782 - RNA, 20 nt, Human
cagagucagaaguuucugcc

SEQ ID NO: 1515783 - RNA, 18 nt, Human
cagaggggguggccuccc

SEQ ID NO: 1515784 - RNA, 19 nt, Human
cagaggggguggccuccca

SEQ ID NO: 1515785 - RNA, 20 nt, Human
cagaggggguggccucccaa

SEQ ID NO: 1515786 - RNA, 22 nt, Human
cagagggccugcaagggaguga

SEQ ID NO: 1515787 - RNA, 19 nt, Human
cagaaguuucugccgcagc

SEQ ID NO: 1515788 - RNA, 20 nt, Human
cagaaguuugagaucagccu

SEQ ID NO: 1515789 - RNA, 22 nt, Human
cagaaguuugagaucagccugg

SEQ ID NO: 1515790 - RNA, 23 nt, Human
cagaaguuugagaucagccuggg

SEQ ID NO: 1515791 - RNA, 18 nt, Human
cagagcugccaccugccu

SEQ ID NO: 1515792 - RNA, 20 nt, Human
cagagcugggauguuucugu

SEQ ID NO: 1515793 - RNA, 23 nt, Human
gaugcuucucacugccaugccag

SEQ ID NO: 1515794 - RNA, 17 nt, Human
gauguagaggagaaacu

SEQ ID NO: 1515795 - RNA, 16 nt, Human
gaugcuuguacauaau

SEQ ID NO: 1515796 - RNA, 14 nt, Human
gaugcuuguacaua

SEQ ID NO: 1515797 - RNA, 20 nt, Human
gaucuggguucacugcaacc

SEQ ID NO: 1515798 - RNA, 22 nt, Human
gaguugauagcacagacccugc

SEQ ID NO: 1515799 - RNA, 18 nt, Human
gaucuggguucacugcaa

SEQ ID NO: 1515800 - RNA, 22 nt, Human
gauuuuuuuuuccuucagugcc

SEQ ID NO: 1515801 - RNA, 12 nt, Human
gauuucaucugc

SEQ ID NO: 1515802 - RNA, 15 nt, Human
gauuucaucugcucu

SEQ ID NO: 1515803 - RNA, 17 nt, Human
gauuucaucugcucucc

SEQ ID NO: 1515804 - RNA, 23 nt, Human
gauuuuuuuuuccuucagugccu

SEQ ID NO: 1515805 - RNA, 12 nt, Human
gauucuuuccug

SEQ ID NO: 1515806 - RNA, 13 nt, Human
gauuucacucucc

SEQ ID NO: 1515807 - RNA, 16 nt, Human
gauuucacucuccuug

SEQ ID NO: 1515808 - RNA, 17 nt, Human
gauuucacucuccuugg

SEQ ID NO: 1515809 - RNA, 18 nt, Human
gauuucacucuccuuggu

SEQ ID NO: 1515810 - RNA, 19 nt, Human
gauucuccugccucagccu

SEQ ID NO: 1515811 - RNA, 11 nt, Human
gauucuccuuc

SEQ ID NO: 1515812 - RNA, 20 nt, Human
gauucuccugccucagccuc

SEQ ID NO: 1515813 - RNA, 21 nt, Human
gauucuccugccucagccucc

SEQ ID NO: 1515814 - RNA, 23 nt, Human
gauuuaacagaaauguacagcaa

SEQ ID NO: 1515815 - RNA, 20 nt, Human
gauuuaacagaaauguacag

SEQ ID NO: 1515816 - RNA, 21 nt, Human
gauucuucugcuucagccucc

SEQ ID NO: 1515817 - RNA, 23 nt, Human
gauucuuauggacaaugacccag

SEQ ID NO: 1515818 - RNA, 22 nt, Human
gcaacccuggugaccagcacca

SEQ ID NO: 1515819 - RNA, 18 nt, Human
gcaaccuccgccucuugg

SEQ ID NO: 1515820 - RNA, 19 nt, Human
gcaaccuccgccucuuggg

SEQ ID NO: 1515821 - RNA, 15 nt, Human
gcaaaagaugcuucu

SEQ ID NO: 1515822 - RNA, 18 nt, Human
gcaacccccagccugcua

SEQ ID NO: 1515823 - RNA, 16 nt, Human
gcaaaagaugcuucuc

SEQ ID NO: 1515824 - RNA, 12 nt, Human
gcacacaccaga

SEQ ID NO: 1515825 - RNA, 14 nt, Human
gcacacaccagagc

SEQ ID NO: 1515826 - RNA, 15 nt, Human
gcacacaccagagcc

SEQ ID NO: 1515827 - RNA, 16 nt, Human
gcacacaccagagccc

SEQ ID NO: 1515828 - RNA, 17 nt, Human
gcacacaccagagccca

SEQ ID NO: 1515829 - RNA, 18 nt, Human
gcacacaccagagcccac

SEQ ID NO: 1515830 - RNA, 19 nt, Human
gcacacaccagagcccacc

SEQ ID NO: 1515831 - RNA, 18 nt, Human
gcaauagucaaauugugu

SEQ ID NO: 1515832 - RNA, 21 nt, Human
gcaauaaagcagcguuucuau

SEQ ID NO: 1515833 - RNA, 11 nt, Human
gcaauaaagca

SEQ ID NO: 1515834 - RNA, 12 nt, Human
gcaccuccugcc

SEQ ID NO: 1515835 - RNA, 20 nt, Human
gcacacaccagagcccaccu

SEQ ID NO: 1515836 - RNA, 11 nt, Human
gcacacauuuu

SEQ ID NO: 1515837 - RNA, 12 nt, Human
gcacacauuuuu

SEQ ID NO: 1515838 - RNA, 14 nt, Human
gcacacauuuuuua

SEQ ID NO: 1515839 - RNA, 18 nt, Human
gcaccggcuggccuggcc

SEQ ID NO: 1515840 - RNA, 17 nt, Human
gcaccggcuggccuggc

SEQ ID NO: 1515841 - RNA, 15 nt, Human
gcaccggcuggccug

SEQ ID NO: 1515842 - RNA, 16 nt, Human
gcaccggcuggccugg

SEQ ID NO: 1515843 - RNA, 17 nt, Human
gcacuccagccugggug

SEQ ID NO: 1515844 - RNA, 12 nt, Human
gcacuccccugc

SEQ ID NO: 1515845 - RNA, 22 nt, Human
gcacuauagccuaggugacaga

SEQ ID NO: 1515846 - RNA, 14 nt, Human
gccaagaauucuua

SEQ ID NO: 1515847 - RNA, 18 nt, Human
gccaagaauucuuaaaua

SEQ ID NO: 1515848 - RNA, 15 nt, Human
gcauuuaaaagauac

SEQ ID NO: 1515849 - RNA, 12 nt, Human
gcauuuaaaaga

SEQ ID NO: 1515850 - RNA, 16 nt, Human
gcauuugaaaauuuug

SEQ ID NO: 1515851 - RNA, 14 nt, Human
gcauuugaaaauuu

SEQ ID NO: 1515852 - RNA, 17 nt, Human
gcauccuggcacccggc

SEQ ID NO: 1515853 - RNA, 21 nt, Human
gcauccuggcacccggccccu

SEQ ID NO: 1515854 - RNA, 22 nt, Human
gcauccuggcacccggccccug

SEQ ID NO: 1515855 - RNA, 23 nt, Human
gcauccuggcacccggccccugc

SEQ ID NO: 1515856 - RNA, 18 nt, Human
gcauggcauauuuuucac

SEQ ID NO: 1515857 - RNA, 18 nt, Human
gcaugugaugagaggaaa

SEQ ID NO: 1515858 - RNA, 16 nt, Human
gcauuguaaaugugcu

SEQ ID NO: 1515859 - RNA, 17 nt, Human
gcaugugaugagaggaa

SEQ ID NO: 1515860 - RNA, 19 nt, Human
gcaugggaaugaaugucag

SEQ ID NO: 1515861 - RNA, 16 nt, Human
gcaugggaaugaaugu

SEQ ID NO: 1515862 - RNA, 19 nt, Human
gccaaggccaaaggaagca

SEQ ID NO: 1515863 - RNA, 17 nt, Human
gccaaggccaaaggaag

SEQ ID NO: 1515864 - RNA, 11 nt, Human
gccaaggccaa

SEQ ID NO: 1515865 - RNA, 16 nt, Human
gcauaccacuuuuguu

SEQ ID NO: 1515866 - RNA, 15 nt, Human
gcauaccacuuuugu

SEQ ID NO: 1515867 - RNA, 19 nt, Human
gcagggacuugaacccaua

SEQ ID NO: 1515868 - RNA, 15 nt, Human
gcauaaaaauuagcc

SEQ ID NO: 1515869 - RNA, 14 nt, Human
gcaguugccaguca

SEQ ID NO: 1515870 - RNA, 23 nt, Human
gcaguugccagucaccccggcca

SEQ ID NO: 1515871 - RNA, 16 nt, Human
gcacuuuguucuggcu

SEQ ID NO: 1515872 - RNA, 18 nt, Human
gcaggcucucaggccagc

SEQ ID NO: 1515873 - RNA, 17 nt, Human
gcaggcucucaggccag

SEQ ID NO: 1515874 - RNA, 22 nt, Human
gcagggaaacagcuaaugggac

SEQ ID NO: 1515875 - RNA, 19 nt, Human
gcagcuugaggguugggcu

SEQ ID NO: 1515876 - RNA, 21 nt, Human
gcagcuugaggguugggcugg

SEQ ID NO: 1515877 - RNA, 22 nt, Human
gcaggcucgggcuccccagccc

SEQ ID NO: 1515878 - RNA, 12 nt, Human
gcaggcucucag

SEQ ID NO: 1515879 - RNA, 13 nt, Human
gcaggcucucagg

SEQ ID NO: 1515880 - RNA, 14 nt, Human
gcaggcucucaggc

SEQ ID NO: 1515881 - RNA, 15 nt, Human
gcaggcucucaggcc

SEQ ID NO: 1515882 - RNA, 16 nt, Human
gcaggcucucaggcca

SEQ ID NO: 1515883 - RNA, 16 nt, Human
gcagcuugaggguugg

SEQ ID NO: 1515884 - RNA, 15 nt, Human
gcagcuuauucacaa

SEQ ID NO: 1515885 - RNA, 22 nt, Human
gcagcugcgguccacccaggag

SEQ ID NO: 1515886 - RNA, 23 nt, Human
gcagcugcgguccacccaggagc

SEQ ID NO: 1515887 - RNA, 13 nt, Human
gcagcugcuuuug

SEQ ID NO: 1515888 - RNA, 20 nt, Human
gcagcugcuuuugucuaugg

SEQ ID NO: 1515889 - RNA, 15 nt, Human
gaggcucugcccuug

SEQ ID NO: 1515890 - RNA, 17 nt, Human
gaggcucugcccuuggu

SEQ ID NO: 1515891 - RNA, 12 nt, Human
gaggcucugccc

SEQ ID NO: 1515892 - RNA, 13 nt, Human
gaggcucugcccu

SEQ ID NO: 1515893 - RNA, 14 nt, Human
gaggcucugcccuu

SEQ ID NO: 1515894 - RNA, 20 nt, Human
gaggccagagacacaagccu

SEQ ID NO: 1515895 - RNA, 14 nt, Human
gaggcugccucucc

SEQ ID NO: 1515896 - RNA, 12 nt, Human
gaggggaacaga

SEQ ID NO: 1515897 - RNA, 12 nt, Human
gagggcuccaga

SEQ ID NO: 1515898 - RNA, 13 nt, Human
gagggcuccagac

SEQ ID NO: 1515899 - RNA, 14 nt, Human
gagggcuccagaca

SEQ ID NO: 1515900 - RNA, 15 nt, Human
gagggcuccagacac

SEQ ID NO: 1515901 - RNA, 17 nt, Human
gaggugggauccuccag

SEQ ID NO: 1515902 - RNA, 14 nt, Human
gagucacuggaaca

SEQ ID NO: 1515903 - RNA, 21 nt, Human
gagucacuggaacacuaauga

SEQ ID NO: 1515904 - RNA, 15 nt, Human
gaggugggauccucc

SEQ ID NO: 1515905 - RNA, 16 nt, Human
gaggugggauccucca

SEQ ID NO: 1515906 - RNA, 18 nt, Human
gagucagaaguuucugcc

SEQ ID NO: 1515907 - RNA, 14 nt, Human
gagugagacucugu

SEQ ID NO: 1515908 - RNA, 18 nt, Human
gagugagacucugucuca

SEQ ID NO: 1515909 - RNA, 24 nt, Human
gagugagcacuaaggugugcucug

SEQ ID NO: 1515910 - RNA, 18 nt, Human
gagugcagugagccgaga

SEQ ID NO: 1515911 - RNA, 22 nt, Human
gaguugauacuacaguuuguua

SEQ ID NO: 1515912 - RNA, 21 nt, Human
gaguugauagcacagacccug

SEQ ID NO: 1515913 - RNA, 19 nt, Human
gaguugauacuacaguuug

SEQ ID NO: 1515914 - RNA, 18 nt, Human
gagugccuuacacaaugg

SEQ ID NO: 1515915 - RNA, 17 nt, Human
gagcuguucacagccag

SEQ ID NO: 1515916 - RNA, 20 nt, Human
gagcugccuguucagcucca

SEQ ID NO: 1515917 - RNA, 17 nt, Human
gagcggagaaaggaagg

SEQ ID NO: 1515918 - RNA, 15 nt, Human
gagcugccuguucag

SEQ ID NO: 1515919 - RNA, 16 nt, Human
gagcugccuguucagc

SEQ ID NO: 1515920 - RNA, 19 nt, Human
gagcugccuguucagcucc

SEQ ID NO: 1515921 - RNA, 15 nt, Human
gagcgcuccugccgc

SEQ ID NO: 1515922 - RNA, 21 nt, Human
gagcgcuccugccgcagagcu

SEQ ID NO: 1515923 - RNA, 22 nt, Human
gagcgcuccugccgcagagcug

SEQ ID NO: 1515924 - RNA, 23 nt, Human
gagcgcuccugccgcagagcugg

SEQ ID NO: 1515925 - RNA, 15 nt, Human
gagcgacagugagac

SEQ ID NO: 1515926 - RNA, 12 nt, Human
gagccuuccagg

SEQ ID NO: 1515927 - RNA, 13 nt, Human
gagccuuccaggg

SEQ ID NO: 1515928 - RNA, 20 nt, Human
gagcaucaggccaggcccuc

SEQ ID NO: 1515929 - RNA, 22 nt, Human
gagcaucaggccaggcccucug

SEQ ID NO: 1515930 - RNA, 15 nt, Human
gaccaucccugaagg

SEQ ID NO: 1515931 - RNA, 18 nt, Human
gaccaucccugaaggccc

SEQ ID NO: 1515932 - RNA, 16 nt, Human
gaccaucccugaaggc

SEQ ID NO: 1515933 - RNA, 17 nt, Human
gaccaucccugaaggcc

SEQ ID NO: 1515934 - RNA, 16 nt, Human
gaccauucuccaccug

SEQ ID NO: 1515935 - RNA, 17 nt, Human
gaccauucuccaccugc

SEQ ID NO: 1515936 - RNA, 16 nt, Human
gacccuauugcugcuu

SEQ ID NO: 1515937 - RNA, 12 nt, Human
gacccggcugcg

SEQ ID NO: 1515938 - RNA, 13 nt, Human
gacccggcugcgu

SEQ ID NO: 1515939 - RNA, 20 nt, Human
gacaguauggcagcuuuccu

SEQ ID NO: 1515940 - RNA, 21 nt, Human
gacagcccuucuuuccacaga

SEQ ID NO: 1515941 - RNA, 20 nt, Human
gacagaaagcagaacaguga

SEQ ID NO: 1515942 - RNA, 14 nt, Human
gacagaaagcagaa

SEQ ID NO: 1515943 - RNA, 16 nt, Human
gacagcuccuucuguc

SEQ ID NO: 1515944 - RNA, 13 nt, Human
gacagcuccuucu

SEQ ID NO: 1515945 - RNA, 14 nt, Human
gacagcuccuucug

SEQ ID NO: 1515946 - RNA, 15 nt, Human
gacagcuccuucugu

SEQ ID NO: 1515947 - RNA, 22 nt, Human
gacuuuguuaguuucuccaagc

SEQ ID NO: 1515948 - RNA, 23 nt, Human
gacuuuucuguccgagcuuugaa

SEQ ID NO: 1515949 - RNA, 21 nt, Human
gacuuuucuguccgagcuuug

SEQ ID NO: 1515950 - RNA, 16 nt, Human
gacuguuuucucuuga

SEQ ID NO: 1515951 - RNA, 18 nt, Human
gacuguuuucucuugaga

SEQ ID NO: 1515952 - RNA, 14 nt, Human
gacuuuggaaagac

SEQ ID NO: 1515953 - RNA, 14 nt, Human
gacuuuggaaagag

SEQ ID NO: 1515954 - RNA, 14 nt, Human
gacucaaugcacug

SEQ ID NO: 1515955 - RNA, 17 nt, Human
gacucaaugcacugaca

SEQ ID NO: 1515956 - RNA, 22 nt, Human
gacuguacaaaguagaagucuu

SEQ ID NO: 1515957 - RNA, 17 nt, Human
gagaagcggcuggcagc

SEQ ID NO: 1515958 - RNA, 12 nt, Human
gacgcugugcug

SEQ ID NO: 1515959 - RNA, 15 nt, Human
gacgcugugcugccc

SEQ ID NO: 1515960 - RNA, 13 nt, Human
gacgcugugcugc

SEQ ID NO: 1515961 - RNA, 22 nt, Human
gacuauucaaacagucucagga

SEQ ID NO: 1515962 - RNA, 18 nt, Human
gacuauauuguacacacc

SEQ ID NO: 1515963 - RNA, 15 nt, Human
gacuauucaaacagu

SEQ ID NO: 1515964 - RNA, 16 nt, Human
gacuauucaaacaguc

SEQ ID NO: 1515965 - RNA, 21 nt, Human
gaaacaagucagucauucaga

SEQ ID NO: 1515966 - RNA, 23 nt, Human
gaaaauuauuuuguucauacaua

SEQ ID NO: 1515967 - RNA, 23 nt, Human
gaaaagaaaaaugagccuggcaa

SEQ ID NO: 1515968 - RNA, 21 nt, Human
gaaaacuuuaugcuaagugaa

SEQ ID NO: 1515969 - RNA, 20 nt, Human
gaaaauuauuuuguucauac

SEQ ID NO: 1515970 - RNA, 21 nt, Human
gaaaauuauuuuguucauaca

SEQ ID NO: 1515971 - RNA, 22 nt, Human
gaaaauuauuuuguucauacau

SEQ ID NO: 1515972 - RNA, 14 nt, Human
gaaaagacuccaaa

SEQ ID NO: 1515973 - RNA, 18 nt, Human
gaaaagacuccaaagaaa

SEQ ID NO: 1515974 - RNA, 16 nt, Human
gaaaagacuccaaaga

SEQ ID NO: 1515975 - RNA, 17 nt, Human
gaaaagacuccaaagaa

SEQ ID NO: 1515976 - RNA, 17 nt, Human
gaaaugaaagcagggac

SEQ ID NO: 1515977 - RNA, 15 nt, Human
gaaagggcccagaga

SEQ ID NO: 1515978 - RNA, 16 nt, Human
gaaagggcccagagag

SEQ ID NO: 1515979 - RNA, 13 nt, Human
gaaagggcccaga

SEQ ID NO: 1515980 - RNA, 16 nt, Human
gaaaggcuccaggagc

SEQ ID NO: 1515981 - RNA, 13 nt, Human
gaaaggcuccagg

SEQ ID NO: 1515982 - RNA, 14 nt, Human
gaaaggcuccagga

SEQ ID NO: 1515983 - RNA, 15 nt, Human
gaaaggcuccaggag

SEQ ID NO: 1515984 - RNA, 17 nt, Human
gaaacuggauuaaacuu

SEQ ID NO: 1515985 - RNA, 13 nt, Human
gaaacuggauuaa

SEQ ID NO: 1515986 - RNA, 18 nt, Human
gaaagaaaaucaggcugg

SEQ ID NO: 1515987 - RNA, 17 nt, Human
gaagcacagugaucaag

SEQ ID NO: 1515988 - RNA, 14 nt, Human
gaagcacaugccuc

SEQ ID NO: 1515989 - RNA, 22 nt, Human
gaagcacaugccucucucaggc

SEQ ID NO: 1515990 - RNA, 13 nt, Human
gaagcacagcuuc

SEQ ID NO: 1515991 - RNA, 14 nt, Human
gaagcacagcuuca

SEQ ID NO: 1515992 - RNA, 16 nt, Human
gaagacucauucuucu

SEQ ID NO: 1515993 - RNA, 17 nt, Human
gaagacucauucuucug

SEQ ID NO: 1515994 - RNA, 18 nt, Human
gaagacucauucuucugu

SEQ ID NO: 1515995 - RNA, 16 nt, Human
gaagcaccauaacuuu

SEQ ID NO: 1515996 - RNA, 21 nt, Human
gaagacacugaugggcaaccc

SEQ ID NO: 1515997 - RNA, 16 nt, Human
gaagacacugaugggc

SEQ ID NO: 1515998 - RNA, 13 nt, Human
gaagacagagcua

SEQ ID NO: 1515999 - RNA, 15 nt, Human
gaagacagagcuaca

SEQ ID NO: 1516000 - RNA, 12 nt, Human
gaagacagcucu

SEQ ID NO: 1516001 - RNA, 13 nt, Human
gaagacagcucuu

SEQ ID NO: 1516002 - RNA, 14 nt, Human
gaagacagcucuua

SEQ ID NO: 1516003 - RNA, 15 nt, Human
gaagacagcucuuau

SEQ ID NO: 1516004 - RNA, 22 nt, Human
gaaccauggucggaaaacaugc

SEQ ID NO: 1516005 - RNA, 23 nt, Human
gaaccaccacacccagcccacuu

SEQ ID NO: 1516006 - RNA, 16 nt, Human
gaacccaaguccaagc

SEQ ID NO: 1516007 - RNA, 17 nt, Human
gaacccaaguccaagca

SEQ ID NO: 1516008 - RNA, 13 nt, Human
gaacugaaaucau

SEQ ID NO: 1516009 - RNA, 17 nt, Human
gaacugauguaaguaaa

SEQ ID NO: 1516010 - RNA, 13 nt, Human
gaacuccuggccu

SEQ ID NO: 1516011 - RNA, 17 nt, Human
gaacccgggaggcagag

SEQ ID NO: 1516012 - RNA, 19 nt, Human
gaacccgggaggcagaggu

SEQ ID NO: 1516013 - RNA, 15 nt, Human
gaacuccuggccuca

SEQ ID NO: 1516014 - RNA, 14 nt, Human
gaacuccuggccuc

SEQ ID NO: 1516015 - RNA, 18 nt, Human
gaaccaccacacccagcc

SEQ ID NO: 1516016 - RNA, 20 nt, Human
gaaccaccacacccagccca

SEQ ID NO: 1516017 - RNA, 21 nt, Human
gaaccaccacacccagcccac

SEQ ID NO: 1516018 - RNA, 22 nt, Human
gaaccaccacacccagcccacu

SEQ ID NO: 1516019 - RNA, 22 nt, Human
cuuuguauucucuccuguaccu

SEQ ID NO: 1516020 - RNA, 21 nt, Human
cuuuuauaaacuuuaccuuuu

SEQ ID NO: 1516021 - RNA, 20 nt, Human
cuuuuauaaacuuuaccuuu

SEQ ID NO: 1516022 - RNA, 17 nt, Human
cuuuguauucucuccug

SEQ ID NO: 1516023 - RNA, 20 nt, Human
cuuugauucuccuucagccc

SEQ ID NO: 1516024 - RNA, 16 nt, Human
cuuugauucuccuuca

SEQ ID NO: 1516025 - RNA, 18 nt, Human
cuuugauucuccuucagc

SEQ ID NO: 1516026 - RNA, 19 nt, Human
cuuugauucuccuucagcc

SEQ ID NO: 1516027 - RNA, 22 nt, Human
cuuugauucuccuucagcccuc

SEQ ID NO: 1516028 - RNA, 18 nt, Human
cuuugacgccaucccagc

SEQ ID NO: 1516029 - RNA, 16 nt, Human
cuuugacgccauccca

SEQ ID NO: 1516030 - RNA, 17 nt, Human
cuuugacgccaucccag

SEQ ID NO: 1516031 - RNA, 17 nt, Human
cuuucuacccagcgagc

SEQ ID NO: 1516032 - RNA, 15 nt, Human
cuuucuacccagcga

SEQ ID NO: 1516033 - RNA, 16 nt, Human
cuuucuacccagcgag

SEQ ID NO: 1516034 - RNA, 17 nt, Human
cuugggucccagggaag

SEQ ID NO: 1516035 - RNA, 22 nt, Human
cuugguagaagcccuucuaccu

SEQ ID NO: 1516036 - RNA, 19 nt, Human
cuuggucugugagaugcua

SEQ ID NO: 1516037 - RNA, 15 nt, Human
cuugguccugcugca

SEQ ID NO: 1516038 - RNA, 16 nt, Human
cuuggucugugagaug

SEQ ID NO: 1516039 - RNA, 14 nt, Human
cuugguccugcugc

SEQ ID NO: 1516040 - RNA, 19 nt, Human
cuuggugucgggcaugaca

SEQ ID NO: 1516041 - RNA, 20 nt, Human
cuuggugucgggcaugacac

SEQ ID NO: 1516042 - RNA, 19 nt, Human
cuugucuuuggacccugag

SEQ ID NO: 1516043 - RNA, 18 nt, Human
cuugucuuuggacccuga

SEQ ID NO: 1516044 - RNA, 13 nt, Human
cuugucuuuggac

SEQ ID NO: 1516045 - RNA, 15 nt, Human
cuugucuuuggaccc

SEQ ID NO: 1516046 - RNA, 20 nt, Human
cuuucacccuuuucuguuug

SEQ ID NO: 1516047 - RNA, 14 nt, Human
cuuucacccuuuuc

SEQ ID NO: 1516048 - RNA, 15 nt, Human
cuuucacccuuuucu

SEQ ID NO: 1516049 - RNA, 15 nt, Human
cuucugacccaugcu

SEQ ID NO: 1516050 - RNA, 13 nt, Human
cuucuucagagac

SEQ ID NO: 1516051 - RNA, 14 nt, Human
cuucuucagagacu

SEQ ID NO: 1516052 - RNA, 18 nt, Human
cuucuucagagacuccug

SEQ ID NO: 1516053 - RNA, 20 nt, Human
cuucucacauuuauauuuuu

SEQ ID NO: 1516054 - RNA, 13 nt, Human
cuucucacauuua

SEQ ID NO: 1516055 - RNA, 13 nt, Human
cuucuaaguaaaa

SEQ ID NO: 1516056 - RNA, 17 nt, Human
cuucuaaguaaaaccac

SEQ ID NO: 1516057 - RNA, 22 nt, Human
cuucuaaguaaaaccacagcag

SEQ ID NO: 1516058 - RNA, 21 nt, Human
cuucuaaguaaaaccacagca

SEQ ID NO: 1516059 - RNA, 13 nt, Human
cuuccuccuggug

SEQ ID NO: 1516060 - RNA, 22 nt, Human
cuuccucuuuccaucuacccuc

SEQ ID NO: 1516061 - RNA, 12 nt, Human
cuugauucauaa

SEQ ID NO: 1516062 - RNA, 12 nt, Human
cuugcaaaguau

SEQ ID NO: 1516063 - RNA, 23 nt, Human
cuuggauuguccccgacccuugc

SEQ ID NO: 1516064 - RNA, 24 nt, Human
cuuggauuguccccgacccuugcc

SEQ ID NO: 1516065 - RNA, 18 nt, Human
cuugaauuguaaggaaug

SEQ ID NO: 1516066 - RNA, 16 nt, Human
cuugacaucaacugca

SEQ ID NO: 1516067 - RNA, 23 nt, Human
cuugaucaacaucuuuucuugcc

SEQ ID NO: 1516068 - RNA, 17 nt, Human
cuugaucaacaucuuuu

SEQ ID NO: 1516069 - RNA, 22 nt, Human
cuugauauccucuuugagugaa

SEQ ID NO: 1516070 - RNA, 17 nt, Human
cuugauauccucuuuga

SEQ ID NO: 1516071 - RNA, 18 nt, Human
cuugauguguuaucucuu

SEQ ID NO: 1516072 - RNA, 19 nt, Human
cuguuggcugggggccuca

SEQ ID NO: 1516073 - RNA, 22 nt, Human
cuguuggcugggggccucagug

SEQ ID NO: 1516074 - RNA, 14 nt, Human
cuguuggcuggggg

SEQ ID NO: 1516075 - RNA, 13 nt, Human
cuuaaauaaugug

SEQ ID NO: 1516076 - RNA, 14 nt, Human
cuuaaaacaacacu

SEQ ID NO: 1516077 - RNA, 15 nt, Human
cuuaccagcagagca

SEQ ID NO: 1516078 - RNA, 12 nt, Human
cuguucacagcc

SEQ ID NO: 1516079 - RNA, 16 nt, Human
cuuaccagcagagcac

SEQ ID NO: 1516080 - RNA, 22 nt, Human
cuuagcucauucuccuuguguu

SEQ ID NO: 1516081 - RNA, 17 nt, Human
cuuagcuccccuccaac

SEQ ID NO: 1516082 - RNA, 23 nt, Human
cuuagcucauucuccuuguguua

SEQ ID NO: 1516083 - RNA, 14 nt, Human
cuuagcuccccucc

SEQ ID NO: 1516084 - RNA, 21 nt, Human
cuuagggaaggauacaaaagc

SEQ ID NO: 1516085 - RNA, 18 nt, Human
cuuagggacaggacccca

SEQ ID NO: 1516086 - RNA, 20 nt, Human
cuuagggacaggaccccagc

SEQ ID NO: 1516087 - RNA, 19 nt, Human
cuuagggaaggauacaaaa

SEQ ID NO: 1516088 - RNA, 23 nt, Human
cuuagggacaggaccccagcucu

SEQ ID NO: 1516089 - RNA, 21 nt, Human
cuuagggacaggaccccagcu

SEQ ID NO: 1516090 - RNA, 22 nt, Human
cuuagggacaggaccccagcuc

SEQ ID NO: 1516091 - RNA, 13 nt, Human
cuguuauaaucuu

SEQ ID NO: 1516092 - RNA, 19 nt, Human
cuguuauaaucuuucacag

SEQ ID NO: 1516093 - RNA, 21 nt, Human
cugugcugcccugcccaccug

SEQ ID NO: 1516094 - RNA, 17 nt, Human
cugugucagcauagaag

SEQ ID NO: 1516095 - RNA, 19 nt, Human
cugugucagcauagaagua

SEQ ID NO: 1516096 - RNA, 15 nt, Human
cugugcugcccugcc

SEQ ID NO: 1516097 - RNA, 17 nt, Human
cugugcugcccugccca

SEQ ID NO: 1516098 - RNA, 18 nt, Human
cugugcugcccugcccac

SEQ ID NO: 1516099 - RNA, 19 nt, Human
cugugcugcccugcccacc

SEQ ID NO: 1516100 - RNA, 12 nt, Human
cugugcugcccu

SEQ ID NO: 1516101 - RNA, 13 nt, Human
cugugcugcccug

SEQ ID NO: 1516102 - RNA, 14 nt, Human
cugugcugcccugc

SEQ ID NO: 1516103 - RNA, 20 nt, Human
cugucaauuacaggaaguac

SEQ ID NO: 1516104 - RNA, 23 nt, Human
cugucaauuacaggaaguacugg

SEQ ID NO: 1516105 - RNA, 16 nt, Human
cugucgcccagucugg

SEQ ID NO: 1516106 - RNA, 22 nt, Human
cuggugacaugucuuuucuugc

SEQ ID NO: 1516107 - RNA, 13 nt, Human
cuguagaguggga

SEQ ID NO: 1516108 - RNA, 11 nt, Human
cugggacacag

SEQ ID NO: 1516109 - RNA, 14 nt, Human
cuggccuagcauac

SEQ ID NO: 1516110 - RNA, 22 nt, Human
cuggccccucagggucccuggu

SEQ ID NO: 1516111 - RNA, 19 nt, Human
cuggcagaguugaagacag

SEQ ID NO: 1516112 - RNA, 11 nt, Human
cuggcagccca

SEQ ID NO: 1516113 - RNA, 12 nt, Human
cuggcagccccu

SEQ ID NO: 1516114 - RNA, 13 nt, Human
cuggcagccccug

SEQ ID NO: 1516115 - RNA, 17 nt, Human
cuggcagaguugaagac

SEQ ID NO: 1516116 - RNA, 18 nt, Human
cuggcagaguugaagaca

SEQ ID NO: 1516117 - RNA, 15 nt, Human
cuggguggggcagug

SEQ ID NO: 1516118 - RNA, 18 nt, Human
cuggguucacugcaaccu

SEQ ID NO: 1516119 - RNA, 20 nt, Human
cuggguucacugcaaccucc

SEQ ID NO: 1516120 - RNA, 12 nt, Human
cugggcagaagg

SEQ ID NO: 1516121 - RNA, 15 nt, Human
cugggcagaaggaag

SEQ ID NO: 1516122 - RNA, 16 nt, Human
cugggcagaaggaaga

SEQ ID NO: 1516123 - RNA, 18 nt, Human
cugggccacuucugggug

SEQ ID NO: 1516124 - RNA, 23 nt, Human
cugccucucccaucacuucccua

SEQ ID NO: 1516125 - RNA, 15 nt, Human
cugccucucccauca

SEQ ID NO: 1516126 - RNA, 22 nt, Human
cugccucucccaucacuucccu

SEQ ID NO: 1516127 - RNA, 17 nt, Human
cugccuguucagcucca

SEQ ID NO: 1516128 - RNA, 18 nt, Human
cugccuguucagcuccag

SEQ ID NO: 1516129 - RNA, 20 nt, Human
cugccuguugggccaggagc

SEQ ID NO: 1516130 - RNA, 19 nt, Human
cugccuguucagcuccagc

SEQ ID NO: 1516131 - RNA, 18 nt, Human
cugcugacuguuuucucu

SEQ ID NO: 1516132 - RNA, 21 nt, Human
cugcugacuguuuucucuuga

SEQ ID NO: 1516133 - RNA, 20 nt, Human
cugccuguucagcuccagcu

SEQ ID NO: 1516134 - RNA, 23 nt, Human
cugccuguugggccaggagccuc

SEQ ID NO: 1516135 - RNA, 21 nt, Human
cugccuguugggccaggagcc

SEQ ID NO: 1516136 - RNA, 22 nt, Human
cugccuguugggccaggagccu

SEQ ID NO: 1516137 - RNA, 17 nt, Human
cugcuaucaaagagguu

SEQ ID NO: 1516138 - RNA, 14 nt, Human
cuggagaaaaugga

SEQ ID NO: 1516139 - RNA, 12 nt, Human
cuggacugaggc

SEQ ID NO: 1516140 - RNA, 13 nt, Human
cuggacugaggcc

SEQ ID NO: 1516141 - RNA, 15 nt, Human
cuggacugaggccug

SEQ ID NO: 1516142 - RNA, 16 nt, Human
cuggacugaggccuga

SEQ ID NO: 1516143 - RNA, 18 nt, Human
cuggacugaggccugagc

SEQ ID NO: 1516144 - RNA, 14 nt, Human
cuggaagcacagcu

SEQ ID NO: 1516145 - RNA, 21 nt, Human
cugcuuuugucuaugggacuc

SEQ ID NO: 1516146 - RNA, 19 nt, Human
cugcuuuuuaaagaaugcu

SEQ ID NO: 1516147 - RNA, 14 nt, Human
cugcuucaaauauu

SEQ ID NO: 1516148 - RNA, 19 nt, Human
cugcuucaaauauuucccu

SEQ ID NO: 1516149 - RNA, 12 nt, Human
cugcuucaagga

SEQ ID NO: 1516150 - RNA, 13 nt, Human
cugcuucaaggau

SEQ ID NO: 1516151 - RNA, 21 nt, Human
cugcuucaaggauccugagcc

SEQ ID NO: 1516152 - RNA, 22 nt, Human
cugcuucaaggauccugagcca

SEQ ID NO: 1516153 - RNA, 23 nt, Human
cugcuucaaggauccugagccag

SEQ ID NO: 1516154 - RNA, 20 nt, Human
cugcuuuugucuaugggacu

SEQ ID NO: 1516155 - RNA, 17 nt, Human
gcucacugcagccucaa

SEQ ID NO: 1516156 - RNA, 15 nt, Human
gcucacugcagccuc

SEQ ID NO: 1516157 - RNA, 16 nt, Human
gcucacugcagccuca

SEQ ID NO: 1516158 - RNA, 11 nt, Human
gcucacugcag

SEQ ID NO: 1516159 - RNA, 12 nt, Human
gcucacugcagc

SEQ ID NO: 1516160 - RNA, 13 nt, Human
gcucacugcagcc

SEQ ID NO: 1516161 - RNA, 14 nt, Human
gcucacugcagccu

SEQ ID NO: 1516162 - RNA, 22 nt, Human
gcuauuuuuauuuguuugugca

SEQ ID NO: 1516163 - RNA, 20 nt, Human
gcuauucaguaauaacucua

SEQ ID NO: 1516164 - RNA, 14 nt, Human
gcucagagagggug

SEQ ID NO: 1516165 - RNA, 13 nt, Human
gcucagagagggu

SEQ ID NO: 1516166 - RNA, 17 nt, Human
gcucaggugucccugca

SEQ ID NO: 1516167 - RNA, 16 nt, Human
gcucaggugucccugc

SEQ ID NO: 1516168 - RNA, 14 nt, Human
gcucaggugucccu

SEQ ID NO: 1516169 - RNA, 16 nt, Human
gcuaggccuggccaga

SEQ ID NO: 1516170 - RNA, 17 nt, Human
gcuaggccuggccagau

SEQ ID NO: 1516171 - RNA, 23 nt, Human
gcuaggccuggccagaugcacca

SEQ ID NO: 1516172 - RNA, 13 nt, Human
gcuaugcauuuga

SEQ ID NO: 1516173 - RNA, 19 nt, Human
gcuauucaguaauaacucu

SEQ ID NO: 1516174 - RNA, 12 nt, Human
gcuaugcauuug

SEQ ID NO: 1516175 - RNA, 21 nt, Human
gcuagugugguguuuccuggc

SEQ ID NO: 1516176 - RNA, 22 nt, Human
gcuagugugguguuuccuggca

SEQ ID NO: 1516177 - RNA, 18 nt, Human
gcguuucuaugacacaug

SEQ ID NO: 1516178 - RNA, 23 nt, Human
gcgugcacacaccagagcccacc

SEQ ID NO: 1516179 - RNA, 20 nt, Human
gcgugcacacaccagagccc

SEQ ID NO: 1516180 - RNA, 21 nt, Human
gcgggaggauguucugggaca

SEQ ID NO: 1516181 - RNA, 22 nt, Human
gcgggaggauguucugggacac

SEQ ID NO: 1516182 - RNA, 23 nt, Human
gcuaagugauccucccaccucag

SEQ ID NO: 1516183 - RNA, 15 nt, Human
gcuaaugggacacua

SEQ ID NO: 1516184 - RNA, 13 nt, Human
gcuaaugggacac

SEQ ID NO: 1516185 - RNA, 12 nt, Human
gcuagaacuccc

SEQ ID NO: 1516186 - RNA, 13 nt, Human
gcuagaacucccu

SEQ ID NO: 1516187 - RNA, 14 nt, Human
gcuagaacucccuu

SEQ ID NO: 1516188 - RNA, 15 nt, Human
gcuagaacucccuuu

SEQ ID NO: 1516189 - RNA, 16 nt, Human
gcuagaacucccuuuc

SEQ ID NO: 1516190 - RNA, 18 nt, Human
gcuagaacucccuuucaa

SEQ ID NO: 1516191 - RNA, 15 nt, Human
gcuccacuuggucug

SEQ ID NO: 1516192 - RNA, 18 nt, Human
gcuccagcucaccagccc

SEQ ID NO: 1516193 - RNA, 18 nt, Human
gcuccacuuggucuguga

SEQ ID NO: 1516194 - RNA, 19 nt, Human
gcuccacuuggucugugag

SEQ ID NO: 1516195 - RNA, 20 nt, Human
gcuccagcucaccagcccca

SEQ ID NO: 1516196 - RNA, 21 nt, Human
gcuccagcucaccagccccag

SEQ ID NO: 1516197 - RNA, 17 nt, Human
gcucccaggcauucccc

SEQ ID NO: 1516198 - RNA, 14 nt, Human
gcuccuggcccacu

SEQ ID NO: 1516199 - RNA, 15 nt, Human
gcuccuggcccacug

SEQ ID NO: 1516200 - RNA, 20 nt, Human
gcuccuggcccacugcaucg

SEQ ID NO: 1516201 - RNA, 18 nt, Human
gcuccuggcccacugcau

SEQ ID NO: 1516202 - RNA, 19 nt, Human
gcuccuggcccacugcauc

SEQ ID NO: 1516203 - RNA, 21 nt, Human
gcuccccucggagaagagcug

SEQ ID NO: 1516204 - RNA, 23 nt, Human
gcucugcaagaauugaagcagga

SEQ ID NO: 1516205 - RNA, 17 nt, Human
gcucugaucauccacug

SEQ ID NO: 1516206 - RNA, 11 nt, Human
gcucugcccuu

SEQ ID NO: 1516207 - RNA, 18 nt, Human
gcccugcagagggcacag

SEQ ID NO: 1516208 - RNA, 11 nt, Human
gcccugccucc

SEQ ID NO: 1516209 - RNA, 17 nt, Human
gcccugcccaccuggcc

SEQ ID NO: 1516210 - RNA, 20 nt, Human
gcccugcccaccuggccucu

SEQ ID NO: 1516211 - RNA, 21 nt, Human
gcccugcccaccuggccucug

SEQ ID NO: 1516212 - RNA, 22 nt, Human
gcccugcccaccuggccucugc

SEQ ID NO: 1516213 - RNA, 22 nt, Human
gcccuuagcagggaaacagcua

SEQ ID NO: 1516214 - RNA, 20 nt, Human
gccgcagcccugcagagggc

SEQ ID NO: 1516215 - RNA, 20 nt, Human
gcccuuagcagggaaacagc

SEQ ID NO: 1516216 - RNA, 14 nt, Human
gcccugccuccuuu

SEQ ID NO: 1516217 - RNA, 12 nt, Human
gcccugccuccu

SEQ ID NO: 1516218 - RNA, 13 nt, Human
gcccugccuccuu

SEQ ID NO: 1516219 - RNA, 23 nt, Human
gccuagcauacguacacauuuua

SEQ ID NO: 1516220 - RNA, 22 nt, Human
gccuagcauacguacacauuuu

SEQ ID NO: 1516221 - RNA, 21 nt, Human
gccuagcauacguacacauuu

SEQ ID NO: 1516222 - RNA, 20 nt, Human
gccuagcauacguacacauu

SEQ ID NO: 1516223 - RNA, 13 nt, Human
gccuaggugacag

SEQ ID NO: 1516224 - RNA, 14 nt, Human
gccuaggugacaga

SEQ ID NO: 1516225 - RNA, 15 nt, Human
gccuaggugacagag

SEQ ID NO: 1516226 - RNA, 20 nt, Human
gccuaggugacagagugaga

SEQ ID NO: 1516227 - RNA, 17 nt, Human
gccccugccacccuggg

SEQ ID NO: 1516228 - RNA, 16 nt, Human
gccccugccacccugg

SEQ ID NO: 1516229 - RNA, 12 nt, Human
gcccccacuggu

SEQ ID NO: 1516230 - RNA, 23 nt, Human
gcccgggcucugccucccaucac

SEQ ID NO: 1516231 - RNA, 18 nt, Human
gcccucaccccugguucu

SEQ ID NO: 1516232 - RNA, 21 nt, Human
gcccucaccccugguucucau

SEQ ID NO: 1516233 - RNA, 22 nt, Human
gcccucaccccugguucucauc

SEQ ID NO: 1516234 - RNA, 22 nt, Human
gcgaucuggguucacugcaacc

SEQ ID NO: 1516235 - RNA, 20 nt, Human
gcgcagcauauucaggaagc

SEQ ID NO: 1516236 - RNA, 17 nt, Human
gcgagcccugguggcag

SEQ ID NO: 1516237 - RNA, 21 nt, Human
gccuucggccuccauccugag

SEQ ID NO: 1516238 - RNA, 23 nt, Human
gccuucggccuccauccugaggc

SEQ ID NO: 1516239 - RNA, 20 nt, Human
gccuucggccuccauccuga

SEQ ID NO: 1516240 - RNA, 21 nt, Human
gccuguugggccaggagccuc

SEQ ID NO: 1516241 - RNA, 17 nt, Human
gccuugaccauucucca

SEQ ID NO: 1516242 - RNA, 19 nt, Human
gccuugaccauucuccacc

SEQ ID NO: 1516243 - RNA, 20 nt, Human
gccuugaccauucuccaccu

SEQ ID NO: 1516244 - RNA, 21 nt, Human
gccuugaccauucuccaccug

SEQ ID NO: 1516245 - RNA, 18 nt, Human
gccugugccucugggacu

SEQ ID NO: 1516246 - RNA, 13 nt, Human
gccuggcucaggu

SEQ ID NO: 1516247 - RNA, 16 nt, Human
gccugugccucuggga

SEQ ID NO: 1516248 - RNA, 17 nt, Human
gccugugccucugggac

SEQ ID NO: 1516249 - RNA, 14 nt, Human
gccuguugggccag

SEQ ID NO: 1516250 - RNA, 15 nt, Human
gccuguugggccagg

SEQ ID NO: 1516251 - RNA, 16 nt, Human
gccuguugggccagga

SEQ ID NO: 1516252 - RNA, 18 nt, Human
gccuguugggccaggagc

SEQ ID NO: 1516253 - RNA, 20 nt, Human
gccuguugggccaggagccu

SEQ ID NO: 1516254 - RNA, 20 nt, Human
gccuggccugagcugggaug

SEQ ID NO: 1516255 - RNA, 13 nt, Human
gccuggccugagc

SEQ ID NO: 1516256 - RNA, 14 nt, Human
gccuggccugagcu

SEQ ID NO: 1516257 - RNA, 18 nt, Human
gccuggccugagcuggga

SEQ ID NO: 1516258 - RNA, 17 nt, Human
gccucgaacuggcugca

SEQ ID NO: 1516259 - RNA, 19 nt, Human
gccuccugugugugcgccu

SEQ ID NO: 1516260 - RNA, 23 nt, Human
gccuccugugugugcgccuacag

SEQ ID NO: 1516261 - RNA, 16 nt, Human
gccucccaaagugcug

SEQ ID NO: 1516262 - RNA, 17 nt, Human
gccucccaaagugcugg

SEQ ID NO: 1516263 - RNA, 12 nt, Human
gccuccauccug

SEQ ID NO: 1516264 - RNA, 21 nt, Human
gccuccagggcuggacugagg

SEQ ID NO: 1516265 - RNA, 22 nt, Human
gccuccagggcuggacugaggc

SEQ ID NO: 1516266 - RNA, 23 nt, Human
gccuccagggcuggacugaggcc

SEQ ID NO: 1516267 - RNA, 24 nt, Human
gccuccagggcuggacugaggccu

SEQ ID NO: 1516268 - RNA, 15 nt, Human
gccucuuagaugcag

SEQ ID NO: 1516269 - RNA, 16 nt, Human
gccucuuaugggcugg

SEQ ID NO: 1516270 - RNA, 17 nt, Human
gccucuuaugggcuggg

SEQ ID NO: 1516271 - RNA, 18 nt, Human
gccucuuaugggcugggu

SEQ ID NO: 1516272 - RNA, 20 nt, Human
gccucgaacuggcugcaaag

SEQ ID NO: 1516273 - RNA, 22 nt, Human
gccucgaacuggcugcaaaggg

SEQ ID NO: 1516274 - RNA, 14 nt, Human
gccucuuggguuca

SEQ ID NO: 1516275 - RNA, 21 nt, Human
gccucuuaugggcuggguucu

SEQ ID NO: 1516276 - RNA, 13 nt, Human
gccugcccaggcc

SEQ ID NO: 1516277 - RNA, 14 nt, Human
gccugcccaggccc

SEQ ID NO: 1516278 - RNA, 22 nt, Human
gccugcccaggccccugccacc

SEQ ID NO: 1516279 - RNA, 15 nt, Human
gccugcccaggcccc

SEQ ID NO: 1516280 - RNA, 17 nt, Human
gccugcccaggccccug

SEQ ID NO: 1516281 - RNA, 9 nt, Human
ggacuuugu

SEQ ID NO: 1516282 - RNA, 13 nt, Human
ggagaaacuggaa

SEQ ID NO: 1516283 - RNA, 16 nt, Human
ggagaaaggaagggcu

SEQ ID NO: 1516284 - RNA, 15 nt, Human
ggacuuggaagcucc

SEQ ID NO: 1516285 - RNA, 14 nt, Human
ggacuuggaagcuc

SEQ ID NO: 1516286 - RNA, 22 nt, Human
ggacucauuuuaaaaaauggaa

SEQ ID NO: 1516287 - RNA, 16 nt, Human
ggacucaaugcacuga

SEQ ID NO: 1516288 - RNA, 18 nt, Human
ggacucaaugcacugaca

SEQ ID NO: 1516289 - RNA, 15 nt, Human
ggacucaaugcacug

SEQ ID NO: 1516290 - RNA, 24 nt, Human
ggacuaacuugucuuuggacccug

SEQ ID NO: 1516291 - RNA, 14 nt, Human
ggacuacaggugug

SEQ ID NO: 1516292 - RNA, 20 nt, Human
ggacuaacuugucuuuggac

SEQ ID NO: 1516293 - RNA, 12 nt, Human
ggacccugaggc

SEQ ID NO: 1516294 - RNA, 13 nt, Human
ggacccugaggcc

SEQ ID NO: 1516295 - RNA, 13 nt, Human
ggaccucaggccu

SEQ ID NO: 1516296 - RNA, 20 nt, Human
ggaccucaggccugggggcu

SEQ ID NO: 1516297 - RNA, 14 nt, Human
ggaccucaggccug

SEQ ID NO: 1516298 - RNA, 15 nt, Human
ggaccucaggccugg

SEQ ID NO: 1516299 - RNA, 20 nt, Human
ggacguguuaugacuccaga

SEQ ID NO: 1516300 - RNA, 11 nt, Human
ggacccugagg

SEQ ID NO: 1516301 - RNA, 12 nt, Human
ggacccccugaa

SEQ ID NO: 1516302 - RNA, 21 nt, Human
ggacaggaccccagcucugcg

SEQ ID NO: 1516303 - RNA, 18 nt, Human
ggacaggaccccagcucu

SEQ ID NO: 1516304 - RNA, 20 nt, Human
ggacaggaccccagcucugc

SEQ ID NO: 1516305 - RNA, 23 nt, Human
ggacaggcauguucucugaggac

SEQ ID NO: 1516306 - RNA, 19 nt, Human
ggaaggaaacccagcucug

SEQ ID NO: 1516307 - RNA, 20 nt, Human
ggaaggaaacccagcucugg

SEQ ID NO: 1516308 - RNA, 16 nt, Human
ggaaggaaacccagcu

SEQ ID NO: 1516309 - RNA, 11 nt, Human
ggaagcuccgc

SEQ ID NO: 1516310 - RNA, 15 nt, Human
ggaagcucagggccu

SEQ ID NO: 1516311 - RNA, 23 nt, Human
ggaagcucagggccuggcucagg

SEQ ID NO: 1516312 - RNA, 15 nt, Human
ggaagccgcuggggc

SEQ ID NO: 1516313 - RNA, 19 nt, Human
ggaaugaagauacugaaau

SEQ ID NO: 1516314 - RNA, 13 nt, Human
ggacaagagcagg

SEQ ID NO: 1516315 - RNA, 22 nt, Human
ggacaaggaugaucuaggaaga

SEQ ID NO: 1516316 - RNA, 23 nt, Human
ggacaaggaugaucuaggaagac

SEQ ID NO: 1516317 - RNA, 16 nt, Human
ggaauccagacccggc

SEQ ID NO: 1516318 - RNA, 18 nt, Human
ggaauaacauguaauuaa

SEQ ID NO: 1516319 - RNA, 21 nt, Human
ggaaguuuuguggaggagcuc

SEQ ID NO: 1516320 - RNA, 21 nt, Human
ggacacagcucuucuccaggc

SEQ ID NO: 1516321 - RNA, 15 nt, Human
ggacacagcucuucu

SEQ ID NO: 1516322 - RNA, 18 nt, Human
ggacacagcucuucucca

SEQ ID NO: 1516323 - RNA, 14 nt, Human
ggacaggaccccag

SEQ ID NO: 1516324 - RNA, 15 nt, Human
ggacaggaccccagc

SEQ ID NO: 1516325 - RNA, 16 nt, Human
ggacaggaccccagcu

SEQ ID NO: 1516326 - RNA, 17 nt, Human
ggacaggaccccagcuc

SEQ ID NO: 1516327 - RNA, 20 nt, Human
ggacagcuccuucuguccua

SEQ ID NO: 1516328 - RNA, 17 nt, Human
ggacacuaaccacgcug

SEQ ID NO: 1516329 - RNA, 22 nt, Human
ggacacuaaccacgcuggaccu

SEQ ID NO: 1516330 - RNA, 19 nt, Human
ggacagcuccuucuguccu

SEQ ID NO: 1516331 - RNA, 15 nt, Human
ggaagagaaaaaaua

SEQ ID NO: 1516332 - RNA, 18 nt, Human
ggaagacuuuggaaagag

SEQ ID NO: 1516333 - RNA, 13 nt, Human
ggaagagaaaaaa

SEQ ID NO: 1516334 - RNA, 13 nt, Human
ggaagacuuugga

SEQ ID NO: 1516335 - RNA, 17 nt, Human
ggaagacuuuggaaaga

SEQ ID NO: 1516336 - RNA, 13 nt, Human
ggaagacagcucu

SEQ ID NO: 1516337 - RNA, 14 nt, Human
ggaagacagcucuu

SEQ ID NO: 1516338 - RNA, 15 nt, Human
ggaacacucugagac

SEQ ID NO: 1516339 - RNA, 16 nt, Human
ggaacacucugagacu

SEQ ID NO: 1516340 - RNA, 17 nt, Human
ggaacagacuggaagca

SEQ ID NO: 1516341 - RNA, 12 nt, Human
ggaacacucuga

SEQ ID NO: 1516342 - RNA, 14 nt, Human
ggaacacucugaga

SEQ ID NO: 1516343 - RNA, 18 nt, Human
gcuggagugcagugagcc

SEQ ID NO: 1516344 - RNA, 17 nt, Human
gcuggagugcagugagc

SEQ ID NO: 1516345 - RNA, 22 nt, Human
gcuggagugcagugagccgaga

SEQ ID NO: 1516346 - RNA, 20 nt, Human
gcuggccuggccccucaggg

SEQ ID NO: 1516347 - RNA, 18 nt, Human
gcugcugaaggcucgagc

SEQ ID NO: 1516348 - RNA, 13 nt, Human
gcugcuggcuggu

SEQ ID NO: 1516349 - RNA, 13 nt, Human
gcucugcccuugg

SEQ ID NO: 1516350 - RNA, 15 nt, Human
gcucugguccauaga

SEQ ID NO: 1516351 - RNA, 16 nt, Human
gcucugguccauagag

SEQ ID NO: 1516352 - RNA, 23 nt, Human
gcucugguccauagagagcaaga

SEQ ID NO: 1516353 - RNA, 13 nt, Human
gcugcugaaggcu

SEQ ID NO: 1516354 - RNA, 14 nt, Human
gcugcugaaggcuc

SEQ ID NO: 1516355 - RNA, 15 nt, Human
gcugcugaaggcucg

SEQ ID NO: 1516356 - RNA, 12 nt, Human
gcugggcucccu

SEQ ID NO: 1516357 - RNA, 15 nt, Human
gcuggcuguuggcug

SEQ ID NO: 1516358 - RNA, 16 nt, Human
gcuggcuguuggcugg

SEQ ID NO: 1516359 - RNA, 17 nt, Human
gcuggcuguuggcuggg

SEQ ID NO: 1516360 - RNA, 21 nt, Human
gcuggguggcaccagcagccu

SEQ ID NO: 1516361 - RNA, 22 nt, Human
gcuggguggcaccagcagccug

SEQ ID NO: 1516362 - RNA, 23 nt, Human
gcuggguggcaccagcagccugg

SEQ ID NO: 1516363 - RNA, 19 nt, Human
gcuucaaggauccugagcc

SEQ ID NO: 1516364 - RNA, 20 nt, Human
gcuucaaggauccugagcca

SEQ ID NO: 1516365 - RNA, 21 nt, Human
gcuucaaggauccugagccag

SEQ ID NO: 1516366 - RNA, 17 nt, Human
gcuucacggaagagccu

SEQ ID NO: 1516367 - RNA, 19 nt, Human
gcuucacggaagagccuug

SEQ ID NO: 1516368 - RNA, 18 nt, Human
gcuucacggaagagccuu

SEQ ID NO: 1516369 - RNA, 12 nt, Human
gcuucagccucc

SEQ ID NO: 1516370 - RNA, 22 nt, Human
gcuuccucauaguaugguggcu

SEQ ID NO: 1516371 - RNA, 12 nt, Human
gcuuguacauaa

SEQ ID NO: 1516372 - RNA, 14 nt, Human
gcuugagcucagga

SEQ ID NO: 1516373 - RNA, 20 nt, Human
gcuuguaaauagcucaggug

SEQ ID NO: 1516374 - RNA, 21 nt, Human
guacuucaaauccuugaagau

SEQ ID NO: 1516375 - RNA, 22 nt, Human
guacuucaaauccuugaagauu

SEQ ID NO: 1516376 - RNA, 15 nt, Human
guacuucaugcuguc

SEQ ID NO: 1516377 - RNA, 14 nt, Human
guacuuaacuauuc

SEQ ID NO: 1516378 - RNA, 16 nt, Human
guacuggagaaaaugg

SEQ ID NO: 1516379 - RNA, 15 nt, Human
guacuauguaucaau

SEQ ID NO: 1516380 - RNA, 17 nt, Human
guacuauguaucaauga

SEQ ID NO: 1516381 - RNA, 13 nt, Human
guacuauguauca

SEQ ID NO: 1516382 - RNA, 13 nt, Human
guacccacugcuc

SEQ ID NO: 1516383 - RNA, 14 nt, Human
guacccacugcucu

SEQ ID NO: 1516384 - RNA, 18 nt, Human
guacuacaguccucccau

SEQ ID NO: 1516385 - RNA, 19 nt, Human
guacuacaguccucccauc

SEQ ID NO: 1516386 - RNA, 11 nt, Human
guagagacagg

SEQ ID NO: 1516387 - RNA, 12 nt, Human
guagagacaggg

SEQ ID NO: 1516388 - RNA, 15 nt, Human
guagagccagggucu

SEQ ID NO: 1516389 - RNA, 18 nt, Human
guagagccagggucucac

SEQ ID NO: 1516390 - RNA, 13 nt, Human
guagagacagggu

SEQ ID NO: 1516391 - RNA, 10 nt, Human
guagagccag

SEQ ID NO: 1516392 - RNA, 11 nt, Human
guagagccagg

SEQ ID NO: 1516393 - RNA, 21 nt, Human
guagaagucuuagauguauau

SEQ ID NO: 1516394 - RNA, 18 nt, Human
guagaagcccuucuaccu

SEQ ID NO: 1516395 - RNA, 20 nt, Human
guagaaauaucugaaaaugu

SEQ ID NO: 1516396 - RNA, 21 nt, Human
guagaaauaucugaaaaugua

SEQ ID NO: 1516397 - RNA, 23 nt, Human
guagaaauaucugaaaauguaug

SEQ ID NO: 1516398 - RNA, 22 nt, Human
guagaacacaaggucauuugcu

SEQ ID NO: 1516399 - RNA, 15 nt, Human
aaauccauacauuug

SEQ ID NO: 1516400 - RNA, 18 nt, Human
aaauccauacauuugugu

SEQ ID NO: 1516401 - RNA, 16 nt, Human
guacaugaaaacacau

SEQ ID NO: 1516402 - RNA, 15 nt, Human
guacaugaaaacaca

SEQ ID NO: 1516403 - RNA, 14 nt, Human
guacaugaaaacac

SEQ ID NO: 1516404 - RNA, 20 nt, Human
guacaugaaaacacauuuuu

SEQ ID NO: 1516405 - RNA, 19 nt, Human
guacaugaaaacacauuuu

SEQ ID NO: 1516406 - RNA, 18 nt, Human
guacaugaaaacacauuu

SEQ ID NO: 1516407 - RNA, 17 nt, Human
guacaugaaaacacauu

SEQ ID NO: 1516408 - RNA, 19 nt, Human
guacauggaauaacaugua

SEQ ID NO: 1516409 - RNA, 15 nt, Human
guacauuuggagaca

SEQ ID NO: 1516410 - RNA, 12 nt, Human
guacccacugcu

SEQ ID NO: 1516411 - RNA, 15 nt, Human
aaauauuauguguuu

SEQ ID NO: 1516412 - RNA, 17 nt, Human
aaauauuauguuaaaac

SEQ ID NO: 1516413 - RNA, 14 nt, Human
aaauauuauguguu

SEQ ID NO: 1516414 - RNA, 15 nt, Human
aaauauuauaacuca

SEQ ID NO: 1516415 - RNA, 19 nt, Human
aaaucauuucugcaucagc

SEQ ID NO: 1516416 - RNA, 21 nt, Human
aaaucauuucugcaucagcug

SEQ ID NO: 1516417 - RNA, 22 nt, Human
aaaucauuucugcaucagcugc

SEQ ID NO: 1516418 - RNA, 23 nt, Human
aaaucauuucugcaucagcugcu

SEQ ID NO: 1516419 - RNA, 12 nt, Human
aaaucauuucug

SEQ ID NO: 1516420 - RNA, 19 nt, Human
aaaucagccguguaaccau

SEQ ID NO: 1516421 - RNA, 12 nt, Human
aaaucagccugc

SEQ ID NO: 1516422 - RNA, 18 nt, Human
aaaucagccugcuccagc

SEQ ID NO: 1516423 - RNA, 20 nt, Human
guaauaggcguaacuaauuu

SEQ ID NO: 1516424 - RNA, 15 nt, Human
guaauaacugugaag

SEQ ID NO: 1516425 - RNA, 16 nt, Human
guaauaacugugaagu

SEQ ID NO: 1516426 - RNA, 22 nt, Human
guaauaacugugaaguuuacau

SEQ ID NO: 1516427 - RNA, 18 nt, Human
guaauaugcacacauuuu

SEQ ID NO: 1516428 - RNA, 17 nt, Human
guaauaugcacacauuu

SEQ ID NO: 1516429 - RNA, 16 nt, Human
guaauaugcacacauu

SEQ ID NO: 1516430 - RNA, 14 nt, Human
guaauaugcacaca

SEQ ID NO: 1516431 - RNA, 22 nt, Human
aaauacgugggcauucaaaugu

SEQ ID NO: 1516432 - RNA, 18 nt, Human
aaauaccagccaguaaau

SEQ ID NO: 1516433 - RNA, 17 nt, Human
aaauacagauagauaua

SEQ ID NO: 1516434 - RNA, 19 nt, Human
aaauacacacucaaaucaa

SEQ ID NO: 1516435 - RNA, 22 nt, Human
aaauaauuuuuauauuugaaau

SEQ ID NO: 1516436 - RNA, 23 nt, Human
aaauaauuuuuauauuugaaaua

SEQ ID NO: 1516437 - RNA, 15 nt, Human
aaauacacacucaaa

SEQ ID NO: 1516438 - RNA, 23 nt, Human
guacacugccuucucaacuccaa

SEQ ID NO: 1516439 - RNA, 21 nt, Human
aaauaauuuuuauauuugaaa

SEQ ID NO: 1516440 - RNA, 21 nt, Human
guaauuuuuuuaucgucacug

SEQ ID NO: 1516441 - RNA, 14 nt, Human
aaauaaaaauauug

SEQ ID NO: 1516442 - RNA, 18 nt, Human
aaaguauguuagugcaaa

SEQ ID NO: 1516443 - RNA, 18 nt, Human
aaaguaucccuacuguaa

SEQ ID NO: 1516444 - RNA, 23 nt, Human
aaaguacuucuccacccugcucu

SEQ ID NO: 1516445 - RNA, 20 nt, Human
aaaguacuucuccacccugc

SEQ ID NO: 1516446 - RNA, 21 nt, Human
aaaguacuucuccacccugcu

SEQ ID NO: 1516447 - RNA, 19 nt, Human
aaaguacuucuccacccug

SEQ ID NO: 1516448 - RNA, 20 nt, Human
aaaguacacuguuucaaacu

SEQ ID NO: 1516449 - RNA, 20 nt, Human
aaagguauuuuaaucaccaa

SEQ ID NO: 1516450 - RNA, 23 nt, Human
aaaguucugcagauaaacaguag

SEQ ID NO: 1516451 - RNA, 20 nt, Human
aaaguuauugauaaguucau

SEQ ID NO: 1516452 - RNA, 13 nt, Human
gguggaugccugg

SEQ ID NO: 1516453 - RNA, 21 nt, Human
ggugcauuugaggucuguucu

SEQ ID NO: 1516454 - RNA, 14 nt, Human
ggugaaaauuauuu

SEQ ID NO: 1516455 - RNA, 22 nt, Human
ggugaaaauuauuuuguucaua

SEQ ID NO: 1516456 - RNA, 13 nt, Human
ggugaacagaaca

SEQ ID NO: 1516457 - RNA, 13 nt, Human
ggucgaggcagga

SEQ ID NO: 1516458 - RNA, 18 nt, Human
ggugauccacccaccuca

SEQ ID NO: 1516459 - RNA, 23 nt, Human
ggugauccacccaccucagccuc

SEQ ID NO: 1516460 - RNA, 24 nt, Human
ggugauccacccaccucagccucc

SEQ ID NO: 1516461 - RNA, 12 nt, Human
ggugcaaugacc

SEQ ID NO: 1516462 - RNA, 13 nt, Human
ggugcaaugaccu

SEQ ID NO: 1516463 - RNA, 16 nt, Human
ggugcaaugaccuuuc

SEQ ID NO: 1516464 - RNA, 14 nt, Human
aaagguacuucaaa

SEQ ID NO: 1516465 - RNA, 17 nt, Human
aaagggugaaaauuauu

SEQ ID NO: 1516466 - RNA, 22 nt, Human
aaagggacuuggaagcuccgcu

SEQ ID NO: 1516467 - RNA, 20 nt, Human
aaagggauggcaagaugugg

SEQ ID NO: 1516468 - RNA, 17 nt, Human
aaaggagauuggaagga

SEQ ID NO: 1516469 - RNA, 21 nt, Human
aaaggagagcuagcagcaggg

SEQ ID NO: 1516470 - RNA, 22 nt, Human
aaaggaaagagggagguaagga

SEQ ID NO: 1516471 - RNA, 13 nt, Human
aaagcugcugaca

SEQ ID NO: 1516472 - RNA, 15 nt, Human
aaagcuuguuaagau

SEQ ID NO: 1516473 - RNA, 17 nt, Human
aaagcacugacuucuaa

SEQ ID NO: 1516474 - RNA, 21 nt, Human
aaagcacugacuucuaaguaa

SEQ ID NO: 1516475 - RNA, 15 nt, Human
aaagcucacuuuacu

SEQ ID NO: 1516476 - RNA, 13 nt, Human
aaagacagugaaa

SEQ ID NO: 1516477 - RNA, 14 nt, Human
aaagacagagcugg

SEQ ID NO: 1516478 - RNA, 22 nt, Human
aaagaccuuuggagcaaagcug

SEQ ID NO: 1516479 - RNA, 18 nt, Human
aaagacuauucaaacagu

SEQ ID NO: 1516480 - RNA, 19 nt, Human
aaagacuauucaaacaguc

SEQ ID NO: 1516481 - RNA, 21 nt, Human
aaagacuauucaaacagucuc

SEQ ID NO: 1516482 - RNA, 15 nt, Human
aaagacuccaaagaa

SEQ ID NO: 1516483 - RNA, 21 nt, Human
aaagacuccaaagaaauguaa

SEQ ID NO: 1516484 - RNA, 23 nt, Human
aaacuucagcgguuuauauaagc

SEQ ID NO: 1516485 - RNA, 14 nt, Human
ggguggccucccaa

SEQ ID NO: 1516486 - RNA, 14 nt, Human
aaagacuguacaaa

SEQ ID NO: 1516487 - RNA, 23 nt, Human
aaagacugaguacguugugcauu

SEQ ID NO: 1516488 - RNA, 13 nt, Human
aaagacuguacaa

SEQ ID NO: 1516489 - RNA, 19 nt, Human
aaagaugcuucucacugcc

SEQ ID NO: 1516490 - RNA, 17 nt, Human
aaagaugcuucucacug

SEQ ID NO: 1516491 - RNA, 14 nt, Human
aaagaugcuucuca

SEQ ID NO: 1516492 - RNA, 15 nt, Human
aaagaggaaugaagu

SEQ ID NO: 1516493 - RNA, 15 nt, Human
aaagaggcagcuuga

SEQ ID NO: 1516494 - RNA, 15 nt, Human
gguccugcagccugc

SEQ ID NO: 1516495 - RNA, 14 nt, Human
gguccugcugcagu

SEQ ID NO: 1516496 - RNA, 12 nt, Human
gguccugcugca

SEQ ID NO: 1516497 - RNA, 16 nt, Human
gguccugcagccugca

SEQ ID NO: 1516498 - RNA, 11 nt, Human
gguccugcugc

SEQ ID NO: 1516499 - RNA, 15 nt, Human
aaacgggcucagcaa

SEQ ID NO: 1516500 - RNA, 23 nt, Human
aaaccaagucaagugaaaaagga

SEQ ID NO: 1516501 - RNA, 15 nt, Human
aaaccacagcaguug

SEQ ID NO: 1516502 - RNA, 12 nt, Human
aaaccacagcag

SEQ ID NO: 1516503 - RNA, 15 nt, Human
aaacucguuaauuug

SEQ ID NO: 1516504 - RNA, 13 nt, Human
aaacgucuuaaau

SEQ ID NO: 1516505 - RNA, 14 nt, Human
aaacgucuuaaaua

SEQ ID NO: 1516506 - RNA, 19 nt, Human
aaacuuaaucuaaauggaa

SEQ ID NO: 1516507 - RNA, 18 nt, Human
aaacuuaaucuaaaugga

SEQ ID NO: 1516508 - RNA, 17 nt, Human
aaacuuaaucuaaaugg

SEQ ID NO: 1516509 - RNA, 16 nt, Human
aaacuuaaucuaaaug

SEQ ID NO: 1516510 - RNA, 19 nt, Human
aaacuguuaauaguucagg

SEQ ID NO: 1516511 - RNA, 13 nt, Human
aaacucuccucug

SEQ ID NO: 1516512 - RNA, 19 nt, Human
ggggaauugaggacacuga

SEQ ID NO: 1516513 - RNA, 15 nt, Human
ggggaauucaucucu

SEQ ID NO: 1516514 - RNA, 16 nt, Human
ggggaccagagcugcc

SEQ ID NO: 1516515 - RNA, 18 nt, Human
ggggaauguuugccucug

SEQ ID NO: 1516516 - RNA, 22 nt, Human
ggggaauguuugccucugccuc

SEQ ID NO: 1516517 - RNA, 17 nt, Human
aaacauggccuuugcuu

SEQ ID NO: 1516518 - RNA, 20 nt, Human
aaacagucucaggaaaucaa

SEQ ID NO: 1516519 - RNA, 14 nt, Human
aaacaguagugaua

SEQ ID NO: 1516520 - RNA, 16 nt, Human
aaacauggccuuugcu

SEQ ID NO: 1516521 - RNA, 15 nt, Human
aaacagucucaggaa

SEQ ID NO: 1516522 - RNA, 15 nt, Human
ggggccucagugcca

SEQ ID NO: 1516523 - RNA, 12 nt, Human
gggggccucagu

SEQ ID NO: 1516524 - RNA, 15 nt, Human
gggggccucagugcc

SEQ ID NO: 1516525 - RNA, 17 nt, Human
gggggccucagugccac

SEQ ID NO: 1516526 - RNA, 18 nt, Human
gggggccucagugccacu

SEQ ID NO: 1516527 - RNA, 16 nt, Human
ggggccggccaguggc

SEQ ID NO: 1516528 - RNA, 11 nt, Human
ggggagaaagu

SEQ ID NO: 1516529 - RNA, 13 nt, Human
ggggaccucaggc

SEQ ID NO: 1516530 - RNA, 20 nt, Human
aaaauuuugauguuuuaagg

SEQ ID NO: 1516531 - RNA, 19 nt, Human
aaaauuuagaaauauaauu

SEQ ID NO: 1516532 - RNA, 13 nt, Human
gggaugagaaagg

SEQ ID NO: 1516533 - RNA, 19 nt, Human
aaacacaaacgggcucagc

SEQ ID NO: 1516534 - RNA, 11 nt, Human
aaacacagcaa

SEQ ID NO: 1516535 - RNA, 12 nt, Human
aaacacauuuuu

SEQ ID NO: 1516536 - RNA, 11 nt, Human
aaacacauuuu

SEQ ID NO: 1516537 - RNA, 12 nt, Human
aaacacagcaag

SEQ ID NO: 1516538 - RNA, 14 nt, Human
aaacacagcaaggg

SEQ ID NO: 1516539 - RNA, 20 nt, Human
gggacagucaccucauggaa

SEQ ID NO: 1516540 - RNA, 21 nt, Human
gggacagucaccucauggaau

SEQ ID NO: 1516541 - RNA, 22 nt, Human
gggacagucaccucauggaauu

SEQ ID NO: 1516542 - RNA, 15 nt, Human
gggacagcuccuucu

SEQ ID NO: 1516543 - RNA, 16 nt, Human
gggacagcuccuucug

SEQ ID NO: 1516544 - RNA, 13 nt, Human
gggaagagacuug

SEQ ID NO: 1516545 - RNA, 12 nt, Human
gggacagcuccu

SEQ ID NO: 1516546 - RNA, 13 nt, Human
gggacagcuccuu

SEQ ID NO: 1516547 - RNA, 21 nt, Human
ggcuuccuccugguguggaag

SEQ ID NO: 1516548 - RNA, 18 nt, Human
gggaagaagcucucuccu

SEQ ID NO: 1516549 - RNA, 20 nt, Human
gggaacccaaguccaagcau

SEQ ID NO: 1516550 - RNA, 19 nt, Human
ggcuggguggcaccagcag

SEQ ID NO: 1516551 - RNA, 19 nt, Human
ggcuggguucuacccaggu

SEQ ID NO: 1516552 - RNA, 21 nt, Human
ggcuggguucuacccaggugc

SEQ ID NO: 1516553 - RNA, 14 nt, Human
aaaaauaacaauga

SEQ ID NO: 1516554 - RNA, 15 nt, Human
ggcugggggccucag

SEQ ID NO: 1516555 - RNA, 16 nt, Human
ggcugggggccucagu

SEQ ID NO: 1516556 - RNA, 17 nt, Human
ggcugggggccucagug

SEQ ID NO: 1516557 - RNA, 19 nt, Human
ggcugggggccucagugcc

SEQ ID NO: 1516558 - RNA, 18 nt, Human
ggcuguaucccaugagcc

SEQ ID NO: 1516559 - RNA, 22 nt, Human
ggcuggguucuacccaggugcu

SEQ ID NO: 1516560 - RNA, 22 nt, Human
ggcugguucggauuuggggugg

SEQ ID NO: 1516561 - RNA, 23 nt, Human
ggcugguucggauuuggggugga

SEQ ID NO: 1516562 - RNA, 18 nt, Human
ggcuucaguggcagcugc

SEQ ID NO: 1516563 - RNA, 19 nt, Human
ggcuucaguggcagcugcu

SEQ ID NO: 1516564 - RNA, 20 nt, Human
ggcuucaguggcagcugcuu

SEQ ID NO: 1516565 - RNA, 22 nt, Human
ggcuucauccuccucagaucuu

SEQ ID NO: 1516566 - RNA, 18 nt, Human
ggcuucauccuccucaga

SEQ ID NO: 1516567 - RNA, 16 nt, Human
ggcuuccucauaguau

SEQ ID NO: 1516568 - RNA, 21 nt, Human
gggagaaccaaaaagaggcua

SEQ ID NO: 1516569 - RNA, 15 nt, Human
gggacuuggaagcuc

SEQ ID NO: 1516570 - RNA, 17 nt, Human
gggacuuggaagcuccg

SEQ ID NO: 1516571 - RNA, 18 nt, Human
gggacuuggaagcuccgc

SEQ ID NO: 1516572 - RNA, 23 nt, Human
gggacuuggaagcuccgcuuucu

SEQ ID NO: 1516573 - RNA, 15 nt, Human
gggaggucgaggcag

SEQ ID NO: 1516574 - RNA, 18 nt, Human
gggaggucaaggcugcag

SEQ ID NO: 1516575 - RNA, 15 nt, Human
gggagggagggcucc

SEQ ID NO: 1516576 - RNA, 16 nt, Human
gggagggagggcucca

SEQ ID NO: 1516577 - RNA, 23 nt, Human
gggagcaggcucgggcuccccag

SEQ ID NO: 1516578 - RNA, 15 nt, Human
gggagagccuuccag

SEQ ID NO: 1516579 - RNA, 19 nt, Human
gggagagccuuccaggggu

SEQ ID NO: 1516580 - RNA, 19 nt, Human
gggacauuugcucauggaa

SEQ ID NO: 1516581 - RNA, 14 nt, Human
gggaccagagcugc

SEQ ID NO: 1516582 - RNA, 20 nt, Human
gggaccagagcugccaccug

SEQ ID NO: 1516583 - RNA, 17 nt, Human
aaaaaugguuuaaaugg

SEQ ID NO: 1516584 - RNA, 14 nt, Human
aaaacaugcuacac

SEQ ID NO: 1516585 - RNA, 13 nt, Human
aaaacaugcuaca

SEQ ID NO: 1516586 - RNA, 12 nt, Human
aaaacccaagug

SEQ ID NO: 1516587 - RNA, 14 nt, Human
aaaacguggcugcu

SEQ ID NO: 1516588 - RNA, 18 nt, Human
aaaacucuccucugcugc

SEQ ID NO: 1516589 - RNA, 21 nt, Human
aaaagauuuucagaaaauauu

SEQ ID NO: 1516590 - RNA, 15 nt, Human
aaaacuucagacaua

SEQ ID NO: 1516591 - RNA, 22 nt, Human
aaaacuugauguguuaucucuu

SEQ ID NO: 1516592 - RNA, 19 nt, Human
ggcucagcaaaagaugcuu

SEQ ID NO: 1516593 - RNA, 18 nt, Human
ggcucagcggggacagcu

SEQ ID NO: 1516594 - RNA, 19 nt, Human
ggcucagcggggacagcuc

SEQ ID NO: 1516595 - RNA, 20 nt, Human
ggcucagcggggacagcucc

SEQ ID NO: 1516596 - RNA, 19 nt, Human
ggcucagguggggucacuc

SEQ ID NO: 1516597 - RNA, 20 nt, Human
ggcucagguggggucacucu

SEQ ID NO: 1516598 - RNA, 14 nt, Human
ggcuccacuugguc

SEQ ID NO: 1516599 - RNA, 16 nt, Human
ggcuccacuuggucug

SEQ ID NO: 1516600 - RNA, 18 nt, Human
ggcugggagagccuucca

SEQ ID NO: 1516601 - RNA, 13 nt, Human
ggcugcugaaggc

SEQ ID NO: 1516602 - RNA, 14 nt, Human
ggcugggagagccu

SEQ ID NO: 1516603 - RNA, 15 nt, Human
ggcugggagagccuu

SEQ ID NO: 1516604 - RNA, 16 nt, Human
ggcugggagagccuuc

SEQ ID NO: 1516605 - RNA, 11 nt, Human
ggcucucaggc

SEQ ID NO: 1516606 - RNA, 14 nt, Human
ggcucuuccaggcu

SEQ ID NO: 1516607 - RNA, 12 nt, Human
ggcucuuccagg

SEQ ID NO: 1516608 - RNA, 14 nt, Human
ggcucucaggccag

SEQ ID NO: 1516609 - RNA, 13 nt, Human
ggcucucaggcca

SEQ ID NO: 1516610 - RNA, 22 nt, Human
ggcugcggaaugaaccacaucu

SEQ ID NO: 1516611 - RNA, 21 nt, Human
ggcugccaaugggagcucaug

SEQ ID NO: 1516612 - RNA, 19 nt, Human
ggcugccaaugggagcuca

SEQ ID NO: 1516613 - RNA, 20 nt, Human
ggcugccaaugggagcucau

SEQ ID NO: 1516614 - RNA, 16 nt, Human
ggagagaagagaaugc

SEQ ID NO: 1516615 - RNA, 11 nt, Human
ggcagccccug

SEQ ID NO: 1516616 - RNA, 20 nt, Human
ggcacagaaaauggaagaca

SEQ ID NO: 1516617 - RNA, 21 nt, Human
ggcacagaaaauggaagacag

SEQ ID NO: 1516618 - RNA, 23 nt, Human
ggcacagaaaauggaagacagcu

SEQ ID NO: 1516619 - RNA, 21 nt, Human
ggcacaguuuucugagaaaga

SEQ ID NO: 1516620 - RNA, 13 nt, Human
ggcacaucagcac

SEQ ID NO: 1516621 - RNA, 23 nt, Human
ggcacucagaagacacugauggg

SEQ ID NO: 1516622 - RNA, 22 nt, Human
ggcagccccuguucuggcagag

SEQ ID NO: 1516623 - RNA, 21 nt, Human
ggcaguggugguuuucuguuc

SEQ ID NO: 1516624 - RNA, 20 nt, Human
ggcaguggugguuuucuguu

SEQ ID NO: 1516625 - RNA, 22 nt, Human
ggccagugcaguuugguguguc

SEQ ID NO: 1516626 - RNA, 20 nt, Human
ggccagugugacaaggauug

SEQ ID NO: 1516627 - RNA, 14 nt, Human
ggccaguugguccc

SEQ ID NO: 1516628 - RNA, 17 nt, Human
ggccaguuggucccccu

SEQ ID NO: 1516629 - RNA, 22 nt, Human
ggcccuucucuccagccccugg

SEQ ID NO: 1516630 - RNA, 23 nt, Human
ggcccuucucuccagccccugga

SEQ ID NO: 1516631 - RNA, 14 nt, Human
ggccuccauccuga

SEQ ID NO: 1516632 - RNA, 15 nt, Human
ggccuccauccugag

SEQ ID NO: 1516633 - RNA, 16 nt, Human
ggccuccauccugagg

SEQ ID NO: 1516634 - RNA, 13 nt, Human
ggcccggcuccag

SEQ ID NO: 1516635 - RNA, 23 nt, Human
ggccccugcugguucaggguugg

SEQ ID NO: 1516636 - RNA, 13 nt, Human
ggccccugcuggu

SEQ ID NO: 1516637 - RNA, 14 nt, Human
ggccccugcugguu

SEQ ID NO: 1516638 - RNA, 15 nt, Human
ggcccggcuccaggc

SEQ ID NO: 1516639 - RNA, 20 nt, Human
ggcccuucucuccagccccu

SEQ ID NO: 1516640 - RNA, 21 nt, Human
ggcccuucucuccagccccug

SEQ ID NO: 1516641 - RNA, 13 nt, Human
auucaggaagcuc

SEQ ID NO: 1516642 - RNA, 22 nt, Human
auuccccacccugaaagcccug

SEQ ID NO: 1516643 - RNA, 19 nt, Human
auucuaacuuuuuugcuau

SEQ ID NO: 1516644 - RNA, 18 nt, Human
auucagaaggaucuucau

SEQ ID NO: 1516645 - RNA, 24 nt, Human
auucagaaggaucuucaucugacu

SEQ ID NO: 1516646 - RNA, 11 nt, Human
auucagacagc

SEQ ID NO: 1516647 - RNA, 12 nt, Human
auucagacagcu

SEQ ID NO: 1516648 - RNA, 13 nt, Human
auucagacagcug

SEQ ID NO: 1516649 - RNA, 18 nt, Human
auucagacagcugccugg

SEQ ID NO: 1516650 - RNA, 12 nt, Human
auucaggaagcu

SEQ ID NO: 1516651 - RNA, 14 nt, Human
auucagacagcugc

SEQ ID NO: 1516652 - RNA, 15 nt, Human
auucagacagcugcc

SEQ ID NO: 1516653 - RNA, 16 nt, Human
auucagacagcugccu

SEQ ID NO: 1516654 - RNA, 17 nt, Human
auucagacagcugccug

SEQ ID NO: 1516655 - RNA, 15 nt, Human
auuauauuuauuacu

SEQ ID NO: 1516656 - RNA, 18 nt, Human
auuauauuuauuacugua

SEQ ID NO: 1516657 - RNA, 21 nt, Human
auuauguuaaaacugggacag

SEQ ID NO: 1516658 - RNA, 18 nt, Human
auuaucuagauacuguau

SEQ ID NO: 1516659 - RNA, 14 nt, Human
auuaucuagauacu

SEQ ID NO: 1516660 - RNA, 19 nt, Human
auucaaacagucucaggaa

SEQ ID NO: 1516661 - RNA, 20 nt, Human
auucaaacagucucaggaaa

SEQ ID NO: 1516662 - RNA, 17 nt, Human
auuauuuuguucauaca

SEQ ID NO: 1516663 - RNA, 18 nt, Human
auuauuuuguucauacau

SEQ ID NO: 1516664 - RNA, 19 nt, Human
auuauuuuguucauacaua

SEQ ID NO: 1516665 - RNA, 21 nt, Human
auuauuuuguucauacauauu

SEQ ID NO: 1516666 - RNA, 18 nt, Human
auucaaacagucucagga

SEQ ID NO: 1516667 - RNA, 15 nt, Human
auuauuuuguucaua

SEQ ID NO: 1516668 - RNA, 16 nt, Human
auuauuuuguucauac

SEQ ID NO: 1516669 - RNA, 15 nt, Human
auuauauuuacaaau

SEQ ID NO: 1516670 - RNA, 19 nt, Human
auucagacagcugccuggg

SEQ ID NO: 1516671 - RNA, 13 nt, Human
auucuuccucccu

SEQ ID NO: 1516672 - RNA, 17 nt, Human
auucuuacaaacaugug

SEQ ID NO: 1516673 - RNA, 16 nt, Human
auucuuacaaacaugu

SEQ ID NO: 1516674 - RNA, 21 nt, Human
auucuuacaaacaugugguua

SEQ ID NO: 1516675 - RNA, 14 nt, Human
auucuuaaauaugu

SEQ ID NO: 1516676 - RNA, 15 nt, Human
auugaaaaaccauuu

SEQ ID NO: 1516677 - RNA, 20 nt, Human
auugaaaucuuuuugcuuug

SEQ ID NO: 1516678 - RNA, 17 nt, Human
auugaaaucuuuuugcu

SEQ ID NO: 1516679 - RNA, 18 nt, Human
auugaaaucuuuuugcuu

SEQ ID NO: 1516680 - RNA, 15 nt, Human
auugacacuuaaaaa

SEQ ID NO: 1516681 - RNA, 17 nt, Human
auugacacuuaaaaaug

SEQ ID NO: 1516682 - RNA, 19 nt, Human
auugacacuuaaaaauggu

SEQ ID NO: 1516683 - RNA, 14 nt, Human
auucuguuggccag

SEQ ID NO: 1516684 - RNA, 19 nt, Human
auucuguuggccaguguga

SEQ ID NO: 1516685 - RNA, 21 nt, Human
auucuguuggccagugugaca

SEQ ID NO: 1516686 - RNA, 18 nt, Human
auucugcucacauaucug

SEQ ID NO: 1516687 - RNA, 20 nt, Human
auucugccugcccaggcccc

SEQ ID NO: 1516688 - RNA, 21 nt, Human
auucugccugcccaggccccu

SEQ ID NO: 1516689 - RNA, 19 nt, Human
auucugcucacauaucugu

SEQ ID NO: 1516690 - RNA, 20 nt, Human
auucugcucacauaucuguc

SEQ ID NO: 1516691 - RNA, 21 nt, Human
auucugcucacauaucuguca

SEQ ID NO: 1516692 - RNA, 22 nt, Human
auucugcucacauaucugucau

SEQ ID NO: 1516693 - RNA, 17 nt, Human
auucucauuugucacac

SEQ ID NO: 1516694 - RNA, 15 nt, Human
auucuagcuaaugua

SEQ ID NO: 1516695 - RNA, 18 nt, Human
auucuagcuaauguaaua

SEQ ID NO: 1516696 - RNA, 11 nt, Human
auucugccugc

SEQ ID NO: 1516697 - RNA, 13 nt, Human
auucugccugccc

SEQ ID NO: 1516698 - RNA, 14 nt, Human
auucugccugccca

SEQ ID NO: 1516699 - RNA, 15 nt, Human
auucugccugcccag

SEQ ID NO: 1516700 - RNA, 16 nt, Human
auucugccugcccagg

SEQ ID NO: 1516701 - RNA, 17 nt, Human
auucugccugcccaggc

SEQ ID NO: 1516702 - RNA, 18 nt, Human
auucugccugcccaggcc

SEQ ID NO: 1516703 - RNA, 19 nt, Human
auucugccugcccaggccc

SEQ ID NO: 1516704 - RNA, 20 nt, Human
auuuuuucucuaggaaauau

SEQ ID NO: 1516705 - RNA, 23 nt, Human
auuuuuucucuaggaaauauuua

SEQ ID NO: 1516706 - RNA, 18 nt, Human
auuuuuuguuaaaugauu

SEQ ID NO: 1516707 - RNA, 22 nt, Human
auuuuugugauuuugugauuga

SEQ ID NO: 1516708 - RNA, 21 nt, Human
auuuuuguagcacugacagau

SEQ ID NO: 1516709 - RNA, 20 nt, Human
auuuuuguagcacugacaga

SEQ ID NO: 1516710 - RNA, 12 nt, Human
auuuuuguaauu

SEQ ID NO: 1516711 - RNA, 19 nt, Human
auuuuuguagagccagggu

SEQ ID NO: 1516712 - RNA, 21 nt, Human
auuuuuguuuucauuaucuca

SEQ ID NO: 1516713 - RNA, 14 nt, Human
auuuuuuaaaugca

SEQ ID NO: 1516714 - RNA, 13 nt, Human
auuuuuuaaaugc

SEQ ID NO: 1516715 - RNA, 22 nt, Human
auuuuugacagaauauguuuca

SEQ ID NO: 1516716 - RNA, 22 nt, Human
auuuuucuuagggaaggauaca

SEQ ID NO: 1516717 - RNA, 15 nt, Human
auuuuucuuauuuca

SEQ ID NO: 1516718 - RNA, 19 nt, Human
auuuuucuuauuucauuuc

SEQ ID NO: 1516719 - RNA, 20 nt, Human
auuuuucuuauuucauuucu

SEQ ID NO: 1516720 - RNA, 12 nt, Human
auuuuugacaga

SEQ ID NO: 1516721 - RNA, 13 nt, Human
auuuuugacagaa

SEQ ID NO: 1516722 - RNA, 14 nt, Human
auuuuugacagaau

SEQ ID NO: 1516723 - RNA, 15 nt, Human
auuuuugacagaaua

SEQ ID NO: 1516724 - RNA, 15 nt, Human
auuuuuccaaaauaa

SEQ ID NO: 1516725 - RNA, 21 nt, Human
auuuuucuuagggaaggauac

SEQ ID NO: 1516726 - RNA, 21 nt, Human
auuuuguuuuugucuuaaaaa

SEQ ID NO: 1516727 - RNA, 15 nt, Human
auuuuucacauaucu

SEQ ID NO: 1516728 - RNA, 18 nt, Human
auuuuucacauaucuagu

SEQ ID NO: 1516729 - RNA, 21 nt, Human
auuuuucacauaucuaguaug

SEQ ID NO: 1516730 - RNA, 12 nt, Human
auuuuaauaaug

SEQ ID NO: 1516731 - RNA, 15 nt, Human
auuuuccaugaaaau

SEQ ID NO: 1516732 - RNA, 15 nt, Human
auuuucuauaauuua

SEQ ID NO: 1516733 - RNA, 14 nt, Human
auuuucuauaauuu

SEQ ID NO: 1516734 - RNA, 14 nt, Human
auuuuccugaaaac

SEQ ID NO: 1516735 - RNA, 19 nt, Human
auuuucccuauuagagaag

SEQ ID NO: 1516736 - RNA, 16 nt, Human
auuuuccugccaggca

SEQ ID NO: 1516737 - RNA, 21 nt, Human
auuuugcugucccuuuuccuu

SEQ ID NO: 1516738 - RNA, 20 nt, Human
auuuugcuaaaugugaauga

SEQ ID NO: 1516739 - RNA, 19 nt, Human
auuuugauccaagcugguc

SEQ ID NO: 1516740 - RNA, 17 nt, Human
auuuugauguuuuaagg

SEQ ID NO: 1516741 - RNA, 15 nt, Human
auuuugauguuuuaa

SEQ ID NO: 1516742 - RNA, 12 nt, Human
auuuuguucaua

SEQ ID NO: 1516743 - RNA, 14 nt, Human
auuuuguucauaca

SEQ ID NO: 1516744 - RNA, 15 nt, Human
auuuuguucauacau

SEQ ID NO: 1516745 - RNA, 16 nt, Human
auuuuguucauacaua

SEQ ID NO: 1516746 - RNA, 18 nt, Human
auuuuguucauacauauu

SEQ ID NO: 1516747 - RNA, 16 nt, Human
auuuuguuucagugca

SEQ ID NO: 1516748 - RNA, 19 nt, Human
auuuugugcccccauguaa

SEQ ID NO: 1516749 - RNA, 23 nt, Human
auuuugucauauaagauucauau

SEQ ID NO: 1516750 - RNA, 20 nt, Human
auuuugcuuugugauuuuug

SEQ ID NO: 1516751 - RNA, 18 nt, Human
auuuugcuuugugauuuu

SEQ ID NO: 1516752 - RNA, 12 nt, Human
auuuugcuuugu

SEQ ID NO: 1516753 - RNA, 20 nt, Human
auuuuggaaaauaaauuauu

SEQ ID NO: 1516754 - RNA, 14 nt, Human
auuuuggaaaauaa

SEQ ID NO: 1516755 - RNA, 19 nt, Human
auuuuggaaaauaaauuau

SEQ ID NO: 1516756 - RNA, 22 nt, Human
auuuguaguguuggagaagaac

SEQ ID NO: 1516757 - RNA, 14 nt, Human
auuuguauaaaaua

SEQ ID NO: 1516758 - RNA, 15 nt, Human
auuuguauaaaauaa

SEQ ID NO: 1516759 - RNA, 23 nt, Human
auuuuaaaagaaugauuaugaau

SEQ ID NO: 1516760 - RNA, 16 nt, Human
auuuuaaaagaaugau

SEQ ID NO: 1516761 - RNA, 22 nt, Human
auuuuaaaaauacagauagaua

SEQ ID NO: 1516762 - RNA, 17 nt, Human
auuucuaggacugaauu

SEQ ID NO: 1516763 - RNA, 18 nt, Human
auuucuaggacugaauua

SEQ ID NO: 1516764 - RNA, 20 nt, Human
auuucuaggacugaauuaug

SEQ ID NO: 1516765 - RNA, 23 nt, Human
auuucuaggacugaauuaugaaa

SEQ ID NO: 1516766 - RNA, 20 nt, Human
auuucuuccacaagagccca

SEQ ID NO: 1516767 - RNA, 23 nt, Human
auuucuuccacaagagcccaggc

SEQ ID NO: 1516768 - RNA, 20 nt, Human
auuucuugagguaaaagcau

SEQ ID NO: 1516769 - RNA, 16 nt, Human
auuugaaaauuuugau

SEQ ID NO: 1516770 - RNA, 14 nt, Human
auuuauuuuaauaa

SEQ ID NO: 1516771 - RNA, 12 nt, Human
auuuauuuaaau

SEQ ID NO: 1516772 - RNA, 14 nt, Human
auuuauuuaaauuu

SEQ ID NO: 1516773 - RNA, 15 nt, Human
auuuccaagagcuga

SEQ ID NO: 1516774 - RNA, 19 nt, Human
auuucccaaagcagugcau

SEQ ID NO: 1516775 - RNA, 16 nt, Human
auuuccaagagcugag

SEQ ID NO: 1516776 - RNA, 19 nt, Human
auuggacaguaaaauccac

SEQ ID NO: 1516777 - RNA, 19 nt, Human
auuggagcucgugggacag

SEQ ID NO: 1516778 - RNA, 13 nt, Human
auugacuuuuuau

SEQ ID NO: 1516779 - RNA, 18 nt, Human
auugacuuuuuauggcac

SEQ ID NO: 1516780 - RNA, 18 nt, Human
auugcuuuggucauauga

SEQ ID NO: 1516781 - RNA, 21 nt, Human
auugauuuccguuaaaauacc

SEQ ID NO: 1516782 - RNA, 14 nt, Human
auugcuuuggucau

SEQ ID NO: 1516783 - RNA, 17 nt, Human
auuuaaaagauacaguu

SEQ ID NO: 1516784 - RNA, 16 nt, Human
auuuaaaagauacagu

SEQ ID NO: 1516785 - RNA, 14 nt, Human
auuuaaaagauaca

SEQ ID NO: 1516786 - RNA, 13 nt, Human
auugucuagugaa

SEQ ID NO: 1516787 - RNA, 14 nt, Human
auugugggaagggg

SEQ ID NO: 1516788 - RNA, 13 nt, Human
auugugggaaggg

SEQ ID NO: 1516789 - RNA, 23 nt, Human
auugucaaaguggugagaggcau

SEQ ID NO: 1516790 - RNA, 17 nt, Human
auuguacgaagaguauu

SEQ ID NO: 1516791 - RNA, 16 nt, Human
auuguacgaagaguau

SEQ ID NO: 1516792 - RNA, 22 nt, Human
auugguuuuccaaucauuugac

SEQ ID NO: 1516793 - RNA, 18 nt, Human
augggccuccugugugug

SEQ ID NO: 1516794 - RNA, 12 nt, Human
auggggaugcag

SEQ ID NO: 1516795 - RNA, 20 nt, Human
augggcuggguucuacccag

SEQ ID NO: 1516796 - RNA, 22 nt, Human
uuugaaaacucuguguuuggaa

SEQ ID NO: 1516797 - RNA, 15 nt, Human
augggggugcauuug

SEQ ID NO: 1516798 - RNA, 14 nt, Human
augggggugcauuu

SEQ ID NO: 1516799 - RNA, 24 nt, Human
auggggcugcaccggcuggccugg

SEQ ID NO: 1516800 - RNA, 21 nt, Human
uuucugcagccacuauuguua

SEQ ID NO: 1516801 - RNA, 18 nt, Human
augggcaacccccagccu

SEQ ID NO: 1516802 - RNA, 18 nt, Human
uuucucccagucauuuaa

SEQ ID NO: 1516803 - RNA, 15 nt, Human
augggauccuggagu

SEQ ID NO: 1516804 - RNA, 19 nt, Human
uuucuggcuaugcauuuga

SEQ ID NO: 1516805 - RNA, 18 nt, Human
uuucuggcuaugcauuug

SEQ ID NO: 1516806 - RNA, 16 nt, Human
uuucuggcuaugcauu

SEQ ID NO: 1516807 - RNA, 15 nt, Human
uuucuggcuaugcau

SEQ ID NO: 1516808 - RNA, 19 nt, Human
uuucugcagccacuauugu

SEQ ID NO: 1516809 - RNA, 13 nt, Human
uuucuccccugcc

SEQ ID NO: 1516810 - RNA, 14 nt, Human
uuucuccccugccc

SEQ ID NO: 1516811 - RNA, 16 nt, Human
uuucuccccugccccc

SEQ ID NO: 1516812 - RNA, 17 nt, Human
uuucuccccugccccca

SEQ ID NO: 1516813 - RNA, 20 nt, Human
uuucuccccugcccccagga

SEQ ID NO: 1516814 - RNA, 21 nt, Human
augguuugaauauaaacacua

SEQ ID NO: 1516815 - RNA, 21 nt, Human
augguucccuugaugaagaag

SEQ ID NO: 1516816 - RNA, 16 nt, Human
augguuuucaaaauaa

SEQ ID NO: 1516817 - RNA, 14 nt, Human
augguuuucuugug

SEQ ID NO: 1516818 - RNA, 22 nt, Human
augguuugaauauaaacacuau

SEQ ID NO: 1516819 - RNA, 16 nt, Human
augguuugcaaggaag

SEQ ID NO: 1516820 - RNA, 17 nt, Human
augguuugcaaggaagc

SEQ ID NO: 1516821 - RNA, 18 nt, Human
augguuugcaaggaagcc

SEQ ID NO: 1516822 - RNA, 14 nt, Human
augguuuucaaaau

SEQ ID NO: 1516823 - RNA, 15 nt, Human
augguuuucaaaaua

SEQ ID NO: 1516824 - RNA, 14 nt, Human
augguguuacauau

SEQ ID NO: 1516825 - RNA, 12 nt, Human
augguggcuggg

SEQ ID NO: 1516826 - RNA, 13 nt, Human
augguggcugggu

SEQ ID NO: 1516827 - RNA, 15 nt, Human
augguggcuggguug

SEQ ID NO: 1516828 - RNA, 17 nt, Human
augguggcuggguugga

SEQ ID NO: 1516829 - RNA, 19 nt, Human
auggugcaaugaccuuuca

SEQ ID NO: 1516830 - RNA, 16 nt, Human
auggugcaaugaccuu

SEQ ID NO: 1516831 - RNA, 17 nt, Human
auggugcaaugaccuuu

SEQ ID NO: 1516832 - RNA, 15 nt, Human
augggugcuuggagg

SEQ ID NO: 1516833 - RNA, 20 nt, Human
auggugagggauacccaucc

SEQ ID NO: 1516834 - RNA, 20 nt, Human
augggugcuuggaggaagga

SEQ ID NO: 1516835 - RNA, 12 nt, Human
auggugcaauga

SEQ ID NO: 1516836 - RNA, 13 nt, Human
auggugcaaugac

SEQ ID NO: 1516837 - RNA, 15 nt, Human
auggugcaaugaccu

SEQ ID NO: 1516838 - RNA, 18 nt, Human
uuugugaaggugauuuau

SEQ ID NO: 1516839 - RNA, 17 nt, Human
uuugugaagcaaaauuu

SEQ ID NO: 1516840 - RNA, 19 nt, Human
uuuguaguguuggagaaga

SEQ ID NO: 1516841 - RNA, 21 nt, Human
uuuguaguguuggagaagaac

SEQ ID NO: 1516842 - RNA, 23 nt, Human
augucucuuuaaugucacaggca

SEQ ID NO: 1516843 - RNA, 16 nt, Human
augugaugagaggaaa

SEQ ID NO: 1516844 - RNA, 17 nt, Human
augugaugagaggaaau

SEQ ID NO: 1516845 - RNA, 19 nt, Human
augugaugagaggaaauca

SEQ ID NO: 1516846 - RNA, 23 nt, Human
augugcacaugcacgugugugca

SEQ ID NO: 1516847 - RNA, 13 nt, Human
uuuggcagaguuc

SEQ ID NO: 1516848 - RNA, 14 nt, Human
auguaugauuacau

SEQ ID NO: 1516849 - RNA, 22 nt, Human
auguauuacaguggggaaugaa

SEQ ID NO: 1516850 - RNA, 16 nt, Human
auguauguguaaguau

SEQ ID NO: 1516851 - RNA, 21 nt, Human
augucucugugagacucgaga

SEQ ID NO: 1516852 - RNA, 23 nt, Human
augucucugugagacucgagaac

SEQ ID NO: 1516853 - RNA, 17 nt, Human
auguccacugguucuuc

SEQ ID NO: 1516854 - RNA, 15 nt, Human
augucagugugacug

SEQ ID NO: 1516855 - RNA, 12 nt, Human
augucaguguga

SEQ ID NO: 1516856 - RNA, 13 nt, Human
augucagugugac

SEQ ID NO: 1516857 - RNA, 16 nt, Human
auguacuucaugcugu

SEQ ID NO: 1516858 - RNA, 17 nt, Human
auguagaggagaaacug

SEQ ID NO: 1516859 - RNA, 19 nt, Human
auguagaggagaaacugga

SEQ ID NO: 1516860 - RNA, 12 nt, Human
auguagaggaga

SEQ ID NO: 1516861 - RNA, 13 nt, Human
auguagaggagaa

SEQ ID NO: 1516862 - RNA, 19 nt, Human
auguagcgcuuugaauaug

SEQ ID NO: 1516863 - RNA, 21 nt, Human
auguagcgcuuugaauaugaa

SEQ ID NO: 1516864 - RNA, 22 nt, Human
uuugacagaauauguuucaaac

SEQ ID NO: 1516865 - RNA, 12 nt, Human
uuugaccucugc

SEQ ID NO: 1516866 - RNA, 18 nt, Human
uuugaccucugcagcaau

SEQ ID NO: 1516867 - RNA, 14 nt, Human
uuugcaagccagau

SEQ ID NO: 1516868 - RNA, 12 nt, Human
uuugcaaggaag

SEQ ID NO: 1516869 - RNA, 14 nt, Human
uuugcaaggaagcc

SEQ ID NO: 1516870 - RNA, 21 nt, Human
uuugcaaggaagccacagcug

SEQ ID NO: 1516871 - RNA, 15 nt, Human
uuugccguuauuaaa

SEQ ID NO: 1516872 - RNA, 21 nt, Human
uuugauucuccuucagcccuc

SEQ ID NO: 1516873 - RNA, 12 nt, Human
uuugauucuccu

SEQ ID NO: 1516874 - RNA, 13 nt, Human
uuugauucuccuu

SEQ ID NO: 1516875 - RNA, 14 nt, Human
uuugauucuccuuc

SEQ ID NO: 1516876 - RNA, 16 nt, Human
uuugauucuccuucag

SEQ ID NO: 1516877 - RNA, 22 nt, Human
uuugauucagacagcugccugg

SEQ ID NO: 1516878 - RNA, 13 nt, Human
uuugccucugccu

SEQ ID NO: 1516879 - RNA, 19 nt, Human
uuugacgggaaacaaaacu

SEQ ID NO: 1516880 - RNA, 20 nt, Human
uuugacgccaucccagcccc

SEQ ID NO: 1516881 - RNA, 13 nt, Human
uuugacgccaucc

SEQ ID NO: 1516882 - RNA, 14 nt, Human
uuugacgccauccc

SEQ ID NO: 1516883 - RNA, 16 nt, Human
uuugacgccaucccag

SEQ ID NO: 1516884 - RNA, 19 nt, Human
uuugacgccaucccagccc

SEQ ID NO: 1516885 - RNA, 23 nt, Human
uuugauuaaauucuugcaaagua

SEQ ID NO: 1516886 - RNA, 21 nt, Human
uuugauucagacagcugccug

SEQ ID NO: 1516887 - RNA, 21 nt, Human
uuugauuaaauucuugcaaag

SEQ ID NO: 1516888 - RNA, 18 nt, Human
uuugauuaaauucuugca

SEQ ID NO: 1516889 - RNA, 13 nt, Human
uuugauuaaauuc

SEQ ID NO: 1516890 - RNA, 22 nt, Human
uuugauguucuuucacccuuuu

SEQ ID NO: 1516891 - RNA, 18 nt, Human
uuuaaauauaugcuaagu

SEQ ID NO: 1516892 - RNA, 13 nt, Human
uuuaauuaaauaa

SEQ ID NO: 1516893 - RNA, 12 nt, Human
uuuaauucaguu

SEQ ID NO: 1516894 - RNA, 18 nt, Human
augcagccucacaguccu

SEQ ID NO: 1516895 - RNA, 13 nt, Human
augcaguucugaa

SEQ ID NO: 1516896 - RNA, 23 nt, Human
augcagugguaugaucacggcuc

SEQ ID NO: 1516897 - RNA, 17 nt, Human
augccauggacagaaga

SEQ ID NO: 1516898 - RNA, 18 nt, Human
augccauggacagaagaa

SEQ ID NO: 1516899 - RNA, 19 nt, Human
augccauggacagaagaag

SEQ ID NO: 1516900 - RNA, 17 nt, Human
augccauuuaaagcuua

SEQ ID NO: 1516901 - RNA, 21 nt, Human
augccauuuaaagcuuauuaa

SEQ ID NO: 1516902 - RNA, 12 nt, Human
augcccagcccc

SEQ ID NO: 1516903 - RNA, 13 nt, Human
augcccagccccu

SEQ ID NO: 1516904 - RNA, 14 nt, Human
augcccagccccuu

SEQ ID NO: 1516905 - RNA, 15 nt, Human
augcccagccccuuc

SEQ ID NO: 1516906 - RNA, 20 nt, Human
augcgugcauaccacuuuug

SEQ ID NO: 1516907 - RNA, 23 nt, Human
augcuaaagguuguauugcauau

SEQ ID NO: 1516908 - RNA, 13 nt, Human
augccuccucagg

SEQ ID NO: 1516909 - RNA, 15 nt, Human
augccuccucaggag

SEQ ID NO: 1516910 - RNA, 14 nt, Human
augccuccucagga

SEQ ID NO: 1516911 - RNA, 18 nt, Human
augccuccucaggagccg

SEQ ID NO: 1516912 - RNA, 17 nt, Human
augcacuuuguucuggc

SEQ ID NO: 1516913 - RNA, 19 nt, Human
augcacuuuguucuggcuc

SEQ ID NO: 1516914 - RNA, 20 nt, Human
augcacuuuguucuggcucu

SEQ ID NO: 1516915 - RNA, 13 nt, Human
augcaccuggaau

SEQ ID NO: 1516916 - RNA, 22 nt, Human
augcaccagcccuuagcaggga

SEQ ID NO: 1516917 - RNA, 13 nt, Human
uuuaaagaaugcu

SEQ ID NO: 1516918 - RNA, 21 nt, Human
augcacuuuguucuggcucuu

SEQ ID NO: 1516919 - RNA, 14 nt, Human
augauuaaguaaug

SEQ ID NO: 1516920 - RNA, 18 nt, Human
augauuaaguaaugauaa

SEQ ID NO: 1516921 - RNA, 17 nt, Human
augaucuaggaagacuu

SEQ ID NO: 1516922 - RNA, 20 nt, Human
augaucuaggaagacuuugg

SEQ ID NO: 1516923 - RNA, 15 nt, Human
augauaacuggaaac

SEQ ID NO: 1516924 - RNA, 17 nt, Human
augauaaguaaaugcua

SEQ ID NO: 1516925 - RNA, 20 nt, Human
uuguguuacuaaguuuuuau

SEQ ID NO: 1516926 - RNA, 15 nt, Human
uuguguuacuaaguu

SEQ ID NO: 1516927 - RNA, 13 nt, Human
uuguguuacuaag

SEQ ID NO: 1516928 - RNA, 13 nt, Human
uuguguucaccuu

SEQ ID NO: 1516929 - RNA, 21 nt, Human
uuguuccacaaguuaaauaaa

SEQ ID NO: 1516930 - RNA, 21 nt, Human
uuuaucaaagggugaaaauua

SEQ ID NO: 1516931 - RNA, 13 nt, Human
augcuaagugaaa

SEQ ID NO: 1516932 - RNA, 20 nt, Human
augcuagaacucccuuucaa

SEQ ID NO: 1516933 - RNA, 21 nt, Human
augcuagaacucccuuucaac

SEQ ID NO: 1516934 - RNA, 22 nt, Human
augcuagaacucccuuucaaca

SEQ ID NO: 1516935 - RNA, 18 nt, Human
augcuagguuaauuccaa

SEQ ID NO: 1516936 - RNA, 17 nt, Human
augcuguucaugaaaga

SEQ ID NO: 1516937 - RNA, 22 nt, Human
augcugugcccuaaaguguauu

SEQ ID NO: 1516938 - RNA, 23 nt, Human
augcuguucaugaaagauucaau

SEQ ID NO: 1516939 - RNA, 19 nt, Human
augcuguucaugaaagauu

SEQ ID NO: 1516940 - RNA, 13 nt, Human
augcuucucacug

SEQ ID NO: 1516941 - RNA, 16 nt, Human
uuucaaacauauauaa

SEQ ID NO: 1516942 - RNA, 17 nt, Human
uuucaaacauauauaac

SEQ ID NO: 1516943 - RNA, 16 nt, Human
uuucaaacuuuacuau

SEQ ID NO: 1516944 - RNA, 22 nt, Human
uuucaaacuuuacuauggcccu

SEQ ID NO: 1516945 - RNA, 11 nt, Human
auggacuuugu

SEQ ID NO: 1516946 - RNA, 12 nt, Human
auggacuuuguu

SEQ ID NO: 1516947 - RNA, 17 nt, Human
uuuccaugaaaaugcaa

SEQ ID NO: 1516948 - RNA, 17 nt, Human
uuuccaugaguccccug

SEQ ID NO: 1516949 - RNA, 18 nt, Human
uuuccaugaguccccugu

SEQ ID NO: 1516950 - RNA, 14 nt, Human
uuucaaacuuugga

SEQ ID NO: 1516951 - RNA, 14 nt, Human
auggcacuaguauu

SEQ ID NO: 1516952 - RNA, 16 nt, Human
auggcacuaguauuuc

SEQ ID NO: 1516953 - RNA, 15 nt, Human
auggcagugucuuuc

SEQ ID NO: 1516954 - RNA, 18 nt, Human
auggcauauuuuucacau

SEQ ID NO: 1516955 - RNA, 20 nt, Human
auggcauauuuuucacauau

SEQ ID NO: 1516956 - RNA, 21 nt, Human
auggcauauuuuucacauauc

SEQ ID NO: 1516957 - RNA, 22 nt, Human
auggcauauuuuucacauaucu

SEQ ID NO: 1516958 - RNA, 23 nt, Human
auggcauauuuuucacauaucua

SEQ ID NO: 1516959 - RNA, 18 nt, Human
auggcuaauguacugcau

SEQ ID NO: 1516960 - RNA, 19 nt, Human
auggcuaagcaaaauguga

SEQ ID NO: 1516961 - RNA, 19 nt, Human
augggagagaagagaaugc

SEQ ID NO: 1516962 - RNA, 15 nt, Human
augggagagaagaga

SEQ ID NO: 1516963 - RNA, 17 nt, Human
aucaggguuaguauugu

SEQ ID NO: 1516964 - RNA, 20 nt, Human
aucaggccaggcccucugcc

SEQ ID NO: 1516965 - RNA, 13 nt, Human
aucagcacgauuu

SEQ ID NO: 1516966 - RNA, 15 nt, Human
aucaggccaggcccu

SEQ ID NO: 1516967 - RNA, 16 nt, Human
aucaggccaggcccuc

SEQ ID NO: 1516968 - RNA, 18 nt, Human
aucaggccaggcccucug

SEQ ID NO: 1516969 - RNA, 12 nt, Human
aucagaauucuc

SEQ ID NO: 1516970 - RNA, 13 nt, Human
uucuaggacugaa

SEQ ID NO: 1516971 - RNA, 14 nt, Human
uucuaggacugaau

SEQ ID NO: 1516972 - RNA, 16 nt, Human
uucuaggacugaauua

SEQ ID NO: 1516973 - RNA, 23 nt, Human
uucuaggacugaauuaugaaacu

SEQ ID NO: 1516974 - RNA, 22 nt, Human
aucacuugucaauaaaauccau

SEQ ID NO: 1516975 - RNA, 11 nt, Human
aucagaauucu

SEQ ID NO: 1516976 - RNA, 21 nt, Human
uucuaaaucuccaaaauaaaa

SEQ ID NO: 1516977 - RNA, 21 nt, Human
uucuaaaggcuaccuuuguau

SEQ ID NO: 1516978 - RNA, 20 nt, Human
uucuaaaggcuaccuuugua

SEQ ID NO: 1516979 - RNA, 15 nt, Human
uucggccuccauccu

SEQ ID NO: 1516980 - RNA, 17 nt, Human
uucggauuuggggugga

SEQ ID NO: 1516981 - RNA, 14 nt, Human
uucggccuccaucc

SEQ ID NO: 1516982 - RNA, 15 nt, Human
uucgcuccugugucu

SEQ ID NO: 1516983 - RNA, 19 nt, Human
uucgcuccugugucuugca

SEQ ID NO: 1516984 - RNA, 17 nt, Human
uucuagcuaauguaaua

SEQ ID NO: 1516985 - RNA, 16 nt, Human
uucuagcauggcugcc

SEQ ID NO: 1516986 - RNA, 22 nt, Human
uucuagcauggcauauuuuuca

SEQ ID NO: 1516987 - RNA, 14 nt, Human
uucuagcauggcau

SEQ ID NO: 1516988 - RNA, 15 nt, Human
uucuagcauggcaua

SEQ ID NO: 1516989 - RNA, 18 nt, Human
uucuagcauggcauauuu

SEQ ID NO: 1516990 - RNA, 20 nt, Human
uucuagcauggcauauuuuu

SEQ ID NO: 1516991 - RNA, 21 nt, Human
uucuagcauggcauauuuuuc

SEQ ID NO: 1516992 - RNA, 14 nt, Human
uucuaaauuuuaua

SEQ ID NO: 1516993 - RNA, 23 nt, Human
uucuaagaagugaaaaucuacac

SEQ ID NO: 1516994 - RNA, 19 nt, Human
uucuaacaaaaaaauauau

SEQ ID NO: 1516995 - RNA, 15 nt, Human
uucuaaguaaaacca

SEQ ID NO: 1516996 - RNA, 17 nt, Human
uucuaaguaaaaccaca

SEQ ID NO: 1516997 - RNA, 16 nt, Human
uucuaaguaaaaccac

SEQ ID NO: 1516998 - RNA, 14 nt, Human
uuccugaacaggau

SEQ ID NO: 1516999 - RNA, 14 nt, Human
uuccugaaccgaug

SEQ ID NO: 1517000 - RNA, 15 nt, Human
uuccugaacaggaua

SEQ ID NO: 1517001 - RNA, 18 nt, Human
uuccugaagaauugaaaa

SEQ ID NO: 1517002 - RNA, 13 nt, Human
uuccucuuuccau

SEQ ID NO: 1517003 - RNA, 17 nt, Human
uuccucuuuccaucuac

SEQ ID NO: 1517004 - RNA, 22 nt, Human
uuccucuuuccaucuacccucc

SEQ ID NO: 1517005 - RNA, 19 nt, Human
uuccguagguuauuuucag

SEQ ID NO: 1517006 - RNA, 16 nt, Human
uuccguuaaaauacca

SEQ ID NO: 1517007 - RNA, 14 nt, Human
uuccguuaaaauac

SEQ ID NO: 1517008 - RNA, 20 nt, Human
uucccucaccuuucccaucu

SEQ ID NO: 1517009 - RNA, 14 nt, Human
aucaaugaguaaca

SEQ ID NO: 1517010 - RNA, 18 nt, Human
aucacggcucacugcagc

SEQ ID NO: 1517011 - RNA, 19 nt, Human
aucacggcucacugcagcc

SEQ ID NO: 1517012 - RNA, 13 nt, Human
aucacgccacugc

SEQ ID NO: 1517013 - RNA, 14 nt, Human
aucacgccacugca

SEQ ID NO: 1517014 - RNA, 15 nt, Human
aucacggcucacugc

SEQ ID NO: 1517015 - RNA, 12 nt, Human
auauuuuucaca

SEQ ID NO: 1517016 - RNA, 13 nt, Human
auauuuuucacau

SEQ ID NO: 1517017 - RNA, 14 nt, Human
auauuuuucacaua

SEQ ID NO: 1517018 - RNA, 15 nt, Human
auauuuuucacauau

SEQ ID NO: 1517019 - RNA, 17 nt, Human
auauuuuucacauaucu

SEQ ID NO: 1517020 - RNA, 11 nt, Human
uuccugugucu

SEQ ID NO: 1517021 - RNA, 14 nt, Human
aucaacagauaaau

SEQ ID NO: 1517022 - RNA, 15 nt, Human
aucaacaucuuuucu

SEQ ID NO: 1517023 - RNA, 13 nt, Human
aucaacaucuuuu

SEQ ID NO: 1517024 - RNA, 20 nt, Human
auauuuuuuguuaaaugauu

SEQ ID NO: 1517025 - RNA, 18 nt, Human
auauuuuuuguuaaauga

SEQ ID NO: 1517026 - RNA, 16 nt, Human
auauuuuuuaucauaa

SEQ ID NO: 1517027 - RNA, 17 nt, Human
uugaaauuguauuacaa

SEQ ID NO: 1517028 - RNA, 19 nt, Human
uugaacccgggaggcagag

SEQ ID NO: 1517029 - RNA, 16 nt, Human
auccuccucagaucuu

SEQ ID NO: 1517030 - RNA, 16 nt, Human
auccuaggcauuugcu

SEQ ID NO: 1517031 - RNA, 21 nt, Human
auccuaagcuauucaguaaua

SEQ ID NO: 1517032 - RNA, 18 nt, Human
auccuaaauuuacccucu

SEQ ID NO: 1517033 - RNA, 12 nt, Human
auccuaagcuau

SEQ ID NO: 1517034 - RNA, 20 nt, Human
uucuucugcuucagccuccc

SEQ ID NO: 1517035 - RNA, 14 nt, Human
uucuucucccucag

SEQ ID NO: 1517036 - RNA, 13 nt, Human
uucuucugcuuca

SEQ ID NO: 1517037 - RNA, 15 nt, Human
uucuucugcuucagc

SEQ ID NO: 1517038 - RNA, 13 nt, Human
uucuucucccuca

SEQ ID NO: 1517039 - RNA, 24 nt, Human
aucccauaugccugggcagaagga

SEQ ID NO: 1517040 - RNA, 13 nt, Human
aucccaugagccu

SEQ ID NO: 1517041 - RNA, 14 nt, Human
aucccucauccuca

SEQ ID NO: 1517042 - RNA, 21 nt, Human
aucccucauccucauacccac

SEQ ID NO: 1517043 - RNA, 23 nt, Human
aucccucauccucauacccaccc

SEQ ID NO: 1517044 - RNA, 18 nt, Human
auccaagcuggucccacu

SEQ ID NO: 1517045 - RNA, 21 nt, Human
auccaagcuggucccacucag

SEQ ID NO: 1517046 - RNA, 13 nt, Human
auccacccaccuc

SEQ ID NO: 1517047 - RNA, 15 nt, Human
auccacccaccucag

SEQ ID NO: 1517048 - RNA, 16 nt, Human
auccacccaccucagc

SEQ ID NO: 1517049 - RNA, 16 nt, Human
auccaguaucuugaag

SEQ ID NO: 1517050 - RNA, 21 nt, Human
auccaguaucuugaagacuuu

SEQ ID NO: 1517051 - RNA, 18 nt, Human
aucccauaugccugggca

SEQ ID NO: 1517052 - RNA, 19 nt, Human
aucccaaacccuucagugc

SEQ ID NO: 1517053 - RNA, 20 nt, Human
aucccaaacccuucagugcc

SEQ ID NO: 1517054 - RNA, 12 nt, Human
uucucuaggaaa

SEQ ID NO: 1517055 - RNA, 17 nt, Human
uucucuaguuugauuaa

SEQ ID NO: 1517056 - RNA, 15 nt, Human
uucucuaguuugauu

SEQ ID NO: 1517057 - RNA, 20 nt, Human
uucucuaguuugauuaaauu

SEQ ID NO: 1517058 - RNA, 14 nt, Human
aucaggugcugcca

SEQ ID NO: 1517059 - RNA, 21 nt, Human
uucuccuuguguuacuaaguu

SEQ ID NO: 1517060 - RNA, 15 nt, Human
uucuccuucagcccu

SEQ ID NO: 1517061 - RNA, 20 nt, Human
uucuccuucagcccucaccc

SEQ ID NO: 1517062 - RNA, 23 nt, Human
uucugaacuuggcgcugccccug

SEQ ID NO: 1517063 - RNA, 15 nt, Human
uucugccauauucug

SEQ ID NO: 1517064 - RNA, 19 nt, Human
uucugaacuuggcgcugcc

SEQ ID NO: 1517065 - RNA, 22 nt, Human
uucugaacuuggcgcugccccu

SEQ ID NO: 1517066 - RNA, 21 nt, Human
uucugccugcccaggccccug

SEQ ID NO: 1517067 - RNA, 18 nt, Human
uucugccugcccaggccc

SEQ ID NO: 1517068 - RNA, 16 nt, Human
uucuggcucuuccagg

SEQ ID NO: 1517069 - RNA, 17 nt, Human
uucuggcucuuccaggc

SEQ ID NO: 1517070 - RNA, 14 nt, Human
aucucauuuccaag

SEQ ID NO: 1517071 - RNA, 14 nt, Human
aucuccaaaauaaa

SEQ ID NO: 1517072 - RNA, 21 nt, Human
aucuccaaaauaaaacuuuuu

SEQ ID NO: 1517073 - RNA, 20 nt, Human
aucuccaaaauaaaacuuuu

SEQ ID NO: 1517074 - RNA, 17 nt, Human
aucuccaaaauaaaacu

SEQ ID NO: 1517075 - RNA, 16 nt, Human
aucucagggccugguc

SEQ ID NO: 1517076 - RNA, 15 nt, Human
aucucuugagccugg

SEQ ID NO: 1517077 - RNA, 18 nt, Human
aucucuugagccugggag

SEQ ID NO: 1517078 - RNA, 14 nt, Human
aucugaaaauguau

SEQ ID NO: 1517079 - RNA, 16 nt, Human
aucugaaaauguaugu

SEQ ID NO: 1517080 - RNA, 19 nt, Human
aucugaaaauguaugugua

SEQ ID NO: 1517081 - RNA, 20 nt, Human
aucugaaaauguauguguaa

SEQ ID NO: 1517082 - RNA, 22 nt, Human
aucugaaaauguauguguaagu

SEQ ID NO: 1517083 - RNA, 15 nt, Human
aucucccccagcccc

SEQ ID NO: 1517084 - RNA, 21 nt, Human
aucucccccagccccauccuc

SEQ ID NO: 1517085 - RNA, 16 nt, Human
aucucccccagcccca

SEQ ID NO: 1517086 - RNA, 17 nt, Human
aucucccccagccccau

SEQ ID NO: 1517087 - RNA, 13 nt, Human
uugauuauaaagu

SEQ ID NO: 1517088 - RNA, 14 nt, Human
uugauuaaauucuu

SEQ ID NO: 1517089 - RNA, 12 nt, Human
uugcaaggaagc

SEQ ID NO: 1517090 - RNA, 13 nt, Human
uugcaaggaagcc

SEQ ID NO: 1517091 - RNA, 23 nt, Human
aucugaaaauguauguguaagua

SEQ ID NO: 1517092 - RNA, 23 nt, Human
uugauguuuuaaggaugcuugua

SEQ ID NO: 1517093 - RNA, 13 nt, Human
uugauuaaauucu

SEQ ID NO: 1517094 - RNA, 14 nt, Human
uugcauauauacau

SEQ ID NO: 1517095 - RNA, 13 nt, Human
uugcaucaauuuu

SEQ ID NO: 1517096 - RNA, 16 nt, Human
uugcaauggcagccuu

SEQ ID NO: 1517097 - RNA, 17 nt, Human
uugcaauggcagccuug

SEQ ID NO: 1517098 - RNA, 19 nt, Human
uugcaauggcagccuuggc

SEQ ID NO: 1517099 - RNA, 15 nt, Human
uugcaccacugcacu

SEQ ID NO: 1517100 - RNA, 16 nt, Human
uugcaccacugcacuc

SEQ ID NO: 1517101 - RNA, 18 nt, Human
uugcaccacugcacucca

SEQ ID NO: 1517102 - RNA, 19 nt, Human
uugacuugacagaacacug

SEQ ID NO: 1517103 - RNA, 20 nt, Human
uugacuugacagaacacugu

SEQ ID NO: 1517104 - RNA, 21 nt, Human
uugacuugacagaacacuguc

SEQ ID NO: 1517105 - RNA, 20 nt, Human
uugacagaauauguuucaaa

SEQ ID NO: 1517106 - RNA, 16 nt, Human
uugagaucagccuggg

SEQ ID NO: 1517107 - RNA, 15 nt, Human
uugauacuacaguuu

SEQ ID NO: 1517108 - RNA, 18 nt, Human
aucuaauauguaacaagc

SEQ ID NO: 1517109 - RNA, 20 nt, Human
aucuaauauguaacaagcca

SEQ ID NO: 1517110 - RNA, 18 nt, Human
aucuacacuccagugaga

SEQ ID NO: 1517111 - RNA, 19 nt, Human
aucuacacuccagugagac

SEQ ID NO: 1517112 - RNA, 20 nt, Human
uugaguugauucagcucugc

SEQ ID NO: 1517113 - RNA, 20 nt, Human
uugagugaagcugggagaac

SEQ ID NO: 1517114 - RNA, 11 nt, Human
uugagugccuu

SEQ ID NO: 1517115 - RNA, 17 nt, Human
uugaagggaaauuucag

SEQ ID NO: 1517116 - RNA, 22 nt, Human
uugacacuuauagauugaaauu

SEQ ID NO: 1517117 - RNA, 14 nt, Human
uugacagaacacug

SEQ ID NO: 1517118 - RNA, 15 nt, Human
uugacagaacacugu

SEQ ID NO: 1517119 - RNA, 16 nt, Human
uugacagaacacuguc

SEQ ID NO: 1517120 - RNA, 17 nt, Human
uugacagaacacugucu

SEQ ID NO: 1517121 - RNA, 17 nt, Human
uugacagaauauguuuc

SEQ ID NO: 1517122 - RNA, 16 nt, Human
auccucuguacagagc

SEQ ID NO: 1517123 - RNA, 17 nt, Human
auccucuguacagagcc

SEQ ID NO: 1517124 - RNA, 19 nt, Human
aucuaaauggaaccacucu

SEQ ID NO: 1517125 - RNA, 18 nt, Human
aucuaaauggaaccacuc

SEQ ID NO: 1517126 - RNA, 17 nt, Human
aucuaaauggaaccacu

SEQ ID NO: 1517127 - RNA, 13 nt, Human
aucuaaauggaac

SEQ ID NO: 1517128 - RNA, 14 nt, Human
aucuuauaauuuaa

SEQ ID NO: 1517129 - RNA, 18 nt, Human
aucuuguagcuuuaucaa

SEQ ID NO: 1517130 - RNA, 13 nt, Human
aucuugcucugcu

SEQ ID NO: 1517131 - RNA, 20 nt, Human
aucuuggucagauuugaacu

SEQ ID NO: 1517132 - RNA, 23 nt, Human
aucugugaaaggaaagagggagg

SEQ ID NO: 1517133 - RNA, 18 nt, Human
aucugugaaaggaaagag

SEQ ID NO: 1517134 - RNA, 19 nt, Human
aucuuguagcuuuaucaaa

SEQ ID NO: 1517135 - RNA, 20 nt, Human
aucuuguagcuuuaucaaag

SEQ ID NO: 1517136 - RNA, 10 nt, Human
aucuggugac

SEQ ID NO: 1517137 - RNA, 16 nt, Human
aucuggugacuuuccu

SEQ ID NO: 1517138 - RNA, 17 nt, Human
aucuggugacuuuccuc

SEQ ID NO: 1517139 - RNA, 17 nt, Human
aucugugaaaggaaaga

SEQ ID NO: 1517140 - RNA, 18 nt, Human
augaacuuguaaaggaau

SEQ ID NO: 1517141 - RNA, 19 nt, Human
augaaauuauauaaguauu

SEQ ID NO: 1517142 - RNA, 21 nt, Human
augaaauuauauaaguauucu

SEQ ID NO: 1517143 - RNA, 19 nt, Human
augaaagggcccagagagg

SEQ ID NO: 1517144 - RNA, 15 nt, Human
augaauuacauuugu

SEQ ID NO: 1517145 - RNA, 23 nt, Human
augaauggcuaagcaaaauguga

SEQ ID NO: 1517146 - RNA, 16 nt, Human
augaauuacauuugua

SEQ ID NO: 1517147 - RNA, 17 nt, Human
augaauuacauuuguau

SEQ ID NO: 1517148 - RNA, 18 nt, Human
uuggggaccagagcugcc

SEQ ID NO: 1517149 - RNA, 20 nt, Human
aucuuugauucuccuucagc

SEQ ID NO: 1517150 - RNA, 18 nt, Human
aucuuugcagacaggcaa

SEQ ID NO: 1517151 - RNA, 22 nt, Human
aucuuuucauuuaggugaggaa

SEQ ID NO: 1517152 - RNA, 17 nt, Human
aucuuugcagacaggca

SEQ ID NO: 1517153 - RNA, 16 nt, Human
aucuuugauucuccuu

SEQ ID NO: 1517154 - RNA, 17 nt, Human
aucuuugauucuccuuc

SEQ ID NO: 1517155 - RNA, 18 nt, Human
aucuuugauucuccuuca

SEQ ID NO: 1517156 - RNA, 19 nt, Human
aucuuugauucuccuucag

SEQ ID NO: 1517157 - RNA, 18 nt, Human
augaaagggcccagagag

SEQ ID NO: 1517158 - RNA, 23 nt, Human
aucuuuucuugccucuguccccu

SEQ ID NO: 1517159 - RNA, 14 nt, Human
aucuuuucuugccu

SEQ ID NO: 1517160 - RNA, 16 nt, Human
uuggcucacacugaga

SEQ ID NO: 1517161 - RNA, 17 nt, Human
uuggcucacacugagaa

SEQ ID NO: 1517162 - RNA, 13 nt, Human
aucuuucuugauc

SEQ ID NO: 1517163 - RNA, 18 nt, Human
aucuuucuugaucaacau

SEQ ID NO: 1517164 - RNA, 14 nt, Human
aucuuugauucucc

SEQ ID NO: 1517165 - RNA, 15 nt, Human
aucuuugauucuccu

SEQ ID NO: 1517166 - RNA, 20 nt, Human
uuggagacacaacuauuuuu

SEQ ID NO: 1517167 - RNA, 14 nt, Human
uugcuugaaagaaa

SEQ ID NO: 1517168 - RNA, 16 nt, Human
uuggagggugucccaa

SEQ ID NO: 1517169 - RNA, 18 nt, Human
uuggccccugcccggcug

SEQ ID NO: 1517170 - RNA, 14 nt, Human
auaauuuuaagaaa

SEQ ID NO: 1517171 - RNA, 19 nt, Human
auaauuuauacaggucaua

SEQ ID NO: 1517172 - RNA, 21 nt, Human
auaauuuauacaggucauauu

SEQ ID NO: 1517173 - RNA, 17 nt, Human
auaauucagaaggaucu

SEQ ID NO: 1517174 - RNA, 14 nt, Human
auaaucuuucacag

SEQ ID NO: 1517175 - RNA, 14 nt, Human
auaauauuuuuaau

SEQ ID NO: 1517176 - RNA, 17 nt, Human
auaaucaaauacauuuu

SEQ ID NO: 1517177 - RNA, 20 nt, Human
auaauauuuuuaauuaaaua

SEQ ID NO: 1517178 - RNA, 14 nt, Human
auaagccagacauc

SEQ ID NO: 1517179 - RNA, 21 nt, Human
auaagauucauauuuacuucu

SEQ ID NO: 1517180 - RNA, 22 nt, Human
auaagccaaaaaaugcuugcuu

SEQ ID NO: 1517181 - RNA, 14 nt, Human
uuaggguuaugauu

SEQ ID NO: 1517182 - RNA, 16 nt, Human
uuaggguuaugauuaa

SEQ ID NO: 1517183 - RNA, 15 nt, Human
uuagggagagaagau

SEQ ID NO: 1517184 - RNA, 18 nt, Human
uuagguuggcaaaaaggc

SEQ ID NO: 1517185 - RNA, 19 nt, Human
uuaggugugggggaagcac

SEQ ID NO: 1517186 - RNA, 15 nt, Human
uuaggugaggaagca

SEQ ID NO: 1517187 - RNA, 13 nt, Human
uuauaaacuuuac

SEQ ID NO: 1517188 - RNA, 13 nt, Human
uuaguagagacag

SEQ ID NO: 1517189 - RNA, 17 nt, Human
uuaguagagacaggguu

SEQ ID NO: 1517190 - RNA, 14 nt, Human
uuaguagagacagg

SEQ ID NO: 1517191 - RNA, 17 nt, Human
uuacaguggggaaugaa

SEQ ID NO: 1517192 - RNA, 19 nt, Human
uuaccagcagagcaccuua

SEQ ID NO: 1517193 - RNA, 20 nt, Human
uuacauaagauaaaugugcu

SEQ ID NO: 1517194 - RNA, 14 nt, Human
uuacaggugugaac

SEQ ID NO: 1517195 - RNA, 19 nt, Human
auaacucauuuguuguuug

SEQ ID NO: 1517196 - RNA, 12 nt, Human
uuacaaacaugu

SEQ ID NO: 1517197 - RNA, 15 nt, Human
uuacaaacauguggu

SEQ ID NO: 1517198 - RNA, 12 nt, Human
uuacuguacaug

SEQ ID NO: 1517199 - RNA, 23 nt, Human
uuacuguacaugaaaacacauuu

SEQ ID NO: 1517200 - RNA, 22 nt, Human
uuacuguacaugaaaacacauu

SEQ ID NO: 1517201 - RNA, 14 nt, Human
uuacuguacaugaa

SEQ ID NO: 1517202 - RNA, 13 nt, Human
uuacuguacauga

SEQ ID NO: 1517203 - RNA, 15 nt, Human
uuacugcagcuuugu

SEQ ID NO: 1517204 - RNA, 16 nt, Human
uuagaagucacacagu

SEQ ID NO: 1517205 - RNA, 14 nt, Human
auaagauucauauu

SEQ ID NO: 1517206 - RNA, 16 nt, Human
uuaauuugguuuucac

SEQ ID NO: 1517207 - RNA, 22 nt, Human
uuaagagagucuauuuacggaa

SEQ ID NO: 1517208 - RNA, 15 nt, Human
uuaaucuaaauggaa

SEQ ID NO: 1517209 - RNA, 16 nt, Human
aguuuuauaugcuucu

SEQ ID NO: 1517210 - RNA, 21 nt, Human
aguuuugugaaggugauuuau

SEQ ID NO: 1517211 - RNA, 22 nt, Human
uuaacuuuuauaaacuuuaccu

SEQ ID NO: 1517212 - RNA, 23 nt, Human
uuaacuuuuauaaacuuuaccuu

SEQ ID NO: 1517213 - RNA, 19 nt, Human
uuaagaaaaaggaugcaca

SEQ ID NO: 1517214 - RNA, 20 nt, Human
aguuuaaauuguaauaggcg

SEQ ID NO: 1517215 - RNA, 17 nt, Human
aguuuaaauuguaauag

SEQ ID NO: 1517216 - RNA, 12 nt, Human
aguuuaccaucu

SEQ ID NO: 1517217 - RNA, 15 nt, Human
aguuuacauuguaaa

SEQ ID NO: 1517218 - RNA, 17 nt, Human
aguuuacauuguaaaua

SEQ ID NO: 1517219 - RNA, 15 nt, Human
aguuuagcuggaaaa

SEQ ID NO: 1517220 - RNA, 16 nt, Human
aguuuaccaucugaaa

SEQ ID NO: 1517221 - RNA, 16 nt, Human
aguuuagcuggaaaag

SEQ ID NO: 1517222 - RNA, 20 nt, Human
uuaaaaaucucaaauuucua

SEQ ID NO: 1517223 - RNA, 19 nt, Human
uuaaaaaucucaaauuucu

SEQ ID NO: 1517224 - RNA, 16 nt, Human
uuaaaaaauggaacau

SEQ ID NO: 1517225 - RNA, 20 nt, Human
uuaaaaaugguuuaaauggu

SEQ ID NO: 1517226 - RNA, 22 nt, Human
uuaaaaucauuucugcaucagc

SEQ ID NO: 1517227 - RNA, 16 nt, Human
uuaacagaaauguaca

SEQ ID NO: 1517228 - RNA, 14 nt, Human
uuaacagaaaugua

SEQ ID NO: 1517229 - RNA, 13 nt, Human
uuaacagaaaugu

SEQ ID NO: 1517230 - RNA, 12 nt, Human
uuaacagaaaug

SEQ ID NO: 1517231 - RNA, 15 nt, Human
uuaaauuuugaguuc

SEQ ID NO: 1517232 - RNA, 20 nt, Human
uuaaauuuugaguucuacau

SEQ ID NO: 1517233 - RNA, 14 nt, Human
uuaaauuuuguguc

SEQ ID NO: 1517234 - RNA, 16 nt, Human
uuaaauuuugugucuc

SEQ ID NO: 1517235 - RNA, 19 nt, Human
aguuucugccgcagcccug

SEQ ID NO: 1517236 - RNA, 22 nt, Human
aguuuguuaguaugaggcauuu

SEQ ID NO: 1517237 - RNA, 15 nt, Human
aguuucugccgcagc

SEQ ID NO: 1517238 - RNA, 14 nt, Human
aguuucucuuuuca

SEQ ID NO: 1517239 - RNA, 18 nt, Human
auagauaggucagugcaa

SEQ ID NO: 1517240 - RNA, 14 nt, Human
auagaguguacuua

SEQ ID NO: 1517241 - RNA, 19 nt, Human
auagaguguacuuaacuau

SEQ ID NO: 1517242 - RNA, 21 nt, Human
auagaguguacuuaacuauuc

SEQ ID NO: 1517243 - RNA, 14 nt, Human
auagagagagacca

SEQ ID NO: 1517244 - RNA, 15 nt, Human
auagagcaaaauuga

SEQ ID NO: 1517245 - RNA, 17 nt, Human
auagagcaaaauugaug

SEQ ID NO: 1517246 - RNA, 21 nt, Human
auagagcaaaauugauguguu

SEQ ID NO: 1517247 - RNA, 22 nt, Human
auagagcaaaauugauguguuu

SEQ ID NO: 1517248 - RNA, 13 nt, Human
auagaaguaaaaa

SEQ ID NO: 1517249 - RNA, 17 nt, Human
auagaauuaacacauga

SEQ ID NO: 1517250 - RNA, 23 nt, Human
auagacaauuuauuauggcacau

SEQ ID NO: 1517251 - RNA, 22 nt, Human
auagacaauuuauuauggcaca

SEQ ID NO: 1517252 - RNA, 16 nt, Human
auagacaauuuauuau

SEQ ID NO: 1517253 - RNA, 14 nt, Human
auacucuuauaucu

SEQ ID NO: 1517254 - RNA, 18 nt, Human
auacucuuauaucuauau

SEQ ID NO: 1517255 - RNA, 16 nt, Human
auacucugcuuagaau

SEQ ID NO: 1517256 - RNA, 17 nt, Human
auacuccuccaagguua

SEQ ID NO: 1517257 - RNA, 14 nt, Human
auacucccaucugu

SEQ ID NO: 1517258 - RNA, 16 nt, Human
auacucauuaggaugg

SEQ ID NO: 1517259 - RNA, 11 nt, Human
auacucccauc

SEQ ID NO: 1517260 - RNA, 14 nt, Human
uuauuauauuuaca

SEQ ID NO: 1517261 - RNA, 19 nt, Human
uuauguuaaaacugggaca

SEQ ID NO: 1517262 - RNA, 15 nt, Human
uuauuauauuuacaa

SEQ ID NO: 1517263 - RNA, 12 nt, Human
uuauuaugcaug

SEQ ID NO: 1517264 - RNA, 13 nt, Human
uuauuaugcauga

SEQ ID NO: 1517265 - RNA, 19 nt, Human
uuaugauuaaguaaugaua

SEQ ID NO: 1517266 - RNA, 22 nt, Human
uuaugauuaaguaaugauaacu

SEQ ID NO: 1517267 - RNA, 19 nt, Human
uuauggcuuuugugcauua

SEQ ID NO: 1517268 - RNA, 20 nt, Human
uuaugaugugggucaaggaa

SEQ ID NO: 1517269 - RNA, 21 nt, Human
uuaugaugugggucaaggaau

SEQ ID NO: 1517270 - RNA, 13 nt, Human
uuaugggcugggu

SEQ ID NO: 1517271 - RNA, 22 nt, Human
uuaugggcuggguucuacccag

SEQ ID NO: 1517272 - RNA, 14 nt, Human
uuaugaaacuuuug

SEQ ID NO: 1517273 - RNA, 17 nt, Human
uuaugaaacuuuuggaa

SEQ ID NO: 1517274 - RNA, 18 nt, Human
uuaugaaacuuuuggaag

SEQ ID NO: 1517275 - RNA, 19 nt, Human
uuaugaaacuuuuggaagg

SEQ ID NO: 1517276 - RNA, 21 nt, Human
uuaucacccagaagaaaauag

SEQ ID NO: 1517277 - RNA, 19 nt, Human
uuaucacccagaagaaaau

SEQ ID NO: 1517278 - RNA, 18 nt, Human
uuaucacccagaagaaaa

SEQ ID NO: 1517279 - RNA, 17 nt, Human
uuaucacccagaagaaa

SEQ ID NO: 1517280 - RNA, 14 nt, Human
uuaugaauuacauu

SEQ ID NO: 1517281 - RNA, 16 nt, Human
uuaugaauuacauuug

SEQ ID NO: 1517282 - RNA, 17 nt, Human
uuaugaauuacauuugu

SEQ ID NO: 1517283 - RNA, 21 nt, Human
uuaugaauuacauuuguauaa

SEQ ID NO: 1517284 - RNA, 11 nt, Human
uuaugacucca

SEQ ID NO: 1517285 - RNA, 18 nt, Human
auacaguuacucagaauu

SEQ ID NO: 1517286 - RNA, 23 nt, Human
auacagauagauauaugcucugc

SEQ ID NO: 1517287 - RNA, 23 nt, Human
auacaggaaaagcugcugacagu

SEQ ID NO: 1517288 - RNA, 20 nt, Human
auacaguuacucagaauucu

SEQ ID NO: 1517289 - RNA, 18 nt, Human
uuauaaacuuuaccuuuu

SEQ ID NO: 1517290 - RNA, 17 nt, Human
uuauaaacuuuaccuuu

SEQ ID NO: 1517291 - RNA, 16 nt, Human
auacagaggcaacugc

SEQ ID NO: 1517292 - RNA, 17 nt, Human
auacagaggcaacugca

SEQ ID NO: 1517293 - RNA, 18 nt, Human
auacgugggcauucaaau

SEQ ID NO: 1517294 - RNA, 19 nt, Human
auacgugggcauucaaaug

SEQ ID NO: 1517295 - RNA, 16 nt, Human
auacguacacauuuua

SEQ ID NO: 1517296 - RNA, 15 nt, Human
auacguacacauuuu

SEQ ID NO: 1517297 - RNA, 14 nt, Human
auacguacacauuu

SEQ ID NO: 1517298 - RNA, 13 nt, Human
auacguacacauu

SEQ ID NO: 1517299 - RNA, 23 nt, Human
auacgcaacauaauuaaauuuug

SEQ ID NO: 1517300 - RNA, 14 nt, Human
auaccuuuuuuaga

SEQ ID NO: 1517301 - RNA, 17 nt, Human
auaccagccaguaaaug

SEQ ID NO: 1517302 - RNA, 18 nt, Human
auaccacuuuuguucuug

SEQ ID NO: 1517303 - RNA, 17 nt, Human
auaccacuuuuguucuu

SEQ ID NO: 1517304 - RNA, 19 nt, Human
uuauauuugaaauauugac

SEQ ID NO: 1517305 - RNA, 17 nt, Human
auacuauggaauuucuc

SEQ ID NO: 1517306 - RNA, 20 nt, Human
auacuaaccagcagaaaugc

SEQ ID NO: 1517307 - RNA, 19 nt, Human
auacuaaccagcagaaaug

SEQ ID NO: 1517308 - RNA, 13 nt, Human
auacuaaccagca

SEQ ID NO: 1517309 - RNA, 16 nt, Human
aguggggaaugaagau

SEQ ID NO: 1517310 - RNA, 11 nt, Human
aguggcagcug

SEQ ID NO: 1517311 - RNA, 19 nt, Human
uguuacauaagauaaaugu

SEQ ID NO: 1517312 - RNA, 23 nt, Human
uguuaagcagauggaaugcugug

SEQ ID NO: 1517313 - RNA, 22 nt, Human
uguguuaucacccagaagaaaa

SEQ ID NO: 1517314 - RNA, 23 nt, Human
uguguuaucacccagaagaaaau

SEQ ID NO: 1517315 - RNA, 20 nt, Human
uguggucacaggaaguagag

SEQ ID NO: 1517316 - RNA, 14 nt, Human
uguguaaaauguga

SEQ ID NO: 1517317 - RNA, 19 nt, Human
ugugucuaaauuugaaugu

SEQ ID NO: 1517318 - RNA, 22 nt, Human
ugugucuaaauuugaauguuaa

SEQ ID NO: 1517319 - RNA, 20 nt, Human
ugugucuugcaauggcagcc

SEQ ID NO: 1517320 - RNA, 11 nt, Human
uguguguuuau

SEQ ID NO: 1517321 - RNA, 13 nt, Human
uguuaugacucca

SEQ ID NO: 1517322 - RNA, 17 nt, Human
uguuaugacuccagaau

SEQ ID NO: 1517323 - RNA, 22 nt, Human
agugugguguuuccuggcacug

SEQ ID NO: 1517324 - RNA, 19 nt, Human
uguuccacaaguuaaauaa

SEQ ID NO: 1517325 - RNA, 21 nt, Human
agugugccugaagucccagau

SEQ ID NO: 1517326 - RNA, 20 nt, Human
agugugacugaucucucgug

SEQ ID NO: 1517327 - RNA, 19 nt, Human
agugugaggguccugcagc

SEQ ID NO: 1517328 - RNA, 16 nt, Human
aguguuguggauuuaa

SEQ ID NO: 1517329 - RNA, 13 nt, Human
aguuacucagaau

SEQ ID NO: 1517330 - RNA, 20 nt, Human
aguguuguggauuuaacaga

SEQ ID NO: 1517331 - RNA, 19 nt, Human
aguguuguggauuuaacag

SEQ ID NO: 1517332 - RNA, 15 nt, Human
uguucuaagaaguga

SEQ ID NO: 1517333 - RNA, 22 nt, Human
uguugcccacagcuguaugauu

SEQ ID NO: 1517334 - RNA, 23 nt, Human
uguugcccaggcuggcgugcagu

SEQ ID NO: 1517335 - RNA, 20 nt, Human
uguugcccaggcuggcgugc

SEQ ID NO: 1517336 - RNA, 12 nt, Human
uguugcccaggc

SEQ ID NO: 1517337 - RNA, 14 nt, Human
agugccaaaaacaa

SEQ ID NO: 1517338 - RNA, 16 nt, Human
agugcaugcugucccu

SEQ ID NO: 1517339 - RNA, 17 nt, Human
agugcacuaauguguaa

SEQ ID NO: 1517340 - RNA, 21 nt, Human
agugcacuaauguguaagaca

SEQ ID NO: 1517341 - RNA, 17 nt, Human
agugcagugagccgaga

SEQ ID NO: 1517342 - RNA, 14 nt, Human
agugcaaauuguca

SEQ ID NO: 1517343 - RNA, 16 nt, Human
agugaggaugaaaaaa

SEQ ID NO: 1517344 - RNA, 14 nt, Human
agugaggcucugcc

SEQ ID NO: 1517345 - RNA, 13 nt, Human
agugaggcucugc

SEQ ID NO: 1517346 - RNA, 12 nt, Human
agugaggcucug

SEQ ID NO: 1517347 - RNA, 12 nt, Human
ugugcucugauc

SEQ ID NO: 1517348 - RNA, 18 nt, Human
ugugcugagucugaaggc

SEQ ID NO: 1517349 - RNA, 19 nt, Human
ugugcugagucugaaggcu

SEQ ID NO: 1517350 - RNA, 12 nt, Human
ugugcugcccug

SEQ ID NO: 1517351 - RNA, 14 nt, Human
uguggaugauaaaa

SEQ ID NO: 1517352 - RNA, 22 nt, Human
uguggauuuaacagaaauguac

SEQ ID NO: 1517353 - RNA, 23 nt, Human
agugagcugguuuuuagcggaga

SEQ ID NO: 1517354 - RNA, 20 nt, Human
uguggauuuaacagaaaugu

SEQ ID NO: 1517355 - RNA, 19 nt, Human
uguggauuuaacagaaaug

SEQ ID NO: 1517356 - RNA, 18 nt, Human
ugugcugcccugcccacc

SEQ ID NO: 1517357 - RNA, 19 nt, Human
ugugcugcccugcccaccu

SEQ ID NO: 1517358 - RNA, 20 nt, Human
ugugcugcccugcccaccug

SEQ ID NO: 1517359 - RNA, 21 nt, Human
ugugcugcccugcccaccugg

SEQ ID NO: 1517360 - RNA, 14 nt, Human
agugagcacuaagg

SEQ ID NO: 1517361 - RNA, 22 nt, Human
agugagcacuaaggugugcucu

SEQ ID NO: 1517362 - RNA, 22 nt, Human
ugugaugaugaaaugaggucag

SEQ ID NO: 1517363 - RNA, 19 nt, Human
ugugaugagaggaaaucac

SEQ ID NO: 1517364 - RNA, 12 nt, Human
agugagcugguu

SEQ ID NO: 1517365 - RNA, 18 nt, Human
agucuuucacauuuaaau

SEQ ID NO: 1517366 - RNA, 21 nt, Human
agugaacaaauuuacagagac

SEQ ID NO: 1517367 - RNA, 16 nt, Human
agucuuucacauuuaa

SEQ ID NO: 1517368 - RNA, 20 nt, Human
agugaacuugggccacugug

SEQ ID NO: 1517369 - RNA, 21 nt, Human
agugacugauggcuaauguac

SEQ ID NO: 1517370 - RNA, 22 nt, Human
agugaacaaauuuacagagaca

SEQ ID NO: 1517371 - RNA, 23 nt, Human
agugaacaaauuuacagagacag

SEQ ID NO: 1517372 - RNA, 16 nt, Human
agugaacuugggccac

SEQ ID NO: 1517373 - RNA, 12 nt, Human
agucugaaggcu

SEQ ID NO: 1517374 - RNA, 13 nt, Human
agucuuagaugua

SEQ ID NO: 1517375 - RNA, 23 nt, Human
agucuuagauguauauauuuccu

SEQ ID NO: 1517376 - RNA, 14 nt, Human
agucuuagauguau

SEQ ID NO: 1517377 - RNA, 16 nt, Human
agucuuagauguauau

SEQ ID NO: 1517378 - RNA, 16 nt, Human
agucucuugauucaua

SEQ ID NO: 1517379 - RNA, 17 nt, Human
agucucuugauucauaa

SEQ ID NO: 1517380 - RNA, 11 nt, Human
ugugaggaagc

SEQ ID NO: 1517381 - RNA, 12 nt, Human
ugugaggaagcc

SEQ ID NO: 1517382 - RNA, 19 nt, Human
ugugagacucgagaacuuu

SEQ ID NO: 1517383 - RNA, 17 nt, Human
agucaccccggccaccu

SEQ ID NO: 1517384 - RNA, 15 nt, Human
agucaccaagcccag

SEQ ID NO: 1517385 - RNA, 19 nt, Human
aguauucuuauuuaaugaa

SEQ ID NO: 1517386 - RNA, 15 nt, Human
aguauuacuucugcu

SEQ ID NO: 1517387 - RNA, 23 nt, Human
ugucauuugcuggagcucugccc

SEQ ID NO: 1517388 - RNA, 14 nt, Human
uguccaagaagccc

SEQ ID NO: 1517389 - RNA, 15 nt, Human
uguccaagaagccca

SEQ ID NO: 1517390 - RNA, 17 nt, Human
ugucagguggggcagcu

SEQ ID NO: 1517391 - RNA, 18 nt, Human
ugucagguggggcagcuu

SEQ ID NO: 1517392 - RNA, 20 nt, Human
ugucagguggggcagcuuga

SEQ ID NO: 1517393 - RNA, 20 nt, Human
ugucauuugagcagggcuca

SEQ ID NO: 1517394 - RNA, 21 nt, Human
ugucauuugagcagggcucag

SEQ ID NO: 1517395 - RNA, 22 nt, Human
ugucauuugagcagggcucagc

SEQ ID NO: 1517396 - RNA, 16 nt, Human
uguccaagaagcccag

SEQ ID NO: 1517397 - RNA, 17 nt, Human
uguccaagaagcccagg

SEQ ID NO: 1517398 - RNA, 18 nt, Human
uguccaagaagcccagga

SEQ ID NO: 1517399 - RNA, 22 nt, Human
uguccaagaagcccaggaaagg

SEQ ID NO: 1517400 - RNA, 22 nt, Human
uguccccuucucucaucucuua

SEQ ID NO: 1517401 - RNA, 20 nt, Human
ugucccugcacuugcagacu

SEQ ID NO: 1517402 - RNA, 22 nt, Human
ugucccugcacuugcagacucu

SEQ ID NO: 1517403 - RNA, 23 nt, Human
ugucccugcacuugcagacucua

SEQ ID NO: 1517404 - RNA, 15 nt, Human
uguccccugacaggg

SEQ ID NO: 1517405 - RNA, 16 nt, Human
uguccccugacagggc

SEQ ID NO: 1517406 - RNA, 18 nt, Human
uguccccugacagggcca

SEQ ID NO: 1517407 - RNA, 11 nt, Human
uguccccuucu

SEQ ID NO: 1517408 - RNA, 14 nt, Human
uguccccuucucuc

SEQ ID NO: 1517409 - RNA, 16 nt, Human
uguccccuucucucau

SEQ ID NO: 1517410 - RNA, 20 nt, Human
uguccccuucucucaucucu

SEQ ID NO: 1517411 - RNA, 15 nt, Human
agucuauuuacggaa

SEQ ID NO: 1517412 - RNA, 20 nt, Human
agucuauuuacggaacucaa

SEQ ID NO: 1517413 - RNA, 23 nt, Human
agucucacuguugcccaggcugg

SEQ ID NO: 1517414 - RNA, 13 nt, Human
agucucaggaaau

SEQ ID NO: 1517415 - RNA, 16 nt, Human
agucucaggaaaucaa

SEQ ID NO: 1517416 - RNA, 11 nt, Human
ugucuccaacc

SEQ ID NO: 1517417 - RNA, 16 nt, Human
ugucuccaacccccca

SEQ ID NO: 1517418 - RNA, 17 nt, Human
ugucuccaaccccccag

SEQ ID NO: 1517419 - RNA, 19 nt, Human
ugucuccaaccccccagca

SEQ ID NO: 1517420 - RNA, 20 nt, Human
ugucuccaaccccccagcac

SEQ ID NO: 1517421 - RNA, 21 nt, Human
ugucuccaaccccccagcacu

SEQ ID NO: 1517422 - RNA, 22 nt, Human
ugucuccaaccccccagcacug

SEQ ID NO: 1517423 - RNA, 23 nt, Human
ugucuccaaccccccagcacuga

SEQ ID NO: 1517424 - RNA, 18 nt, Human
agucgcugugccacaggc

SEQ ID NO: 1517425 - RNA, 14 nt, Human
aguccucccaucuc

SEQ ID NO: 1517426 - RNA, 16 nt, Human
aguccucccaucucac

SEQ ID NO: 1517427 - RNA, 14 nt, Human
agucaggaaagaga

SEQ ID NO: 1517428 - RNA, 15 nt, Human
agucaggaaagagaa

SEQ ID NO: 1517429 - RNA, 22 nt, Human
agucagaaguuucugccgcagc

SEQ ID NO: 1517430 - RNA, 19 nt, Human
ugucccuuacgugaguccu

SEQ ID NO: 1517431 - RNA, 23 nt, Human
ugucccuuacgugaguccuggca

SEQ ID NO: 1517432 - RNA, 18 nt, Human
agucccaccuuggcugca

SEQ ID NO: 1517433 - RNA, 19 nt, Human
agucccaccuuggcugcag

SEQ ID NO: 1517434 - RNA, 20 nt, Human
agucccaccuuggcugcagg

SEQ ID NO: 1517435 - RNA, 15 nt, Human
agucccaccuuggcu

SEQ ID NO: 1517436 - RNA, 16 nt, Human
agucccaccuuggcug

SEQ ID NO: 1517437 - RNA, 16 nt, Human
uguaggguuauaauaa

SEQ ID NO: 1517438 - RNA, 17 nt, Human
uguaggguuauaauaau

SEQ ID NO: 1517439 - RNA, 17 nt, Human
uguaguguuggagaaga

SEQ ID NO: 1517440 - RNA, 18 nt, Human
uguaguguuggagaagaa

SEQ ID NO: 1517441 - RNA, 19 nt, Human
uguaguguuggagaagaac

SEQ ID NO: 1517442 - RNA, 18 nt, Human
uguauauccuuucuaaca

SEQ ID NO: 1517443 - RNA, 22 nt, Human
uguauauauuuccuauauuguu

SEQ ID NO: 1517444 - RNA, 18 nt, Human
uguauauauuuccuauau

SEQ ID NO: 1517445 - RNA, 21 nt, Human
uguacauggaauaacauguaa

SEQ ID NO: 1517446 - RNA, 13 nt, Human
aguaauagagcaa

SEQ ID NO: 1517447 - RNA, 16 nt, Human
aguaaaaccacagcag

SEQ ID NO: 1517448 - RNA, 17 nt, Human
aguaaaaccacagcagu

SEQ ID NO: 1517449 - RNA, 19 nt, Human
aguaaaaccacagcaguug

SEQ ID NO: 1517450 - RNA, 20 nt, Human
aguaaaaccacagcaguuga

SEQ ID NO: 1517451 - RNA, 13 nt, Human
aguaaugauaacu

SEQ ID NO: 1517452 - RNA, 12 nt, Human
aguaauuggaaa

SEQ ID NO: 1517453 - RNA, 13 nt, Human
aguaauuggaaag

SEQ ID NO: 1517454 - RNA, 19 nt, Human
aguaauucaagaaaacaac

SEQ ID NO: 1517455 - RNA, 19 nt, Human
aguacauuuggagacacaa

SEQ ID NO: 1517456 - RNA, 23 nt, Human
aguacacuguuucaaacuuuacu

SEQ ID NO: 1517457 - RNA, 21 nt, Human
aguacacuguuucaaacuuua

SEQ ID NO: 1517458 - RNA, 12 nt, Human
aggugugcucug

SEQ ID NO: 1517459 - RNA, 14 nt, Human
agguugaagcacca

SEQ ID NO: 1517460 - RNA, 16 nt, Human
aggugucccugcacuu

SEQ ID NO: 1517461 - RNA, 20 nt, Human
aggugucccugcacuugcag

SEQ ID NO: 1517462 - RNA, 21 nt, Human
aggugugagucaccaagccca

SEQ ID NO: 1517463 - RNA, 22 nt, Human
aggugugagucaccaagcccag

SEQ ID NO: 1517464 - RNA, 12 nt, Human
aggugggaggau

SEQ ID NO: 1517465 - RNA, 16 nt, Human
aggugcuacaaaaaca

SEQ ID NO: 1517466 - RNA, 14 nt, Human
agguuucugaaaau

SEQ ID NO: 1517467 - RNA, 20 nt, Human
agguuggcaaaaaggcagga

SEQ ID NO: 1517468 - RNA, 15 nt, Human
agguuucugaaaauu

SEQ ID NO: 1517469 - RNA, 23 nt, Human
agguuucugaaaauuaacacugc

SEQ ID NO: 1517470 - RNA, 13 nt, Human
uguaagggaaacu

SEQ ID NO: 1517471 - RNA, 18 nt, Human
uguaagggaaacugccag

SEQ ID NO: 1517472 - RNA, 23 nt, Human
uguaauuaaguacuauguaucaa

SEQ ID NO: 1517473 - RNA, 18 nt, Human
uguaauuaaguacuaugu

SEQ ID NO: 1517474 - RNA, 19 nt, Human
uguaagggaaacugccagc

SEQ ID NO: 1517475 - RNA, 19 nt, Human
uguaauuaaguacuaugua

SEQ ID NO: 1517476 - RNA, 21 nt, Human
uguaauuaaguacuauguauc

SEQ ID NO: 1517477 - RNA, 14 nt, Human
uguacaugaaaaca

SEQ ID NO: 1517478 - RNA, 16 nt, Human
uguacaugaaaacaca

SEQ ID NO: 1517479 - RNA, 20 nt, Human
uguacauaaugcgugcauac

SEQ ID NO: 1517480 - RNA, 19 nt, Human
uguacauaaugcgugcaua

SEQ ID NO: 1517481 - RNA, 20 nt, Human
uguaauuuuuuuaucgucac

SEQ ID NO: 1517482 - RNA, 18 nt, Human
ugggaaacaaaaggauaa

SEQ ID NO: 1517483 - RNA, 21 nt, Human
uggcuuuugugcauuaucuag

SEQ ID NO: 1517484 - RNA, 16 nt, Human
uggcuuuugugcauua

SEQ ID NO: 1517485 - RNA, 22 nt, Human
uggcuucacggaagagccuugc

SEQ ID NO: 1517486 - RNA, 17 nt, Human
uggcuucacggaagagc

SEQ ID NO: 1517487 - RNA, 20 nt, Human
uggcuucacggaagagccuu

SEQ ID NO: 1517488 - RNA, 14 nt, Human
ugggaaagcauugu

SEQ ID NO: 1517489 - RNA, 16 nt, Human
ugggaaagcauuguaa

SEQ ID NO: 1517490 - RNA, 21 nt, Human
ugggaaagcauuguaaaugug

SEQ ID NO: 1517491 - RNA, 17 nt, Human
ugggaaagcauuguaaa

SEQ ID NO: 1517492 - RNA, 18 nt, Human
ugggaaagcauuguaaau

SEQ ID NO: 1517493 - RNA, 16 nt, Human
uggcuguuggcugggg

SEQ ID NO: 1517494 - RNA, 18 nt, Human
uggcuguuggcugggggc

SEQ ID NO: 1517495 - RNA, 23 nt, Human
uggcuguuggcugggggccucag

SEQ ID NO: 1517496 - RNA, 14 nt, Human
uggcuucacggaag

SEQ ID NO: 1517497 - RNA, 23 nt, Human
uggcugcaaaggguaucaggugc

SEQ ID NO: 1517498 - RNA, 13 nt, Human
uggcucacgccug

SEQ ID NO: 1517499 - RNA, 23 nt, Human
uggcuauaggugcuacaaaaaca

SEQ ID NO: 1517500 - RNA, 12 nt, Human
uggcucacacug

SEQ ID NO: 1517501 - RNA, 13 nt, Human
uggcucacacuga

SEQ ID NO: 1517502 - RNA, 14 nt, Human
uggcucacacugag

SEQ ID NO: 1517503 - RNA, 15 nt, Human
uggcucacacugaga

SEQ ID NO: 1517504 - RNA, 16 nt, Human
uggcucacacugagaa

SEQ ID NO: 1517505 - RNA, 18 nt, Human
uggcuaagcaaaauguga

SEQ ID NO: 1517506 - RNA, 17 nt, Human
aggcuccaggagcagcc

SEQ ID NO: 1517507 - RNA, 18 nt, Human
aggcuccaggagcagcca

SEQ ID NO: 1517508 - RNA, 19 nt, Human
aggcuccaggagcagccac

SEQ ID NO: 1517509 - RNA, 23 nt, Human
aggcuccaggagcagccacauuc

SEQ ID NO: 1517510 - RNA, 17 nt, Human
uggcuaauguacugcau

SEQ ID NO: 1517511 - RNA, 19 nt, Human
uggcuaauguacugcauau

SEQ ID NO: 1517512 - RNA, 15 nt, Human
uggcuauaggugcua

SEQ ID NO: 1517513 - RNA, 19 nt, Human
uggcuauaggugcuacaaa

SEQ ID NO: 1517514 - RNA, 14 nt, Human
aggcuggguucuga

SEQ ID NO: 1517515 - RNA, 17 nt, Human
aggcuggguucugaucc

SEQ ID NO: 1517516 - RNA, 22 nt, Human
aggcugggggaagaagcucucu

SEQ ID NO: 1517517 - RNA, 18 nt, Human
aggcugggcuucaguggc

SEQ ID NO: 1517518 - RNA, 19 nt, Human
aggcugggcuucaguggca

SEQ ID NO: 1517519 - RNA, 20 nt, Human
aggcugggcuucaguggcag

SEQ ID NO: 1517520 - RNA, 21 nt, Human
aggcugggcuucaguggcagc

SEQ ID NO: 1517521 - RNA, 22 nt, Human
aggcugggcuucaguggcagcu

SEQ ID NO: 1517522 - RNA, 23 nt, Human
aggcugggcuucaguggcagcug

SEQ ID NO: 1517523 - RNA, 17 nt, Human
aggcugggggaagaagc

SEQ ID NO: 1517524 - RNA, 20 nt, Human
ugggaacccaaguccaagca

SEQ ID NO: 1517525 - RNA, 19 nt, Human
aggcugggagagccuucca

SEQ ID NO: 1517526 - RNA, 16 nt, Human
aggcugggagagccuu

SEQ ID NO: 1517527 - RNA, 22 nt, Human
aggcugggagagccuuccaggg

SEQ ID NO: 1517528 - RNA, 20 nt, Human
aggcugggagagccuuccag

SEQ ID NO: 1517529 - RNA, 21 nt, Human
aggcugggagagccuuccagg

SEQ ID NO: 1517530 - RNA, 13 nt, Human
aggcugggcuccc

SEQ ID NO: 1517531 - RNA, 14 nt, Human
aggcugggcucccu

SEQ ID NO: 1517532 - RNA, 18 nt, Human
aggcugggcucccuuccc

SEQ ID NO: 1517533 - RNA, 14 nt, Human
aggcugggcuucag

SEQ ID NO: 1517534 - RNA, 21 nt, Human
aggcugggcucccuucccacc

SEQ ID NO: 1517535 - RNA, 23 nt, Human
aggcugggcucccuucccaccuc

SEQ ID NO: 1517536 - RNA, 14 nt, Human
agggaaacugccag

SEQ ID NO: 1517537 - RNA, 15 nt, Human
agggaaacugccagc

SEQ ID NO: 1517538 - RNA, 16 nt, Human
agggaaacugccagca

SEQ ID NO: 1517539 - RNA, 19 nt, Human
agggaaacugccagcaacg

SEQ ID NO: 1517540 - RNA, 21 nt, Human
agggaaacugccagcaacgca

SEQ ID NO: 1517541 - RNA, 23 nt, Human
agggaaacugccagcaacgcagg

SEQ ID NO: 1517542 - RNA, 23 nt, Human
aggcuuagucacugagacagccc

SEQ ID NO: 1517543 - RNA, 22 nt, Human
aggcuuagucacugagacagcc

SEQ ID NO: 1517544 - RNA, 14 nt, Human
ugggcauucaaaug

SEQ ID NO: 1517545 - RNA, 13 nt, Human
ugggcauucaaau

SEQ ID NO: 1517546 - RNA, 23 nt, Human
ugggcagaaggaagacuucaucc

SEQ ID NO: 1517547 - RNA, 16 nt, Human
ugggcagaaggaagac

SEQ ID NO: 1517548 - RNA, 20 nt, Human
ugggcagaaggaagacuuca

SEQ ID NO: 1517549 - RNA, 13 nt, Human
ugggcagaaggaa

SEQ ID NO: 1517550 - RNA, 17 nt, Human
ugggaggucaaggcugc

SEQ ID NO: 1517551 - RNA, 19 nt, Human
ugggaggcugagaugggag

SEQ ID NO: 1517552 - RNA, 21 nt, Human
ugggagaaccaaaaagaggcu

SEQ ID NO: 1517553 - RNA, 22 nt, Human
ugggagaaccaaaaagaggcua

SEQ ID NO: 1517554 - RNA, 22 nt, Human
ugggaggauugcuugagcucag

SEQ ID NO: 1517555 - RNA, 18 nt, Human
ugggaggauugcuugagc

SEQ ID NO: 1517556 - RNA, 21 nt, Human
ugggaggauugcuugagcuca

SEQ ID NO: 1517557 - RNA, 13 nt, Human
agggagagaagau

SEQ ID NO: 1517558 - RNA, 14 nt, Human
agggagagaagaua

SEQ ID NO: 1517559 - RNA, 21 nt, Human
agggagaagacuauauuguac

SEQ ID NO: 1517560 - RNA, 20 nt, Human
agggacuuggaagcuccgcu

SEQ ID NO: 1517561 - RNA, 13 nt, Human
agggaaauuucag

SEQ ID NO: 1517562 - RNA, 23 nt, Human
agggacuucugucuucacaacag

SEQ ID NO: 1517563 - RNA, 15 nt, Human
agggacuuggaagcu

SEQ ID NO: 1517564 - RNA, 18 nt, Human
agggacuuggaagcuccg

SEQ ID NO: 1517565 - RNA, 19 nt, Human
agggacuuggaagcuccgc

SEQ ID NO: 1517566 - RNA, 18 nt, Human
ugggacucaaugcacuga

SEQ ID NO: 1517567 - RNA, 16 nt, Human
ugggacuacaggugug

SEQ ID NO: 1517568 - RNA, 18 nt, Human
ugggacuacaggcaccca

SEQ ID NO: 1517569 - RNA, 16 nt, Human
agggagcgagggagaa

SEQ ID NO: 1517570 - RNA, 22 nt, Human
agggcuguuauaaucuuucaca

SEQ ID NO: 1517571 - RNA, 14 nt, Human
ugggcucccuuccc

SEQ ID NO: 1517572 - RNA, 15 nt, Human
ugggcucccuuccca

SEQ ID NO: 1517573 - RNA, 16 nt, Human
agggcugagccugguc

SEQ ID NO: 1517574 - RNA, 17 nt, Human
agggcugagccuggucc

SEQ ID NO: 1517575 - RNA, 14 nt, Human
agggcuggacugag

SEQ ID NO: 1517576 - RNA, 15 nt, Human
agggcuggacugagg

SEQ ID NO: 1517577 - RNA, 16 nt, Human
agggcuggacugaggc

SEQ ID NO: 1517578 - RNA, 17 nt, Human
agggcuggacugaggcc

SEQ ID NO: 1517579 - RNA, 18 nt, Human
agggcuggacugaggccu

SEQ ID NO: 1517580 - RNA, 20 nt, Human
agggcuggacugaggccuga

SEQ ID NO: 1517581 - RNA, 20 nt, Human
agggcuccagacacaugucc

SEQ ID NO: 1517582 - RNA, 14 nt, Human
agggcccagagagg

SEQ ID NO: 1517583 - RNA, 18 nt, Human
agggcccagagagggugg

SEQ ID NO: 1517584 - RNA, 12 nt, Human
agggagggcucc

SEQ ID NO: 1517585 - RNA, 13 nt, Human
agggagggcucca

SEQ ID NO: 1517586 - RNA, 19 nt, Human
agggagggcuccagacaca

SEQ ID NO: 1517587 - RNA, 22 nt, Human
agggagggcuccagacacaugu

SEQ ID NO: 1517588 - RNA, 20 nt, Human
agggaguccgaaagggacuu

SEQ ID NO: 1517589 - RNA, 23 nt, Human
agggaguccgaaagggacuugga

SEQ ID NO: 1517590 - RNA, 20 nt, Human
agggagugaguugauagcac

SEQ ID NO: 1517591 - RNA, 12 nt, Human
agggcccagaga

SEQ ID NO: 1517592 - RNA, 13 nt, Human
agggcccagagag

SEQ ID NO: 1517593 - RNA, 16 nt, Human
agggauacccauccca

SEQ ID NO: 1517594 - RNA, 15 nt, Human
aggaggccagccuug

SEQ ID NO: 1517595 - RNA, 21 nt, Human
aggaguuugagaccaaccugg

SEQ ID NO: 1517596 - RNA, 20 nt, Human
uggaaguacuauaauuuacc

SEQ ID NO: 1517597 - RNA, 13 nt, Human
uggaagcuccgcu

SEQ ID NO: 1517598 - RNA, 14 nt, Human
uggaacacucugag

SEQ ID NO: 1517599 - RNA, 12 nt, Human
uggaacacucug

SEQ ID NO: 1517600 - RNA, 12 nt, Human
ugcugcccugcc

SEQ ID NO: 1517601 - RNA, 10 nt, Human
ugcugcccug

SEQ ID NO: 1517602 - RNA, 17 nt, Human
uggacaaaauggaauac

SEQ ID NO: 1517603 - RNA, 14 nt, Human
uggacaaaauggaa

SEQ ID NO: 1517604 - RNA, 15 nt, Human
uggacaccggaaaca

SEQ ID NO: 1517605 - RNA, 17 nt, Human
aggcaagcaccuccugc

SEQ ID NO: 1517606 - RNA, 14 nt, Human
aggcaagcaccucc

SEQ ID NO: 1517607 - RNA, 18 nt, Human
aggaugcuuguacauaau

SEQ ID NO: 1517608 - RNA, 12 nt, Human
aggaucagucug

SEQ ID NO: 1517609 - RNA, 21 nt, Human
aggauccugagccagauuuca

SEQ ID NO: 1517610 - RNA, 16 nt, Human
aggaugcuuguacaua

SEQ ID NO: 1517611 - RNA, 15 nt, Human
aggaugcuuguacau

SEQ ID NO: 1517612 - RNA, 12 nt, Human
aggaucucuuga

SEQ ID NO: 1517613 - RNA, 18 nt, Human
uggagaagccacaggccu

SEQ ID NO: 1517614 - RNA, 19 nt, Human
uggagaagccacaggccug

SEQ ID NO: 1517615 - RNA, 20 nt, Human
uggagaagccacaggccuga

SEQ ID NO: 1517616 - RNA, 16 nt, Human
uggagaagaacugaaa

SEQ ID NO: 1517617 - RNA, 24 nt, Human
uggacuuuguuaguuucuccaagc

SEQ ID NO: 1517618 - RNA, 14 nt, Human
uggagaaaauggac

SEQ ID NO: 1517619 - RNA, 22 nt, Human
uggacuuuguuaguuucuccaa

SEQ ID NO: 1517620 - RNA, 11 nt, Human
uggacuuuguu

SEQ ID NO: 1517621 - RNA, 15 nt, Human
aggcaaugcuggcug

SEQ ID NO: 1517622 - RNA, 16 nt, Human
aggcaaugcuggcugu

SEQ ID NO: 1517623 - RNA, 20 nt, Human
uggagcccagaggagggcag

SEQ ID NO: 1517624 - RNA, 23 nt, Human
uggagcccagaggagggcagcag

SEQ ID NO: 1517625 - RNA, 21 nt, Human
uggagaagccacaggccugag

SEQ ID NO: 1517626 - RNA, 15 nt, Human
uggagcccagaggag

SEQ ID NO: 1517627 - RNA, 19 nt, Human
uggagcccagaggagggca

SEQ ID NO: 1517628 - RNA, 21 nt, Human
aggcaggucuugaacuccugg

SEQ ID NO: 1517629 - RNA, 22 nt, Human
aggcagggucucacucugucgc

SEQ ID NO: 1517630 - RNA, 14 nt, Human
aggcagguccaggg

SEQ ID NO: 1517631 - RNA, 19 nt, Human
aggcagggucucacucugu

SEQ ID NO: 1517632 - RNA, 20 nt, Human
aggcagggucucacucuguc

SEQ ID NO: 1517633 - RNA, 21 nt, Human
aggcagggucucacucugucg

SEQ ID NO: 1517634 - RNA, 20 nt, Human
aggcagcucuaaaugucaau

SEQ ID NO: 1517635 - RNA, 22 nt, Human
aggcagccccauucugccugcc

SEQ ID NO: 1517636 - RNA, 15 nt, Human
aggcacccaccauca

SEQ ID NO: 1517637 - RNA, 19 nt, Human
aggcagccccauucugccu

SEQ ID NO: 1517638 - RNA, 20 nt, Human
aggcagccccauucugccug

SEQ ID NO: 1517639 - RNA, 21 nt, Human
aggcagccccauucugccugc

SEQ ID NO: 1517640 - RNA, 12 nt, Human
aggcaggauggc

SEQ ID NO: 1517641 - RNA, 13 nt, Human
aggccuggccaga

SEQ ID NO: 1517642 - RNA, 15 nt, Human
aggccuggccagaug

SEQ ID NO: 1517643 - RNA, 12 nt, Human
aggccuggccag

SEQ ID NO: 1517644 - RNA, 17 nt, Human
aggcccggcuccaggcu

SEQ ID NO: 1517645 - RNA, 21 nt, Human
aggccccugucucagggugag

SEQ ID NO: 1517646 - RNA, 14 nt, Human
aggcccggcuccag

SEQ ID NO: 1517647 - RNA, 15 nt, Human
aggcccggcuccagg

SEQ ID NO: 1517648 - RNA, 16 nt, Human
aggcccggcuccaggc

SEQ ID NO: 1517649 - RNA, 19 nt, Human
aggcccagagggccugcaa

SEQ ID NO: 1517650 - RNA, 20 nt, Human
aggcccagagggccugcaag

SEQ ID NO: 1517651 - RNA, 13 nt, Human
aggccccugccac

SEQ ID NO: 1517652 - RNA, 15 nt, Human
aggccccugccaccc

SEQ ID NO: 1517653 - RNA, 17 nt, Human
aggccccugccacccug

SEQ ID NO: 1517654 - RNA, 18 nt, Human
aggccccugccacccugg

SEQ ID NO: 1517655 - RNA, 21 nt, Human
aggccccugccacccugggga

SEQ ID NO: 1517656 - RNA, 18 nt, Human
uggcaccagcagccugga

SEQ ID NO: 1517657 - RNA, 16 nt, Human
uggcaccagcagccug

SEQ ID NO: 1517658 - RNA, 17 nt, Human
uggcaccagcagccugg

SEQ ID NO: 1517659 - RNA, 18 nt, Human
uggcacagcccaaagaag

SEQ ID NO: 1517660 - RNA, 20 nt, Human
uggcacagcccaaagaagga

SEQ ID NO: 1517661 - RNA, 16 nt, Human
aggcccagagggccug

SEQ ID NO: 1517662 - RNA, 23 nt, Human
aggccagagacacaagccuucgg

SEQ ID NO: 1517663 - RNA, 18 nt, Human
aggccaugggccuccugu

SEQ ID NO: 1517664 - RNA, 14 nt, Human
uggcagcucagaga

SEQ ID NO: 1517665 - RNA, 15 nt, Human
uggcagcucagagag

SEQ ID NO: 1517666 - RNA, 16 nt, Human
uggcagcucagagagg

SEQ ID NO: 1517667 - RNA, 18 nt, Human
uggcagcucagagagggu

SEQ ID NO: 1517668 - RNA, 13 nt, Human
aggccagagacac

SEQ ID NO: 1517669 - RNA, 18 nt, Human
aggccagagacacaagcc

SEQ ID NO: 1517670 - RNA, 13 nt, Human
aggcuccaggagc

SEQ ID NO: 1517671 - RNA, 14 nt, Human
aggcuccaggagca

SEQ ID NO: 1517672 - RNA, 16 nt, Human
aggcuccaggagcagc

SEQ ID NO: 1517673 - RNA, 11 nt, Human
aggcuccacuu

SEQ ID NO: 1517674 - RNA, 17 nt, Human
aggcuccacuuggucug

SEQ ID NO: 1517675 - RNA, 21 nt, Human
aggcuccacuuggucugugag

SEQ ID NO: 1517676 - RNA, 22 nt, Human
aggcuccacuuggucugugaga

SEQ ID NO: 1517677 - RNA, 17 nt, Human
aggccuucucugaagga

SEQ ID NO: 1517678 - RNA, 18 nt, Human
aggccuucucugaaggac

SEQ ID NO: 1517679 - RNA, 20 nt, Human
uggccucugcacuccccugc

SEQ ID NO: 1517680 - RNA, 19 nt, Human
uggccucugcacuccccug

SEQ ID NO: 1517681 - RNA, 19 nt, Human
uggcccacgcacuucggga

SEQ ID NO: 1517682 - RNA, 13 nt, Human
uggcccacugcau

SEQ ID NO: 1517683 - RNA, 14 nt, Human
uggcccacugcauc

SEQ ID NO: 1517684 - RNA, 15 nt, Human
ugccuguucagcucc

SEQ ID NO: 1517685 - RNA, 16 nt, Human
ugccuguucagcucca

SEQ ID NO: 1517686 - RNA, 17 nt, Human
ugccuguucagcuccag

SEQ ID NO: 1517687 - RNA, 13 nt, Human
ugcgaaaggauga

SEQ ID NO: 1517688 - RNA, 19 nt, Human
ugcgaaaggaugaaaguga

SEQ ID NO: 1517689 - RNA, 18 nt, Human
ugcggacagccacggcca

SEQ ID NO: 1517690 - RNA, 22 nt, Human
ugccucugacacacagcucugu

SEQ ID NO: 1517691 - RNA, 10 nt, Human
agcugccugu

SEQ ID NO: 1517692 - RNA, 13 nt, Human
agcuggaaaagua

SEQ ID NO: 1517693 - RNA, 21 nt, Human
agcugccugggaucccucauc

SEQ ID NO: 1517694 - RNA, 13 nt, Human
agcugccugggau

SEQ ID NO: 1517695 - RNA, 19 nt, Human
agcugccugggaucccuca

SEQ ID NO: 1517696 - RNA, 17 nt, Human
agcugggauguuucugu

SEQ ID NO: 1517697 - RNA, 14 nt, Human
agcugggcagguug

SEQ ID NO: 1517698 - RNA, 19 nt, Human
agcugggacuacaggugug

SEQ ID NO: 1517699 - RNA, 23 nt, Human
agcugggaugauuggagggggga

SEQ ID NO: 1517700 - RNA, 20 nt, Human
ugccucugacacacagcucu

SEQ ID NO: 1517701 - RNA, 21 nt, Human
ugccucugacacacagcucug

SEQ ID NO: 1517702 - RNA, 16 nt, Human
ugccucucucaggcca

SEQ ID NO: 1517703 - RNA, 15 nt, Human
ugccucucucaggcc

SEQ ID NO: 1517704 - RNA, 13 nt, Human
ugccucccaucac

SEQ ID NO: 1517705 - RNA, 14 nt, Human
ugccucccaucacc

SEQ ID NO: 1517706 - RNA, 19 nt, Human
ugccucccaucacccgcua

SEQ ID NO: 1517707 - RNA, 13 nt, Human
ugccucucucagg

SEQ ID NO: 1517708 - RNA, 14 nt, Human
ugccucucucaggc

SEQ ID NO: 1517709 - RNA, 14 nt, Human
agcugccagccgag

SEQ ID NO: 1517710 - RNA, 13 nt, Human
agcugccaccugc

SEQ ID NO: 1517711 - RNA, 13 nt, Human
agcugcacccuca

SEQ ID NO: 1517712 - RNA, 17 nt, Human
agcugcacccucaggca

SEQ ID NO: 1517713 - RNA, 18 nt, Human
agcugcacccucaggcag

SEQ ID NO: 1517714 - RNA, 19 nt, Human
agcugcacccucaggcagg

SEQ ID NO: 1517715 - RNA, 20 nt, Human
agcugcacccucaggcaggu

SEQ ID NO: 1517716 - RNA, 22 nt, Human
agcugcacccucaggcaggugg

SEQ ID NO: 1517717 - RNA, 18 nt, Human
agcucuucuccaggcugu

SEQ ID NO: 1517718 - RNA, 23 nt, Human
agcucugcgucgguccuggugcc

SEQ ID NO: 1517719 - RNA, 12 nt, Human
agcucuguccug

SEQ ID NO: 1517720 - RNA, 14 nt, Human
agcucuguccuggg

SEQ ID NO: 1517721 - RNA, 22 nt, Human
ugcccuccaagaccuucuccuu

SEQ ID NO: 1517722 - RNA, 19 nt, Human
ugcccuccaagaccuucuc

SEQ ID NO: 1517723 - RNA, 20 nt, Human
ugcccuccaagaccuucucc

SEQ ID NO: 1517724 - RNA, 16 nt, Human
agcucucuccucccuu

SEQ ID NO: 1517725 - RNA, 22 nt, Human
agcucugcuccucuccccagca

SEQ ID NO: 1517726 - RNA, 12 nt, Human
agcucugcuccu

SEQ ID NO: 1517727 - RNA, 22 nt, Human
agcucugcgucgguccuggugc

SEQ ID NO: 1517728 - RNA, 14 nt, Human
aggaaauauuuauu

SEQ ID NO: 1517729 - RNA, 18 nt, Human
aggaaauauuuauuuuaa

SEQ ID NO: 1517730 - RNA, 22 nt, Human
aggaaaggcuccaggagcagcc

SEQ ID NO: 1517731 - RNA, 23 nt, Human
aggaaaggcuccaggagcagcca

SEQ ID NO: 1517732 - RNA, 18 nt, Human
aggaaaggcuccaggagc

SEQ ID NO: 1517733 - RNA, 20 nt, Human
aggaaaggcuccaggagcag

SEQ ID NO: 1517734 - RNA, 21 nt, Human
ugcugacuguuuucucuugag

SEQ ID NO: 1517735 - RNA, 24 nt, Human
ugcugacuguuuucucuugagagg

SEQ ID NO: 1517736 - RNA, 14 nt, Human
ugcugagucugaag

SEQ ID NO: 1517737 - RNA, 19 nt, Human
ugcuauccagcuauuuuua

SEQ ID NO: 1517738 - RNA, 22 nt, Human
ugcucugaucauccacugugcc

SEQ ID NO: 1517739 - RNA, 17 nt, Human
ugcugacuguuuucucu

SEQ ID NO: 1517740 - RNA, 15 nt, Human
ugcucugcauguuac

SEQ ID NO: 1517741 - RNA, 18 nt, Human
ugcucugcauguuacaua

SEQ ID NO: 1517742 - RNA, 17 nt, Human
aggaagcucagggccug

SEQ ID NO: 1517743 - RNA, 18 nt, Human
aggaagcucagggccugg

SEQ ID NO: 1517744 - RNA, 22 nt, Human
aggaagcucagggccuggcuca

SEQ ID NO: 1517745 - RNA, 14 nt, Human
aggaagagaaaaaa

SEQ ID NO: 1517746 - RNA, 15 nt, Human
aggaagacuuuggaa

SEQ ID NO: 1517747 - RNA, 19 nt, Human
aggaaaucaaauaugcaaa

SEQ ID NO: 1517748 - RNA, 23 nt, Human
aggaauccagacccggcugcgug

SEQ ID NO: 1517749 - RNA, 19 nt, Human
aggaauugacccacaagaa

SEQ ID NO: 1517750 - RNA, 23 nt, Human
aggaauugacccacaagaaauga

SEQ ID NO: 1517751 - RNA, 11 nt, Human
ugcugccaucc

SEQ ID NO: 1517752 - RNA, 21 nt, Human
ugcugccauccagguucagcu

SEQ ID NO: 1517753 - RNA, 22 nt, Human
ugcugccauccagguucagcuu

SEQ ID NO: 1517754 - RNA, 12 nt, Human
ugcugccaucca

SEQ ID NO: 1517755 - RNA, 13 nt, Human
ugcugccauccag

SEQ ID NO: 1517756 - RNA, 14 nt, Human
ugcugccauccagg

SEQ ID NO: 1517757 - RNA, 15 nt, Human
ugcugccauccaggu

SEQ ID NO: 1517758 - RNA, 21 nt, Human
agcuuauugucuagugaaacu

SEQ ID NO: 1517759 - RNA, 23 nt, Human
agcuuggaaacuggaugagguca

SEQ ID NO: 1517760 - RNA, 15 nt, Human
agcuuauuaaaacuc

SEQ ID NO: 1517761 - RNA, 20 nt, Human
agcuuauuaaaacucauuuu

SEQ ID NO: 1517762 - RNA, 19 nt, Human
agcuuguaaauagcucagg

SEQ ID NO: 1517763 - RNA, 20 nt, Human
agcuuguaaauagcucaggu

SEQ ID NO: 1517764 - RNA, 21 nt, Human
agcuuguaaauagcucaggug

SEQ ID NO: 1517765 - RNA, 20 nt, Human
agcuuaaaggggcuagagug

SEQ ID NO: 1517766 - RNA, 12 nt, Human
agcuuaucucag

SEQ ID NO: 1517767 - RNA, 14 nt, Human
agcuuaucucaggg

SEQ ID NO: 1517768 - RNA, 15 nt, Human
agcuuaucucagggg

SEQ ID NO: 1517769 - RNA, 20 nt, Human
ugcggacagccacggccagg

SEQ ID NO: 1517770 - RNA, 21 nt, Human
ugcggacagccacggccaggc

SEQ ID NO: 1517771 - RNA, 13 nt, Human
aggaaagagaacu

SEQ ID NO: 1517772 - RNA, 19 nt, Human
aggaaagagaacuuccaga

SEQ ID NO: 1517773 - RNA, 12 nt, Human
aggaaagaggcu

SEQ ID NO: 1517774 - RNA, 13 nt, Human
aggaaagaggcuc

SEQ ID NO: 1517775 - RNA, 16 nt, Human
ugcuaguaauuggaaa

SEQ ID NO: 1517776 - RNA, 19 nt, Human
aggaaagcaaaggagauug

SEQ ID NO: 1517777 - RNA, 14 nt, Human
ugcuaguaauugga

SEQ ID NO: 1517778 - RNA, 16 nt, Human
aggaaagaggcucugg

SEQ ID NO: 1517779 - RNA, 17 nt, Human
aggaaagcaaaggagau

SEQ ID NO: 1517780 - RNA, 12 nt, Human
agcuuugaaaau

SEQ ID NO: 1517781 - RNA, 16 nt, Human
agcuuugaaaauucag

SEQ ID NO: 1517782 - RNA, 18 nt, Human
agcuuugaaaauucagug

SEQ ID NO: 1517783 - RNA, 19 nt, Human
agcuuugaaaauucagugg

SEQ ID NO: 1517784 - RNA, 21 nt, Human
aggaaacccagcucuggucca

SEQ ID NO: 1517785 - RNA, 18 nt, Human
aggaaacccagcucuggu

SEQ ID NO: 1517786 - RNA, 20 nt, Human
aggaaacccagcucuggucc

SEQ ID NO: 1517787 - RNA, 15 nt, Human
aggaaacccagcucu

SEQ ID NO: 1517788 - RNA, 16 nt, Human
aggaaacccagcucug

SEQ ID NO: 1517789 - RNA, 17 nt, Human
aggaaacccagcucugg

SEQ ID NO: 1517790 - RNA, 19 nt, Human
ugcagugagccgagauugu

SEQ ID NO: 1517791 - RNA, 21 nt, Human
ugcaguuugguguguccuccg

SEQ ID NO: 1517792 - RNA, 14 nt, Human
ugcagugagccgag

SEQ ID NO: 1517793 - RNA, 19 nt, Human
agccugagcgacagugaga

SEQ ID NO: 1517794 - RNA, 18 nt, Human
ugcagccucaaccuccug

SEQ ID NO: 1517795 - RNA, 19 nt, Human
ugcagccucaaccuccugg

SEQ ID NO: 1517796 - RNA, 20 nt, Human
ugcagccucaaccuccuggg

SEQ ID NO: 1517797 - RNA, 16 nt, Human
agccucagcauccugg

SEQ ID NO: 1517798 - RNA, 15 nt, Human
agccucagcauccug

SEQ ID NO: 1517799 - RNA, 19 nt, Human
agccucaaccuccugggcu

SEQ ID NO: 1517800 - RNA, 18 nt, Human
agccugagcgacagugag

SEQ ID NO: 1517801 - RNA, 17 nt, Human
agccucaaccuccuggg

SEQ ID NO: 1517802 - RNA, 18 nt, Human
agccucaaccuccugggc

SEQ ID NO: 1517803 - RNA, 13 nt, Human
agccucagcaucc

SEQ ID NO: 1517804 - RNA, 14 nt, Human
agccucagcauccu

SEQ ID NO: 1517805 - RNA, 16 nt, Human
agccugccucuucucu

SEQ ID NO: 1517806 - RNA, 19 nt, Human
agccugccucuucucuacu

SEQ ID NO: 1517807 - RNA, 20 nt, Human
agccugcaggaccucgugcc

SEQ ID NO: 1517808 - RNA, 21 nt, Human
agccugcaggaccucgugcca

SEQ ID NO: 1517809 - RNA, 23 nt, Human
agccugcaguuauuaacacuaac

SEQ ID NO: 1517810 - RNA, 16 nt, Human
ugcaugcugucccuua

SEQ ID NO: 1517811 - RNA, 19 nt, Human
agccugcaauuucauaugc

SEQ ID NO: 1517812 - RNA, 21 nt, Human
agccugcaauuucauaugcug

SEQ ID NO: 1517813 - RNA, 22 nt, Human
ugcaugaaguaauaugcacaca

SEQ ID NO: 1517814 - RNA, 21 nt, Human
ugcaugaggcuaguguggugu

SEQ ID NO: 1517815 - RNA, 13 nt, Human
ugcaugcuguccc

SEQ ID NO: 1517816 - RNA, 14 nt, Human
ugcaugcugucccu

SEQ ID NO: 1517817 - RNA, 15 nt, Human
ugcaugcugucccuu

SEQ ID NO: 1517818 - RNA, 22 nt, Human
ugcauaccacuuuuguucuugg

SEQ ID NO: 1517819 - RNA, 13 nt, Human
ugcauacucauua

SEQ ID NO: 1517820 - RNA, 18 nt, Human
agcccuucuuuccacaga

SEQ ID NO: 1517821 - RNA, 19 nt, Human
agcccuucuuuccacagaa

SEQ ID NO: 1517822 - RNA, 15 nt, Human
agccuaggugacaga

SEQ ID NO: 1517823 - RNA, 17 nt, Human
agccuaggugacagagu

SEQ ID NO: 1517824 - RNA, 15 nt, Human
agccucaaccuccug

SEQ ID NO: 1517825 - RNA, 19 nt, Human
ugcagacucuacagaggcc

SEQ ID NO: 1517826 - RNA, 20 nt, Human
ugcagacucuacagaggcca

SEQ ID NO: 1517827 - RNA, 15 nt, Human
ugcacuccccugcug

SEQ ID NO: 1517828 - RNA, 22 nt, Human
ugcagacucuacagaggccaug

SEQ ID NO: 1517829 - RNA, 14 nt, Human
ugcacaagcugcac

SEQ ID NO: 1517830 - RNA, 15 nt, Human
ugcacacaccagagc

SEQ ID NO: 1517831 - RNA, 17 nt, Human
ugcacacaccagagccc

SEQ ID NO: 1517832 - RNA, 15 nt, Human
ugcacaagcuccaag

SEQ ID NO: 1517833 - RNA, 16 nt, Human
ugcacaagcuccaagc

SEQ ID NO: 1517834 - RNA, 18 nt, Human
ugcacaagcuccaagcuc

SEQ ID NO: 1517835 - RNA, 20 nt, Human
ugcacaagcuccaagcuccc

SEQ ID NO: 1517836 - RNA, 22 nt, Human
ugcacaagcuccaagcucccag

SEQ ID NO: 1517837 - RNA, 23 nt, Human
ugcacaagcuccaagcucccagg

SEQ ID NO: 1517838 - RNA, 14 nt, Human
ugcaccacugcacu

SEQ ID NO: 1517839 - RNA, 15 nt, Human
ugcaccacugcacuc

SEQ ID NO: 1517840 - RNA, 22 nt, Human
ugcacuauagccuaggugacag

SEQ ID NO: 1517841 - RNA, 12 nt, Human
ugcacuccccug

SEQ ID NO: 1517842 - RNA, 13 nt, Human
ugcacuccccugc

SEQ ID NO: 1517843 - RNA, 18 nt, Human
ugcauuugaggucuguuc

SEQ ID NO: 1517844 - RNA, 23 nt, Human
ugcauuugaaaauuuugauguuu

SEQ ID NO: 1517845 - RNA, 19 nt, Human
ugcauuugaaaauuuugau

SEQ ID NO: 1517846 - RNA, 22 nt, Human
agcgcuccugccgcagagcugg

SEQ ID NO: 1517847 - RNA, 17 nt, Human
agcgcuccugccgcaga

SEQ ID NO: 1517848 - RNA, 20 nt, Human
agcgcuccugccgcagagcu

SEQ ID NO: 1517849 - RNA, 21 nt, Human
agcgcuccugccgcagagcug

SEQ ID NO: 1517850 - RNA, 14 nt, Human
agccugcuccagcu

SEQ ID NO: 1517851 - RNA, 14 nt, Human
agcgcccaguuggg

SEQ ID NO: 1517852 - RNA, 22 nt, Human
agcgcccaguuggguggaugcc

SEQ ID NO: 1517853 - RNA, 15 nt, Human
ugccagucaccccgg

SEQ ID NO: 1517854 - RNA, 16 nt, Human
ugccagucaccccggc

SEQ ID NO: 1517855 - RNA, 18 nt, Human
ugccagucaccccggcca

SEQ ID NO: 1517856 - RNA, 20 nt, Human
ugccagucaccccggccacc

SEQ ID NO: 1517857 - RNA, 22 nt, Human
ugccagucaccccggccaccug

SEQ ID NO: 1517858 - RNA, 23 nt, Human
ugccagucaccccggccaccugc

SEQ ID NO: 1517859 - RNA, 15 nt, Human
ugccauauucuguug

SEQ ID NO: 1517860 - RNA, 16 nt, Human
ugccauauucuguugg

SEQ ID NO: 1517861 - RNA, 17 nt, Human
ugccauauucuguuggc

SEQ ID NO: 1517862 - RNA, 15 nt, Human
agcgugagccacugc

SEQ ID NO: 1517863 - RNA, 16 nt, Human
agcggggacagcuccu

SEQ ID NO: 1517864 - RNA, 17 nt, Human
agcggggacagcuccuu

SEQ ID NO: 1517865 - RNA, 15 nt, Human
agcggggacagcucc

SEQ ID NO: 1517866 - RNA, 20 nt, Human
ugccauauucuguuggccag

SEQ ID NO: 1517867 - RNA, 21 nt, Human
ugccauauucuguuggccagu

SEQ ID NO: 1517868 - RNA, 20 nt, Human
agcgugguggacaugcacag

SEQ ID NO: 1517869 - RNA, 16 nt, Human
agcgugagccacugca

SEQ ID NO: 1517870 - RNA, 17 nt, Human
agcgugagccacugcac

SEQ ID NO: 1517871 - RNA, 23 nt, Human
agcgugguggacaugcacagcua

SEQ ID NO: 1517872 - RNA, 19 nt, Human
agcuauggugucauaggcu

SEQ ID NO: 1517873 - RNA, 18 nt, Human
agcucagggccuggcuca

SEQ ID NO: 1517874 - RNA, 20 nt, Human
ugccauguuggccaggcugg

SEQ ID NO: 1517875 - RNA, 21 nt, Human
ugccauguuggccaggcuggu

SEQ ID NO: 1517876 - RNA, 22 nt, Human
agcuauuuuuauuuguuugugc

SEQ ID NO: 1517877 - RNA, 15 nt, Human
agcucagggccuggc

SEQ ID NO: 1517878 - RNA, 16 nt, Human
agcucagggccuggcu

SEQ ID NO: 1517879 - RNA, 17 nt, Human
agcucagggccuggcuc

SEQ ID NO: 1517880 - RNA, 17 nt, Human
ugccauguuggccaggc

SEQ ID NO: 1517881 - RNA, 18 nt, Human
ugccauguuggccaggcu

SEQ ID NO: 1517882 - RNA, 19 nt, Human
ugccauguuggccaggcug

SEQ ID NO: 1517883 - RNA, 19 nt, Human
ugccccucaacucuccucc

SEQ ID NO: 1517884 - RNA, 12 nt, Human
ugcccccaggac

SEQ ID NO: 1517885 - RNA, 13 nt, Human
ugcccccaggacu

SEQ ID NO: 1517886 - RNA, 14 nt, Human
ugcccccaggacug

SEQ ID NO: 1517887 - RNA, 15 nt, Human
ugcccccaggacugg

SEQ ID NO: 1517888 - RNA, 16 nt, Human
ugcccccaggacuggg

SEQ ID NO: 1517889 - RNA, 17 nt, Human
ugcccccaggacugggc

SEQ ID NO: 1517890 - RNA, 19 nt, Human
ugcccccaggacugggcca

SEQ ID NO: 1517891 - RNA, 11 nt, Human
ugcccccagga

SEQ ID NO: 1517892 - RNA, 12 nt, Human
ugcccaggcccc

SEQ ID NO: 1517893 - RNA, 16 nt, Human
ugcccacaggaucagu

SEQ ID NO: 1517894 - RNA, 14 nt, Human
ugcccaggccccug

SEQ ID NO: 1517895 - RNA, 20 nt, Human
ugcccaggccccugccaccc

SEQ ID NO: 1517896 - RNA, 22 nt, Human
ugcccaggccccugccacccug

SEQ ID NO: 1517897 - RNA, 14 nt, Human
ugcccacaggauca

SEQ ID NO: 1517898 - RNA, 15 nt, Human
ugcccaggcaggucu

SEQ ID NO: 1517899 - RNA, 16 nt, Human
ugcccaggcaggucuu

SEQ ID NO: 1517900 - RNA, 17 nt, Human
ugcccaggcaggucuug

SEQ ID NO: 1517901 - RNA, 20 nt, Human
ugcccaggcaggucuugaac

SEQ ID NO: 1517902 - RNA, 11 nt, Human
ugcccaggccc

SEQ ID NO: 1517903 - RNA, 14 nt, Human
agaagcuccaggua

SEQ ID NO: 1517904 - RNA, 15 nt, Human
agaagcggcuggcag

SEQ ID NO: 1517905 - RNA, 16 nt, Human
agaagcggcuggcagc

SEQ ID NO: 1517906 - RNA, 16 nt, Human
ucuggcagcucagaga

SEQ ID NO: 1517907 - RNA, 14 nt, Human
ucuggcagcucaga

SEQ ID NO: 1517908 - RNA, 15 nt, Human
ucuggcagcucagag

SEQ ID NO: 1517909 - RNA, 21 nt, Human
agaagaacugaaaucauacuu

SEQ ID NO: 1517910 - RNA, 13 nt, Human
agaagaaggcagc

SEQ ID NO: 1517911 - RNA, 14 nt, Human
agaagaaggcagca

SEQ ID NO: 1517912 - RNA, 21 nt, Human
agaagaaggcagcagguggca

SEQ ID NO: 1517913 - RNA, 14 nt, Human
ucugcccuccaaga

SEQ ID NO: 1517914 - RNA, 18 nt, Human
ucugcccuccaagaccuu

SEQ ID NO: 1517915 - RNA, 13 nt, Human
ucugcuucagccu

SEQ ID NO: 1517916 - RNA, 17 nt, Human
ucugcucacauaucugu

SEQ ID NO: 1517917 - RNA, 16 nt, Human
ucugcucacauaucug

SEQ ID NO: 1517918 - RNA, 23 nt, Human
ucugagaaagacuauucaaacag

SEQ ID NO: 1517919 - RNA, 21 nt, Human
ucugagaaagacuauucaaac

SEQ ID NO: 1517920 - RNA, 22 nt, Human
ucugagaaagacuauucaaaca

SEQ ID NO: 1517921 - RNA, 16 nt, Human
ucugauacagaaaagu

SEQ ID NO: 1517922 - RNA, 17 nt, Human
ucugauacagaaaaguu

SEQ ID NO: 1517923 - RNA, 19 nt, Human
ucugauucccaagcucugc

SEQ ID NO: 1517924 - RNA, 20 nt, Human
ucugauucccaagcucugcu

SEQ ID NO: 1517925 - RNA, 21 nt, Human
ucugauucccaagcucugcuc

SEQ ID NO: 1517926 - RNA, 21 nt, Human
ucugacuguuuccaucaaggg

SEQ ID NO: 1517927 - RNA, 14 nt, Human
ucugagaaagacua

SEQ ID NO: 1517928 - RNA, 15 nt, Human
ucugagaaagacuau

SEQ ID NO: 1517929 - RNA, 19 nt, Human
ucugagaaagacuauucaa

SEQ ID NO: 1517930 - RNA, 20 nt, Human
ucugagaaagacuauucaaa

SEQ ID NO: 1517931 - RNA, 19 nt, Human
ucugacccugcuucaaaua

SEQ ID NO: 1517932 - RNA, 15 nt, Human
agaaagacagagcug

SEQ ID NO: 1517933 - RNA, 19 nt, Human
agaaagacuauucaaacag

SEQ ID NO: 1517934 - RNA, 20 nt, Human
agaaagacuauucaaacagu

SEQ ID NO: 1517935 - RNA, 23 nt, Human
agaaagacuauucaaacagucuc

SEQ ID NO: 1517936 - RNA, 11 nt, Human
agaaauguguu

SEQ ID NO: 1517937 - RNA, 15 nt, Human
ucugcagauaaacag

SEQ ID NO: 1517938 - RNA, 16 nt, Human
agaaauguacagcaag

SEQ ID NO: 1517939 - RNA, 17 nt, Human
agaaauguacagcaagg

SEQ ID NO: 1517940 - RNA, 14 nt, Human
agaacucccuuuca

SEQ ID NO: 1517941 - RNA, 15 nt, Human
agaacucccuuucaa

SEQ ID NO: 1517942 - RNA, 22 nt, Human
agaacuacaaacaaaauuucua

SEQ ID NO: 1517943 - RNA, 23 nt, Human
agaacuacaaacaaaauuucuau

SEQ ID NO: 1517944 - RNA, 18 nt, Human
agaacuacaaacaaaauu

SEQ ID NO: 1517945 - RNA, 17 nt, Human
agaacggggcucuucuc

SEQ ID NO: 1517946 - RNA, 19 nt, Human
agaacggggcucuucucau

SEQ ID NO: 1517947 - RNA, 20 nt, Human
agaacggggcucuucucauu

SEQ ID NO: 1517948 - RNA, 21 nt, Human
agaacggggcucuucucauuu

SEQ ID NO: 1517949 - RNA, 23 nt, Human
acuuuuuugcuauccagcuauuu

SEQ ID NO: 1517950 - RNA, 15 nt, Human
acuuuuucuuuaugu

SEQ ID NO: 1517951 - RNA, 23 nt, Human
acuuuggaaagacuuuuccaacc

SEQ ID NO: 1517952 - RNA, 17 nt, Human
acuuuggaaagacuuuu

SEQ ID NO: 1517953 - RNA, 13 nt, Human
acuuuggaaagac

SEQ ID NO: 1517954 - RNA, 14 nt, Human
acuuuggaaagacu

SEQ ID NO: 1517955 - RNA, 23 nt, Human
acuuugaccucugcagcaauaaa

SEQ ID NO: 1517956 - RNA, 19 nt, Human
acuuugaccucugcagcaa

SEQ ID NO: 1517957 - RNA, 23 nt, Human
acuuuaccuuuuuuauacauaaa

SEQ ID NO: 1517958 - RNA, 22 nt, Human
acuuuaccuuuuuuauacauaa

SEQ ID NO: 1517959 - RNA, 19 nt, Human
acuuuaccuuuuuuauaca

SEQ ID NO: 1517960 - RNA, 18 nt, Human
acuuuaccuuuuuuauac

SEQ ID NO: 1517961 - RNA, 15 nt, Human
ucucccagucauuua

SEQ ID NO: 1517962 - RNA, 11 nt, Human
ucucccuugga

SEQ ID NO: 1517963 - RNA, 18 nt, Human
ucucccuuggauuguccc

SEQ ID NO: 1517964 - RNA, 15 nt, Human
ucuccucugcugcug

SEQ ID NO: 1517965 - RNA, 13 nt, Human
ucuccucugcugc

SEQ ID NO: 1517966 - RNA, 14 nt, Human
ucuccucugcugcu

SEQ ID NO: 1517967 - RNA, 12 nt, Human
ucuccucugcug

SEQ ID NO: 1517968 - RNA, 19 nt, Human
ucucccuuggauugucccc

SEQ ID NO: 1517969 - RNA, 21 nt, Human
ucucccuuggauuguccccga

SEQ ID NO: 1517970 - RNA, 13 nt, Human
agaaacuggaacu

SEQ ID NO: 1517971 - RNA, 15 nt, Human
agaaacuggaacucu

SEQ ID NO: 1517972 - RNA, 19 nt, Human
agaaaacaaggaugaauua

SEQ ID NO: 1517973 - RNA, 17 nt, Human
agaaaaaugagccuggc

SEQ ID NO: 1517974 - RNA, 22 nt, Human
ucucuuuaaugucacaggcagg

SEQ ID NO: 1517975 - RNA, 17 nt, Human
ucucuugagccugggag

SEQ ID NO: 1517976 - RNA, 15 nt, Human
ucucuugagccuggg

SEQ ID NO: 1517977 - RNA, 13 nt, Human
ucucuugagccug

SEQ ID NO: 1517978 - RNA, 14 nt, Human
ucucuugagccugg

SEQ ID NO: 1517979 - RNA, 12 nt, Human
ucucuucuuuaa

SEQ ID NO: 1517980 - RNA, 14 nt, Human
ucucuugagagggu

SEQ ID NO: 1517981 - RNA, 13 nt, Human
ucucuucuuuaaa

SEQ ID NO: 1517982 - RNA, 11 nt, Human
ucucugcccuc

SEQ ID NO: 1517983 - RNA, 16 nt, Human
ucucuggccuucggcc

SEQ ID NO: 1517984 - RNA, 17 nt, Human
ucucuggccuucggccu

SEQ ID NO: 1517985 - RNA, 22 nt, Human
ucucuccuguaccucuugagcc

SEQ ID NO: 1517986 - RNA, 20 nt, Human
ucucuccuguaccucuugag

SEQ ID NO: 1517987 - RNA, 16 nt, Human
ucucuccagccccugg

SEQ ID NO: 1517988 - RNA, 15 nt, Human
ucucuccagccccug

SEQ ID NO: 1517989 - RNA, 20 nt, Human
ucuccuucagcccucacccc

SEQ ID NO: 1517990 - RNA, 13 nt, Human
ucucuccagcccc

SEQ ID NO: 1517991 - RNA, 14 nt, Human
ucucuccagccccu

SEQ ID NO: 1517992 - RNA, 20 nt, Human
ucuccuucaccuuugucccc

SEQ ID NO: 1517993 - RNA, 15 nt, Human
ucuccuucagcccuc

SEQ ID NO: 1517994 - RNA, 19 nt, Human
ucuccuucagcccucaccc

SEQ ID NO: 1517995 - RNA, 20 nt, Human
ucuguuuuauaauuuuguga

SEQ ID NO: 1517996 - RNA, 18 nt, Human
ucuguuuuauaauuuugu

SEQ ID NO: 1517997 - RNA, 13 nt, Human
agaauuucuagga

SEQ ID NO: 1517998 - RNA, 21 nt, Human
agaauuucuaggacugaauua

SEQ ID NO: 1517999 - RNA, 23 nt, Human
agaauuucccaaagcagugcaug

SEQ ID NO: 1518000 - RNA, 17 nt, Human
agaauuucccaaagcag

SEQ ID NO: 1518001 - RNA, 18 nt, Human
agaauuucccaaagcagu

SEQ ID NO: 1518002 - RNA, 18 nt, Human
ucuguuggccagugugac

SEQ ID NO: 1518003 - RNA, 19 nt, Human
ucuguuggccagugugaca

SEQ ID NO: 1518004 - RNA, 20 nt, Human
ucuguuggccagugugacaa

SEQ ID NO: 1518005 - RNA, 22 nt, Human
ucugugaaaggaaagagggagg

SEQ ID NO: 1518006 - RNA, 15 nt, Human
ucugugaaaggaaag

SEQ ID NO: 1518007 - RNA, 21 nt, Human
ucugugaaaggaaagagggag

SEQ ID NO: 1518008 - RNA, 22 nt, Human
ucuggucuaaauuguguuacua

SEQ ID NO: 1518009 - RNA, 15 nt, Human
ucugucauuugagca

SEQ ID NO: 1518010 - RNA, 20 nt, Human
ucugucauuugagcagggcu

SEQ ID NO: 1518011 - RNA, 23 nt, Human
ucugucauuugagcagggcucag

SEQ ID NO: 1518012 - RNA, 16 nt, Human
agaaggaaaaggcagg

SEQ ID NO: 1518013 - RNA, 18 nt, Human
ucugguccauagagagca

SEQ ID NO: 1518014 - RNA, 11 nt, Human
ucuggggcugu

SEQ ID NO: 1518015 - RNA, 14 nt, Human
ucuggguucacugc

SEQ ID NO: 1518016 - RNA, 16 nt, Human
ucuggguucacugcaa

SEQ ID NO: 1518017 - RNA, 17 nt, Human
agaauuugauaugugaa

SEQ ID NO: 1518018 - RNA, 18 nt, Human
agaauuugauaugugaac

SEQ ID NO: 1518019 - RNA, 19 nt, Human
agaauuugauaugugaaca

SEQ ID NO: 1518020 - RNA, 20 nt, Human
agaauuugauaugugaacag

SEQ ID NO: 1518021 - RNA, 19 nt, Human
agacagucccugccaaugg

SEQ ID NO: 1518022 - RNA, 15 nt, Human
agacagucccugcca

SEQ ID NO: 1518023 - RNA, 16 nt, Human
agacagucccugccaa

SEQ ID NO: 1518024 - RNA, 17 nt, Human
agacagucccugccaau

SEQ ID NO: 1518025 - RNA, 21 nt, Human
agacaggguuuugccauguug

SEQ ID NO: 1518026 - RNA, 15 nt, Human
agacaggaccaggga

SEQ ID NO: 1518027 - RNA, 16 nt, Human
agacaggaccagggau

SEQ ID NO: 1518028 - RNA, 23 nt, Human
agacaggcaagcaccuccugccu

SEQ ID NO: 1518029 - RNA, 22 nt, Human
ucuuagaugcaguucugaagaa

SEQ ID NO: 1518030 - RNA, 14 nt, Human
ucuuaugggcuggg

SEQ ID NO: 1518031 - RNA, 15 nt, Human
ucuuaugggcugggu

SEQ ID NO: 1518032 - RNA, 16 nt, Human
ucuuaugggcuggguu

SEQ ID NO: 1518033 - RNA, 14 nt, Human
ucuuauugcccacg

SEQ ID NO: 1518034 - RNA, 18 nt, Human
ucuuaugggcuggguucu

SEQ ID NO: 1518035 - RNA, 18 nt, Human
ucuuauugcccacgcugg

SEQ ID NO: 1518036 - RNA, 22 nt, Human
ucuuauugcccacgcuggagug

SEQ ID NO: 1518037 - RNA, 18 nt, Human
ucuuaauuaaaagaauau

SEQ ID NO: 1518038 - RNA, 21 nt, Human
ucuuaauuaaaagaauauuuu

SEQ ID NO: 1518039 - RNA, 22 nt, Human
ucuuccaggcugggagagccuu

SEQ ID NO: 1518040 - RNA, 17 nt, Human
ucuuauuuaaugaaaga

SEQ ID NO: 1518041 - RNA, 22 nt, Human
agacuccaaagaaauguaaggg

SEQ ID NO: 1518042 - RNA, 23 nt, Human
agacuauucaaacagucucagga

SEQ ID NO: 1518043 - RNA, 16 nt, Human
agacuccaaagaaaug

SEQ ID NO: 1518044 - RNA, 19 nt, Human
agacuccaaagaaauguaa

SEQ ID NO: 1518045 - RNA, 17 nt, Human
ucuugcaauggcagccu

SEQ ID NO: 1518046 - RNA, 13 nt, Human
ucuugcaauggca

SEQ ID NO: 1518047 - RNA, 16 nt, Human
ucuugcaauggcagcc

SEQ ID NO: 1518048 - RNA, 19 nt, Human
agacuaucuaaauguugaa

SEQ ID NO: 1518049 - RNA, 17 nt, Human
agacuaucuaaauguug

SEQ ID NO: 1518050 - RNA, 18 nt, Human
agacuaucuaaauguuga

SEQ ID NO: 1518051 - RNA, 17 nt, Human
agacucauucuucugua

SEQ ID NO: 1518052 - RNA, 21 nt, Human
agacuauucaaacagucucag

SEQ ID NO: 1518053 - RNA, 18 nt, Human
agacuauucaaacagucu

SEQ ID NO: 1518054 - RNA, 20 nt, Human
agacuauucaaacagucuca

SEQ ID NO: 1518055 - RNA, 18 nt, Human
agacucauucuucuguac

SEQ ID NO: 1518056 - RNA, 12 nt, Human
agacuccaaaga

SEQ ID NO: 1518057 - RNA, 13 nt, Human
agacuccaaagaa

SEQ ID NO: 1518058 - RNA, 14 nt, Human
agacuccaaagaaa

SEQ ID NO: 1518059 - RNA, 19 nt, Human
agacccuuguggucccacc

SEQ ID NO: 1518060 - RNA, 20 nt, Human
agacccuuguggucccaccc

SEQ ID NO: 1518061 - RNA, 22 nt, Human
agacccuuguggucccacccca

SEQ ID NO: 1518062 - RNA, 23 nt, Human
agacccuuguggucccaccccac

SEQ ID NO: 1518063 - RNA, 13 nt, Human
agacccuuguggu

SEQ ID NO: 1518064 - RNA, 15 nt, Human
agacccuuguggucc

SEQ ID NO: 1518065 - RNA, 16 nt, Human
agacccugcccugugg

SEQ ID NO: 1518066 - RNA, 19 nt, Human
agacccugcccugugggcc

SEQ ID NO: 1518067 - RNA, 21 nt, Human
agacccugcccugugggcccc

SEQ ID NO: 1518068 - RNA, 23 nt, Human
agacccugcccugugggccccca

SEQ ID NO: 1518069 - RNA, 12 nt, Human
agacccugcccu

SEQ ID NO: 1518070 - RNA, 13 nt, Human
agacccugcccug

SEQ ID NO: 1518071 - RNA, 14 nt, Human
agacccugcccugu

SEQ ID NO: 1518072 - RNA, 17 nt, Human
ucuuuaaaauacacacu

SEQ ID NO: 1518073 - RNA, 21 nt, Human
ucuuuaaagggauggcaagau

SEQ ID NO: 1518074 - RNA, 15 nt, Human
ucuuuacuucaugga

SEQ ID NO: 1518075 - RNA, 19 nt, Human
agacucuacagaggccaug

SEQ ID NO: 1518076 - RNA, 17 nt, Human
agacucuacagaggcca

SEQ ID NO: 1518077 - RNA, 18 nt, Human
agacuccugcaggcagcc

SEQ ID NO: 1518078 - RNA, 19 nt, Human
agacuccugcaggcagcca

SEQ ID NO: 1518079 - RNA, 20 nt, Human
agacuccugcaggcagccag

SEQ ID NO: 1518080 - RNA, 23 nt, Human
agacuccugcaggcagccaggcc

SEQ ID NO: 1518081 - RNA, 13 nt, Human
ucuuuccugaggc

SEQ ID NO: 1518082 - RNA, 14 nt, Human
ucuuuccugaggcu

SEQ ID NO: 1518083 - RNA, 15 nt, Human
ucuuuccugaggcug

SEQ ID NO: 1518084 - RNA, 16 nt, Human
ucuuuccugaggcugg

SEQ ID NO: 1518085 - RNA, 15 nt, Human
agacuccugcaggca

SEQ ID NO: 1518086 - RNA, 16 nt, Human
agacuccugcaggcag

SEQ ID NO: 1518087 - RNA, 17 nt, Human
agacuccugcaggcagc

SEQ ID NO: 1518088 - RNA, 18 nt, Human
agagacacacugaagaag

SEQ ID NO: 1518089 - RNA, 20 nt, Human
agagacacacugaagaagca

SEQ ID NO: 1518090 - RNA, 13 nt, Human
agagaccaucccu

SEQ ID NO: 1518091 - RNA, 14 nt, Human
agagaccaucccug

SEQ ID NO: 1518092 - RNA, 18 nt, Human
agagaccaucccugaagg

SEQ ID NO: 1518093 - RNA, 15 nt, Human
agagaccaucccuga

SEQ ID NO: 1518094 - RNA, 17 nt, Human
agagacacacugaagaa

SEQ ID NO: 1518095 - RNA, 15 nt, Human
agagaaugagagaca

SEQ ID NO: 1518096 - RNA, 15 nt, Human
agacuuuggaaagac

SEQ ID NO: 1518097 - RNA, 12 nt, Human
agacuuuggaaa

SEQ ID NO: 1518098 - RNA, 14 nt, Human
agacuuuggaaaga

SEQ ID NO: 1518099 - RNA, 18 nt, Human
agagaaugaaagggccca

SEQ ID NO: 1518100 - RNA, 18 nt, Human
agacuggcacaguuuucu

SEQ ID NO: 1518101 - RNA, 14 nt, Human
agacuggcacaguu

SEQ ID NO: 1518102 - RNA, 15 nt, Human
agacuggcacaguuu

SEQ ID NO: 1518103 - RNA, 14 nt, Human
agacuucaucccuc

SEQ ID NO: 1518104 - RNA, 17 nt, Human
agacuucaucccucugg

SEQ ID NO: 1518105 - RNA, 17 nt, Human
agaggcuaugugagcac

SEQ ID NO: 1518106 - RNA, 21 nt, Human
agagggagggagggcuccaga

SEQ ID NO: 1518107 - RNA, 15 nt, Human
agagggagguaagga

SEQ ID NO: 1518108 - RNA, 22 nt, Human
agagggagggagggcuccagac

SEQ ID NO: 1518109 - RNA, 18 nt, Human
ugaagauguagaggagaa

SEQ ID NO: 1518110 - RNA, 22 nt, Human
ugaagaagcaccaaucaugaau

SEQ ID NO: 1518111 - RNA, 11 nt, Human
ugaagaagaga

SEQ ID NO: 1518112 - RNA, 11 nt, Human
ugaagacaaug

SEQ ID NO: 1518113 - RNA, 17 nt, Human
ugaagacaaugacuuac

SEQ ID NO: 1518114 - RNA, 13 nt, Human
ugaagacaaugac

SEQ ID NO: 1518115 - RNA, 14 nt, Human
ugaagaagauggua

SEQ ID NO: 1518116 - RNA, 20 nt, Human
ugaagaagcaccaaucauga

SEQ ID NO: 1518117 - RNA, 17 nt, Human
ugaacuuugaccucugc

SEQ ID NO: 1518118 - RNA, 16 nt, Human
ugaacuuugaccucug

SEQ ID NO: 1518119 - RNA, 11 nt, Human
ugaacuuugac

SEQ ID NO: 1518120 - RNA, 14 nt, Human
ucuuuggucuacac

SEQ ID NO: 1518121 - RNA, 21 nt, Human
ucuuuggucuacacugugcug

SEQ ID NO: 1518122 - RNA, 21 nt, Human
ugaagacaaugacuuacugua

SEQ ID NO: 1518123 - RNA, 19 nt, Human
agagcugggugucaagagg

SEQ ID NO: 1518124 - RNA, 12 nt, Human
agaggaaagcaa

SEQ ID NO: 1518125 - RNA, 16 nt, Human
agaggaaagcaaagga

SEQ ID NO: 1518126 - RNA, 18 nt, Human
agaggaaagcaaaggaga

SEQ ID NO: 1518127 - RNA, 19 nt, Human
agaggaaagcaaaggagau

SEQ ID NO: 1518128 - RNA, 11 nt, Human
agaggaaauca

SEQ ID NO: 1518129 - RNA, 12 nt, Human
agaggaaaucac

SEQ ID NO: 1518130 - RNA, 21 nt, Human
agaggaaaucaccgaaaacgu

SEQ ID NO: 1518131 - RNA, 18 nt, Human
agaggcaacugcauuggc

SEQ ID NO: 1518132 - RNA, 13 nt, Human
ugaagguuucuga

SEQ ID NO: 1518133 - RNA, 16 nt, Human
ugaagguuucugaaaa

SEQ ID NO: 1518134 - RNA, 15 nt, Human
ugaauauaaacacua

SEQ ID NO: 1518135 - RNA, 14 nt, Human
ugaauauaaucccu

SEQ ID NO: 1518136 - RNA, 16 nt, Human
ugaauauaaacacuau

SEQ ID NO: 1518137 - RNA, 18 nt, Human
agagucuauuuacggaac

SEQ ID NO: 1518138 - RNA, 22 nt, Human
agagugaacaaauuuacagaga

SEQ ID NO: 1518139 - RNA, 15 nt, Human
agagugagacucugu

SEQ ID NO: 1518140 - RNA, 16 nt, Human
agagugagacucuguc

SEQ ID NO: 1518141 - RNA, 20 nt, Human
agagucucacuguugcccag

SEQ ID NO: 1518142 - RNA, 22 nt, Human
agagucucacuguugcccaggc

SEQ ID NO: 1518143 - RNA, 14 nt, Human
ugaaugucagugug

SEQ ID NO: 1518144 - RNA, 15 nt, Human
ugaaugucaguguga

SEQ ID NO: 1518145 - RNA, 18 nt, Human
ugaaugucagugugacug

SEQ ID NO: 1518146 - RNA, 15 nt, Human
agagucgcugugcca

SEQ ID NO: 1518147 - RNA, 19 nt, Human
agagucgcugugccacagg

SEQ ID NO: 1518148 - RNA, 14 nt, Human
agagucgcugugcc

SEQ ID NO: 1518149 - RNA, 21 nt, Human
agaucaaccccuucgcuccug

SEQ ID NO: 1518150 - RNA, 14 nt, Human
agaucaaccccuuc

SEQ ID NO: 1518151 - RNA, 19 nt, Human
agaucaaccccuucgcucc

SEQ ID NO: 1518152 - RNA, 19 nt, Human
agauacaggaaaagcugcu

SEQ ID NO: 1518153 - RNA, 19 nt, Human
agagugagacucugucuca

SEQ ID NO: 1518154 - RNA, 19 nt, Human
agauaaggguaucugguga

SEQ ID NO: 1518155 - RNA, 18 nt, Human
agauaauacaccacuaca

SEQ ID NO: 1518156 - RNA, 19 nt, Human
agauaaucagugugucuaa

SEQ ID NO: 1518157 - RNA, 15 nt, Human
agauccuuccuuuug

SEQ ID NO: 1518158 - RNA, 12 nt, Human
ugacccaugcug

SEQ ID NO: 1518159 - RNA, 13 nt, Human
ugaccucugccug

SEQ ID NO: 1518160 - RNA, 14 nt, Human
ugaccucugccuga

SEQ ID NO: 1518161 - RNA, 12 nt, Human
ugaccugaggcc

SEQ ID NO: 1518162 - RNA, 18 nt, Human
agaugcuucucacugcca

SEQ ID NO: 1518163 - RNA, 23 nt, Human
agaugcuagaacucccuuucaac

SEQ ID NO: 1518164 - RNA, 23 nt, Human
agauuauauauauuuuuuucuga

SEQ ID NO: 1518165 - RNA, 21 nt, Human
agauucaaugccccugaauuu

SEQ ID NO: 1518166 - RNA, 22 nt, Human
agauucaaugccccugaauuua

SEQ ID NO: 1518167 - RNA, 17 nt, Human
ugacuugacagaacacu

SEQ ID NO: 1518168 - RNA, 19 nt, Human
ugacuugacagaacacugu

SEQ ID NO: 1518169 - RNA, 15 nt, Human
ugacuucuaaguaaa

SEQ ID NO: 1518170 - RNA, 15 nt, Human
ugacuguuuccauca

SEQ ID NO: 1518171 - RNA, 21 nt, Human
ugacuguuuucucuugagagg

SEQ ID NO: 1518172 - RNA, 20 nt, Human
ugacuccagaauuucccaaa

SEQ ID NO: 1518173 - RNA, 23 nt, Human
ugacuccagaauuucccaaagca

SEQ ID NO: 1518174 - RNA, 17 nt, Human
ugaccugaggcccuucu

SEQ ID NO: 1518175 - RNA, 14 nt, Human
ugaccugaggcccu

SEQ ID NO: 1518176 - RNA, 15 nt, Human
ugaccugaggcccuu

SEQ ID NO: 1518177 - RNA, 17 nt, Human
ugacuccagaauuuccc

SEQ ID NO: 1518178 - RNA, 19 nt, Human
ugacuccagaauuucccaa

SEQ ID NO: 1518179 - RNA, 14 nt, Human
agauuuuccugaaa

SEQ ID NO: 1518180 - RNA, 17 nt, Human
agauuuucagaaaauau

SEQ ID NO: 1518181 - RNA, 12 nt, Human
agauuuucagaa

SEQ ID NO: 1518182 - RNA, 16 nt, Human
agauuuaccacuugug

SEQ ID NO: 1518183 - RNA, 23 nt, Human
agauuggcucacacugagaaugu

SEQ ID NO: 1518184 - RNA, 16 nt, Human
agauugugccccugca

SEQ ID NO: 1518185 - RNA, 21 nt, Human
agauugugccccugcacucca

SEQ ID NO: 1518186 - RNA, 13 nt, Human
agauuucacucuc

SEQ ID NO: 1518187 - RNA, 14 nt, Human
agauuucacucucc

SEQ ID NO: 1518188 - RNA, 17 nt, Human
agauuucacucuccuug

SEQ ID NO: 1518189 - RNA, 17 nt, Human
ugagguacugagaguga

SEQ ID NO: 1518190 - RNA, 20 nt, Human
ugaggguugggcugguguca

SEQ ID NO: 1518191 - RNA, 22 nt, Human
ugagguacugagagugaacaaa

SEQ ID NO: 1518192 - RNA, 13 nt, Human
ugaggucagagcc

SEQ ID NO: 1518193 - RNA, 14 nt, Human
ugaggucagagccu

SEQ ID NO: 1518194 - RNA, 16 nt, Human
ugaggucagagccugc

SEQ ID NO: 1518195 - RNA, 20 nt, Human
agcagagaccaucccugaag

SEQ ID NO: 1518196 - RNA, 20 nt, Human
agcagagcaccuuagacagu

SEQ ID NO: 1518197 - RNA, 17 nt, Human
ugaggucagagccugca

SEQ ID NO: 1518198 - RNA, 18 nt, Human
agcagagaccaucccuga

SEQ ID NO: 1518199 - RNA, 19 nt, Human
agcagagaccaucccugaa

SEQ ID NO: 1518200 - RNA, 17 nt, Human
agcagaggaaggagagg

SEQ ID NO: 1518201 - RNA, 21 nt, Human
agcagauggaaugcuguguua

SEQ ID NO: 1518202 - RNA, 19 nt, Human
agcagauggagaccccuug

SEQ ID NO: 1518203 - RNA, 13 nt, Human
ugaggggccucuu

SEQ ID NO: 1518204 - RNA, 23 nt, Human
ugaggguccugcagccugcagga

SEQ ID NO: 1518205 - RNA, 21 nt, Human
ugaggguccugcagccugcag

SEQ ID NO: 1518206 - RNA, 22 nt, Human
ugaggguccugcagccugcagg

SEQ ID NO: 1518207 - RNA, 14 nt, Human
ugaggguccugcag

SEQ ID NO: 1518208 - RNA, 15 nt, Human
ugaggguccugcagc

SEQ ID NO: 1518209 - RNA, 18 nt, Human
ugaggguccugcagccug

SEQ ID NO: 1518210 - RNA, 19 nt, Human
ugaggguccugcagccugc

SEQ ID NO: 1518211 - RNA, 12 nt, Human
ugaggggccucu

SEQ ID NO: 1518212 - RNA, 19 nt, Human
ugagggauacccaucccau

SEQ ID NO: 1518213 - RNA, 16 nt, Human
ugaggcccuucucucc

SEQ ID NO: 1518214 - RNA, 18 nt, Human
ugaggcccuucucuccag

SEQ ID NO: 1518215 - RNA, 19 nt, Human
ugaggcccuucucuccagc

SEQ ID NO: 1518216 - RNA, 20 nt, Human
ugaggcccuucucuccagcc

SEQ ID NO: 1518217 - RNA, 22 nt, Human
ugaggcccuucucuccagcccc

SEQ ID NO: 1518218 - RNA, 23 nt, Human
ugaggcccuucucuccagccccu

SEQ ID NO: 1518219 - RNA, 24 nt, Human
ugaggcccuucucuccagccccug

SEQ ID NO: 1518220 - RNA, 16 nt, Human
ugagcuacaaaugcau

SEQ ID NO: 1518221 - RNA, 14 nt, Human
ugagcuacaaaugc

SEQ ID NO: 1518222 - RNA, 13 nt, Human
ugagcuacaaaug

SEQ ID NO: 1518223 - RNA, 14 nt, Human
ugagcgcuccugcc

SEQ ID NO: 1518224 - RNA, 18 nt, Human
ugagcgcuccugccgcag

SEQ ID NO: 1518225 - RNA, 22 nt, Human
ugagcgcuccugccgcagagcu

SEQ ID NO: 1518226 - RNA, 15 nt, Human
ugaggaagcaaaagc

SEQ ID NO: 1518227 - RNA, 17 nt, Human
ugaggaagaacggggcu

SEQ ID NO: 1518228 - RNA, 19 nt, Human
ugaggaagaacggggcucu

SEQ ID NO: 1518229 - RNA, 23 nt, Human
ugaggaagaacggggcucuucuc

SEQ ID NO: 1518230 - RNA, 24 nt, Human
ugaggaagaacggggcucuucuca

SEQ ID NO: 1518231 - RNA, 22 nt, Human
ugaggaagcaaaagcaucuaug

SEQ ID NO: 1518232 - RNA, 14 nt, Human
ugaggaagccgcug

SEQ ID NO: 1518233 - RNA, 17 nt, Human
ugaggaagccgcugggg

SEQ ID NO: 1518234 - RNA, 18 nt, Human
ugaggaagccgcuggggc

SEQ ID NO: 1518235 - RNA, 19 nt, Human
ugaggaagccgcuggggcc

SEQ ID NO: 1518236 - RNA, 21 nt, Human
ugaggaagccgcuggggccag

SEQ ID NO: 1518237 - RNA, 20 nt, Human
ugaggccagagacacaagcc

SEQ ID NO: 1518238 - RNA, 14 nt, Human
ugaggccagagaca

SEQ ID NO: 1518239 - RNA, 16 nt, Human
ugaggccagagacaca

SEQ ID NO: 1518240 - RNA, 12 nt, Human
ugaggcccagag

SEQ ID NO: 1518241 - RNA, 13 nt, Human
ugaggcccagagg

SEQ ID NO: 1518242 - RNA, 23 nt, Human
ugaggcccagagggccugcaagg

SEQ ID NO: 1518243 - RNA, 21 nt, Human
ugaggcccagagggccugcaa

SEQ ID NO: 1518244 - RNA, 22 nt, Human
ugaggcccagagggccugcaag

SEQ ID NO: 1518245 - RNA, 15 nt, Human
ugaggcccagagggc

SEQ ID NO: 1518246 - RNA, 17 nt, Human
ugaggcccagagggccu

SEQ ID NO: 1518247 - RNA, 18 nt, Human
ugaggcccagagggccug

SEQ ID NO: 1518248 - RNA, 20 nt, Human
ugaggcccagagggccugca

SEQ ID NO: 1518249 - RNA, 15 nt, Human
ugaggacacugauau

SEQ ID NO: 1518250 - RNA, 21 nt, Human
ugaggacacuaaccacgcugg

SEQ ID NO: 1518251 - RNA, 12 nt, Human
ugaggccagaga

SEQ ID NO: 1518252 - RNA, 21 nt, Human
ugaggaauccagacccggcug

SEQ ID NO: 1518253 - RNA, 22 nt, Human
ugaggaauccagacccggcugc

SEQ ID NO: 1518254 - RNA, 15 nt, Human
agcacagugaucaag

SEQ ID NO: 1518255 - RNA, 22 nt, Human
agcacagccucuuagaugcagu

SEQ ID NO: 1518256 - RNA, 16 nt, Human
agcacagcuucauuuc

SEQ ID NO: 1518257 - RNA, 16 nt, Human
agcaccaaucaugaau

SEQ ID NO: 1518258 - RNA, 13 nt, Human
agcacaugccucu

SEQ ID NO: 1518259 - RNA, 14 nt, Human
agcacaugccucuc

SEQ ID NO: 1518260 - RNA, 16 nt, Human
agcacaugccucucuc

SEQ ID NO: 1518261 - RNA, 22 nt, Human
agcaagugagagcuggguguca

SEQ ID NO: 1518262 - RNA, 14 nt, Human
agcaagugagagcu

SEQ ID NO: 1518263 - RNA, 17 nt, Human
ugagccagauuucacuc

SEQ ID NO: 1518264 - RNA, 22 nt, Human
ugagccagauuucacucuccuu

SEQ ID NO: 1518265 - RNA, 20 nt, Human
agcaagugagacccugucuc

SEQ ID NO: 1518266 - RNA, 13 nt, Human
agcaagugagagc

SEQ ID NO: 1518267 - RNA, 14 nt, Human
agcaacgcaggccc

SEQ ID NO: 1518268 - RNA, 15 nt, Human
ugagcaauccugcaa

SEQ ID NO: 1518269 - RNA, 20 nt, Human
ugagcacuaaggugugcucu

SEQ ID NO: 1518270 - RNA, 21 nt, Human
ugagcacuaaggugugcucug

SEQ ID NO: 1518271 - RNA, 22 nt, Human
ugagcacuaaggugugcucuga

SEQ ID NO: 1518272 - RNA, 23 nt, Human
ugagcacuaaggugugcucugau

SEQ ID NO: 1518273 - RNA, 21 nt, Human
ugagcaucaggccaggcccuc

SEQ ID NO: 1518274 - RNA, 22 nt, Human
ugagcaucaggccaggcccucu

SEQ ID NO: 1518275 - RNA, 24 nt, Human
ugagcaucaggccaggcccucugc

SEQ ID NO: 1518276 - RNA, 21 nt, Human
ugagccacugcaccgggccac

SEQ ID NO: 1518277 - RNA, 23 nt, Human
ugagccacugcaccgggccacag

SEQ ID NO: 1518278 - RNA, 13 nt, Human
ugagccagauuuc

SEQ ID NO: 1518279 - RNA, 14 nt, Human
ugagccagauuuca

SEQ ID NO: 1518280 - RNA, 16 nt, Human
ugagccagauuucacu

SEQ ID NO: 1518281 - RNA, 21 nt, Human
agcagagaaugaaagggccca

SEQ ID NO: 1518282 - RNA, 22 nt, Human
agcagagaaugaaagggcccag

SEQ ID NO: 1518283 - RNA, 23 nt, Human
agcagagaaugaaagggcccaga

SEQ ID NO: 1518284 - RNA, 14 nt, Human
agcagagaauucuc

SEQ ID NO: 1518285 - RNA, 21 nt, Human
agcagagaauucucuuaucca

SEQ ID NO: 1518286 - RNA, 15 nt, Human
agcagagaccauccc

SEQ ID NO: 1518287 - RNA, 16 nt, Human
agcagagaccaucccu

SEQ ID NO: 1518288 - RNA, 17 nt, Human
agcagagaccaucccug

SEQ ID NO: 1518289 - RNA, 10 nt, Human
ugagccuggc

SEQ ID NO: 1518290 - RNA, 14 nt, Human
ugagccuugaacuu

SEQ ID NO: 1518291 - RNA, 11 nt, Human
ugagccugguc

SEQ ID NO: 1518292 - RNA, 19 nt, Human
ugagccugggaggucaagg

SEQ ID NO: 1518293 - RNA, 22 nt, Human
ugagccugggaggucaaggcug

SEQ ID NO: 1518294 - RNA, 11 nt, Human
ugagccuggca

SEQ ID NO: 1518295 - RNA, 16 nt, Human
ugagccuggcaagaau

SEQ ID NO: 1518296 - RNA, 14 nt, Human
ugagccugggaggu

SEQ ID NO: 1518297 - RNA, 19 nt, Human
ugagccuugaacuuugacc

SEQ ID NO: 1518298 - RNA, 18 nt, Human
ugagccuugaacuuugac

SEQ ID NO: 1518299 - RNA, 17 nt, Human
ugagccuugaacuuuga

SEQ ID NO: 1518300 - RNA, 15 nt, Human
ugagccuugaacuuu

SEQ ID NO: 1518301 - RNA, 13 nt, Human
ugagcgacaguga

SEQ ID NO: 1518302 - RNA, 14 nt, Human
ugagcgacagugag

SEQ ID NO: 1518303 - RNA, 16 nt, Human
ugagcgacagugagac

SEQ ID NO: 1518304 - RNA, 20 nt, Human
ugagcgacagugagacucug

SEQ ID NO: 1518305 - RNA, 22 nt, Human
agcacuuugggaggccaaggug

SEQ ID NO: 1518306 - RNA, 23 nt, Human
agcacuuugggaggccaaggugg

SEQ ID NO: 1518307 - RNA, 13 nt, Human
agcagaaaugccu

SEQ ID NO: 1518308 - RNA, 12 nt, Human
agcagaaaugcc

SEQ ID NO: 1518309 - RNA, 19 nt, Human
agcagaaaugccuuacccu

SEQ ID NO: 1518310 - RNA, 14 nt, Human
agcagaacagugau

SEQ ID NO: 1518311 - RNA, 12 nt, Human
agcagaaggggg

SEQ ID NO: 1518312 - RNA, 16 nt, Human
agcagaaggggguggu

SEQ ID NO: 1518313 - RNA, 22 nt, Human
agcagaaggggguggugucucc

SEQ ID NO: 1518314 - RNA, 23 nt, Human
agcagaaggggguggugucucca

SEQ ID NO: 1518315 - RNA, 19 nt, Human
agcaccuuagacagucccu

SEQ ID NO: 1518316 - RNA, 20 nt, Human
agcaccuuagacagucccug

SEQ ID NO: 1518317 - RNA, 21 nt, Human
agcaccuuagacagucccugc

SEQ ID NO: 1518318 - RNA, 22 nt, Human
agcaccuuagacagucccugcc

SEQ ID NO: 1518319 - RNA, 23 nt, Human
agcaccuuagacagucccugcca

SEQ ID NO: 1518320 - RNA, 13 nt, Human
agcacgauuucug

SEQ ID NO: 1518321 - RNA, 15 nt, Human
agcacgauuucuguu

SEQ ID NO: 1518322 - RNA, 14 nt, Human
agcacgauuucugu

SEQ ID NO: 1518323 - RNA, 16 nt, Human
agcacgauuucuguuu

SEQ ID NO: 1518324 - RNA, 20 nt, Human
acuggguacuuguggacaca

SEQ ID NO: 1518325 - RNA, 23 nt, Human
acuggguacuuguggacacagcu

SEQ ID NO: 1518326 - RNA, 19 nt, Human
acuggguacuuguggacac

SEQ ID NO: 1518327 - RNA, 12 nt, Human
ucgcuccugugu

SEQ ID NO: 1518328 - RNA, 13 nt, Human
ucgcuccuguguc

SEQ ID NO: 1518329 - RNA, 14 nt, Human
ucgcuccugugucu

SEQ ID NO: 1518330 - RNA, 19 nt, Human
acuguaauuugugauacaa

SEQ ID NO: 1518331 - RNA, 13 nt, Human
acuguacaaagua

SEQ ID NO: 1518332 - RNA, 14 nt, Human
acuguacaaaguag

SEQ ID NO: 1518333 - RNA, 15 nt, Human
acuguacaaaguaga

SEQ ID NO: 1518334 - RNA, 14 nt, Human
acuguacaugaaaa

SEQ ID NO: 1518335 - RNA, 13 nt, Human
acuguacaugaaa

SEQ ID NO: 1518336 - RNA, 23 nt, Human
acuguacaugaaaacacauuuuu

SEQ ID NO: 1518337 - RNA, 16 nt, Human
acuguacaugaaaaca

SEQ ID NO: 1518338 - RNA, 14 nt, Human
ucgagcaugccugg

SEQ ID NO: 1518339 - RNA, 15 nt, Human
ucgagcaugccugga

SEQ ID NO: 1518340 - RNA, 14 nt, Human
ucgaggacagggag

SEQ ID NO: 1518341 - RNA, 17 nt, Human
ucgaggacagggaggug

SEQ ID NO: 1518342 - RNA, 14 nt, Human
ucgcgacaaugcaa

SEQ ID NO: 1518343 - RNA, 13 nt, Human
ucgcgacaaugca

SEQ ID NO: 1518344 - RNA, 19 nt, Human
uccuuucaaugguuugcaa

SEQ ID NO: 1518345 - RNA, 15 nt, Human
uccuuucaccacaug

SEQ ID NO: 1518346 - RNA, 22 nt, Human
uccuuucuaacaaaaaaauaua

SEQ ID NO: 1518347 - RNA, 14 nt, Human
ucgaacuggcugca

SEQ ID NO: 1518348 - RNA, 15 nt, Human
ucgaacuggcugcaa

SEQ ID NO: 1518349 - RNA, 20 nt, Human
uccuuccuggagcccagagg

SEQ ID NO: 1518350 - RNA, 14 nt, Human
uccuucagugccuu

SEQ ID NO: 1518351 - RNA, 22 nt, Human
uccuucagugccuuauggaaca

SEQ ID NO: 1518352 - RNA, 13 nt, Human
uccuucagugccu

SEQ ID NO: 1518353 - RNA, 13 nt, Human
uccuucagccuga

SEQ ID NO: 1518354 - RNA, 11 nt, Human
uccuucagugc

SEQ ID NO: 1518355 - RNA, 12 nt, Human
uccuucagugcc

SEQ ID NO: 1518356 - RNA, 21 nt, Human
uccuucagcccucaccccugg

SEQ ID NO: 1518357 - RNA, 14 nt, Human
uccuucagcccuca

SEQ ID NO: 1518358 - RNA, 15 nt, Human
uccuucagcccucac

SEQ ID NO: 1518359 - RNA, 19 nt, Human
uccuucagcccucaccccu

SEQ ID NO: 1518360 - RNA, 13 nt, Human
uccuucagcccuc

SEQ ID NO: 1518361 - RNA, 22 nt, Human
acuggcugcaaaggguaucagg

SEQ ID NO: 1518362 - RNA, 22 nt, Human
acuggcacaguuuucugagaaa

SEQ ID NO: 1518363 - RNA, 16 nt, Human
acugccuuuggcagag

SEQ ID NO: 1518364 - RNA, 19 nt, Human
acugccuuuggcagaguuc

SEQ ID NO: 1518365 - RNA, 22 nt, Human
acugccuucucaacuccaaacu

SEQ ID NO: 1518366 - RNA, 21 nt, Human
acugcuugugaaaggaaagag

SEQ ID NO: 1518367 - RNA, 18 nt, Human
acugcuuccagugaggcu

SEQ ID NO: 1518368 - RNA, 21 nt, Human
acugcuuccagugaggcucug

SEQ ID NO: 1518369 - RNA, 22 nt, Human
acugcuuccagugaggcucugc

SEQ ID NO: 1518370 - RNA, 23 nt, Human
acugcuuccagugaggcucugcc

SEQ ID NO: 1518371 - RNA, 13 nt, Human
uccugcagccugc

SEQ ID NO: 1518372 - RNA, 22 nt, Human
uccugcaggcagccaggccaca

SEQ ID NO: 1518373 - RNA, 19 nt, Human
uccugccucagccucccaa

SEQ ID NO: 1518374 - RNA, 16 nt, Human
uccugcaggcagccag

SEQ ID NO: 1518375 - RNA, 17 nt, Human
uccugcaggcagccagg

SEQ ID NO: 1518376 - RNA, 19 nt, Human
uccugcaggcagccaggcc

SEQ ID NO: 1518377 - RNA, 20 nt, Human
uccugcaggcagccaggcca

SEQ ID NO: 1518378 - RNA, 21 nt, Human
uccugccucgaacuggcugca

SEQ ID NO: 1518379 - RNA, 20 nt, Human
uccugccucgaacuggcugc

SEQ ID NO: 1518380 - RNA, 13 nt, Human
acugaggccugag

SEQ ID NO: 1518381 - RNA, 14 nt, Human
acugaggccugagc

SEQ ID NO: 1518382 - RNA, 17 nt, Human
acugaggggaggggagc

SEQ ID NO: 1518383 - RNA, 22 nt, Human
acugaggggaggggagcauggg

SEQ ID NO: 1518384 - RNA, 13 nt, Human
acugaggaagaac

SEQ ID NO: 1518385 - RNA, 22 nt, Human
acugaggaagaacggggcucuu

SEQ ID NO: 1518386 - RNA, 15 nt, Human
uccucuccccagcaa

SEQ ID NO: 1518387 - RNA, 16 nt, Human
acugcaaccuccgccu

SEQ ID NO: 1518388 - RNA, 22 nt, Human
acugcaaccuccgccucuuggg

SEQ ID NO: 1518389 - RNA, 13 nt, Human
acugcaaccuccg

SEQ ID NO: 1518390 - RNA, 14 nt, Human
acugcaaccuccgc

SEQ ID NO: 1518391 - RNA, 23 nt, Human
acugaguacguugugcauuuggu

SEQ ID NO: 1518392 - RNA, 22 nt, Human
acugaguacguugugcauuugg

SEQ ID NO: 1518393 - RNA, 21 nt, Human
acugaguacguugugcauuug

SEQ ID NO: 1518394 - RNA, 19 nt, Human
acugaguacguugugcauu

SEQ ID NO: 1518395 - RNA, 18 nt, Human
acugaguacguugugcau

SEQ ID NO: 1518396 - RNA, 19 nt, Human
uccuguucccaugagauga

SEQ ID NO: 1518397 - RNA, 18 nt, Human
uccugugugugcgccuac

SEQ ID NO: 1518398 - RNA, 13 nt, Human
uccugugugugcg

SEQ ID NO: 1518399 - RNA, 14 nt, Human
uccugugugugcgc

SEQ ID NO: 1518400 - RNA, 23 nt, Human
uccugugucuugcaauggcagcc

SEQ ID NO: 1518401 - RNA, 24 nt, Human
uccugugucuugcaauggcagccu

SEQ ID NO: 1518402 - RNA, 23 nt, Human
acugcagccucaaccuccugggc

SEQ ID NO: 1518403 - RNA, 19 nt, Human
acugcagccucaaccuccu

SEQ ID NO: 1518404 - RNA, 21 nt, Human
acugcagccucaaccuccugg

SEQ ID NO: 1518405 - RNA, 22 nt, Human
acugcagccucaaccuccuggg

SEQ ID NO: 1518406 - RNA, 13 nt, Human
uccugcugcaguu

SEQ ID NO: 1518407 - RNA, 21 nt, Human
uccugcugcaguugccaguca

SEQ ID NO: 1518408 - RNA, 23 nt, Human
acucuuauaucuauauuuuacau

SEQ ID NO: 1518409 - RNA, 21 nt, Human
acucuccucugcugcuggcug

SEQ ID NO: 1518410 - RNA, 14 nt, Human
acucucccccaccc

SEQ ID NO: 1518411 - RNA, 20 nt, Human
acucucccccacccccuccc

SEQ ID NO: 1518412 - RNA, 18 nt, Human
acucuccucugcugcugg

SEQ ID NO: 1518413 - RNA, 19 nt, Human
acucuccucugcugcuggc

SEQ ID NO: 1518414 - RNA, 18 nt, Human
acucgcgacaaugcaaac

SEQ ID NO: 1518415 - RNA, 19 nt, Human
uccuaggcauuugcugaau

SEQ ID NO: 1518416 - RNA, 20 nt, Human
acucgcgacaaugcaaacca

SEQ ID NO: 1518417 - RNA, 23 nt, Human
acucgcgacaaugcaaaccauca

SEQ ID NO: 1518418 - RNA, 10 nt, Human
acucuccccc

SEQ ID NO: 1518419 - RNA, 17 nt, Human
acucuccucugcugcug

SEQ ID NO: 1518420 - RNA, 20 nt, Human
uccucagaucuucugugggu

SEQ ID NO: 1518421 - RNA, 16 nt, Human
acucuuauugcccacg

SEQ ID NO: 1518422 - RNA, 19 nt, Human
acucuuauugcccacgcug

SEQ ID NO: 1518423 - RNA, 22 nt, Human
uccucauacccacccccaccca

SEQ ID NO: 1518424 - RNA, 14 nt, Human
uccucauacccacc

SEQ ID NO: 1518425 - RNA, 18 nt, Human
uccucauacccaccccca

SEQ ID NO: 1518426 - RNA, 12 nt, Human
uccucuccccag

SEQ ID NO: 1518427 - RNA, 17 nt, Human
uccucccucccucuuuc

SEQ ID NO: 1518428 - RNA, 15 nt, Human
uccucccucccucuu

SEQ ID NO: 1518429 - RNA, 19 nt, Human
uccucccucccucuuuccc

SEQ ID NO: 1518430 - RNA, 19 nt, Human
acuccagugagacagcucu

SEQ ID NO: 1518431 - RNA, 20 nt, Human
acucauuuuaaaaaauggaa

SEQ ID NO: 1518432 - RNA, 22 nt, Human
ucccucauccucauacccaccc

SEQ ID NO: 1518433 - RNA, 21 nt, Human
ucccucagucuggcccuuccu

SEQ ID NO: 1518434 - RNA, 12 nt, Human
acuccugcaggc

SEQ ID NO: 1518435 - RNA, 22 nt, Human
ucccuuuccaaaugcccagcuu

SEQ ID NO: 1518436 - RNA, 18 nt, Human
ucccuuacgugaguccug

SEQ ID NO: 1518437 - RNA, 22 nt, Human
ucccuuacgugaguccuggcau

SEQ ID NO: 1518438 - RNA, 20 nt, Human
uccuagcacuuugggaggcc

SEQ ID NO: 1518439 - RNA, 14 nt, Human
uccuaggcauuugc

SEQ ID NO: 1518440 - RNA, 22 nt, Human
ucccuuugacgccaucccagcc

SEQ ID NO: 1518441 - RNA, 23 nt, Human
ucccuuugacgccaucccagccc

SEQ ID NO: 1518442 - RNA, 18 nt, Human
ucccuauuagagaagaga

SEQ ID NO: 1518443 - RNA, 18 nt, Human
ucccgaauagcugggacu

SEQ ID NO: 1518444 - RNA, 18 nt, Human
uccccuucucucaucucu

SEQ ID NO: 1518445 - RNA, 15 nt, Human
uccccuucucucauc

SEQ ID NO: 1518446 - RNA, 16 nt, Human
uccccuucucucaucu

SEQ ID NO: 1518447 - RNA, 13 nt, Human
uccccuucucuca

SEQ ID NO: 1518448 - RNA, 14 nt, Human
uccccuccuccacu

SEQ ID NO: 1518449 - RNA, 16 nt, Human
uccccuccuccacucu

SEQ ID NO: 1518450 - RNA, 15 nt, Human
ucccgaauagcuggg

SEQ ID NO: 1518451 - RNA, 16 nt, Human
ucccgaauagcuggga

SEQ ID NO: 1518452 - RNA, 12 nt, Human
uccccuccaacc

SEQ ID NO: 1518453 - RNA, 13 nt, Human
uccccuccaaccu

SEQ ID NO: 1518454 - RNA, 22 nt, Human
uccccuccaaccuggggggcag

SEQ ID NO: 1518455 - RNA, 12 nt, Human
uccccuccucca

SEQ ID NO: 1518456 - RNA, 18 nt, Human
acuauguugcccaggcag

SEQ ID NO: 1518457 - RNA, 22 nt, Human
acuaugacauaaaaacaacuuu

SEQ ID NO: 1518458 - RNA, 16 nt, Human
acuaucuaaauguuga

SEQ ID NO: 1518459 - RNA, 19 nt, Human
acuauguugcccaggcagg

SEQ ID NO: 1518460 - RNA, 20 nt, Human
acuauguugcccaggcaggu

SEQ ID NO: 1518461 - RNA, 23 nt, Human
acuauguugcccaggcaggucuu

SEQ ID NO: 1518462 - RNA, 24 nt, Human
uccccaccgcagacaggaccaggg

SEQ ID NO: 1518463 - RNA, 15 nt, Human
acuauauuguacaca

SEQ ID NO: 1518464 - RNA, 23 nt, Human
acuauaauuuaccugaagucuuu

SEQ ID NO: 1518465 - RNA, 17 nt, Human
acuauagccuaggugac

SEQ ID NO: 1518466 - RNA, 18 nt, Human
acuauagccuaggugaca

SEQ ID NO: 1518467 - RNA, 13 nt, Human
uccagccugggug

SEQ ID NO: 1518468 - RNA, 24 nt, Human
uccagccugggugacagagcaagu

SEQ ID NO: 1518469 - RNA, 21 nt, Human
uccagcuauuuuuauuuguuu

SEQ ID NO: 1518470 - RNA, 15 nt, Human
uccagcucaccagcc

SEQ ID NO: 1518471 - RNA, 14 nt, Human
uccagcucaccagc

SEQ ID NO: 1518472 - RNA, 12 nt, Human
acguuucuaaag

SEQ ID NO: 1518473 - RNA, 14 nt, Human
acguuucuaaaggc

SEQ ID NO: 1518474 - RNA, 15 nt, Human
acguuucuaaaggcu

SEQ ID NO: 1518475 - RNA, 13 nt, Human
acuaaaaauacaa

SEQ ID NO: 1518476 - RNA, 16 nt, Human
acuaaccagcagaaau

SEQ ID NO: 1518477 - RNA, 13 nt, Human
acuaaccacgcug

SEQ ID NO: 1518478 - RNA, 17 nt, Human
acuaaccagcagaaaug

SEQ ID NO: 1518479 - RNA, 15 nt, Human
acuacaguccuccca

SEQ ID NO: 1518480 - RNA, 17 nt, Human
acuacaguccucccauc

SEQ ID NO: 1518481 - RNA, 16 nt, Human
acuacaguccucccau

SEQ ID NO: 1518482 - RNA, 11 nt, Human
acuacauucug

SEQ ID NO: 1518483 - RNA, 15 nt, Human
ucccagugaauucuu

SEQ ID NO: 1518484 - RNA, 19 nt, Human
ucccagugccgagaaggaa

SEQ ID NO: 1518485 - RNA, 22 nt, Human
ucccagugccgagaaggaagcc

SEQ ID NO: 1518486 - RNA, 15 nt, Human
ucccauaugccuggg

SEQ ID NO: 1518487 - RNA, 16 nt, Human
ucccauaugccugggc

SEQ ID NO: 1518488 - RNA, 13 nt, Human
ucccaucucacac

SEQ ID NO: 1518489 - RNA, 14 nt, Human
ucccaucucacaca

SEQ ID NO: 1518490 - RNA, 19 nt, Human
ucccaucucacacaugagc

SEQ ID NO: 1518491 - RNA, 19 nt, Human
ucaugacaaagacugagua

SEQ ID NO: 1518492 - RNA, 22 nt, Human
ucaugaauuaguuuuauaugcu

SEQ ID NO: 1518493 - RNA, 23 nt, Human
ucauccacugugccaugugccag

SEQ ID NO: 1518494 - RNA, 19 nt, Human
ucauccacugugccaugug

SEQ ID NO: 1518495 - RNA, 21 nt, Human
ucauccacugugccaugugcc

SEQ ID NO: 1518496 - RNA, 13 nt, Human
ucaugucuggcua

SEQ ID NO: 1518497 - RNA, 17 nt, Human
ucauguucuuaauucuu

SEQ ID NO: 1518498 - RNA, 11 nt, Human
ucauguucuua

SEQ ID NO: 1518499 - RNA, 21 nt, Human
accucuaaauucuuucauuuu

SEQ ID NO: 1518500 - RNA, 13 nt, Human
accucucccuugg

SEQ ID NO: 1518501 - RNA, 14 nt, Human
accucucccuugga

SEQ ID NO: 1518502 - RNA, 15 nt, Human
accucucccuuggau

SEQ ID NO: 1518503 - RNA, 12 nt, Human
accucugcacaa

SEQ ID NO: 1518504 - RNA, 23 nt, Human
accucucccuuggauuguccccg

SEQ ID NO: 1518505 - RNA, 14 nt, Human
accucucucacucc

SEQ ID NO: 1518506 - RNA, 19 nt, Human
accucucucacuccuugaa

SEQ ID NO: 1518507 - RNA, 18 nt, Human
accucuaaauucuuucau

SEQ ID NO: 1518508 - RNA, 17 nt, Human
accucggugccuuccuc

SEQ ID NO: 1518509 - RNA, 21 nt, Human
ucauucuccuuguguuacuaa

SEQ ID NO: 1518510 - RNA, 22 nt, Human
ucauugaccugaggcccuucuc

SEQ ID NO: 1518511 - RNA, 17 nt, Human
accgccaaggcuggggg

SEQ ID NO: 1518512 - RNA, 20 nt, Human
accgcagacaggaccaggga

SEQ ID NO: 1518513 - RNA, 10 nt, Human
acccuuuucu

SEQ ID NO: 1518514 - RNA, 19 nt, Human
ucauauuaauauauuucca

SEQ ID NO: 1518515 - RNA, 18 nt, Human
accgacguugccaucaaa

SEQ ID NO: 1518516 - RNA, 20 nt, Human
ucauauuuacuucuuauaca

SEQ ID NO: 1518517 - RNA, 21 nt, Human
ucauauuuacuucuuauacau

SEQ ID NO: 1518518 - RNA, 22 nt, Human
ucauauuuacuucuuauacauu

SEQ ID NO: 1518519 - RNA, 13 nt, Human
accuagccuuaga

SEQ ID NO: 1518520 - RNA, 11 nt, Human
accucagccuc

SEQ ID NO: 1518521 - RNA, 20 nt, Human
accuccgccucuuggguuca

SEQ ID NO: 1518522 - RNA, 20 nt, Human
ucauuuuagggguagcauuu

SEQ ID NO: 1518523 - RNA, 21 nt, Human
ucauuugagcagggcucagcg

SEQ ID NO: 1518524 - RNA, 18 nt, Human
ucauuugacuaagagucu

SEQ ID NO: 1518525 - RNA, 20 nt, Human
ucauuugcuaacuagcuugg

SEQ ID NO: 1518526 - RNA, 17 nt, Human
ucauuuuuuuuaagaaa

SEQ ID NO: 1518527 - RNA, 13 nt, Human
ucauuuuuuuuaa

SEQ ID NO: 1518528 - RNA, 18 nt, Human
ucauuuuuuuccaggcug

SEQ ID NO: 1518529 - RNA, 13 nt, Human
ucauuuuuuucca

SEQ ID NO: 1518530 - RNA, 16 nt, Human
ucauuuuuuuccaggc

SEQ ID NO: 1518531 - RNA, 15 nt, Human
accugaagucuuugu

SEQ ID NO: 1518532 - RNA, 22 nt, Human
accugaagucuuuguacagaca

SEQ ID NO: 1518533 - RNA, 23 nt, Human
accugcggugcuaucucccccag

SEQ ID NO: 1518534 - RNA, 19 nt, Human
accugcggugcuaucuccc

SEQ ID NO: 1518535 - RNA, 22 nt, Human
accugcggugcuaucuccccca

SEQ ID NO: 1518536 - RNA, 19 nt, Human
ucauuugagcagggcucag

SEQ ID NO: 1518537 - RNA, 17 nt, Human
accuggaauauauaacc

SEQ ID NO: 1518538 - RNA, 14 nt, Human
accuggaauauaua

SEQ ID NO: 1518539 - RNA, 21 nt, Human
uccaacuaucucauuuccaag

SEQ ID NO: 1518540 - RNA, 12 nt, Human
uccaagcuccca

SEQ ID NO: 1518541 - RNA, 13 nt, Human
uccaagcucccag

SEQ ID NO: 1518542 - RNA, 16 nt, Human
uccaagcucccaggca

SEQ ID NO: 1518543 - RNA, 14 nt, Human
uccaagcucccagg

SEQ ID NO: 1518544 - RNA, 15 nt, Human
uccaagcucccaggc

SEQ ID NO: 1518545 - RNA, 16 nt, Human
uccaagcuggucccac

SEQ ID NO: 1518546 - RNA, 11 nt, Human
uccaagcuggu

SEQ ID NO: 1518547 - RNA, 12 nt, Human
accuucuccuuc

SEQ ID NO: 1518548 - RNA, 16 nt, Human
accuugacagggcaca

SEQ ID NO: 1518549 - RNA, 15 nt, Human
accuugacagggcac

SEQ ID NO: 1518550 - RNA, 15 nt, Human
accuugaaugaugcc

SEQ ID NO: 1518551 - RNA, 14 nt, Human
accuugacagggca

SEQ ID NO: 1518552 - RNA, 14 nt, Human
accuucuccuucac

SEQ ID NO: 1518553 - RNA, 13 nt, Human
accuucuccuuca

SEQ ID NO: 1518554 - RNA, 17 nt, Human
accuuagacagucccug

SEQ ID NO: 1518555 - RNA, 23 nt, Human
accuuaggaauaaucuccuguua

SEQ ID NO: 1518556 - RNA, 15 nt, Human
uccaccaucaagcca

SEQ ID NO: 1518557 - RNA, 18 nt, Human
uccaccaucaagccacca

SEQ ID NO: 1518558 - RNA, 22 nt, Human
uccacucucccccacccccucc

SEQ ID NO: 1518559 - RNA, 22 nt, Human
uccagaaguuugagaucagccu

SEQ ID NO: 1518560 - RNA, 19 nt, Human
accuuuguauucucuccug

SEQ ID NO: 1518561 - RNA, 15 nt, Human
accuuuguauucucu

SEQ ID NO: 1518562 - RNA, 23 nt, Human
accuuuguauucucuccuguacc

SEQ ID NO: 1518563 - RNA, 21 nt, Human
uccagccugagcgacagugag

SEQ ID NO: 1518564 - RNA, 20 nt, Human
uccagccugagcgacaguga

SEQ ID NO: 1518565 - RNA, 22 nt, Human
uccagccccuggaugcagccuc

SEQ ID NO: 1518566 - RNA, 14 nt, Human
uccagacccggcug

SEQ ID NO: 1518567 - RNA, 15 nt, Human
uccagccccuggaug

SEQ ID NO: 1518568 - RNA, 16 nt, Human
uccagccccuggaugc

SEQ ID NO: 1518569 - RNA, 17 nt, Human
uccagccccuggaugca

SEQ ID NO: 1518570 - RNA, 19 nt, Human
uccagccccuggaugcagc

SEQ ID NO: 1518571 - RNA, 21 nt, Human
uccagccccuggaugcagccu

SEQ ID NO: 1518572 - RNA, 18 nt, Human
ucagcggggacagcuccu

SEQ ID NO: 1518573 - RNA, 16 nt, Human
ucagcggggacagcuc

SEQ ID NO: 1518574 - RNA, 17 nt, Human
ucagcggggacagcucc

SEQ ID NO: 1518575 - RNA, 20 nt, Human
ucaggccaaacucaccugcc

SEQ ID NO: 1518576 - RNA, 23 nt, Human
ucaggccaaacucaccugccccu

SEQ ID NO: 1518577 - RNA, 12 nt, Human
ucaggaagcuca

SEQ ID NO: 1518578 - RNA, 17 nt, Human
ucaggaagcucagggcc

SEQ ID NO: 1518579 - RNA, 19 nt, Human
ucaggaagcucagggccug

SEQ ID NO: 1518580 - RNA, 20 nt, Human
ucaggaagcucagggccugg

SEQ ID NO: 1518581 - RNA, 15 nt, Human
ucaggccagcugcuu

SEQ ID NO: 1518582 - RNA, 20 nt, Human
ucaggccagcugcuugggcu

SEQ ID NO: 1518583 - RNA, 11 nt, Human
ucaggccaggc

SEQ ID NO: 1518584 - RNA, 12 nt, Human
ucaggccaggcc

SEQ ID NO: 1518585 - RNA, 13 nt, Human
ucagggucccugg

SEQ ID NO: 1518586 - RNA, 14 nt, Human
ucagggucccuggu

SEQ ID NO: 1518587 - RNA, 18 nt, Human
ucagggucccugguggca

SEQ ID NO: 1518588 - RNA, 13 nt, Human
ucagguaacaggc

SEQ ID NO: 1518589 - RNA, 15 nt, Human
ucagguaacaggcag

SEQ ID NO: 1518590 - RNA, 16 nt, Human
ucagguaacaggcaga

SEQ ID NO: 1518591 - RNA, 19 nt, Human
accccuucgcuccuguguc

SEQ ID NO: 1518592 - RNA, 20 nt, Human
accccuucgcuccugugucu

SEQ ID NO: 1518593 - RNA, 16 nt, Human
acccuuguggucccac

SEQ ID NO: 1518594 - RNA, 17 nt, Human
acccuuguggucccacc

SEQ ID NO: 1518595 - RNA, 19 nt, Human
acccuuguggucccacccc

SEQ ID NO: 1518596 - RNA, 20 nt, Human
acccuuguggucccacccca

SEQ ID NO: 1518597 - RNA, 14 nt, Human
acccugcccugugg

SEQ ID NO: 1518598 - RNA, 13 nt, Human
acccugcccugug

SEQ ID NO: 1518599 - RNA, 11 nt, Human
acccugcccug

SEQ ID NO: 1518600 - RNA, 12 nt, Human
acccugcccugu

SEQ ID NO: 1518601 - RNA, 14 nt, Human
acccucuuagaaaa

SEQ ID NO: 1518602 - RNA, 13 nt, Human
acccagcucuggu

SEQ ID NO: 1518603 - RNA, 15 nt, Human
acccagcucuggucc

SEQ ID NO: 1518604 - RNA, 13 nt, Human
ucagaucuucugu

SEQ ID NO: 1518605 - RNA, 14 nt, Human
ucagaagacacuga

SEQ ID NO: 1518606 - RNA, 13 nt, Human
ucagaagacacug

SEQ ID NO: 1518607 - RNA, 10 nt, Human
ucagccuggg

SEQ ID NO: 1518608 - RNA, 12 nt, Human
ucagccugggca

SEQ ID NO: 1518609 - RNA, 15 nt, Human
acccccuccccgccc

SEQ ID NO: 1518610 - RNA, 13 nt, Human
accccucccuuuc

SEQ ID NO: 1518611 - RNA, 14 nt, Human
accccucccuuucu

SEQ ID NO: 1518612 - RNA, 16 nt, Human
accccucccuuucucc

SEQ ID NO: 1518613 - RNA, 18 nt, Human
accccucccuuucucccc

SEQ ID NO: 1518614 - RNA, 19 nt, Human
accccucccuuucuccccu

SEQ ID NO: 1518615 - RNA, 23 nt, Human
accccucccuuucuccccugccc

SEQ ID NO: 1518616 - RNA, 15 nt, Human
acccccagccugcua

SEQ ID NO: 1518617 - RNA, 19 nt, Human
accacuuguguuuugcaag

SEQ ID NO: 1518618 - RNA, 23 nt, Human
accacuuguguuuugcaagccag

SEQ ID NO: 1518619 - RNA, 12 nt, Human
accacuuuuguu

SEQ ID NO: 1518620 - RNA, 11 nt, Human
accagacaggu

SEQ ID NO: 1518621 - RNA, 22 nt, Human
accagacaccuugacagggcac

SEQ ID NO: 1518622 - RNA, 23 nt, Human
accagacaccuugacagggcaca

SEQ ID NO: 1518623 - RNA, 12 nt, Human
accagagcugcc

SEQ ID NO: 1518624 - RNA, 19 nt, Human
accagagcccaccuuggcu

SEQ ID NO: 1518625 - RNA, 22 nt, Human
accagagcccaccuuggcucaa

SEQ ID NO: 1518626 - RNA, 19 nt, Human
ucaccugaagacucauucu

SEQ ID NO: 1518627 - RNA, 23 nt, Human
ucaccugaagacucauucuucug

SEQ ID NO: 1518628 - RNA, 13 nt, Human
uauuucauuuauu

SEQ ID NO: 1518629 - RNA, 12 nt, Human
uauuucauuucu

SEQ ID NO: 1518630 - RNA, 13 nt, Human
uauuucauuucuu

SEQ ID NO: 1518631 - RNA, 22 nt, Human
accacagacauacuaaccagca

SEQ ID NO: 1518632 - RNA, 21 nt, Human
accacagacauacuaaccagc

SEQ ID NO: 1518633 - RNA, 11 nt, Human
accacagcagu

SEQ ID NO: 1518634 - RNA, 14 nt, Human
accacaucuugcuc

SEQ ID NO: 1518635 - RNA, 15 nt, Human
accacuucagcugac

SEQ ID NO: 1518636 - RNA, 13 nt, Human
accacuucagcug

SEQ ID NO: 1518637 - RNA, 14 nt, Human
accacuucagcuga

SEQ ID NO: 1518638 - RNA, 17 nt, Human
accacugcacuccagcc

SEQ ID NO: 1518639 - RNA, 14 nt, Human
accacugcagaaga

SEQ ID NO: 1518640 - RNA, 19 nt, Human
accacugcagaagacagua

SEQ ID NO: 1518641 - RNA, 20 nt, Human
accacucuaucaaguauuau

SEQ ID NO: 1518642 - RNA, 16 nt, Human
accacaucuugcucug

SEQ ID NO: 1518643 - RNA, 20 nt, Human
accacaucuugcucugcuga

SEQ ID NO: 1518644 - RNA, 21 nt, Human
accacaucuugcucugcugac

SEQ ID NO: 1518645 - RNA, 24 nt, Human
accacaucuugcucugcugacaga

SEQ ID NO: 1518646 - RNA, 16 nt, Human
acccagcccacuucug

SEQ ID NO: 1518647 - RNA, 17 nt, Human
acccagcccacuucugc

SEQ ID NO: 1518648 - RNA, 18 nt, Human
acccagcccacuucugcc

SEQ ID NO: 1518649 - RNA, 16 nt, Human
acccagaagaaaauag

SEQ ID NO: 1518650 - RNA, 21 nt, Human
acccaaauguucaucaaugaa

SEQ ID NO: 1518651 - RNA, 18 nt, Human
acccaaaaggcagaagca

SEQ ID NO: 1518652 - RNA, 23 nt, Human
accauuuugggguacccacugcu

SEQ ID NO: 1518653 - RNA, 13 nt, Human
acccaaaaggcag

SEQ ID NO: 1518654 - RNA, 15 nt, Human
acccaaaaggcagaa

SEQ ID NO: 1518655 - RNA, 23 nt, Human
accaugauuaaccacuucagcug

SEQ ID NO: 1518656 - RNA, 22 nt, Human
accaugauuaaccacuucagcu

SEQ ID NO: 1518657 - RNA, 18 nt, Human
accauucuccaccugcca

SEQ ID NO: 1518658 - RNA, 13 nt, Human
accauucuccacc

SEQ ID NO: 1518659 - RNA, 16 nt, Human
accauucuccaccugc

SEQ ID NO: 1518660 - RNA, 19 nt, Human
ucacuguugcccaggcugg

SEQ ID NO: 1518661 - RNA, 17 nt, Human
ucacuguugcccaggcu

SEQ ID NO: 1518662 - RNA, 18 nt, Human
ucacuguugcccaggcug

SEQ ID NO: 1518663 - RNA, 21 nt, Human
accaguguuguggauuuaaca

SEQ ID NO: 1518664 - RNA, 13 nt, Human
ucacugagacagc

SEQ ID NO: 1518665 - RNA, 14 nt, Human
ucacugagacagcc

SEQ ID NO: 1518666 - RNA, 15 nt, Human
ucacugagacagccc

SEQ ID NO: 1518667 - RNA, 16 nt, Human
ucacugagacagcccg

SEQ ID NO: 1518668 - RNA, 13 nt, Human
ucacugcagccuc

SEQ ID NO: 1518669 - RNA, 12 nt, Human
ucacugcagccu

SEQ ID NO: 1518670 - RNA, 21 nt, Human
uauguuuucaggcuagaugua

SEQ ID NO: 1518671 - RNA, 17 nt, Human
uauguuuuaagaggcag

SEQ ID NO: 1518672 - RNA, 19 nt, Human
uauguuuuaagaggcaggg

SEQ ID NO: 1518673 - RNA, 22 nt, Human
uauuaaaaaucucaaauuucua

SEQ ID NO: 1518674 - RNA, 20 nt, Human
uauuaaaaaucucaaauuuc

SEQ ID NO: 1518675 - RNA, 18 nt, Human
uauuaaaaaucucaaauu

SEQ ID NO: 1518676 - RNA, 16 nt, Human
uauuaaaaaucucaaa

SEQ ID NO: 1518677 - RNA, 23 nt, Human
uauuacaguggggaaugaagaua

SEQ ID NO: 1518678 - RNA, 23 nt, Human
uauuaaaaaucucaaauuucuaa

SEQ ID NO: 1518679 - RNA, 12 nt, Human
uauuaaaacuca

SEQ ID NO: 1518680 - RNA, 16 nt, Human
uauuaaaacucauuuu

SEQ ID NO: 1518681 - RNA, 16 nt, Human
uauuaccacagacaua

SEQ ID NO: 1518682 - RNA, 12 nt, Human
uauuagagaaga

SEQ ID NO: 1518683 - RNA, 23 nt, Human
uauucauagcagcuuauucacaa

SEQ ID NO: 1518684 - RNA, 16 nt, Human
uauucaggagaguaga

SEQ ID NO: 1518685 - RNA, 18 nt, Human
uauucaggaagcucaggg

SEQ ID NO: 1518686 - RNA, 22 nt, Human
uauucaggaagcucagggccug

SEQ ID NO: 1518687 - RNA, 21 nt, Human
acaguuaccucugccucagaa

SEQ ID NO: 1518688 - RNA, 15 nt, Human
acaguuaagagaaau

SEQ ID NO: 1518689 - RNA, 14 nt, Human
acagugagacucug

SEQ ID NO: 1518690 - RNA, 18 nt, Human
acagugagacucugucuc

SEQ ID NO: 1518691 - RNA, 20 nt, Human
acagugaaagaaaauaacaa

SEQ ID NO: 1518692 - RNA, 17 nt, Human
acagucucaggaaauca

SEQ ID NO: 1518693 - RNA, 21 nt, Human
acaguccuuaccagcagagca

SEQ ID NO: 1518694 - RNA, 22 nt, Human
acaguccuuaccagcagagcac

SEQ ID NO: 1518695 - RNA, 13 nt, Human
acagucucaggaa

SEQ ID NO: 1518696 - RNA, 14 nt, Human
acagucucaggaaa

SEQ ID NO: 1518697 - RNA, 15 nt, Human
acagucucaggaaau

SEQ ID NO: 1518698 - RNA, 16 nt, Human
acagucucaggaaauc

SEQ ID NO: 1518699 - RNA, 17 nt, Human
acaguccucccaucuca

SEQ ID NO: 1518700 - RNA, 18 nt, Human
acaguccuuaccagcaga

SEQ ID NO: 1518701 - RNA, 20 nt, Human
acaguccuuaccagcagagc

SEQ ID NO: 1518702 - RNA, 15 nt, Human
acagucccugccaau

SEQ ID NO: 1518703 - RNA, 13 nt, Human
acaguccucccau

SEQ ID NO: 1518704 - RNA, 14 nt, Human
acaguccucccauc

SEQ ID NO: 1518705 - RNA, 15 nt, Human
acaguccucccaucu

SEQ ID NO: 1518706 - RNA, 13 nt, Human
acagucccugcca

SEQ ID NO: 1518707 - RNA, 15 nt, Human
acaguauuacuucug

SEQ ID NO: 1518708 - RNA, 16 nt, Human
acaguauuacuucugc

SEQ ID NO: 1518709 - RNA, 17 nt, Human
acaguauuacuucugcu

SEQ ID NO: 1518710 - RNA, 19 nt, Human
acaguauuacuucugcuac

SEQ ID NO: 1518711 - RNA, 21 nt, Human
acaguauggcagcuuuccuca

SEQ ID NO: 1518712 - RNA, 21 nt, Human
acaggcugggcuucaguggca

SEQ ID NO: 1518713 - RNA, 14 nt, Human
acaggcugggcuuc

SEQ ID NO: 1518714 - RNA, 17 nt, Human
acaggcugggcuucagu

SEQ ID NO: 1518715 - RNA, 22 nt, Human
acagguuuuccugaagaauuga

SEQ ID NO: 1518716 - RNA, 22 nt, Human
acagggcacaccgggcacucag

SEQ ID NO: 1518717 - RNA, 17 nt, Human
uauuguagcauccugga

SEQ ID NO: 1518718 - RNA, 18 nt, Human
uauuguagcauccuggaa

SEQ ID NO: 1518719 - RNA, 20 nt, Human
uauuguagcauccuggaaua

SEQ ID NO: 1518720 - RNA, 21 nt, Human
uauuguagcauccuggaauau

SEQ ID NO: 1518721 - RNA, 13 nt, Human
uauugucaaagug

SEQ ID NO: 1518722 - RNA, 17 nt, Human
uauugucaaagugguga

SEQ ID NO: 1518723 - RNA, 17 nt, Human
uauugucuagugaaacu

SEQ ID NO: 1518724 - RNA, 17 nt, Human
uauuuaaccucuaaauu

SEQ ID NO: 1518725 - RNA, 18 nt, Human
uauuuaaccucuaaauuc

SEQ ID NO: 1518726 - RNA, 14 nt, Human
uauuuaauagguuu

SEQ ID NO: 1518727 - RNA, 15 nt, Human
uauuuaaugaaagac

SEQ ID NO: 1518728 - RNA, 21 nt, Human
uauuuaaugaaagacuguaca

SEQ ID NO: 1518729 - RNA, 14 nt, Human
uauuuauuuuaaua

SEQ ID NO: 1518730 - RNA, 16 nt, Human
uauuuauuuuaauaau

SEQ ID NO: 1518731 - RNA, 18 nt, Human
uauuuauuuuaauaaugu

SEQ ID NO: 1518732 - RNA, 22 nt, Human
uauuucaauuuccaagagcuga

SEQ ID NO: 1518733 - RNA, 13 nt, Human
uauuuauuuaaau

SEQ ID NO: 1518734 - RNA, 14 nt, Human
uauuuauuuaaauu

SEQ ID NO: 1518735 - RNA, 23 nt, Human
uauuuaauuuuuuugagacagag

SEQ ID NO: 1518736 - RNA, 19 nt, Human
uauuuaaugauaaguaaau

SEQ ID NO: 1518737 - RNA, 18 nt, Human
uauuuacuucuuauacau

SEQ ID NO: 1518738 - RNA, 22 nt, Human
acaguucggugagcuacaaaug

SEQ ID NO: 1518739 - RNA, 19 nt, Human
acaguucggugagcuacaa

SEQ ID NO: 1518740 - RNA, 23 nt, Human
acaguucggugagcuacaaaugc

SEQ ID NO: 1518741 - RNA, 16 nt, Human
acaguucucuccuucu

SEQ ID NO: 1518742 - RNA, 20 nt, Human
acaguucaauucucauuugu

SEQ ID NO: 1518743 - RNA, 20 nt, Human
acaguuacucagaauucucu

SEQ ID NO: 1518744 - RNA, 13 nt, Human
acaguuacucaga

SEQ ID NO: 1518745 - RNA, 17 nt, Human
acaguucucuccuucuu

SEQ ID NO: 1518746 - RNA, 24 nt, Human
uauucucuccuguaccucuugagc

SEQ ID NO: 1518747 - RNA, 20 nt, Human
uauucucuccuguaccucuu

SEQ ID NO: 1518748 - RNA, 15 nt, Human
uauucuuauuuaaug

SEQ ID NO: 1518749 - RNA, 16 nt, Human
uauucuguuggccagu

SEQ ID NO: 1518750 - RNA, 17 nt, Human
acagacuggaagcacag

SEQ ID NO: 1518751 - RNA, 14 nt, Human
acagacuggaagca

SEQ ID NO: 1518752 - RNA, 18 nt, Human
acagacccugcccugugg

SEQ ID NO: 1518753 - RNA, 20 nt, Human
acagacccugcccugugggc

SEQ ID NO: 1518754 - RNA, 17 nt, Human
acagacccugcccugug

SEQ ID NO: 1518755 - RNA, 16 nt, Human
acagacccugcccugu

SEQ ID NO: 1518756 - RNA, 11 nt, Human
acacuccuuca

SEQ ID NO: 1518757 - RNA, 13 nt, Human
acacuccuucaca

SEQ ID NO: 1518758 - RNA, 23 nt, Human
acagacacaggcccggcuccagg

SEQ ID NO: 1518759 - RNA, 14 nt, Human
uauauuuacaaaug

SEQ ID NO: 1518760 - RNA, 15 nt, Human
uauauuuacaaaugg

SEQ ID NO: 1518761 - RNA, 21 nt, Human
uaucaaguauuauaccuuuuu

SEQ ID NO: 1518762 - RNA, 18 nt, Human
uaucacccagaagaaaau

SEQ ID NO: 1518763 - RNA, 16 nt, Human
uaucuagauacuguau

SEQ ID NO: 1518764 - RNA, 15 nt, Human
uaucuagauacugua

SEQ ID NO: 1518765 - RNA, 10 nt, Human
uaucagaauu

SEQ ID NO: 1518766 - RNA, 14 nt, Human
uaucuaguaugaaa

SEQ ID NO: 1518767 - RNA, 16 nt, Human
uaucuaguaugaaauu

SEQ ID NO: 1518768 - RNA, 17 nt, Human
uaucuaguaugaaauua

SEQ ID NO: 1518769 - RNA, 19 nt, Human
uaucuagauacuguaucau

SEQ ID NO: 1518770 - RNA, 18 nt, Human
uaucucccccagccccau

SEQ ID NO: 1518771 - RNA, 17 nt, Human
uaucucccccagcccca

SEQ ID NO: 1518772 - RNA, 18 nt, Human
acagagcuacacagggga

SEQ ID NO: 1518773 - RNA, 16 nt, Human
acagagcuacacaggg

SEQ ID NO: 1518774 - RNA, 15 nt, Human
acagcuccaagaauu

SEQ ID NO: 1518775 - RNA, 17 nt, Human
acagcuaacauggaagu

SEQ ID NO: 1518776 - RNA, 14 nt, Human
acagcuaacaugga

SEQ ID NO: 1518777 - RNA, 15 nt, Human
acagcuaacauggaa

SEQ ID NO: 1518778 - RNA, 16 nt, Human
uauggcuuuugugcau

SEQ ID NO: 1518779 - RNA, 17 nt, Human
uauggcuauaggugcua

SEQ ID NO: 1518780 - RNA, 16 nt, Human
uauggcuauaggugcu

SEQ ID NO: 1518781 - RNA, 19 nt, Human
uaugcucugcauguuacau

SEQ ID NO: 1518782 - RNA, 16 nt, Human
uauggccgggcagggu

SEQ ID NO: 1518783 - RNA, 18 nt, Human
uaugaugugggucaagga

SEQ ID NO: 1518784 - RNA, 18 nt, Human
uaugcucugcauguuaca

SEQ ID NO: 1518785 - RNA, 15 nt, Human
uaucuugaagacuuu

SEQ ID NO: 1518786 - RNA, 18 nt, Human
uaugagcuuccuucugug

SEQ ID NO: 1518787 - RNA, 21 nt, Human
uaugagcuuccuucugugaaa

SEQ ID NO: 1518788 - RNA, 13 nt, Human
uaugaggcauuug

SEQ ID NO: 1518789 - RNA, 21 nt, Human
uaugaucacggcucacugcag

SEQ ID NO: 1518790 - RNA, 23 nt, Human
uaugaucacggcucacugcagcc

SEQ ID NO: 1518791 - RNA, 19 nt, Human
acagcccaaagaaggaaaa

SEQ ID NO: 1518792 - RNA, 20 nt, Human
acagaguuuucacucuuauu

SEQ ID NO: 1518793 - RNA, 15 nt, Human
acagaguuguuacau

SEQ ID NO: 1518794 - RNA, 18 nt, Human
acagaguuuucacucuua

SEQ ID NO: 1518795 - RNA, 14 nt, Human
uauaauuuugugaa

SEQ ID NO: 1518796 - RNA, 20 nt, Human
uauaaccaguguuguggauu

SEQ ID NO: 1518797 - RNA, 14 nt, Human
uauacauuugauaa

SEQ ID NO: 1518798 - RNA, 19 nt, Human
uauaauuuugugaagcaaa

SEQ ID NO: 1518799 - RNA, 14 nt, Human
uauacauaaacaag

SEQ ID NO: 1518800 - RNA, 13 nt, Human
uauacauaaacaa

SEQ ID NO: 1518801 - RNA, 21 nt, Human
uauacacuuacacuuuaugca

SEQ ID NO: 1518802 - RNA, 21 nt, Human
uauauauuuuuuucugaaauu

SEQ ID NO: 1518803 - RNA, 22 nt, Human
uauauauuuuuuucugaaauuu

SEQ ID NO: 1518804 - RNA, 20 nt, Human
uauauauuuuuuucugaaau

SEQ ID NO: 1518805 - RNA, 23 nt, Human
uauauauuuuuuucugaaauuuc

SEQ ID NO: 1518806 - RNA, 16 nt, Human
uauauccuuucuaaca

SEQ ID NO: 1518807 - RNA, 21 nt, Human
acacucauugaccugaggccc

SEQ ID NO: 1518808 - RNA, 23 nt, Human
acacucauugaccugaggcccuu

SEQ ID NO: 1518809 - RNA, 17 nt, Human
uauauccuuucuaacaa

SEQ ID NO: 1518810 - RNA, 19 nt, Human
uauagauugaaauuuccua

SEQ ID NO: 1518811 - RNA, 20 nt, Human
uauagccuaggugacagagu

SEQ ID NO: 1518812 - RNA, 13 nt, Human
uauaggaauugac

SEQ ID NO: 1518813 - RNA, 14 nt, Human
uauaggaauugacc

SEQ ID NO: 1518814 - RNA, 19 nt, Human
uauaggaauugacccacaa

SEQ ID NO: 1518815 - RNA, 23 nt, Human
uauaggugcuacaaaaacacagc

SEQ ID NO: 1518816 - RNA, 21 nt, Human
uauaggugcuacaaaaacaca

SEQ ID NO: 1518817 - RNA, 16 nt, Human
uaguuuuauaugcuuc

SEQ ID NO: 1518818 - RNA, 20 nt, Human
uaguuccucauuagcauuuu

SEQ ID NO: 1518819 - RNA, 22 nt, Human
uagugagcagucaggaaagaga

SEQ ID NO: 1518820 - RNA, 22 nt, Human
acaagcucacagaccuuugaac

SEQ ID NO: 1518821 - RNA, 21 nt, Human
uagucaggugccucaagagaa

SEQ ID NO: 1518822 - RNA, 19 nt, Human
acaagcugcacccucaggc

SEQ ID NO: 1518823 - RNA, 21 nt, Human
acaagcugcacccucaggcag

SEQ ID NO: 1518824 - RNA, 22 nt, Human
acaagcugcacccucaggcagg

SEQ ID NO: 1518825 - RNA, 23 nt, Human
acaagcugcacccucaggcaggu

SEQ ID NO: 1518826 - RNA, 19 nt, Human
acacccugugauggggccc

SEQ ID NO: 1518827 - RNA, 11 nt, Human
acacccuguga

SEQ ID NO: 1518828 - RNA, 12 nt, Human
acacccugugau

SEQ ID NO: 1518829 - RNA, 18 nt, Human
acacccugugauggggcc

SEQ ID NO: 1518830 - RNA, 20 nt, Human
acacccagcccacuucugcc

SEQ ID NO: 1518831 - RNA, 21 nt, Human
acacccagcccacuucugcca

SEQ ID NO: 1518832 - RNA, 21 nt, Human
acacaugcaaggucauuuuuu

SEQ ID NO: 1518833 - RNA, 21 nt, Human
uauaaaauaauuuuuauauuu

SEQ ID NO: 1518834 - RNA, 22 nt, Human
uauaaaauaauuuuuauauuug

SEQ ID NO: 1518835 - RNA, 23 nt, Human
uauaaaauaauuuuuauauuuga

SEQ ID NO: 1518836 - RNA, 20 nt, Human
acacaugcaaggucauuuuu

SEQ ID NO: 1518837 - RNA, 19 nt, Human
acacaugcaaggucauuuu

SEQ ID NO: 1518838 - RNA, 14 nt, Human
aauucuuucauuuu

SEQ ID NO: 1518839 - RNA, 15 nt, Human
uacguacacauuuua

SEQ ID NO: 1518840 - RNA, 21 nt, Human
aauugacccacaagaaaugaa

SEQ ID NO: 1518841 - RNA, 16 nt, Human
aauugacccacaagaa

SEQ ID NO: 1518842 - RNA, 19 nt, Human
aauugacccacaagaaaug

SEQ ID NO: 1518843 - RNA, 17 nt, Human
aauucuuacaaacaugu

SEQ ID NO: 1518844 - RNA, 22 nt, Human
aauucuucuccacuuucuagcc

SEQ ID NO: 1518845 - RNA, 15 nt, Human
aauucuugaaggaaa

SEQ ID NO: 1518846 - RNA, 16 nt, Human
aauucuugaaggaaaa

SEQ ID NO: 1518847 - RNA, 21 nt, Human
aauucuugaaggaaaaugaua

SEQ ID NO: 1518848 - RNA, 21 nt, Human
aauucuugccaaauauaaaua

SEQ ID NO: 1518849 - RNA, 20 nt, Human
aauucuugcaaaguaucccu

SEQ ID NO: 1518850 - RNA, 14 nt, Human
aauucuugcaaagu

SEQ ID NO: 1518851 - RNA, 20 nt, Human
uacucuuauaucuauauuuu

SEQ ID NO: 1518852 - RNA, 22 nt, Human
uacucuuauaucuauauuuuac

SEQ ID NO: 1518853 - RNA, 16 nt, Human
uacuauaauuuaccug

SEQ ID NO: 1518854 - RNA, 16 nt, Human
uacuauguaucaauga

SEQ ID NO: 1518855 - RNA, 14 nt, Human
uacguugugcauuu

SEQ ID NO: 1518856 - RNA, 13 nt, Human
uacguugugcauu

SEQ ID NO: 1518857 - RNA, 13 nt, Human
uacguaugagacg

SEQ ID NO: 1518858 - RNA, 14 nt, Human
uacgucugacaggc

SEQ ID NO: 1518859 - RNA, 17 nt, Human
aauuugagauacaaaca

SEQ ID NO: 1518860 - RNA, 14 nt, Human
uacuucaaauccuu

SEQ ID NO: 1518861 - RNA, 19 nt, Human
uacuucaaauccuugaaga

SEQ ID NO: 1518862 - RNA, 19 nt, Human
aauuugauaugugaacagu

SEQ ID NO: 1518863 - RNA, 15 nt, Human
aauuugauaugugaa

SEQ ID NO: 1518864 - RNA, 21 nt, Human
aauuugauaguauugugcaua

SEQ ID NO: 1518865 - RNA, 16 nt, Human
aauuugauaugugaac

SEQ ID NO: 1518866 - RNA, 18 nt, Human
aauuugauaugugaacag

SEQ ID NO: 1518867 - RNA, 20 nt, Human
aauuucucccagucauuuaa

SEQ ID NO: 1518868 - RNA, 21 nt, Human
aauuucuaaaucuccaaaaua

SEQ ID NO: 1518869 - RNA, 13 nt, Human
aauuucuaaaucu

SEQ ID NO: 1518870 - RNA, 17 nt, Human
aauuuaucaguaccuaa

SEQ ID NO: 1518871 - RNA, 17 nt, Human
aauuuagaaauauaauu

SEQ ID NO: 1518872 - RNA, 15 nt, Human
aauuuaccugaaguc

SEQ ID NO: 1518873 - RNA, 15 nt, Human
aauuuaaauagcuuu

SEQ ID NO: 1518874 - RNA, 16 nt, Human
aauuuaaauagcuuuu

SEQ ID NO: 1518875 - RNA, 19 nt, Human
aauuuacccucuugaauau

SEQ ID NO: 1518876 - RNA, 22 nt, Human
aauuuacccucuugaauauaau

SEQ ID NO: 1518877 - RNA, 19 nt, Human
aauuuacauacucugcuua

SEQ ID NO: 1518878 - RNA, 12 nt, Human
aauuuaaagcaa

SEQ ID NO: 1518879 - RNA, 13 nt, Human
aauuuaaaagucu

SEQ ID NO: 1518880 - RNA, 23 nt, Human
aauugugugaaagguacuucaaa

SEQ ID NO: 1518881 - RNA, 13 nt, Human
uacuguaagaaaa

SEQ ID NO: 1518882 - RNA, 22 nt, Human
aauuguuuggggaugagaaagg

SEQ ID NO: 1518883 - RNA, 21 nt, Human
uacuucaaauccuugaagauu

SEQ ID NO: 1518884 - RNA, 16 nt, Human
uacuucaugcugucua

SEQ ID NO: 1518885 - RNA, 15 nt, Human
uagaacucccuuuca

SEQ ID NO: 1518886 - RNA, 23 nt, Human
uagaagucacauuccugaacagg

SEQ ID NO: 1518887 - RNA, 16 nt, Human
uagaagucacacagua

SEQ ID NO: 1518888 - RNA, 16 nt, Human
uagaagucuuagaugu

SEQ ID NO: 1518889 - RNA, 17 nt, Human
uagaagucuuagaugua

SEQ ID NO: 1518890 - RNA, 20 nt, Human
uagaagucuuagauguauau

SEQ ID NO: 1518891 - RNA, 18 nt, Human
uagaagucuuagauguau

SEQ ID NO: 1518892 - RNA, 19 nt, Human
uagaagucuuagauguaua

SEQ ID NO: 1518893 - RNA, 19 nt, Human
uagaauuugauaugugaac

SEQ ID NO: 1518894 - RNA, 16 nt, Human
uagacaauuuauuaug

SEQ ID NO: 1518895 - RNA, 19 nt, Human
aauuuuuauauuugaaaua

SEQ ID NO: 1518896 - RNA, 17 nt, Human
aauuuuuauuaaauuau

SEQ ID NO: 1518897 - RNA, 18 nt, Human
aauuuuuauuaaauuaug

SEQ ID NO: 1518898 - RNA, 12 nt, Human
uagacagucccu

SEQ ID NO: 1518899 - RNA, 14 nt, Human
uagacagucccugc

SEQ ID NO: 1518900 - RNA, 16 nt, Human
uagacagucccugcca

SEQ ID NO: 1518901 - RNA, 19 nt, Human
aauuuuuucucuaggaaau

SEQ ID NO: 1518902 - RNA, 13 nt, Human
acaaaaaaauaua

SEQ ID NO: 1518903 - RNA, 17 nt, Human
acaaaaaaauauauuua

SEQ ID NO: 1518904 - RNA, 17 nt, Human
aauuuuuuugagacaga

SEQ ID NO: 1518905 - RNA, 13 nt, Human
acaaaaacauggc

SEQ ID NO: 1518906 - RNA, 20 nt, Human
acaaaaaaauauauuuaaug

SEQ ID NO: 1518907 - RNA, 19 nt, Human
uagcauuuguguugaagag

SEQ ID NO: 1518908 - RNA, 15 nt, Human
acaacaacaaaauga

SEQ ID NO: 1518909 - RNA, 12 nt, Human
acaacacucaca

SEQ ID NO: 1518910 - RNA, 18 nt, Human
acaagcacuaaacaaaga

SEQ ID NO: 1518911 - RNA, 17 nt, Human
acaagagcccaggccuc

SEQ ID NO: 1518912 - RNA, 18 nt, Human
acaagagcccaggccucc

SEQ ID NO: 1518913 - RNA, 12 nt, Human
acaagccacccc

SEQ ID NO: 1518914 - RNA, 13 nt, Human
acaagcugcaccc

SEQ ID NO: 1518915 - RNA, 20 nt, Human
acaagcgugagccacugcac

SEQ ID NO: 1518916 - RNA, 21 nt, Human
acaagcgugagccacugcacc

SEQ ID NO: 1518917 - RNA, 21 nt, Human
uagcaugucgucaaagcugaa

SEQ ID NO: 1518918 - RNA, 22 nt, Human
uagauuuuagacccuauugcug

SEQ ID NO: 1518919 - RNA, 17 nt, Human
uagcacagacccugccc

SEQ ID NO: 1518920 - RNA, 18 nt, Human
uagcacagacccugcccu

SEQ ID NO: 1518921 - RNA, 19 nt, Human
uagcacagacccugcccug

SEQ ID NO: 1518922 - RNA, 17 nt, Human
uagaugcaguucugaag

SEQ ID NO: 1518923 - RNA, 19 nt, Human
uagaugcaguucugaagaa

SEQ ID NO: 1518924 - RNA, 16 nt, Human
uagaugcaguucugaa

SEQ ID NO: 1518925 - RNA, 19 nt, Human
uagaggagaaacuggaacu

SEQ ID NO: 1518926 - RNA, 16 nt, Human
acaaaaagcauaaaaa

SEQ ID NO: 1518927 - RNA, 16 nt, Human
uaccaugccauuuaaa

SEQ ID NO: 1518928 - RNA, 17 nt, Human
uaccauccccuguagag

SEQ ID NO: 1518929 - RNA, 17 nt, Human
uaccacuuuuguucuug

SEQ ID NO: 1518930 - RNA, 14 nt, Human
uacccgcagaguuc

SEQ ID NO: 1518931 - RNA, 20 nt, Human
uacccgggaagggggcuggg

SEQ ID NO: 1518932 - RNA, 16 nt, Human
uacccucauguucuua

SEQ ID NO: 1518933 - RNA, 20 nt, Human
uacccuggcacuauaaugua

SEQ ID NO: 1518934 - RNA, 22 nt, Human
uacccuggcacuauaauguaag

SEQ ID NO: 1518935 - RNA, 18 nt, Human
aauguugacaugggacau

SEQ ID NO: 1518936 - RNA, 15 nt, Human
aaugucacaggcagg

SEQ ID NO: 1518937 - RNA, 17 nt, Human
aauuaaauuuugugucu

SEQ ID NO: 1518938 - RNA, 18 nt, Human
aauuaaauuuugugucuc

SEQ ID NO: 1518939 - RNA, 12 nt, Human
aauuaacacugc

SEQ ID NO: 1518940 - RNA, 22 nt, Human
aauuaacuuuuauaaacuuuac

SEQ ID NO: 1518941 - RNA, 20 nt, Human
aauuaacuuuuauaaacuuu

SEQ ID NO: 1518942 - RNA, 18 nt, Human
aauuaacuuuuauaaacu

SEQ ID NO: 1518943 - RNA, 23 nt, Human
uacauuguacgaagaguauuuuu

SEQ ID NO: 1518944 - RNA, 20 nt, Human
uacauuguacgaagaguauu

SEQ ID NO: 1518945 - RNA, 22 nt, Human
uacauuguacgaagaguauuuu

SEQ ID NO: 1518946 - RNA, 23 nt, Human
uacauggcuggagcuagaauuug

SEQ ID NO: 1518947 - RNA, 13 nt, Human
aauuaaguacuau

SEQ ID NO: 1518948 - RNA, 20 nt, Human
uacaguggggaaugaagaua

SEQ ID NO: 1518949 - RNA, 16 nt, Human
uacauaaguaauucaa

SEQ ID NO: 1518950 - RNA, 17 nt, Human
uacauaaguaauucaag

SEQ ID NO: 1518951 - RNA, 15 nt, Human
uacauaaugcgugca

SEQ ID NO: 1518952 - RNA, 19 nt, Human
uacauaaguaauucaagaa

SEQ ID NO: 1518953 - RNA, 18 nt, Human
uacaguaucucagggccu

SEQ ID NO: 1518954 - RNA, 12 nt, Human
uacaguccuccc

SEQ ID NO: 1518955 - RNA, 15 nt, Human
uacaguccucccauc

SEQ ID NO: 1518956 - RNA, 17 nt, Human
uacaguccucccaucuc

SEQ ID NO: 1518957 - RNA, 18 nt, Human
uacaguccucccaucuca

SEQ ID NO: 1518958 - RNA, 22 nt, Human
aaugugaaacuggauuaaacuu

SEQ ID NO: 1518959 - RNA, 14 nt, Human
aaugucacaggcag

SEQ ID NO: 1518960 - RNA, 13 nt, Human
aaugucacaggca

SEQ ID NO: 1518961 - RNA, 13 nt, Human
aauguaagcucua

SEQ ID NO: 1518962 - RNA, 15 nt, Human
aauguaagcucuacu

SEQ ID NO: 1518963 - RNA, 17 nt, Human
aaugguuuucuugugug

SEQ ID NO: 1518964 - RNA, 18 nt, Human
aaugguuuucuugugugu

SEQ ID NO: 1518965 - RNA, 22 nt, Human
aaugguuuucuuguguguuuau

SEQ ID NO: 1518966 - RNA, 17 nt, Human
aaugguuugaauauaaa

SEQ ID NO: 1518967 - RNA, 23 nt, Human
aaugguuugaauauaaacacuau

SEQ ID NO: 1518968 - RNA, 17 nt, Human
aaugguuugcaaggaag

SEQ ID NO: 1518969 - RNA, 14 nt, Human
aaugguuugaauau

SEQ ID NO: 1518970 - RNA, 16 nt, Human
aaugguuuaaaugguc

SEQ ID NO: 1518971 - RNA, 23 nt, Human
aauguacagcaaggagauuuaca

SEQ ID NO: 1518972 - RNA, 21 nt, Human
aauguacagcaaggagauuua

SEQ ID NO: 1518973 - RNA, 22 nt, Human
uacagcaaggagauuuacaacu

SEQ ID NO: 1518974 - RNA, 17 nt, Human
uaauuuaccugaagucu

SEQ ID NO: 1518975 - RNA, 18 nt, Human
uaauuuaccugaagucuu

SEQ ID NO: 1518976 - RNA, 22 nt, Human
uaauuugauaguauugugcaua

SEQ ID NO: 1518977 - RNA, 15 nt, Human
uacaaaaagcauaaa

SEQ ID NO: 1518978 - RNA, 16 nt, Human
uacaaaaacauggccu

SEQ ID NO: 1518979 - RNA, 17 nt, Human
uacaaaaacacagcaag

SEQ ID NO: 1518980 - RNA, 18 nt, Human
uacaaaaacacagcaagg

SEQ ID NO: 1518981 - RNA, 21 nt, Human
uacaagcgugagccacugcac

SEQ ID NO: 1518982 - RNA, 16 nt, Human
uacaagcgugagccac

SEQ ID NO: 1518983 - RNA, 18 nt, Human
uacaagcgugagccacug

SEQ ID NO: 1518984 - RNA, 19 nt, Human
uacaagcgugagccacugc

SEQ ID NO: 1518985 - RNA, 20 nt, Human
uacaagcgugagccacugca

SEQ ID NO: 1518986 - RNA, 23 nt, Human
uaauuaguuccucauuagcauuu

SEQ ID NO: 1518987 - RNA, 19 nt, Human
aaugcacuuuguucuggcu

SEQ ID NO: 1518988 - RNA, 20 nt, Human
aaugcacuuuguucuggcuc

SEQ ID NO: 1518989 - RNA, 19 nt, Human
aaugcacaaacagaggccg

SEQ ID NO: 1518990 - RNA, 20 nt, Human
aaugcacaaacagaggccgc

SEQ ID NO: 1518991 - RNA, 13 nt, Human
aaugcacuuuguu

SEQ ID NO: 1518992 - RNA, 16 nt, Human
aaugcacuuuguucug

SEQ ID NO: 1518993 - RNA, 22 nt, Human
aaugcaaaccaucauugaaauc

SEQ ID NO: 1518994 - RNA, 23 nt, Human
aaugcaaaccaucauugaaaucu

SEQ ID NO: 1518995 - RNA, 15 nt, Human
aaugcaacaacaugu

SEQ ID NO: 1518996 - RNA, 18 nt, Human
aaugcaacaacauguaua

SEQ ID NO: 1518997 - RNA, 18 nt, Human
aaugcacaaacagaggcc

SEQ ID NO: 1518998 - RNA, 20 nt, Human
aaugaaugucagugugacug

SEQ ID NO: 1518999 - RNA, 21 nt, Human
aaugaaugucagugugacuga

SEQ ID NO: 1519000 - RNA, 13 nt, Human
aaugaccuuucaa

SEQ ID NO: 1519001 - RNA, 14 nt, Human
aaugaccuuucaau

SEQ ID NO: 1519002 - RNA, 15 nt, Human
aaugaccuuucaaua

SEQ ID NO: 1519003 - RNA, 16 nt, Human
aaugcaaaccaucauu

SEQ ID NO: 1519004 - RNA, 16 nt, Human
uaauguaagcucuacu

SEQ ID NO: 1519005 - RNA, 17 nt, Human
uaauguaagcucuacug

SEQ ID NO: 1519006 - RNA, 23 nt, Human
uaaugugaaacuggauuaaacuu

SEQ ID NO: 1519007 - RNA, 22 nt, Human
uaaugugaaacuggauuaaacu

SEQ ID NO: 1519008 - RNA, 20 nt, Human
uaaugugaaacuggauuaaa

SEQ ID NO: 1519009 - RNA, 12 nt, Human
uaaugugaaacu

SEQ ID NO: 1519010 - RNA, 18 nt, Human
uaauguaauaacugugaa

SEQ ID NO: 1519011 - RNA, 17 nt, Human
uaauguaauaacuguga

SEQ ID NO: 1519012 - RNA, 15 nt, Human
uaaugucacaggcag

SEQ ID NO: 1519013 - RNA, 16 nt, Human
uaaugucacaggcagg

SEQ ID NO: 1519014 - RNA, 17 nt, Human
uaaugucacaggcaggu

SEQ ID NO: 1519015 - RNA, 23 nt, Human
aaucuucugaacuuggcgcugcc

SEQ ID NO: 1519016 - RNA, 15 nt, Human
aaugaaugaaugaau

SEQ ID NO: 1519017 - RNA, 14 nt, Human
aaugaaugaaacau

SEQ ID NO: 1519018 - RNA, 15 nt, Human
aaugaaugucagugu

SEQ ID NO: 1519019 - RNA, 23 nt, Human
uaaucagugugucuaaauuugaa

SEQ ID NO: 1519020 - RNA, 13 nt, Human
uaaucuuucacag

SEQ ID NO: 1519021 - RNA, 17 nt, Human
uaaucagugugucuaaa

SEQ ID NO: 1519022 - RNA, 18 nt, Human
uaaucagugugucuaaau

SEQ ID NO: 1519023 - RNA, 21 nt, Human
uaauauugauaugcuuauaca

SEQ ID NO: 1519024 - RNA, 14 nt, Human
uaauagacaauuua

SEQ ID NO: 1519025 - RNA, 19 nt, Human
uaacaaugcuguauuuuaa

SEQ ID NO: 1519026 - RNA, 20 nt, Human
aauacaguaucucagggccu

SEQ ID NO: 1519027 - RNA, 23 nt, Human
uaauacaccacuacauucuguua

SEQ ID NO: 1519028 - RNA, 22 nt, Human
uaauacaccacuacauucuguu

SEQ ID NO: 1519029 - RNA, 22 nt, Human
guuccccuccuccacucucccc

SEQ ID NO: 1519030 - RNA, 19 nt, Human
aaggaaaaaauaacaauga

SEQ ID NO: 1519031 - RNA, 16 nt, Human
aaggaaaaaauaacaa

SEQ ID NO: 1519032 - RNA, 17 nt, Human
aagcucugcuccucucc

SEQ ID NO: 1519033 - RNA, 13 nt, Human
aagcucugcuccu

SEQ ID NO: 1519034 - RNA, 18 nt, Human
aagcuguuacugucuuca

SEQ ID NO: 1519035 - RNA, 13 nt, Human
guguuuauuguca

SEQ ID NO: 1519036 - RNA, 13 nt, Human
guguuuauuuaua

SEQ ID NO: 1519037 - RNA, 11 nt, Human
aagcucccagg

SEQ ID NO: 1519038 - RNA, 23 nt, Human
aagcucccaggcauuccccagga

SEQ ID NO: 1519039 - RNA, 12 nt, Human
aagcucccaggc

SEQ ID NO: 1519040 - RNA, 22 nt, Human
aagcucccaggcauuccccagg

SEQ ID NO: 1519041 - RNA, 13 nt, Human
guugaauuuuaca

SEQ ID NO: 1519042 - RNA, 13 nt, Human
guugacaugggac

SEQ ID NO: 1519043 - RNA, 23 nt, Human
guugauagcacagacccugcccu

SEQ ID NO: 1519044 - RNA, 16 nt, Human
guucucugaggacacu

SEQ ID NO: 1519045 - RNA, 11 nt, Human
guucucugccc

SEQ ID NO: 1519046 - RNA, 13 nt, Human
guucucugcccuc

SEQ ID NO: 1519047 - RNA, 12 nt, Human
guucucugcccu

SEQ ID NO: 1519048 - RNA, 11 nt, Human
guucucaucuu

SEQ ID NO: 1519049 - RNA, 16 nt, Human
guucucaucuuucuug

SEQ ID NO: 1519050 - RNA, 15 nt, Human
aaggcuaccuuugua

SEQ ID NO: 1519051 - RNA, 13 nt, Human
aaggcuaccuuug

SEQ ID NO: 1519052 - RNA, 19 nt, Human
aaggccccgcccaggcuua

SEQ ID NO: 1519053 - RNA, 14 nt, Human
aaggccccgcccag

SEQ ID NO: 1519054 - RNA, 16 nt, Human
aaggccccgcccaggc

SEQ ID NO: 1519055 - RNA, 24 nt, Human
aaggaugcacagaguuguuacauu

SEQ ID NO: 1519056 - RNA, 14 nt, Human
aaggaugcccaaag

SEQ ID NO: 1519057 - RNA, 19 nt, Human
aaggaugcccaaagaugca

SEQ ID NO: 1519058 - RNA, 17 nt, Human
guugggcuggugucacc

SEQ ID NO: 1519059 - RNA, 14 nt, Human
guugggucaccaga

SEQ ID NO: 1519060 - RNA, 13 nt, Human
guuggguggaugc

SEQ ID NO: 1519061 - RNA, 21 nt, Human
guugggucaccagacggggcu

SEQ ID NO: 1519062 - RNA, 15 nt, Human
guugcccaggcuggc

SEQ ID NO: 1519063 - RNA, 16 nt, Human
guugcccaggcuggcg

SEQ ID NO: 1519064 - RNA, 17 nt, Human
guugcccaggcuggcgu

SEQ ID NO: 1519065 - RNA, 18 nt, Human
aaggagauuuacaacugg

SEQ ID NO: 1519066 - RNA, 16 nt, Human
aaggaaacccagcucu

SEQ ID NO: 1519067 - RNA, 15 nt, Human
aaggaaacccagcuc

SEQ ID NO: 1519068 - RNA, 14 nt, Human
aaggaaaaugauac

SEQ ID NO: 1519069 - RNA, 13 nt, Human
aaggauaaugaau

SEQ ID NO: 1519070 - RNA, 12 nt, Human
aaggagcaucua

SEQ ID NO: 1519071 - RNA, 20 nt, Human
aaggaggaagagaaaaaaua

SEQ ID NO: 1519072 - RNA, 11 nt, Human
aaggauccuga

SEQ ID NO: 1519073 - RNA, 12 nt, Human
aaggauccugag

SEQ ID NO: 1519074 - RNA, 14 nt, Human
aaggaucuucaucu

SEQ ID NO: 1519075 - RNA, 13 nt, Human
aaggauccugagc

SEQ ID NO: 1519076 - RNA, 22 nt, Human
aaggauccugagccagauuuca

SEQ ID NO: 1519077 - RNA, 20 nt, Human
aagucacauuccugaacagg

SEQ ID NO: 1519078 - RNA, 13 nt, Human
aagucacacagug

SEQ ID NO: 1519079 - RNA, 24 nt, Human
aagucacacaguauuacuucugcu

SEQ ID NO: 1519080 - RNA, 21 nt, Human
aagucaagugaaaaaggagga

SEQ ID NO: 1519081 - RNA, 18 nt, Human
aaguauucuuauuuaaug

SEQ ID NO: 1519082 - RNA, 19 nt, Human
aaguauucuuauuuaauga

SEQ ID NO: 1519083 - RNA, 23 nt, Human
aaguauguuagugcaaauuguca

SEQ ID NO: 1519084 - RNA, 22 nt, Human
aaguacuucuccacccugcucu

SEQ ID NO: 1519085 - RNA, 23 nt, Human
aaguacuucuccacccugcucuc

SEQ ID NO: 1519086 - RNA, 15 nt, Human
aaguauucuaaauuu

SEQ ID NO: 1519087 - RNA, 13 nt, Human
aaguauucuaaau

SEQ ID NO: 1519088 - RNA, 16 nt, Human
aaguacuauguaucaa

SEQ ID NO: 1519089 - RNA, 15 nt, Human
aaguacuggagaaaa

SEQ ID NO: 1519090 - RNA, 21 nt, Human
aaguacuucuccacccugcuc

SEQ ID NO: 1519091 - RNA, 16 nt, Human
guuuucugagaaagac

SEQ ID NO: 1519092 - RNA, 17 nt, Human
guuuucugagaaagacu

SEQ ID NO: 1519093 - RNA, 22 nt, Human
guuuucugagaaagacuauuca

SEQ ID NO: 1519094 - RNA, 23 nt, Human
guuuuuuuuuaaaaaagaaacau

SEQ ID NO: 1519095 - RNA, 16 nt, Human
guuuuugucuuaaaaa

SEQ ID NO: 1519096 - RNA, 24 nt, Human
guuuuuggaugguguuacauauua

SEQ ID NO: 1519097 - RNA, 18 nt, Human
guuuuucuaggccugggg

SEQ ID NO: 1519098 - RNA, 22 nt, Human
aagucuuauauauuguagauaa

SEQ ID NO: 1519099 - RNA, 18 nt, Human
aagucuuagauguauaua

SEQ ID NO: 1519100 - RNA, 19 nt, Human
aagucuuagauguauauau

SEQ ID NO: 1519101 - RNA, 15 nt, Human
guuuuauaauuuugu

SEQ ID NO: 1519102 - RNA, 22 nt, Human
guuuuauaauuuugugaagcaa

SEQ ID NO: 1519103 - RNA, 16 nt, Human
guuuuacugcagcuuu

SEQ ID NO: 1519104 - RNA, 18 nt, Human
guuuuacugcagcuuugu

SEQ ID NO: 1519105 - RNA, 14 nt, Human
guuuuaagaggcag

SEQ ID NO: 1519106 - RNA, 18 nt, Human
guuuuaaggaugcuugua

SEQ ID NO: 1519107 - RNA, 16 nt, Human
guuuuaagaggcaggg

SEQ ID NO: 1519108 - RNA, 17 nt, Human
guuugccucugccucug

SEQ ID NO: 1519109 - RNA, 13 nt, Human
guuugcuaaguga

SEQ ID NO: 1519110 - RNA, 22 nt, Human
guuucugccgcagcccugcaga

SEQ ID NO: 1519111 - RNA, 22 nt, Human
guuucuaugacacaugcaaggu

SEQ ID NO: 1519112 - RNA, 15 nt, Human
aagggcccagagagg

SEQ ID NO: 1519113 - RNA, 13 nt, Human
aagggcccagaga

SEQ ID NO: 1519114 - RNA, 17 nt, Human
aaggggcaguggugguu

SEQ ID NO: 1519115 - RNA, 14 nt, Human
aaggggcaguggug

SEQ ID NO: 1519116 - RNA, 19 nt, Human
aaggguaucaggugcugcc

SEQ ID NO: 1519117 - RNA, 16 nt, Human
aaggguaucuggugac

SEQ ID NO: 1519118 - RNA, 14 nt, Human
aaggcugggggaag

SEQ ID NO: 1519119 - RNA, 13 nt, Human
aagggccuggccu

SEQ ID NO: 1519120 - RNA, 14 nt, Human
aaguaaaaccacag

SEQ ID NO: 1519121 - RNA, 15 nt, Human
aaguaaaaccacagc

SEQ ID NO: 1519122 - RNA, 16 nt, Human
aaguaaaaccacagca

SEQ ID NO: 1519123 - RNA, 21 nt, Human
aagggugaugggaaagcauug

SEQ ID NO: 1519124 - RNA, 17 nt, Human
aaguaaaaccacagcag

SEQ ID NO: 1519125 - RNA, 18 nt, Human
aaguaaaaccacagcagu

SEQ ID NO: 1519126 - RNA, 12 nt, Human
aaguaaaugcua

SEQ ID NO: 1519127 - RNA, 15 nt, Human
aauaacaauaaaaga

SEQ ID NO: 1519128 - RNA, 12 nt, Human
aauaacauguaa

SEQ ID NO: 1519129 - RNA, 19 nt, Human
aauaacauguaauuaagua

SEQ ID NO: 1519130 - RNA, 22 nt, Human
aauaacauguaauuaaguacua

SEQ ID NO: 1519131 - RNA, 12 nt, Human
aauaaauuauuu

SEQ ID NO: 1519132 - RNA, 12 nt, Human
aauaaaugugcc

SEQ ID NO: 1519133 - RNA, 21 nt, Human
aauaaaugugccuucauuuuu

SEQ ID NO: 1519134 - RNA, 15 nt, Human
aauaacuaaaaggua

SEQ ID NO: 1519135 - RNA, 13 nt, Human
uaaagucaggggu

SEQ ID NO: 1519136 - RNA, 20 nt, Human
uaaaguguauuuuuuuacua

SEQ ID NO: 1519137 - RNA, 19 nt, Human
uaaaguguauuuuuuuacu

SEQ ID NO: 1519138 - RNA, 15 nt, Human
uaaaguguauuuuuu

SEQ ID NO: 1519139 - RNA, 14 nt, Human
uaaaguguauuuuu

SEQ ID NO: 1519140 - RNA, 12 nt, Human
aauaaaaauaau

SEQ ID NO: 1519141 - RNA, 22 nt, Human
aauaaaaauauuguguugugaa

SEQ ID NO: 1519142 - RNA, 22 nt, Human
aauaaaauccauacauuugugu

SEQ ID NO: 1519143 - RNA, 14 nt, Human
aauaaaguaauuau

SEQ ID NO: 1519144 - RNA, 12 nt, Human
uaaauagcuuuu

SEQ ID NO: 1519145 - RNA, 18 nt, Human
uaaauaguauuugagagu

SEQ ID NO: 1519146 - RNA, 19 nt, Human
uaaaucuccaaaauaaaac

SEQ ID NO: 1519147 - RNA, 15 nt, Human
aauacaccacuacau

SEQ ID NO: 1519148 - RNA, 14 nt, Human
aauacacacucaaa

SEQ ID NO: 1519149 - RNA, 21 nt, Human
aauacaccacuacauucuguu

SEQ ID NO: 1519150 - RNA, 20 nt, Human
aauacaccacuacauucugu

SEQ ID NO: 1519151 - RNA, 18 nt, Human
aauacaccacuacauucu

SEQ ID NO: 1519152 - RNA, 16 nt, Human
aauacaccacuacauu

SEQ ID NO: 1519153 - RNA, 21 nt, Human
uaaaucuccaaaauaaaacuu

SEQ ID NO: 1519154 - RNA, 20 nt, Human
uaaaucuccaaaauaaaacu

SEQ ID NO: 1519155 - RNA, 22 nt, Human
uaaaucuccaaaauaaaacuuu

SEQ ID NO: 1519156 - RNA, 17 nt, Human
uaaaugauuucauucaa

SEQ ID NO: 1519157 - RNA, 15 nt, Human
uaacaaugcuguauu

SEQ ID NO: 1519158 - RNA, 17 nt, Human
uaacaaugcuguauuuu

SEQ ID NO: 1519159 - RNA, 13 nt, Human
uaacaagccaccc

SEQ ID NO: 1519160 - RNA, 14 nt, Human
uaaauuuuauaucu

SEQ ID NO: 1519161 - RNA, 16 nt, Human
uaaauuuugaguucua

SEQ ID NO: 1519162 - RNA, 17 nt, Human
uaaauuuugaguucuac

SEQ ID NO: 1519163 - RNA, 20 nt, Human
uaacaaaaaaauauauuuaa

SEQ ID NO: 1519164 - RNA, 23 nt, Human
uaacaaaaaaauauauuuaauga

SEQ ID NO: 1519165 - RNA, 13 nt, Human
uaaacgucuuaaa

SEQ ID NO: 1519166 - RNA, 17 nt, Human
uaaacgucuuaaauauu

SEQ ID NO: 1519167 - RNA, 18 nt, Human
uaaaccucaaaaugucua

SEQ ID NO: 1519168 - RNA, 19 nt, Human
uaaaccucaaaaugucuaa

SEQ ID NO: 1519169 - RNA, 16 nt, Human
uaaaccgccaaggcug

SEQ ID NO: 1519170 - RNA, 18 nt, Human
uaaaccgccaaggcuggg

SEQ ID NO: 1519171 - RNA, 19 nt, Human
uaaaggcuaccuuuguauu

SEQ ID NO: 1519172 - RNA, 21 nt, Human
uaaaggcuaccuuuguauucu

SEQ ID NO: 1519173 - RNA, 19 nt, Human
aaguuauugauaaguucau

SEQ ID NO: 1519174 - RNA, 20 nt, Human
aaguuauugauaaguucaua

SEQ ID NO: 1519175 - RNA, 19 nt, Human
aaguuagaacauuugcugu

SEQ ID NO: 1519176 - RNA, 14 nt, Human
aaguuaaauuuuau

SEQ ID NO: 1519177 - RNA, 12 nt, Human
aaguuaaauaaa

SEQ ID NO: 1519178 - RNA, 14 nt, Human
aaguuaaauaaauc

SEQ ID NO: 1519179 - RNA, 14 nt, Human
aaguuuaccaucug

SEQ ID NO: 1519180 - RNA, 19 nt, Human
aaguuuacauuguaaauag

SEQ ID NO: 1519181 - RNA, 18 nt, Human
aaguuuacauuguaaaua

SEQ ID NO: 1519182 - RNA, 17 nt, Human
aaguucugcagauaaac

SEQ ID NO: 1519183 - RNA, 22 nt, Human
aaguuauugauaaguucauaca

SEQ ID NO: 1519184 - RNA, 23 nt, Human
aaguuauugauaaguucauacau

SEQ ID NO: 1519185 - RNA, 15 nt, Human
aaguucauacauugu

SEQ ID NO: 1519186 - RNA, 12 nt, Human
aaguucauacau

SEQ ID NO: 1519187 - RNA, 13 nt, Human
aaguucauacauu

SEQ ID NO: 1519188 - RNA, 16 nt, Human
aagcaaguauuagaau

SEQ ID NO: 1519189 - RNA, 20 nt, Human
gugucccaaaaagaaaggag

SEQ ID NO: 1519190 - RNA, 21 nt, Human
gugucuugcaauggcagccuu

SEQ ID NO: 1519191 - RNA, 17 nt, Human
gugugaggguccugcag

SEQ ID NO: 1519192 - RNA, 20 nt, Human
gugugagucaccaagcccag

SEQ ID NO: 1519193 - RNA, 15 nt, Human
gugugguguuuccug

SEQ ID NO: 1519194 - RNA, 13 nt, Human
gugugagucacca

SEQ ID NO: 1519195 - RNA, 18 nt, Human
gugugagucaccaagccc

SEQ ID NO: 1519196 - RNA, 19 nt, Human
gugugguguuuccuggcac

SEQ ID NO: 1519197 - RNA, 19 nt, Human
aagcaaaauuuuuucucua

SEQ ID NO: 1519198 - RNA, 21 nt, Human
aagauguagcgcuuugaauau

SEQ ID NO: 1519199 - RNA, 22 nt, Human
aagauguagaggagaaacugga

SEQ ID NO: 1519200 - RNA, 22 nt, Human
aagauauuuugcuuugugauuu

SEQ ID NO: 1519201 - RNA, 20 nt, Human
aagaguaggaagacuuugga

SEQ ID NO: 1519202 - RNA, 20 nt, Human
aagauauuuugcuuugugau

SEQ ID NO: 1519203 - RNA, 17 nt, Human
aagauauuuugcuuugu

SEQ ID NO: 1519204 - RNA, 16 nt, Human
aagaguaggaagacuu

SEQ ID NO: 1519205 - RNA, 18 nt, Human
aagaguaggaagacuuug

SEQ ID NO: 1519206 - RNA, 19 nt, Human
aagaguaggaagacuuugg

SEQ ID NO: 1519207 - RNA, 15 nt, Human
aagauauuuugcuuu

SEQ ID NO: 1519208 - RNA, 19 nt, Human
gugguguuuccuggcacug

SEQ ID NO: 1519209 - RNA, 18 nt, Human
gugguuauggagagggug

SEQ ID NO: 1519210 - RNA, 23 nt, Human
gugguuaaugccauggacagaag

SEQ ID NO: 1519211 - RNA, 14 nt, Human
gugggucaaggaau

SEQ ID NO: 1519212 - RNA, 14 nt, Human
gugguguggagaag

SEQ ID NO: 1519213 - RNA, 22 nt, Human
gugguguggagaagccacaggc

SEQ ID NO: 1519214 - RNA, 15 nt, Human
gugguguuuccuggc

SEQ ID NO: 1519215 - RNA, 16 nt, Human
gugguguuuccuggca

SEQ ID NO: 1519216 - RNA, 12 nt, Human
gugggagcugag

SEQ ID NO: 1519217 - RNA, 15 nt, Human
gugggauccuccagg

SEQ ID NO: 1519218 - RNA, 18 nt, Human
gugggauccuccaggugc

SEQ ID NO: 1519219 - RNA, 15 nt, Human
guggccucccaacuc

SEQ ID NO: 1519220 - RNA, 23 nt, Human
gugggaaagauuacuuuuucuuu

SEQ ID NO: 1519221 - RNA, 13 nt, Human
guggccucccaac

SEQ ID NO: 1519222 - RNA, 14 nt, Human
guggccucccaacu

SEQ ID NO: 1519223 - RNA, 11 nt, Human
aagagcugagg

SEQ ID NO: 1519224 - RNA, 18 nt, Human
aagagcugaggcaauucu

SEQ ID NO: 1519225 - RNA, 18 nt, Human
aagagcuguucacagcca

SEQ ID NO: 1519226 - RNA, 19 nt, Human
aagagcuguucacagccag

SEQ ID NO: 1519227 - RNA, 16 nt, Human
aagagcccaggccucc

SEQ ID NO: 1519228 - RNA, 12 nt, Human
aagagcccaggc

SEQ ID NO: 1519229 - RNA, 14 nt, Human
aagagcccaggccu

SEQ ID NO: 1519230 - RNA, 16 nt, Human
aagacuguacaaagua

SEQ ID NO: 1519231 - RNA, 16 nt, Human
aagagauugugguuuc

SEQ ID NO: 1519232 - RNA, 19 nt, Human
aagagauugugguuucauu

SEQ ID NO: 1519233 - RNA, 17 nt, Human
aagacucauucuucugu

SEQ ID NO: 1519234 - RNA, 14 nt, Human
aagacuccaaagaa

SEQ ID NO: 1519235 - RNA, 16 nt, Human
aagacuccaaagaaau

SEQ ID NO: 1519236 - RNA, 17 nt, Human
aagacuccaaagaaaug

SEQ ID NO: 1519237 - RNA, 21 nt, Human
aagacgcugugcugcccugcc

SEQ ID NO: 1519238 - RNA, 22 nt, Human
aagacgcugugcugcccugccc

SEQ ID NO: 1519239 - RNA, 14 nt, Human
aagacuauucaaac

SEQ ID NO: 1519240 - RNA, 23 nt, Human
aagacgcugugcugcccugccca

SEQ ID NO: 1519241 - RNA, 24 nt, Human
aagaauuucuaggacugaauuaug

SEQ ID NO: 1519242 - RNA, 16 nt, Human
aagacaaaaagcuacu

SEQ ID NO: 1519243 - RNA, 13 nt, Human
aagacccaaaagg

SEQ ID NO: 1519244 - RNA, 19 nt, Human
guggcagcugcgguccacc

SEQ ID NO: 1519245 - RNA, 17 nt, Human
guggcagcugcggucca

SEQ ID NO: 1519246 - RNA, 13 nt, Human
aagaauauuuuaa

SEQ ID NO: 1519247 - RNA, 18 nt, Human
guggcaccagcagccugg

SEQ ID NO: 1519248 - RNA, 13 nt, Human
guggcaccagcag

SEQ ID NO: 1519249 - RNA, 14 nt, Human
guggcaccagcagc

SEQ ID NO: 1519250 - RNA, 22 nt, Human
guggcagcucaccucucccuug

SEQ ID NO: 1519251 - RNA, 14 nt, Human
guggcagcugcggu

SEQ ID NO: 1519252 - RNA, 23 nt, Human
guggauuuaacagaaauguacag

SEQ ID NO: 1519253 - RNA, 21 nt, Human
guggauuuugguuuuguuccc

SEQ ID NO: 1519254 - RNA, 21 nt, Human
guggauuuaacagaaauguac

SEQ ID NO: 1519255 - RNA, 14 nt, Human
guggacacagcucu

SEQ ID NO: 1519256 - RNA, 15 nt, Human
guggacacagcucuu

SEQ ID NO: 1519257 - RNA, 17 nt, Human
guggacacagcucuucu

SEQ ID NO: 1519258 - RNA, 24 nt, Human
guggacacagcucuucuccaggcu

SEQ ID NO: 1519259 - RNA, 21 nt, Human
gugcugcccugcccaccuggc

SEQ ID NO: 1519260 - RNA, 19 nt, Human
gugcugcccugcccaccug

SEQ ID NO: 1519261 - RNA, 20 nt, Human
gugcugcccugcccaccugg

SEQ ID NO: 1519262 - RNA, 20 nt, Human
gugcacuaauguguaagaca

SEQ ID NO: 1519263 - RNA, 22 nt, Human
gugcacuaauguguaagacaaa

SEQ ID NO: 1519264 - RNA, 22 nt, Human
gugcauuugaggucuguucuuu

SEQ ID NO: 1519265 - RNA, 21 nt, Human
gugcauuugaggucuguucuu

SEQ ID NO: 1519266 - RNA, 15 nt, Human
gugcauuuggugguu

SEQ ID NO: 1519267 - RNA, 14 nt, Human
gugccaagcagagg

SEQ ID NO: 1519268 - RNA, 12 nt, Human
gugcacacacca

SEQ ID NO: 1519269 - RNA, 14 nt, Human
gugcacacaccaga

SEQ ID NO: 1519270 - RNA, 18 nt, Human
gugcacguacacacacau

SEQ ID NO: 1519271 - RNA, 17 nt, Human
gugcacacaccagagcc

SEQ ID NO: 1519272 - RNA, 14 nt, Human
aacuuggcgcugcc

SEQ ID NO: 1519273 - RNA, 17 nt, Human
aacuuggcgcugccccu

SEQ ID NO: 1519274 - RNA, 23 nt, Human
aacuugguucccauuugcuccuu

SEQ ID NO: 1519275 - RNA, 15 nt, Human
gugccucugggacug

SEQ ID NO: 1519276 - RNA, 13 nt, Human
aagaaaauaucac

SEQ ID NO: 1519277 - RNA, 16 nt, Human
aagaaaauaccaagga

SEQ ID NO: 1519278 - RNA, 15 nt, Human
aagaagcucucuccu

SEQ ID NO: 1519279 - RNA, 14 nt, Human
aagaagcucucucc

SEQ ID NO: 1519280 - RNA, 16 nt, Human
aagaagcccaggaaag

SEQ ID NO: 1519281 - RNA, 17 nt, Human
aagaagcccaggaaagg

SEQ ID NO: 1519282 - RNA, 16 nt, Human
aagaaaaguuuaccau

SEQ ID NO: 1519283 - RNA, 20 nt, Human
aagaaaaaggaugcacagag

SEQ ID NO: 1519284 - RNA, 19 nt, Human
aagaaaaaggaugcacaga

SEQ ID NO: 1519285 - RNA, 22 nt, Human
aagaaaaaggaugcacagaguu

SEQ ID NO: 1519286 - RNA, 20 nt, Human
gucuaccugaggggccucuu

SEQ ID NO: 1519287 - RNA, 23 nt, Human
gucgcccagucuggaaugcagug

SEQ ID NO: 1519288 - RNA, 13 nt, Human
gucgcccagucug

SEQ ID NO: 1519289 - RNA, 14 nt, Human
gucgcccagucugg

SEQ ID NO: 1519290 - RNA, 14 nt, Human
gucgaggacaggga

SEQ ID NO: 1519291 - RNA, 10 nt, Human
guccugcagc

SEQ ID NO: 1519292 - RNA, 17 nt, Human
guccugcugcaguugcc

SEQ ID NO: 1519293 - RNA, 18 nt, Human
guccugcagccugcagga

SEQ ID NO: 1519294 - RNA, 14 nt, Human
guccugcagccugc

SEQ ID NO: 1519295 - RNA, 13 nt, Human
guccugcugcagu

SEQ ID NO: 1519296 - RNA, 16 nt, Human
guccugcugcaguugc

SEQ ID NO: 1519297 - RNA, 13 nt, Human
aaccacaucuugc

SEQ ID NO: 1519298 - RNA, 18 nt, Human
aaccacaucuugcucugc

SEQ ID NO: 1519299 - RNA, 13 nt, Human
gucuccauguuug

SEQ ID NO: 1519300 - RNA, 16 nt, Human
aacauuuugucauaua

SEQ ID NO: 1519301 - RNA, 22 nt, Human
gucucaaacucuugaccucagg

SEQ ID NO: 1519302 - RNA, 14 nt, Human
gucuaugggacuca

SEQ ID NO: 1519303 - RNA, 15 nt, Human
gucuaugggacucaa

SEQ ID NO: 1519304 - RNA, 23 nt, Human
gucucaguccaugaagauguaga

SEQ ID NO: 1519305 - RNA, 22 nt, Human
gucuccaaccccccagcacuga

SEQ ID NO: 1519306 - RNA, 16 nt, Human
gucuccaaccccccag

SEQ ID NO: 1519307 - RNA, 17 nt, Human
gucuccaaccccccagc

SEQ ID NO: 1519308 - RNA, 20 nt, Human
gucuccaaccccccagcacu

SEQ ID NO: 1519309 - RNA, 21 nt, Human
gucuccaaccccccagcacug

SEQ ID NO: 1519310 - RNA, 22 nt, Human
guagcucuaggagggcuggcaa

SEQ ID NO: 1519311 - RNA, 19 nt, Human
gucccaccuuggcugcagg

SEQ ID NO: 1519312 - RNA, 20 nt, Human
gucccaccuuggcugcaggg

SEQ ID NO: 1519313 - RNA, 17 nt, Human
gucccaccuuggcugca

SEQ ID NO: 1519314 - RNA, 18 nt, Human
gucccaccuuggcugcag

SEQ ID NO: 1519315 - RNA, 13 nt, Human
guccgagcuuuga

SEQ ID NO: 1519316 - RNA, 22 nt, Human
guccgaaagggacuuggaagcu

SEQ ID NO: 1519317 - RNA, 13 nt, Human
gucccuuuuccuu

SEQ ID NO: 1519318 - RNA, 21 nt, Human
guccgaaagggacuuggaagc

SEQ ID NO: 1519319 - RNA, 12 nt, Human
guccccuucucu

SEQ ID NO: 1519320 - RNA, 13 nt, Human
guccccuucucuc

SEQ ID NO: 1519321 - RNA, 14 nt, Human
guccccuucucuca

SEQ ID NO: 1519322 - RNA, 17 nt, Human
guccccuucucucaucu

SEQ ID NO: 1519323 - RNA, 18 nt, Human
guccccuucucucaucuc

SEQ ID NO: 1519324 - RNA, 19 nt, Human
guccccuucucucaucucu

SEQ ID NO: 1519325 - RNA, 20 nt, Human
guccccuucucucaucucuu

SEQ ID NO: 1519326 - RNA, 18 nt, Human
gucccccugacaacacuc

SEQ ID NO: 1519327 - RNA, 13 nt, Human
gucccccugacaa

SEQ ID NO: 1519328 - RNA, 15 nt, Human
guccccgcacugggc

SEQ ID NO: 1519329 - RNA, 16 nt, Human
guccccgcacugggcu

SEQ ID NO: 1519330 - RNA, 23 nt, Human
guccccuguuuguuucugaaagg

SEQ ID NO: 1519331 - RNA, 11 nt, Human
guccccuucuc

SEQ ID NO: 1519332 - RNA, 16 nt, Human
aacauauauaacaaug

SEQ ID NO: 1519333 - RNA, 14 nt, Human
aacaucaacaucuu

SEQ ID NO: 1519334 - RNA, 22 nt, Human
aacauguuuuucuucucccuca

SEQ ID NO: 1519335 - RNA, 12 nt, Human
aacauaauuaaa

SEQ ID NO: 1519336 - RNA, 20 nt, Human
aacauacucccaucugugaa

SEQ ID NO: 1519337 - RNA, 18 nt, Human
aacauacucccaucugug

SEQ ID NO: 1519338 - RNA, 19 nt, Human
aacagucucaggaaaucaa

SEQ ID NO: 1519339 - RNA, 19 nt, Human
aacagguuuuccugaagaa

SEQ ID NO: 1519340 - RNA, 17 nt, Human
aacagucucaggaaauc

SEQ ID NO: 1519341 - RNA, 13 nt, Human
guccuacccaccc

SEQ ID NO: 1519342 - RNA, 15 nt, Human
guccuacccacccuc

SEQ ID NO: 1519343 - RNA, 16 nt, Human
aacagauaaauaguuu

SEQ ID NO: 1519344 - RNA, 19 nt, Human
aacagauuauuaccuuaca

SEQ ID NO: 1519345 - RNA, 20 nt, Human
aacugaaaucauacuucuua

SEQ ID NO: 1519346 - RNA, 20 nt, Human
gugaguccuggcaugggaau

SEQ ID NO: 1519347 - RNA, 15 nt, Human
gugagucgaggacag

SEQ ID NO: 1519348 - RNA, 17 nt, Human
gugaguccuggcauggg

SEQ ID NO: 1519349 - RNA, 19 nt, Human
gugaguacuacaguccucc

SEQ ID NO: 1519350 - RNA, 21 nt, Human
gugaguacuacaguccuccca

SEQ ID NO: 1519351 - RNA, 12 nt, Human
gugagagcuggg

SEQ ID NO: 1519352 - RNA, 12 nt, Human
gugaccccaggu

SEQ ID NO: 1519353 - RNA, 21 nt, Human
gugagcacuaaggugugcucu

SEQ ID NO: 1519354 - RNA, 17 nt, Human
gugaguacuacaguccu

SEQ ID NO: 1519355 - RNA, 13 nt, Human
gugagagcugggu

SEQ ID NO: 1519356 - RNA, 16 nt, Human
gugagaggggaacaga

SEQ ID NO: 1519357 - RNA, 17 nt, Human
gugaccaaugaugguca

SEQ ID NO: 1519358 - RNA, 18 nt, Human
gugaccauguuuuguuua

SEQ ID NO: 1519359 - RNA, 18 nt, Human
gugaccagcaccaucucu

SEQ ID NO: 1519360 - RNA, 21 nt, Human
gugaccagcaccaucucuccu

SEQ ID NO: 1519361 - RNA, 23 nt, Human
gugacagaggcagccccauucug

SEQ ID NO: 1519362 - RNA, 14 nt, Human
gugacaugucuuuu

SEQ ID NO: 1519363 - RNA, 16 nt, Human
gugacagaggcagccc

SEQ ID NO: 1519364 - RNA, 18 nt, Human
gugacagaggcagcccca

SEQ ID NO: 1519365 - RNA, 19 nt, Human
gugacagaggcagccccau

SEQ ID NO: 1519366 - RNA, 13 nt, Human
aacuauauuguuu

SEQ ID NO: 1519367 - RNA, 20 nt, Human
aacuaucucauuuccaagca

SEQ ID NO: 1519368 - RNA, 23 nt, Human
aacuaucucauuuccaagcaagu

SEQ ID NO: 1519369 - RNA, 23 nt, Human
gugaagacaaugacuuacuguac

SEQ ID NO: 1519370 - RNA, 14 nt, Human
gugaagugaagaca

SEQ ID NO: 1519371 - RNA, 16 nt, Human
gugaagugaaugaaac

SEQ ID NO: 1519372 - RNA, 23 nt, Human
aacguggcugcuucaaggauccu

SEQ ID NO: 1519373 - RNA, 19 nt, Human
aaccugauugugucucuug

SEQ ID NO: 1519374 - RNA, 18 nt, Human
aaccugauugugucucuu

SEQ ID NO: 1519375 - RNA, 15 nt, Human
gucuuuguacagaca

SEQ ID NO: 1519376 - RNA, 16 nt, Human
gucuuuguacagacaa

SEQ ID NO: 1519377 - RNA, 16 nt, Human
gucuucaguaagccgu

SEQ ID NO: 1519378 - RNA, 18 nt, Human
gucucuuuaaugucacag

SEQ ID NO: 1519379 - RNA, 19 nt, Human
gucucuuuaaugucacagg

SEQ ID NO: 1519380 - RNA, 20 nt, Human
gucucuuuaaugucacaggc

SEQ ID NO: 1519381 - RNA, 19 nt, Human
gucugaaggcuggguucug

SEQ ID NO: 1519382 - RNA, 22 nt, Human
gucucuuuaaugucacaggcag

SEQ ID NO: 1519383 - RNA, 23 nt, Human
gucucuuuaaugucacaggcagg

SEQ ID NO: 1519384 - RNA, 17 nt, Human
gucucuugguccugcug

SEQ ID NO: 1519385 - RNA, 20 nt, Human
gucucuugguccugcugcag

SEQ ID NO: 1519386 - RNA, 18 nt, Human
gucucuugguccugcugc

SEQ ID NO: 1519387 - RNA, 19 nt, Human
gucucuugguccugcugca

SEQ ID NO: 1519388 - RNA, 13 nt, Human
gucugacccacug

SEQ ID NO: 1519389 - RNA, 21 nt, Human
gucugacaggcaaugcuggcu

SEQ ID NO: 1519390 - RNA, 22 nt, Human
gucugacaggcaaugcuggcug

SEQ ID NO: 1519391 - RNA, 23 nt, Human
gucugacaggcaaugcuggcugu

SEQ ID NO: 1519392 - RNA, 19 nt, Human
aguggccuuccccagcaug

SEQ ID NO: 1519393 - RNA, 23 nt, Human
aguggcuuaaaacaacacucaca

SEQ ID NO: 1519394 - RNA, 15 nt, Human
agugucuuaauuaaa

SEQ ID NO: 1519395 - RNA, 18 nt, Human
aguguauuuuuuuacuaa

SEQ ID NO: 1519396 - RNA, 17 nt, Human
aguguauuuuuuuacua

SEQ ID NO: 1519397 - RNA, 16 nt, Human
agugggagcugccugu

SEQ ID NO: 1519398 - RNA, 15 nt, Human
agugggagcugccug

SEQ ID NO: 1519399 - RNA, 14 nt, Human
agugggagcugccu

SEQ ID NO: 1519400 - RNA, 21 nt, Human
agugucuuaauuaaaagaaua

SEQ ID NO: 1519401 - RNA, 17 nt, Human
agugucuuaauuaaaag

SEQ ID NO: 1519402 - RNA, 18 nt, Human
agugucuuaauuaaaaga

SEQ ID NO: 1519403 - RNA, 22 nt, Human
aguugaaaaucuuauaauuuaa

SEQ ID NO: 1519404 - RNA, 15 nt, Human
aguucauacauugua

SEQ ID NO: 1519405 - RNA, 20 nt, Human
aguucagguaacaggcagau

SEQ ID NO: 1519406 - RNA, 17 nt, Human
aguuacagacaaagcgu

SEQ ID NO: 1519407 - RNA, 19 nt, Human
aguucagguaacaggcaga

SEQ ID NO: 1519408 - RNA, 10 nt, Human
aguucauaca

SEQ ID NO: 1519409 - RNA, 11 nt, Human
aguucauacau

SEQ ID NO: 1519410 - RNA, 14 nt, Human
aguuacagacaaag

SEQ ID NO: 1519411 - RNA, 16 nt, Human
aguuacagacaaagcg

SEQ ID NO: 1519412 - RNA, 12 nt, Human
aguuaaauaaau

SEQ ID NO: 1519413 - RNA, 23 nt, Human
aguugaaaaucuuauaauuuaaa

SEQ ID NO: 1519414 - RNA, 22 nt, Human
aguugaaaagacuccaaagaaa

SEQ ID NO: 1519415 - RNA, 16 nt, Human
aguuguguuugaagca

SEQ ID NO: 1519416 - RNA, 14 nt, Human
aguugaagacagag

SEQ ID NO: 1519417 - RNA, 20 nt, Human
aguuguuugauucagacagc

SEQ ID NO: 1519418 - RNA, 11 nt, Human
aguaucuugaa

SEQ ID NO: 1519419 - RNA, 12 nt, Human
aguaucuugaag

SEQ ID NO: 1519420 - RNA, 15 nt, Human
aguaucuugaagacu

SEQ ID NO: 1519421 - RNA, 14 nt, Human
aguaugaaauuaua

SEQ ID NO: 1519422 - RNA, 16 nt, Human
aguaugaaauuauaua

SEQ ID NO: 1519423 - RNA, 17 nt, Human
aguaugaggcauuuguu

SEQ ID NO: 1519424 - RNA, 16 nt, Human
aguaugaggcauuugu

SEQ ID NO: 1519425 - RNA, 15 nt, Human
aguaugaggcauuug

SEQ ID NO: 1519426 - RNA, 23 nt, Human
agucaaauugugugaaagguacu

SEQ ID NO: 1519427 - RNA, 19 nt, Human
agucaaauugugugaaagg

SEQ ID NO: 1519428 - RNA, 14 nt, Human
aguaugguggcugg

SEQ ID NO: 1519429 - RNA, 12 nt, Human
aguccuguaaug

SEQ ID NO: 1519430 - RNA, 17 nt, Human
agucugaaggcuggguu

SEQ ID NO: 1519431 - RNA, 16 nt, Human
agucugaaggcugggu

SEQ ID NO: 1519432 - RNA, 13 nt, Human
agucugaaggcug

SEQ ID NO: 1519433 - RNA, 15 nt, Human
agucugaaggcuggg

SEQ ID NO: 1519434 - RNA, 22 nt, Human
aguccuggcaugggaaugaaug

SEQ ID NO: 1519435 - RNA, 20 nt, Human
aguccuggcaugggaaugaa

SEQ ID NO: 1519436 - RNA, 21 nt, Human
aguccuggcaugggaaugaau

SEQ ID NO: 1519437 - RNA, 16 nt, Human
agugaagacaaugacu

SEQ ID NO: 1519438 - RNA, 14 nt, Human
agugaagacaauga

SEQ ID NO: 1519439 - RNA, 20 nt, Human
agucugauucccaagcucug

SEQ ID NO: 1519440 - RNA, 16 nt, Human
agucugauucccaagc

SEQ ID NO: 1519441 - RNA, 18 nt, Human
agucugauucccaagcuc

SEQ ID NO: 1519442 - RNA, 17 nt, Human
agucuggaaugcagugg

SEQ ID NO: 1519443 - RNA, 18 nt, Human
agucuggaaugcaguggu

SEQ ID NO: 1519444 - RNA, 14 nt, Human
auagucaaauugug

SEQ ID NO: 1519445 - RNA, 23 nt, Human
auaguauuugagaguucuaaauu

SEQ ID NO: 1519446 - RNA, 17 nt, Human
auagucaaauuguguga

SEQ ID NO: 1519447 - RNA, 15 nt, Human
auagguuuaauaauu

SEQ ID NO: 1519448 - RNA, 14 nt, Human
auagguuuggacaa

SEQ ID NO: 1519449 - RNA, 18 nt, Human
auagguuuggacaaaaug

SEQ ID NO: 1519450 - RNA, 17 nt, Human
auaguaugguggcuggg

SEQ ID NO: 1519451 - RNA, 18 nt, Human
auaguaugguggcugggu

SEQ ID NO: 1519452 - RNA, 20 nt, Human
auaguauuugagaguucuaa

SEQ ID NO: 1519453 - RNA, 21 nt, Human
auaguauuugagaguucuaaa

SEQ ID NO: 1519454 - RNA, 14 nt, Human
auaggugcuacaaa

SEQ ID NO: 1519455 - RNA, 23 nt, Human
auaggugcuacaaaaacacagca

SEQ ID NO: 1519456 - RNA, 15 nt, Human
auaggugcuacaaaa

SEQ ID NO: 1519457 - RNA, 21 nt, Human
auaggugcuacaaaaacacag

SEQ ID NO: 1519458 - RNA, 15 nt, Human
auagccaaggccaaa

SEQ ID NO: 1519459 - RNA, 21 nt, Human
auagccaaggccaaaggaagc

SEQ ID NO: 1519460 - RNA, 19 nt, Human
auauauuuuuuucugaaau

SEQ ID NO: 1519461 - RNA, 15 nt, Human
auaucaauuuaaaaa

SEQ ID NO: 1519462 - RNA, 13 nt, Human
auauuauguguuu

SEQ ID NO: 1519463 - RNA, 14 nt, Human
auauuuacguauga

SEQ ID NO: 1519464 - RNA, 13 nt, Human
auauuuauuuuaa

SEQ ID NO: 1519465 - RNA, 19 nt, Human
auauuuacuucuuauacau

SEQ ID NO: 1519466 - RNA, 23 nt, Human
auaugcuucuguuuuauaauuuu

SEQ ID NO: 1519467 - RNA, 22 nt, Human
auauuaccacagacauacuaac

SEQ ID NO: 1519468 - RNA, 20 nt, Human
auaugcuucuguuuuauaau

SEQ ID NO: 1519469 - RNA, 22 nt, Human
auaugcuucuguuuuauaauuu

SEQ ID NO: 1519470 - RNA, 16 nt, Human
auaugcucugcauguu

SEQ ID NO: 1519471 - RNA, 23 nt, Human
auaauguuucaaacauauauaac

SEQ ID NO: 1519472 - RNA, 11 nt, Human
auaaugucucu

SEQ ID NO: 1519473 - RNA, 15 nt, Human
auaauguaagcucua

SEQ ID NO: 1519474 - RNA, 15 nt, Human
auaaugucucuguga

SEQ ID NO: 1519475 - RNA, 19 nt, Human
auaaugucucugugagacu

SEQ ID NO: 1519476 - RNA, 20 nt, Human
auaauuaaauuuugaguucu

SEQ ID NO: 1519477 - RNA, 20 nt, Human
auacaccacuacauucuguu

SEQ ID NO: 1519478 - RNA, 19 nt, Human
auacaccacuacauucugu

SEQ ID NO: 1519479 - RNA, 21 nt, Human
auacaccacuacauucuguua

SEQ ID NO: 1519480 - RNA, 17 nt, Human
auacacacucaaaucaa

SEQ ID NO: 1519481 - RNA, 18 nt, Human
auacacacucaaaucaag

SEQ ID NO: 1519482 - RNA, 20 nt, Human
auacacacucaaaucaagaa

SEQ ID NO: 1519483 - RNA, 21 nt, Human
auaaugcgugcauaccacuuu

SEQ ID NO: 1519484 - RNA, 12 nt, Human
auacccaccccc

SEQ ID NO: 1519485 - RNA, 11 nt, Human
auacccacccc

SEQ ID NO: 1519486 - RNA, 18 nt, Human
auaccugucccccugaca

SEQ ID NO: 1519487 - RNA, 18 nt, Human
auaaaggauuaaugucaa

SEQ ID NO: 1519488 - RNA, 24 nt, Human
auaaacuuuaccuuuuuuauacau

SEQ ID NO: 1519489 - RNA, 21 nt, Human
auaaacuuuaccuuuuuuaua

SEQ ID NO: 1519490 - RNA, 17 nt, Human
auaaaacuuuuuaaaau

SEQ ID NO: 1519491 - RNA, 22 nt, Human
auaaaaauauuguguugugaau

SEQ ID NO: 1519492 - RNA, 14 nt, Human
auaaaaauauugug

SEQ ID NO: 1519493 - RNA, 11 nt, Human
auaaaacuuuu

SEQ ID NO: 1519494 - RNA, 15 nt, Human
auaaaacuuuuuaaa

SEQ ID NO: 1519495 - RNA, 13 nt, Human
auaaagcagcguu

SEQ ID NO: 1519496 - RNA, 20 nt, Human
auaaagcagcguuucuauga

SEQ ID NO: 1519497 - RNA, 19 nt, Human
auaaagcagcguuucuaug

SEQ ID NO: 1519498 - RNA, 18 nt, Human
auaaagcagcguuucuau

SEQ ID NO: 1519499 - RNA, 14 nt, Human
auaaagcagcguuu

SEQ ID NO: 1519500 - RNA, 17 nt, Human
auauuuauuuuaauaau

SEQ ID NO: 1519501 - RNA, 14 nt, Human
auauuuauuuuaau

SEQ ID NO: 1519502 - RNA, 15 nt, Human
auauuuauuuuaaua

SEQ ID NO: 1519503 - RNA, 21 nt, Human
aucacagccucugaaaaccaa

SEQ ID NO: 1519504 - RNA, 18 nt, Human
aucaccaacgucugugcc

SEQ ID NO: 1519505 - RNA, 19 nt, Human
aucaccaacgucugugcca

SEQ ID NO: 1519506 - RNA, 20 nt, Human
aucaccaacgucugugccau

SEQ ID NO: 1519507 - RNA, 23 nt, Human
aucagcacgauuucuguuuagau

SEQ ID NO: 1519508 - RNA, 20 nt, Human
aucagcacgauuucuguuua

SEQ ID NO: 1519509 - RNA, 19 nt, Human
aucagcacgauuucuguuu

SEQ ID NO: 1519510 - RNA, 14 nt, Human
aucaccgaaaacgu

SEQ ID NO: 1519511 - RNA, 19 nt, Human
aucaccgaaaacguggcug

SEQ ID NO: 1519512 - RNA, 21 nt, Human
aucaccgaaaacguggcugcu

SEQ ID NO: 1519513 - RNA, 20 nt, Human
aucagccugcuccagcuguu

SEQ ID NO: 1519514 - RNA, 19 nt, Human
aucagccugcuccagcugu

SEQ ID NO: 1519515 - RNA, 18 nt, Human
aucagccugcuccagcug

SEQ ID NO: 1519516 - RNA, 18 nt, Human
aucagcuccacuuucagu

SEQ ID NO: 1519517 - RNA, 21 nt, Human
aucagcugcugaaacaacaaa

SEQ ID NO: 1519518 - RNA, 22 nt, Human
aucagcugcugaaacaacaaau

SEQ ID NO: 1519519 - RNA, 23 nt, Human
aucagcugcugaaacaacaaaua

SEQ ID NO: 1519520 - RNA, 15 nt, Human
auccagacccggcug

SEQ ID NO: 1519521 - RNA, 14 nt, Human
aucccauuuaaaaa

SEQ ID NO: 1519522 - RNA, 15 nt, Human
aucccauuuaaaaaa

SEQ ID NO: 1519523 - RNA, 15 nt, Human
auccccuguagagug

SEQ ID NO: 1519524 - RNA, 11 nt, Human
auccuccaggu

SEQ ID NO: 1519525 - RNA, 23 nt, Human
auccuccaggugcacaagcucca

SEQ ID NO: 1519526 - RNA, 13 nt, Human
auccuccaggugc

SEQ ID NO: 1519527 - RNA, 15 nt, Human
auccucccaccucag

SEQ ID NO: 1519528 - RNA, 20 nt, Human
auccucccaccucagccucc

SEQ ID NO: 1519529 - RNA, 18 nt, Human
auccucccaccucagccu

SEQ ID NO: 1519530 - RNA, 19 nt, Human
auccucccaccucagccuc

SEQ ID NO: 1519531 - RNA, 21 nt, Human
augaccuuucaauaggaaaaa

SEQ ID NO: 1519532 - RNA, 22 nt, Human
augaccuuucaauaggaaaaac

SEQ ID NO: 1519533 - RNA, 23 nt, Human
augaccuuucaauaggaaaaacu

SEQ ID NO: 1519534 - RNA, 17 nt, Human
augaagguuucugaaaa

SEQ ID NO: 1519535 - RNA, 19 nt, Human
augaagguuucugaaaauu

SEQ ID NO: 1519536 - RNA, 13 nt, Human
augaaagacugua

SEQ ID NO: 1519537 - RNA, 16 nt, Human
augaaagacuguacaa

SEQ ID NO: 1519538 - RNA, 17 nt, Human
augaaagacuguacaaa

SEQ ID NO: 1519539 - RNA, 19 nt, Human
augaaagacuguacaaagu

SEQ ID NO: 1519540 - RNA, 17 nt, Human
aucuauauuuuacauaa

SEQ ID NO: 1519541 - RNA, 21 nt, Human
aucuauauuuuacauaaauuu

SEQ ID NO: 1519542 - RNA, 22 nt, Human
aucugcuuuuuaaagaaugcuc

SEQ ID NO: 1519543 - RNA, 17 nt, Human
aucuugaauuguaagga

SEQ ID NO: 1519544 - RNA, 18 nt, Human
aucuugaagacuuuucuu

SEQ ID NO: 1519545 - RNA, 14 nt, Human
aucuucuuuauaau

SEQ ID NO: 1519546 - RNA, 11 nt, Human
augugaacagu

SEQ ID NO: 1519547 - RNA, 21 nt, Human
augugaacaguuguguuugaa

SEQ ID NO: 1519548 - RNA, 23 nt, Human
augugaacaguuguguuugaagc

SEQ ID NO: 1519549 - RNA, 22 nt, Human
augugaaacuggauuaaacuua

SEQ ID NO: 1519550 - RNA, 14 nt, Human
augucuuuucuugc

SEQ ID NO: 1519551 - RNA, 19 nt, Human
auggucaccaaaucagcug

SEQ ID NO: 1519552 - RNA, 20 nt, Human
auguauucuagcuaauguaa

SEQ ID NO: 1519553 - RNA, 23 nt, Human
auguaauuaaguacuauguauca

SEQ ID NO: 1519554 - RNA, 19 nt, Human
auguauucuagcuaaugua

SEQ ID NO: 1519555 - RNA, 15 nt, Human
auggucggaaaacau

SEQ ID NO: 1519556 - RNA, 14 nt, Human
auguaagggaaacu

SEQ ID NO: 1519557 - RNA, 16 nt, Human
auguaagggaaacugc

SEQ ID NO: 1519558 - RNA, 20 nt, Human
auguaagggaaacugccagc

SEQ ID NO: 1519559 - RNA, 19 nt, Human
auguaagggaaacugccag

SEQ ID NO: 1519560 - RNA, 15 nt, Human
auguaauuaaguacu

SEQ ID NO: 1519561 - RNA, 17 nt, Human
auguaauuaaguacuau

SEQ ID NO: 1519562 - RNA, 20 nt, Human
augugggcuaguugggcuuc

SEQ ID NO: 1519563 - RNA, 18 nt, Human
augugggcagugauguca

SEQ ID NO: 1519564 - RNA, 17 nt, Human
auguucuaagaagugaa

SEQ ID NO: 1519565 - RNA, 16 nt, Human
auguucucucuucucc

SEQ ID NO: 1519566 - RNA, 11 nt, Human
auguucuggga

SEQ ID NO: 1519567 - RNA, 12 nt, Human
auguucugggac

SEQ ID NO: 1519568 - RNA, 14 nt, Human
auguuucaaacuuu

SEQ ID NO: 1519569 - RNA, 17 nt, Human
auguuucaaacuuugga

SEQ ID NO: 1519570 - RNA, 13 nt, Human
auguucugggaca

SEQ ID NO: 1519571 - RNA, 12 nt, Human
auguuucaaacu

SEQ ID NO: 1519572 - RNA, 13 nt, Human
auguuucaaacuu

SEQ ID NO: 1519573 - RNA, 22 nt, Human
auguuugccucugccucugaca

SEQ ID NO: 1519574 - RNA, 19 nt, Human
auguuugccucugccucug

SEQ ID NO: 1519575 - RNA, 20 nt, Human
augcaugaaguaauaugcac

SEQ ID NO: 1519576 - RNA, 16 nt, Human
augcaugaaguaauau

SEQ ID NO: 1519577 - RNA, 19 nt, Human
augccucucucaggccaaa

SEQ ID NO: 1519578 - RNA, 21 nt, Human
augcauagguuuagcaguaua

SEQ ID NO: 1519579 - RNA, 18 nt, Human
augcacagaguuguuaca

SEQ ID NO: 1519580 - RNA, 17 nt, Human
augcacagaguuguuac

SEQ ID NO: 1519581 - RNA, 16 nt, Human
augcacagaguuguua

SEQ ID NO: 1519582 - RNA, 16 nt, Human
augcacaaacagaggc

SEQ ID NO: 1519583 - RNA, 17 nt, Human
augcacaaacagaggcc

SEQ ID NO: 1519584 - RNA, 15 nt, Human
augcacaaacagagg

SEQ ID NO: 1519585 - RNA, 24 nt, Human
augauguuuuccaugaguccccug

SEQ ID NO: 1519586 - RNA, 16 nt, Human
augaugccaugaggaa

SEQ ID NO: 1519587 - RNA, 17 nt, Human
augaugccaugaggaac

SEQ ID NO: 1519588 - RNA, 15 nt, Human
augcuuguacauaau

SEQ ID NO: 1519589 - RNA, 14 nt, Human
augcuuguacauaa

SEQ ID NO: 1519590 - RNA, 13 nt, Human
augcuuguacaua

SEQ ID NO: 1519591 - RNA, 12 nt, Human
augcuuguacau

SEQ ID NO: 1519592 - RNA, 12 nt, Human
augcugcccugu

SEQ ID NO: 1519593 - RNA, 15 nt, Human
auggauuuccagcca

SEQ ID NO: 1519594 - RNA, 16 nt, Human
augcucuuuacuucau

SEQ ID NO: 1519595 - RNA, 11 nt, Human
augcugcccug

SEQ ID NO: 1519596 - RNA, 15 nt, Human
agacagauacuccuc

SEQ ID NO: 1519597 - RNA, 22 nt, Human
agacagauacuccuccaagguu

SEQ ID NO: 1519598 - RNA, 21 nt, Human
agacagauacuccuccaaggu

SEQ ID NO: 1519599 - RNA, 16 nt, Human
agacagcccgggcucu

SEQ ID NO: 1519600 - RNA, 14 nt, Human
agacagcccgggcu

SEQ ID NO: 1519601 - RNA, 15 nt, Human
agacagcccgggcuc

SEQ ID NO: 1519602 - RNA, 22 nt, Human
agacgcugugcugcccugccca

SEQ ID NO: 1519603 - RNA, 18 nt, Human
agacggagucccaccuug

SEQ ID NO: 1519604 - RNA, 12 nt, Human
agacagcugccu

SEQ ID NO: 1519605 - RNA, 11 nt, Human
agacagcucuu

SEQ ID NO: 1519606 - RNA, 12 nt, Human
agacagcucuua

SEQ ID NO: 1519607 - RNA, 21 nt, Human
agacgcugugcugcccugccc

SEQ ID NO: 1519608 - RNA, 17 nt, Human
agagaacuuccagaucc

SEQ ID NO: 1519609 - RNA, 17 nt, Human
agagcccacgcccccac

SEQ ID NO: 1519610 - RNA, 16 nt, Human
agagcccacgccccca

SEQ ID NO: 1519611 - RNA, 19 nt, Human
agagcccaccuuggcucaa

SEQ ID NO: 1519612 - RNA, 13 nt, Human
agagcccacgccc

SEQ ID NO: 1519613 - RNA, 23 nt, Human
agagaggguggugaccucugccu

SEQ ID NO: 1519614 - RNA, 22 nt, Human
agagaggguggugaccucugcc

SEQ ID NO: 1519615 - RNA, 20 nt, Human
agagaggguggugaccucug

SEQ ID NO: 1519616 - RNA, 21 nt, Human
agagaggguggugaccucugc

SEQ ID NO: 1519617 - RNA, 19 nt, Human
agacuggaagcacagcuuc

SEQ ID NO: 1519618 - RNA, 17 nt, Human
agacuggaagcacagcu

SEQ ID NO: 1519619 - RNA, 19 nt, Human
agauauaugcucugcaugu

SEQ ID NO: 1519620 - RNA, 19 nt, Human
agaguggggauaugauuua

SEQ ID NO: 1519621 - RNA, 23 nt, Human
agaggguggugaccucugccuga

SEQ ID NO: 1519622 - RNA, 11 nt, Human
agagugggagc

SEQ ID NO: 1519623 - RNA, 14 nt, Human
agagugugccugaa

SEQ ID NO: 1519624 - RNA, 12 nt, Human
agagggcacaga

SEQ ID NO: 1519625 - RNA, 20 nt, Human
agaggguggugaccucugcc

SEQ ID NO: 1519626 - RNA, 22 nt, Human
agaggguggugaccucugccug

SEQ ID NO: 1519627 - RNA, 14 nt, Human
agaggacuuuucuu

SEQ ID NO: 1519628 - RNA, 15 nt, Human
agaggagagaggacc

SEQ ID NO: 1519629 - RNA, 16 nt, Human
agaggagagaggaccc

SEQ ID NO: 1519630 - RNA, 16 nt, Human
agaggaaggagaggag

SEQ ID NO: 1519631 - RNA, 15 nt, Human
agagcccaggccucc

SEQ ID NO: 1519632 - RNA, 13 nt, Human
agagcccaggccu

SEQ ID NO: 1519633 - RNA, 14 nt, Human
agagcccaggccuc

SEQ ID NO: 1519634 - RNA, 23 nt, Human
agccaagugugguagagugugcc

SEQ ID NO: 1519635 - RNA, 23 nt, Human
agcaugccuggauggggcugcac

SEQ ID NO: 1519636 - RNA, 22 nt, Human
agcauccuggcacccggccccu

SEQ ID NO: 1519637 - RNA, 23 nt, Human
agcauccuggcacccggccccug

SEQ ID NO: 1519638 - RNA, 16 nt, Human
agcaguugaaaagacu

SEQ ID NO: 1519639 - RNA, 13 nt, Human
agcaguugaaaag

SEQ ID NO: 1519640 - RNA, 21 nt, Human
agcaguugaaaagacuccaaa

SEQ ID NO: 1519641 - RNA, 18 nt, Human
agcagcguuucuaugaca

SEQ ID NO: 1519642 - RNA, 13 nt, Human
agcagcguuucua

SEQ ID NO: 1519643 - RNA, 19 nt, Human
agcagugcaugcugucccu

SEQ ID NO: 1519644 - RNA, 20 nt, Human
agcagugcaugcugucccuu

SEQ ID NO: 1519645 - RNA, 20 nt, Human
agcacagacccugcccugug

SEQ ID NO: 1519646 - RNA, 18 nt, Human
agcacagacccugcccug

SEQ ID NO: 1519647 - RNA, 19 nt, Human
agcacagacccugcccugu

SEQ ID NO: 1519648 - RNA, 13 nt, Human
agcacugacagau

SEQ ID NO: 1519649 - RNA, 14 nt, Human
agcacugacagauu

SEQ ID NO: 1519650 - RNA, 18 nt, Human
agcacugacagauuucca

SEQ ID NO: 1519651 - RNA, 16 nt, Human
agcacugacuucuaag

SEQ ID NO: 1519652 - RNA, 23 nt, Human
agcacacuugacaucaacugcau

SEQ ID NO: 1519653 - RNA, 12 nt, Human
agcacagacccu

SEQ ID NO: 1519654 - RNA, 13 nt, Human
agccgcuggggcc

SEQ ID NO: 1519655 - RNA, 21 nt, Human
agccgccaugcuccuggccca

SEQ ID NO: 1519656 - RNA, 23 nt, Human
agcccucaccccugguucucauc

SEQ ID NO: 1519657 - RNA, 21 nt, Human
agccgggcgugguggugagug

SEQ ID NO: 1519658 - RNA, 22 nt, Human
agccucccacgacugcccggca

SEQ ID NO: 1519659 - RNA, 21 nt, Human
agccucccaaagugcugggau

SEQ ID NO: 1519660 - RNA, 22 nt, Human
agccucccgaguagcugggacu

SEQ ID NO: 1519661 - RNA, 20 nt, Human
agccucccgaguagcuggga

SEQ ID NO: 1519662 - RNA, 18 nt, Human
agccucccgaguagcugg

SEQ ID NO: 1519663 - RNA, 19 nt, Human
agccucccgaguagcuggg

SEQ ID NO: 1519664 - RNA, 14 nt, Human
agccuccuccagcc

SEQ ID NO: 1519665 - RNA, 13 nt, Human
agccccagugccc

SEQ ID NO: 1519666 - RNA, 14 nt, Human
agccccagugccca

SEQ ID NO: 1519667 - RNA, 15 nt, Human
agccccagugcccac

SEQ ID NO: 1519668 - RNA, 22 nt, Human
agcccucaccccugguucucau

SEQ ID NO: 1519669 - RNA, 13 nt, Human
agccccauucugc

SEQ ID NO: 1519670 - RNA, 16 nt, Human
agccccauucugccug

SEQ ID NO: 1519671 - RNA, 18 nt, Human
agccagcaggcucucagg

SEQ ID NO: 1519672 - RNA, 19 nt, Human
agccagcaggcucucaggc

SEQ ID NO: 1519673 - RNA, 20 nt, Human
agccagcaggcucucaggcc

SEQ ID NO: 1519674 - RNA, 23 nt, Human
aggaugguucccuugaugaagaa

SEQ ID NO: 1519675 - RNA, 15 nt, Human
aggauguucugggac

SEQ ID NO: 1519676 - RNA, 16 nt, Human
aggauguucugggaca

SEQ ID NO: 1519677 - RNA, 14 nt, Human
aggauuauuggaaa

SEQ ID NO: 1519678 - RNA, 18 nt, Human
aggauguucugggacaca

SEQ ID NO: 1519679 - RNA, 23 nt, Human
aggaugcuuguacauaaugcgug

SEQ ID NO: 1519680 - RNA, 21 nt, Human
aggaugcuuguacauaaugcg

SEQ ID NO: 1519681 - RNA, 13 nt, Human
aggaccucaggug

SEQ ID NO: 1519682 - RNA, 13 nt, Human
aggaccccagcuc

SEQ ID NO: 1519683 - RNA, 20 nt, Human
aggaauccagacccggcugc

SEQ ID NO: 1519684 - RNA, 21 nt, Human
aggaaucaugugccaagcaga

SEQ ID NO: 1519685 - RNA, 17 nt, Human
aggaauccagacccggc

SEQ ID NO: 1519686 - RNA, 23 nt, Human
agcugcgguccacccaggagccc

SEQ ID NO: 1519687 - RNA, 12 nt, Human
agcuccuucugu

SEQ ID NO: 1519688 - RNA, 13 nt, Human
agcuccuucuguc

SEQ ID NO: 1519689 - RNA, 20 nt, Human
agcuccgcuuucuacccagc

SEQ ID NO: 1519690 - RNA, 21 nt, Human
agcuccgcuuucuacccagcg

SEQ ID NO: 1519691 - RNA, 23 nt, Human
agcuccgcuuucuacccagcgag

SEQ ID NO: 1519692 - RNA, 20 nt, Human
agguaaaagcaucacaugaa

SEQ ID NO: 1519693 - RNA, 18 nt, Human
aggucuguucuuuccaaa

SEQ ID NO: 1519694 - RNA, 23 nt, Human
aggucuguucuuuccaaaguaca

SEQ ID NO: 1519695 - RNA, 22 nt, Human
aggucuguucuuuccaaaguac

SEQ ID NO: 1519696 - RNA, 18 nt, Human
aggugcuacaaaaacaca

SEQ ID NO: 1519697 - RNA, 19 nt, Human
aggugcuacaaaaacacag

SEQ ID NO: 1519698 - RNA, 20 nt, Human
aggugcuacaaaaacacagc

SEQ ID NO: 1519699 - RNA, 21 nt, Human
aggugcuacaaaaacacagca

SEQ ID NO: 1519700 - RNA, 22 nt, Human
aggugcuacaaaaacacagcaa

SEQ ID NO: 1519701 - RNA, 15 nt, Human
agguuaauaaaguaa

SEQ ID NO: 1519702 - RNA, 23 nt, Human
aggugcuaggaacacuccuucac

SEQ ID NO: 1519703 - RNA, 19 nt, Human
aggugcuaggaacacuccu

SEQ ID NO: 1519704 - RNA, 22 nt, Human
aggugcuaggaacacuccuuca

SEQ ID NO: 1519705 - RNA, 23 nt, Human
aggugcuacaaaaacacagcaag

SEQ ID NO: 1519706 - RNA, 24 nt, Human
aggugcuacaaaaacacagcaagg

SEQ ID NO: 1519707 - RNA, 15 nt, Human
agguucaaagauauu

SEQ ID NO: 1519708 - RNA, 14 nt, Human
agguucaaagauau

SEQ ID NO: 1519709 - RNA, 22 nt, Human
agguucccuuugacgccauccc

SEQ ID NO: 1519710 - RNA, 23 nt, Human
agguucccuuugacgccauccca

SEQ ID NO: 1519711 - RNA, 19 nt, Human
aggguaucaggugcugcca

SEQ ID NO: 1519712 - RNA, 21 nt, Human
aggguaucaggugcugccauc

SEQ ID NO: 1519713 - RNA, 15 nt, Human
aggguaucuggugac

SEQ ID NO: 1519714 - RNA, 19 nt, Human
aggggccucuuaugggcug

SEQ ID NO: 1519715 - RNA, 20 nt, Human
aggggccucuuaugggcugg

SEQ ID NO: 1519716 - RNA, 21 nt, Human
aggggccucuuaugggcuggg

SEQ ID NO: 1519717 - RNA, 11 nt, Human
agggucccugg

SEQ ID NO: 1519718 - RNA, 20 nt, Human
agggacaggaccccagcucu

SEQ ID NO: 1519719 - RNA, 17 nt, Human
agggacaggaccccagc

SEQ ID NO: 1519720 - RNA, 18 nt, Human
agggacaggaccccagcu

SEQ ID NO: 1519721 - RNA, 13 nt, Human
agggacaggaccc

SEQ ID NO: 1519722 - RNA, 16 nt, Human
agggacaggaccccag

SEQ ID NO: 1519723 - RNA, 23 nt, Human
agggacagaggggguggccuccc

SEQ ID NO: 1519724 - RNA, 21 nt, Human
aggcugucaauuacaggaagu

SEQ ID NO: 1519725 - RNA, 22 nt, Human
agggacagaggggguggccucc

SEQ ID NO: 1519726 - RNA, 15 nt, Human
aggcuagauguaugu

SEQ ID NO: 1519727 - RNA, 16 nt, Human
aggcuagauguaugua

SEQ ID NO: 1519728 - RNA, 17 nt, Human
aggcuagauguauguac

SEQ ID NO: 1519729 - RNA, 22 nt, Human
aggcugguucggauuuggggug

SEQ ID NO: 1519730 - RNA, 20 nt, Human
aggcugucaauuacaggaag

SEQ ID NO: 1519731 - RNA, 13 nt, Human
aggcuguauccca

SEQ ID NO: 1519732 - RNA, 18 nt, Human
aggcuguaucccaugagc

SEQ ID NO: 1519733 - RNA, 17 nt, Human
agggacgcuacccggga

SEQ ID NO: 1519734 - RNA, 17 nt, Human
aggcuacugucagcucc

SEQ ID NO: 1519735 - RNA, 18 nt, Human
aggcuaaagcccagagac

SEQ ID NO: 1519736 - RNA, 21 nt, Human
aggcuagaaccaccugccuau

SEQ ID NO: 1519737 - RNA, 20 nt, Human
aggcccuucucuccagcccc

SEQ ID NO: 1519738 - RNA, 21 nt, Human
aggcccuucucuccagccccu

SEQ ID NO: 1519739 - RNA, 22 nt, Human
aggcccuucucuccagccccug

SEQ ID NO: 1519740 - RNA, 23 nt, Human
aggcccuucucuccagccccugg

SEQ ID NO: 1519741 - RNA, 16 nt, Human
accccuccaugugggc

SEQ ID NO: 1519742 - RNA, 19 nt, Human
accccuccaugugggcuag

SEQ ID NO: 1519743 - RNA, 16 nt, Human
acccaccucagccucc

SEQ ID NO: 1519744 - RNA, 11 nt, Human
acccccugaau

SEQ ID NO: 1519745 - RNA, 18 nt, Human
acccaagggccuggccug

SEQ ID NO: 1519746 - RNA, 19 nt, Human
acccaagggccuggccuga

SEQ ID NO: 1519747 - RNA, 22 nt, Human
acccaagggccuggccugagcu

SEQ ID NO: 1519748 - RNA, 20 nt, Human
accauauuaccacagacaua

SEQ ID NO: 1519749 - RNA, 21 nt, Human
acccacaagaaaugaaagcag

SEQ ID NO: 1519750 - RNA, 17 nt, Human
acccacaagaaaugaaa

SEQ ID NO: 1519751 - RNA, 23 nt, Human
acccaagggccuggccugagcug

SEQ ID NO: 1519752 - RNA, 13 nt, Human
acccaccucagcc

SEQ ID NO: 1519753 - RNA, 14 nt, Human
acccaccucagccu

SEQ ID NO: 1519754 - RNA, 15 nt, Human
acccaccucagccuc

SEQ ID NO: 1519755 - RNA, 16 nt, Human
accauauuaccacaga

SEQ ID NO: 1519756 - RNA, 14 nt, Human
accauauuaccaca

SEQ ID NO: 1519757 - RNA, 13 nt, Human
accagcagaaaug

SEQ ID NO: 1519758 - RNA, 17 nt, Human
accagccaguaaauggg

SEQ ID NO: 1519759 - RNA, 12 nt, Human
accaagcccagu

SEQ ID NO: 1519760 - RNA, 15 nt, Human
acauuuauucugcuc

SEQ ID NO: 1519761 - RNA, 14 nt, Human
acaggcacccacca

SEQ ID NO: 1519762 - RNA, 19 nt, Human
acaggcaaugcuggcuguu

SEQ ID NO: 1519763 - RNA, 23 nt, Human
acaggcaaugcuggcuguuggcu

SEQ ID NO: 1519764 - RNA, 19 nt, Human
acaggguuuugccauguug

SEQ ID NO: 1519765 - RNA, 22 nt, Human
acauaaugcgugcauaccacuu

SEQ ID NO: 1519766 - RNA, 23 nt, Human
acauaaugcgugcauaccacuuu

SEQ ID NO: 1519767 - RNA, 19 nt, Human
acaucagcacgauuucugu

SEQ ID NO: 1519768 - RNA, 18 nt, Human
acaucagcacgauuucug

SEQ ID NO: 1519769 - RNA, 17 nt, Human
acaucagcacgauuucu

SEQ ID NO: 1519770 - RNA, 15 nt, Human
acaucagcacgauuu

SEQ ID NO: 1519771 - RNA, 16 nt, Human
acaugugcacaugcac

SEQ ID NO: 1519772 - RNA, 18 nt, Human
acaugugcacaugcacgu

SEQ ID NO: 1519773 - RNA, 21 nt, Human
acagagugagacucugucuca

SEQ ID NO: 1519774 - RNA, 14 nt, Human
acagaggggguggc

SEQ ID NO: 1519775 - RNA, 15 nt, Human
acagagugagacucu

SEQ ID NO: 1519776 - RNA, 19 nt, Human
acagagugagacucugucu

SEQ ID NO: 1519777 - RNA, 21 nt, Human
acagcaguugaaaagacucca

SEQ ID NO: 1519778 - RNA, 22 nt, Human
acagcaguugaaaagacuccaa

SEQ ID NO: 1519779 - RNA, 23 nt, Human
acagcaguugaaaagacuccaaa

SEQ ID NO: 1519780 - RNA, 11 nt, Human
acagacacagg

SEQ ID NO: 1519781 - RNA, 13 nt, Human
acagacaaagcgu

SEQ ID NO: 1519782 - RNA, 15 nt, Human
acacuguacugcaau

SEQ ID NO: 1519783 - RNA, 15 nt, Human
acagacacaggcccg

SEQ ID NO: 1519784 - RNA, 19 nt, Human
acagaggcagccccauucu

SEQ ID NO: 1519785 - RNA, 23 nt, Human
acagaggcagccccauucugccu

SEQ ID NO: 1519786 - RNA, 13 nt, Human
acagacacaggcc

SEQ ID NO: 1519787 - RNA, 14 nt, Human
acagacacaggccc

SEQ ID NO: 1519788 - RNA, 15 nt, Human
acagaggcagcccca

SEQ ID NO: 1519789 - RNA, 19 nt, Human
acacugcuuguguuuuuaa

SEQ ID NO: 1519790 - RNA, 23 nt, Human
acacugcuuguguuuuuaacuca

SEQ ID NO: 1519791 - RNA, 15 nt, Human
acacugcauguuugu

SEQ ID NO: 1519792 - RNA, 14 nt, Human
acacugcauguuug

SEQ ID NO: 1519793 - RNA, 12 nt, Human
acaggcaagcac

SEQ ID NO: 1519794 - RNA, 15 nt, Human
acaggcaagcaccuc

SEQ ID NO: 1519795 - RNA, 16 nt, Human
acagcucuucuccagg

SEQ ID NO: 1519796 - RNA, 17 nt, Human
acagcucuucuccaggc

SEQ ID NO: 1519797 - RNA, 18 nt, Human
acagcucuucuccaggcu

SEQ ID NO: 1519798 - RNA, 19 nt, Human
acagccacggccaggccag

SEQ ID NO: 1519799 - RNA, 18 nt, Human
acagccacggccaggcca

SEQ ID NO: 1519800 - RNA, 15 nt, Human
acagccacggccagg

SEQ ID NO: 1519801 - RNA, 16 nt, Human
acagccacggccaggc

SEQ ID NO: 1519802 - RNA, 17 nt, Human
acagccacggccaggcc

SEQ ID NO: 1519803 - RNA, 13 nt, Human
aauuuugugaagc

SEQ ID NO: 1519804 - RNA, 16 nt, Human
acaaacaaaauuucua

SEQ ID NO: 1519805 - RNA, 18 nt, Human
acaaacaaaauuucuauu

SEQ ID NO: 1519806 - RNA, 19 nt, Human
acaaacaaaauuucuauua

SEQ ID NO: 1519807 - RNA, 14 nt, Human
acaaaauuucuauu

SEQ ID NO: 1519808 - RNA, 22 nt, Human
acaaaauguaggguuauaauaa

SEQ ID NO: 1519809 - RNA, 13 nt, Human
acaagaaaugaaa

SEQ ID NO: 1519810 - RNA, 17 nt, Human
acaaggauugcuacugu

SEQ ID NO: 1519811 - RNA, 12 nt, Human
acaaggcaaggc

SEQ ID NO: 1519812 - RNA, 14 nt, Human
acaaggcaaggcug

SEQ ID NO: 1519813 - RNA, 15 nt, Human
acaaggcaaggcugu

SEQ ID NO: 1519814 - RNA, 20 nt, Human
acacagcucuguccugggag

SEQ ID NO: 1519815 - RNA, 19 nt, Human
acacagaggcugccucucc

SEQ ID NO: 1519816 - RNA, 22 nt, Human
acacauuuuuuaaaugcaccug

SEQ ID NO: 1519817 - RNA, 20 nt, Human
acacauuuuuuaaaugcacc

SEQ ID NO: 1519818 - RNA, 12 nt, Human
acacauuuuucu

SEQ ID NO: 1519819 - RNA, 22 nt, Human
acacauuuuauuuuauuaugca

SEQ ID NO: 1519820 - RNA, 11 nt, Human
acacagcucuu

SEQ ID NO: 1519821 - RNA, 13 nt, Human
acacagcucuucu

SEQ ID NO: 1519822 - RNA, 19 nt, Human
acacgagcaggcuacuguc

SEQ ID NO: 1519823 - RNA, 21 nt, Human
acacgagcaggcuacugucag

SEQ ID NO: 1519824 - RNA, 15 nt, Human
acacgcgugcacaca

SEQ ID NO: 1519825 - RNA, 17 nt, Human
acacgcgugcacacacc

SEQ ID NO: 1519826 - RNA, 16 nt, Human
accugucccccugaca

SEQ ID NO: 1519827 - RNA, 12 nt, Human
accugucccccu

SEQ ID NO: 1519828 - RNA, 15 nt, Human
accugucccccugac

SEQ ID NO: 1519829 - RNA, 17 nt, Human
accuuggcugcagggag

SEQ ID NO: 1519830 - RNA, 18 nt, Human
accuuggcugcagggagu

SEQ ID NO: 1519831 - RNA, 13 nt, Human
accuuucccaucu

SEQ ID NO: 1519832 - RNA, 18 nt, Human
accuuucccaucuuccaa

SEQ ID NO: 1519833 - RNA, 15 nt, Human
accuuuaagagaaau

SEQ ID NO: 1519834 - RNA, 20 nt, Human
accucugcagcaauaaagca

SEQ ID NO: 1519835 - RNA, 18 nt, Human
accucugcagcaauaaag

SEQ ID NO: 1519836 - RNA, 21 nt, Human
accucugcagcaauaaagcag

SEQ ID NO: 1519837 - RNA, 14 nt, Human
acggaacucaaaua

SEQ ID NO: 1519838 - RNA, 13 nt, Human
acgucugacaggc

SEQ ID NO: 1519839 - RNA, 14 nt, Human
acgucugacaggca

SEQ ID NO: 1519840 - RNA, 15 nt, Human
acgucugacaggcaa

SEQ ID NO: 1519841 - RNA, 15 nt, Human
acgcugugcugcccu

SEQ ID NO: 1519842 - RNA, 11 nt, Human
acgcugugcug

SEQ ID NO: 1519843 - RNA, 12 nt, Human
acgcugugcugc

SEQ ID NO: 1519844 - RNA, 14 nt, Human
acgcugugcugccc

SEQ ID NO: 1519845 - RNA, 22 nt, Human
acgcaggcccccaggugccagu

SEQ ID NO: 1519846 - RNA, 13 nt, Human
acuaagagagaau

SEQ ID NO: 1519847 - RNA, 15 nt, Human
acuaagagagaauga

SEQ ID NO: 1519848 - RNA, 11 nt, Human
acgugaguccu

SEQ ID NO: 1519849 - RNA, 20 nt, Human
acuaguauuucuaugaaaua

SEQ ID NO: 1519850 - RNA, 21 nt, Human
acuauucaaacagucucagga

SEQ ID NO: 1519851 - RNA, 22 nt, Human
acuauucaggagaguagaacag

SEQ ID NO: 1519852 - RNA, 13 nt, Human
acucaaaagcugg

SEQ ID NO: 1519853 - RNA, 18 nt, Human
acucaaaagcugggcagg

SEQ ID NO: 1519854 - RNA, 19 nt, Human
acucaguccauagcagaga

SEQ ID NO: 1519855 - RNA, 15 nt, Human
acucauauuuucaug

SEQ ID NO: 1519856 - RNA, 23 nt, Human
acucuaucaaguauuauaccuuu

SEQ ID NO: 1519857 - RNA, 17 nt, Human
acucuauguucuaagaa

SEQ ID NO: 1519858 - RNA, 19 nt, Human
acucugucgcccagucugg

SEQ ID NO: 1519859 - RNA, 15 nt, Human
acucuagggaaaaac

SEQ ID NO: 1519860 - RNA, 17 nt, Human
acucuagggaaaaacca

SEQ ID NO: 1519861 - RNA, 19 nt, Human
acuguaagaaaauaucacu

SEQ ID NO: 1519862 - RNA, 13 nt, Human
acuguaagaaaau

SEQ ID NO: 1519863 - RNA, 22 nt, Human
acuguaagaaaauaucacuugu

SEQ ID NO: 1519864 - RNA, 18 nt, Human
acugguuccauggccucu

SEQ ID NO: 1519865 - RNA, 22 nt, Human
acugugaaguuuacauuguaaa

SEQ ID NO: 1519866 - RNA, 14 nt, Human
acugguauuuuauc

SEQ ID NO: 1519867 - RNA, 15 nt, Human
acuggagaaaaugga

SEQ ID NO: 1519868 - RNA, 19 nt, Human
acuggaagcacagcuucau

SEQ ID NO: 1519869 - RNA, 17 nt, Human
acuggaagcacagcuuc

SEQ ID NO: 1519870 - RNA, 13 nt, Human
acugccagcaacg

SEQ ID NO: 1519871 - RNA, 20 nt, Human
acucugucucaguccaugaa

SEQ ID NO: 1519872 - RNA, 18 nt, Human
acucugucucaguccaug

SEQ ID NO: 1519873 - RNA, 18 nt, Human
acuuguaaaggaauuuaa

SEQ ID NO: 1519874 - RNA, 16 nt, Human
acuugguuuuuaaaaa

SEQ ID NO: 1519875 - RNA, 14 nt, Human
acuugggccacugu

SEQ ID NO: 1519876 - RNA, 15 nt, Human
acuugggccacugug

SEQ ID NO: 1519877 - RNA, 22 nt, Human
acuucugucuucacaacagauu

SEQ ID NO: 1519878 - RNA, 12 nt, Human
acuucagacaua

SEQ ID NO: 1519879 - RNA, 16 nt, Human
acuucuggguggggca

SEQ ID NO: 1519880 - RNA, 17 nt, Human
acuucuggguggggcag

SEQ ID NO: 1519881 - RNA, 21 nt, Human
acuucugucuucacaacagau

SEQ ID NO: 1519882 - RNA, 22 nt, Human
acugugcugagucugaaggcug

SEQ ID NO: 1519883 - RNA, 20 nt, Human
acugugcugagucugaaggc

SEQ ID NO: 1519884 - RNA, 14 nt, Human
acuuuuggaaggua

SEQ ID NO: 1519885 - RNA, 14 nt, Human
acuuuucuuugugg

SEQ ID NO: 1519886 - RNA, 19 nt, Human
agaaaauaguggugugauu

SEQ ID NO: 1519887 - RNA, 15 nt, Human
agaaaauaccaagga

SEQ ID NO: 1519888 - RNA, 16 nt, Human
agaaaaucaggcuggc

SEQ ID NO: 1519889 - RNA, 15 nt, Human
acuuuuauaaacuuu

SEQ ID NO: 1519890 - RNA, 20 nt, Human
acuuuucauaaccuagccuu

SEQ ID NO: 1519891 - RNA, 16 nt, Human
acuuuucuuucagcca

SEQ ID NO: 1519892 - RNA, 13 nt, Human
acuuuuauaaacu

SEQ ID NO: 1519893 - RNA, 20 nt, Human
acuuuguucuggcucuucca

SEQ ID NO: 1519894 - RNA, 19 nt, Human
acuuuguucuggcucuucc

SEQ ID NO: 1519895 - RNA, 22 nt, Human
acuuuauuuucuauaauuuaaa

SEQ ID NO: 1519896 - RNA, 16 nt, Human
acuuuguucuggcucu

SEQ ID NO: 1519897 - RNA, 17 nt, Human
acuuuguucuggcucuu

SEQ ID NO: 1519898 - RNA, 20 nt, Human
acuuuauacccagaaaguua

SEQ ID NO: 1519899 - RNA, 22 nt, Human
acuuuauacccagaaaguuauu

SEQ ID NO: 1519900 - RNA, 23 nt, Human
agaaaguuauugauaaguucaua

SEQ ID NO: 1519901 - RNA, 11 nt, Human
agaaaguuauu

SEQ ID NO: 1519902 - RNA, 23 nt, Human
agaaaguacuucuccacccugcu

SEQ ID NO: 1519903 - RNA, 22 nt, Human
agaaaguacuucuccacccugc

SEQ ID NO: 1519904 - RNA, 23 nt, Human
aauguuucaaacauauauaacaa

SEQ ID NO: 1519905 - RNA, 15 nt, Human
aauguuugccucugc

SEQ ID NO: 1519906 - RNA, 16 nt, Human
aauguuugccucugcc

SEQ ID NO: 1519907 - RNA, 17 nt, Human
aaugugaaaagaaaaau

SEQ ID NO: 1519908 - RNA, 15 nt, Human
aaugugaaaagaaaa

SEQ ID NO: 1519909 - RNA, 21 nt, Human
aaugcuggcuguuggcugggg

SEQ ID NO: 1519910 - RNA, 21 nt, Human
aaugcuagguuaauuccaauu

SEQ ID NO: 1519911 - RNA, 19 nt, Human
aaugcgugcauaccacuuu

SEQ ID NO: 1519912 - RNA, 18 nt, Human
aaugcuagguuaauucca

SEQ ID NO: 1519913 - RNA, 19 nt, Human
aaugcuagguuaauuccaa

SEQ ID NO: 1519914 - RNA, 18 nt, Human
aaugcgugcauaccacuu

SEQ ID NO: 1519915 - RNA, 23 nt, Human
aaugccuuacccucauguucuua

SEQ ID NO: 1519916 - RNA, 13 nt, Human
aauacucuuauau

SEQ ID NO: 1519917 - RNA, 20 nt, Human
aauacucuacccucuuagaa

SEQ ID NO: 1519918 - RNA, 22 nt, Human
aauacucuacccucuuagaaaa

SEQ ID NO: 1519919 - RNA, 13 nt, Human
aauauguuucaaa

SEQ ID NO: 1519920 - RNA, 15 nt, Human
aauauguuucaaacu

SEQ ID NO: 1519921 - RNA, 16 nt, Human
aauauguuucaaacuu

SEQ ID NO: 1519922 - RNA, 17 nt, Human
aauauguuucaaacuuu

SEQ ID NO: 1519923 - RNA, 13 nt, Human
aauagacaauuua

SEQ ID NO: 1519924 - RNA, 22 nt, Human
aauauuauaacucauuuguugu

SEQ ID NO: 1519925 - RNA, 15 nt, Human
aaucaccaaaggcuc

SEQ ID NO: 1519926 - RNA, 14 nt, Human
aaucaccgaaaacg

SEQ ID NO: 1519927 - RNA, 15 nt, Human
aaucaccgaaaacgu

SEQ ID NO: 1519928 - RNA, 21 nt, Human
aaugauuaugaauuacauuug

SEQ ID NO: 1519929 - RNA, 23 nt, Human
aaugauuaugaauuacauuugua

SEQ ID NO: 1519930 - RNA, 15 nt, Human
aaugauuaugaauua

SEQ ID NO: 1519931 - RNA, 16 nt, Human
aaucucaaauuucuaa

SEQ ID NO: 1519932 - RNA, 15 nt, Human
aauccaaugaaauga

SEQ ID NO: 1519933 - RNA, 19 nt, Human
aauccagacccggcugcgu

SEQ ID NO: 1519934 - RNA, 18 nt, Human
aaucucaaauuucuaaau

SEQ ID NO: 1519935 - RNA, 17 nt, Human
aaucucaaauuucuaaa

SEQ ID NO: 1519936 - RNA, 19 nt, Human
aaguagaagucuuagaugu

SEQ ID NO: 1519937 - RNA, 20 nt, Human
aaguagaagucuuagaugua

SEQ ID NO: 1519938 - RNA, 21 nt, Human
aaguagaagucuuagauguau

SEQ ID NO: 1519939 - RNA, 21 nt, Human
aaguagggacuucugucuuca

SEQ ID NO: 1519940 - RNA, 23 nt, Human
aaguaucccuacuguaauuugug

SEQ ID NO: 1519941 - RNA, 18 nt, Human
aaguaucccuacuguaau

SEQ ID NO: 1519942 - RNA, 18 nt, Human
aaguccaagcauuuagau

SEQ ID NO: 1519943 - RNA, 17 nt, Human
aaguccaagcauaccaa

SEQ ID NO: 1519944 - RNA, 18 nt, Human
aaguccucuuuucugaga

SEQ ID NO: 1519945 - RNA, 22 nt, Human
aaguccucuuuucugagaggac

SEQ ID NO: 1519946 - RNA, 19 nt, Human
aaggucauuuuuuuuaaga

SEQ ID NO: 1519947 - RNA, 18 nt, Human
aaggucauuuuuuuuaag

SEQ ID NO: 1519948 - RNA, 18 nt, Human
aagggacgcuacccggga

SEQ ID NO: 1519949 - RNA, 23 nt, Human
aagggaaacugccagcaacgcag

SEQ ID NO: 1519950 - RNA, 16 nt, Human
aagggaaacugccagc

SEQ ID NO: 1519951 - RNA, 17 nt, Human
aagggaaacugccagca

SEQ ID NO: 1519952 - RNA, 12 nt, Human
aaguugaauuuu

SEQ ID NO: 1519953 - RNA, 21 nt, Human
aaguggaaaaauagccugccu

SEQ ID NO: 1519954 - RNA, 19 nt, Human
aaguggaaaaauagccugc

SEQ ID NO: 1519955 - RNA, 18 nt, Human
aagcuggucccacucagu

SEQ ID NO: 1519956 - RNA, 21 nt, Human
aagcuggucccacucagucca

SEQ ID NO: 1519957 - RNA, 20 nt, Human
aaggcagcucuaaaugucaa

SEQ ID NO: 1519958 - RNA, 20 nt, Human
aaggcagggagcgagggaga

SEQ ID NO: 1519959 - RNA, 15 nt, Human
aaggauguucuagca

SEQ ID NO: 1519960 - RNA, 15 nt, Human
aaggauugcuacugu

SEQ ID NO: 1519961 - RNA, 21 nt, Human
aagcgauucuucugcuucagc

SEQ ID NO: 1519962 - RNA, 14 nt, Human
aagauacugaaaua

SEQ ID NO: 1519963 - RNA, 17 nt, Human
aagauuacuuuuucuuu

SEQ ID NO: 1519964 - RNA, 13 nt, Human
aagauacugaaau

SEQ ID NO: 1519965 - RNA, 12 nt, Human
aagauaaaugug

SEQ ID NO: 1519966 - RNA, 13 nt, Human
aagauaaaugugc

SEQ ID NO: 1519967 - RNA, 14 nt, Human
aagauaaaugugcu

SEQ ID NO: 1519968 - RNA, 11 nt, Human
aacuuucauuu

SEQ ID NO: 1519969 - RNA, 14 nt, Human
aacuuucauuuuuu

SEQ ID NO: 1519970 - RNA, 17 nt, Human
aacuuucauuuuuuucc

SEQ ID NO: 1519971 - RNA, 20 nt, Human
aagccagcaggcucucaggc

SEQ ID NO: 1519972 - RNA, 23 nt, Human
aagccagcaggcucucaggccag

SEQ ID NO: 1519973 - RNA, 20 nt, Human
aagcagcguuucuaugacac

SEQ ID NO: 1519974 - RNA, 17 nt, Human
aagcagcguuucuauga

SEQ ID NO: 1519975 - RNA, 14 nt, Human
aagcagcguuucua

SEQ ID NO: 1519976 - RNA, 17 nt, Human
aagcagauggaaugcug

SEQ ID NO: 1519977 - RNA, 19 nt, Human
aagcagauggaaugcugug

SEQ ID NO: 1519978 - RNA, 20 nt, Human
aagcagauggaaugcugugu

SEQ ID NO: 1519979 - RNA, 22 nt, Human
aagcagcguuucuaugacacau

SEQ ID NO: 1519980 - RNA, 21 nt, Human
aagcagcguuucuaugacaca

SEQ ID NO: 1519981 - RNA, 14 nt, Human
aagccacagcuggu

SEQ ID NO: 1519982 - RNA, 14 nt, Human
aagccacaggccug

SEQ ID NO: 1519983 - RNA, 15 nt, Human
aagccacaggccuga

SEQ ID NO: 1519984 - RNA, 17 nt, Human
aagccacaggccugaga

SEQ ID NO: 1519985 - RNA, 19 nt, Human
aagccacaggccugagauu

SEQ ID NO: 1519986 - RNA, 22 nt, Human
aagccacaggccugagauuuca

SEQ ID NO: 1519987 - RNA, 23 nt, Human
aagccacaggccugagauuucau

SEQ ID NO: 1519988 - RNA, 15 nt, Human
aaauauuuauuuuaa

SEQ ID NO: 1519989 - RNA, 13 nt, Human
aaauauuuauuuu

SEQ ID NO: 1519990 - RNA, 20 nt, Human
aaauauuuauuuuaauaaug

SEQ ID NO: 1519991 - RNA, 12 nt, Human
aaaucaaauaug

SEQ ID NO: 1519992 - RNA, 14 nt, Human
aaaucaaauaugca

SEQ ID NO: 1519993 - RNA, 15 nt, Human
aaaucaaauaugcaa

SEQ ID NO: 1519994 - RNA, 16 nt, Human
aaaucaaauaugcaaa

SEQ ID NO: 1519995 - RNA, 17 nt, Human
aaauagcuuuuuucucu

SEQ ID NO: 1519996 - RNA, 20 nt, Human
aaauagcuuuuuucucugau

SEQ ID NO: 1519997 - RNA, 24 nt, Human
aaauagcucaggugucccugcacu

SEQ ID NO: 1519998 - RNA, 16 nt, Human
aaagccuccuccagcc

SEQ ID NO: 1519999 - RNA, 15 nt, Human
aaaggcuccaggagc

SEQ ID NO: 1520000 - RNA, 16 nt, Human
aaaggcuccaggagca

SEQ ID NO: 1520001 - RNA, 14 nt, Human
aaaggcagaagcaa

SEQ ID NO: 1520002 - RNA, 19 nt, Human
aaaggcagaagcaacccaa

SEQ ID NO: 1520003 - RNA, 19 nt, Human
aaauaaaacuuuuuaaaau

SEQ ID NO: 1520004 - RNA, 16 nt, Human
aaauaaaacuuuuuaa

SEQ ID NO: 1520005 - RNA, 13 nt, Human
aaauaaaacuuuu

SEQ ID NO: 1520006 - RNA, 19 nt, Human
aaaggcuccaggagcagcc

SEQ ID NO: 1520007 - RNA, 20 nt, Human
aaaggcuccaggagcagcca

SEQ ID NO: 1520008 - RNA, 13 nt, Human
aaaguggaaaaau

SEQ ID NO: 1520009 - RNA, 13 nt, Human
aaaaguugaauuu

SEQ ID NO: 1520010 - RNA, 17 nt, Human
aaaauaaaacuuuuuaa

SEQ ID NO: 1520011 - RNA, 18 nt, Human
aaaaguucugcagauaaa

SEQ ID NO: 1520012 - RNA, 17 nt, Human
aaaaucaguuguacagu

SEQ ID NO: 1520013 - RNA, 21 nt, Human
aaaaucuacacuccagugaga

SEQ ID NO: 1520014 - RNA, 16 nt, Human
aaaaagaaacauuugg

SEQ ID NO: 1520015 - RNA, 15 nt, Human
aaaaagaaaggaggg

SEQ ID NO: 1520016 - RNA, 24 nt, Human
aaacacucaguuguucaauaauaa

SEQ ID NO: 1520017 - RNA, 16 nt, Human
aaacacuguucucugc

SEQ ID NO: 1520018 - RNA, 12 nt, Human
aaaauugaugug

SEQ ID NO: 1520019 - RNA, 14 nt, Human
aaaauugauguguu

SEQ ID NO: 1520020 - RNA, 21 nt, Human
aaaauugauguguuuauuuau

SEQ ID NO: 1520021 - RNA, 16 nt, Human
aaaaucucaauauuuc

SEQ ID NO: 1520022 - RNA, 17 nt, Human
aaaaucucaauauuuca

SEQ ID NO: 1520023 - RNA, 22 nt, Human
aaaaucucaaauuucuaaaucu

SEQ ID NO: 1520024 - RNA, 19 nt, Human
aaaaucucaaauuucuaaa

SEQ ID NO: 1520025 - RNA, 22 nt, Human
aaacugagauccuuccuuuuga

SEQ ID NO: 1520026 - RNA, 21 nt, Human
aaacugagaugugaacacauc

SEQ ID NO: 1520027 - RNA, 23 nt, Human
aaacugagaugugaacacaucag

SEQ ID NO: 1520028 - RNA, 14 nt, Human
aaagaguaggaaga

SEQ ID NO: 1520029 - RNA, 15 nt, Human
aaagaaauguaaggg

SEQ ID NO: 1520030 - RNA, 16 nt, Human
aaagauauuuugcuuu

SEQ ID NO: 1520031 - RNA, 12 nt, Human
aaagauauuuug

SEQ ID NO: 1520032 - RNA, 20 nt, Human
aaagauauuuugcuuuguga

SEQ ID NO: 1520033 - RNA, 17 nt, Human
aaagauauuuugcuuug

SEQ ID NO: 1520034 - RNA, 20 nt, Human
aaaccauuaugaagaagaga

SEQ ID NO: 1520035 - RNA, 18 nt, Human
aaacucuccucugcugcu

SEQ ID NO: 1520036 - RNA, 18 nt, Human
aaaccaucauugaaaucu

SEQ ID NO: 1520037 - RNA, 17 nt, Human
aaccuagggugauauua

SEQ ID NO: 1520038 - RNA, 21 nt, Human
aaccgaacugauguaaguaaa

SEQ ID NO: 1520039 - RNA, 13 nt, Human
aaccacgcuggac

SEQ ID NO: 1520040 - RNA, 15 nt, Human
aaccacuucagcuga

SEQ ID NO: 1520041 - RNA, 16 nt, Human
aacacaucagcuugcc

SEQ ID NO: 1520042 - RNA, 13 nt, Human
aacaacauguaua

SEQ ID NO: 1520043 - RNA, 18 nt, Human
aacaaauuuacagagaca

SEQ ID NO: 1520044 - RNA, 17 nt, Human
aaaucuuauaauuuaaa

SEQ ID NO: 1520045 - RNA, 22 nt, Human
aaauguuguucucuucuuuaaa

SEQ ID NO: 1520046 - RNA, 22 nt, Human
aaauugacacuuaaaaaugguu

SEQ ID NO: 1520047 - RNA, 19 nt, Human
aaauugacacuuaaaaaug

SEQ ID NO: 1520048 - RNA, 12 nt, Human
aaauuaacacug

SEQ ID NO: 1520049 - RNA, 13 nt, Human
aaauuaacacugc

SEQ ID NO: 1520050 - RNA, 21 nt, Human
aaauuaacacugcuuguguuu

SEQ ID NO: 1520051 - RNA, 13 nt, Human
aaauucuuucauu

SEQ ID NO: 1520052 - RNA, 21 nt, Human
aaauucuugcaaaguaucccu

SEQ ID NO: 1520053 - RNA, 15 nt, Human
aacugacucuuaaga

SEQ ID NO: 1520054 - RNA, 18 nt, Human
aacugacucuuaagaaga

SEQ ID NO: 1520055 - RNA, 19 nt, Human
aacugacucuuaagaagac

SEQ ID NO: 1520056 - RNA, 20 nt, Human
aacugacucuuaagaagacu

SEQ ID NO: 1520057 - RNA, 20 nt, Human
aacugagaugugaacacauc

SEQ ID NO: 1520058 - RNA, 18 nt, Human
aacugagauccuuccuuu

SEQ ID NO: 1520059 - RNA, 23 nt, Human
aacugagaugugaacacaucagc

SEQ ID NO: 1520060 - RNA, 14 nt, Human
aacugauaaagaug

SEQ ID NO: 1520061 - RNA, 16 nt, Human
aacuuaaucuaaaugg

SEQ ID NO: 1520062 - RNA, 15 nt, Human
aacuuaaucuaaaug

SEQ ID NO: 1520063 - RNA, 18 nt, Human
aacuuaaucuaaauggaa

SEQ ID NO: 1520064 - RNA, 21 nt, Human
aacuuuaugcuaagugaaaua

SEQ ID NO: 1520065 - RNA, 20 nt, Human
aacuuuaugcuaagugaaau

SEQ ID NO: 1520066 - RNA, 22 nt, Human
aacuuuauacccagaaaguuau

SEQ ID NO: 1520067 - RNA, 23 nt, Human
aacuuuauacccagaaaguuauu

SEQ ID NO: 1520068 - RNA, 13 nt, Human
aaaaacacagcaa

SEQ ID NO: 1520069 - RNA, 18 nt, Human
aaaaacacagcaagggug

SEQ ID NO: 1520070 - RNA, 15 nt, Human
aaaaaauauuuuccu

SEQ ID NO: 1520071 - RNA, 14 nt, Human
caccccggccaccu

SEQ ID NO: 1520072 - RNA, 15 nt, Human
caccccggccaccug

SEQ ID NO: 1520073 - RNA, 16 nt, Human
caccccggccaccugc

SEQ ID NO: 1520074 - RNA, 17 nt, Human
caccccggccaccugcg

SEQ ID NO: 1520075 - RNA, 15 nt, Human
caccccgagggcuga

SEQ ID NO: 1520076 - RNA, 16 nt, Human
cacccccuccccgccc

SEQ ID NO: 1520077 - RNA, 22 nt, Human
cacccccacccaagggccuggc

SEQ ID NO: 1520078 - RNA, 19 nt, Human
cacccaagggccuggccug

SEQ ID NO: 1520079 - RNA, 20 nt, Human
cacccaagggccuggccuga

SEQ ID NO: 1520080 - RNA, 21 nt, Human
cacccaagggccuggccugag

SEQ ID NO: 1520081 - RNA, 23 nt, Human
cacccaagggccuggccugagcu

SEQ ID NO: 1520082 - RNA, 17 nt, Human
cacccaagggccuggcc

SEQ ID NO: 1520083 - RNA, 18 nt, Human
cacccaagggccuggccu

SEQ ID NO: 1520084 - RNA, 20 nt, Human
cacccaccaucaugucuggc

SEQ ID NO: 1520085 - RNA, 22 nt, Human
cacccaccaucaugucuggcua

SEQ ID NO: 1520086 - RNA, 12 nt, Human
cacccaccucag

SEQ ID NO: 1520087 - RNA, 13 nt, Human
cacccaccucagc

SEQ ID NO: 1520088 - RNA, 14 nt, Human
cacccaccucagcc

SEQ ID NO: 1520089 - RNA, 16 nt, Human
cacccaccucagccuc

SEQ ID NO: 1520090 - RNA, 13 nt, Human
caccccagcccca

SEQ ID NO: 1520091 - RNA, 16 nt, Human
caaaaaaugcuugcuu

SEQ ID NO: 1520092 - RNA, 23 nt, Human
caaaaaaauauauuuaaugauaa

SEQ ID NO: 1520093 - RNA, 18 nt, Human
auuuuuuuacuaauagac

SEQ ID NO: 1520094 - RNA, 16 nt, Human
caaaggaguagaaaga

SEQ ID NO: 1520095 - RNA, 12 nt, Human
caaaggaagcac

SEQ ID NO: 1520096 - RNA, 16 nt, Human
caaagcuuguuaagau

SEQ ID NO: 1520097 - RNA, 20 nt, Human
caaagccaaagcuaggccug

SEQ ID NO: 1520098 - RNA, 21 nt, Human
caaagccaaagcuaggccugg

SEQ ID NO: 1520099 - RNA, 22 nt, Human
caaagccaaagcuaggccuggc

SEQ ID NO: 1520100 - RNA, 16 nt, Human
caaagcuaggccuggc

SEQ ID NO: 1520101 - RNA, 17 nt, Human
caaagcuaggccuggcc

SEQ ID NO: 1520102 - RNA, 18 nt, Human
caaagcuaggccuggcca

SEQ ID NO: 1520103 - RNA, 13 nt, Human
caaauacauuuua

SEQ ID NO: 1520104 - RNA, 13 nt, Human
caaauaaugucuc

SEQ ID NO: 1520105 - RNA, 16 nt, Human
caaauaaugucucugu

SEQ ID NO: 1520106 - RNA, 20 nt, Human
caaauaaugucucugugaga

SEQ ID NO: 1520107 - RNA, 23 nt, Human
caaauaaugucucugugagacuc

SEQ ID NO: 1520108 - RNA, 15 nt, Human
caaauaaaaauauug

SEQ ID NO: 1520109 - RNA, 21 nt, Human
caaaggaugcccaaagaugca

SEQ ID NO: 1520110 - RNA, 19 nt, Human
caaauaugcaaagcacuga

SEQ ID NO: 1520111 - RNA, 18 nt, Human
caaauaugcaaagcacug

SEQ ID NO: 1520112 - RNA, 16 nt, Human
caaauaugcaaagcac

SEQ ID NO: 1520113 - RNA, 17 nt, Human
caaauaugcaaagcacu

SEQ ID NO: 1520114 - RNA, 13 nt, Human
caaaucagcugcu

SEQ ID NO: 1520115 - RNA, 16 nt, Human
caaaucagcugcuacu

SEQ ID NO: 1520116 - RNA, 22 nt, Human
caaauucugcuugcuugcuuuu

SEQ ID NO: 1520117 - RNA, 21 nt, Human
caaauguucaucaaugaauga

SEQ ID NO: 1520118 - RNA, 12 nt, Human
caacuuuauacc

SEQ ID NO: 1520119 - RNA, 21 nt, Human
caacucugaaggguaauuaua

SEQ ID NO: 1520120 - RNA, 20 nt, Human
caacucuccuccagagucag

SEQ ID NO: 1520121 - RNA, 19 nt, Human
caacucuccuccagaguca

SEQ ID NO: 1520122 - RNA, 16 nt, Human
caaccugauugugucu

SEQ ID NO: 1520123 - RNA, 12 nt, Human
caacccucauca

SEQ ID NO: 1520124 - RNA, 15 nt, Human
caacccucaucacca

SEQ ID NO: 1520125 - RNA, 14 nt, Human
caaauuuacagaga

SEQ ID NO: 1520126 - RNA, 16 nt, Human
caaauuuacagagaca

SEQ ID NO: 1520127 - RNA, 24 nt, Human
caacaggcugggcuucaguggcag

SEQ ID NO: 1520128 - RNA, 15 nt, Human
caaauuuacagagac

SEQ ID NO: 1520129 - RNA, 23 nt, Human
caacaggcugggcuucaguggca

SEQ ID NO: 1520130 - RNA, 22 nt, Human
caacaucuuggucagauuugaa

SEQ ID NO: 1520131 - RNA, 19 nt, Human
caacagguuuuccugaaga

SEQ ID NO: 1520132 - RNA, 18 nt, Human
caacaggguuuuuuucca

SEQ ID NO: 1520133 - RNA, 15 nt, Human
caacagguuuuccug

SEQ ID NO: 1520134 - RNA, 17 nt, Human
caacauguauaauauuu

SEQ ID NO: 1520135 - RNA, 18 nt, Human
caacauguauaauauuuu

SEQ ID NO: 1520136 - RNA, 19 nt, Human
caacauguauaauauuuuu

SEQ ID NO: 1520137 - RNA, 23 nt, Human
caacauguauaauauuuuuaauu

SEQ ID NO: 1520138 - RNA, 13 nt, Human
caacaucuuuucu

SEQ ID NO: 1520139 - RNA, 13 nt, Human
caacauguauaau

SEQ ID NO: 1520140 - RNA, 22 nt, Human
caaccccuucgcuccugugucu

SEQ ID NO: 1520141 - RNA, 21 nt, Human
caaccccuucgcuccuguguc

SEQ ID NO: 1520142 - RNA, 18 nt, Human
caaccccuucgcuccugu

SEQ ID NO: 1520143 - RNA, 19 nt, Human
caaccccuucgcuccugug

SEQ ID NO: 1520144 - RNA, 22 nt, Human
caagccaccaacauacucccau

SEQ ID NO: 1520145 - RNA, 18 nt, Human
caagugauucuccugccu

SEQ ID NO: 1520146 - RNA, 22 nt, Human
caagugauucuccugccucagc

SEQ ID NO: 1520147 - RNA, 22 nt, Human
caagugugguagagugugccug

SEQ ID NO: 1520148 - RNA, 19 nt, Human
caagugaaaaaggaggaag

SEQ ID NO: 1520149 - RNA, 16 nt, Human
caagugauucuccugc

SEQ ID NO: 1520150 - RNA, 17 nt, Human
caagugauucuccugcc

SEQ ID NO: 1520151 - RNA, 15 nt, Human
caaggauugcuacug

SEQ ID NO: 1520152 - RNA, 19 nt, Human
caaggauugcuacuguccu

SEQ ID NO: 1520153 - RNA, 19 nt, Human
caagggccuggccugagcu

SEQ ID NO: 1520154 - RNA, 12 nt, Human
caaggugggagg

SEQ ID NO: 1520155 - RNA, 23 nt, Human
caaggugggaggauugcuugagc

SEQ ID NO: 1520156 - RNA, 17 nt, Human
caagcacuaaacaaaga

SEQ ID NO: 1520157 - RNA, 21 nt, Human
caagccaccaacauacuccca

SEQ ID NO: 1520158 - RNA, 16 nt, Human
caagcgugagccacug

SEQ ID NO: 1520159 - RNA, 13 nt, Human
caaggauccugag

SEQ ID NO: 1520160 - RNA, 21 nt, Human
caaggaugaucuaggaagacu

SEQ ID NO: 1520161 - RNA, 17 nt, Human
caagcgugagccacugc

SEQ ID NO: 1520162 - RNA, 18 nt, Human
caagcgugagccacugca

SEQ ID NO: 1520163 - RNA, 16 nt, Human
caaggaagccacagcu

SEQ ID NO: 1520164 - RNA, 16 nt, Human
cacauuccugaacagg

SEQ ID NO: 1520165 - RNA, 16 nt, Human
cacauuccugaugcuu

SEQ ID NO: 1520166 - RNA, 17 nt, Human
cacaugugcacaugcac

SEQ ID NO: 1520167 - RNA, 14 nt, Human
cacaugugcacaug

SEQ ID NO: 1520168 - RNA, 15 nt, Human
cacaugugcacaugc

SEQ ID NO: 1520169 - RNA, 19 nt, Human
cacaugccucucucaggcc

SEQ ID NO: 1520170 - RNA, 18 nt, Human
cacauggcuauguuuuag

SEQ ID NO: 1520171 - RNA, 18 nt, Human
cacaucagcacgauuucu

SEQ ID NO: 1520172 - RNA, 12 nt, Human
cacauaucuguc

SEQ ID NO: 1520173 - RNA, 14 nt, Human
cacauaucugucau

SEQ ID NO: 1520174 - RNA, 19 nt, Human
cacaucagcacgauuucug

SEQ ID NO: 1520175 - RNA, 13 nt, Human
cacaugccucucu

SEQ ID NO: 1520176 - RNA, 17 nt, Human
cacaugccucucucagg

SEQ ID NO: 1520177 - RNA, 18 nt, Human
cacaugccucucucaggc

SEQ ID NO: 1520178 - RNA, 17 nt, Human
cacauuggaaacaaguc

SEQ ID NO: 1520179 - RNA, 13 nt, Human
caccacacccagc

SEQ ID NO: 1520180 - RNA, 15 nt, Human
caccacacccagccc

SEQ ID NO: 1520181 - RNA, 17 nt, Human
caccacacccagcccac

SEQ ID NO: 1520182 - RNA, 19 nt, Human
caccacaugugcacaugca

SEQ ID NO: 1520183 - RNA, 15 nt, Human
caccacaugugcaca

SEQ ID NO: 1520184 - RNA, 18 nt, Human
caccacaugugcacaugc

SEQ ID NO: 1520185 - RNA, 18 nt, Human
caccacuacauucuguua

SEQ ID NO: 1520186 - RNA, 17 nt, Human
caccacuacauucuguu

SEQ ID NO: 1520187 - RNA, 16 nt, Human
caccacuacauucugu

SEQ ID NO: 1520188 - RNA, 14 nt, Human
caccaccucuuugg

SEQ ID NO: 1520189 - RNA, 20 nt, Human
caccacuacauucuguuaau

SEQ ID NO: 1520190 - RNA, 19 nt, Human
caccacuacauucuguuaa

SEQ ID NO: 1520191 - RNA, 19 nt, Human
cacaggaaccacaagacug

SEQ ID NO: 1520192 - RNA, 20 nt, Human
cacaggaaccacaagacugc

SEQ ID NO: 1520193 - RNA, 15 nt, Human
cacaggaaguagagg

SEQ ID NO: 1520194 - RNA, 12 nt, Human
cacaggaucagu

SEQ ID NO: 1520195 - RNA, 15 nt, Human
cacaggaucagucug

SEQ ID NO: 1520196 - RNA, 16 nt, Human
cacaggaucagucuga

SEQ ID NO: 1520197 - RNA, 17 nt, Human
cacaggaucagucugau

SEQ ID NO: 1520198 - RNA, 10 nt, Human
cacaggcagg

SEQ ID NO: 1520199 - RNA, 16 nt, Human
cacaggcccggcucca

SEQ ID NO: 1520200 - RNA, 17 nt, Human
cacaggcccggcuccag

SEQ ID NO: 1520201 - RNA, 18 nt, Human
cacaggcccggcuccagg

SEQ ID NO: 1520202 - RNA, 19 nt, Human
cacaggcccggcuccaggc

SEQ ID NO: 1520203 - RNA, 23 nt, Human
cacauaucuaguaugaaauuaua

SEQ ID NO: 1520204 - RNA, 17 nt, Human
cacauacacacacacgc

SEQ ID NO: 1520205 - RNA, 15 nt, Human
cacaguuuucugaga

SEQ ID NO: 1520206 - RNA, 14 nt, Human
cacaguuuucugag

SEQ ID NO: 1520207 - RNA, 19 nt, Human
cacagugagucgaggacag

SEQ ID NO: 1520208 - RNA, 20 nt, Human
cacagugagucgaggacagg

SEQ ID NO: 1520209 - RNA, 18 nt, Human
cacagugagucgaggaca

SEQ ID NO: 1520210 - RNA, 20 nt, Human
cacaggcccggcuccaggcu

SEQ ID NO: 1520211 - RNA, 23 nt, Human
cacaggcccggcuccaggcuccu

SEQ ID NO: 1520212 - RNA, 20 nt, Human
cacagaugggugcuuggagg

SEQ ID NO: 1520213 - RNA, 21 nt, Human
cacagaguuguuacauuuuua

SEQ ID NO: 1520214 - RNA, 20 nt, Human
cacagaguuguuacauuuuu

SEQ ID NO: 1520215 - RNA, 14 nt, Human
cacagaugggugcu

SEQ ID NO: 1520216 - RNA, 18 nt, Human
cacagaugggugcuugga

SEQ ID NO: 1520217 - RNA, 23 nt, Human
cacagaugggugcuuggaggaag

SEQ ID NO: 1520218 - RNA, 21 nt, Human
cacagugagucgaggacaggg

SEQ ID NO: 1520219 - RNA, 19 nt, Human
cacacucaaaucaagaaac

SEQ ID NO: 1520220 - RNA, 21 nt, Human
cacacuugacaucaacugcau

SEQ ID NO: 1520221 - RNA, 12 nt, Human
cacagagaaagu

SEQ ID NO: 1520222 - RNA, 17 nt, Human
cacagaguuguuacauu

SEQ ID NO: 1520223 - RNA, 16 nt, Human
cacagaguuguuacau

SEQ ID NO: 1520224 - RNA, 13 nt, Human
cacaacuauauug

SEQ ID NO: 1520225 - RNA, 14 nt, Human
cacaacuauuuuuc

SEQ ID NO: 1520226 - RNA, 19 nt, Human
cacaacuauuuuuccaaaa

SEQ ID NO: 1520227 - RNA, 14 nt, Human
cacacaccagagcc

SEQ ID NO: 1520228 - RNA, 19 nt, Human
cacacagaggcugccucuc

SEQ ID NO: 1520229 - RNA, 21 nt, Human
cacacagaggcugccucuccc

SEQ ID NO: 1520230 - RNA, 12 nt, Human
cacacagcucug

SEQ ID NO: 1520231 - RNA, 13 nt, Human
cacacccagccca

SEQ ID NO: 1520232 - RNA, 15 nt, Human
cacaccagagcccac

SEQ ID NO: 1520233 - RNA, 12 nt, Human
cacaccagagcc

SEQ ID NO: 1520234 - RNA, 13 nt, Human
cacaccagagccc

SEQ ID NO: 1520235 - RNA, 17 nt, Human
cacaccgggcacucaga

SEQ ID NO: 1520236 - RNA, 13 nt, Human
caaugaccuuuca

SEQ ID NO: 1520237 - RNA, 22 nt, Human
caaugaaugaaugaauggcuaa

SEQ ID NO: 1520238 - RNA, 23 nt, Human
caaugcacuuuguucuggcucuu

SEQ ID NO: 1520239 - RNA, 19 nt, Human
caaugcaaaccaucauuga

SEQ ID NO: 1520240 - RNA, 20 nt, Human
caaugcaaaccaucauugaa

SEQ ID NO: 1520241 - RNA, 17 nt, Human
caaugcaaaccaucauu

SEQ ID NO: 1520242 - RNA, 18 nt, Human
caaugcaaaccaucauug

SEQ ID NO: 1520243 - RNA, 21 nt, Human
caauaggaaaaacugauuuuu

SEQ ID NO: 1520244 - RNA, 20 nt, Human
caauaggaaaaacugauuuu

SEQ ID NO: 1520245 - RNA, 11 nt, Human
cacaacagauu

SEQ ID NO: 1520246 - RNA, 16 nt, Human
cacaaaaguuucucuu

SEQ ID NO: 1520247 - RNA, 18 nt, Human
cacaaaaguuucucuuuu

SEQ ID NO: 1520248 - RNA, 19 nt, Human
caaugugaaaagaaaaaug

SEQ ID NO: 1520249 - RNA, 18 nt, Human
uuggacaaaauggaauac

SEQ ID NO: 1520250 - RNA, 19 nt, Human
uuggaagcuccgcuuucua

SEQ ID NO: 1520251 - RNA, 15 nt, Human
uuggauuguccccga

SEQ ID NO: 1520252 - RNA, 18 nt, Human
uuggacccugaggcccag

SEQ ID NO: 1520253 - RNA, 19 nt, Human
uuggacccugaggcccaga

SEQ ID NO: 1520254 - RNA, 21 nt, Human
uuggacccugaggcccagagg

SEQ ID NO: 1520255 - RNA, 16 nt, Human
uugcuaagcauuccaa

SEQ ID NO: 1520256 - RNA, 18 nt, Human
uugcuaagcauuccaacu

SEQ ID NO: 1520257 - RNA, 14 nt, Human
uugcugcuugaggc

SEQ ID NO: 1520258 - RNA, 16 nt, Human
uugcugcuugaggcaa

SEQ ID NO: 1520259 - RNA, 16 nt, Human
uugcugucccuuuucc

SEQ ID NO: 1520260 - RNA, 18 nt, Human
uugcugucccuuuuccuu

SEQ ID NO: 1520261 - RNA, 20 nt, Human
uugccauguuggccaggcug

SEQ ID NO: 1520262 - RNA, 21 nt, Human
uugccauguuggccaggcugg

SEQ ID NO: 1520263 - RNA, 17 nt, Human
uuguagaagucacauuc

SEQ ID NO: 1520264 - RNA, 22 nt, Human
uuguagaagucacauuccugaa

SEQ ID NO: 1520265 - RNA, 15 nt, Human
uuguagcauccugga

SEQ ID NO: 1520266 - RNA, 17 nt, Human
uuguagcauccucuuua

SEQ ID NO: 1520267 - RNA, 22 nt, Human
uuguagcacugacagauuucca

SEQ ID NO: 1520268 - RNA, 14 nt, Human
uuguagcacugaca

SEQ ID NO: 1520269 - RNA, 16 nt, Human
uuguagcacugacaga

SEQ ID NO: 1520270 - RNA, 17 nt, Human
uuguagcacugacagau

SEQ ID NO: 1520271 - RNA, 18 nt, Human
uuguagcacugacagauu

SEQ ID NO: 1520272 - RNA, 20 nt, Human
uuguaaaauggugugaccac

SEQ ID NO: 1520273 - RNA, 16 nt, Human
uuguaccgcaauguga

SEQ ID NO: 1520274 - RNA, 16 nt, Human
uuguacgaagaguauu

SEQ ID NO: 1520275 - RNA, 19 nt, Human
uuguacgaagaguauuuuu

SEQ ID NO: 1520276 - RNA, 20 nt, Human
uugucuaugggacucaaugc

SEQ ID NO: 1520277 - RNA, 22 nt, Human
uugucaaaguggugagaggcau

SEQ ID NO: 1520278 - RNA, 14 nt, Human
uugucuaugggacu

SEQ ID NO: 1520279 - RNA, 20 nt, Human
uugguaaggggaauugagga

SEQ ID NO: 1520280 - RNA, 13 nt, Human
uugggauuaauau

SEQ ID NO: 1520281 - RNA, 20 nt, Human
uuggucugacccacugcuuu

SEQ ID NO: 1520282 - RNA, 15 nt, Human
uuggucugugagaug

SEQ ID NO: 1520283 - RNA, 12 nt, Human
uuguaaaauggu

SEQ ID NO: 1520284 - RNA, 13 nt, Human
uuguaaaauggug

SEQ ID NO: 1520285 - RNA, 23 nt, Human
uuggcuucacggaagagccuugc

SEQ ID NO: 1520286 - RNA, 21 nt, Human
uugaagagguuuuaaagcuuc

SEQ ID NO: 1520287 - RNA, 20 nt, Human
uugaagcacagugaucaagu

SEQ ID NO: 1520288 - RNA, 16 nt, Human
uugaagagguuuuaaa

SEQ ID NO: 1520289 - RNA, 20 nt, Human
uugaacuuugaccucugcag

SEQ ID NO: 1520290 - RNA, 18 nt, Human
uugaacuuugaccucugc

SEQ ID NO: 1520291 - RNA, 17 nt, Human
uugaacuuugaccucug

SEQ ID NO: 1520292 - RNA, 14 nt, Human
uugaauguuaagca

SEQ ID NO: 1520293 - RNA, 17 nt, Human
uugaauguuaagcagau

SEQ ID NO: 1520294 - RNA, 12 nt, Human
uugaaugaugcc

SEQ ID NO: 1520295 - RNA, 16 nt, Human
uugaaugaugccauga

SEQ ID NO: 1520296 - RNA, 15 nt, Human
uugaacuuugaccuc

SEQ ID NO: 1520297 - RNA, 21 nt, Human
uugaaaaucuuauaauuuaaa

SEQ ID NO: 1520298 - RNA, 21 nt, Human
uucuuuccugaggcugggcuc

SEQ ID NO: 1520299 - RNA, 19 nt, Human
uucuuaggguuaugauuaa

SEQ ID NO: 1520300 - RNA, 17 nt, Human
uucuuagggaaggauac

SEQ ID NO: 1520301 - RNA, 13 nt, Human
uucuucagagacu

SEQ ID NO: 1520302 - RNA, 14 nt, Human
uucuuguguguuua

SEQ ID NO: 1520303 - RNA, 16 nt, Human
uucuggcuaugcauuu

SEQ ID NO: 1520304 - RNA, 20 nt, Human
uucuggcagaguugaagaca

SEQ ID NO: 1520305 - RNA, 24 nt, Human
uucuaaguaaaaccacagcaguug

SEQ ID NO: 1520306 - RNA, 18 nt, Human
uucuaagucauucauaaa

SEQ ID NO: 1520307 - RNA, 20 nt, Human
uugauaugccuuuucccaac

SEQ ID NO: 1520308 - RNA, 16 nt, Human
uugauaugugaacagu

SEQ ID NO: 1520309 - RNA, 16 nt, Human
uugauaugcuuauaca

SEQ ID NO: 1520310 - RNA, 17 nt, Human
uugaucaacaucuuuuc

SEQ ID NO: 1520311 - RNA, 18 nt, Human
uugaucaacaucuuuucu

SEQ ID NO: 1520312 - RNA, 22 nt, Human
uugaucaacaucuuuucuugcc

SEQ ID NO: 1520313 - RNA, 17 nt, Human
uugauucagacagcugc

SEQ ID NO: 1520314 - RNA, 21 nt, Human
uugauucagacagcugccugg

SEQ ID NO: 1520315 - RNA, 23 nt, Human
uugauucagacagcugccuggga

SEQ ID NO: 1520316 - RNA, 16 nt, Human
uugauucagcucugca

SEQ ID NO: 1520317 - RNA, 16 nt, Human
uugagccuugaacuuu

SEQ ID NO: 1520318 - RNA, 15 nt, Human
uugagccuugaacuu

SEQ ID NO: 1520319 - RNA, 14 nt, Human
uugagccuugaacu

SEQ ID NO: 1520320 - RNA, 14 nt, Human
uugaauuguaagga

SEQ ID NO: 1520321 - RNA, 19 nt, Human
uugagccuugaacuuugac

SEQ ID NO: 1520322 - RNA, 13 nt, Human
uugccagucaccc

SEQ ID NO: 1520323 - RNA, 16 nt, Human
uugccauguuggccag

SEQ ID NO: 1520324 - RNA, 17 nt, Human
uugccauguuggccagg

SEQ ID NO: 1520325 - RNA, 18 nt, Human
uugccauguuggccaggc

SEQ ID NO: 1520326 - RNA, 19 nt, Human
uugccauguuggccaggcu

SEQ ID NO: 1520327 - RNA, 23 nt, Human
uugcagacaggcaagcaccuccu

SEQ ID NO: 1520328 - RNA, 12 nt, Human
uugauucuccuu

SEQ ID NO: 1520329 - RNA, 13 nt, Human
uugauucuccuuc

SEQ ID NO: 1520330 - RNA, 17 nt, Human
uugauucuccuucagcc

SEQ ID NO: 1520331 - RNA, 20 nt, Human
uugauucuccuucagcccuc

SEQ ID NO: 1520332 - RNA, 13 nt, Human
uugauucauaaug

SEQ ID NO: 1520333 - RNA, 17 nt, Human
uugauucauaaugacuu

SEQ ID NO: 1520334 - RNA, 20 nt, Human
uugucuuuggacccugaggc

SEQ ID NO: 1520335 - RNA, 24 nt, Human
uugucuuuggacccugaggcccag

SEQ ID NO: 1520336 - RNA, 15 nt, Human
uugucuuuggacccu

SEQ ID NO: 1520337 - RNA, 19 nt, Human
uuguucaauaauaaauauu

SEQ ID NO: 1520338 - RNA, 18 nt, Human
uuguuuaaaaucauuucu

SEQ ID NO: 1520339 - RNA, 13 nt, Human
uuguuugguuaua

SEQ ID NO: 1520340 - RNA, 20 nt, Human
uuguuuggggaugagaaagg

SEQ ID NO: 1520341 - RNA, 12 nt, Human
uuuaaaaugucu

SEQ ID NO: 1520342 - RNA, 13 nt, Human
uuuaacagaaaug

SEQ ID NO: 1520343 - RNA, 19 nt, Human
uuuaaaauacacacucaaa

SEQ ID NO: 1520344 - RNA, 16 nt, Human
uuuaaaaucauuucug

SEQ ID NO: 1520345 - RNA, 14 nt, Human
uuuaaaagaaugau

SEQ ID NO: 1520346 - RNA, 17 nt, Human
uuuaaaagaaugauuau

SEQ ID NO: 1520347 - RNA, 13 nt, Human
uuuaaaagauaca

SEQ ID NO: 1520348 - RNA, 16 nt, Human
uuuacauggcuggagc

SEQ ID NO: 1520349 - RNA, 14 nt, Human
uuuaccaucugaaa

SEQ ID NO: 1520350 - RNA, 13 nt, Human
uuuaccaucugaa

SEQ ID NO: 1520351 - RNA, 13 nt, Human
uuuacagagacag

SEQ ID NO: 1520352 - RNA, 13 nt, Human
uuuaauaaaccau

SEQ ID NO: 1520353 - RNA, 15 nt, Human
uuuaauaauguuuca

SEQ ID NO: 1520354 - RNA, 19 nt, Human
uuuaauaauguuucaaaca

SEQ ID NO: 1520355 - RNA, 14 nt, Human
uuuaaccucuaaau

SEQ ID NO: 1520356 - RNA, 15 nt, Human
uuuaacagaaaugua

SEQ ID NO: 1520357 - RNA, 14 nt, Human
uuuaacagaaaugu

SEQ ID NO: 1520358 - RNA, 22 nt, Human
uuuagacccuauugcugcuuga

SEQ ID NO: 1520359 - RNA, 19 nt, Human
uuuagacccuauugcugcu

SEQ ID NO: 1520360 - RNA, 21 nt, Human
uuuacccucuugaauauaauc

SEQ ID NO: 1520361 - RNA, 20 nt, Human
uuuauacauaaacaagacca

SEQ ID NO: 1520362 - RNA, 12 nt, Human
uuuauacauaaa

SEQ ID NO: 1520363 - RNA, 15 nt, Human
uuuauacaggucaua

SEQ ID NO: 1520364 - RNA, 17 nt, Human
uuuauggcacuaguauu

SEQ ID NO: 1520365 - RNA, 20 nt, Human
uuuaugccuuuuauuucuua

SEQ ID NO: 1520366 - RNA, 14 nt, Human
uuucaauuuccaag

SEQ ID NO: 1520367 - RNA, 17 nt, Human
uuucagccaagaauucu

SEQ ID NO: 1520368 - RNA, 15 nt, Human
uuucacauaucuagu

SEQ ID NO: 1520369 - RNA, 21 nt, Human
uuucacauaucuaguaugaaa

SEQ ID NO: 1520370 - RNA, 17 nt, Human
uuucagugaaagcauca

SEQ ID NO: 1520371 - RNA, 15 nt, Human
uuucauuuuuuucca

SEQ ID NO: 1520372 - RNA, 20 nt, Human
uuucauuuuuuuccaggcug

SEQ ID NO: 1520373 - RNA, 12 nt, Human
uuucugaaauuu

SEQ ID NO: 1520374 - RNA, 19 nt, Human
uuucugaaauuuccuggga

SEQ ID NO: 1520375 - RNA, 19 nt, Human
uuucugaaaauuaacacug

SEQ ID NO: 1520376 - RNA, 20 nt, Human
uuucugaaaauuaacacugc

SEQ ID NO: 1520377 - RNA, 14 nt, Human
uuucugaaauaaca

SEQ ID NO: 1520378 - RNA, 12 nt, Human
uuucucuaggaa

SEQ ID NO: 1520379 - RNA, 23 nt, Human
uuucuacucgaguuacagacaaa

SEQ ID NO: 1520380 - RNA, 22 nt, Human
uuucuacccagcgagcccuggu

SEQ ID NO: 1520381 - RNA, 15 nt, Human
uuucuacccagcgag

SEQ ID NO: 1520382 - RNA, 18 nt, Human
uuucuacccagcgagccc

SEQ ID NO: 1520383 - RNA, 19 nt, Human
uuucuaaaucuccaaaaua

SEQ ID NO: 1520384 - RNA, 21 nt, Human
uuucuaacaaaaaaauauauu

SEQ ID NO: 1520385 - RNA, 13 nt, Human
uuuccuaauuuau

SEQ ID NO: 1520386 - RNA, 23 nt, Human
uuuccuggcacugcuuccaguga

SEQ ID NO: 1520387 - RNA, 19 nt, Human
uuuccuggcacugcuucca

SEQ ID NO: 1520388 - RNA, 14 nt, Human
uuugauaugugaac

SEQ ID NO: 1520389 - RNA, 15 nt, Human
uuugauaugugaaca

SEQ ID NO: 1520390 - RNA, 17 nt, Human
uuugauaugugaacagu

SEQ ID NO: 1520391 - RNA, 14 nt, Human
uuugauccaagcug

SEQ ID NO: 1520392 - RNA, 15 nt, Human
uuuggacccugaggc

SEQ ID NO: 1520393 - RNA, 19 nt, Human
uuuggacccugaggcccag

SEQ ID NO: 1520394 - RNA, 16 nt, Human
uuugcuugaaagaaaa

SEQ ID NO: 1520395 - RNA, 14 nt, Human
uuugcuugaaagaa

SEQ ID NO: 1520396 - RNA, 18 nt, Human
uuugguaaggggaauuga

SEQ ID NO: 1520397 - RNA, 15 nt, Human
uuuguauucucuccu

SEQ ID NO: 1520398 - RNA, 18 nt, Human
uuugaagcacagugauca

SEQ ID NO: 1520399 - RNA, 21 nt, Human
uuugaaauuguauuacaaauc

SEQ ID NO: 1520400 - RNA, 18 nt, Human
uuucuugccucugucccc

SEQ ID NO: 1520401 - RNA, 21 nt, Human
uuucuugccucuguccccuuc

SEQ ID NO: 1520402 - RNA, 19 nt, Human
uuucuuguguguuuauugu

SEQ ID NO: 1520403 - RNA, 17 nt, Human
uuugaauauaaacacua

SEQ ID NO: 1520404 - RNA, 18 nt, Human
uuugaauauaaacacuau

SEQ ID NO: 1520405 - RNA, 19 nt, Human
uuugaauauaaacacuaua

SEQ ID NO: 1520406 - RNA, 16 nt, Human
uuugagaguucuaaau

SEQ ID NO: 1520407 - RNA, 16 nt, Human
uuugagaucagccugg

SEQ ID NO: 1520408 - RNA, 17 nt, Human
uuugagaucagccuggg

SEQ ID NO: 1520409 - RNA, 13 nt, Human
uuugaguucuaca

SEQ ID NO: 1520410 - RNA, 21 nt, Human
uguuucaaacauauauaacaa

SEQ ID NO: 1520411 - RNA, 22 nt, Human
uguuucaaacauauauaacaau

SEQ ID NO: 1520412 - RNA, 15 nt, Human
uguuucaaacuuuac

SEQ ID NO: 1520413 - RNA, 20 nt, Human
uguuuagauaauacaccacu

SEQ ID NO: 1520414 - RNA, 16 nt, Human
uguuuagauaauacac

SEQ ID NO: 1520415 - RNA, 19 nt, Human
uguuucaaacauauauaac

SEQ ID NO: 1520416 - RNA, 13 nt, Human
uguuugugauuga

SEQ ID NO: 1520417 - RNA, 13 nt, Human
uuaaaagaaugau

SEQ ID NO: 1520418 - RNA, 15 nt, Human
uuaaaagaugaaaau

SEQ ID NO: 1520419 - RNA, 18 nt, Human
uuaaaagaugaaaauauu

SEQ ID NO: 1520420 - RNA, 21 nt, Human
uuaaaauaccagccaguaaau

SEQ ID NO: 1520421 - RNA, 22 nt, Human
uuaaacugguauuuuaucuuug

SEQ ID NO: 1520422 - RNA, 13 nt, Human
uuaaacugguauu

SEQ ID NO: 1520423 - RNA, 19 nt, Human
uuaaacugguauuuuaucu

SEQ ID NO: 1520424 - RNA, 17 nt, Human
uuaaaagauacaguuac

SEQ ID NO: 1520425 - RNA, 14 nt, Human
uuaaaagauacagu

SEQ ID NO: 1520426 - RNA, 21 nt, Human
uuaaaagaauauuuuaacuuc

SEQ ID NO: 1520427 - RNA, 22 nt, Human
uuaaaagaauauuuuaacuucc

SEQ ID NO: 1520428 - RNA, 18 nt, Human
uguuuuaaggaugcuugu

SEQ ID NO: 1520429 - RNA, 22 nt, Human
uguuuuaagaggcagggucuca

SEQ ID NO: 1520430 - RNA, 19 nt, Human
uguuuuaaggaugcuugua

SEQ ID NO: 1520431 - RNA, 12 nt, Human
uuaacucaauau

SEQ ID NO: 1520432 - RNA, 16 nt, Human
uuaacuucacauauug

SEQ ID NO: 1520433 - RNA, 15 nt, Human
uuaacuuuuauaaac

SEQ ID NO: 1520434 - RNA, 17 nt, Human
uuaacuuuuauaaacuu

SEQ ID NO: 1520435 - RNA, 16 nt, Human
uuaacuuuuauaaacu

SEQ ID NO: 1520436 - RNA, 18 nt, Human
uuaacuuuuauaaacuuu

SEQ ID NO: 1520437 - RNA, 21 nt, Human
uuaagcagauggaaugcugug

SEQ ID NO: 1520438 - RNA, 17 nt, Human
uuaaccacuucagcuga

SEQ ID NO: 1520439 - RNA, 22 nt, Human
uuaaugucaauucuugccaaau

SEQ ID NO: 1520440 - RNA, 21 nt, Human
uuacaagcgugagccacugca

SEQ ID NO: 1520441 - RNA, 20 nt, Human
uuacaagcgugagccacugc

SEQ ID NO: 1520442 - RNA, 13 nt, Human
uuaauauauuucc

SEQ ID NO: 1520443 - RNA, 14 nt, Human
uuaauauauuucca

SEQ ID NO: 1520444 - RNA, 21 nt, Human
uuaaugauaaguaaaugcuag

SEQ ID NO: 1520445 - RNA, 18 nt, Human
uuaauauugauaugcuua

SEQ ID NO: 1520446 - RNA, 22 nt, Human
uuaauauugauaugcuuauaca

SEQ ID NO: 1520447 - RNA, 17 nt, Human
uuaagcuguuacugucu

SEQ ID NO: 1520448 - RNA, 19 nt, Human
uuacuauggcccuggccua

SEQ ID NO: 1520449 - RNA, 21 nt, Human
uuacuuaaaccgccaaggcug

SEQ ID NO: 1520450 - RNA, 11 nt, Human
uuacuucugcu

SEQ ID NO: 1520451 - RNA, 12 nt, Human
uuacuucugcua

SEQ ID NO: 1520452 - RNA, 23 nt, Human
uuacuucuuauacauuugauaaa

SEQ ID NO: 1520453 - RNA, 18 nt, Human
uuacuuagguguggggga

SEQ ID NO: 1520454 - RNA, 17 nt, Human
uuacuaguuucccuugc

SEQ ID NO: 1520455 - RNA, 16 nt, Human
uuacuaauagacaauu

SEQ ID NO: 1520456 - RNA, 14 nt, Human
uuacuaaguuuuua

SEQ ID NO: 1520457 - RNA, 13 nt, Human
uuacuaaguuuuu

SEQ ID NO: 1520458 - RNA, 19 nt, Human
uuagaaacacaacuauauu

SEQ ID NO: 1520459 - RNA, 15 nt, Human
uuagacagucccugc

SEQ ID NO: 1520460 - RNA, 14 nt, Human
uuacuuuguguuca

SEQ ID NO: 1520461 - RNA, 17 nt, Human
uuacuuuaaaaggagcc

SEQ ID NO: 1520462 - RNA, 18 nt, Human
uuacuuuaaaaggagcca

SEQ ID NO: 1520463 - RNA, 16 nt, Human
uuagacagucccugcc

SEQ ID NO: 1520464 - RNA, 17 nt, Human
uuagacagucccugcca

SEQ ID NO: 1520465 - RNA, 18 nt, Human
uuagacagucccugccaa

SEQ ID NO: 1520466 - RNA, 18 nt, Human
uuaggauguugaaaaagu

SEQ ID NO: 1520467 - RNA, 18 nt, Human
uuaguaugaggcauuugu

SEQ ID NO: 1520468 - RNA, 16 nt, Human
uuaguaugaggcauuu

SEQ ID NO: 1520469 - RNA, 12 nt, Human
uuagcuggaaaa

SEQ ID NO: 1520470 - RNA, 13 nt, Human
uuagcuggaaaag

SEQ ID NO: 1520471 - RNA, 13 nt, Human
uuagcuccccucc

SEQ ID NO: 1520472 - RNA, 14 nt, Human
uuagcuccccucca

SEQ ID NO: 1520473 - RNA, 18 nt, Human
uuagcuccccuccaaccu

SEQ ID NO: 1520474 - RNA, 20 nt, Human
uuagaugcaguucugaagaa

SEQ ID NO: 1520475 - RNA, 21 nt, Human
uuagaugcaguucugaagaag

SEQ ID NO: 1520476 - RNA, 22 nt, Human
uuagauaauacaccacuacauu

SEQ ID NO: 1520477 - RNA, 14 nt, Human
uuagaguugauacu

SEQ ID NO: 1520478 - RNA, 21 nt, Human
uuauggcacuaguauuucuau

SEQ ID NO: 1520479 - RNA, 16 nt, Human
uuauggaacacucuga

SEQ ID NO: 1520480 - RNA, 15 nt, Human
uuaugccuuuuauuu

SEQ ID NO: 1520481 - RNA, 22 nt, Human
uuaugcaugaaguaauaugcac

SEQ ID NO: 1520482 - RNA, 16 nt, Human
uuaugcaugaaguaau

SEQ ID NO: 1520483 - RNA, 16 nt, Human
uuaucuagauacugua

SEQ ID NO: 1520484 - RNA, 16 nt, Human
uuaguuccucauuagc

SEQ ID NO: 1520485 - RNA, 14 nt, Human
uuaguuccuugagu

SEQ ID NO: 1520486 - RNA, 17 nt, Human
uuaucuagauacuguau

SEQ ID NO: 1520487 - RNA, 16 nt, Human
uuauggccgggcaggg

SEQ ID NO: 1520488 - RNA, 17 nt, Human
uuauggcuauaggugcu

SEQ ID NO: 1520489 - RNA, 18 nt, Human
uuauggcuauaggugcua

SEQ ID NO: 1520490 - RNA, 16 nt, Human
uuauuacuguaagaaa

SEQ ID NO: 1520491 - RNA, 17 nt, Human
uuauuacuguaagaaaa

SEQ ID NO: 1520492 - RNA, 18 nt, Human
uuauuacuguaagaaaau

SEQ ID NO: 1520493 - RNA, 11 nt, Human
uuauucugcuc

SEQ ID NO: 1520494 - RNA, 15 nt, Human
uuauugcccacgcug

SEQ ID NO: 1520495 - RNA, 15 nt, Human
uuauugauaaguuca

SEQ ID NO: 1520496 - RNA, 19 nt, Human
uuauugauaaguucauaca

SEQ ID NO: 1520497 - RNA, 20 nt, Human
uuauugauaaguucauacau

SEQ ID NO: 1520498 - RNA, 20 nt, Human
uucagauaaucacaauacau

SEQ ID NO: 1520499 - RNA, 16 nt, Human
uucagacauagaauua

SEQ ID NO: 1520500 - RNA, 21 nt, Human
uucagacagcugccugggauc

SEQ ID NO: 1520501 - RNA, 20 nt, Human
uucagacauagaauuaacac

SEQ ID NO: 1520502 - RNA, 13 nt, Human
uucacucuccuug

SEQ ID NO: 1520503 - RNA, 15 nt, Human
uucacgugguccuaa

SEQ ID NO: 1520504 - RNA, 18 nt, Human
uucacggaagagccuugc

SEQ ID NO: 1520505 - RNA, 17 nt, Human
uucaauuuccaagagcu

SEQ ID NO: 1520506 - RNA, 19 nt, Human
uucaauuuccaagagcuga

SEQ ID NO: 1520507 - RNA, 13 nt, Human
uucaauaggaaaa

SEQ ID NO: 1520508 - RNA, 15 nt, Human
uucaauaggaaaaac

SEQ ID NO: 1520509 - RNA, 18 nt, Human
uucaauaggaaaaacuga

SEQ ID NO: 1520510 - RNA, 20 nt, Human
uucaauaggaaaaacugauu

SEQ ID NO: 1520511 - RNA, 17 nt, Human
uucaaauccuugaagau

SEQ ID NO: 1520512 - RNA, 17 nt, Human
uuauuuuaauaauguuu

SEQ ID NO: 1520513 - RNA, 15 nt, Human
uuauuuuaauaaugu

SEQ ID NO: 1520514 - RNA, 16 nt, Human
uuauuuuaauaauguu

SEQ ID NO: 1520515 - RNA, 15 nt, Human
uuauugucuagugaa

SEQ ID NO: 1520516 - RNA, 18 nt, Human
uuauugucaaagugguga

SEQ ID NO: 1520517 - RNA, 17 nt, Human
uuauugucaaaguggug

SEQ ID NO: 1520518 - RNA, 20 nt, Human
uuauugguuuuccaaucauu

SEQ ID NO: 1520519 - RNA, 13 nt, Human
uuccaaaauaauu

SEQ ID NO: 1520520 - RNA, 21 nt, Human
uuccaaaauaauuuuaagaaa

SEQ ID NO: 1520521 - RNA, 15 nt, Human
uuccaaauucugcuu

SEQ ID NO: 1520522 - RNA, 15 nt, Human
uucaugaaagauuca

SEQ ID NO: 1520523 - RNA, 17 nt, Human
uucaugaaagauucaau

SEQ ID NO: 1520524 - RNA, 21 nt, Human
uucaucuugaauuguaaggaa

SEQ ID NO: 1520525 - RNA, 11 nt, Human
uucaggaagcu

SEQ ID NO: 1520526 - RNA, 13 nt, Human
uucaggaagcuca

SEQ ID NO: 1520527 - RNA, 15 nt, Human
uucaggaagcucagg

SEQ ID NO: 1520528 - RNA, 19 nt, Human
uucaugcauagguuuagca

SEQ ID NO: 1520529 - RNA, 12 nt, Human
uuccaaaauaau

SEQ ID NO: 1520530 - RNA, 15 nt, Human
uucauuuccuguguc

SEQ ID NO: 1520531 - RNA, 16 nt, Human
uucauuuccugugucu

SEQ ID NO: 1520532 - RNA, 16 nt, Human
uucccauuugcuccuu

SEQ ID NO: 1520533 - RNA, 15 nt, Human
uuccccaggaggcca

SEQ ID NO: 1520534 - RNA, 16 nt, Human
uuccccaggaggccag

SEQ ID NO: 1520535 - RNA, 11 nt, Human
uucccucccuu

SEQ ID NO: 1520536 - RNA, 17 nt, Human
uucccucccuuccucuu

SEQ ID NO: 1520537 - RNA, 20 nt, Human
uucccucccuuccucuuucc

SEQ ID NO: 1520538 - RNA, 21 nt, Human
uuccccaggaggccagccuug

SEQ ID NO: 1520539 - RNA, 17 nt, Human
uuccccaggaggccagc

SEQ ID NO: 1520540 - RNA, 18 nt, Human
uuccccaggaggccagcc

SEQ ID NO: 1520541 - RNA, 19 nt, Human
uuccccaggaggccagccu

SEQ ID NO: 1520542 - RNA, 20 nt, Human
uuccccaggaggccagccuu

SEQ ID NO: 1520543 - RNA, 17 nt, Human
uucccuugaugaagaag

SEQ ID NO: 1520544 - RNA, 18 nt, Human
uucccuugaugaagaagu

SEQ ID NO: 1520545 - RNA, 20 nt, Human
uucccuuugacgccauccca

SEQ ID NO: 1520546 - RNA, 21 nt, Human
uucccuuugacgccaucccag

SEQ ID NO: 1520547 - RNA, 22 nt, Human
uucccuuugacgccaucccagc

SEQ ID NO: 1520548 - RNA, 13 nt, Human
uuccucauuagca

SEQ ID NO: 1520549 - RNA, 13 nt, Human
uucuaaagcugcc

SEQ ID NO: 1520550 - RNA, 17 nt, Human
uucuaaagcugccagcc

SEQ ID NO: 1520551 - RNA, 20 nt, Human
uucgggaggucgaggcagga

SEQ ID NO: 1520552 - RNA, 20 nt, Human
uuccuuggacucauuuuaaa

SEQ ID NO: 1520553 - RNA, 17 nt, Human
uuccugccaggcauggu

SEQ ID NO: 1520554 - RNA, 23 nt, Human
uuccugaugcuucuucagagacu

SEQ ID NO: 1520555 - RNA, 15 nt, Human
uuccugaugcuucuu

SEQ ID NO: 1520556 - RNA, 18 nt, Human
uuccugaugcuucuucag

SEQ ID NO: 1520557 - RNA, 19 nt, Human
uuccugaugcuucuucaga

SEQ ID NO: 1520558 - RNA, 15 nt, Human
uuccuggagcccaga

SEQ ID NO: 1520559 - RNA, 16 nt, Human
uuccuggagcccagag

SEQ ID NO: 1520560 - RNA, 14 nt, Human
uuccuggcacugcu

SEQ ID NO: 1520561 - RNA, 19 nt, Human
uuccuggcacugcuuccag

SEQ ID NO: 1520562 - RNA, 20 nt, Human
uuccuugaguugauucagcu

SEQ ID NO: 1520563 - RNA, 21 nt, Human
uggggccaguuggucccccuu

SEQ ID NO: 1520564 - RNA, 20 nt, Human
uggggccaguuggucccccu

SEQ ID NO: 1520565 - RNA, 15 nt, Human
uggggaugagaaagg

SEQ ID NO: 1520566 - RNA, 23 nt, Human
uggggaugagaaagguugaagca

SEQ ID NO: 1520567 - RNA, 16 nt, Human
ugggggaguggccaca

SEQ ID NO: 1520568 - RNA, 17 nt, Human
uggguacuuguggacac

SEQ ID NO: 1520569 - RNA, 18 nt, Human
uggguacuuguggacaca

SEQ ID NO: 1520570 - RNA, 14 nt, Human
ugggccuggcuccc

SEQ ID NO: 1520571 - RNA, 14 nt, Human
ugggauguuucugu

SEQ ID NO: 1520572 - RNA, 23 nt, Human
ugggcagagcagagaccaucccu

SEQ ID NO: 1520573 - RNA, 22 nt, Human
ugggauuacaagcgugagccac

SEQ ID NO: 1520574 - RNA, 22 nt, Human
ugggcagagcagagaccauccc

SEQ ID NO: 1520575 - RNA, 14 nt, Human
ugggauccuccagg

SEQ ID NO: 1520576 - RNA, 12 nt, Human
ugggauccucca

SEQ ID NO: 1520577 - RNA, 13 nt, Human
ugggauccuccag

SEQ ID NO: 1520578 - RNA, 14 nt, Human
ugggagugggccca

SEQ ID NO: 1520579 - RNA, 16 nt, Human
ugggagugggcccaau

SEQ ID NO: 1520580 - RNA, 16 nt, Human
uggcugggggccucag

SEQ ID NO: 1520581 - RNA, 17 nt, Human
uggcugggggccucagu

SEQ ID NO: 1520582 - RNA, 20 nt, Human
uggcugggggccucagugcc

SEQ ID NO: 1520583 - RNA, 13 nt, Human
ugguauguuuuca

SEQ ID NO: 1520584 - RNA, 21 nt, Human
ugguauguuuucaggcuagau

SEQ ID NO: 1520585 - RNA, 20 nt, Human
ugggucaccagacggggcug

SEQ ID NO: 1520586 - RNA, 21 nt, Human
ugggucaccagacggggcugg

SEQ ID NO: 1520587 - RNA, 19 nt, Human
ugggucaccagacggggcu

SEQ ID NO: 1520588 - RNA, 13 nt, Human
ugggucaaggaau

SEQ ID NO: 1520589 - RNA, 14 nt, Human
uggucccccuucca

SEQ ID NO: 1520590 - RNA, 22 nt, Human
uggucacaggaaguagaggagg

SEQ ID NO: 1520591 - RNA, 15 nt, Human
uggucccccuuccau

SEQ ID NO: 1520592 - RNA, 16 nt, Human
uggucccccuuccaug

SEQ ID NO: 1520593 - RNA, 18 nt, Human
uggucccccuuccaugga

SEQ ID NO: 1520594 - RNA, 23 nt, Human
uggucccccuuccauggacuuug

SEQ ID NO: 1520595 - RNA, 13 nt, Human
ugguccugcugca

SEQ ID NO: 1520596 - RNA, 15 nt, Human
ugguccugcugcagu

SEQ ID NO: 1520597 - RNA, 23 nt, Human
ugguccugcugcaguugccaguc

SEQ ID NO: 1520598 - RNA, 17 nt, Human
ugguccuaaucuucuga

SEQ ID NO: 1520599 - RNA, 19 nt, Human
ugguccuaaucuucugaac

SEQ ID NO: 1520600 - RNA, 17 nt, Human
uggucggaaaacaugcu

SEQ ID NO: 1520601 - RNA, 14 nt, Human
uggucggaaaacau

SEQ ID NO: 1520602 - RNA, 19 nt, Human
uggucuacacugugcugag

SEQ ID NO: 1520603 - RNA, 13 nt, Human
uggugaccucugc

SEQ ID NO: 1520604 - RNA, 14 nt, Human
uggugaccucugcc

SEQ ID NO: 1520605 - RNA, 15 nt, Human
uggucuacacugugc

SEQ ID NO: 1520606 - RNA, 16 nt, Human
uggucuacacugugcu

SEQ ID NO: 1520607 - RNA, 17 nt, Human
uggucuacacugugcug

SEQ ID NO: 1520608 - RNA, 18 nt, Human
uggucuacacugugcuga

SEQ ID NO: 1520609 - RNA, 21 nt, Human
uggugcaaugaccuuucaaua

SEQ ID NO: 1520610 - RNA, 19 nt, Human
uggugacuuuccucuuugg

SEQ ID NO: 1520611 - RNA, 15 nt, Human
uggugaccucugccu

SEQ ID NO: 1520612 - RNA, 16 nt, Human
uggugaccucugccug

SEQ ID NO: 1520613 - RNA, 17 nt, Human
uggugaccucugccuga

SEQ ID NO: 1520614 - RNA, 22 nt, Human
uggugaccucugccugaaguca

SEQ ID NO: 1520615 - RNA, 11 nt, Human
uggacugaggc

SEQ ID NO: 1520616 - RNA, 14 nt, Human
uggacugaggccug

SEQ ID NO: 1520617 - RNA, 15 nt, Human
uggacugaggccuga

SEQ ID NO: 1520618 - RNA, 16 nt, Human
uggacugaggccugag

SEQ ID NO: 1520619 - RNA, 20 nt, Human
uggcaauagucaaauugugu

SEQ ID NO: 1520620 - RNA, 15 nt, Human
uggcacuaguauuuc

SEQ ID NO: 1520621 - RNA, 22 nt, Human
uggcagaauggggugcaugaag

SEQ ID NO: 1520622 - RNA, 15 nt, Human
uggcacuauaaugua

SEQ ID NO: 1520623 - RNA, 16 nt, Human
uggcacuauaauguaa

SEQ ID NO: 1520624 - RNA, 16 nt, Human
uggcaaaaaggcagga

SEQ ID NO: 1520625 - RNA, 12 nt, Human
uggcaaaaaggc

SEQ ID NO: 1520626 - RNA, 20 nt, Human
uggaggagcucaggacacua

SEQ ID NO: 1520627 - RNA, 22 nt, Human
uggaggagcucaggacacuaau

SEQ ID NO: 1520628 - RNA, 21 nt, Human
uggaggaaggaaacccagcuc

SEQ ID NO: 1520629 - RNA, 23 nt, Human
uggaggaaggaaacccagcucug

SEQ ID NO: 1520630 - RNA, 11 nt, Human
uggcugcuuca

SEQ ID NO: 1520631 - RNA, 15 nt, Human
uggcugcuucaagga

SEQ ID NO: 1520632 - RNA, 16 nt, Human
uggcugcuucaaggau

SEQ ID NO: 1520633 - RNA, 22 nt, Human
uggcgcagcauauucaggaagc

SEQ ID NO: 1520634 - RNA, 23 nt, Human
uggcgcagcauauucaggaagcu

SEQ ID NO: 1520635 - RNA, 16 nt, Human
uggcgcugccccuggc

SEQ ID NO: 1520636 - RNA, 23 nt, Human
uggcgcugccccuggcagccccu

SEQ ID NO: 1520637 - RNA, 20 nt, Human
uggccccugcccggcugcgg

SEQ ID NO: 1520638 - RNA, 15 nt, Human
uggccccugcccggc

SEQ ID NO: 1520639 - RNA, 16 nt, Human
uggccccugcccggcu

SEQ ID NO: 1520640 - RNA, 15 nt, Human
uggccaggcuggucu

SEQ ID NO: 1520641 - RNA, 13 nt, Human
uggccaggcuggu

SEQ ID NO: 1520642 - RNA, 20 nt, Human
uggccagaugcaccagcccu

SEQ ID NO: 1520643 - RNA, 19 nt, Human
uggccagaugcaccagccc

SEQ ID NO: 1520644 - RNA, 15 nt, Human
uggcagaguugaaga

SEQ ID NO: 1520645 - RNA, 21 nt, Human
uggcagaguggauucuugaac

SEQ ID NO: 1520646 - RNA, 17 nt, Human
uggcagaguugaagaca

SEQ ID NO: 1520647 - RNA, 19 nt, Human
uggcagaguugaagacaga

SEQ ID NO: 1520648 - RNA, 17 nt, Human
uggccagaugcaccagc

SEQ ID NO: 1520649 - RNA, 18 nt, Human
uggccagaugcaccagcc

SEQ ID NO: 1520650 - RNA, 17 nt, Human
ugcggacagccacggcc

SEQ ID NO: 1520651 - RNA, 20 nt, Human
ugcuaacuagcuuggaaacu

SEQ ID NO: 1520652 - RNA, 22 nt, Human
ugcuaacuagcuuggaaacugg

SEQ ID NO: 1520653 - RNA, 21 nt, Human
ugcuacuguccuacccacccu

SEQ ID NO: 1520654 - RNA, 22 nt, Human
ugcuacuguccuacccacccuc

SEQ ID NO: 1520655 - RNA, 22 nt, Human
ugcuaggaacacuccuucacag

SEQ ID NO: 1520656 - RNA, 18 nt, Human
ugcuagaacucccuuuca

SEQ ID NO: 1520657 - RNA, 21 nt, Human
ugcuaggaacacuccuucaca

SEQ ID NO: 1520658 - RNA, 13 nt, Human
ugcuagaacuccc

SEQ ID NO: 1520659 - RNA, 14 nt, Human
ugcuagaacucccu

SEQ ID NO: 1520660 - RNA, 15 nt, Human
ugcuagaacucccuu

SEQ ID NO: 1520661 - RNA, 17 nt, Human
ugcuagaacucccuuuc

SEQ ID NO: 1520662 - RNA, 23 nt, Human
ugcucuccgaccagacaccuuga

SEQ ID NO: 1520663 - RNA, 16 nt, Human
ugcuguucaugaaaga

SEQ ID NO: 1520664 - RNA, 17 nt, Human
ugcuguucaugaaagau

SEQ ID NO: 1520665 - RNA, 11 nt, Human
ugcuguguuaa

SEQ ID NO: 1520666 - RNA, 18 nt, Human
ugcuguguuaaauaaacc

SEQ ID NO: 1520667 - RNA, 18 nt, Human
ugcuguaacuuucugaaa

SEQ ID NO: 1520668 - RNA, 20 nt, Human
ugcugggggggauuguaaaa

SEQ ID NO: 1520669 - RNA, 17 nt, Human
ugcugggcuugucugua

SEQ ID NO: 1520670 - RNA, 13 nt, Human
ugcuggguguggc

SEQ ID NO: 1520671 - RNA, 23 nt, Human
ugcugcauuuaaaagauacaguu

SEQ ID NO: 1520672 - RNA, 19 nt, Human
ugcugcauuuaaaagauac

SEQ ID NO: 1520673 - RNA, 18 nt, Human
ugcugcauuuaaaagaua

SEQ ID NO: 1520674 - RNA, 17 nt, Human
ugcugcauuuaaaagau

SEQ ID NO: 1520675 - RNA, 20 nt, Human
ugcugggauuacagguguga

SEQ ID NO: 1520676 - RNA, 19 nt, Human
ugcugcuugaggcaacuca

SEQ ID NO: 1520677 - RNA, 12 nt, Human
ugcugcuugagg

SEQ ID NO: 1520678 - RNA, 18 nt, Human
ugcccaggcuggcgugca

SEQ ID NO: 1520679 - RNA, 19 nt, Human
ugcccaggcuggcgugcag

SEQ ID NO: 1520680 - RNA, 20 nt, Human
ugcccaggcuggcgugcagu

SEQ ID NO: 1520681 - RNA, 17 nt, Human
ugccccuggcagccccu

SEQ ID NO: 1520682 - RNA, 12 nt, Human
ugcccggcugcg

SEQ ID NO: 1520683 - RNA, 14 nt, Human
ugcccggcugcgga

SEQ ID NO: 1520684 - RNA, 16 nt, Human
ugccccuggcagcccc

SEQ ID NO: 1520685 - RNA, 15 nt, Human
ugccucaagagaagg

SEQ ID NO: 1520686 - RNA, 14 nt, Human
ugccucaagagaag

SEQ ID NO: 1520687 - RNA, 16 nt, Human
ugccuccucaggagcc

SEQ ID NO: 1520688 - RNA, 13 nt, Human
ugccuccucagga

SEQ ID NO: 1520689 - RNA, 15 nt, Human
ugcccugcccaccug

SEQ ID NO: 1520690 - RNA, 16 nt, Human
ugcccugcccaccugg

SEQ ID NO: 1520691 - RNA, 20 nt, Human
ugcccugcccaccuggccuc

SEQ ID NO: 1520692 - RNA, 21 nt, Human
ugcccugcccaccuggccucu

SEQ ID NO: 1520693 - RNA, 23 nt, Human
ugcccugugaguacuacaguccu

SEQ ID NO: 1520694 - RNA, 16 nt, Human
ugccacuaaauugaca

SEQ ID NO: 1520695 - RNA, 20 nt, Human
ugccaggaagccagcaggcu

SEQ ID NO: 1520696 - RNA, 22 nt, Human
ugccaggaagccagcaggcucu

SEQ ID NO: 1520697 - RNA, 14 nt, Human
ugccaggcauggug

SEQ ID NO: 1520698 - RNA, 20 nt, Human
ugccacuaaauugacacuua

SEQ ID NO: 1520699 - RNA, 23 nt, Human
ugcauuuggugguuucagaaaug

SEQ ID NO: 1520700 - RNA, 21 nt, Human
ugcauuuggugguuucagaaa

SEQ ID NO: 1520701 - RNA, 17 nt, Human
ugcaugguuuagaaagc

SEQ ID NO: 1520702 - RNA, 13 nt, Human
ugcaucagcugcu

SEQ ID NO: 1520703 - RNA, 19 nt, Human
ugcaucagcugcugaaaca

SEQ ID NO: 1520704 - RNA, 22 nt, Human
ugcaucaauuuuucuuauuuca

SEQ ID NO: 1520705 - RNA, 12 nt, Human
ugcaguucugaa

SEQ ID NO: 1520706 - RNA, 14 nt, Human
ugcaguucugaaga

SEQ ID NO: 1520707 - RNA, 16 nt, Human
ugcaguugccagucac

SEQ ID NO: 1520708 - RNA, 16 nt, Human
ugcauagguuuagcag

SEQ ID NO: 1520709 - RNA, 21 nt, Human
ugcaguuacacuaaaagguga

SEQ ID NO: 1520710 - RNA, 21 nt, Human
ugcaguggugcgaucuggguu

SEQ ID NO: 1520711 - RNA, 13 nt, Human
ugcagggaguccg

SEQ ID NO: 1520712 - RNA, 18 nt, Human
ugacagaauauguuucaa

SEQ ID NO: 1520713 - RNA, 22 nt, Human
ugacagagugagacucugucuc

SEQ ID NO: 1520714 - RNA, 19 nt, Human
ugacagagugagacucugu

SEQ ID NO: 1520715 - RNA, 18 nt, Human
ugacagaggcagccccau

SEQ ID NO: 1520716 - RNA, 23 nt, Human
ugacagaggcagccccauucugc

SEQ ID NO: 1520717 - RNA, 14 nt, Human
ugacagagugagac

SEQ ID NO: 1520718 - RNA, 17 nt, Human
ugacagagugagacucu

SEQ ID NO: 1520719 - RNA, 20 nt, Human
ugacagacacaggcccggcu

SEQ ID NO: 1520720 - RNA, 23 nt, Human
ugacagacacaggcccggcucca

SEQ ID NO: 1520721 - RNA, 14 nt, Human
ugacagaggcagcc

SEQ ID NO: 1520722 - RNA, 15 nt, Human
ugacagaggcagccc

SEQ ID NO: 1520723 - RNA, 16 nt, Human
ugacagaggcagcccc

SEQ ID NO: 1520724 - RNA, 17 nt, Human
ugacagaggcagcccca

SEQ ID NO: 1520725 - RNA, 12 nt, Human
ugacaagcucac

SEQ ID NO: 1520726 - RNA, 15 nt, Human
ugacaagcucacaga

SEQ ID NO: 1520727 - RNA, 20 nt, Human
ugacaagcucacagaccuuu

SEQ ID NO: 1520728 - RNA, 18 nt, Human
ugacaaggauugcuacug

SEQ ID NO: 1520729 - RNA, 13 nt, Human
ugacagaacacug

SEQ ID NO: 1520730 - RNA, 14 nt, Human
ugacagaacacugu

SEQ ID NO: 1520731 - RNA, 15 nt, Human
ugacagaacacuguc

SEQ ID NO: 1520732 - RNA, 16 nt, Human
ugacagaacacugucu

SEQ ID NO: 1520733 - RNA, 17 nt, Human
ugacagaacacugucuu

SEQ ID NO: 1520734 - RNA, 21 nt, Human
ugacagaacacugucuugaag

SEQ ID NO: 1520735 - RNA, 16 nt, Human
ugacagaauauguuuc

SEQ ID NO: 1520736 - RNA, 16 nt, Human
ugacaugggacauuug

SEQ ID NO: 1520737 - RNA, 17 nt, Human
ugacaugggacauuugc

SEQ ID NO: 1520738 - RNA, 18 nt, Human
ugacaugggacauuugcu

SEQ ID NO: 1520739 - RNA, 13 nt, Human
ugacaugucuuuu

SEQ ID NO: 1520740 - RNA, 15 nt, Human
ugacaugucuuuucu

SEQ ID NO: 1520741 - RNA, 20 nt, Human
ugaccacugcagaagacagu

SEQ ID NO: 1520742 - RNA, 19 nt, Human
ugaccagcaccaucucucc

SEQ ID NO: 1520743 - RNA, 20 nt, Human
ugaccagcaccaucucuccu

SEQ ID NO: 1520744 - RNA, 16 nt, Human
ugaccauucuccaccu

SEQ ID NO: 1520745 - RNA, 17 nt, Human
ugaccauucuccaccug

SEQ ID NO: 1520746 - RNA, 18 nt, Human
ugaccauucuccaccugc

SEQ ID NO: 1520747 - RNA, 19 nt, Human
ugaccauucuccaccugcc

SEQ ID NO: 1520748 - RNA, 13 nt, Human
ugaccgugaggcc

SEQ ID NO: 1520749 - RNA, 14 nt, Human
ugaccgugaggcca

SEQ ID NO: 1520750 - RNA, 16 nt, Human
ugaccgugaggccaga

SEQ ID NO: 1520751 - RNA, 20 nt, Human
ugaccgugaggccagagaca

SEQ ID NO: 1520752 - RNA, 15 nt, Human
ugaagauacugaaau

SEQ ID NO: 1520753 - RNA, 16 nt, Human
ugaagauacugaaaua

SEQ ID NO: 1520754 - RNA, 18 nt, Human
ugaagauacugaaauaaa

SEQ ID NO: 1520755 - RNA, 14 nt, Human
ugaagauacugaaa

SEQ ID NO: 1520756 - RNA, 17 nt, Human
ugaacuccuggccucaa

SEQ ID NO: 1520757 - RNA, 15 nt, Human
ugaaggccccgccca

SEQ ID NO: 1520758 - RNA, 16 nt, Human
ugaaggccccgcccag

SEQ ID NO: 1520759 - RNA, 22 nt, Human
ugaaggacauugcggacagcca

SEQ ID NO: 1520760 - RNA, 19 nt, Human
ugaaggacauugcggacag

SEQ ID NO: 1520761 - RNA, 20 nt, Human
ugaaggacauugcggacagc

SEQ ID NO: 1520762 - RNA, 13 nt, Human
ugaaguccaagca

SEQ ID NO: 1520763 - RNA, 11 nt, Human
ugaaguccaag

SEQ ID NO: 1520764 - RNA, 17 nt, Human
ugaaggccccgcccagg

SEQ ID NO: 1520765 - RNA, 15 nt, Human
ugaauuacauuugua

SEQ ID NO: 1520766 - RNA, 16 nt, Human
ugaauuacauuuguau

SEQ ID NO: 1520767 - RNA, 18 nt, Human
ugaauuacauuuguauaa

SEQ ID NO: 1520768 - RNA, 13 nt, Human
ugaauuaugaaac

SEQ ID NO: 1520769 - RNA, 15 nt, Human
ugaauuaugaaacuu

SEQ ID NO: 1520770 - RNA, 17 nt, Human
ugaauuaugaaacuuuu

SEQ ID NO: 1520771 - RNA, 23 nt, Human
ugaaugaugauccuaggcauuug

SEQ ID NO: 1520772 - RNA, 19 nt, Human
ucuuuccacagaagcucca

SEQ ID NO: 1520773 - RNA, 17 nt, Human
ucuuuccaaaguacacu

SEQ ID NO: 1520774 - RNA, 14 nt, Human
ucuuuccaaaguac

SEQ ID NO: 1520775 - RNA, 13 nt, Human
ucuuuccaaagua

SEQ ID NO: 1520776 - RNA, 16 nt, Human
ucuuucagccaagaau

SEQ ID NO: 1520777 - RNA, 19 nt, Human
ucuuucagccaagaauucu

SEQ ID NO: 1520778 - RNA, 20 nt, Human
ucuuucagccaagaauucuu

SEQ ID NO: 1520779 - RNA, 21 nt, Human
ucuuucagccaagaauucuua

SEQ ID NO: 1520780 - RNA, 12 nt, Human
ucuuugccaagu

SEQ ID NO: 1520781 - RNA, 15 nt, Human
ucuuugauucuccuu

SEQ ID NO: 1520782 - RNA, 16 nt, Human
ucuuugauucuccuuc

SEQ ID NO: 1520783 - RNA, 19 nt, Human
ucuuugauucuccuucagc

SEQ ID NO: 1520784 - RNA, 20 nt, Human
ucuuugauucuccuucagcc

SEQ ID NO: 1520785 - RNA, 23 nt, Human
ucuuugauucuccuucagcccuc

SEQ ID NO: 1520786 - RNA, 17 nt, Human
ucuuuggacacucacac

SEQ ID NO: 1520787 - RNA, 16 nt, Human
ucucccuucauccuuc

SEQ ID NO: 1520788 - RNA, 20 nt, Human
ucuccucugcugcuggcugg

SEQ ID NO: 1520789 - RNA, 15 nt, Human
ucuugcaugaggcua

SEQ ID NO: 1520790 - RNA, 16 nt, Human
ucuuguguguuuauug

SEQ ID NO: 1520791 - RNA, 21 nt, Human
ucuuguguguuuauugucaaa

SEQ ID NO: 1520792 - RNA, 23 nt, Human
ucuuucacccuuuucuguuugcu

SEQ ID NO: 1520793 - RNA, 16 nt, Human
ugaaauauugacuuuu

SEQ ID NO: 1520794 - RNA, 19 nt, Human
ugaacaguuguguuugaag

SEQ ID NO: 1520795 - RNA, 22 nt, Human
ugaaccaagaacuuuccaggaa

SEQ ID NO: 1520796 - RNA, 19 nt, Human
ugaaccacaucuugcucug

SEQ ID NO: 1520797 - RNA, 23 nt, Human
ugaaccacaucuugcucugcuga

SEQ ID NO: 1520798 - RNA, 17 nt, Human
ugaaccaccacacccag

SEQ ID NO: 1520799 - RNA, 20 nt, Human
ugaaccaccacacccagccc

SEQ ID NO: 1520800 - RNA, 21 nt, Human
ugaaccaccacacccagccca

SEQ ID NO: 1520801 - RNA, 20 nt, Human
ugaaaagcuccauuuuuagu

SEQ ID NO: 1520802 - RNA, 13 nt, Human
ugaaaauuuugau

SEQ ID NO: 1520803 - RNA, 21 nt, Human
ugaaaauuuugauguuuuaag

SEQ ID NO: 1520804 - RNA, 19 nt, Human
ugaaaauuuugauguuuua

SEQ ID NO: 1520805 - RNA, 22 nt, Human
ugaaacaacaaauaggaauugu

SEQ ID NO: 1520806 - RNA, 14 nt, Human
ugaaacauuuuguc

SEQ ID NO: 1520807 - RNA, 16 nt, Human
ugaaagguacuucaaa

SEQ ID NO: 1520808 - RNA, 15 nt, Human
ugaaagguacuucaa

SEQ ID NO: 1520809 - RNA, 15 nt, Human
ugaaagggcccagag

SEQ ID NO: 1520810 - RNA, 23 nt, Human
ugaaagggaguauuacaaaaaca

SEQ ID NO: 1520811 - RNA, 13 nt, Human
ugaaagggcccag

SEQ ID NO: 1520812 - RNA, 18 nt, Human
ugaaacccugucucuacu

SEQ ID NO: 1520813 - RNA, 18 nt, Human
ugaaagaggcagcuugaa

SEQ ID NO: 1520814 - RNA, 18 nt, Human
ugaaagcccugagcuuuc

SEQ ID NO: 1520815 - RNA, 13 nt, Human
ugagcugggauga

SEQ ID NO: 1520816 - RNA, 23 nt, Human
ugaggcauuuguuugaacugaua

SEQ ID NO: 1520817 - RNA, 23 nt, Human
ugaggcuagugugguguuuccug

SEQ ID NO: 1520818 - RNA, 21 nt, Human
ugaggcauuuguuugaacuga

SEQ ID NO: 1520819 - RNA, 17 nt, Human
ugaggcuaguguggugu

SEQ ID NO: 1520820 - RNA, 20 nt, Human
ugaggcauuuguuugaacug

SEQ ID NO: 1520821 - RNA, 19 nt, Human
ugaggcauuuguuugaacu

SEQ ID NO: 1520822 - RNA, 12 nt, Human
ugaggcauuugu

SEQ ID NO: 1520823 - RNA, 15 nt, Human
ugaggcucugcccuu

SEQ ID NO: 1520824 - RNA, 17 nt, Human
ugagggaacagagaggu

SEQ ID NO: 1520825 - RNA, 18 nt, Human
ugaggcuccacuuggucu

SEQ ID NO: 1520826 - RNA, 20 nt, Human
ugaggcuccacuuggucugu

SEQ ID NO: 1520827 - RNA, 13 nt, Human
ugaggcucugccc

SEQ ID NO: 1520828 - RNA, 14 nt, Human
ugaggcucugcccu

SEQ ID NO: 1520829 - RNA, 12 nt, Human
ugaggugggagg

SEQ ID NO: 1520830 - RNA, 13 nt, Human
ugaggugggagga

SEQ ID NO: 1520831 - RNA, 16 nt, Human
ugauaacuggaaacuu

SEQ ID NO: 1520832 - RNA, 14 nt, Human
ugagugagcaugcc

SEQ ID NO: 1520833 - RNA, 16 nt, Human
ugaguugauagcacag

SEQ ID NO: 1520834 - RNA, 20 nt, Human
ugaguugauagcacagaccc

SEQ ID NO: 1520835 - RNA, 23 nt, Human
ugaguugacuugacagaacacug

SEQ ID NO: 1520836 - RNA, 21 nt, Human
ugaguugauagcacagacccu

SEQ ID NO: 1520837 - RNA, 19 nt, Human
ugagucgaggacagggagg

SEQ ID NO: 1520838 - RNA, 21 nt, Human
ugaggugggaggaucucuuga

SEQ ID NO: 1520839 - RNA, 19 nt, Human
ugaguccagaaguuugaga

SEQ ID NO: 1520840 - RNA, 13 nt, Human
ugagucugaaggc

SEQ ID NO: 1520841 - RNA, 15 nt, Human
ugagucugaaggcug

SEQ ID NO: 1520842 - RNA, 17 nt, Human
ugagucugaaggcuggg

SEQ ID NO: 1520843 - RNA, 18 nt, Human
ugagucugaaggcugggu

SEQ ID NO: 1520844 - RNA, 23 nt, Human
ugagacguuuuuggaagaguagu

SEQ ID NO: 1520845 - RNA, 12 nt, Human
ugagacucgaga

SEQ ID NO: 1520846 - RNA, 15 nt, Human
ugagacucgagaacu

SEQ ID NO: 1520847 - RNA, 16 nt, Human
ugagacucgagaacuu

SEQ ID NO: 1520848 - RNA, 19 nt, Human
ugagacucgcgacaaugca

SEQ ID NO: 1520849 - RNA, 20 nt, Human
ugaccucaggugauccaccc

SEQ ID NO: 1520850 - RNA, 21 nt, Human
ugaccucaggugauccaccca

SEQ ID NO: 1520851 - RNA, 17 nt, Human
ugagacucgagaacuuu

SEQ ID NO: 1520852 - RNA, 16 nt, Human
ugagagugaacaaauu

SEQ ID NO: 1520853 - RNA, 20 nt, Human
ugagacucgcgacaaugcaa

SEQ ID NO: 1520854 - RNA, 21 nt, Human
ugagacucgcgacaaugcaaa

SEQ ID NO: 1520855 - RNA, 22 nt, Human
ugagacucgcgacaaugcaaac

SEQ ID NO: 1520856 - RNA, 23 nt, Human
ugagacucgcgacaaugcaaacc

SEQ ID NO: 1520857 - RNA, 15 nt, Human
ugagaucaaaacggu

SEQ ID NO: 1520858 - RNA, 14 nt, Human
ugagaucagccugg

SEQ ID NO: 1520859 - RNA, 15 nt, Human
ugagaucagccuggg

SEQ ID NO: 1520860 - RNA, 13 nt, Human
ugagcagggcuca

SEQ ID NO: 1520861 - RNA, 14 nt, Human
ugagcagggcucag

SEQ ID NO: 1520862 - RNA, 15 nt, Human
ugagcagggcucagc

SEQ ID NO: 1520863 - RNA, 19 nt, Human
ugagccgagaucacgccac

SEQ ID NO: 1520864 - RNA, 21 nt, Human
ugagccgagaucacgccacug

SEQ ID NO: 1520865 - RNA, 17 nt, Human
ugagccucagcauccug

SEQ ID NO: 1520866 - RNA, 22 nt, Human
ugagccucagcauccuggcacc

SEQ ID NO: 1520867 - RNA, 18 nt, Human
ugagccucagcauccugg

SEQ ID NO: 1520868 - RNA, 21 nt, Human
ugagccucagcauccuggcac

SEQ ID NO: 1520869 - RNA, 18 nt, Human
ugagcaucaggccaggcc

SEQ ID NO: 1520870 - RNA, 19 nt, Human
ugagcaucaggccaggccc

SEQ ID NO: 1520871 - RNA, 20 nt, Human
ugagcaucaggccaggcccu

SEQ ID NO: 1520872 - RNA, 19 nt, Human
ugagcagggcucagcgggg

SEQ ID NO: 1520873 - RNA, 16 nt, Human
ugagcagggcucagcg

SEQ ID NO: 1520874 - RNA, 17 nt, Human
ugagcagggcucagcgg

SEQ ID NO: 1520875 - RNA, 13 nt, Human
ugauuauauguca

SEQ ID NO: 1520876 - RNA, 17 nt, Human
ugauuaugaauuacauu

SEQ ID NO: 1520877 - RNA, 19 nt, Human
ugauuaugaauuacauuug

SEQ ID NO: 1520878 - RNA, 22 nt, Human
ugauguuuagaaacacaacuau

SEQ ID NO: 1520879 - RNA, 20 nt, Human
ugauguucuuucacccuuuu

SEQ ID NO: 1520880 - RNA, 21 nt, Human
ugauuaugaauuacauuugua

SEQ ID NO: 1520881 - RNA, 22 nt, Human
ugauuaugaauuacauuuguau

SEQ ID NO: 1520882 - RNA, 20 nt, Human
ugauucaacagguuuuccug

SEQ ID NO: 1520883 - RNA, 13 nt, Human
ugauucagacagc

SEQ ID NO: 1520884 - RNA, 14 nt, Human
ugauucagacagcu

SEQ ID NO: 1520885 - RNA, 15 nt, Human
ugauucagacagcug

SEQ ID NO: 1520886 - RNA, 16 nt, Human
ugauucagacagcugc

SEQ ID NO: 1520887 - RNA, 16 nt, Human
ugauugugucucuugg

SEQ ID NO: 1520888 - RNA, 13 nt, Human
ugauuggaggggg

SEQ ID NO: 1520889 - RNA, 21 nt, Human
ugauuggaggggggagguggg

SEQ ID NO: 1520890 - RNA, 23 nt, Human
ugauucuccuucagcccucaccc

SEQ ID NO: 1520891 - RNA, 18 nt, Human
ugauucagacagcugccu

SEQ ID NO: 1520892 - RNA, 19 nt, Human
ugauucagacagcugccug

SEQ ID NO: 1520893 - RNA, 20 nt, Human
ugauucagacagcugccugg

SEQ ID NO: 1520894 - RNA, 21 nt, Human
ugauucagacagcugccuggg

SEQ ID NO: 1520895 - RNA, 23 nt, Human
ugauucagacagcugccugggau

SEQ ID NO: 1520896 - RNA, 21 nt, Human
ugauucuccugccucagccuc

SEQ ID NO: 1520897 - RNA, 12 nt, Human
ugauucuccuuc

SEQ ID NO: 1520898 - RNA, 13 nt, Human
ugauucuccuuca

SEQ ID NO: 1520899 - RNA, 14 nt, Human
ugauucuccuucag

SEQ ID NO: 1520900 - RNA, 16 nt, Human
ugauucuccuucagcc

SEQ ID NO: 1520901 - RNA, 18 nt, Human
ugauucuccuucagcccu

SEQ ID NO: 1520902 - RNA, 19 nt, Human
ugauucuccuucagcccuc

SEQ ID NO: 1520903 - RNA, 21 nt, Human
ugauucuccuucagcccucac

SEQ ID NO: 1520904 - RNA, 16 nt, Human
ugaugcuucuucagag

SEQ ID NO: 1520905 - RNA, 17 nt, Human
ugaugcuucuucagaga

SEQ ID NO: 1520906 - RNA, 18 nt, Human
ugaugcuucuucagagac

SEQ ID NO: 1520907 - RNA, 14 nt, Human
ugauguguuuauuu

SEQ ID NO: 1520908 - RNA, 18 nt, Human
ugauguguuuauuuauag

SEQ ID NO: 1520909 - RNA, 16 nt, Human
ugauguguuaucucuu

SEQ ID NO: 1520910 - RNA, 18 nt, Human
ugaugugggucaaggaau

SEQ ID NO: 1520911 - RNA, 20 nt, Human
ugaugcuacaggauuugaaa

SEQ ID NO: 1520912 - RNA, 23 nt, Human
ugaugcuacaggauuugaaauug

SEQ ID NO: 1520913 - RNA, 18 nt, Human
ugaucuuugcagacaggc

SEQ ID NO: 1520914 - RNA, 16 nt, Human
ugaucuuugcagacag

SEQ ID NO: 1520915 - RNA, 17 nt, Human
ugaucuuuaaaauacac

SEQ ID NO: 1520916 - RNA, 17 nt, Human
ugaucagcuuauugucu

SEQ ID NO: 1520917 - RNA, 24 nt, Human
ugaucagcuuauugucuagugaaa

SEQ ID NO: 1520918 - RNA, 20 nt, Human
ugauaagaaccuuuugagug

SEQ ID NO: 1520919 - RNA, 13 nt, Human
ugauagcacagac

SEQ ID NO: 1520920 - RNA, 14 nt, Human
ugauagcacagacc

SEQ ID NO: 1520921 - RNA, 13 nt, Human
ugauccaagcugg

SEQ ID NO: 1520922 - RNA, 14 nt, Human
ugauccaagcuggu

SEQ ID NO: 1520923 - RNA, 15 nt, Human
ugauccaagcugguc

SEQ ID NO: 1520924 - RNA, 17 nt, Human
ugauccaagcugguccc

SEQ ID NO: 1520925 - RNA, 20 nt, Human
ugaucuucuuuauaauucua

SEQ ID NO: 1520926 - RNA, 14 nt, Human
ugaucuuuaaaaua

SEQ ID NO: 1520927 - RNA, 17 nt, Human
ugaucucucgugauuga

SEQ ID NO: 1520928 - RNA, 17 nt, Human
ugauccacccaccucag

SEQ ID NO: 1520929 - RNA, 18 nt, Human
ugauccacccaccucagc

SEQ ID NO: 1520930 - RNA, 19 nt, Human
ugauccacccaccucagcc

SEQ ID NO: 1520931 - RNA, 22 nt, Human
ucuccagccccuggaugcagcc

SEQ ID NO: 1520932 - RNA, 16 nt, Human
ucuccagccccuggau

SEQ ID NO: 1520933 - RNA, 18 nt, Human
ucuccagccccuggaugc

SEQ ID NO: 1520934 - RNA, 12 nt, Human
ucuccagccccu

SEQ ID NO: 1520935 - RNA, 13 nt, Human
ucuccagccccug

SEQ ID NO: 1520936 - RNA, 14 nt, Human
ucuccagccccugg

SEQ ID NO: 1520937 - RNA, 15 nt, Human
ucuccagccccugga

SEQ ID NO: 1520938 - RNA, 16 nt, Human
ucuccccugcccccag

SEQ ID NO: 1520939 - RNA, 12 nt, Human
ucuccccugccc

SEQ ID NO: 1520940 - RNA, 14 nt, Human
ucuccccugccccc

SEQ ID NO: 1520941 - RNA, 15 nt, Human
ucuccccugccccca

SEQ ID NO: 1520942 - RNA, 18 nt, Human
ucucccucagucuggccc

SEQ ID NO: 1520943 - RNA, 23 nt, Human
ucucccucagucuggcccuuccu

SEQ ID NO: 1520944 - RNA, 12 nt, Human
ucucccccaccc

SEQ ID NO: 1520945 - RNA, 15 nt, Human
ucucccccacccccu

SEQ ID NO: 1520946 - RNA, 11 nt, Human
ucuccaggcug

SEQ ID NO: 1520947 - RNA, 12 nt, Human
ucucccccagcc

SEQ ID NO: 1520948 - RNA, 19 nt, Human
ucucccccacccccucccc

SEQ ID NO: 1520949 - RNA, 20 nt, Human
ucucccccacccccuccccg

SEQ ID NO: 1520950 - RNA, 13 nt, Human
ucucccccagccc

SEQ ID NO: 1520951 - RNA, 23 nt, Human
ucucaguccaugaagauguagag

SEQ ID NO: 1520952 - RNA, 23 nt, Human
ucuaugggacucaaugcacugac

SEQ ID NO: 1520953 - RNA, 19 nt, Human
ucuaugggacucaaugcac

SEQ ID NO: 1520954 - RNA, 12 nt, Human
ucuaugggacuc

SEQ ID NO: 1520955 - RNA, 13 nt, Human
ucuaugggacuca

SEQ ID NO: 1520956 - RNA, 13 nt, Human
ucucaucuuucuu

SEQ ID NO: 1520957 - RNA, 22 nt, Human
ucucaucuuucuugaucaacau

SEQ ID NO: 1520958 - RNA, 12 nt, Human
ucucaucuuucu

SEQ ID NO: 1520959 - RNA, 20 nt, Human
ucucaucucuuagcuccccu

SEQ ID NO: 1520960 - RNA, 17 nt, Human
ucucaucucuuagcucc

SEQ ID NO: 1520961 - RNA, 16 nt, Human
ucucauacucaccuca

SEQ ID NO: 1520962 - RNA, 18 nt, Human
ucucauacucaccucacc

SEQ ID NO: 1520963 - RNA, 13 nt, Human
ucuccacccugcu

SEQ ID NO: 1520964 - RNA, 17 nt, Human
ucuccacccugcucucc

SEQ ID NO: 1520965 - RNA, 14 nt, Human
ucuccacccugcuc

SEQ ID NO: 1520966 - RNA, 16 nt, Human
ucuccacccugcucuc

SEQ ID NO: 1520967 - RNA, 22 nt, Human
ucuccaccugccagggacagag

SEQ ID NO: 1520968 - RNA, 17 nt, Human
ucuccaccugccaggga

SEQ ID NO: 1520969 - RNA, 19 nt, Human
ucuccaccugccagggaca

SEQ ID NO: 1520970 - RNA, 14 nt, Human
ucuccaccugccag

SEQ ID NO: 1520971 - RNA, 15 nt, Human
ucuccaccugccagg

SEQ ID NO: 1520972 - RNA, 16 nt, Human
ucuccaccugccaggg

SEQ ID NO: 1520973 - RNA, 17 nt, Human
ucuacacuaagagagaa

SEQ ID NO: 1520974 - RNA, 16 nt, Human
ucuacacauacaugua

SEQ ID NO: 1520975 - RNA, 15 nt, Human
ucuacagaggccaug

SEQ ID NO: 1520976 - RNA, 16 nt, Human
ucuacagaggccaugg

SEQ ID NO: 1520977 - RNA, 12 nt, Human
ucuacuaaaaau

SEQ ID NO: 1520978 - RNA, 14 nt, Human
ucuaccuuccugca

SEQ ID NO: 1520979 - RNA, 17 nt, Human
ucuaugacacaugcaag

SEQ ID NO: 1520980 - RNA, 14 nt, Human
ucuaugacacaugc

SEQ ID NO: 1520981 - RNA, 16 nt, Human
ucuaucagauuaaguu

SEQ ID NO: 1520982 - RNA, 15 nt, Human
ucuaggaagacuuug

SEQ ID NO: 1520983 - RNA, 16 nt, Human
ucuaggaagacuuugg

SEQ ID NO: 1520984 - RNA, 19 nt, Human
ucuaggaagacuuuggaaa

SEQ ID NO: 1520985 - RNA, 21 nt, Human
ucuaggaagacuuuggaaaga

SEQ ID NO: 1520986 - RNA, 20 nt, Human
ucuaaaggcuaccuuuguau

SEQ ID NO: 1520987 - RNA, 19 nt, Human
ucuaaaggcuaccuuugua

SEQ ID NO: 1520988 - RNA, 17 nt, Human
ucuaaaggcuaccuuug

SEQ ID NO: 1520989 - RNA, 18 nt, Human
ucuaaaggcuaccuuugu

SEQ ID NO: 1520990 - RNA, 12 nt, Human
ucggagaagagc

SEQ ID NO: 1520991 - RNA, 14 nt, Human
ucggagaagagcug

SEQ ID NO: 1520992 - RNA, 16 nt, Human
ucggagaagagcuguu

SEQ ID NO: 1520993 - RNA, 13 nt, Human
ucgugacaacacu

SEQ ID NO: 1520994 - RNA, 16 nt, Human
ucggauuuggggugga

SEQ ID NO: 1520995 - RNA, 17 nt, Human
uccuggcaauagucaaa

SEQ ID NO: 1520996 - RNA, 23 nt, Human
uccuggcacccggccccugcugg

SEQ ID NO: 1520997 - RNA, 13 nt, Human
uccuggcacugcu

SEQ ID NO: 1520998 - RNA, 16 nt, Human
uccuggcacugcuucc

SEQ ID NO: 1520999 - RNA, 17 nt, Human
uccuggcacugcuucca

SEQ ID NO: 1521000 - RNA, 12 nt, Human
uccuggccucaa

SEQ ID NO: 1521001 - RNA, 11 nt, Human
uccuguagccc

SEQ ID NO: 1521002 - RNA, 13 nt, Human
uccuguagcccua

SEQ ID NO: 1521003 - RNA, 14 nt, Human
uccuggaguucugg

SEQ ID NO: 1521004 - RNA, 15 nt, Human
uccuggagcccagag

SEQ ID NO: 1521005 - RNA, 18 nt, Human
uccuggagcccagaggag

SEQ ID NO: 1521006 - RNA, 22 nt, Human
uccuggagcccagaggagggca

SEQ ID NO: 1521007 - RNA, 18 nt, Human
uccugccgcagagcuggc

SEQ ID NO: 1521008 - RNA, 20 nt, Human
uccugccgcagagcuggccg

SEQ ID NO: 1521009 - RNA, 13 nt, Human
uccugccgcagag

SEQ ID NO: 1521010 - RNA, 15 nt, Human
uccugccgcagagcu

SEQ ID NO: 1521011 - RNA, 16 nt, Human
uccugccgcagagcug

SEQ ID NO: 1521012 - RNA, 17 nt, Human
uccugccgcagagcugg

SEQ ID NO: 1521013 - RNA, 20 nt, Human
uccugcccuuaccugccagg

SEQ ID NO: 1521014 - RNA, 17 nt, Human
uccugcccuuaccugcc

SEQ ID NO: 1521015 - RNA, 13 nt, Human
uccugccaggcau

SEQ ID NO: 1521016 - RNA, 14 nt, Human
uccugccaggcaug

SEQ ID NO: 1521017 - RNA, 21 nt, Human
uccugaggcuccacuuggucu

SEQ ID NO: 1521018 - RNA, 19 nt, Human
uccugaggcuccacuuggu

SEQ ID NO: 1521019 - RNA, 20 nt, Human
uccugaggcuccacuugguc

SEQ ID NO: 1521020 - RNA, 17 nt, Human
uccugccccugagccca

SEQ ID NO: 1521021 - RNA, 18 nt, Human
uccugccccugagcccau

SEQ ID NO: 1521022 - RNA, 14 nt, Human
uccuagugaaagag

SEQ ID NO: 1521023 - RNA, 23 nt, Human
uccuagugaaagaggcagcuuga

SEQ ID NO: 1521024 - RNA, 12 nt, Human
uccuaguuccac

SEQ ID NO: 1521025 - RNA, 23 nt, Human
uccuauauuguuuucaguguaca

SEQ ID NO: 1521026 - RNA, 12 nt, Human
uccucccaccuc

SEQ ID NO: 1521027 - RNA, 13 nt, Human
uccucccaccuca

SEQ ID NO: 1521028 - RNA, 10 nt, Human
uccuccaggu

SEQ ID NO: 1521029 - RNA, 18 nt, Human
uccucauuagcauuuugc

SEQ ID NO: 1521030 - RNA, 19 nt, Human
uccgccuuaccaggagaag

SEQ ID NO: 1521031 - RNA, 16 nt, Human
uccgcuuucuacccag

SEQ ID NO: 1521032 - RNA, 18 nt, Human
uccgcuuucuacccagcg

SEQ ID NO: 1521033 - RNA, 20 nt, Human
uccgcuuucuacccagcgag

SEQ ID NO: 1521034 - RNA, 20 nt, Human
uccuaagcuauucaguaaua

SEQ ID NO: 1521035 - RNA, 21 nt, Human
uccuaagcuauucaguaauaa

SEQ ID NO: 1521036 - RNA, 14 nt, Human
uccgccucuugggu

SEQ ID NO: 1521037 - RNA, 15 nt, Human
ucccuuccucuuucc

SEQ ID NO: 1521038 - RNA, 16 nt, Human
ucccuuccucuuucca

SEQ ID NO: 1521039 - RNA, 15 nt, Human
ucccccuuccaugga

SEQ ID NO: 1521040 - RNA, 16 nt, Human
uccaaaguacacuguu

SEQ ID NO: 1521041 - RNA, 14 nt, Human
uccaaaguacacug

SEQ ID NO: 1521042 - RNA, 21 nt, Human
uccacuuggucugugagaugc

SEQ ID NO: 1521043 - RNA, 23 nt, Human
uccacuuggucugugagaugcua

SEQ ID NO: 1521044 - RNA, 20 nt, Human
uccacuuucuagccagagga

SEQ ID NO: 1521045 - RNA, 21 nt, Human
uccacuuucuagccagaggag

SEQ ID NO: 1521046 - RNA, 19 nt, Human
uccaggggugggacacccu

SEQ ID NO: 1521047 - RNA, 20 nt, Human
uccaggggugggacacccug

SEQ ID NO: 1521048 - RNA, 12 nt, Human
uccaggagcagc

SEQ ID NO: 1521049 - RNA, 13 nt, Human
uccaggagcagcc

SEQ ID NO: 1521050 - RNA, 14 nt, Human
uccaggagcagcca

SEQ ID NO: 1521051 - RNA, 15 nt, Human
uccaggagcagccac

SEQ ID NO: 1521052 - RNA, 20 nt, Human
uccaugggccauaugaaaag

SEQ ID NO: 1521053 - RNA, 13 nt, Human
uccauggacuuug

SEQ ID NO: 1521054 - RNA, 15 nt, Human
uccauacauuugugu

SEQ ID NO: 1521055 - RNA, 14 nt, Human
uccauagagagcaa

SEQ ID NO: 1521056 - RNA, 15 nt, Human
uccauagagagcaag

SEQ ID NO: 1521057 - RNA, 20 nt, Human
uccagguuuaagcuguuacu

SEQ ID NO: 1521058 - RNA, 19 nt, Human
uccagguagagggugugua

SEQ ID NO: 1521059 - RNA, 22 nt, Human
uccaggggugggacacccugug

SEQ ID NO: 1521060 - RNA, 20 nt, Human
ucccaugagccucagcaucc

SEQ ID NO: 1521061 - RNA, 13 nt, Human
uccccagauugca

SEQ ID NO: 1521062 - RNA, 18 nt, Human
uccccagauugcaacagg

SEQ ID NO: 1521063 - RNA, 19 nt, Human
uccccagauugcaacaggc

SEQ ID NO: 1521064 - RNA, 20 nt, Human
uccccagauugcaacaggcu

SEQ ID NO: 1521065 - RNA, 22 nt, Human
uccccagauugcaacaggcugg

SEQ ID NO: 1521066 - RNA, 23 nt, Human
uccccagauugcaacaggcuggg

SEQ ID NO: 1521067 - RNA, 20 nt, Human
uccccagcaagugagagcug

SEQ ID NO: 1521068 - RNA, 21 nt, Human
uccccagcaagugagagcugg

SEQ ID NO: 1521069 - RNA, 22 nt, Human
uccccagcaagugagagcuggg

SEQ ID NO: 1521070 - RNA, 21 nt, Human
uccccagcaugcaccacgggc

SEQ ID NO: 1521071 - RNA, 19 nt, Human
uccccagcaugcaccacgg

SEQ ID NO: 1521072 - RNA, 20 nt, Human
uccccagcaugcaccacggg

SEQ ID NO: 1521073 - RNA, 14 nt, Human
uccccaggaggcca

SEQ ID NO: 1521074 - RNA, 22 nt, Human
ucccccagccccauccucugua

SEQ ID NO: 1521075 - RNA, 20 nt, Human
ucccccagccccauccucug

SEQ ID NO: 1521076 - RNA, 21 nt, Human
ucccccagccccauccucugu

SEQ ID NO: 1521077 - RNA, 15 nt, Human
uccccaggaggccag

SEQ ID NO: 1521078 - RNA, 16 nt, Human
uccccaggaggccagc

SEQ ID NO: 1521079 - RNA, 17 nt, Human
ucccccagccccauccu

SEQ ID NO: 1521080 - RNA, 17 nt, Human
uccccaggaggccagcc

SEQ ID NO: 1521081 - RNA, 23 nt, Human
ucccagcugugcucuggacaggc

SEQ ID NO: 1521082 - RNA, 21 nt, Human
ucccagcugugcucuggacag

SEQ ID NO: 1521083 - RNA, 22 nt, Human
ucccagcugugcucuggacagg

SEQ ID NO: 1521084 - RNA, 24 nt, Human
ucccaggcauuccccaggaggcca

SEQ ID NO: 1521085 - RNA, 15 nt, Human
ucccaucuuccaagg

SEQ ID NO: 1521086 - RNA, 18 nt, Human
ucccaugagccucagcau

SEQ ID NO: 1521087 - RNA, 19 nt, Human
ucccaugagccucagcauc

SEQ ID NO: 1521088 - RNA, 20 nt, Human
uccaugugggcuaguugggc

SEQ ID NO: 1521089 - RNA, 22 nt, Human
ucccaccucucucacuccuuga

SEQ ID NO: 1521090 - RNA, 13 nt, Human
ucccaccuuggcu

SEQ ID NO: 1521091 - RNA, 16 nt, Human
ucccaccuuggcugca

SEQ ID NO: 1521092 - RNA, 17 nt, Human
ucccaccuuggcugcag

SEQ ID NO: 1521093 - RNA, 18 nt, Human
ucccaccuuggcugcagg

SEQ ID NO: 1521094 - RNA, 17 nt, Human
ucaugcuguucaugaaa

SEQ ID NO: 1521095 - RNA, 18 nt, Human
ucauccacugugccaugu

SEQ ID NO: 1521096 - RNA, 14 nt, Human
ucauccacugugcc

SEQ ID NO: 1521097 - RNA, 17 nt, Human
ucauccacugugccaug

SEQ ID NO: 1521098 - RNA, 17 nt, Human
ucaucaaugaaugaaug

SEQ ID NO: 1521099 - RNA, 12 nt, Human
ucauagcagcuu

SEQ ID NO: 1521100 - RNA, 11 nt, Human
ucauagcagcu

SEQ ID NO: 1521101 - RNA, 16 nt, Human
ucagugccaaaaacaa

SEQ ID NO: 1521102 - RNA, 20 nt, Human
ucaguguacauggaauaaca

SEQ ID NO: 1521103 - RNA, 16 nt, Human
ucauuaggauggcuag

SEQ ID NO: 1521104 - RNA, 14 nt, Human
uccaaagaaaugua

SEQ ID NO: 1521105 - RNA, 17 nt, Human
uccaaagaaauguaagg

SEQ ID NO: 1521106 - RNA, 13 nt, Human
uccaaaguacacu

SEQ ID NO: 1521107 - RNA, 22 nt, Human
uccaaaaagauuuucagaaaau

SEQ ID NO: 1521108 - RNA, 16 nt, Human
uccaaaccaaauaaaa

SEQ ID NO: 1521109 - RNA, 21 nt, Human
ucagucugauucccaagcucu

SEQ ID NO: 1521110 - RNA, 22 nt, Human
ucagucugauucccaagcucug

SEQ ID NO: 1521111 - RNA, 23 nt, Human
ucagucugauucccaagcucugc

SEQ ID NO: 1521112 - RNA, 20 nt, Human
ucagguggggcagcuugagg

SEQ ID NO: 1521113 - RNA, 21 nt, Human
ucagguggggcagcuugaggg

SEQ ID NO: 1521114 - RNA, 16 nt, Human
ucaggugauccaccca

SEQ ID NO: 1521115 - RNA, 23 nt, Human
ucaggugccucaagagaaggcaa

SEQ ID NO: 1521116 - RNA, 23 nt, Human
ucaggugauccacccaccucagc

SEQ ID NO: 1521117 - RNA, 18 nt, Human
ucagguggggcagcuuga

SEQ ID NO: 1521118 - RNA, 19 nt, Human
ucagguggggcagcuugag

SEQ ID NO: 1521119 - RNA, 12 nt, Human
ucaggacacuaa

SEQ ID NO: 1521120 - RNA, 13 nt, Human
ucaggacacuaau

SEQ ID NO: 1521121 - RNA, 21 nt, Human
ucaggccugggggcugggcag

SEQ ID NO: 1521122 - RNA, 23 nt, Human
ucagcucugcaagaauugaagca

SEQ ID NO: 1521123 - RNA, 23 nt, Human
ucaggaagcucagggccuggcuc

SEQ ID NO: 1521124 - RNA, 23 nt, Human
ucagcuccagcucaccagcccca

SEQ ID NO: 1521125 - RNA, 24 nt, Human
ucagcuccagcucaccagccccag

SEQ ID NO: 1521126 - RNA, 16 nt, Human
uaugauucccagccag

SEQ ID NO: 1521127 - RNA, 16 nt, Human
uaugauucaaaugucu

SEQ ID NO: 1521128 - RNA, 21 nt, Human
uaugauucaaaugucuauaaa

SEQ ID NO: 1521129 - RNA, 17 nt, Human
uaugacuccagaauuuc

SEQ ID NO: 1521130 - RNA, 23 nt, Human
uaugacuccagaauuucccaaag

SEQ ID NO: 1521131 - RNA, 16 nt, Human
uaugacuccagaauuu

SEQ ID NO: 1521132 - RNA, 18 nt, Human
uaugaccuucuaggaagc

SEQ ID NO: 1521133 - RNA, 16 nt, Human
uaugaccuucuaggaa

SEQ ID NO: 1521134 - RNA, 14 nt, Human
uaugcacacauuuu

SEQ ID NO: 1521135 - RNA, 13 nt, Human
uaugcacacauuu

SEQ ID NO: 1521136 - RNA, 15 nt, Human
uaugcaaagcacuga

SEQ ID NO: 1521137 - RNA, 18 nt, Human
uaugcaaucaaaucugcu

SEQ ID NO: 1521138 - RNA, 12 nt, Human
uaugcaaagcac

SEQ ID NO: 1521139 - RNA, 13 nt, Human
uaugcaaagcacu

SEQ ID NO: 1521140 - RNA, 14 nt, Human
uaugcaaagcacug

SEQ ID NO: 1521141 - RNA, 15 nt, Human
uaugcuucuguuuua

SEQ ID NO: 1521142 - RNA, 16 nt, Human
uaugcuucuguuuuau

SEQ ID NO: 1521143 - RNA, 18 nt, Human
uaugcaugaaguaauaug

SEQ ID NO: 1521144 - RNA, 13 nt, Human
uaugcaugaagua

SEQ ID NO: 1521145 - RNA, 22 nt, Human
uaugcuuauacacuuacacuuu

SEQ ID NO: 1521146 - RNA, 13 nt, Human
uauggaacacucu

SEQ ID NO: 1521147 - RNA, 16 nt, Human
uauggaacacucugag

SEQ ID NO: 1521148 - RNA, 17 nt, Human
uauggaacacucugaga

SEQ ID NO: 1521149 - RNA, 18 nt, Human
uauggaacacucugagac

SEQ ID NO: 1521150 - RNA, 19 nt, Human
uauggaacacucugagacu

SEQ ID NO: 1521151 - RNA, 17 nt, Human
uauggacaaugacccag

SEQ ID NO: 1521152 - RNA, 14 nt, Human
uaucuugaagacuu

SEQ ID NO: 1521153 - RNA, 20 nt, Human
uaucugucauuugagcaggg

SEQ ID NO: 1521154 - RNA, 21 nt, Human
uaucugucauuugagcagggc

SEQ ID NO: 1521155 - RNA, 23 nt, Human
uaucugucauuugagcagggcuc

SEQ ID NO: 1521156 - RNA, 17 nt, Human
uaugaauuacauuugua

SEQ ID NO: 1521157 - RNA, 23 nt, Human
uaugaauuacauuuguauaaaau

SEQ ID NO: 1521158 - RNA, 23 nt, Human
uaugacauaaaaacaacuuuaua

SEQ ID NO: 1521159 - RNA, 19 nt, Human
uaugacauaaaaacaacuu

SEQ ID NO: 1521160 - RNA, 22 nt, Human
uaugacauaaaaacaacuuuau

SEQ ID NO: 1521161 - RNA, 12 nt, Human
uaugacacaugc

SEQ ID NO: 1521162 - RNA, 22 nt, Human
uaugacacaugcaaggucauuu

SEQ ID NO: 1521163 - RNA, 17 nt, Human
uauccuuucuaacaaaa

SEQ ID NO: 1521164 - RNA, 15 nt, Human
uauccuucagccuga

SEQ ID NO: 1521165 - RNA, 19 nt, Human
uauauguuuuaagaggcag

SEQ ID NO: 1521166 - RNA, 21 nt, Human
uaucuaauauguaacaagcca

SEQ ID NO: 1521167 - RNA, 16 nt, Human
uaucgucacugcuuaa

SEQ ID NO: 1521168 - RNA, 16 nt, Human
uaggucagugcaaaua

SEQ ID NO: 1521169 - RNA, 19 nt, Human
uagggaaaaaccagcgugu

SEQ ID NO: 1521170 - RNA, 20 nt, Human
uagggaaaaaccagcgugug

SEQ ID NO: 1521171 - RNA, 21 nt, Human
uagggaaaaaccagcguguga

SEQ ID NO: 1521172 - RNA, 20 nt, Human
uaggaauugacccacaagaa

SEQ ID NO: 1521173 - RNA, 12 nt, Human
uaggaauugacc

SEQ ID NO: 1521174 - RNA, 15 nt, Human
uaggccuggccagau

SEQ ID NO: 1521175 - RNA, 18 nt, Human
uaggccuggccagaugca

SEQ ID NO: 1521176 - RNA, 18 nt, Human
uaggccaugggacaggga

SEQ ID NO: 1521177 - RNA, 13 nt, Human
uagucaaauugug

SEQ ID NO: 1521178 - RNA, 14 nt, Human
uagucaaauugugu

SEQ ID NO: 1521179 - RNA, 14 nt, Human
uagugcaaauuguc

SEQ ID NO: 1521180 - RNA, 15 nt, Human
uagugcaaauuguca

SEQ ID NO: 1521181 - RNA, 18 nt, Human
uaguauuucuaugaaaua

SEQ ID NO: 1521182 - RNA, 19 nt, Human
uaguauuucuaugaaauau

SEQ ID NO: 1521183 - RNA, 15 nt, Human
uaguaugaggcauuu

SEQ ID NO: 1521184 - RNA, 16 nt, Human
uaguauuucuaugaaa

SEQ ID NO: 1521185 - RNA, 15 nt, Human
uaguaugaaauuaua

SEQ ID NO: 1521186 - RNA, 23 nt, Human
uaguaugaaauuauauaaguauu

SEQ ID NO: 1521187 - RNA, 13 nt, Human
uaguaugaaauua

SEQ ID NO: 1521188 - RNA, 13 nt, Human
uaguaucaaaaga

SEQ ID NO: 1521189 - RNA, 23 nt, Human
uaggugacagagugagacucugu

SEQ ID NO: 1521190 - RNA, 18 nt, Human
uaggugcuacaaaaacac

SEQ ID NO: 1521191 - RNA, 22 nt, Human
uauaauauuuuuaauuaaauaa

SEQ ID NO: 1521192 - RNA, 13 nt, Human
uauauaacaaugc

SEQ ID NO: 1521193 - RNA, 13 nt, Human
uauaugcuucugu

SEQ ID NO: 1521194 - RNA, 21 nt, Human
uauaugcucugcauguuacau

SEQ ID NO: 1521195 - RNA, 14 nt, Human
uauuucuaugaaau

SEQ ID NO: 1521196 - RNA, 15 nt, Human
uauuucuaugaaaua

SEQ ID NO: 1521197 - RNA, 13 nt, Human
uauuucuaugaaa

SEQ ID NO: 1521198 - RNA, 14 nt, Human
uauuuauuacugua

SEQ ID NO: 1521199 - RNA, 22 nt, Human
uauuuauuaaaugcccagcccc

SEQ ID NO: 1521200 - RNA, 20 nt, Human
uauuguuuaaaaucauuucu

SEQ ID NO: 1521201 - RNA, 17 nt, Human
uauuuaugggauccugg

SEQ ID NO: 1521202 - RNA, 14 nt, Human
uauugauaaguuca

SEQ ID NO: 1521203 - RNA, 16 nt, Human
uauugauaaguucaua

SEQ ID NO: 1521204 - RNA, 20 nt, Human
uauugauaugcuuauacacu

SEQ ID NO: 1521205 - RNA, 21 nt, Human
uauugauaugcuuauacacuu

SEQ ID NO: 1521206 - RNA, 23 nt, Human
uauugauaaguucauacauugua

SEQ ID NO: 1521207 - RNA, 23 nt, Human
uauugcugauggugcaaugaccu

SEQ ID NO: 1521208 - RNA, 13 nt, Human
uauugcccacgcu

SEQ ID NO: 1521209 - RNA, 14 nt, Human
uauugcccacgcug

SEQ ID NO: 1521210 - RNA, 15 nt, Human
uauugcccacgcugg

SEQ ID NO: 1521211 - RNA, 14 nt, Human
uauuguguugugaa

SEQ ID NO: 1521212 - RNA, 15 nt, Human
uauuguuuaaaauca

SEQ ID NO: 1521213 - RNA, 16 nt, Human
uauuguuuaaaaucau

SEQ ID NO: 1521214 - RNA, 17 nt, Human
uauuguuuaaaaucauu

SEQ ID NO: 1521215 - RNA, 16 nt, Human
uauuauguuaaaacug

SEQ ID NO: 1521216 - RNA, 12 nt, Human
uauuauguguuu

SEQ ID NO: 1521217 - RNA, 17 nt, Human
uauuauauuuacaaaug

SEQ ID NO: 1521218 - RNA, 14 nt, Human
uauuauauguucua

SEQ ID NO: 1521219 - RNA, 17 nt, Human
uauuauauguucuagaa

SEQ ID NO: 1521220 - RNA, 14 nt, Human
uauuauaccuuuuu

SEQ ID NO: 1521221 - RNA, 13 nt, Human
uauuauaccuuuu

SEQ ID NO: 1521222 - RNA, 12 nt, Human
uauuauaccuuu

SEQ ID NO: 1521223 - RNA, 14 nt, Human
uauuaaggaagaca

SEQ ID NO: 1521224 - RNA, 24 nt, Human
uauuaagaaagacuaucuaaaugu

SEQ ID NO: 1521225 - RNA, 19 nt, Human
uauggaggcuuugcauaga

SEQ ID NO: 1521226 - RNA, 12 nt, Human
uauguuaaaacu

SEQ ID NO: 1521227 - RNA, 19 nt, Human
uauguuagugcaaauuguc

SEQ ID NO: 1521228 - RNA, 17 nt, Human
uauguucuaagaaguga

SEQ ID NO: 1521229 - RNA, 22 nt, Human
uauguucuuaguggauguucug

SEQ ID NO: 1521230 - RNA, 21 nt, Human
uauguugcccaggcaggucuu

SEQ ID NO: 1521231 - RNA, 16 nt, Human
uauuaagaaagacuau

SEQ ID NO: 1521232 - RNA, 15 nt, Human
uauuaaaugcccagc

SEQ ID NO: 1521233 - RNA, 17 nt, Human
uauuaaaugcccagccc

SEQ ID NO: 1521234 - RNA, 19 nt, Human
uauuaaaugcccagccccu

SEQ ID NO: 1521235 - RNA, 17 nt, Human
ucaaacauauauaacaa

SEQ ID NO: 1521236 - RNA, 16 nt, Human
ucaaauccuugaagau

SEQ ID NO: 1521237 - RNA, 18 nt, Human
ucaaauaugcaaagcacu

SEQ ID NO: 1521238 - RNA, 19 nt, Human
ucaaauaugcaaagcacug

SEQ ID NO: 1521239 - RNA, 20 nt, Human
ucaaagagagaaaauaaaga

SEQ ID NO: 1521240 - RNA, 15 nt, Human
ucaaagagagaaaau

SEQ ID NO: 1521241 - RNA, 12 nt, Human
ucaaagagguuu

SEQ ID NO: 1521242 - RNA, 23 nt, Human
ucaaagagguuuuaaaaaaaucc

SEQ ID NO: 1521243 - RNA, 17 nt, Human
ucaaauaugcaaagcac

SEQ ID NO: 1521244 - RNA, 22 nt, Human
ucaacuccaaacugacucuuaa

SEQ ID NO: 1521245 - RNA, 20 nt, Human
ucaacucuccuccagaguca

SEQ ID NO: 1521246 - RNA, 16 nt, Human
ucaaccuccugggcua

SEQ ID NO: 1521247 - RNA, 20 nt, Human
ucaaccccuucgcuccugug

SEQ ID NO: 1521248 - RNA, 15 nt, Human
ucaaccuccugggcu

SEQ ID NO: 1521249 - RNA, 18 nt, Human
ucaaccccuucgcuccug

SEQ ID NO: 1521250 - RNA, 19 nt, Human
ucaaccccuucgcuccugu

SEQ ID NO: 1521251 - RNA, 13 nt, Human
ucaaggauccuga

SEQ ID NO: 1521252 - RNA, 14 nt, Human
ucaaggauccugag

SEQ ID NO: 1521253 - RNA, 17 nt, Human
ucaaggauccugagcca

SEQ ID NO: 1521254 - RNA, 15 nt, Human
ucaaggauccugagc

SEQ ID NO: 1521255 - RNA, 16 nt, Human
ucaaggauccugagcc

SEQ ID NO: 1521256 - RNA, 21 nt, Human
ucaagcgauucuucugcuuca

SEQ ID NO: 1521257 - RNA, 18 nt, Human
ucaagcgauucuucugcu

SEQ ID NO: 1521258 - RNA, 19 nt, Human
ucaagcgauucuucugcuu

SEQ ID NO: 1521259 - RNA, 12 nt, Human
ucaagccaccaa

SEQ ID NO: 1521260 - RNA, 20 nt, Human
ucaagccaccaacauacucc

SEQ ID NO: 1521261 - RNA, 14 nt, Human
ucaauaaaauccau

SEQ ID NO: 1521262 - RNA, 22 nt, Human
ucacaagacccaaaaggcagaa

SEQ ID NO: 1521263 - RNA, 14 nt, Human
ucacauuggaaaca

SEQ ID NO: 1521264 - RNA, 15 nt, Human
ucacacacuuuggcu

SEQ ID NO: 1521265 - RNA, 23 nt, Human
ucacacaugagcaucaggccagg

SEQ ID NO: 1521266 - RNA, 12 nt, Human
ucacauuuaaau

SEQ ID NO: 1521267 - RNA, 17 nt, Human
ucacauuggaaacaagu

SEQ ID NO: 1521268 - RNA, 14 nt, Human
ucacauuuauucug

SEQ ID NO: 1521269 - RNA, 17 nt, Human
ucaccaacgucugugcc

SEQ ID NO: 1521270 - RNA, 18 nt, Human
ucaccaacgucugugcca

SEQ ID NO: 1521271 - RNA, 15 nt, Human
ucaccagacggggcu

SEQ ID NO: 1521272 - RNA, 19 nt, Human
ucaccagacggggcuggag

SEQ ID NO: 1521273 - RNA, 21 nt, Human
ucaccccugguucucaucuuu

SEQ ID NO: 1521274 - RNA, 22 nt, Human
ucaccccugguucucaucuuuc

SEQ ID NO: 1521275 - RNA, 18 nt, Human
ucacccgcuaagagggag

SEQ ID NO: 1521276 - RNA, 13 nt, Human
ucaccaagcccag

SEQ ID NO: 1521277 - RNA, 22 nt, Human
ucaccgaaaacguggcugcuuc

SEQ ID NO: 1521278 - RNA, 23 nt, Human
ucaccgaaaacguggcugcuuca

SEQ ID NO: 1521279 - RNA, 15 nt, Human
ucaccgaaaacgugg

SEQ ID NO: 1521280 - RNA, 19 nt, Human
ucaccgaaaacguggcugc

SEQ ID NO: 1521281 - RNA, 20 nt, Human
ucaccgaaaacguggcugcu

SEQ ID NO: 1521282 - RNA, 21 nt, Human
ucaccgaaaacguggcugcuu

SEQ ID NO: 1521283 - RNA, 19 nt, Human
ucacccgcuaagagggagg

SEQ ID NO: 1521284 - RNA, 12 nt, Human
ucacccuuuucu

SEQ ID NO: 1521285 - RNA, 14 nt, Human
ucaccgaaaacgug

SEQ ID NO: 1521286 - RNA, 19 nt, Human
guggcagugggagcugccu

SEQ ID NO: 1521287 - RNA, 21 nt, Human
guggcagugggagcugccugu

SEQ ID NO: 1521288 - RNA, 15 nt, Human
guggcagugggagcu

SEQ ID NO: 1521289 - RNA, 16 nt, Human
guggcagugggagcug

SEQ ID NO: 1521290 - RNA, 17 nt, Human
guggcagugggagcugc

SEQ ID NO: 1521291 - RNA, 20 nt, Human
guggaugccugguggcagcu

SEQ ID NO: 1521292 - RNA, 21 nt, Human
guggcagcugcgguccaccca

SEQ ID NO: 1521293 - RNA, 22 nt, Human
guggcagcugcgguccacccag

SEQ ID NO: 1521294 - RNA, 23 nt, Human
guggcagcugcgguccacccagg

SEQ ID NO: 1521295 - RNA, 12 nt, Human
guggcagcugcu

SEQ ID NO: 1521296 - RNA, 13 nt, Human
guggcagcugcuu

SEQ ID NO: 1521297 - RNA, 19 nt, Human
guggcagcugcuuuugucu

SEQ ID NO: 1521298 - RNA, 20 nt, Human
guggagaagcggcuggcagc

SEQ ID NO: 1521299 - RNA, 17 nt, Human
guggagaagccacaggc

SEQ ID NO: 1521300 - RNA, 20 nt, Human
guggagaagccacaggccug

SEQ ID NO: 1521301 - RNA, 22 nt, Human
guggagaagccacaggccugag

SEQ ID NO: 1521302 - RNA, 16 nt, Human
guggaugccugguggc

SEQ ID NO: 1521303 - RNA, 18 nt, Human
guggaugccugguggcag

SEQ ID NO: 1521304 - RNA, 17 nt, Human
guggaguucaucuugaa

SEQ ID NO: 1521305 - RNA, 16 nt, Human
guggaggagcucagga

SEQ ID NO: 1521306 - RNA, 20 nt, Human
guggaggagcucaggacacu

SEQ ID NO: 1521307 - RNA, 23 nt, Human
guggaggagcucaggacacuaau

SEQ ID NO: 1521308 - RNA, 12 nt, Human
gugcuuggagga

SEQ ID NO: 1521309 - RNA, 13 nt, Human
gugcuuggaggaa

SEQ ID NO: 1521310 - RNA, 15 nt, Human
gugcuuggaggaagg

SEQ ID NO: 1521311 - RNA, 22 nt, Human
gugcugccauccagguucagcu

SEQ ID NO: 1521312 - RNA, 11 nt, Human
gugcugcccug

SEQ ID NO: 1521313 - RNA, 12 nt, Human
gugcugcccugc

SEQ ID NO: 1521314 - RNA, 18 nt, Human
guggaaaaauagccugcc

SEQ ID NO: 1521315 - RNA, 15 nt, Human
gugcucuggacaggc

SEQ ID NO: 1521316 - RNA, 16 nt, Human
gugcucuggacaggca

SEQ ID NO: 1521317 - RNA, 19 nt, Human
gugcccuggaugcccagga

SEQ ID NO: 1521318 - RNA, 18 nt, Human
gugcccuggaugcccagg

SEQ ID NO: 1521319 - RNA, 22 nt, Human
gugccgagaaggaagccuccca

SEQ ID NO: 1521320 - RNA, 21 nt, Human
gugccuuggggacaagagcag

SEQ ID NO: 1521321 - RNA, 17 nt, Human
gugcucuggacaggcau

SEQ ID NO: 1521322 - RNA, 18 nt, Human
gugcucuggacaggcaug

SEQ ID NO: 1521323 - RNA, 23 nt, Human
gugcugaaugguuuucaaaauaa

SEQ ID NO: 1521324 - RNA, 19 nt, Human
gugcugaaugguuuucaaa

SEQ ID NO: 1521325 - RNA, 20 nt, Human
gugcugaaugguuuucaaaa

SEQ ID NO: 1521326 - RNA, 20 nt, Human
gugcugcauuuaaaagauac

SEQ ID NO: 1521327 - RNA, 19 nt, Human
gugcugcauuuaaaagaua

SEQ ID NO: 1521328 - RNA, 12 nt, Human
gugcugcauuua

SEQ ID NO: 1521329 - RNA, 23 nt, Human
gugcugaguugguguugacaugu

SEQ ID NO: 1521330 - RNA, 15 nt, Human
gugcugccauccagg

SEQ ID NO: 1521331 - RNA, 18 nt, Human
gugcugccauccagguuc

SEQ ID NO: 1521332 - RNA, 19 nt, Human
gugcugccauccagguuca

SEQ ID NO: 1521333 - RNA, 12 nt, Human
gugcugagucug

SEQ ID NO: 1521334 - RNA, 16 nt, Human
gugcugagucugaagg

SEQ ID NO: 1521335 - RNA, 17 nt, Human
gugcugagucugaaggc

SEQ ID NO: 1521336 - RNA, 18 nt, Human
gugcugagucugaaggcu

SEQ ID NO: 1521337 - RNA, 19 nt, Human
gugcugagucugaaggcug

SEQ ID NO: 1521338 - RNA, 21 nt, Human
gugcauaccacuuuuguucuu

SEQ ID NO: 1521339 - RNA, 14 nt, Human
gugcauaccacuuu

SEQ ID NO: 1521340 - RNA, 13 nt, Human
gugcauaccacuu

SEQ ID NO: 1521341 - RNA, 22 nt, Human
gugcaugaagguuucugaaaau

SEQ ID NO: 1521342 - RNA, 22 nt, Human
gugcaugcugucccuuacguga

SEQ ID NO: 1521343 - RNA, 22 nt, Human
gugccagguuuuuggucugacc

SEQ ID NO: 1521344 - RNA, 18 nt, Human
gugcaaauugucacagga

SEQ ID NO: 1521345 - RNA, 19 nt, Human
gugcauaaguuaacuucca

SEQ ID NO: 1521346 - RNA, 20 nt, Human
gugcccacaggaucagucug

SEQ ID NO: 1521347 - RNA, 14 nt, Human
gugauucuccugcc

SEQ ID NO: 1521348 - RNA, 16 nt, Human
gugauucuccugccuc

SEQ ID NO: 1521349 - RNA, 17 nt, Human
gugauucuccugccuca

SEQ ID NO: 1521350 - RNA, 18 nt, Human
gugauucuccugccucag

SEQ ID NO: 1521351 - RNA, 19 nt, Human
gugauucuccugccucagc

SEQ ID NO: 1521352 - RNA, 20 nt, Human
gugauucuccugccucagcc

SEQ ID NO: 1521353 - RNA, 22 nt, Human
gugauucuccugccucagccuc

SEQ ID NO: 1521354 - RNA, 23 nt, Human
gugauucuccugccucagccucc

SEQ ID NO: 1521355 - RNA, 23 nt, Human
gugauccucccaccucagccucc

SEQ ID NO: 1521356 - RNA, 20 nt, Human
gugauccucccaccucagcc

SEQ ID NO: 1521357 - RNA, 22 nt, Human
gugauccucccaccucagccuc

SEQ ID NO: 1521358 - RNA, 22 nt, Human
gugauccacccaccucagccuc

SEQ ID NO: 1521359 - RNA, 14 nt, Human
gugauccucccacc

SEQ ID NO: 1521360 - RNA, 15 nt, Human
gugauccucccaccu

SEQ ID NO: 1521361 - RNA, 18 nt, Human
gugauccucccaccucag

SEQ ID NO: 1521362 - RNA, 11 nt, Human
gugaggccaga

SEQ ID NO: 1521363 - RNA, 13 nt, Human
gugaggccagaga

SEQ ID NO: 1521364 - RNA, 15 nt, Human
gugauccacccaccu

SEQ ID NO: 1521365 - RNA, 18 nt, Human
gugauccacccaccucag

SEQ ID NO: 1521366 - RNA, 20 nt, Human
gugauccacccaccucagcc

SEQ ID NO: 1521367 - RNA, 16 nt, Human
gugacaagcucacaga

SEQ ID NO: 1521368 - RNA, 16 nt, Human
gugacaacacuugugu

SEQ ID NO: 1521369 - RNA, 12 nt, Human
gugaccucugcc

SEQ ID NO: 1521370 - RNA, 15 nt, Human
gugacugaauuucuu

SEQ ID NO: 1521371 - RNA, 18 nt, Human
gugacugaauuucuuuug

SEQ ID NO: 1521372 - RNA, 16 nt, Human
gugacugaauuucuuu

SEQ ID NO: 1521373 - RNA, 16 nt, Human
gugagcagucaggaaa

SEQ ID NO: 1521374 - RNA, 17 nt, Human
gugacugaucucucgug

SEQ ID NO: 1521375 - RNA, 13 nt, Human
gugagccacugca

SEQ ID NO: 1521376 - RNA, 14 nt, Human
gugagccacugcac

SEQ ID NO: 1521377 - RNA, 11 nt, Human
gugaggaagcc

SEQ ID NO: 1521378 - RNA, 16 nt, Human
gugaggaagccgcugg

SEQ ID NO: 1521379 - RNA, 19 nt, Human
gugaggaagccgcuggggc

SEQ ID NO: 1521380 - RNA, 19 nt, Human
gugaaaggaaagagggagg

SEQ ID NO: 1521381 - RNA, 17 nt, Human
gugaaaguacauuugga

SEQ ID NO: 1521382 - RNA, 20 nt, Human
gugaaagcaucacuugggau

SEQ ID NO: 1521383 - RNA, 19 nt, Human
gugaaagaaaauaacaaua

SEQ ID NO: 1521384 - RNA, 20 nt, Human
gugaaacucguuaauuugua

SEQ ID NO: 1521385 - RNA, 12 nt, Human
gugaaacuggau

SEQ ID NO: 1521386 - RNA, 12 nt, Human
gugaaaauuauu

SEQ ID NO: 1521387 - RNA, 15 nt, Human
gugaaaauuauuuug

SEQ ID NO: 1521388 - RNA, 14 nt, Human
gugaaaagaaaaau

SEQ ID NO: 1521389 - RNA, 23 nt, Human
gugaaaagaaaaaugagccuggc

SEQ ID NO: 1521390 - RNA, 17 nt, Human
gucuacacuaagagaga

SEQ ID NO: 1521391 - RNA, 23 nt, Human
gucuacacuaagagagaaugaga

SEQ ID NO: 1521392 - RNA, 15 nt, Human
gucuacacugugcug

SEQ ID NO: 1521393 - RNA, 18 nt, Human
guccuuaccagcagagca

SEQ ID NO: 1521394 - RNA, 15 nt, Human
guccuuaccagcaga

SEQ ID NO: 1521395 - RNA, 16 nt, Human
guccuuaccagcagag

SEQ ID NO: 1521396 - RNA, 17 nt, Human
guccuuaccagcagagc

SEQ ID NO: 1521397 - RNA, 13 nt, Human
gucuaccugaggg

SEQ ID NO: 1521398 - RNA, 11 nt, Human
gucucacucug

SEQ ID NO: 1521399 - RNA, 20 nt, Human
gucucacuguugcccaggcu

SEQ ID NO: 1521400 - RNA, 21 nt, Human
gucucacuguugcccaggcug

SEQ ID NO: 1521401 - RNA, 22 nt, Human
gucucacuguugcccaggcugg

SEQ ID NO: 1521402 - RNA, 23 nt, Human
gucucacuguugcccaggcuggc

SEQ ID NO: 1521403 - RNA, 20 nt, Human
gucucacuauguugcccagg

SEQ ID NO: 1521404 - RNA, 21 nt, Human
gucucacuauguugcccaggc

SEQ ID NO: 1521405 - RNA, 23 nt, Human
gucucacuauguugcccaggcag

SEQ ID NO: 1521406 - RNA, 16 nt, Human
gucucacuguugccca

SEQ ID NO: 1521407 - RNA, 17 nt, Human
gucucacuguugcccag

SEQ ID NO: 1521408 - RNA, 18 nt, Human
gucucacuguugcccagg

SEQ ID NO: 1521409 - RNA, 19 nt, Human
gucucacuguugcccaggc

SEQ ID NO: 1521410 - RNA, 13 nt, Human
gucugacuguuuc

SEQ ID NO: 1521411 - RNA, 21 nt, Human
gucugaggaauccagacccgg

SEQ ID NO: 1521412 - RNA, 17 nt, Human
gucugauucccaagcuc

SEQ ID NO: 1521413 - RNA, 18 nt, Human
gucugauucccaagcucu

SEQ ID NO: 1521414 - RNA, 19 nt, Human
gucugauucccaagcucug

SEQ ID NO: 1521415 - RNA, 20 nt, Human
gucugauucccaagcucugc

SEQ ID NO: 1521416 - RNA, 21 nt, Human
gucugauucccaagcucugcu

SEQ ID NO: 1521417 - RNA, 15 nt, Human
gucucugugagacuc

SEQ ID NO: 1521418 - RNA, 14 nt, Human
gucugacccacugc

SEQ ID NO: 1521419 - RNA, 15 nt, Human
gucugacccacugcu

SEQ ID NO: 1521420 - RNA, 18 nt, Human
gucugaggaauccagacc

SEQ ID NO: 1521421 - RNA, 19 nt, Human
gucugaggaauccagaccc

SEQ ID NO: 1521422 - RNA, 15 nt, Human
gucccagcucccugg

SEQ ID NO: 1521423 - RNA, 12 nt, Human
gucccagugccg

SEQ ID NO: 1521424 - RNA, 23 nt, Human
guccuagaaauuccccacccuga

SEQ ID NO: 1521425 - RNA, 15 nt, Human
guccuacucuguguc

SEQ ID NO: 1521426 - RNA, 23 nt, Human
guccuacucugugucaggugggg

SEQ ID NO: 1521427 - RNA, 16 nt, Human
gucccugguggcagcu

SEQ ID NO: 1521428 - RNA, 17 nt, Human
gucccugguggcagcuc

SEQ ID NO: 1521429 - RNA, 19 nt, Human
guccugggagugagcuggu

SEQ ID NO: 1521430 - RNA, 17 nt, Human
guccugggagugagcug

SEQ ID NO: 1521431 - RNA, 18 nt, Human
guccugggagugagcugg

SEQ ID NO: 1521432 - RNA, 11 nt, Human
guccuggugcc

SEQ ID NO: 1521433 - RNA, 12 nt, Human
guccuggugccc

SEQ ID NO: 1521434 - RNA, 20 nt, Human
guccuggugcccuggaugcc

SEQ ID NO: 1521435 - RNA, 23 nt, Human
guccuggugcccuggaugcccag

SEQ ID NO: 1521436 - RNA, 12 nt, Human
guccucccaucu

SEQ ID NO: 1521437 - RNA, 13 nt, Human
guccucccaucuc

SEQ ID NO: 1521438 - RNA, 14 nt, Human
guccucccaucuca

SEQ ID NO: 1521439 - RNA, 23 nt, Human
guccucccaucucacacaugagc

SEQ ID NO: 1521440 - RNA, 15 nt, Human
guccugggagugagc

SEQ ID NO: 1521441 - RNA, 16 nt, Human
guccugggagugagcu

SEQ ID NO: 1521442 - RNA, 18 nt, Human
guccuccgccuuaccagg

SEQ ID NO: 1521443 - RNA, 17 nt, Human
guccuggcaugggaaug

SEQ ID NO: 1521444 - RNA, 21 nt, Human
guauucuaaauuuuauaucuu

SEQ ID NO: 1521445 - RNA, 17 nt, Human
guauuucuaugaaauau

SEQ ID NO: 1521446 - RNA, 22 nt, Human
guauuucuaugaaauauuaugu

SEQ ID NO: 1521447 - RNA, 19 nt, Human
guauuugagaguucuaaau

SEQ ID NO: 1521448 - RNA, 21 nt, Human
guauuugagaguucuaaauuu

SEQ ID NO: 1521449 - RNA, 20 nt, Human
guauuacaguggggaaugaa

SEQ ID NO: 1521450 - RNA, 15 nt, Human
guagagugggagcug

SEQ ID NO: 1521451 - RNA, 13 nt, Human
guagagugggagc

SEQ ID NO: 1521452 - RNA, 22 nt, Human
guauuacaguggggaaugaaga

SEQ ID NO: 1521453 - RNA, 13 nt, Human
guauuacuucugc

SEQ ID NO: 1521454 - RNA, 14 nt, Human
guauuacuucugcu

SEQ ID NO: 1521455 - RNA, 15 nt, Human
guauuacuucugcua

SEQ ID NO: 1521456 - RNA, 14 nt, Human
guauuauaccuuuu

SEQ ID NO: 1521457 - RNA, 14 nt, Human
gucaccucauggaa

SEQ ID NO: 1521458 - RNA, 20 nt, Human
gucaccugaagacucauucu

SEQ ID NO: 1521459 - RNA, 13 nt, Human
gucaccccggcca

SEQ ID NO: 1521460 - RNA, 15 nt, Human
gucaccccggccacc

SEQ ID NO: 1521461 - RNA, 15 nt, Human
gucaauaaaauccau

SEQ ID NO: 1521462 - RNA, 21 nt, Human
gucaauaaaauccauacauuu

SEQ ID NO: 1521463 - RNA, 16 nt, Human
gucaauuacaggaagu

SEQ ID NO: 1521464 - RNA, 13 nt, Human
gucaauuacagga

SEQ ID NO: 1521465 - RNA, 15 nt, Human
gucaauuacaggaag

SEQ ID NO: 1521466 - RNA, 16 nt, Human
guauuuuaaaagaaug

SEQ ID NO: 1521467 - RNA, 17 nt, Human
guauuuuaaaagaauga

SEQ ID NO: 1521468 - RNA, 14 nt, Human
guauuuguuaaugg

SEQ ID NO: 1521469 - RNA, 18 nt, Human
guauuuuaaaagaaugau

SEQ ID NO: 1521470 - RNA, 18 nt, Human
gucaagagggucugagga

SEQ ID NO: 1521471 - RNA, 19 nt, Human
gucaagagggucugaggaa

SEQ ID NO: 1521472 - RNA, 19 nt, Human
gucaagugaaaaaggagga

SEQ ID NO: 1521473 - RNA, 16 nt, Human
gucaagugaaaaagga

SEQ ID NO: 1521474 - RNA, 18 nt, Human
gucaagugaaaaaggagg

SEQ ID NO: 1521475 - RNA, 17 nt, Human
gucccagauacuugggg

SEQ ID NO: 1521476 - RNA, 17 nt, Human
gucccagauuggcucac

SEQ ID NO: 1521477 - RNA, 21 nt, Human
gucccagauuggcucacacug

SEQ ID NO: 1521478 - RNA, 22 nt, Human
gucccagauuggcucacacuga

SEQ ID NO: 1521479 - RNA, 11 nt, Human
gucccagcucc

SEQ ID NO: 1521480 - RNA, 14 nt, Human
gucccacucagucc

SEQ ID NO: 1521481 - RNA, 15 nt, Human
gucccacucagucca

SEQ ID NO: 1521482 - RNA, 14 nt, Human
guccacccaggagc

SEQ ID NO: 1521483 - RNA, 15 nt, Human
guccacccaggagcc

SEQ ID NO: 1521484 - RNA, 16 nt, Human
guccacccaggagccc

SEQ ID NO: 1521485 - RNA, 21 nt, Human
gucauauaagauucauauuua

SEQ ID NO: 1521486 - RNA, 17 nt, Human
ggggaucacagccucug

SEQ ID NO: 1521487 - RNA, 13 nt, Human
ggggaguggccac

SEQ ID NO: 1521488 - RNA, 22 nt, Human
gggcuuggggaccagagcugcc

SEQ ID NO: 1521489 - RNA, 21 nt, Human
gggcuuggggaccagagcugc

SEQ ID NO: 1521490 - RNA, 20 nt, Human
gggcuucauccuccucagau

SEQ ID NO: 1521491 - RNA, 20 nt, Human
gggcuuggggaccagagcug

SEQ ID NO: 1521492 - RNA, 19 nt, Human
gggcuucauccuccucaga

SEQ ID NO: 1521493 - RNA, 19 nt, Human
gggcuucaguggcagcugc

SEQ ID NO: 1521494 - RNA, 20 nt, Human
gggcuucaguggcagcugcu

SEQ ID NO: 1521495 - RNA, 15 nt, Human
gggcuucaguggcag

SEQ ID NO: 1521496 - RNA, 16 nt, Human
gggcuucaguggcagc

SEQ ID NO: 1521497 - RNA, 17 nt, Human
gggcuucaguggcagcu

SEQ ID NO: 1521498 - RNA, 18 nt, Human
gggcuucaguggcagcug

SEQ ID NO: 1521499 - RNA, 13 nt, Human
ggggcugggacau

SEQ ID NO: 1521500 - RNA, 16 nt, Human
ggggcugggcagagga

SEQ ID NO: 1521501 - RNA, 17 nt, Human
ggggcugggcagaggaa

SEQ ID NO: 1521502 - RNA, 20 nt, Human
ggggugcggcggucccagcu

SEQ ID NO: 1521503 - RNA, 19 nt, Human
ggggugcggcggucccagc

SEQ ID NO: 1521504 - RNA, 23 nt, Human
gggguucccuuuuuuggcugcug

SEQ ID NO: 1521505 - RNA, 18 nt, Human
ggguacccacugcucugg

SEQ ID NO: 1521506 - RNA, 13 nt, Human
ggguacccacugc

SEQ ID NO: 1521507 - RNA, 15 nt, Human
ggguacccacugcuc

SEQ ID NO: 1521508 - RNA, 19 nt, Human
ggguacuuguggacacagc

SEQ ID NO: 1521509 - RNA, 22 nt, Human
ggguacuuguggacacagcucu

SEQ ID NO: 1521510 - RNA, 23 nt, Human
ggguacuuguggacacagcucuu

SEQ ID NO: 1521511 - RNA, 23 nt, Human
ggguagagcggagaaaggaaggg

SEQ ID NO: 1521512 - RNA, 16 nt, Human
gggcgcgguggcucac

SEQ ID NO: 1521513 - RNA, 13 nt, Human
gggcucccuuccc

SEQ ID NO: 1521514 - RNA, 14 nt, Human
gggcucccuuccca

SEQ ID NO: 1521515 - RNA, 17 nt, Human
gggcucccuucccaccu

SEQ ID NO: 1521516 - RNA, 18 nt, Human
gggcucccuucccaccuc

SEQ ID NO: 1521517 - RNA, 23 nt, Human
gggcucccuucccaccucucuca

SEQ ID NO: 1521518 - RNA, 21 nt, Human
gggcccggguugggucaccag

SEQ ID NO: 1521519 - RNA, 22 nt, Human
gggcccggguugggucaccaga

SEQ ID NO: 1521520 - RNA, 17 nt, Human
gggccuggcucaggugg

SEQ ID NO: 1521521 - RNA, 18 nt, Human
gggccuggucguuuucaa

SEQ ID NO: 1521522 - RNA, 14 nt, Human
gggccuggcucagg

SEQ ID NO: 1521523 - RNA, 16 nt, Human
gggccuggcucaggug

SEQ ID NO: 1521524 - RNA, 12 nt, Human
gggccuggccug

SEQ ID NO: 1521525 - RNA, 12 nt, Human
gggccuggcuca

SEQ ID NO: 1521526 - RNA, 14 nt, Human
gggcuucaguggca

SEQ ID NO: 1521527 - RNA, 17 nt, Human
gggcugcaccggcuggc

SEQ ID NO: 1521528 - RNA, 16 nt, Human
gggcugaggugggagg

SEQ ID NO: 1521529 - RNA, 14 nt, Human
gggcugcaccggcu

SEQ ID NO: 1521530 - RNA, 15 nt, Human
gggcugagccugguc

SEQ ID NO: 1521531 - RNA, 23 nt, Human
gggcugagccuggucccacgagg

SEQ ID NO: 1521532 - RNA, 13 nt, Human
gggcugagccugg

SEQ ID NO: 1521533 - RNA, 12 nt, Human
gggcucuucuca

SEQ ID NO: 1521534 - RNA, 15 nt, Human
gggcucuucucauuu

SEQ ID NO: 1521535 - RNA, 13 nt, Human
gggcucugccucc

SEQ ID NO: 1521536 - RNA, 15 nt, Human
gggcucugccuccca

SEQ ID NO: 1521537 - RNA, 16 nt, Human
gggcucugccucccau

SEQ ID NO: 1521538 - RNA, 17 nt, Human
gggcucugccucccauc

SEQ ID NO: 1521539 - RNA, 20 nt, Human
gggcucugccucccaucacc

SEQ ID NO: 1521540 - RNA, 19 nt, Human
ggguuggccccugcccggc

SEQ ID NO: 1521541 - RNA, 23 nt, Human
ggguucccuuuuuuggcugcuga

SEQ ID NO: 1521542 - RNA, 22 nt, Human
ggguucuacccaggugcuagga

SEQ ID NO: 1521543 - RNA, 22 nt, Human
gguacuucaaauccuugaagau

SEQ ID NO: 1521544 - RNA, 21 nt, Human
gguacuuguggacacagcucu

SEQ ID NO: 1521545 - RNA, 22 nt, Human
gguacuuguggacacagcucuu

SEQ ID NO: 1521546 - RNA, 17 nt, Human
gguacccacugcucugg

SEQ ID NO: 1521547 - RNA, 15 nt, Human
ggguugggcuggugu

SEQ ID NO: 1521548 - RNA, 15 nt, Human
gguagacacacauga

SEQ ID NO: 1521549 - RNA, 22 nt, Human
gguagacacacaugaaguccaa

SEQ ID NO: 1521550 - RNA, 16 nt, Human
ggucacucuggcagcu

SEQ ID NO: 1521551 - RNA, 20 nt, Human
ggucacucuggcagcucaga

SEQ ID NO: 1521552 - RNA, 22 nt, Human
ggucacucuggcagcucagaga

SEQ ID NO: 1521553 - RNA, 12 nt, Human
ggucagagccug

SEQ ID NO: 1521554 - RNA, 13 nt, Human
ggucagagccugc

SEQ ID NO: 1521555 - RNA, 14 nt, Human
ggucagagccugca

SEQ ID NO: 1521556 - RNA, 15 nt, Human
ggucagagccugcag

SEQ ID NO: 1521557 - RNA, 16 nt, Human
ggucagagccugcagu

SEQ ID NO: 1521558 - RNA, 22 nt, Human
ggucccacucaguccauagcag

SEQ ID NO: 1521559 - RNA, 12 nt, Human
ggucccacucag

SEQ ID NO: 1521560 - RNA, 14 nt, Human
ggucccacucaguc

SEQ ID NO: 1521561 - RNA, 13 nt, Human
ggucccccuucca

SEQ ID NO: 1521562 - RNA, 18 nt, Human
ggucccccuuccauggac

SEQ ID NO: 1521563 - RNA, 23 nt, Human
ggucccccuuccauggacuuugu

SEQ ID NO: 1521564 - RNA, 20 nt, Human
ggucccagcucccuggcucc

SEQ ID NO: 1521565 - RNA, 12 nt, Human
ggucccagcucc

SEQ ID NO: 1521566 - RNA, 14 nt, Human
ggucccagcucccu

SEQ ID NO: 1521567 - RNA, 15 nt, Human
ggucccagcucccug

SEQ ID NO: 1521568 - RNA, 14 nt, Human
ggucccugguggca

SEQ ID NO: 1521569 - RNA, 22 nt, Human
ggucccugguggcagcucaccu

SEQ ID NO: 1521570 - RNA, 23 nt, Human
gguccuagaaauuccccacccug

SEQ ID NO: 1521571 - RNA, 22 nt, Human
ggucucacuauguugcccaggc

SEQ ID NO: 1521572 - RNA, 12 nt, Human
ggucucacucug

SEQ ID NO: 1521573 - RNA, 16 nt, Human
ggucucacucugucgc

SEQ ID NO: 1521574 - RNA, 15 nt, Human
ggucugacccacugc

SEQ ID NO: 1521575 - RNA, 16 nt, Human
ggucugacccacugcu

SEQ ID NO: 1521576 - RNA, 18 nt, Human
ggugaagugaagacaaug

SEQ ID NO: 1521577 - RNA, 19 nt, Human
ggucugaggaauccagacc

SEQ ID NO: 1521578 - RNA, 16 nt, Human
ggugaacuugguuccc

SEQ ID NO: 1521579 - RNA, 15 nt, Human
ggugcccuggaugcc

SEQ ID NO: 1521580 - RNA, 18 nt, Human
ggugcccuggaugcccag

SEQ ID NO: 1521581 - RNA, 19 nt, Human
ggugcccuggaugcccagg

SEQ ID NO: 1521582 - RNA, 20 nt, Human
ggugcccuggaugcccagga

SEQ ID NO: 1521583 - RNA, 21 nt, Human
ggugacagagugagacucugu

SEQ ID NO: 1521584 - RNA, 14 nt, Human
ggugaccucugccu

SEQ ID NO: 1521585 - RNA, 16 nt, Human
ggugaccucugccuga

SEQ ID NO: 1521586 - RNA, 21 nt, Human
ggugaccucugccugaaguca

SEQ ID NO: 1521587 - RNA, 19 nt, Human
ggugcggcggucccagcuc

SEQ ID NO: 1521588 - RNA, 19 nt, Human
ggugcuacaaaaacacagc

SEQ ID NO: 1521589 - RNA, 23 nt, Human
ggugcuaucucccccagccccau

SEQ ID NO: 1521590 - RNA, 22 nt, Human
ggugcuaucucccccagcccca

SEQ ID NO: 1521591 - RNA, 21 nt, Human
ggugcuacaaaaacacagcaa

SEQ ID NO: 1521592 - RNA, 16 nt, Human
gguggcagugggagcu

SEQ ID NO: 1521593 - RNA, 15 nt, Human
gguggcagcugcggu

SEQ ID NO: 1521594 - RNA, 23 nt, Human
gguggcagcugcgguccacccag

SEQ ID NO: 1521595 - RNA, 13 nt, Human
gguggcagcucac

SEQ ID NO: 1521596 - RNA, 11 nt, Human
gguggcagcug

SEQ ID NO: 1521597 - RNA, 12 nt, Human
gguggcagcugc

SEQ ID NO: 1521598 - RNA, 13 nt, Human
gguggcagcugcg

SEQ ID NO: 1521599 - RNA, 15 nt, Human
guaaauaguauuuga

SEQ ID NO: 1521600 - RNA, 16 nt, Human
guaaauaguauuugag

SEQ ID NO: 1521601 - RNA, 17 nt, Human
guaaauaguauuugaga

SEQ ID NO: 1521602 - RNA, 20 nt, Human
guaaaugggggugcauuuga

SEQ ID NO: 1521603 - RNA, 19 nt, Human
guaaaugggggugcauuug

SEQ ID NO: 1521604 - RNA, 18 nt, Human
guaaaugggggugcauuu

SEQ ID NO: 1521605 - RNA, 22 nt, Human
guaaauuaacuuuuauaaacuu

SEQ ID NO: 1521606 - RNA, 21 nt, Human
guaaauuaacuuuuauaaacu

SEQ ID NO: 1521607 - RNA, 17 nt, Human
guaaauuaacuuuuaua

SEQ ID NO: 1521608 - RNA, 16 nt, Human
guaaauuaacuuuuau

SEQ ID NO: 1521609 - RNA, 15 nt, Human
guaaauuaacuuuua

SEQ ID NO: 1521610 - RNA, 18 nt, Human
guaaggaauaccuguccc

SEQ ID NO: 1521611 - RNA, 20 nt, Human
guaaggaauaccuguccccc

SEQ ID NO: 1521612 - RNA, 21 nt, Human
guaaggaauaccugucccccu

SEQ ID NO: 1521613 - RNA, 23 nt, Human
guaaggaauaccugucccccuga

SEQ ID NO: 1521614 - RNA, 13 nt, Human
guaaggaaugauu

SEQ ID NO: 1521615 - RNA, 22 nt, Human
guaaguauucuuauuuaaugaa

SEQ ID NO: 1521616 - RNA, 17 nt, Human
guaagggaaacugccag

SEQ ID NO: 1521617 - RNA, 18 nt, Human
guaagggaaacugccagc

SEQ ID NO: 1521618 - RNA, 23 nt, Human
guaaauuaacuuuuauaaacuuu

SEQ ID NO: 1521619 - RNA, 14 nt, Human
guaaaaccacagca

SEQ ID NO: 1521620 - RNA, 15 nt, Human
guaaaaccacagcag

SEQ ID NO: 1521621 - RNA, 16 nt, Human
guaaaaccacagcagu

SEQ ID NO: 1521622 - RNA, 18 nt, Human
guaaaaccacagcaguug

SEQ ID NO: 1521623 - RNA, 23 nt, Human
guaaaaccacagcaguugaaaag

SEQ ID NO: 1521624 - RNA, 20 nt, Human
gguuuucacauuggaaacaa

SEQ ID NO: 1521625 - RNA, 21 nt, Human
gguuuuccaaucauuugacua

SEQ ID NO: 1521626 - RNA, 15 nt, Human
gguuuucuguucuuu

SEQ ID NO: 1521627 - RNA, 13 nt, Human
gguuuucuguucu

SEQ ID NO: 1521628 - RNA, 12 nt, Human
gguuuucuguuc

SEQ ID NO: 1521629 - RNA, 14 nt, Human
gguuuuguuccccu

SEQ ID NO: 1521630 - RNA, 19 nt, Human
gguuuuguuccccuccucc

SEQ ID NO: 1521631 - RNA, 22 nt, Human
gguuuuguuccccuccuccacu

SEQ ID NO: 1521632 - RNA, 23 nt, Human
gguuuugccauguuggccaggcu

SEQ ID NO: 1521633 - RNA, 14 nt, Human
gguugggcuggugu

SEQ ID NO: 1521634 - RNA, 18 nt, Human
gguuggcaaaaaggcagg

SEQ ID NO: 1521635 - RNA, 13 nt, Human
gguuggugggggc

SEQ ID NO: 1521636 - RNA, 13 nt, Human
gguuuaagcuguu

SEQ ID NO: 1521637 - RNA, 20 nt, Human
gguucacugcaaccuccgcc

SEQ ID NO: 1521638 - RNA, 22 nt, Human
gguucaagcgauucuucugcuu

SEQ ID NO: 1521639 - RNA, 23 nt, Human
gguucaagcgauucuucugcuuc

SEQ ID NO: 1521640 - RNA, 12 nt, Human
gguucagcuugu

SEQ ID NO: 1521641 - RNA, 14 nt, Human
gguugaagcaccaa

SEQ ID NO: 1521642 - RNA, 13 nt, Human
gguggccucccaa

SEQ ID NO: 1521643 - RNA, 17 nt, Human
gguggccucccaacuca

SEQ ID NO: 1521644 - RNA, 21 nt, Human
gguucaagcgauucuucugcu

SEQ ID NO: 1521645 - RNA, 19 nt, Human
guaaugauaacuggaaacu

SEQ ID NO: 1521646 - RNA, 13 nt, Human
guaauucaagaaa

SEQ ID NO: 1521647 - RNA, 14 nt, Human
guaauucaagaaaa

SEQ ID NO: 1521648 - RNA, 15 nt, Human
guaauuggaaaggca

SEQ ID NO: 1521649 - RNA, 18 nt, Human
guacacuguuucaaacuu

SEQ ID NO: 1521650 - RNA, 21 nt, Human
guaauuaaguacuauguauca

SEQ ID NO: 1521651 - RNA, 14 nt, Human
guaauuaaguacua

SEQ ID NO: 1521652 - RNA, 17 nt, Human
guaauuaaguacuaugu

SEQ ID NO: 1521653 - RNA, 20 nt, Human
guaauuaaguacuauguauc

SEQ ID NO: 1521654 - RNA, 16 nt, Human
guacagacaacaaacc

SEQ ID NO: 1521655 - RNA, 21 nt, Human
guacacuguuucaaacuuuac

SEQ ID NO: 1521656 - RNA, 20 nt, Human
guacacuguuucaaacuuua

SEQ ID NO: 1521657 - RNA, 19 nt, Human
guacacuguuucaaacuuu

SEQ ID NO: 1521658 - RNA, 12 nt, Human
guacagagccca

SEQ ID NO: 1521659 - RNA, 18 nt, Human
guacagagcccacgcccc

SEQ ID NO: 1521660 - RNA, 22 nt, Human
guacagagcccacgcccccacu

SEQ ID NO: 1521661 - RNA, 20 nt, Human
guacagcaaggagauuuaca

SEQ ID NO: 1521662 - RNA, 23 nt, Human
guacaguugcuguugugugauca

SEQ ID NO: 1521663 - RNA, 20 nt, Human
guacauaaugcgugcauacc

SEQ ID NO: 1521664 - RNA, 15 nt, Human
guacccacugcucug

SEQ ID NO: 1521665 - RNA, 16 nt, Human
guacuuguggacacag

SEQ ID NO: 1521666 - RNA, 20 nt, Human
guacuuguggacacagcucu

SEQ ID NO: 1521667 - RNA, 20 nt, Human
guacuucuccacccugcucu

SEQ ID NO: 1521668 - RNA, 21 nt, Human
guacuucuccacccugcucuc

SEQ ID NO: 1521669 - RNA, 16 nt, Human
guacuucuccacccug

SEQ ID NO: 1521670 - RNA, 17 nt, Human
guacuucuccacccugc

SEQ ID NO: 1521671 - RNA, 18 nt, Human
guacuucuccacccugcu

SEQ ID NO: 1521672 - RNA, 19 nt, Human
guacuucuccacccugcuc

SEQ ID NO: 1521673 - RNA, 23 nt, Human
guacuuuauuuucuauaauuuaa

SEQ ID NO: 1521674 - RNA, 21 nt, Human
guacuuguggacacagcucuu

SEQ ID NO: 1521675 - RNA, 18 nt, Human
guagaaagacagagcugg

SEQ ID NO: 1521676 - RNA, 21 nt, Human
guagaaagacagagcugggau

SEQ ID NO: 1521677 - RNA, 16 nt, Human
guagagcggagaaagg

SEQ ID NO: 1521678 - RNA, 15 nt, Human
guagaggagaaacug

SEQ ID NO: 1521679 - RNA, 12 nt, Human
guacuacaauuu

SEQ ID NO: 1521680 - RNA, 17 nt, Human
guacuacaguccuccca

SEQ ID NO: 1521681 - RNA, 15 nt, Human
guacuacaauuuaaa

SEQ ID NO: 1521682 - RNA, 14 nt, Human
guacuucuccaccc

SEQ ID NO: 1521683 - RNA, 15 nt, Human
guacuucuccacccu

SEQ ID NO: 1521684 - RNA, 17 nt, Human
guacguugugcauuugg

SEQ ID NO: 1521685 - RNA, 15 nt, Human
guacuaaggaaucuu

SEQ ID NO: 1521686 - RNA, 23 nt, Human
guacuaaggaaucuuucugcuuu

SEQ ID NO: 1521687 - RNA, 16 nt, Human
guacguugugcauuug

SEQ ID NO: 1521688 - RNA, 15 nt, Human
guacguugugcauuu

SEQ ID NO: 1521689 - RNA, 14 nt, Human
guacguugugcauu

SEQ ID NO: 1521690 - RNA, 17 nt, Human
guacgucugacaggcaa

SEQ ID NO: 1521691 - RNA, 15 nt, Human
guacgaagaguauuu

SEQ ID NO: 1521692 - RNA, 14 nt, Human
guacgucugacagg

SEQ ID NO: 1521693 - RNA, 15 nt, Human
guacgucugacaggc

SEQ ID NO: 1521694 - RNA, 15 nt, Human
guaccgcaaugugac

SEQ ID NO: 1521695 - RNA, 16 nt, Human
guacccacugcucugg

SEQ ID NO: 1521696 - RNA, 22 nt, Human
guaccucuugagccuugaacuu

SEQ ID NO: 1521697 - RNA, 21 nt, Human
guaccucuugagccuugaacu

SEQ ID NO: 1521698 - RNA, 13 nt, Human
guaccucuugagc

SEQ ID NO: 1521699 - RNA, 19 nt, Human
ggcgcugccccuggcagcc

SEQ ID NO: 1521700 - RNA, 21 nt, Human
ggcgcugccccuggcagcccc

SEQ ID NO: 1521701 - RNA, 23 nt, Human
ggcgcugccccuggcagccccug

SEQ ID NO: 1521702 - RNA, 15 nt, Human
ggcgcgguggcucac

SEQ ID NO: 1521703 - RNA, 14 nt, Human
ggccugggggcugg

SEQ ID NO: 1521704 - RNA, 20 nt, Human
ggccugggggcugggcagag

SEQ ID NO: 1521705 - RNA, 22 nt, Human
ggccugggggcugggcagagga

SEQ ID NO: 1521706 - RNA, 22 nt, Human
ggcuaggaccccuccauguggg

SEQ ID NO: 1521707 - RNA, 16 nt, Human
ggcuaggaccccucca

SEQ ID NO: 1521708 - RNA, 22 nt, Human
ggcuagagguucaaagauauuu

SEQ ID NO: 1521709 - RNA, 17 nt, Human
ggcuagagguucaaaga

SEQ ID NO: 1521710 - RNA, 16 nt, Human
ggcuaguugggcuucc

SEQ ID NO: 1521711 - RNA, 23 nt, Human
ggcuagugugguguuuccuggca

SEQ ID NO: 1521712 - RNA, 15 nt, Human
ggcuaguugggcuuc

SEQ ID NO: 1521713 - RNA, 15 nt, Human
ggcuaugcauuugaa

SEQ ID NO: 1521714 - RNA, 12 nt, Human
ggcuccaggagc

SEQ ID NO: 1521715 - RNA, 13 nt, Human
ggcuccaggagca

SEQ ID NO: 1521716 - RNA, 19 nt, Human
ggcuccaggagcagccaca

SEQ ID NO: 1521717 - RNA, 12 nt, Human
ggcucacacuga

SEQ ID NO: 1521718 - RNA, 14 nt, Human
ggcucacacugaga

SEQ ID NO: 1521719 - RNA, 15 nt, Human
ggcucaaguccucuu

SEQ ID NO: 1521720 - RNA, 21 nt, Human
ggcucaaguccucuuuucuga

SEQ ID NO: 1521721 - RNA, 11 nt, Human
ggcuccaggcu

SEQ ID NO: 1521722 - RNA, 16 nt, Human
ggcuccaggcuccuuu

SEQ ID NO: 1521723 - RNA, 18 nt, Human
ggccucuuaugggcuggg

SEQ ID NO: 1521724 - RNA, 20 nt, Human
ggccucgguguggagaagcg

SEQ ID NO: 1521725 - RNA, 17 nt, Human
ggccucuuaugggcugg

SEQ ID NO: 1521726 - RNA, 13 nt, Human
ggccucugcacuc

SEQ ID NO: 1521727 - RNA, 14 nt, Human
ggccucugcacucc

SEQ ID NO: 1521728 - RNA, 15 nt, Human
ggccucugcacuccc

SEQ ID NO: 1521729 - RNA, 16 nt, Human
ggccucugcacucccc

SEQ ID NO: 1521730 - RNA, 13 nt, Human
ggcccugccuccu

SEQ ID NO: 1521731 - RNA, 14 nt, Human
ggcccugccuccuu

SEQ ID NO: 1521732 - RNA, 15 nt, Human
ggcccugccuccuuu

SEQ ID NO: 1521733 - RNA, 11 nt, Human
ggcccagagag

SEQ ID NO: 1521734 - RNA, 12 nt, Human
ggcccagagagg

SEQ ID NO: 1521735 - RNA, 21 nt, Human
ggcccucugcccacucccugc

SEQ ID NO: 1521736 - RNA, 19 nt, Human
ggcccucugcccacucccu

SEQ ID NO: 1521737 - RNA, 20 nt, Human
ggcccucugcccacucccug

SEQ ID NO: 1521738 - RNA, 13 nt, Human
ggcccucugccca

SEQ ID NO: 1521739 - RNA, 15 nt, Human
ggcccucugcccacu

SEQ ID NO: 1521740 - RNA, 16 nt, Human
ggcccucugcccacuc

SEQ ID NO: 1521741 - RNA, 17 nt, Human
ggcccucugcccacucc

SEQ ID NO: 1521742 - RNA, 12 nt, Human
ggagugcaguga

SEQ ID NO: 1521743 - RNA, 14 nt, Human
ggagugcagugagc

SEQ ID NO: 1521744 - RNA, 15 nt, Human
ggagugcagugagcc

SEQ ID NO: 1521745 - RNA, 18 nt, Human
ggauacaaaagcauguga

SEQ ID NO: 1521746 - RNA, 22 nt, Human
ggaucccucauccucauaccca

SEQ ID NO: 1521747 - RNA, 13 nt, Human
ggaucccucaucc

SEQ ID NO: 1521748 - RNA, 17 nt, Human
ggaucccucauccucau

SEQ ID NO: 1521749 - RNA, 23 nt, Human
ggaugcacagaguuguuacauuu

SEQ ID NO: 1521750 - RNA, 21 nt, Human
ggaugauuggaggggggaggu

SEQ ID NO: 1521751 - RNA, 16 nt, Human
ggaugcagccucacag

SEQ ID NO: 1521752 - RNA, 17 nt, Human
ggaugcagccucacagu

SEQ ID NO: 1521753 - RNA, 12 nt, Human
ggauccuccagg

SEQ ID NO: 1521754 - RNA, 13 nt, Human
ggauccuccaggu

SEQ ID NO: 1521755 - RNA, 19 nt, Human
ggaugcagccucacagucc

SEQ ID NO: 1521756 - RNA, 13 nt, Human
ggaugcagcauua

SEQ ID NO: 1521757 - RNA, 15 nt, Human
ggaugcuuguacaua

SEQ ID NO: 1521758 - RNA, 19 nt, Human
ggauuacaagcgugagcca

SEQ ID NO: 1521759 - RNA, 18 nt, Human
ggcaacccccagccugcu

SEQ ID NO: 1521760 - RNA, 19 nt, Human
ggcaacccccagccugcua

SEQ ID NO: 1521761 - RNA, 14 nt, Human
ggcaaugcuggcug

SEQ ID NO: 1521762 - RNA, 15 nt, Human
ggcaaugcuggcugu

SEQ ID NO: 1521763 - RNA, 23 nt, Human
ggcaaugcuggcuguuggcuggg

SEQ ID NO: 1521764 - RNA, 22 nt, Human
ggcacccggccccugcugguuc

SEQ ID NO: 1521765 - RNA, 23 nt, Human
ggcacccaccaucaugucuggcu

SEQ ID NO: 1521766 - RNA, 16 nt, Human
ggauucuuauggacaa

SEQ ID NO: 1521767 - RNA, 16 nt, Human
ggauucuuccucccuc

SEQ ID NO: 1521768 - RNA, 23 nt, Human
ggauuacaagcgugagccacugc

SEQ ID NO: 1521769 - RNA, 17 nt, Human
ggauuagggagagaaga

SEQ ID NO: 1521770 - RNA, 17 nt, Human
ggauugcuacuguccua

SEQ ID NO: 1521771 - RNA, 15 nt, Human
ggauuguaaaauggu

SEQ ID NO: 1521772 - RNA, 16 nt, Human
ggcaacccccagccug

SEQ ID NO: 1521773 - RNA, 17 nt, Human
ggcaacccccagccugc

SEQ ID NO: 1521774 - RNA, 16 nt, Human
ggccaugggccuccug

SEQ ID NO: 1521775 - RNA, 23 nt, Human
ggccagcugcuugggcuucaucc

SEQ ID NO: 1521776 - RNA, 18 nt, Human
ggccaggcccucugccca

SEQ ID NO: 1521777 - RNA, 20 nt, Human
ggccagccuugaccauucuc

SEQ ID NO: 1521778 - RNA, 22 nt, Human
ggccagccuugaccauucucca

SEQ ID NO: 1521779 - RNA, 17 nt, Human
ggccagcugcuugggcu

SEQ ID NO: 1521780 - RNA, 18 nt, Human
ggcauuccccaggaggcc

SEQ ID NO: 1521781 - RNA, 19 nt, Human
ggcauuccccaggaggcca

SEQ ID NO: 1521782 - RNA, 18 nt, Human
ggcaugggaaugaauguc

SEQ ID NO: 1521783 - RNA, 14 nt, Human
ggcauggcugggaa

SEQ ID NO: 1521784 - RNA, 22 nt, Human
ggcaugggaaugaaugucagug

SEQ ID NO: 1521785 - RNA, 17 nt, Human
ggcauuccccaggaggc

SEQ ID NO: 1521786 - RNA, 15 nt, Human
ggcaugaagacagau

SEQ ID NO: 1521787 - RNA, 18 nt, Human
ggcaugacacgaauauug

SEQ ID NO: 1521788 - RNA, 22 nt, Human
ggcaugacacgaauauugcuga

SEQ ID NO: 1521789 - RNA, 19 nt, Human
ggcagggucucacucuguc

SEQ ID NO: 1521790 - RNA, 20 nt, Human
ggcagggucucacucugucg

SEQ ID NO: 1521791 - RNA, 13 nt, Human
ggcagugggagcu

SEQ ID NO: 1521792 - RNA, 14 nt, Human
ggcagugggagcug

SEQ ID NO: 1521793 - RNA, 16 nt, Human
ggcagugggagcugcc

SEQ ID NO: 1521794 - RNA, 12 nt, Human
ggcagcucaccu

SEQ ID NO: 1521795 - RNA, 14 nt, Human
ggcagcucaccucu

SEQ ID NO: 1521796 - RNA, 17 nt, Human
ggcagcuugaggguugg

SEQ ID NO: 1521797 - RNA, 16 nt, Human
ggcagcucaccucucc

SEQ ID NO: 1521798 - RNA, 21 nt, Human
ggcagcucagagaggguggga

SEQ ID NO: 1521799 - RNA, 15 nt, Human
ggagaaucacuugaa

SEQ ID NO: 1521800 - RNA, 19 nt, Human
ggagaaucacuugaacccg

SEQ ID NO: 1521801 - RNA, 17 nt, Human
ggagaagcggcuggcag

SEQ ID NO: 1521802 - RNA, 18 nt, Human
ggagaagcggcuggcagc

SEQ ID NO: 1521803 - RNA, 15 nt, Human
ggacgcucucuggcc

SEQ ID NO: 1521804 - RNA, 13 nt, Human
ggacgcucucugg

SEQ ID NO: 1521805 - RNA, 14 nt, Human
ggacgcucucuggc

SEQ ID NO: 1521806 - RNA, 16 nt, Human
ggacauuugcucaugg

SEQ ID NO: 1521807 - RNA, 22 nt, Human
ggacagccacggccaggccaga

SEQ ID NO: 1521808 - RNA, 20 nt, Human
ggacauugcggacagccacg

SEQ ID NO: 1521809 - RNA, 17 nt, Human
ggacacucaaaagcugg

SEQ ID NO: 1521810 - RNA, 22 nt, Human
ggacacucaaaagcugggcagg

SEQ ID NO: 1521811 - RNA, 15 nt, Human
ggacagccacggcca

SEQ ID NO: 1521812 - RNA, 19 nt, Human
ggacagccacggccaggcc

SEQ ID NO: 1521813 - RNA, 20 nt, Human
ggacagccacggccaggcca

SEQ ID NO: 1521814 - RNA, 21 nt, Human
ggacagccacggccaggccag

SEQ ID NO: 1521815 - RNA, 17 nt, Human
ggacgcuacccgggaag

SEQ ID NO: 1521816 - RNA, 19 nt, Human
ggacgcuacccgggaaggg

SEQ ID NO: 1521817 - RNA, 20 nt, Human
ggacgcuacccgggaagggg

SEQ ID NO: 1521818 - RNA, 13 nt, Human
ggaccucgugcca

SEQ ID NO: 1521819 - RNA, 15 nt, Human
ggaccuugaacuggg

SEQ ID NO: 1521820 - RNA, 17 nt, Human
ggaccuugaacugggua

SEQ ID NO: 1521821 - RNA, 13 nt, Human
ggaccagagcugc

SEQ ID NO: 1521822 - RNA, 14 nt, Human
ggaccagagcugcc

SEQ ID NO: 1521823 - RNA, 19 nt, Human
ggaccucaggugagaagca

SEQ ID NO: 1521824 - RNA, 23 nt, Human
ggaccucaggugagaagcagagg

SEQ ID NO: 1521825 - RNA, 23 nt, Human
ggaaggggagauaaggguaucug

SEQ ID NO: 1521826 - RNA, 20 nt, Human
ggaagugacgguuuaauggg

SEQ ID NO: 1521827 - RNA, 18 nt, Human
ggaaguacuggagaaaau

SEQ ID NO: 1521828 - RNA, 12 nt, Human
ggaaguacugga

SEQ ID NO: 1521829 - RNA, 16 nt, Human
ggaaguacuggagaaa

SEQ ID NO: 1521830 - RNA, 16 nt, Human
ggaauuggagcucgug

SEQ ID NO: 1521831 - RNA, 22 nt, Human
ggaauuggagcucgugggacag

SEQ ID NO: 1521832 - RNA, 23 nt, Human
ggaauuucucccagucauuuaau

SEQ ID NO: 1521833 - RNA, 16 nt, Human
ggacaaaauggaauac

SEQ ID NO: 1521834 - RNA, 17 nt, Human
ggacaaaauggaauacu

SEQ ID NO: 1521835 - RNA, 19 nt, Human
ggaauguuugccucugccu

SEQ ID NO: 1521836 - RNA, 20 nt, Human
ggaauucaucucucuuuaau

SEQ ID NO: 1521837 - RNA, 14 nt, Human
ggaaugcuguguua

SEQ ID NO: 1521838 - RNA, 15 nt, Human
ggaauggcacagccc

SEQ ID NO: 1521839 - RNA, 24 nt, Human
ggaaugauuaauuaaaacacaaca

SEQ ID NO: 1521840 - RNA, 12 nt, Human
ggaaugcagugg

SEQ ID NO: 1521841 - RNA, 14 nt, Human
ggaaaagcugcuga

SEQ ID NO: 1521842 - RNA, 20 nt, Human
ggaaaaggcagggagcgagg

SEQ ID NO: 1521843 - RNA, 18 nt, Human
ggaaaagcugcugacagu

SEQ ID NO: 1521844 - RNA, 20 nt, Human
ggaaaagcugcugacagugu

SEQ ID NO: 1521845 - RNA, 18 nt, Human
ggaaaacaugcuacacac

SEQ ID NO: 1521846 - RNA, 21 nt, Human
gcuuuguuuguugucagcuga

SEQ ID NO: 1521847 - RNA, 17 nt, Human
gcuuuuaaaaaaaaaua

SEQ ID NO: 1521848 - RNA, 15 nt, Human
gcuuugugauuuuug

SEQ ID NO: 1521849 - RNA, 22 nt, Human
gcuugaggguugggcugguguc

SEQ ID NO: 1521850 - RNA, 18 nt, Human
gcuugaggguugggcugg

SEQ ID NO: 1521851 - RNA, 20 nt, Human
gcuugaggguugggcuggug

SEQ ID NO: 1521852 - RNA, 14 nt, Human
gcuuuaucaaaggg

SEQ ID NO: 1521853 - RNA, 16 nt, Human
ggaacaggaaacugau

SEQ ID NO: 1521854 - RNA, 21 nt, Human
ggaaaucaccgaaaacguggc

SEQ ID NO: 1521855 - RNA, 14 nt, Human
ggaaaucaccgaaa

SEQ ID NO: 1521856 - RNA, 17 nt, Human
ggaaaucaaauaugcaa

SEQ ID NO: 1521857 - RNA, 12 nt, Human
ggaaaggcucca

SEQ ID NO: 1521858 - RNA, 13 nt, Human
ggaaaggcuccag

SEQ ID NO: 1521859 - RNA, 14 nt, Human
ggaaaggcuccagg

SEQ ID NO: 1521860 - RNA, 19 nt, Human
ggaaaaucagccugcucca

SEQ ID NO: 1521861 - RNA, 23 nt, Human
ggaaaaucagccugcuccagcug

SEQ ID NO: 1521862 - RNA, 22 nt, Human
ggaaaggcuccaggagcagcca

SEQ ID NO: 1521863 - RNA, 21 nt, Human
ggaaaggggcaggccagagcu

SEQ ID NO: 1521864 - RNA, 17 nt, Human
ggaaaggcuccaggagc

SEQ ID NO: 1521865 - RNA, 19 nt, Human
ggaaaggcuccaggagcag

SEQ ID NO: 1521866 - RNA, 20 nt, Human
ggaaaggcuccaggagcagc

SEQ ID NO: 1521867 - RNA, 21 nt, Human
ggaaaggcuccaggagcagcc

SEQ ID NO: 1521868 - RNA, 21 nt, Human
gcuguucaugaaagauucaau

SEQ ID NO: 1521869 - RNA, 12 nt, Human
gcuguucaugaa

SEQ ID NO: 1521870 - RNA, 14 nt, Human
gcuguucagcuggu

SEQ ID NO: 1521871 - RNA, 17 nt, Human
gcugucuccauguuuga

SEQ ID NO: 1521872 - RNA, 20 nt, Human
gcugucuacacuaagagaga

SEQ ID NO: 1521873 - RNA, 20 nt, Human
gcugccaaugggagcucaug

SEQ ID NO: 1521874 - RNA, 15 nt, Human
gcugccaaugggagc

SEQ ID NO: 1521875 - RNA, 16 nt, Human
gcugccaaugggagcu

SEQ ID NO: 1521876 - RNA, 19 nt, Human
gcugccaaugggagcucau

SEQ ID NO: 1521877 - RNA, 21 nt, Human
gcuuagucacugagacagccc

SEQ ID NO: 1521878 - RNA, 19 nt, Human
gcuuagucacugagacagc

SEQ ID NO: 1521879 - RNA, 20 nt, Human
gcuuagucacugagacagcc

SEQ ID NO: 1521880 - RNA, 15 nt, Human
gcuuagucacugaga

SEQ ID NO: 1521881 - RNA, 17 nt, Human
gcuuagucacugagaca

SEQ ID NO: 1521882 - RNA, 22 nt, Human
gcuuagggacaggaccccagcu

SEQ ID NO: 1521883 - RNA, 23 nt, Human
gcuuagggacaggaccccagcuc

SEQ ID NO: 1521884 - RNA, 16 nt, Human
gcuucaguggcagcug

SEQ ID NO: 1521885 - RNA, 12 nt, Human
gcuuauacacuu

SEQ ID NO: 1521886 - RNA, 20 nt, Human
gcuuauacacuuacacuuua

SEQ ID NO: 1521887 - RNA, 19 nt, Human
gcuuaucucaggggugugc

SEQ ID NO: 1521888 - RNA, 17 nt, Human
gcuucaguggcagcugc

SEQ ID NO: 1521889 - RNA, 18 nt, Human
gcuucaguggcagcugcu

SEQ ID NO: 1521890 - RNA, 12 nt, Human
gcuucauccucc

SEQ ID NO: 1521891 - RNA, 15 nt, Human
gcuucauccuccuca

SEQ ID NO: 1521892 - RNA, 13 nt, Human
gcuucauuuccug

SEQ ID NO: 1521893 - RNA, 16 nt, Human
gcuucauuuccugugu

SEQ ID NO: 1521894 - RNA, 16 nt, Human
gcuuccagugaggcuc

SEQ ID NO: 1521895 - RNA, 18 nt, Human
gcuuccagugaggcucug

SEQ ID NO: 1521896 - RNA, 17 nt, Human
gcuucauuuccuguguc

SEQ ID NO: 1521897 - RNA, 21 nt, Human
gcuucauccuccucagaucuu

SEQ ID NO: 1521898 - RNA, 18 nt, Human
gcuucauuuccugugucu

SEQ ID NO: 1521899 - RNA, 15 nt, Human
gcuuccagugaggcu

SEQ ID NO: 1521900 - RNA, 16 nt, Human
gcuugaggguugggcu

SEQ ID NO: 1521901 - RNA, 14 nt, Human
gcuccaagaauuuc

SEQ ID NO: 1521902 - RNA, 13 nt, Human
gcuccaagcuccc

SEQ ID NO: 1521903 - RNA, 14 nt, Human
gcuccaagcuccca

SEQ ID NO: 1521904 - RNA, 15 nt, Human
gcuccaagcucccag

SEQ ID NO: 1521905 - RNA, 21 nt, Human
gcuccaagcucccaggcauuc

SEQ ID NO: 1521906 - RNA, 16 nt, Human
gcuccaagcucccagg

SEQ ID NO: 1521907 - RNA, 17 nt, Human
gcuccaagcucccaggc

SEQ ID NO: 1521908 - RNA, 18 nt, Human
gcuccaagcucccaggca

SEQ ID NO: 1521909 - RNA, 19 nt, Human
gcuccaagcucccaggcau

SEQ ID NO: 1521910 - RNA, 20 nt, Human
gcuccauuuuuagugaaaua

SEQ ID NO: 1521911 - RNA, 20 nt, Human
gcuccagcuguucagcuggu

SEQ ID NO: 1521912 - RNA, 24 nt, Human
gcuccaggcuccuuuagcgcccag

SEQ ID NO: 1521913 - RNA, 11 nt, Human
gcuccagcugu

SEQ ID NO: 1521914 - RNA, 16 nt, Human
gcuccaggcuccuuua

SEQ ID NO: 1521915 - RNA, 23 nt, Human
gcuccaggcuccuuuagcgccca

SEQ ID NO: 1521916 - RNA, 14 nt, Human
gcucaccucucccu

SEQ ID NO: 1521917 - RNA, 20 nt, Human
gcucaccagccccagugccc

SEQ ID NO: 1521918 - RNA, 23 nt, Human
gcucaccagccccagugcccaca

SEQ ID NO: 1521919 - RNA, 19 nt, Human
gcucaccagccccagugcc

SEQ ID NO: 1521920 - RNA, 17 nt, Human
gcucagcaaaagaugcu

SEQ ID NO: 1521921 - RNA, 20 nt, Human
gcucagcaaaagaugcuucu

SEQ ID NO: 1521922 - RNA, 22 nt, Human
gcucagcaaaagaugcuucuca

SEQ ID NO: 1521923 - RNA, 23 nt, Human
gcucagcaaaagaugcuucucac

SEQ ID NO: 1521924 - RNA, 19 nt, Human
gcucaggugucccugcacu

SEQ ID NO: 1521925 - RNA, 15 nt, Human
gcucagcggggacag

SEQ ID NO: 1521926 - RNA, 16 nt, Human
gcucagcggggacagc

SEQ ID NO: 1521927 - RNA, 20 nt, Human
gcucagcggggacagcuccu

SEQ ID NO: 1521928 - RNA, 21 nt, Human
gcucagcggggacagcuccuu

SEQ ID NO: 1521929 - RNA, 22 nt, Human
gcucagcggggacagcuccuuc

SEQ ID NO: 1521930 - RNA, 18 nt, Human
gcucaggugucccugcac

SEQ ID NO: 1521931 - RNA, 14 nt, Human
gcuaagcauuccaa

SEQ ID NO: 1521932 - RNA, 17 nt, Human
gcuaagcaaaaugugau

SEQ ID NO: 1521933 - RNA, 23 nt, Human
gcuaagagggagggagggcucca

SEQ ID NO: 1521934 - RNA, 16 nt, Human
gcuacccgcagaguuc

SEQ ID NO: 1521935 - RNA, 14 nt, Human
gcuacccgggaagg

SEQ ID NO: 1521936 - RNA, 15 nt, Human
gcuacccgggaaggg

SEQ ID NO: 1521937 - RNA, 22 nt, Human
gcuacccgcagaguucucagaa

SEQ ID NO: 1521938 - RNA, 21 nt, Human
gcuacccgggaagggggcugg

SEQ ID NO: 1521939 - RNA, 21 nt, Human
gcuagagguucaaagauauuu

SEQ ID NO: 1521940 - RNA, 19 nt, Human
gcuagagguucaaagauau

SEQ ID NO: 1521941 - RNA, 18 nt, Human
gcuagagguucaaagaua

SEQ ID NO: 1521942 - RNA, 23 nt, Human
gcuaucucccccagccccauccu

SEQ ID NO: 1521943 - RNA, 19 nt, Human
gcuaucucccccagcccca

SEQ ID NO: 1521944 - RNA, 20 nt, Human
gcuaucucccccagccccau

SEQ ID NO: 1521945 - RNA, 21 nt, Human
gcuaucucccccagccccauc

SEQ ID NO: 1521946 - RNA, 22 nt, Human
gcuaucucccccagccccaucc

SEQ ID NO: 1521947 - RNA, 16 nt, Human
gcuaucucccccagcc

SEQ ID NO: 1521948 - RNA, 17 nt, Human
gcuaucucccccagccc

SEQ ID NO: 1521949 - RNA, 18 nt, Human
gcuaucucccccagcccc

SEQ ID NO: 1521950 - RNA, 15 nt, Human
gcgggcuuccuccug

SEQ ID NO: 1521951 - RNA, 12 nt, Human
gcggggacagcu

SEQ ID NO: 1521952 - RNA, 13 nt, Human
gcggggacagcuc

SEQ ID NO: 1521953 - RNA, 16 nt, Human
gcgguccacccaggag

SEQ ID NO: 1521954 - RNA, 20 nt, Human
gcgguccacccaggagcccc

SEQ ID NO: 1521955 - RNA, 18 nt, Human
gcgguccacccaggagcc

SEQ ID NO: 1521956 - RNA, 19 nt, Human
gcgguccacccaggagccc

SEQ ID NO: 1521957 - RNA, 18 nt, Human
gcgugagccacugcaccg

SEQ ID NO: 1521958 - RNA, 23 nt, Human
gcgugagccacugcaccgggcca

SEQ ID NO: 1521959 - RNA, 16 nt, Human
gcuaaagcccagagac

SEQ ID NO: 1521960 - RNA, 13 nt, Human
gcuaaaugugaau

SEQ ID NO: 1521961 - RNA, 16 nt, Human
gcuaaaugugaaugau

SEQ ID NO: 1521962 - RNA, 14 nt, Human
gcuaacauggaagu

SEQ ID NO: 1521963 - RNA, 22 nt, Human
gcuaagagggagggagggcucc

SEQ ID NO: 1521964 - RNA, 15 nt, Human
gcugauggugcaaug

SEQ ID NO: 1521965 - RNA, 16 nt, Human
gcugauggugcaauga

SEQ ID NO: 1521966 - RNA, 22 nt, Human
gcugagugggggaucacagccu

SEQ ID NO: 1521967 - RNA, 13 nt, Human
gcugaguuggugu

SEQ ID NO: 1521968 - RNA, 23 nt, Human
gcugagugggggaucacagccuc

SEQ ID NO: 1521969 - RNA, 15 nt, Human
gcugagucugaaggc

SEQ ID NO: 1521970 - RNA, 16 nt, Human
gcugagucugaaggcu

SEQ ID NO: 1521971 - RNA, 18 nt, Human
gcugagucugaaggcugg

SEQ ID NO: 1521972 - RNA, 19 nt, Human
gcugagucugaaggcuggg

SEQ ID NO: 1521973 - RNA, 17 nt, Human
gcugcauuuaaaagaua

SEQ ID NO: 1521974 - RNA, 21 nt, Human
gcugcaguugccagucacccc

SEQ ID NO: 1521975 - RNA, 18 nt, Human
gcugcaguugccagucac

SEQ ID NO: 1521976 - RNA, 20 nt, Human
gcugcaguugccagucaccc

SEQ ID NO: 1521977 - RNA, 18 nt, Human
gcugauggugcaaugacc

SEQ ID NO: 1521978 - RNA, 21 nt, Human
gcugauggugcaaugaccuuu

SEQ ID NO: 1521979 - RNA, 21 nt, Human
gcugacagacacaggcccggc

SEQ ID NO: 1521980 - RNA, 22 nt, Human
gcucuucucauuucaccccucc

SEQ ID NO: 1521981 - RNA, 23 nt, Human
gcucuucucauuucaccccuccc

SEQ ID NO: 1521982 - RNA, 14 nt, Human
gcucuucuccaggc

SEQ ID NO: 1521983 - RNA, 16 nt, Human
gcucuucuccaggcug

SEQ ID NO: 1521984 - RNA, 19 nt, Human
gcucuuccaggcugggaga

SEQ ID NO: 1521985 - RNA, 18 nt, Human
gcucuuccaggcugggag

SEQ ID NO: 1521986 - RNA, 12 nt, Human
gcucuucucauu

SEQ ID NO: 1521987 - RNA, 22 nt, Human
gcucuuccaggcugggagagcc

SEQ ID NO: 1521988 - RNA, 12 nt, Human
gcucuucuccag

SEQ ID NO: 1521989 - RNA, 14 nt, Human
gcucuucucauuuc

SEQ ID NO: 1521990 - RNA, 15 nt, Human
gcucuucucauuuca

SEQ ID NO: 1521991 - RNA, 16 nt, Human
gcucuucucauuucac

SEQ ID NO: 1521992 - RNA, 20 nt, Human
gcucuucucauuucaccccu

SEQ ID NO: 1521993 - RNA, 19 nt, Human
gcucuccgaccagacaccu

SEQ ID NO: 1521994 - RNA, 13 nt, Human
gcucuccgaccag

SEQ ID NO: 1521995 - RNA, 17 nt, Human
gcucuccgaccagacac

SEQ ID NO: 1521996 - RNA, 11 nt, Human
gcucuccuucc

SEQ ID NO: 1521997 - RNA, 12 nt, Human
gcucuccuuccu

SEQ ID NO: 1521998 - RNA, 22 nt, Human
gcucuccuuccuggagcccaga

SEQ ID NO: 1521999 - RNA, 11 nt, Human
gcucucuggcc

SEQ ID NO: 1522000 - RNA, 12 nt, Human
gcucucuggccu

SEQ ID NO: 1522001 - RNA, 13 nt, Human
gcucucuggccuu

SEQ ID NO: 1522002 - RNA, 15 nt, Human
gcucccuucccaccu

SEQ ID NO: 1522003 - RNA, 16 nt, Human
gcucccuucccaccuc

SEQ ID NO: 1522004 - RNA, 18 nt, Human
gcucccuucccaccucuc

SEQ ID NO: 1522005 - RNA, 19 nt, Human
gcucccuucccaccucucu

SEQ ID NO: 1522006 - RNA, 21 nt, Human
gcuccuucuguccuacucugu

SEQ ID NO: 1522007 - RNA, 16 nt, Human
gcucgagcaugccugg

SEQ ID NO: 1522008 - RNA, 17 nt, Human
gcucgagcaugccugga

SEQ ID NO: 1522009 - RNA, 21 nt, Human
gcucugcgucgguccuggugc

SEQ ID NO: 1522010 - RNA, 20 nt, Human
gcucugcgucgguccuggug

SEQ ID NO: 1522011 - RNA, 13 nt, Human
gcucugcuccucu

SEQ ID NO: 1522012 - RNA, 14 nt, Human
gcucugcuccucuc

SEQ ID NO: 1522013 - RNA, 13 nt, Human
gcucugccuccca

SEQ ID NO: 1522014 - RNA, 14 nt, Human
gcucugccucccau

SEQ ID NO: 1522015 - RNA, 15 nt, Human
gcucugccucccauc

SEQ ID NO: 1522016 - RNA, 22 nt, Human
gcucugccucccaucacccgcu

SEQ ID NO: 1522017 - RNA, 14 nt, Human
gcucucuggccuuc

SEQ ID NO: 1522018 - RNA, 15 nt, Human
gcucucuggccuucg

SEQ ID NO: 1522019 - RNA, 19 nt, Human
gcucucuggccuucggccu

SEQ ID NO: 1522020 - RNA, 20 nt, Human
gcucucuggccuucggccuc

SEQ ID NO: 1522021 - RNA, 14 nt, Human
gcucugcccuuggu

SEQ ID NO: 1522022 - RNA, 23 nt, Human
gcucugcccuugguuaggcauug

SEQ ID NO: 1522023 - RNA, 11 nt, Human
gcucugccucc

SEQ ID NO: 1522024 - RNA, 14 nt, Human
gcucuggacaggca

SEQ ID NO: 1522025 - RNA, 15 nt, Human
gcucuggacaggcau

SEQ ID NO: 1522026 - RNA, 16 nt, Human
gcucuggacaggcaug

SEQ ID NO: 1522027 - RNA, 21 nt, Human
gcucuggacaggcauguucuc

SEQ ID NO: 1522028 - RNA, 22 nt, Human
gcucuggacaggcauguucucu

SEQ ID NO: 1522029 - RNA, 19 nt, Human
gcucugcuccucuccccag

SEQ ID NO: 1522030 - RNA, 21 nt, Human
gcucugcuccucuccccagca

SEQ ID NO: 1522031 - RNA, 13 nt, Human
gcucugcugacag

SEQ ID NO: 1522032 - RNA, 14 nt, Human
gcucugcugacaga

SEQ ID NO: 1522033 - RNA, 18 nt, Human
gcucugcugacagacaca

SEQ ID NO: 1522034 - RNA, 19 nt, Human
gcucugcugacagacacag

SEQ ID NO: 1522035 - RNA, 20 nt, Human
gcucugcugacagacacagg

SEQ ID NO: 1522036 - RNA, 23 nt, Human
gcucugcugacagacacaggccc

SEQ ID NO: 1522037 - RNA, 22 nt, Human
gccugaagucacacagugaguc

SEQ ID NO: 1522038 - RNA, 16 nt, Human
gccugcuccagcuguu

SEQ ID NO: 1522039 - RNA, 18 nt, Human
gccugcuccagcuguuca

SEQ ID NO: 1522040 - RNA, 15 nt, Human
gccugcuccagcugu

SEQ ID NO: 1522041 - RNA, 21 nt, Human
gccugggggcugggcagagga

SEQ ID NO: 1522042 - RNA, 20 nt, Human
gccugggggcugggcagagg

SEQ ID NO: 1522043 - RNA, 18 nt, Human
gccugggcagaaggaaga

SEQ ID NO: 1522044 - RNA, 16 nt, Human
gccugggcagaaggaa

SEQ ID NO: 1522045 - RNA, 17 nt, Human
gccugggcagaaggaag

SEQ ID NO: 1522046 - RNA, 14 nt, Human
gccuggauggggcu

SEQ ID NO: 1522047 - RNA, 15 nt, Human
gccuggauggggcug

SEQ ID NO: 1522048 - RNA, 15 nt, Human
gccugggcagaagga

SEQ ID NO: 1522049 - RNA, 16 nt, Human
gccuggccagaugcac

SEQ ID NO: 1522050 - RNA, 14 nt, Human
gccuggccagaugc

SEQ ID NO: 1522051 - RNA, 15 nt, Human
gccuggccagaugca

SEQ ID NO: 1522052 - RNA, 17 nt, Human
gccucccgaguagcugg

SEQ ID NO: 1522053 - RNA, 23 nt, Human
gccucccgaauagcugggacuac

SEQ ID NO: 1522054 - RNA, 15 nt, Human
gccucccgaguagcu

SEQ ID NO: 1522055 - RNA, 15 nt, Human
gccucagugccacua

SEQ ID NO: 1522056 - RNA, 22 nt, Human
gccucccaacucaccccagccc

SEQ ID NO: 1522057 - RNA, 23 nt, Human
gccucccaacucaccccagcccc

SEQ ID NO: 1522058 - RNA, 21 nt, Human
gccucccacgacugcccggca

SEQ ID NO: 1522059 - RNA, 14 nt, Human
gccucccacgacug

SEQ ID NO: 1522060 - RNA, 22 nt, Human
gccucaagugauucuccugccu

SEQ ID NO: 1522061 - RNA, 23 nt, Human
gccucagccucccaaagugcugg

SEQ ID NO: 1522062 - RNA, 12 nt, Human
gccucagugcca

SEQ ID NO: 1522063 - RNA, 14 nt, Human
gccucagugccacu

SEQ ID NO: 1522064 - RNA, 22 nt, Human
gccuauauuuuuuguuaaauga

SEQ ID NO: 1522065 - RNA, 17 nt, Human
gccuaagugcagccccg

SEQ ID NO: 1522066 - RNA, 14 nt, Human
gccucaaccuccug

SEQ ID NO: 1522067 - RNA, 16 nt, Human
gccucaaccuccuggg

SEQ ID NO: 1522068 - RNA, 17 nt, Human
gccucaaccuccugggc

SEQ ID NO: 1522069 - RNA, 19 nt, Human
gccucaagugauucuccug

SEQ ID NO: 1522070 - RNA, 20 nt, Human
gccucaagugauucuccugc

SEQ ID NO: 1522071 - RNA, 21 nt, Human
gccucaagugauucuccugcc

SEQ ID NO: 1522072 - RNA, 14 nt, Human
gcccugguggcagu

SEQ ID NO: 1522073 - RNA, 17 nt, Human
gcccugguggcaguggg

SEQ ID NO: 1522074 - RNA, 18 nt, Human
gcccugguggcaguggga

SEQ ID NO: 1522075 - RNA, 19 nt, Human
gcccugguggcagugggag

SEQ ID NO: 1522076 - RNA, 20 nt, Human
gcccugguggcagugggagc

SEQ ID NO: 1522077 - RNA, 21 nt, Human
gcccugguggcagugggagcu

SEQ ID NO: 1522078 - RNA, 22 nt, Human
gcccugguggcagugggagcug

SEQ ID NO: 1522079 - RNA, 23 nt, Human
gcccugguggcagugggagcugc

SEQ ID NO: 1522080 - RNA, 16 nt, Human
gccgagaucacgccac

SEQ ID NO: 1522081 - RNA, 18 nt, Human
gccgagaucacgccacug

SEQ ID NO: 1522082 - RNA, 19 nt, Human
gccgagaucacgccacugc

SEQ ID NO: 1522083 - RNA, 18 nt, Human
gccgagauugcaccacug

SEQ ID NO: 1522084 - RNA, 17 nt, Human
gccgagauugcaccacu

SEQ ID NO: 1522085 - RNA, 23 nt, Human
gcccuucucuccagccccuggau

SEQ ID NO: 1522086 - RNA, 21 nt, Human
gcccuucucuccagccccugg

SEQ ID NO: 1522087 - RNA, 22 nt, Human
gcccuucucuccagccccugga

SEQ ID NO: 1522088 - RNA, 19 nt, Human
gcccuucucuccagccccu

SEQ ID NO: 1522089 - RNA, 20 nt, Human
gcccuggaugcccaggaauc

SEQ ID NO: 1522090 - RNA, 17 nt, Human
gcccggcuccaggcucc

SEQ ID NO: 1522091 - RNA, 18 nt, Human
gcccggcuccaggcuccu

SEQ ID NO: 1522092 - RNA, 12 nt, Human
gcccucugccca

SEQ ID NO: 1522093 - RNA, 16 nt, Human
gcccugagcuuucugc

SEQ ID NO: 1522094 - RNA, 17 nt, Human
gcagacucuacagaggc

SEQ ID NO: 1522095 - RNA, 15 nt, Human
gcagacucuacagag

SEQ ID NO: 1522096 - RNA, 13 nt, Human
gccccugccaccc

SEQ ID NO: 1522097 - RNA, 14 nt, Human
gccccugccacccu

SEQ ID NO: 1522098 - RNA, 15 nt, Human
gccccugccacccug

SEQ ID NO: 1522099 - RNA, 21 nt, Human
gccccuguucuggcagaguug

SEQ ID NO: 1522100 - RNA, 12 nt, Human
gcccggcuccag

SEQ ID NO: 1522101 - RNA, 16 nt, Human
gcccggcuccaggcuc

SEQ ID NO: 1522102 - RNA, 19 nt, Human
gaugggugcuuggaggaag

SEQ ID NO: 1522103 - RNA, 13 nt, Human
gauggggcugcac

SEQ ID NO: 1522104 - RNA, 19 nt, Human
gauggggcugcaccggcug

SEQ ID NO: 1522105 - RNA, 15 nt, Human
gauggggcugcaccg

SEQ ID NO: 1522106 - RNA, 22 nt, Human
gauggccgggcgcgguggcuca

SEQ ID NO: 1522107 - RNA, 20 nt, Human
gaugggcaacccccagccug

SEQ ID NO: 1522108 - RNA, 21 nt, Human
gaugggcaacccccagccugc

SEQ ID NO: 1522109 - RNA, 24 nt, Human
gauggggcccugccuccuuuguga

SEQ ID NO: 1522110 - RNA, 18 nt, Human
gaugcuagaacucccuuu

SEQ ID NO: 1522111 - RNA, 20 nt, Human
gaugcuagaacucccuuuca

SEQ ID NO: 1522112 - RNA, 22 nt, Human
gaugcuagaacucccuuucaac

SEQ ID NO: 1522113 - RNA, 20 nt, Human
gaugcccaaagaugcagccg

SEQ ID NO: 1522114 - RNA, 19 nt, Human
gaugcccaaagaugcagcc

SEQ ID NO: 1522115 - RNA, 22 nt, Human
gaugguucccuugaugaagaag

SEQ ID NO: 1522116 - RNA, 17 nt, Human
gaugugggucaaggaau

SEQ ID NO: 1522117 - RNA, 12 nt, Human
gauggugcaaug

SEQ ID NO: 1522118 - RNA, 14 nt, Human
gauggugcaaugac

SEQ ID NO: 1522119 - RNA, 17 nt, Human
gauggugcaaugaccuu

SEQ ID NO: 1522120 - RNA, 15 nt, Human
gauggugcaaugacc

SEQ ID NO: 1522121 - RNA, 16 nt, Human
gauggugcaaugaccu

SEQ ID NO: 1522122 - RNA, 23 nt, Human
gauuacaagcgugagccacugca

SEQ ID NO: 1522123 - RNA, 15 nt, Human
gauuaaacuuaaucu

SEQ ID NO: 1522124 - RNA, 22 nt, Human
gauuacaagcgugagccacugc

SEQ ID NO: 1522125 - RNA, 21 nt, Human
gauucaaugccccugaauuua

SEQ ID NO: 1522126 - RNA, 19 nt, Human
gauucaaugccccugaauu

SEQ ID NO: 1522127 - RNA, 20 nt, Human
gauucaaugccccugaauuu

SEQ ID NO: 1522128 - RNA, 20 nt, Human
gauuacaggugugaaccacc

SEQ ID NO: 1522129 - RNA, 14 nt, Human
gauucuccugccuc

SEQ ID NO: 1522130 - RNA, 15 nt, Human
gauugcaacaggcug

SEQ ID NO: 1522131 - RNA, 22 nt, Human
gauugcguggaauugugcugag

SEQ ID NO: 1522132 - RNA, 14 nt, Human
gauuuaacagaaau

SEQ ID NO: 1522133 - RNA, 13 nt, Human
gauuuaacagaaa

SEQ ID NO: 1522134 - RNA, 22 nt, Human
gauuuccguuaaaauaccagcc

SEQ ID NO: 1522135 - RNA, 15 nt, Human
gauuuaacagaaaug

SEQ ID NO: 1522136 - RNA, 16 nt, Human
gcaaauugucacagga

SEQ ID NO: 1522137 - RNA, 15 nt, Human
gcaaaccaucauuga

SEQ ID NO: 1522138 - RNA, 23 nt, Human
gcaaagcacugacuucuaaguaa

SEQ ID NO: 1522139 - RNA, 21 nt, Human
gcaaagcugaugacaacuucc

SEQ ID NO: 1522140 - RNA, 17 nt, Human
gcaaaggaguagaaaga

SEQ ID NO: 1522141 - RNA, 19 nt, Human
gauuuugguuuuguucccc

SEQ ID NO: 1522142 - RNA, 22 nt, Human
gauuuugguuuuguuccccucc

SEQ ID NO: 1522143 - RNA, 12 nt, Human
gcaaaccaucau

SEQ ID NO: 1522144 - RNA, 21 nt, Human
gauuuugaaauuuuuauuaaa

SEQ ID NO: 1522145 - RNA, 19 nt, Human
gauuuugauccaagcuggu

SEQ ID NO: 1522146 - RNA, 14 nt, Human
gcagaagggggugg

SEQ ID NO: 1522147 - RNA, 15 nt, Human
gcagaaggggguggu

SEQ ID NO: 1522148 - RNA, 22 nt, Human
gcagaaggggguggugucucca

SEQ ID NO: 1522149 - RNA, 19 nt, Human
gcacuguggguagacacac

SEQ ID NO: 1522150 - RNA, 12 nt, Human
gcagacaggcaa

SEQ ID NO: 1522151 - RNA, 13 nt, Human
gcagacaggcaag

SEQ ID NO: 1522152 - RNA, 14 nt, Human
gcagacaggcaagc

SEQ ID NO: 1522153 - RNA, 23 nt, Human
gcacugcuuccagugaggcucug

SEQ ID NO: 1522154 - RNA, 16 nt, Human
gcacgauuucuguuua

SEQ ID NO: 1522155 - RNA, 15 nt, Human
gcacugacuucuaag

SEQ ID NO: 1522156 - RNA, 18 nt, Human
gcacugacuucuaaguaa

SEQ ID NO: 1522157 - RNA, 11 nt, Human
gcacugaggaa

SEQ ID NO: 1522158 - RNA, 13 nt, Human
gcacugaggaaga

SEQ ID NO: 1522159 - RNA, 18 nt, Human
gcacugaggaagaacggg

SEQ ID NO: 1522160 - RNA, 12 nt, Human
gcaccauaacuu

SEQ ID NO: 1522161 - RNA, 20 nt, Human
gcaccuuagacagucccugc

SEQ ID NO: 1522162 - RNA, 21 nt, Human
gcaccuuagacagucccugcc

SEQ ID NO: 1522163 - RNA, 15 nt, Human
gcacgauuucuguuu

SEQ ID NO: 1522164 - RNA, 13 nt, Human
gcacgauuucugu

SEQ ID NO: 1522165 - RNA, 21 nt, Human
gcacagaguuguuacauuuuu

SEQ ID NO: 1522166 - RNA, 19 nt, Human
gcacagaguuguuacauuu

SEQ ID NO: 1522167 - RNA, 18 nt, Human
gcacagaguuguuacauu

SEQ ID NO: 1522168 - RNA, 16 nt, Human
gcacagaguuguuaca

SEQ ID NO: 1522169 - RNA, 22 nt, Human
gcacagaguuguuacauuuuua

SEQ ID NO: 1522170 - RNA, 13 nt, Human
gcaacucugaagg

SEQ ID NO: 1522171 - RNA, 15 nt, Human
gcaauggcagccuug

SEQ ID NO: 1522172 - RNA, 14 nt, Human
gcaacucaucuuag

SEQ ID NO: 1522173 - RNA, 14 nt, Human
gcaaugugauaaaa

SEQ ID NO: 1522174 - RNA, 14 nt, Human
gcaauuucauaugc

SEQ ID NO: 1522175 - RNA, 15 nt, Human
gcacaaacagaggcc

SEQ ID NO: 1522176 - RNA, 16 nt, Human
gcacaaacagaggccg

SEQ ID NO: 1522177 - RNA, 14 nt, Human
gcacaaacagaggc

SEQ ID NO: 1522178 - RNA, 21 nt, Human
gcacaagcuccaagcucccag

SEQ ID NO: 1522179 - RNA, 18 nt, Human
gcacaagcuccaagcucc

SEQ ID NO: 1522180 - RNA, 15 nt, Human
gcacaagcuccaagc

SEQ ID NO: 1522181 - RNA, 17 nt, Human
gcacaagcuccaagcuc

SEQ ID NO: 1522182 - RNA, 20 nt, Human
gcacagaaaauggaagacag

SEQ ID NO: 1522183 - RNA, 15 nt, Human
gcacagaguuguuac

SEQ ID NO: 1522184 - RNA, 22 nt, Human
gcacagacccugcccugugggc

SEQ ID NO: 1522185 - RNA, 18 nt, Human
gcacagacccugcccugu

SEQ ID NO: 1522186 - RNA, 19 nt, Human
gcacagacccugcccugug

SEQ ID NO: 1522187 - RNA, 20 nt, Human
gcacagacccugcccugugg

SEQ ID NO: 1522188 - RNA, 21 nt, Human
gcacagacccugcccuguggg

SEQ ID NO: 1522189 - RNA, 21 nt, Human
gcacagaaaauggaagacagc

SEQ ID NO: 1522190 - RNA, 22 nt, Human
gcacagaaaauggaagacagcu

SEQ ID NO: 1522191 - RNA, 23 nt, Human
gcacagaaaauggaagacagcuc

SEQ ID NO: 1522192 - RNA, 14 nt, Human
gcacagacccugcc

SEQ ID NO: 1522193 - RNA, 15 nt, Human
gcacagacccugccc

SEQ ID NO: 1522194 - RNA, 16 nt, Human
gcacagacccugcccu

SEQ ID NO: 1522195 - RNA, 17 nt, Human
gcacagacccugcccug

SEQ ID NO: 1522196 - RNA, 22 nt, Human
gauaaauggcuuccuggcaaua

SEQ ID NO: 1522197 - RNA, 15 nt, Human
gaguugaagacagag

SEQ ID NO: 1522198 - RNA, 17 nt, Human
gaguugaagacagagcu

SEQ ID NO: 1522199 - RNA, 21 nt, Human
gaguugaagacagagcuacac

SEQ ID NO: 1522200 - RNA, 23 nt, Human
gaguugacuugacagaacacugu

SEQ ID NO: 1522201 - RNA, 13 nt, Human
gaguuacagacaa

SEQ ID NO: 1522202 - RNA, 15 nt, Human
gaguuacagacaaag

SEQ ID NO: 1522203 - RNA, 14 nt, Human
gaguucaucuugaa

SEQ ID NO: 1522204 - RNA, 19 nt, Human
gaguucaucuugaauugua

SEQ ID NO: 1522205 - RNA, 20 nt, Human
gaguucaucuugaauuguaa

SEQ ID NO: 1522206 - RNA, 18 nt, Human
gaguguacuuaacuauuc

SEQ ID NO: 1522207 - RNA, 13 nt, Human
gagugggugaaua

SEQ ID NO: 1522208 - RNA, 17 nt, Human
gagugacagaggcagcc

SEQ ID NO: 1522209 - RNA, 19 nt, Human
gagugucuuaauuaaaaga

SEQ ID NO: 1522210 - RNA, 20 nt, Human
gagugugccugaagucccag

SEQ ID NO: 1522211 - RNA, 12 nt, Human
gaguuacagaca

SEQ ID NO: 1522212 - RNA, 14 nt, Human
gauaugauucaaau

SEQ ID NO: 1522213 - RNA, 22 nt, Human
gauaugauucaaaugucuauaa

SEQ ID NO: 1522214 - RNA, 24 nt, Human
gauaugauucaaaugucuauaaac

SEQ ID NO: 1522215 - RNA, 18 nt, Human
gaucacggcucacugcag

SEQ ID NO: 1522216 - RNA, 14 nt, Human
gaucacagccucug

SEQ ID NO: 1522217 - RNA, 20 nt, Human
gaucacggcucacugcagcc

SEQ ID NO: 1522218 - RNA, 15 nt, Human
gaucacggcucacug

SEQ ID NO: 1522219 - RNA, 16 nt, Human
gaucacggcucacugc

SEQ ID NO: 1522220 - RNA, 21 nt, Human
gauacaggaaaagcugcugac

SEQ ID NO: 1522221 - RNA, 23 nt, Human
gauacaggaaaagcugcugacag

SEQ ID NO: 1522222 - RNA, 22 nt, Human
gauaagaaccuuuugagugccu

SEQ ID NO: 1522223 - RNA, 20 nt, Human
gauacaggaaaagcugcuga

SEQ ID NO: 1522224 - RNA, 16 nt, Human
gauagcacagacccug

SEQ ID NO: 1522225 - RNA, 15 nt, Human
gauagcacagacccu

SEQ ID NO: 1522226 - RNA, 22 nt, Human
gauagccaaggccaaaggaagc

SEQ ID NO: 1522227 - RNA, 21 nt, Human
gagucuauuuacggaacucaa

SEQ ID NO: 1522228 - RNA, 12 nt, Human
gagucugaaggc

SEQ ID NO: 1522229 - RNA, 13 nt, Human
gagucugaaggcu

SEQ ID NO: 1522230 - RNA, 15 nt, Human
gagucugaaggcugg

SEQ ID NO: 1522231 - RNA, 14 nt, Human
gagucugaaggcug

SEQ ID NO: 1522232 - RNA, 17 nt, Human
gagugaagcugggagaa

SEQ ID NO: 1522233 - RNA, 14 nt, Human
gagugacagaggca

SEQ ID NO: 1522234 - RNA, 15 nt, Human
gagugacagaggcag

SEQ ID NO: 1522235 - RNA, 16 nt, Human
gagugacagaggcagc

SEQ ID NO: 1522236 - RNA, 11 nt, Human
gaguauauguc

SEQ ID NO: 1522237 - RNA, 18 nt, Human
gaguaggaagacuuugga

SEQ ID NO: 1522238 - RNA, 19 nt, Human
gaguaggaagacuuuggaa

SEQ ID NO: 1522239 - RNA, 15 nt, Human
gagucgaggacaggg

SEQ ID NO: 1522240 - RNA, 16 nt, Human
gagucgaggacaggga

SEQ ID NO: 1522241 - RNA, 19 nt, Human
gaguccgaaagggacuugg

SEQ ID NO: 1522242 - RNA, 14 nt, Human
gagucgaggacagg

SEQ ID NO: 1522243 - RNA, 20 nt, Human
gaguacuacaguccucccau

SEQ ID NO: 1522244 - RNA, 17 nt, Human
gaguagaaagacagagc

SEQ ID NO: 1522245 - RNA, 20 nt, Human
gaguagaaagacagagcugg

SEQ ID NO: 1522246 - RNA, 21 nt, Human
gaguacuacaguccucccauc

SEQ ID NO: 1522247 - RNA, 23 nt, Human
gaguacuacaguccucccaucuc

SEQ ID NO: 1522248 - RNA, 22 nt, Human
gaguagaaagacagagcuggga

SEQ ID NO: 1522249 - RNA, 22 nt, Human
gaguagcugggacuacaggcac

SEQ ID NO: 1522250 - RNA, 12 nt, Human
gaguaggaagac

SEQ ID NO: 1522251 - RNA, 13 nt, Human
gaguaggaagacu

SEQ ID NO: 1522252 - RNA, 17 nt, Human
gaguaggaagacuuugg

SEQ ID NO: 1522253 - RNA, 17 nt, Human
gaggucagagccugcag

SEQ ID NO: 1522254 - RNA, 20 nt, Human
gaggucagagccugcaguua

SEQ ID NO: 1522255 - RNA, 15 nt, Human
gagguugggaggcca

SEQ ID NO: 1522256 - RNA, 17 nt, Human
gagguugggaggccauu

SEQ ID NO: 1522257 - RNA, 16 nt, Human
gagguuucaaaccucc

SEQ ID NO: 1522258 - RNA, 24 nt, Human
gagguaaggaauaccugucccccu

SEQ ID NO: 1522259 - RNA, 21 nt, Human
gagguaaggaauaccuguccc

SEQ ID NO: 1522260 - RNA, 14 nt, Human
gaggguugggcugg

SEQ ID NO: 1522261 - RNA, 15 nt, Human
gaggguugggcuggu

SEQ ID NO: 1522262 - RNA, 17 nt, Human
gaggucaaggcugcagu

SEQ ID NO: 1522263 - RNA, 12 nt, Human
gaggucagagcc

SEQ ID NO: 1522264 - RNA, 13 nt, Human
gaggucagagccu

SEQ ID NO: 1522265 - RNA, 13 nt, Human
gaggguccugcag

SEQ ID NO: 1522266 - RNA, 17 nt, Human
gaggguccugcagccug

SEQ ID NO: 1522267 - RNA, 21 nt, Human
gaggguccugcagccugcagg

SEQ ID NO: 1522268 - RNA, 18 nt, Human
gaggguccugcagccugc

SEQ ID NO: 1522269 - RNA, 13 nt, Human
gagggucugagga

SEQ ID NO: 1522270 - RNA, 14 nt, Human
gagggucugaggaa

SEQ ID NO: 1522271 - RNA, 21 nt, Human
gagggugaagugaagacaaug

SEQ ID NO: 1522272 - RNA, 23 nt, Human
gagggugccguguccccugacag

SEQ ID NO: 1522273 - RNA, 12 nt, Human
gaggguggaaua

SEQ ID NO: 1522274 - RNA, 15 nt, Human
gagggugggaguggg

SEQ ID NO: 1522275 - RNA, 14 nt, Human
gaggguggugaccu

SEQ ID NO: 1522276 - RNA, 21 nt, Human
gaggguggugaccucugccug

SEQ ID NO: 1522277 - RNA, 22 nt, Human
gagggugucccaaaaagaaagg

SEQ ID NO: 1522278 - RNA, 20 nt, Human
gaggcugggcucccuuccca

SEQ ID NO: 1522279 - RNA, 22 nt, Human
gagggagcaaguccuucccuuu

SEQ ID NO: 1522280 - RNA, 19 nt, Human
gagggagggcuccagacac

SEQ ID NO: 1522281 - RNA, 21 nt, Human
gagggagugacagaggcagcc

SEQ ID NO: 1522282 - RNA, 22 nt, Human
gagggagugacagaggcagccc

SEQ ID NO: 1522283 - RNA, 20 nt, Human
gagggagggcuccagacaca

SEQ ID NO: 1522284 - RNA, 14 nt, Human
gagggagguaagga

SEQ ID NO: 1522285 - RNA, 18 nt, Human
gagggagugacagaggca

SEQ ID NO: 1522286 - RNA, 14 nt, Human
gagggcacagaaaa

SEQ ID NO: 1522287 - RNA, 17 nt, Human
gaggggguggccuccca

SEQ ID NO: 1522288 - RNA, 13 nt, Human
gaggguaaggcug

SEQ ID NO: 1522289 - RNA, 19 nt, Human
gaggggugcggcgguccca

SEQ ID NO: 1522290 - RNA, 22 nt, Human
gaggggugcggcggucccagcu

SEQ ID NO: 1522291 - RNA, 16 nt, Human
gaggccuucucugaag

SEQ ID NO: 1522292 - RNA, 18 nt, Human
gaggccuucucugaagga

SEQ ID NO: 1522293 - RNA, 19 nt, Human
gaggccuucucugaaggac

SEQ ID NO: 1522294 - RNA, 11 nt, Human
gaggcccagag

SEQ ID NO: 1522295 - RNA, 13 nt, Human
gaggcccagaggg

SEQ ID NO: 1522296 - RNA, 14 nt, Human
gaggcccagagggc

SEQ ID NO: 1522297 - RNA, 19 nt, Human
gaggcccagagggccugca

SEQ ID NO: 1522298 - RNA, 15 nt, Human
gaggcccagagggcc

SEQ ID NO: 1522299 - RNA, 16 nt, Human
gaggcccagagggccu

SEQ ID NO: 1522300 - RNA, 22 nt, Human
gaggcccuucucuccagccccu

SEQ ID NO: 1522301 - RNA, 21 nt, Human
gaggcccuucucuccagcccc

SEQ ID NO: 1522302 - RNA, 15 nt, Human
gaggcccuucucucc

SEQ ID NO: 1522303 - RNA, 20 nt, Human
gaggcccuucucuccagccc

SEQ ID NO: 1522304 - RNA, 19 nt, Human
gaggcagagguugcaguga

SEQ ID NO: 1522305 - RNA, 19 nt, Human
gaggcagccccauucugcc

SEQ ID NO: 1522306 - RNA, 21 nt, Human
gaggcagccccauucugccug

SEQ ID NO: 1522307 - RNA, 20 nt, Human
gaggcagccccauucugccu

SEQ ID NO: 1522308 - RNA, 9 nt, Human
gaggcaggg

SEQ ID NO: 1522309 - RNA, 14 nt, Human
gaggccaugggccu

SEQ ID NO: 1522310 - RNA, 17 nt, Human
gaggccaugggccuccu

SEQ ID NO: 1522311 - RNA, 18 nt, Human
gaggccaugggccuccug

SEQ ID NO: 1522312 - RNA, 20 nt, Human
gaggccaugggccuccugug

SEQ ID NO: 1522313 - RNA, 21 nt, Human
gaggccaugggccuccugugu

SEQ ID NO: 1522314 - RNA, 23 nt, Human
gaggccaugggccuccugugugu

SEQ ID NO: 1522315 - RNA, 20 nt, Human
gaggauugcuugagcucagg

SEQ ID NO: 1522316 - RNA, 13 nt, Human
gaggaucucuuga

SEQ ID NO: 1522317 - RNA, 22 nt, Human
gaggaucucuugagccugggag

SEQ ID NO: 1522318 - RNA, 16 nt, Human
gaggaucucuugagcc

SEQ ID NO: 1522319 - RNA, 19 nt, Human
gaggaucucuugagccugg

SEQ ID NO: 1522320 - RNA, 19 nt, Human
gagauagccaaggccaaag

SEQ ID NO: 1522321 - RNA, 18 nt, Human
gagaucacgccacugcac

SEQ ID NO: 1522322 - RNA, 19 nt, Human
gagaucacgccacugcacu

SEQ ID NO: 1522323 - RNA, 14 nt, Human
gagauagccaaggc

SEQ ID NO: 1522324 - RNA, 16 nt, Human
gagauagccaaggcca

SEQ ID NO: 1522325 - RNA, 23 nt, Human
gagaucaaccccuucgcuccugu

SEQ ID NO: 1522326 - RNA, 20 nt, Human
gagcaccuuagacagucccu

SEQ ID NO: 1522327 - RNA, 21 nt, Human
gagcacuaaggugugcucuga

SEQ ID NO: 1522328 - RNA, 15 nt, Human
gagcacuaaggugug

SEQ ID NO: 1522329 - RNA, 21 nt, Human
gagcaccuuagacagucccug

SEQ ID NO: 1522330 - RNA, 22 nt, Human
gagcaccuuagacagucccugc

SEQ ID NO: 1522331 - RNA, 19 nt, Human
gagccaauuuaaagaaaac

SEQ ID NO: 1522332 - RNA, 12 nt, Human
gagcagagacca

SEQ ID NO: 1522333 - RNA, 16 nt, Human
gagcagagaauucucu

SEQ ID NO: 1522334 - RNA, 14 nt, Human
gagccagggucuca

SEQ ID NO: 1522335 - RNA, 23 nt, Human
gagccagauuucacucuccuugg

SEQ ID NO: 1522336 - RNA, 19 nt, Human
gagccagggucucacuaug

SEQ ID NO: 1522337 - RNA, 14 nt, Human
gagcccagaggagg

SEQ ID NO: 1522338 - RNA, 22 nt, Human
gagcccagaggagggcagcaga

SEQ ID NO: 1522339 - RNA, 20 nt, Human
gagaaugagagacacacuga

SEQ ID NO: 1522340 - RNA, 21 nt, Human
gagaaugagagacacacugaa

SEQ ID NO: 1522341 - RNA, 23 nt, Human
gagaaugcacaaacagaggccgc

SEQ ID NO: 1522342 - RNA, 19 nt, Human
gagacagcuugaucaaagg

SEQ ID NO: 1522343 - RNA, 15 nt, Human
gagaauguaagaacu

SEQ ID NO: 1522344 - RNA, 16 nt, Human
gagaauguaagaacua

SEQ ID NO: 1522345 - RNA, 20 nt, Human
gagacagcucugcauacuca

SEQ ID NO: 1522346 - RNA, 14 nt, Human
gagaccaucccuga

SEQ ID NO: 1522347 - RNA, 18 nt, Human
gagaccaucccugaaggc

SEQ ID NO: 1522348 - RNA, 21 nt, Human
gagaccaucccugaaggcccc

SEQ ID NO: 1522349 - RNA, 22 nt, Human
gagacaggguuuugccauguug

SEQ ID NO: 1522350 - RNA, 19 nt, Human
gagacuccugcaggcagcc

SEQ ID NO: 1522351 - RNA, 20 nt, Human
gagacuccugcaggcagcca

SEQ ID NO: 1522352 - RNA, 21 nt, Human
gagacuccugcaggcagccag

SEQ ID NO: 1522353 - RNA, 20 nt, Human
gagacucgcgacaaugcaaa

SEQ ID NO: 1522354 - RNA, 21 nt, Human
gagacucgcgacaaugcaaac

SEQ ID NO: 1522355 - RNA, 22 nt, Human
gagacuccugcaggcagccagg

SEQ ID NO: 1522356 - RNA, 13 nt, Human
gagacucugucuc

SEQ ID NO: 1522357 - RNA, 18 nt, Human
gagagccccucacacagc

SEQ ID NO: 1522358 - RNA, 13 nt, Human
gagagagcuggag

SEQ ID NO: 1522359 - RNA, 15 nt, Human
gagaguagaacagau

SEQ ID NO: 1522360 - RNA, 13 nt, Human
gagaggggcacag

SEQ ID NO: 1522361 - RNA, 19 nt, Human
gagaggggaacagacugga

SEQ ID NO: 1522362 - RNA, 14 nt, Human
gagagggugggagu

SEQ ID NO: 1522363 - RNA, 20 nt, Human
gagagggugggagugggccc

SEQ ID NO: 1522364 - RNA, 16 nt, Human
gagagggugggagugg

SEQ ID NO: 1522365 - RNA, 13 nt, Human
gagaagccacagg

SEQ ID NO: 1522366 - RNA, 17 nt, Human
gagaagccacaggccug

SEQ ID NO: 1522367 - RNA, 18 nt, Human
gagaagccacaggccuga

SEQ ID NO: 1522368 - RNA, 17 nt, Human
gagaaugagagacacac

SEQ ID NO: 1522369 - RNA, 20 nt, Human
gagaagccacaggccugaga

SEQ ID NO: 1522370 - RNA, 22 nt, Human
gagaagccacaggccugagauu

SEQ ID NO: 1522371 - RNA, 16 nt, Human
gagaagagaaugcaca

SEQ ID NO: 1522372 - RNA, 16 nt, Human
gagaagcagaggaagg

SEQ ID NO: 1522373 - RNA, 13 nt, Human
gagaagagcuguu

SEQ ID NO: 1522374 - RNA, 22 nt, Human
gagaacuuccagauccuggaaa

SEQ ID NO: 1522375 - RNA, 23 nt, Human
gagaacuuccagauccuggaaau

SEQ ID NO: 1522376 - RNA, 13 nt, Human
gagaagaacugaa

SEQ ID NO: 1522377 - RNA, 14 nt, Human
gagaagagaaugca

SEQ ID NO: 1522378 - RNA, 15 nt, Human
gagaacuuucauuuu

SEQ ID NO: 1522379 - RNA, 16 nt, Human
gagaacuuucauuuuu

SEQ ID NO: 1522380 - RNA, 17 nt, Human
gagaacuuucauuuuuu

SEQ ID NO: 1522381 - RNA, 21 nt, Human
gagaaccuagggugauauuaa

SEQ ID NO: 1522382 - RNA, 22 nt, Human
gagaaccuagggugauauuaac

SEQ ID NO: 1522383 - RNA, 14 nt, Human
gagaaaugagcuug

SEQ ID NO: 1522384 - RNA, 22 nt, Human
gagaaaguacuucuccacccug

SEQ ID NO: 1522385 - RNA, 16 nt, Human
gagaaagguugaagca

SEQ ID NO: 1522386 - RNA, 13 nt, Human
gacuuggaagcuc

SEQ ID NO: 1522387 - RNA, 16 nt, Human
gacuugacagaacacu

SEQ ID NO: 1522388 - RNA, 18 nt, Human
gacuugacagaacacugu

SEQ ID NO: 1522389 - RNA, 19 nt, Human
gacuuaagcacacuugaca

SEQ ID NO: 1522390 - RNA, 16 nt, Human
gacuucuaaguaaaac

SEQ ID NO: 1522391 - RNA, 17 nt, Human
gacuucuaaguaaaacc

SEQ ID NO: 1522392 - RNA, 18 nt, Human
gacuucuaaguaaaacca

SEQ ID NO: 1522393 - RNA, 24 nt, Human
gacuucuaaguaaaaccacagcag

SEQ ID NO: 1522394 - RNA, 19 nt, Human
gacuucuaaguaaaaccac

SEQ ID NO: 1522395 - RNA, 23 nt, Human
gacuucuaaguaaaaccacagca

SEQ ID NO: 1522396 - RNA, 20 nt, Human
gacuucugucuucacaacag

SEQ ID NO: 1522397 - RNA, 23 nt, Human
gacuucugucuucacaacagauu

SEQ ID NO: 1522398 - RNA, 24 nt, Human
gacugcauuauauuuauuacugua

SEQ ID NO: 1522399 - RNA, 13 nt, Human
gacugcccggcag

SEQ ID NO: 1522400 - RNA, 15 nt, Human
gacugcccggcaggg

SEQ ID NO: 1522401 - RNA, 14 nt, Human
gacugcauuauauu

SEQ ID NO: 1522402 - RNA, 16 nt, Human
gacugcauuauauuua

SEQ ID NO: 1522403 - RNA, 23 nt, Human
gacugaguacguugugcauuugg

SEQ ID NO: 1522404 - RNA, 17 nt, Human
gacucgcgacaaugcaa

SEQ ID NO: 1522405 - RNA, 19 nt, Human
gacucgagaacuuucauuu

SEQ ID NO: 1522406 - RNA, 16 nt, Human
gacucgagaacuuuca

SEQ ID NO: 1522407 - RNA, 22 nt, Human
gacugaguacguugugcauuug

SEQ ID NO: 1522408 - RNA, 21 nt, Human
gacugaguacguugugcauuu

SEQ ID NO: 1522409 - RNA, 14 nt, Human
gacuggaagcacag

SEQ ID NO: 1522410 - RNA, 15 nt, Human
gacuggaagcacagc

SEQ ID NO: 1522411 - RNA, 16 nt, Human
gacuggaagcacagcu

SEQ ID NO: 1522412 - RNA, 18 nt, Human
gacuggaagcacagcuuc

SEQ ID NO: 1522413 - RNA, 14 nt, Human
gacucauucuucug

SEQ ID NO: 1522414 - RNA, 15 nt, Human
gacucauucuucugu

SEQ ID NO: 1522415 - RNA, 18 nt, Human
gacuacaggugugaguca

SEQ ID NO: 1522416 - RNA, 21 nt, Human
gacuacaggugugagucacca

SEQ ID NO: 1522417 - RNA, 13 nt, Human
gacuacaggugug

SEQ ID NO: 1522418 - RNA, 12 nt, Human
gacuccugcagg

SEQ ID NO: 1522419 - RNA, 14 nt, Human
gacuccugcaggca

SEQ ID NO: 1522420 - RNA, 13 nt, Human
gacuccugcaggc

SEQ ID NO: 1522421 - RNA, 13 nt, Human
gacucgcgacaau

SEQ ID NO: 1522422 - RNA, 16 nt, Human
gacuccaaagaaaugu

SEQ ID NO: 1522423 - RNA, 18 nt, Human
gacuccaaagaaauguaa

SEQ ID NO: 1522424 - RNA, 21 nt, Human
gacucauuuuaaaaaauggaa

SEQ ID NO: 1522425 - RNA, 11 nt, Human
gacuccaaaga

SEQ ID NO: 1522426 - RNA, 12 nt, Human
gacuccaaagaa

SEQ ID NO: 1522427 - RNA, 15 nt, Human
gacuccaaagaaaug

SEQ ID NO: 1522428 - RNA, 16 nt, Human
gaauuggagcucgugg

SEQ ID NO: 1522429 - RNA, 16 nt, Human
gaauugacccacaaga

SEQ ID NO: 1522430 - RNA, 21 nt, Human
gaauugacccacaagaaauga

SEQ ID NO: 1522431 - RNA, 18 nt, Human
gaauucuugaaggaaaau

SEQ ID NO: 1522432 - RNA, 23 nt, Human
gaauucuugaaggaaaaugauac

SEQ ID NO: 1522433 - RNA, 15 nt, Human
gaauguuaagcagau

SEQ ID NO: 1522434 - RNA, 15 nt, Human
gaauguuugccucug

SEQ ID NO: 1522435 - RNA, 14 nt, Human
gaauguuaagcaga

SEQ ID NO: 1522436 - RNA, 13 nt, Human
gaaugucagugug

SEQ ID NO: 1522437 - RNA, 20 nt, Human
gaauccagacccggcugcgu

SEQ ID NO: 1522438 - RNA, 12 nt, Human
gaaaggcuccag

SEQ ID NO: 1522439 - RNA, 18 nt, Human
gaaucucugaauuugaga

SEQ ID NO: 1522440 - RNA, 19 nt, Human
gaaucucauaauuuauaca

SEQ ID NO: 1522441 - RNA, 20 nt, Human
gaaugcacaaacagaggccg

SEQ ID NO: 1522442 - RNA, 18 nt, Human
gaaugaaccacaucuugc

SEQ ID NO: 1522443 - RNA, 21 nt, Human
gaaugcacaaacagaggccgc

SEQ ID NO: 1522444 - RNA, 13 nt, Human
gaaugcuguguua

SEQ ID NO: 1522445 - RNA, 11 nt, Human
gaaugcagugg

SEQ ID NO: 1522446 - RNA, 14 nt, Human
gaaugcuguguuaa

SEQ ID NO: 1522447 - RNA, 22 nt, Human
gaauggcacagcccaaagaagg

SEQ ID NO: 1522448 - RNA, 20 nt, Human
gaauuugauaugugaacagu

SEQ ID NO: 1522449 - RNA, 22 nt, Human
gaauuucuuuugccguuauuaa

SEQ ID NO: 1522450 - RNA, 19 nt, Human
gaauuucuaggacugaauu

SEQ ID NO: 1522451 - RNA, 20 nt, Human
gaauuucuaggacugaauua

SEQ ID NO: 1522452 - RNA, 15 nt, Human
gaauuguaaggaaug

SEQ ID NO: 1522453 - RNA, 22 nt, Human
gacaacacucauugaccugagg

SEQ ID NO: 1522454 - RNA, 23 nt, Human
gacaacacucauugaccugaggc

SEQ ID NO: 1522455 - RNA, 16 nt, Human
gacaaggaaaaaauaa

SEQ ID NO: 1522456 - RNA, 21 nt, Human
gacaaggaugaucuaggaaga

SEQ ID NO: 1522457 - RNA, 18 nt, Human
gacaaggauugcuacugu

SEQ ID NO: 1522458 - RNA, 19 nt, Human
gacaaggauugcuacuguc

SEQ ID NO: 1522459 - RNA, 21 nt, Human
gacaaggauugcuacuguccu

SEQ ID NO: 1522460 - RNA, 19 nt, Human
gacaaugugaaaagaaaaa

SEQ ID NO: 1522461 - RNA, 20 nt, Human
gacaaugugaaaagaaaaau

SEQ ID NO: 1522462 - RNA, 22 nt, Human
gacaaugcaaaccaucauugaa

SEQ ID NO: 1522463 - RNA, 12 nt, Human
gacaaugugaaa

SEQ ID NO: 1522464 - RNA, 18 nt, Human
gacaaugugaaaagaaaa

SEQ ID NO: 1522465 - RNA, 16 nt, Human
gacacaagccuucggc

SEQ ID NO: 1522466 - RNA, 22 nt, Human
gacacaagccuucggcgccuua

SEQ ID NO: 1522467 - RNA, 13 nt, Human
gacacaacuauuu

SEQ ID NO: 1522468 - RNA, 19 nt, Human
gacacaggcccggcuccag

SEQ ID NO: 1522469 - RNA, 14 nt, Human
gacacaugcaaggu

SEQ ID NO: 1522470 - RNA, 20 nt, Human
gacacaggcccggcuccagg

SEQ ID NO: 1522471 - RNA, 21 nt, Human
gacacaggcccggcuccaggc

SEQ ID NO: 1522472 - RNA, 19 nt, Human
gacacaugcaaggucauuu

SEQ ID NO: 1522473 - RNA, 15 nt, Human
gacacauguccaaga

SEQ ID NO: 1522474 - RNA, 20 nt, Human
gacacauguccaagaagccc

SEQ ID NO: 1522475 - RNA, 23 nt, Human
gacacauguccaagaagcccagg

SEQ ID NO: 1522476 - RNA, 17 nt, Human
gacaugggacauuugcu

SEQ ID NO: 1522477 - RNA, 16 nt, Human
gacaugggacauuugc

SEQ ID NO: 1522478 - RNA, 18 nt, Human
gacaugggaaaggggaag

SEQ ID NO: 1522479 - RNA, 14 nt, Human
gaccacguuucuaa

SEQ ID NO: 1522480 - RNA, 16 nt, Human
gaccacguuucuaaag

SEQ ID NO: 1522481 - RNA, 21 nt, Human
gaccacugcagaagacaguau

SEQ ID NO: 1522482 - RNA, 21 nt, Human
gaccagacaccuugacagggc

SEQ ID NO: 1522483 - RNA, 11 nt, Human
gaccagagcug

SEQ ID NO: 1522484 - RNA, 19 nt, Human
gaccauucuccaccugcca

SEQ ID NO: 1522485 - RNA, 20 nt, Human
gaccauucuccaccugccag

SEQ ID NO: 1522486 - RNA, 21 nt, Human
gaccauucuccaccugccagg

SEQ ID NO: 1522487 - RNA, 22 nt, Human
gaccauucuccaccugccaggg

SEQ ID NO: 1522488 - RNA, 18 nt, Human
gaccagagcugccaccug

SEQ ID NO: 1522489 - RNA, 19 nt, Human
gaccagagcugccaccugc

SEQ ID NO: 1522490 - RNA, 13 nt, Human
gaccagagcugcc

SEQ ID NO: 1522491 - RNA, 14 nt, Human
gaccagagcugcca

SEQ ID NO: 1522492 - RNA, 15 nt, Human
gaccagagcugccac

SEQ ID NO: 1522493 - RNA, 17 nt, Human
gaccagagcugccaccu

SEQ ID NO: 1522494 - RNA, 12 nt, Human
gacccugucuca

SEQ ID NO: 1522495 - RNA, 19 nt, Human
gacccuuguggucccaccc

SEQ ID NO: 1522496 - RNA, 20 nt, Human
gacccuuguggucccacccc

SEQ ID NO: 1522497 - RNA, 21 nt, Human
gacccuuguggucccacccca

SEQ ID NO: 1522498 - RNA, 19 nt, Human
gaccgugaggccagagaca

SEQ ID NO: 1522499 - RNA, 18 nt, Human
gaccgugaggccagagac

SEQ ID NO: 1522500 - RNA, 16 nt, Human
gaccgugaggccagag

SEQ ID NO: 1522501 - RNA, 17 nt, Human
gaccgugaggccagaga

SEQ ID NO: 1522502 - RNA, 16 nt, Human
gacccaaaaggcagaa

SEQ ID NO: 1522503 - RNA, 15 nt, Human
gacccacaagaaaug

SEQ ID NO: 1522504 - RNA, 22 nt, Human
gacccacaagaaaugaaagcag

SEQ ID NO: 1522505 - RNA, 14 nt, Human
gaccccuccaugug

SEQ ID NO: 1522506 - RNA, 18 nt, Human
gaccccuccaugugggcu

SEQ ID NO: 1522507 - RNA, 21 nt, Human
gaccccuccaugugggcuagu

SEQ ID NO: 1522508 - RNA, 22 nt, Human
gacccugaggcccagagggccu

SEQ ID NO: 1522509 - RNA, 23 nt, Human
gacccugaggcccagagggccug

SEQ ID NO: 1522510 - RNA, 12 nt, Human
gacccugcccug

SEQ ID NO: 1522511 - RNA, 22 nt, Human
gacaguuaagagaaaugagcuu

SEQ ID NO: 1522512 - RNA, 20 nt, Human
gacauagaauuaacacauga

SEQ ID NO: 1522513 - RNA, 14 nt, Human
gacaugaucuucuu

SEQ ID NO: 1522514 - RNA, 14 nt, Human
gacaugggaaaggg

SEQ ID NO: 1522515 - RNA, 23 nt, Human
gacagggcacaccgggcacucag

SEQ ID NO: 1522516 - RNA, 18 nt, Human
gacagggaggacgcucuc

SEQ ID NO: 1522517 - RNA, 16 nt, Human
gacagggaggugaccc

SEQ ID NO: 1522518 - RNA, 14 nt, Human
gacaguuaagagaa

SEQ ID NO: 1522519 - RNA, 24 nt, Human
gacagggcacaccgggcacucaga

SEQ ID NO: 1522520 - RNA, 17 nt, Human
gacagggaggacgcucu

SEQ ID NO: 1522521 - RNA, 19 nt, Human
gacaggaccccagcucugc

SEQ ID NO: 1522522 - RNA, 14 nt, Human
gacaggaccccagc

SEQ ID NO: 1522523 - RNA, 15 nt, Human
gacaggaccccagcu

SEQ ID NO: 1522524 - RNA, 16 nt, Human
gacaggaccccagcuc

SEQ ID NO: 1522525 - RNA, 17 nt, Human
gacaggaccccagcucu

SEQ ID NO: 1522526 - RNA, 18 nt, Human
gacaggaccccagcucug

SEQ ID NO: 1522527 - RNA, 20 nt, Human
gacaggaccccagcucugcg

SEQ ID NO: 1522528 - RNA, 14 nt, Human
gacaggaccaggga

SEQ ID NO: 1522529 - RNA, 15 nt, Human
gacaggaccagggau

SEQ ID NO: 1522530 - RNA, 23 nt, Human
gacaggaccagggauuuccauga

SEQ ID NO: 1522531 - RNA, 18 nt, Human
gacagcugccugggaucc

SEQ ID NO: 1522532 - RNA, 21 nt, Human
gacagcugccugggaucccuc

SEQ ID NO: 1522533 - RNA, 20 nt, Human
gacagccacggccaggccag

SEQ ID NO: 1522534 - RNA, 21 nt, Human
gacagccacggccaggccaga

SEQ ID NO: 1522535 - RNA, 16 nt, Human
gacagcugccugggau

SEQ ID NO: 1522536 - RNA, 17 nt, Human
gacagcugccugggauc

SEQ ID NO: 1522537 - RNA, 20 nt, Human
gacagagugagacucugucu

SEQ ID NO: 1522538 - RNA, 22 nt, Human
gacagagugagacucugucuca

SEQ ID NO: 1522539 - RNA, 14 nt, Human
gacagccacggcca

SEQ ID NO: 1522540 - RNA, 17 nt, Human
gacagccacggccaggc

SEQ ID NO: 1522541 - RNA, 18 nt, Human
gacagccacggccaggcc

SEQ ID NO: 1522542 - RNA, 19 nt, Human
gacagccacggccaggcca

SEQ ID NO: 1522543 - RNA, 21 nt, Human
gacagagcaagugagacccug

SEQ ID NO: 1522544 - RNA, 14 nt, Human
gacagaggcagccc

SEQ ID NO: 1522545 - RNA, 16 nt, Human
gacagaggcagcccca

SEQ ID NO: 1522546 - RNA, 17 nt, Human
gacagaggcagccccau

SEQ ID NO: 1522547 - RNA, 15 nt, Human
gacagaggggguggc

SEQ ID NO: 1522548 - RNA, 18 nt, Human
gacagaggggguggccuc

SEQ ID NO: 1522549 - RNA, 19 nt, Human
gacagaggggguggccucc

SEQ ID NO: 1522550 - RNA, 21 nt, Human
gacagaggggguggccuccca

SEQ ID NO: 1522551 - RNA, 22 nt, Human
gacagaggggguggccucccaa

SEQ ID NO: 1522552 - RNA, 23 nt, Human
gacagaggggguggccucccaac

SEQ ID NO: 1522553 - RNA, 14 nt, Human
gacagagucucacu

SEQ ID NO: 1522554 - RNA, 20 nt, Human
cuuuuguucuugguuuguaa

SEQ ID NO: 1522555 - RNA, 18 nt, Human
cuuuguuaguuucuccaa

SEQ ID NO: 1522556 - RNA, 12 nt, Human
cuuuuguucuug

SEQ ID NO: 1522557 - RNA, 11 nt, Human
cuuuuguucuu

SEQ ID NO: 1522558 - RNA, 12 nt, Human
gaaaaaggagga

SEQ ID NO: 1522559 - RNA, 15 nt, Human
gaaaaaggaggaaga

SEQ ID NO: 1522560 - RNA, 18 nt, Human
gaaaacacauuuuucuua

SEQ ID NO: 1522561 - RNA, 17 nt, Human
gaaaaaggaugcacaga

SEQ ID NO: 1522562 - RNA, 19 nt, Human
gaaaacacauuuuucuuag

SEQ ID NO: 1522563 - RNA, 18 nt, Human
gaaaacacuguucucugc

SEQ ID NO: 1522564 - RNA, 17 nt, Human
cuuuuuuggcugcugaa

SEQ ID NO: 1522565 - RNA, 20 nt, Human
cuuuuuuggcugcugaaggc

SEQ ID NO: 1522566 - RNA, 22 nt, Human
cuuuuuuggcugcugaaggcuc

SEQ ID NO: 1522567 - RNA, 21 nt, Human
gaaaauauuauguguuuccau

SEQ ID NO: 1522568 - RNA, 18 nt, Human
gaaaauauuuguaucaca

SEQ ID NO: 1522569 - RNA, 18 nt, Human
gaaaaucuuauaauuuaa

SEQ ID NO: 1522570 - RNA, 22 nt, Human
gaaaaucuacacuccagugaga

SEQ ID NO: 1522571 - RNA, 20 nt, Human
gaaaaucagccugcuccagc

SEQ ID NO: 1522572 - RNA, 22 nt, Human
gaaaaucagccugcuccagcug

SEQ ID NO: 1522573 - RNA, 14 nt, Human
gaaaaguugaauuu

SEQ ID NO: 1522574 - RNA, 15 nt, Human
gaaaaguugaauuuu

SEQ ID NO: 1522575 - RNA, 11 nt, Human
gaaaaggcagg

SEQ ID NO: 1522576 - RNA, 24 nt, Human
gaaaacacuguucucugcccucca

SEQ ID NO: 1522577 - RNA, 20 nt, Human
gaaaacguggcugcuucaag

SEQ ID NO: 1522578 - RNA, 22 nt, Human
gaaaacguggcugcuucaagga

SEQ ID NO: 1522579 - RNA, 21 nt, Human
gaaagcuugcccuggugccuc

SEQ ID NO: 1522580 - RNA, 14 nt, Human
gaaagcagggacuu

SEQ ID NO: 1522581 - RNA, 17 nt, Human
gaaagcccugagcuuuc

SEQ ID NO: 1522582 - RNA, 21 nt, Human
gaaagcccugagcuuucugcu

SEQ ID NO: 1522583 - RNA, 22 nt, Human
gaaagcccugagcuuucugcua

SEQ ID NO: 1522584 - RNA, 15 nt, Human
gaaagaguaggaaga

SEQ ID NO: 1522585 - RNA, 16 nt, Human
gaaagaguaggaagac

SEQ ID NO: 1522586 - RNA, 22 nt, Human
gaaagcagaacagugauuacca

SEQ ID NO: 1522587 - RNA, 17 nt, Human
gaaagcagaacagugau

SEQ ID NO: 1522588 - RNA, 20 nt, Human
gaaagaggcagcuugaaacu

SEQ ID NO: 1522589 - RNA, 21 nt, Human
gaaagaggaaugaaguacuca

SEQ ID NO: 1522590 - RNA, 17 nt, Human
gaaagagaacuuccaga

SEQ ID NO: 1522591 - RNA, 19 nt, Human
gaaagacuuuuccaacccu

SEQ ID NO: 1522592 - RNA, 23 nt, Human
gaaacucguuaauuuguaguguu

SEQ ID NO: 1522593 - RNA, 14 nt, Human
gaaacccugucucu

SEQ ID NO: 1522594 - RNA, 23 nt, Human
gaaacccagcucugguccauaga

SEQ ID NO: 1522595 - RNA, 21 nt, Human
gaaaccauuaugaagaagaga

SEQ ID NO: 1522596 - RNA, 16 nt, Human
gaaacacaacuauauu

SEQ ID NO: 1522597 - RNA, 16 nt, Human
gaaaaugaaucccucu

SEQ ID NO: 1522598 - RNA, 20 nt, Human
gaaaaugauacgcaacauaa

SEQ ID NO: 1522599 - RNA, 18 nt, Human
gaaaaugcaacaacaugu

SEQ ID NO: 1522600 - RNA, 20 nt, Human
gaaaaugcaacaacauguau

SEQ ID NO: 1522601 - RNA, 13 nt, Human
gaaacccagcucu

SEQ ID NO: 1522602 - RNA, 14 nt, Human
gaaacccagcucug

SEQ ID NO: 1522603 - RNA, 15 nt, Human
gaaacccagcucugg

SEQ ID NO: 1522604 - RNA, 16 nt, Human
gaaacccagcucuggu

SEQ ID NO: 1522605 - RNA, 18 nt, Human
gaaacccagcucuggucc

SEQ ID NO: 1522606 - RNA, 19 nt, Human
gaaacccagcucuggucca

SEQ ID NO: 1522607 - RNA, 17 nt, Human
cuuguacuuuauuuucu

SEQ ID NO: 1522608 - RNA, 23 nt, Human
cuugucaauaaaauccauacauu

SEQ ID NO: 1522609 - RNA, 19 nt, Human
cuugaguuuaaauuguaau

SEQ ID NO: 1522610 - RNA, 23 nt, Human
cuuggggggcugaggugggagga

SEQ ID NO: 1522611 - RNA, 12 nt, Human
cuuguacauaau

SEQ ID NO: 1522612 - RNA, 15 nt, Human
cuuguacauaaugcg

SEQ ID NO: 1522613 - RNA, 17 nt, Human
cuuguaaauagcucagg

SEQ ID NO: 1522614 - RNA, 18 nt, Human
cuuguaaauagcucaggu

SEQ ID NO: 1522615 - RNA, 21 nt, Human
cuuguacauaaugcgugcaua

SEQ ID NO: 1522616 - RNA, 19 nt, Human
cuuguacauaaugcgugca

SEQ ID NO: 1522617 - RNA, 22 nt, Human
cuuguacauaaugcgugcauac

SEQ ID NO: 1522618 - RNA, 21 nt, Human
cuuguaaauagcucagguguc

SEQ ID NO: 1522619 - RNA, 15 nt, Human
cuuuaugcacaaaau

SEQ ID NO: 1522620 - RNA, 21 nt, Human
cuuuaucaaagggugaaaauu

SEQ ID NO: 1522621 - RNA, 22 nt, Human
cuuuaucaaagggugaaaauua

SEQ ID NO: 1522622 - RNA, 14 nt, Human
cuuuagcgcccagu

SEQ ID NO: 1522623 - RNA, 15 nt, Human
cuuuagcgcccaguu

SEQ ID NO: 1522624 - RNA, 19 nt, Human
cuuuauaauucuacuuuga

SEQ ID NO: 1522625 - RNA, 22 nt, Human
cuuuaccuuuuuuauacauaaa

SEQ ID NO: 1522626 - RNA, 13 nt, Human
cuuuacuauggcc

SEQ ID NO: 1522627 - RNA, 14 nt, Human
cuuuguccccaccg

SEQ ID NO: 1522628 - RNA, 19 nt, Human
cuuuggcuauuagagauca

SEQ ID NO: 1522629 - RNA, 19 nt, Human
cuuugugaggaagccgcug

SEQ ID NO: 1522630 - RNA, 15 nt, Human
cuuugugaggaagcc

SEQ ID NO: 1522631 - RNA, 15 nt, Human
cuuuguccccaccgc

SEQ ID NO: 1522632 - RNA, 20 nt, Human
cuuugcagacaggcaagcac

SEQ ID NO: 1522633 - RNA, 24 nt, Human
cuuugaccucugcagcaauaaagc

SEQ ID NO: 1522634 - RNA, 20 nt, Human
cuuugaccucugcagcaaua

SEQ ID NO: 1522635 - RNA, 18 nt, Human
cuuugaccucugcagcaa

SEQ ID NO: 1522636 - RNA, 17 nt, Human
cuuugaccucugcagca

SEQ ID NO: 1522637 - RNA, 15 nt, Human
cuuugaccucugcag

SEQ ID NO: 1522638 - RNA, 14 nt, Human
cuuugaccucugca

SEQ ID NO: 1522639 - RNA, 15 nt, Human
cuuuccaucuacccu

SEQ ID NO: 1522640 - RNA, 12 nt, Human
cuuuccugaggc

SEQ ID NO: 1522641 - RNA, 11 nt, Human
cuuucccuccc

SEQ ID NO: 1522642 - RNA, 13 nt, Human
cuuucccucccuu

SEQ ID NO: 1522643 - RNA, 14 nt, Human
cuuucccucccuuc

SEQ ID NO: 1522644 - RNA, 16 nt, Human
cuuucccucccuuccu

SEQ ID NO: 1522645 - RNA, 20 nt, Human
cuuucuggcuaugcauuuga

SEQ ID NO: 1522646 - RNA, 19 nt, Human
cuuucuggcuaugcauuug

SEQ ID NO: 1522647 - RNA, 18 nt, Human
cuuucuggcuaugcauuu

SEQ ID NO: 1522648 - RNA, 17 nt, Human
cuuucuggcuaugcauu

SEQ ID NO: 1522649 - RNA, 13 nt, Human
cuuuccugaggcu

SEQ ID NO: 1522650 - RNA, 15 nt, Human
cuuuccugaggcugg

SEQ ID NO: 1522651 - RNA, 16 nt, Human
cuuucugcuuguguua

SEQ ID NO: 1522652 - RNA, 19 nt, Human
cuuauaucuauauuuuaca

SEQ ID NO: 1522653 - RNA, 19 nt, Human
cuuauaggaauugacccac

SEQ ID NO: 1522654 - RNA, 22 nt, Human
cuuagaugcaguucugaagaag

SEQ ID NO: 1522655 - RNA, 13 nt, Human
cuuagauguauau

SEQ ID NO: 1522656 - RNA, 19 nt, Human
cuuagauguauauauuucc

SEQ ID NO: 1522657 - RNA, 16 nt, Human
cuuagucacugagaca

SEQ ID NO: 1522658 - RNA, 16 nt, Human
cuguucuggcagaguu

SEQ ID NO: 1522659 - RNA, 20 nt, Human
cuuagucacugagacagccc

SEQ ID NO: 1522660 - RNA, 18 nt, Human
cuuagucacugagacagc

SEQ ID NO: 1522661 - RNA, 19 nt, Human
cuuagucacugagacagcc

SEQ ID NO: 1522662 - RNA, 17 nt, Human
cuuauuuaaugaaagac

SEQ ID NO: 1522663 - RNA, 14 nt, Human
cuuauuucauuucu

SEQ ID NO: 1522664 - RNA, 18 nt, Human
cuuauuuaaugaaagacu

SEQ ID NO: 1522665 - RNA, 15 nt, Human
cuuauuucauuucuu

SEQ ID NO: 1522666 - RNA, 15 nt, Human
cuucaaauauuuccc

SEQ ID NO: 1522667 - RNA, 10 nt, Human
cuucaaggau

SEQ ID NO: 1522668 - RNA, 13 nt, Human
cuucaaggauccu

SEQ ID NO: 1522669 - RNA, 15 nt, Human
cuucaaggauccuga

SEQ ID NO: 1522670 - RNA, 16 nt, Human
cuucaaggauccugag

SEQ ID NO: 1522671 - RNA, 23 nt, Human
cuucacagaugggugcuuggagg

SEQ ID NO: 1522672 - RNA, 13 nt, Human
cuucccuuucugc

SEQ ID NO: 1522673 - RNA, 17 nt, Human
cuucccuacaguugaaa

SEQ ID NO: 1522674 - RNA, 15 nt, Human
cuuccaggcugggag

SEQ ID NO: 1522675 - RNA, 16 nt, Human
cuuccaggcugggaga

SEQ ID NO: 1522676 - RNA, 19 nt, Human
cuuccaggcugggagagcc

SEQ ID NO: 1522677 - RNA, 14 nt, Human
cuuccagggguggg

SEQ ID NO: 1522678 - RNA, 15 nt, Human
cuuccagggguggga

SEQ ID NO: 1522679 - RNA, 17 nt, Human
cuuccaggggugggaca

SEQ ID NO: 1522680 - RNA, 21 nt, Human
cuuccaggggugggacacccu

SEQ ID NO: 1522681 - RNA, 22 nt, Human
cuuccacaagagcccaggccuc

SEQ ID NO: 1522682 - RNA, 12 nt, Human
cuuccaggcugg

SEQ ID NO: 1522683 - RNA, 14 nt, Human
cuuccaggcuggga

SEQ ID NO: 1522684 - RNA, 17 nt, Human
cuucaguggcagcugcu

SEQ ID NO: 1522685 - RNA, 17 nt, Human
cuuccacaagagcccag

SEQ ID NO: 1522686 - RNA, 19 nt, Human
cuuccacaagagcccaggc

SEQ ID NO: 1522687 - RNA, 21 nt, Human
cuuccacaagagcccaggccu

SEQ ID NO: 1522688 - RNA, 16 nt, Human
cuucaguaagccguga

SEQ ID NO: 1522689 - RNA, 23 nt, Human
cuucaguaagccgugauuuucau

SEQ ID NO: 1522690 - RNA, 18 nt, Human
cuucagugccuuauggaa

SEQ ID NO: 1522691 - RNA, 22 nt, Human
cuucagugccuuauggaacacu

SEQ ID NO: 1522692 - RNA, 13 nt, Human
cuucaguggcagc

SEQ ID NO: 1522693 - RNA, 14 nt, Human
cuucaguggcagcu

SEQ ID NO: 1522694 - RNA, 15 nt, Human
cuucaguggcagcug

SEQ ID NO: 1522695 - RNA, 16 nt, Human
cuucaguggcagcugc

SEQ ID NO: 1522696 - RNA, 22 nt, Human
cuucuuuauaauucuacuuuga

SEQ ID NO: 1522697 - RNA, 14 nt, Human
cuugaaaacacugu

SEQ ID NO: 1522698 - RNA, 23 nt, Human
cuugaaaacacuguucucugccc

SEQ ID NO: 1522699 - RNA, 14 nt, Human
cuucugugaaagua

SEQ ID NO: 1522700 - RNA, 13 nt, Human
cuucuguggguuu

SEQ ID NO: 1522701 - RNA, 14 nt, Human
cuucuguggguuuc

SEQ ID NO: 1522702 - RNA, 21 nt, Human
cuucuguggguuucuaaagcu

SEQ ID NO: 1522703 - RNA, 18 nt, Human
cuugagccuugaacuuug

SEQ ID NO: 1522704 - RNA, 17 nt, Human
cuugagccuugaacuuu

SEQ ID NO: 1522705 - RNA, 15 nt, Human
cuugagccuugaacu

SEQ ID NO: 1522706 - RNA, 21 nt, Human
cuugaggguugggcugguguc

SEQ ID NO: 1522707 - RNA, 19 nt, Human
cuugaggguugggcuggug

SEQ ID NO: 1522708 - RNA, 20 nt, Human
cuugaggguugggcuggugu

SEQ ID NO: 1522709 - RNA, 16 nt, Human
cuugaagacuuuucuu

SEQ ID NO: 1522710 - RNA, 17 nt, Human
cuugaccgugaggccag

SEQ ID NO: 1522711 - RNA, 22 nt, Human
cuugaccauucuccaccugcca

SEQ ID NO: 1522712 - RNA, 23 nt, Human
cuugaccauucuccaccugccag

SEQ ID NO: 1522713 - RNA, 18 nt, Human
cuugaccgugaggccaga

SEQ ID NO: 1522714 - RNA, 20 nt, Human
cuugaccgugaggccagaga

SEQ ID NO: 1522715 - RNA, 21 nt, Human
cuugaccgugaggccagagac

SEQ ID NO: 1522716 - RNA, 13 nt, Human
cuugaccucaggu

SEQ ID NO: 1522717 - RNA, 14 nt, Human
cuugaacccgggag

SEQ ID NO: 1522718 - RNA, 13 nt, Human
cuugaacuccugg

SEQ ID NO: 1522719 - RNA, 21 nt, Human
cuugaacuuugaccucugcag

SEQ ID NO: 1522720 - RNA, 17 nt, Human
cuugaacuuugaccucu

SEQ ID NO: 1522721 - RNA, 15 nt, Human
cuucuggguggggca

SEQ ID NO: 1522722 - RNA, 13 nt, Human
cuucugcuucagc

SEQ ID NO: 1522723 - RNA, 21 nt, Human
cuucuguacgucugacaggca

SEQ ID NO: 1522724 - RNA, 14 nt, Human
cuucuguacgucug

SEQ ID NO: 1522725 - RNA, 15 nt, Human
cuucuguacgucuga

SEQ ID NO: 1522726 - RNA, 18 nt, Human
cuucuguacgucugacag

SEQ ID NO: 1522727 - RNA, 20 nt, Human
cuucuguacgucugacaggc

SEQ ID NO: 1522728 - RNA, 16 nt, Human
cuucuguccuacucug

SEQ ID NO: 1522729 - RNA, 17 nt, Human
cuucuguccuacucugu

SEQ ID NO: 1522730 - RNA, 18 nt, Human
cuucuguccuacucugug

SEQ ID NO: 1522731 - RNA, 19 nt, Human
cuucuguccuacucugugu

SEQ ID NO: 1522732 - RNA, 21 nt, Human
cuucuguccuacucuguguca

SEQ ID NO: 1522733 - RNA, 18 nt, Human
cuucugucuucacaacag

SEQ ID NO: 1522734 - RNA, 21 nt, Human
cuucugucuucacaacagauu

SEQ ID NO: 1522735 - RNA, 22 nt, Human
cuucugucuucacaacagauua

SEQ ID NO: 1522736 - RNA, 13 nt, Human
cuucucugaagga

SEQ ID NO: 1522737 - RNA, 19 nt, Human
cuucuccuucaccuuuguc

SEQ ID NO: 1522738 - RNA, 13 nt, Human
cuucucuccagcc

SEQ ID NO: 1522739 - RNA, 15 nt, Human
cuucucuccagcccc

SEQ ID NO: 1522740 - RNA, 17 nt, Human
cuucucuccagccccug

SEQ ID NO: 1522741 - RNA, 19 nt, Human
cuucucuccagccccugga

SEQ ID NO: 1522742 - RNA, 12 nt, Human
cuucuccaggcu

SEQ ID NO: 1522743 - RNA, 13 nt, Human
cuucuccaggcug

SEQ ID NO: 1522744 - RNA, 14 nt, Human
cuucuccaggcugu

SEQ ID NO: 1522745 - RNA, 16 nt, Human
cuuccuggagcccaga

SEQ ID NO: 1522746 - RNA, 17 nt, Human
cuuccuggagcccagag

SEQ ID NO: 1522747 - RNA, 22 nt, Human
cuuccuggagcccagaggaggg

SEQ ID NO: 1522748 - RNA, 11 nt, Human
cuucuccacuu

SEQ ID NO: 1522749 - RNA, 20 nt, Human
cuucuccacuuucuagccag

SEQ ID NO: 1522750 - RNA, 21 nt, Human
cugugucuugcaauggcagcc

SEQ ID NO: 1522751 - RNA, 22 nt, Human
cugugucuugcaauggcagccu

SEQ ID NO: 1522752 - RNA, 23 nt, Human
cugugucuugcaauggcagccuu

SEQ ID NO: 1522753 - RNA, 21 nt, Human
cuguuaaaagaugaaaauauu

SEQ ID NO: 1522754 - RNA, 23 nt, Human
cuguuaaaagaugaaaauauuug

SEQ ID NO: 1522755 - RNA, 20 nt, Human
cugugugugcgccuacagga

SEQ ID NO: 1522756 - RNA, 17 nt, Human
cuguucaugaaagauuc

SEQ ID NO: 1522757 - RNA, 18 nt, Human
cuguucaugaaagauuca

SEQ ID NO: 1522758 - RNA, 23 nt, Human
cuguucaugaaagauucaaugcc

SEQ ID NO: 1522759 - RNA, 13 nt, Human
cuguuacugucuu

SEQ ID NO: 1522760 - RNA, 19 nt, Human
cuguucagcugguugaggu

SEQ ID NO: 1522761 - RNA, 21 nt, Human
cuguucagcugguugagguuu

SEQ ID NO: 1522762 - RNA, 20 nt, Human
cuguucucugcccuccaaga

SEQ ID NO: 1522763 - RNA, 18 nt, Human
cuguucucugcccuccaa

SEQ ID NO: 1522764 - RNA, 19 nt, Human
cuguucucugcccuccaag

SEQ ID NO: 1522765 - RNA, 14 nt, Human
cuguucucugcccu

SEQ ID NO: 1522766 - RNA, 15 nt, Human
cuguucucugcccuc

SEQ ID NO: 1522767 - RNA, 16 nt, Human
cuguucucugcccucc

SEQ ID NO: 1522768 - RNA, 17 nt, Human
cuguucucugcccucca

SEQ ID NO: 1522769 - RNA, 13 nt, Human
cuguucucugccc

SEQ ID NO: 1522770 - RNA, 18 nt, Human
cugucuccauguuugaug

SEQ ID NO: 1522771 - RNA, 13 nt, Human
cugucucagggug

SEQ ID NO: 1522772 - RNA, 23 nt, Human
cugugaguacuacaguccuccca

SEQ ID NO: 1522773 - RNA, 20 nt, Human
cugugaguacuacaguccuc

SEQ ID NO: 1522774 - RNA, 21 nt, Human
cugugaguacuacaguccucc

SEQ ID NO: 1522775 - RNA, 18 nt, Human
cugugauggggcccugcc

SEQ ID NO: 1522776 - RNA, 17 nt, Human
cugugauggggcccugc

SEQ ID NO: 1522777 - RNA, 19 nt, Human
cugugauggggcccugccu

SEQ ID NO: 1522778 - RNA, 20 nt, Human
cugugauggggcccugccuc

SEQ ID NO: 1522779 - RNA, 22 nt, Human
cugugccauuuuguauuuuacu

SEQ ID NO: 1522780 - RNA, 14 nt, Human
cugugccauuuugu

SEQ ID NO: 1522781 - RNA, 16 nt, Human
cugugccaugugccag

SEQ ID NO: 1522782 - RNA, 18 nt, Human
cugugccaugugccaggu

SEQ ID NO: 1522783 - RNA, 13 nt, Human
cugugccacaggc

SEQ ID NO: 1522784 - RNA, 17 nt, Human
cuguggaugauaaaaca

SEQ ID NO: 1522785 - RNA, 14 nt, Human
cugugggcccccaa

SEQ ID NO: 1522786 - RNA, 14 nt, Human
cugugccucuggga

SEQ ID NO: 1522787 - RNA, 16 nt, Human
cugugccucugggacu

SEQ ID NO: 1522788 - RNA, 22 nt, Human
cugugcugcccugcccaccugg

SEQ ID NO: 1522789 - RNA, 17 nt, Human
cugugccucugggacug

SEQ ID NO: 1522790 - RNA, 18 nt, Human
cugugccucugggacugg

SEQ ID NO: 1522791 - RNA, 22 nt, Human
cuguauuuuaaaagaaugauua

SEQ ID NO: 1522792 - RNA, 20 nt, Human
cuguauuuuaaaagaaugau

SEQ ID NO: 1522793 - RNA, 14 nt, Human
cuguaucccaugag

SEQ ID NO: 1522794 - RNA, 23 nt, Human
cuguaucccaugagccucagcau

SEQ ID NO: 1522795 - RNA, 13 nt, Human
cugucaauuacag

SEQ ID NO: 1522796 - RNA, 13 nt, Human
cuguacagagccc

SEQ ID NO: 1522797 - RNA, 22 nt, Human
cuguauauauuuauggccgggc

SEQ ID NO: 1522798 - RNA, 14 nt, Human
cuguccuacccacc

SEQ ID NO: 1522799 - RNA, 22 nt, Human
cugucccuuacgugaguccugg

SEQ ID NO: 1522800 - RNA, 15 nt, Human
cuguccgagcuuuga

SEQ ID NO: 1522801 - RNA, 18 nt, Human
cugucucaaaaaaagaaa

SEQ ID NO: 1522802 - RNA, 23 nt, Human
cugucucaaaaaaacacaaaagu

SEQ ID NO: 1522803 - RNA, 16 nt, Human
cugucucaaaaaaaga

SEQ ID NO: 1522804 - RNA, 18 nt, Human
cuguccccgcacugggcu

SEQ ID NO: 1522805 - RNA, 19 nt, Human
cuguccccgcacugggcuu

SEQ ID NO: 1522806 - RNA, 22 nt, Human
cuguccccgcacugggcuuggg

SEQ ID NO: 1522807 - RNA, 20 nt, Human
cugucccuuacgugaguccu

SEQ ID NO: 1522808 - RNA, 14 nt, Human
cuguccccuucucu

SEQ ID NO: 1522809 - RNA, 16 nt, Human
cuguccccuucucuca

SEQ ID NO: 1522810 - RNA, 19 nt, Human
cuguccccuucucucaucu

SEQ ID NO: 1522811 - RNA, 20 nt, Human
cuguccccuucucucaucuc

SEQ ID NO: 1522812 - RNA, 21 nt, Human
cuguccccuucucucaucucu

SEQ ID NO: 1522813 - RNA, 22 nt, Human
cuguccccuucucucaucucuu

SEQ ID NO: 1522814 - RNA, 23 nt, Human
cuguccccuucucucaucucuua

SEQ ID NO: 1522815 - RNA, 22 nt, Human
cuggguaacuagggaagauaau

SEQ ID NO: 1522816 - RNA, 19 nt, Human
cuggguucuacccaggugc

SEQ ID NO: 1522817 - RNA, 14 nt, Human
cuggguacuugugg

SEQ ID NO: 1522818 - RNA, 15 nt, Human
cuggguucuacccag

SEQ ID NO: 1522819 - RNA, 16 nt, Human
cuggguucuacccagg

SEQ ID NO: 1522820 - RNA, 17 nt, Human
cuggguucuacccaggu

SEQ ID NO: 1522821 - RNA, 16 nt, Human
cuggggggcaguggug

SEQ ID NO: 1522822 - RNA, 13 nt, Human
cuggggggcagug

SEQ ID NO: 1522823 - RNA, 22 nt, Human
cugggggggauuguaaaauggu

SEQ ID NO: 1522824 - RNA, 19 nt, Human
cugggggcugggcagagga

SEQ ID NO: 1522825 - RNA, 15 nt, Human
cugggggaagaagcu

SEQ ID NO: 1522826 - RNA, 24 nt, Human
cugggcuucaguggcagcugcuuu

SEQ ID NO: 1522827 - RNA, 13 nt, Human
cugggggaagaag

SEQ ID NO: 1522828 - RNA, 20 nt, Human
cuguaauccuagcacuuugg

SEQ ID NO: 1522829 - RNA, 13 nt, Human
cuguacaaaguag

SEQ ID NO: 1522830 - RNA, 15 nt, Human
cuguacaaaguagaa

SEQ ID NO: 1522831 - RNA, 21 nt, Human
cugguucggauuuggggugga

SEQ ID NO: 1522832 - RNA, 23 nt, Human
cugguucggauuugggguggauu

SEQ ID NO: 1522833 - RNA, 23 nt, Human
cuguaaucacagcuacuugggag

SEQ ID NO: 1522834 - RNA, 23 nt, Human
cugguggcagcucaccucucccu

SEQ ID NO: 1522835 - RNA, 13 nt, Human
cugguggcagcug

SEQ ID NO: 1522836 - RNA, 14 nt, Human
cugguggcagcugc

SEQ ID NO: 1522837 - RNA, 14 nt, Human
cugguauuuuaucu

SEQ ID NO: 1522838 - RNA, 20 nt, Human
cuggcacccggccccugcug

SEQ ID NO: 1522839 - RNA, 21 nt, Human
cuggcacccggccccugcugg

SEQ ID NO: 1522840 - RNA, 20 nt, Human
cuggagugcagugagccgag

SEQ ID NO: 1522841 - RNA, 21 nt, Human
cuggcacaguuuucugagaaa

SEQ ID NO: 1522842 - RNA, 22 nt, Human
cuggcacaguuuucugagaaag

SEQ ID NO: 1522843 - RNA, 22 nt, Human
cuggcacccggccccugcuggu

SEQ ID NO: 1522844 - RNA, 19 nt, Human
cuggcacugcuuccaguga

SEQ ID NO: 1522845 - RNA, 20 nt, Human
cuggcacugcuuccagugag

SEQ ID NO: 1522846 - RNA, 23 nt, Human
cuggcacugcuuccagugaggcu

SEQ ID NO: 1522847 - RNA, 14 nt, Human
cuggccagaugcac

SEQ ID NO: 1522848 - RNA, 15 nt, Human
cuggcccacugcauc

SEQ ID NO: 1522849 - RNA, 21 nt, Human
cuggccucugcacuccccugc

SEQ ID NO: 1522850 - RNA, 18 nt, Human
cuggccucugcacucccc

SEQ ID NO: 1522851 - RNA, 20 nt, Human
cuggccucugcacuccccug

SEQ ID NO: 1522852 - RNA, 13 nt, Human
cuggccuggcccc

SEQ ID NO: 1522853 - RNA, 24 nt, Human
cuggccuggccccucagggucccu

SEQ ID NO: 1522854 - RNA, 22 nt, Human
cuggccuucggccuccauccug

SEQ ID NO: 1522855 - RNA, 14 nt, Human
cuggccugugucua

SEQ ID NO: 1522856 - RNA, 23 nt, Human
cuggccuucggccuccauccuga

SEQ ID NO: 1522857 - RNA, 14 nt, Human
cuggcgugcagugg

SEQ ID NO: 1522858 - RNA, 15 nt, Human
cuggcgugcaguggu

SEQ ID NO: 1522859 - RNA, 21 nt, Human
cuggcucuuccaggcugggag

SEQ ID NO: 1522860 - RNA, 22 nt, Human
cuggcucuuccaggcugggaga

SEQ ID NO: 1522861 - RNA, 24 nt, Human
cuggcucuuccaggcugggagagc

SEQ ID NO: 1522862 - RNA, 21 nt, Human
cuggagcccagaggagggcag

SEQ ID NO: 1522863 - RNA, 23 nt, Human
cuggagcccagaggagggcagca

SEQ ID NO: 1522864 - RNA, 16 nt, Human
cuggagcucugcccau

SEQ ID NO: 1522865 - RNA, 13 nt, Human
cuggagcucugcc

SEQ ID NO: 1522866 - RNA, 17 nt, Human
cuggagguacgaaaaga

SEQ ID NO: 1522867 - RNA, 22 nt, Human
cuggagguacgaaaagagggga

SEQ ID NO: 1522868 - RNA, 14 nt, Human
cuggagugcaguga

SEQ ID NO: 1522869 - RNA, 15 nt, Human
cuggagugcagugag

SEQ ID NO: 1522870 - RNA, 16 nt, Human
cuggagugcagugagc

SEQ ID NO: 1522871 - RNA, 17 nt, Human
cuggagugcagugagcc

SEQ ID NO: 1522872 - RNA, 23 nt, Human
cuggacaggcauguucucugagg

SEQ ID NO: 1522873 - RNA, 17 nt, Human
cuggacaggcauguucu

SEQ ID NO: 1522874 - RNA, 16 nt, Human
cuggaccuugaacugg

SEQ ID NO: 1522875 - RNA, 15 nt, Human
cuggacccuguggau

SEQ ID NO: 1522876 - RNA, 17 nt, Human
cuggaccuugaacuggg

SEQ ID NO: 1522877 - RNA, 20 nt, Human
cuggaccuugaacuggguac

SEQ ID NO: 1522878 - RNA, 21 nt, Human
cuggaccuugaacuggguacu

SEQ ID NO: 1522879 - RNA, 15 nt, Human
cugcugcuggcuggu

SEQ ID NO: 1522880 - RNA, 13 nt, Human
cugcugguucagg

SEQ ID NO: 1522881 - RNA, 15 nt, Human
cugcugguucagggu

SEQ ID NO: 1522882 - RNA, 23 nt, Human
cugcugguucaggguuggccccu

SEQ ID NO: 1522883 - RNA, 15 nt, Human
cugcuuccagugagg

SEQ ID NO: 1522884 - RNA, 16 nt, Human
cugcuuccagugaggc

SEQ ID NO: 1522885 - RNA, 18 nt, Human
cugcuuccagugaggcuc

SEQ ID NO: 1522886 - RNA, 19 nt, Human
cugcuuccagugaggcucu

SEQ ID NO: 1522887 - RNA, 20 nt, Human
cugcuuccagugaggcucug

SEQ ID NO: 1522888 - RNA, 21 nt, Human
cugcuuccagugaggcucugc

SEQ ID NO: 1522889 - RNA, 23 nt, Human
cugcuuccagugaggcucugccc

SEQ ID NO: 1522890 - RNA, 15 nt, Human
cugcucuccuuccug

SEQ ID NO: 1522891 - RNA, 12 nt, Human
cugcucuccuuc

SEQ ID NO: 1522892 - RNA, 13 nt, Human
cugcucuccuucc

SEQ ID NO: 1522893 - RNA, 16 nt, Human
cugcucuccuuccugg

SEQ ID NO: 1522894 - RNA, 11 nt, Human
cugcugaaggc

SEQ ID NO: 1522895 - RNA, 12 nt, Human
cugcugaaggcu

SEQ ID NO: 1522896 - RNA, 19 nt, Human
cugcgaccacaagaaggau

SEQ ID NO: 1522897 - RNA, 19 nt, Human
cugcuccagcuguucagcu

SEQ ID NO: 1522898 - RNA, 20 nt, Human
cugcuccagcuguucagcug

SEQ ID NO: 1522899 - RNA, 23 nt, Human
cucccuucccaccucucucacuc

SEQ ID NO: 1522900 - RNA, 12 nt, Human
cugcccuccaag

SEQ ID NO: 1522901 - RNA, 14 nt, Human
cucccuucccaccu

SEQ ID NO: 1522902 - RNA, 15 nt, Human
cucccuucccaccuc

SEQ ID NO: 1522903 - RNA, 16 nt, Human
cucccuucccaccucu

SEQ ID NO: 1522904 - RNA, 17 nt, Human
cucccuucccaccucuc

SEQ ID NO: 1522905 - RNA, 19 nt, Human
cugcccuccaagaccuucu

SEQ ID NO: 1522906 - RNA, 15 nt, Human
cugccgcagcccugc

SEQ ID NO: 1522907 - RNA, 19 nt, Human
cugccgcagcccugcagag

SEQ ID NO: 1522908 - RNA, 17 nt, Human
cugccgcagcccugcag

SEQ ID NO: 1522909 - RNA, 18 nt, Human
cugccgcagcccugcaga

SEQ ID NO: 1522910 - RNA, 15 nt, Human
cugccucugacacac

SEQ ID NO: 1522911 - RNA, 22 nt, Human
cugccucugacacacagcucug

SEQ ID NO: 1522912 - RNA, 23 nt, Human
cugccucugacacacagcucugu

SEQ ID NO: 1522913 - RNA, 11 nt, Human
cugccucccau

SEQ ID NO: 1522914 - RNA, 12 nt, Human
cugccucccauc

SEQ ID NO: 1522915 - RNA, 14 nt, Human
cugccucccaucac

SEQ ID NO: 1522916 - RNA, 16 nt, Human
cugccucccaucaccc

SEQ ID NO: 1522917 - RNA, 19 nt, Human
cugccucccaucacccgcu

SEQ ID NO: 1522918 - RNA, 15 nt, Human
cugccucuucucuac

SEQ ID NO: 1522919 - RNA, 15 nt, Human
cugccugaagucaca

SEQ ID NO: 1522920 - RNA, 16 nt, Human
cugccugcccaggccc

SEQ ID NO: 1522921 - RNA, 17 nt, Human
cugccugcccaggcccc

SEQ ID NO: 1522922 - RNA, 21 nt, Human
cugccugggaucccucauccu

SEQ ID NO: 1522923 - RNA, 22 nt, Human
cugccugggaucccucauccuc

SEQ ID NO: 1522924 - RNA, 20 nt, Human
cugccugcccaggccccugc

SEQ ID NO: 1522925 - RNA, 18 nt, Human
cuagaguuuagcuggaaa

SEQ ID NO: 1522926 - RNA, 19 nt, Human
cuagaguuuagcuggaaaa

SEQ ID NO: 1522927 - RNA, 21 nt, Human
cuagagguucaaagauauuuu

SEQ ID NO: 1522928 - RNA, 18 nt, Human
cuagagguucaaagauau

SEQ ID NO: 1522929 - RNA, 17 nt, Human
cuagagguucaaagaua

SEQ ID NO: 1522930 - RNA, 20 nt, Human
cuacuguccuacccacccuc

SEQ ID NO: 1522931 - RNA, 12 nt, Human
cuacucuguguc

SEQ ID NO: 1522932 - RNA, 13 nt, Human
cuacucuguguca

SEQ ID NO: 1522933 - RNA, 19 nt, Human
cuacuguccuacccacccu

SEQ ID NO: 1522934 - RNA, 15 nt, Human
cuacucgaguuacag

SEQ ID NO: 1522935 - RNA, 16 nt, Human
cuacucgaguuacaga

SEQ ID NO: 1522936 - RNA, 19 nt, Human
cuacucgaguuacagacaa

SEQ ID NO: 1522937 - RNA, 14 nt, Human
cuaggaaauauuua

SEQ ID NO: 1522938 - RNA, 15 nt, Human
cuaggaaauauuuau

SEQ ID NO: 1522939 - RNA, 19 nt, Human
cuaggaaauauuuauuuua

SEQ ID NO: 1522940 - RNA, 20 nt, Human
cuaggaaauauuuauuuuaa

SEQ ID NO: 1522941 - RNA, 22 nt, Human
cuagcuaauguaauaacuguga

SEQ ID NO: 1522942 - RNA, 22 nt, Human
cuagccuuagaagucacacagu

SEQ ID NO: 1522943 - RNA, 23 nt, Human
cuagccuuagaagucacacagua

SEQ ID NO: 1522944 - RNA, 16 nt, Human
cuagauacuguaucau

SEQ ID NO: 1522945 - RNA, 13 nt, Human
cuagauacuguau

SEQ ID NO: 1522946 - RNA, 24 nt, Human
cuagauacuguaucaugacaaaga

SEQ ID NO: 1522947 - RNA, 21 nt, Human
cuagccugugccucugggacu

SEQ ID NO: 1522948 - RNA, 19 nt, Human
cuagccugugccucuggga

SEQ ID NO: 1522949 - RNA, 22 nt, Human
cuagccugugccucugggacug

SEQ ID NO: 1522950 - RNA, 21 nt, Human
cuagccuuagaagucacacag

SEQ ID NO: 1522951 - RNA, 15 nt, Human
cuauaggugcuacaa

SEQ ID NO: 1522952 - RNA, 19 nt, Human
cuaugaaauauuauguuaa

SEQ ID NO: 1522953 - RNA, 19 nt, Human
cuauagccuaggugacaga

SEQ ID NO: 1522954 - RNA, 18 nt, Human
cuauagccuaggugacag

SEQ ID NO: 1522955 - RNA, 20 nt, Human
cuauagccuaggugacagag

SEQ ID NO: 1522956 - RNA, 21 nt, Human
cuauagccuaggugacagagu

SEQ ID NO: 1522957 - RNA, 13 nt, Human
cuauaauuuaaau

SEQ ID NO: 1522958 - RNA, 12 nt, Human
cuauaauuuaaa

SEQ ID NO: 1522959 - RNA, 20 nt, Human
cuaggaacacuccuucacag

SEQ ID NO: 1522960 - RNA, 15 nt, Human
cuaggaagacuuugg

SEQ ID NO: 1522961 - RNA, 17 nt, Human
cuaggaagacuuuggaa

SEQ ID NO: 1522962 - RNA, 23 nt, Human
cuauucaguaauaacucuacccu

SEQ ID NO: 1522963 - RNA, 16 nt, Human
cuauucaaacagucuc

SEQ ID NO: 1522964 - RNA, 17 nt, Human
cuauucaguaauaacuc

SEQ ID NO: 1522965 - RNA, 21 nt, Human
cuauucaggagaguagaacag

SEQ ID NO: 1522966 - RNA, 13 nt, Human
cuauguaucaaug

SEQ ID NO: 1522967 - RNA, 16 nt, Human
cuauguaucaaugagu

SEQ ID NO: 1522968 - RNA, 14 nt, Human
cucaacucuccucc

SEQ ID NO: 1522969 - RNA, 17 nt, Human
cucaaauuucuaaaucu

SEQ ID NO: 1522970 - RNA, 15 nt, Human
cucaaauuucuaaau

SEQ ID NO: 1522971 - RNA, 12 nt, Human
cucaaauuugga

SEQ ID NO: 1522972 - RNA, 14 nt, Human
cucaaauuucuaaa

SEQ ID NO: 1522973 - RNA, 14 nt, Human
cucacacugagaau

SEQ ID NO: 1522974 - RNA, 20 nt, Human
cucacacugagaauguaaga

SEQ ID NO: 1522975 - RNA, 12 nt, Human
cucacacugaga

SEQ ID NO: 1522976 - RNA, 13 nt, Human
cucacacugagaa

SEQ ID NO: 1522977 - RNA, 14 nt, Human
cucaaguccucuuu

SEQ ID NO: 1522978 - RNA, 23 nt, Human
cucacacggacacucaaaagcug

SEQ ID NO: 1522979 - RNA, 19 nt, Human
cucaacucuccuccagagu

SEQ ID NO: 1522980 - RNA, 16 nt, Human
cucaacucuccuccag

SEQ ID NO: 1522981 - RNA, 18 nt, Human
cucaacucuccuccagag

SEQ ID NO: 1522982 - RNA, 16 nt, Human
cuauugcugcuugagg

SEQ ID NO: 1522983 - RNA, 15 nt, Human
cucccgaguagcugg

SEQ ID NO: 1522984 - RNA, 20 nt, Human
cucccgaauagcugggacua

SEQ ID NO: 1522985 - RNA, 23 nt, Human
cucccgaauagcugggacuacag

SEQ ID NO: 1522986 - RNA, 15 nt, Human
cucccuucauccuuc

SEQ ID NO: 1522987 - RNA, 18 nt, Human
cucccucagucuggcccu

SEQ ID NO: 1522988 - RNA, 20 nt, Human
cuccccagccccaucccaaa

SEQ ID NO: 1522989 - RNA, 14 nt, Human
cuccccucggagaa

SEQ ID NO: 1522990 - RNA, 21 nt, Human
cuccccugcuggguguggcgc

SEQ ID NO: 1522991 - RNA, 23 nt, Human
cuccccugcuggguguggcgcag

SEQ ID NO: 1522992 - RNA, 16 nt, Human
cucccaaagugcuggg

SEQ ID NO: 1522993 - RNA, 23 nt, Human
cucccaaagugcugggauuacag

SEQ ID NO: 1522994 - RNA, 16 nt, Human
cucccaacucacccca

SEQ ID NO: 1522995 - RNA, 15 nt, Human
cucccacaaaggaga

SEQ ID NO: 1522996 - RNA, 14 nt, Human
cucccaacucaccc

SEQ ID NO: 1522997 - RNA, 15 nt, Human
cucccaacucacccc

SEQ ID NO: 1522998 - RNA, 16 nt, Human
cucccaucacuucccu

SEQ ID NO: 1522999 - RNA, 13 nt, Human
cuccacucucccc

SEQ ID NO: 1523000 - RNA, 15 nt, Human
cuccacucuccccca

SEQ ID NO: 1523001 - RNA, 11 nt, Human
cuccagccccu

SEQ ID NO: 1523002 - RNA, 13 nt, Human
cuccagccccugg

SEQ ID NO: 1523003 - RNA, 14 nt, Human
cuccagccccugga

SEQ ID NO: 1523004 - RNA, 15 nt, Human
cuccagccccuggau

SEQ ID NO: 1523005 - RNA, 15 nt, Human
cuccagcucaccagc

SEQ ID NO: 1523006 - RNA, 16 nt, Human
cuccagcucaccagcc

SEQ ID NO: 1523007 - RNA, 18 nt, Human
cuccagcucaccagcccc

SEQ ID NO: 1523008 - RNA, 16 nt, Human
cuccacucucccccac

SEQ ID NO: 1523009 - RNA, 16 nt, Human
cuccagagucagaagu

SEQ ID NO: 1523010 - RNA, 21 nt, Human
cucauaaaaagccugcaauuu

SEQ ID NO: 1523011 - RNA, 22 nt, Human
cucauucuccuuguguuacuaa

SEQ ID NO: 1523012 - RNA, 18 nt, Human
cucauucuccuuguguua

SEQ ID NO: 1523013 - RNA, 12 nt, Human
cucauucuucug

SEQ ID NO: 1523014 - RNA, 17 nt, Human
cucauugaccugaggcc

SEQ ID NO: 1523015 - RNA, 14 nt, Human
cucauuucaccccu

SEQ ID NO: 1523016 - RNA, 17 nt, Human
cucauuucaccccuccc

SEQ ID NO: 1523017 - RNA, 19 nt, Human
cucauuucaccccucccuu

SEQ ID NO: 1523018 - RNA, 22 nt, Human
cucauuucaccccucccuuucu

SEQ ID NO: 1523019 - RNA, 19 nt, Human
cucauugaccugaggcccu

SEQ ID NO: 1523020 - RNA, 21 nt, Human
cucauugaccugaggcccuuc

SEQ ID NO: 1523021 - RNA, 23 nt, Human
cucauuucaccccucccuuucuc

SEQ ID NO: 1523022 - RNA, 12 nt, Human
cucauuuccaag

SEQ ID NO: 1523023 - RNA, 13 nt, Human
cucauuuccaagc

SEQ ID NO: 1523024 - RNA, 14 nt, Human
cucauuuccaagca

SEQ ID NO: 1523025 - RNA, 17 nt, Human
cucauuuccaagcaagu

SEQ ID NO: 1523026 - RNA, 21 nt, Human
cucauuuccaagcaaguauua

SEQ ID NO: 1523027 - RNA, 21 nt, Human
cucauuugucacacacuuugg

SEQ ID NO: 1523028 - RNA, 22 nt, Human
cucaggaaaucaaauaugcaaa

SEQ ID NO: 1523029 - RNA, 23 nt, Human
cucaggagccgaagcccaggggc

SEQ ID NO: 1523030 - RNA, 21 nt, Human
cucaggagccgaagcccaggg

SEQ ID NO: 1523031 - RNA, 15 nt, Human
cucaggcagguggga

SEQ ID NO: 1523032 - RNA, 18 nt, Human
cucaggcaggugggaugg

SEQ ID NO: 1523033 - RNA, 13 nt, Human
cucagggccuggc

SEQ ID NO: 1523034 - RNA, 18 nt, Human
cucagggccuggcucagg

SEQ ID NO: 1523035 - RNA, 19 nt, Human
cucagggccuggcucaggu

SEQ ID NO: 1523036 - RNA, 20 nt, Human
cucagggccuggcucaggug

SEQ ID NO: 1523037 - RNA, 23 nt, Human
cucaggugauccacccaccucag

SEQ ID NO: 1523038 - RNA, 19 nt, Human
cucagguggggucacucug

SEQ ID NO: 1523039 - RNA, 20 nt, Human
cucagguggggucacucugg

SEQ ID NO: 1523040 - RNA, 21 nt, Human
cucagguggggucacucuggc

SEQ ID NO: 1523041 - RNA, 24 nt, Human
cucagggucccugguggcagcuca

SEQ ID NO: 1523042 - RNA, 14 nt, Human
cucagggccugguc

SEQ ID NO: 1523043 - RNA, 20 nt, Human
cucagggucccugguggcag

SEQ ID NO: 1523044 - RNA, 21 nt, Human
cucagggucccugguggcagc

SEQ ID NO: 1523045 - RNA, 22 nt, Human
cucagggucccugguggcagcu

SEQ ID NO: 1523046 - RNA, 23 nt, Human
cucagcggggacagcuccuucug

SEQ ID NO: 1523047 - RNA, 14 nt, Human
cucagcggggacag

SEQ ID NO: 1523048 - RNA, 15 nt, Human
cucagcggggacagc

SEQ ID NO: 1523049 - RNA, 16 nt, Human
cucagcggggacagcu

SEQ ID NO: 1523050 - RNA, 18 nt, Human
cucagcggggacagcucc

SEQ ID NO: 1523051 - RNA, 19 nt, Human
cucagcggggacagcuccu

SEQ ID NO: 1523052 - RNA, 20 nt, Human
cucagcggggacagcuccuu

SEQ ID NO: 1523053 - RNA, 21 nt, Human
cucagcggggacagcuccuuc

SEQ ID NO: 1523054 - RNA, 15 nt, Human
cucagcauccuggca

SEQ ID NO: 1523055 - RNA, 21 nt, Human
cucagcaaaagaugcuucuca

SEQ ID NO: 1523056 - RNA, 16 nt, Human
cucagcaggggagggu

SEQ ID NO: 1523057 - RNA, 19 nt, Human
cucagcaaaagaugcuucu

SEQ ID NO: 1523058 - RNA, 20 nt, Human
cucagcaaaagaugcuucuc

SEQ ID NO: 1523059 - RNA, 13 nt, Human
cucagcauccugg

SEQ ID NO: 1523060 - RNA, 21 nt, Human
cucagcauccuggcacccggc

SEQ ID NO: 1523061 - RNA, 22 nt, Human
cucagcauccuggcacccggcc

SEQ ID NO: 1523062 - RNA, 16 nt, Human
cucagaucuucugugg

SEQ ID NO: 1523063 - RNA, 23 nt, Human
cucagagagggugggagugggcc

SEQ ID NO: 1523064 - RNA, 19 nt, Human
cucagagagggugggagug

SEQ ID NO: 1523065 - RNA, 16 nt, Human
cucacuguugcccagg

SEQ ID NO: 1523066 - RNA, 17 nt, Human
cucacuguugcccaggc

SEQ ID NO: 1523067 - RNA, 18 nt, Human
cucacuguugcccaggcu

SEQ ID NO: 1523068 - RNA, 19 nt, Human
cucacuguugcccaggcug

SEQ ID NO: 1523069 - RNA, 14 nt, Human
cucacuguugccca

SEQ ID NO: 1523070 - RNA, 15 nt, Human
cucacuguugcccag

SEQ ID NO: 1523071 - RNA, 15 nt, Human
cucacugcagccuca

SEQ ID NO: 1523072 - RNA, 16 nt, Human
cucacugcagccucaa

SEQ ID NO: 1523073 - RNA, 22 nt, Human
cuaggaaauauuuauuuuaaua

SEQ ID NO: 1523074 - RNA, 14 nt, Human
cuacauucuguuaa

SEQ ID NO: 1523075 - RNA, 13 nt, Human
cuacauucuguua

SEQ ID NO: 1523076 - RNA, 22 nt, Human
cuacauuauaaaugucucuuua

SEQ ID NO: 1523077 - RNA, 17 nt, Human
cuacccucuuagaaaaa

SEQ ID NO: 1523078 - RNA, 19 nt, Human
cuacccagcgagcccuggu

SEQ ID NO: 1523079 - RNA, 18 nt, Human
cuacccagcgagcccugg

SEQ ID NO: 1523080 - RNA, 13 nt, Human
cuacccaggugcu

SEQ ID NO: 1523081 - RNA, 13 nt, Human
cuacccacccucc

SEQ ID NO: 1523082 - RNA, 15 nt, Human
cuacccagcgagccc

SEQ ID NO: 1523083 - RNA, 17 nt, Human
cuacccagcgagcccug

SEQ ID NO: 1523084 - RNA, 15 nt, Human
cuacaggcacccacc

SEQ ID NO: 1523085 - RNA, 17 nt, Human
cuacaggcacccaccau

SEQ ID NO: 1523086 - RNA, 14 nt, Human
cuacaggagugagc

SEQ ID NO: 1523087 - RNA, 15 nt, Human
cuacaggagugagca

SEQ ID NO: 1523088 - RNA, 16 nt, Human
cuacaggagugagcac

SEQ ID NO: 1523089 - RNA, 14 nt, Human
cuacaggugugagu

SEQ ID NO: 1523090 - RNA, 16 nt, Human
cuacaggugugaguca

SEQ ID NO: 1523091 - RNA, 13 nt, Human
cuacaguccuccc

SEQ ID NO: 1523092 - RNA, 18 nt, Human
cuacauggaguauauguc

SEQ ID NO: 1523093 - RNA, 20 nt, Human
cuacauggaguauaugucaa

SEQ ID NO: 1523094 - RNA, 23 nt, Human
cuacagcuugaccgugaggccag

SEQ ID NO: 1523095 - RNA, 19 nt, Human
cuacagcuugaccgugagg

SEQ ID NO: 1523096 - RNA, 22 nt, Human
cuacagcuugaccgugaggcca

SEQ ID NO: 1523097 - RNA, 22 nt, Human
cuacagaggccaugggccuccu

SEQ ID NO: 1523098 - RNA, 18 nt, Human
cuacagaggccaugggcc

SEQ ID NO: 1523099 - RNA, 20 nt, Human
cuacagaggccaugggccuc

SEQ ID NO: 1523100 - RNA, 13 nt, Human
cuacacugugcug

SEQ ID NO: 1523101 - RNA, 14 nt, Human
cuacacugugcuga

SEQ ID NO: 1523102 - RNA, 17 nt, Human
cuacacugugcugaguc

SEQ ID NO: 1523103 - RNA, 18 nt, Human
cuacacugugcugagucu

SEQ ID NO: 1523104 - RNA, 23 nt, Human
cuaauagacaauuuauuauggca

SEQ ID NO: 1523105 - RNA, 19 nt, Human
cuaauagacaauuuauuau

SEQ ID NO: 1523106 - RNA, 17 nt, Human
cuaauagacaauuuauu

SEQ ID NO: 1523107 - RNA, 12 nt, Human
cuaauacaccag

SEQ ID NO: 1523108 - RNA, 20 nt, Human
cuaaguaaaaccacagcagu

SEQ ID NO: 1523109 - RNA, 19 nt, Human
cuaaguaaaaccacagcag

SEQ ID NO: 1523110 - RNA, 14 nt, Human
cuaaguaaaaccac

SEQ ID NO: 1523111 - RNA, 18 nt, Human
cuaaguaaaaccacagca

SEQ ID NO: 1523112 - RNA, 21 nt, Human
cuaagcuucacuguaaaauaa

SEQ ID NO: 1523113 - RNA, 22 nt, Human
cuaagcuauucaguaauaacuc

SEQ ID NO: 1523114 - RNA, 23 nt, Human
cuacacgagauacagaauuuuau

SEQ ID NO: 1523115 - RNA, 14 nt, Human
cuacacuaagagag

SEQ ID NO: 1523116 - RNA, 21 nt, Human
cuacacaggggaaaagaggag

SEQ ID NO: 1523117 - RNA, 12 nt, Human
cuaaugggacac

SEQ ID NO: 1523118 - RNA, 13 nt, Human
cuaaugggacacu

SEQ ID NO: 1523119 - RNA, 18 nt, Human
cuaauauguaacaagcca

SEQ ID NO: 1523120 - RNA, 19 nt, Human
cuaaauucuuucauuuuag

SEQ ID NO: 1523121 - RNA, 19 nt, Human
cuaaauugacacuuaaaaa

SEQ ID NO: 1523122 - RNA, 20 nt, Human
cuaaauuuuauaucuuguag

SEQ ID NO: 1523123 - RNA, 14 nt, Human
cuaaauuuuaagug

SEQ ID NO: 1523124 - RNA, 13 nt, Human
cuaaauuuuauau

SEQ ID NO: 1523125 - RNA, 15 nt, Human
cuaaauuuuauaucu

SEQ ID NO: 1523126 - RNA, 16 nt, Human
cuaaauuuuauaucuu

SEQ ID NO: 1523127 - RNA, 12 nt, Human
cuaaccacgcug

SEQ ID NO: 1523128 - RNA, 14 nt, Human
cuaaccacgcugga

SEQ ID NO: 1523129 - RNA, 14 nt, Human
cuaagagagaauga

SEQ ID NO: 1523130 - RNA, 15 nt, Human
cuaagagagaaugag

SEQ ID NO: 1523131 - RNA, 13 nt, Human
cuaagagggaggg

SEQ ID NO: 1523132 - RNA, 15 nt, Human
cuaagagggagggag

SEQ ID NO: 1523133 - RNA, 22 nt, Human
cuaagagggagggagggcucca

SEQ ID NO: 1523134 - RNA, 16 nt, Human
cuaagauaguaacaau

SEQ ID NO: 1523135 - RNA, 23 nt, Human
cuaagagggagggagggcuccag

SEQ ID NO: 1523136 - RNA, 21 nt, Human
cuaaaucuccaaaauaaaacu

SEQ ID NO: 1523137 - RNA, 22 nt, Human
cuaaaugaaaaucgugacaaca

SEQ ID NO: 1523138 - RNA, 23 nt, Human
cgggaggauguucugggacacag

SEQ ID NO: 1523139 - RNA, 20 nt, Human
cgggaggcagagguugcagu

SEQ ID NO: 1523140 - RNA, 11 nt, Human
cuaaaaacaua

SEQ ID NO: 1523141 - RNA, 16 nt, Human
cgggaagggggcuggg

SEQ ID NO: 1523142 - RNA, 19 nt, Human
cgggaagggggcugggaca

SEQ ID NO: 1523143 - RNA, 20 nt, Human
cgggaagggggcugggacau

SEQ ID NO: 1523144 - RNA, 14 nt, Human
cggcuggccuggcc

SEQ ID NO: 1523145 - RNA, 23 nt, Human
cggcuggcagcccaccccucaac

SEQ ID NO: 1523146 - RNA, 13 nt, Human
cggcuggccuggc

SEQ ID NO: 1523147 - RNA, 11 nt, Human
cggccaggcca

SEQ ID NO: 1523148 - RNA, 12 nt, Human
cggccaggccag

SEQ ID NO: 1523149 - RNA, 20 nt, Human
cggccaggccagagggagug

SEQ ID NO: 1523150 - RNA, 19 nt, Human
cgcugugcugcccugccca

SEQ ID NO: 1523151 - RNA, 15 nt, Human
cgcugugccacaggc

SEQ ID NO: 1523152 - RNA, 21 nt, Human
cgcugugcugcccugcccacc

SEQ ID NO: 1523153 - RNA, 23 nt, Human
cgcugugcugcccugcccaccug

SEQ ID NO: 1523154 - RNA, 11 nt, Human
cgcugugcugc

SEQ ID NO: 1523155 - RNA, 13 nt, Human
cgcugugcugccc

SEQ ID NO: 1523156 - RNA, 14 nt, Human
cgcugugcugcccu

SEQ ID NO: 1523157 - RNA, 18 nt, Human
cgcuccugccgcagagcu

SEQ ID NO: 1523158 - RNA, 19 nt, Human
cgcuccugccgcagagcug

SEQ ID NO: 1523159 - RNA, 20 nt, Human
cgcuccugccgcagagcugg

SEQ ID NO: 1523160 - RNA, 16 nt, Human
cgcuuucuacccagcg

SEQ ID NO: 1523161 - RNA, 14 nt, Human
cgcuuucuacccag

SEQ ID NO: 1523162 - RNA, 16 nt, Human
cggaauaguuggcuag

SEQ ID NO: 1523163 - RNA, 17 nt, Human
cggaauaguuggcuagg

SEQ ID NO: 1523164 - RNA, 13 nt, Human
cggaauauauuuu

SEQ ID NO: 1523165 - RNA, 21 nt, Human
cggacagccacggccaggcca

SEQ ID NO: 1523166 - RNA, 22 nt, Human
cggacagccacggccaggccag

SEQ ID NO: 1523167 - RNA, 15 nt, Human
cggagaaaggaaggg

SEQ ID NO: 1523168 - RNA, 17 nt, Human
cggagaaaggaagggcu

SEQ ID NO: 1523169 - RNA, 19 nt, Human
cgcgguggcucacgccugu

SEQ ID NO: 1523170 - RNA, 15 nt, Human
cgcgacaaugcaaac

SEQ ID NO: 1523171 - RNA, 14 nt, Human
cgcgacaaugcaaa

SEQ ID NO: 1523172 - RNA, 18 nt, Human
cgcuacccgggaaggggg

SEQ ID NO: 1523173 - RNA, 21 nt, Human
cgcuacccgggaagggggcug

SEQ ID NO: 1523174 - RNA, 24 nt, Human
cgcuacccgggaagggggcuggga

SEQ ID NO: 1523175 - RNA, 18 nt, Human
cgcagcccugcagagggc

SEQ ID NO: 1523176 - RNA, 19 nt, Human
cgcagcccugcagagggca

SEQ ID NO: 1523177 - RNA, 13 nt, Human
cgcccagucugga

SEQ ID NO: 1523178 - RNA, 19 nt, Human
cgcccagucuggaaugcag

SEQ ID NO: 1523179 - RNA, 21 nt, Human
cgcccagucuggaaugcagug

SEQ ID NO: 1523180 - RNA, 13 nt, Human
cgcacugggcuug

SEQ ID NO: 1523181 - RNA, 21 nt, Human
cgaugggcccaauucuuacaa

SEQ ID NO: 1523182 - RNA, 23 nt, Human
cgcacuucgggaggucgaggcag

SEQ ID NO: 1523183 - RNA, 17 nt, Human
cgcacugggcuugggga

SEQ ID NO: 1523184 - RNA, 14 nt, Human
cgcagagcuggccg

SEQ ID NO: 1523185 - RNA, 19 nt, Human
cgcagcauauucaggaagc

SEQ ID NO: 1523186 - RNA, 20 nt, Human
cgcagcauauucaggaagcu

SEQ ID NO: 1523187 - RNA, 17 nt, Human
cgcagcccugcagaggg

SEQ ID NO: 1523188 - RNA, 19 nt, Human
cgagcccugguggcagugg

SEQ ID NO: 1523189 - RNA, 16 nt, Human
cgaggacagggaggug

SEQ ID NO: 1523190 - RNA, 17 nt, Human
cgaggagguaaugaauu

SEQ ID NO: 1523191 - RNA, 20 nt, Human
ccuguggaugauaaaacaca

SEQ ID NO: 1523192 - RNA, 20 nt, Human
ccugugggcccccaaaugga

SEQ ID NO: 1523193 - RNA, 20 nt, Human
ccugugccucugggacugga

SEQ ID NO: 1523194 - RNA, 19 nt, Human
ccuucauuuggcauucccc

SEQ ID NO: 1523195 - RNA, 16 nt, Human
ccuucucucaucucuu

SEQ ID NO: 1523196 - RNA, 17 nt, Human
ccuucucucaucucuua

SEQ ID NO: 1523197 - RNA, 21 nt, Human
ccuucucucaucucuuagcuc

SEQ ID NO: 1523198 - RNA, 12 nt, Human
ccuucucuccag

SEQ ID NO: 1523199 - RNA, 13 nt, Human
ccuucucuccagc

SEQ ID NO: 1523200 - RNA, 15 nt, Human
ccuucucuccagccc

SEQ ID NO: 1523201 - RNA, 16 nt, Human
ccuucucuccagcccc

SEQ ID NO: 1523202 - RNA, 17 nt, Human
ccuucggccuccauccu

SEQ ID NO: 1523203 - RNA, 19 nt, Human
ccuucggccuccauccuga

SEQ ID NO: 1523204 - RNA, 18 nt, Human
ccuucggccuccauccug

SEQ ID NO: 1523205 - RNA, 17 nt, Human
ccuuccauggacuuugu

SEQ ID NO: 1523206 - RNA, 21 nt, Human
ccuuccuggagcccagaggag

SEQ ID NO: 1523207 - RNA, 13 nt, Human
ccuuccaggggug

SEQ ID NO: 1523208 - RNA, 21 nt, Human
ccuuggugucgggcaugacac

SEQ ID NO: 1523209 - RNA, 19 nt, Human
ccuuggugucgggcaugac

SEQ ID NO: 1523210 - RNA, 20 nt, Human
ccuuggugucgggcaugaca

SEQ ID NO: 1523211 - RNA, 14 nt, Human
ccuuggggagcagg

SEQ ID NO: 1523212 - RNA, 16 nt, Human
ccuuggcugcagggag

SEQ ID NO: 1523213 - RNA, 19 nt, Human
ccuuggauuguccccgacc

SEQ ID NO: 1523214 - RNA, 22 nt, Human
ccuuggcucaaguccucuuuuc

SEQ ID NO: 1523215 - RNA, 15 nt, Human
ccuuggauugucccc

SEQ ID NO: 1523216 - RNA, 15 nt, Human
ccuuggacucauuuu

SEQ ID NO: 1523217 - RNA, 17 nt, Human
ccuucucuccagccccu

SEQ ID NO: 1523218 - RNA, 18 nt, Human
ccuucucuccagccccug

SEQ ID NO: 1523219 - RNA, 18 nt, Human
ccuugacagggcacaccg

SEQ ID NO: 1523220 - RNA, 21 nt, Human
ccuugacagggcacaccgggc

SEQ ID NO: 1523221 - RNA, 19 nt, Human
ccuucucuccagccccugg

SEQ ID NO: 1523222 - RNA, 23 nt, Human
ccuuuguauucucuccuguaccu

SEQ ID NO: 1523223 - RNA, 22 nt, Human
ccuuuguauucucuccuguacc

SEQ ID NO: 1523224 - RNA, 24 nt, Human
ccuuuguauucucuccuguaccuc

SEQ ID NO: 1523225 - RNA, 16 nt, Human
ccuuuguccccaccgc

SEQ ID NO: 1523226 - RNA, 18 nt, Human
ccuuuguccccaccgcag

SEQ ID NO: 1523227 - RNA, 14 nt, Human
ccuuuguccccacc

SEQ ID NO: 1523228 - RNA, 15 nt, Human
ccuuuuuuggcugcu

SEQ ID NO: 1523229 - RNA, 14 nt, Human
ccuuugugaggaag

SEQ ID NO: 1523230 - RNA, 22 nt, Human
ccuuuguccccaccgcagacag

SEQ ID NO: 1523231 - RNA, 23 nt, Human
ccuuuguccccaccgcagacagg

SEQ ID NO: 1523232 - RNA, 15 nt, Human
ccuuugugaggaagc

SEQ ID NO: 1523233 - RNA, 16 nt, Human
ccuuugugaggaagcc

SEQ ID NO: 1523234 - RNA, 17 nt, Human
ccuuugugaggaagccg

SEQ ID NO: 1523235 - RNA, 23 nt, Human
ccuuugugaggaagccgcugggg

SEQ ID NO: 1523236 - RNA, 16 nt, Human
cgaagcccaggggccg

SEQ ID NO: 1523237 - RNA, 21 nt, Human
cgaacauguuuuucuucuccc

SEQ ID NO: 1523238 - RNA, 23 nt, Human
cgaacauguuuuucuucucccuc

SEQ ID NO: 1523239 - RNA, 23 nt, Human
cgaaagggacuuggaagcuccgc

SEQ ID NO: 1523240 - RNA, 17 nt, Human
ccuuuuuuggcugcuga

SEQ ID NO: 1523241 - RNA, 18 nt, Human
ccuuuuuuggcugcugaa

SEQ ID NO: 1523242 - RNA, 20 nt, Human
ccuuuuuuggcugcugaagg

SEQ ID NO: 1523243 - RNA, 22 nt, Human
ccuuuuuuggcugcugaaggcu

SEQ ID NO: 1523244 - RNA, 15 nt, Human
cgaauauugcugaug

SEQ ID NO: 1523245 - RNA, 17 nt, Human
cgaauauugcugauggu

SEQ ID NO: 1523246 - RNA, 16 nt, Human
cgaauagcugggacua

SEQ ID NO: 1523247 - RNA, 11 nt, Human
cgaauauugcu

SEQ ID NO: 1523248 - RNA, 12 nt, Human
cgaauauugcug

SEQ ID NO: 1523249 - RNA, 14 nt, Human
cgaauauugcugau

SEQ ID NO: 1523250 - RNA, 11 nt, Human
ccugcccugug

SEQ ID NO: 1523251 - RNA, 12 nt, Human
ccugcccugugg

SEQ ID NO: 1523252 - RNA, 14 nt, Human
ccugcccugugggc

SEQ ID NO: 1523253 - RNA, 15 nt, Human
ccugcccugugggcc

SEQ ID NO: 1523254 - RNA, 19 nt, Human
ccugcccuuaccugccagg

SEQ ID NO: 1523255 - RNA, 21 nt, Human
ccugcccuuaccugccaggaa

SEQ ID NO: 1523256 - RNA, 22 nt, Human
ccugcccuuaccugccaggaag

SEQ ID NO: 1523257 - RNA, 13 nt, Human
ccugccgcagagc

SEQ ID NO: 1523258 - RNA, 14 nt, Human
ccugccgcagagcu

SEQ ID NO: 1523259 - RNA, 15 nt, Human
ccugccgcagagcug

SEQ ID NO: 1523260 - RNA, 16 nt, Human
ccugccgcagagcugg

SEQ ID NO: 1523261 - RNA, 12 nt, Human
ccugccucagcc

SEQ ID NO: 1523262 - RNA, 13 nt, Human
ccugccucagccu

SEQ ID NO: 1523263 - RNA, 14 nt, Human
ccugccucagccuc

SEQ ID NO: 1523264 - RNA, 14 nt, Human
ccugccuguugggc

SEQ ID NO: 1523265 - RNA, 17 nt, Human
ccugccgcagagcuggc

SEQ ID NO: 1523266 - RNA, 12 nt, Human
ccugccaggcau

SEQ ID NO: 1523267 - RNA, 15 nt, Human
ccugccaggcauggu

SEQ ID NO: 1523268 - RNA, 14 nt, Human
ccugcccggcugcg

SEQ ID NO: 1523269 - RNA, 16 nt, Human
ccugcccggcugcgga

SEQ ID NO: 1523270 - RNA, 17 nt, Human
ccugccccugagcccau

SEQ ID NO: 1523271 - RNA, 22 nt, Human
ccugccuguugggccaggagcc

SEQ ID NO: 1523272 - RNA, 18 nt, Human
ccugaaggccccgcccag

SEQ ID NO: 1523273 - RNA, 19 nt, Human
ccugaaggccccgcccagg

SEQ ID NO: 1523274 - RNA, 22 nt, Human
ccugaaggccccgcccaggcuu

SEQ ID NO: 1523275 - RNA, 20 nt, Human
ccugaaggccccgcccaggc

SEQ ID NO: 1523276 - RNA, 21 nt, Human
ccugaaggccccgcccaggcu

SEQ ID NO: 1523277 - RNA, 18 nt, Human
ccugaaagcccugagcuu

SEQ ID NO: 1523278 - RNA, 13 nt, Human
ccugaaagaggaa

SEQ ID NO: 1523279 - RNA, 13 nt, Human
ccugaaagcccug

SEQ ID NO: 1523280 - RNA, 14 nt, Human
ccugaaagcccuga

SEQ ID NO: 1523281 - RNA, 15 nt, Human
ccugagcugggauga

SEQ ID NO: 1523282 - RNA, 16 nt, Human
ccugccacccugggga

SEQ ID NO: 1523283 - RNA, 22 nt, Human
ccugccacccuggggagaaagu

SEQ ID NO: 1523284 - RNA, 14 nt, Human
ccugccacccuggg

SEQ ID NO: 1523285 - RNA, 12 nt, Human
ccugccacccug

SEQ ID NO: 1523286 - RNA, 13 nt, Human
ccugccacccugg

SEQ ID NO: 1523287 - RNA, 16 nt, Human
ccugcacuugcagacu

SEQ ID NO: 1523288 - RNA, 19 nt, Human
ccugccaauggacuaacuu

SEQ ID NO: 1523289 - RNA, 17 nt, Human
ccugaggcuccacuugg

SEQ ID NO: 1523290 - RNA, 13 nt, Human
ccugaggcuccac

SEQ ID NO: 1523291 - RNA, 14 nt, Human
ccugaggcuccacu

SEQ ID NO: 1523292 - RNA, 13 nt, Human
ccugaggcugggc

SEQ ID NO: 1523293 - RNA, 14 nt, Human
ccugaggcugggcu

SEQ ID NO: 1523294 - RNA, 15 nt, Human
ccugaggcugggcuc

SEQ ID NO: 1523295 - RNA, 16 nt, Human
ccugaggcugggcucc

SEQ ID NO: 1523296 - RNA, 12 nt, Human
ccugagcuggga

SEQ ID NO: 1523297 - RNA, 15 nt, Human
ccugaggcccagagg

SEQ ID NO: 1523298 - RNA, 16 nt, Human
ccugaggcccagaggg

SEQ ID NO: 1523299 - RNA, 17 nt, Human
ccugaggcccagagggc

SEQ ID NO: 1523300 - RNA, 18 nt, Human
ccugaggcccagagggcc

SEQ ID NO: 1523301 - RNA, 20 nt, Human
ccugagccagauuucacucu

SEQ ID NO: 1523302 - RNA, 12 nt, Human
ccugagcgcucc

SEQ ID NO: 1523303 - RNA, 16 nt, Human
ccugagcgcuccugcc

SEQ ID NO: 1523304 - RNA, 21 nt, Human
ccugagcgcuccugccgcaga

SEQ ID NO: 1523305 - RNA, 23 nt, Human
ccugagcgcuccugccgcagagc

SEQ ID NO: 1523306 - RNA, 22 nt, Human
ccugaagucuuuguacagacaa

SEQ ID NO: 1523307 - RNA, 20 nt, Human
ccugaagucacacagugagu

SEQ ID NO: 1523308 - RNA, 15 nt, Human
ccugagccagauuuc

SEQ ID NO: 1523309 - RNA, 16 nt, Human
ccugagccagauuuca

SEQ ID NO: 1523310 - RNA, 18 nt, Human
ccugagccagauuucacu

SEQ ID NO: 1523311 - RNA, 18 nt, Human
ccugccuguugggccagg

SEQ ID NO: 1523312 - RNA, 19 nt, Human
ccugccuguugggccagga

SEQ ID NO: 1523313 - RNA, 20 nt, Human
ccugccuguugggccaggag

SEQ ID NO: 1523314 - RNA, 21 nt, Human
ccugcuaauuccccagauugc

SEQ ID NO: 1523315 - RNA, 19 nt, Human
ccuggcacccggccccugc

SEQ ID NO: 1523316 - RNA, 20 nt, Human
ccuggcacccggccccugcu

SEQ ID NO: 1523317 - RNA, 21 nt, Human
ccuggcacccggccccugcug

SEQ ID NO: 1523318 - RNA, 12 nt, Human
ccuggcacugcu

SEQ ID NO: 1523319 - RNA, 17 nt, Human
ccuggcacugcuuccag

SEQ ID NO: 1523320 - RNA, 13 nt, Human
ccuggcacugcuu

SEQ ID NO: 1523321 - RNA, 16 nt, Human
ccuggcacugcuucca

SEQ ID NO: 1523322 - RNA, 13 nt, Human
ccuggcaugggaa

SEQ ID NO: 1523323 - RNA, 13 nt, Human
ccuggcccacugc

SEQ ID NO: 1523324 - RNA, 14 nt, Human
ccuggcccacugca

SEQ ID NO: 1523325 - RNA, 21 nt, Human
ccuggccagaugcaccagccc

SEQ ID NO: 1523326 - RNA, 23 nt, Human
ccuggccagaugcaccagcccuu

SEQ ID NO: 1523327 - RNA, 12 nt, Human
ccuggggggcag

SEQ ID NO: 1523328 - RNA, 19 nt, Human
ccugggggcugggcagagg

SEQ ID NO: 1523329 - RNA, 20 nt, Human
ccugggggcugggcagagga

SEQ ID NO: 1523330 - RNA, 21 nt, Human
ccugggggcugggcagaggaa

SEQ ID NO: 1523331 - RNA, 22 nt, Human
ccugggaggucaaggcugcagu

SEQ ID NO: 1523332 - RNA, 16 nt, Human
ccugggagugagcugg

SEQ ID NO: 1523333 - RNA, 18 nt, Human
ccugggagugagcugguu

SEQ ID NO: 1523334 - RNA, 16 nt, Human
ccugggcagaaggaag

SEQ ID NO: 1523335 - RNA, 16 nt, Human
ccuggcccacugcauc

SEQ ID NO: 1523336 - RNA, 14 nt, Human
ccuggcaugggaau

SEQ ID NO: 1523337 - RNA, 12 nt, Human
ccuguaccucuu

SEQ ID NO: 1523338 - RNA, 10 nt, Human
ccuguaccuc

SEQ ID NO: 1523339 - RNA, 15 nt, Human
ccugguggcaguggg

SEQ ID NO: 1523340 - RNA, 13 nt, Human
ccugguggcagug

SEQ ID NO: 1523341 - RNA, 14 nt, Human
ccugguggcagugg

SEQ ID NO: 1523342 - RNA, 13 nt, Human
ccuguagcccuaa

SEQ ID NO: 1523343 - RNA, 19 nt, Human
ccuguagagugggagcuga

SEQ ID NO: 1523344 - RNA, 15 nt, Human
ccuguagagugggag

SEQ ID NO: 1523345 - RNA, 16 nt, Human
ccuguagagugggagc

SEQ ID NO: 1523346 - RNA, 12 nt, Human
ccugucccccug

SEQ ID NO: 1523347 - RNA, 13 nt, Human
ccugucccccuga

SEQ ID NO: 1523348 - RNA, 14 nt, Human
ccugucccccugac

SEQ ID NO: 1523349 - RNA, 15 nt, Human
ccugucccccugaca

SEQ ID NO: 1523350 - RNA, 16 nt, Human
ccugucccccugacaa

SEQ ID NO: 1523351 - RNA, 19 nt, Human
ccugguggcagcucaccuc

SEQ ID NO: 1523352 - RNA, 21 nt, Human
ccugguggcagcucaccucuc

SEQ ID NO: 1523353 - RNA, 22 nt, Human
ccugguggcagcucaccucucc

SEQ ID NO: 1523354 - RNA, 14 nt, Human
ccugguggcagcug

SEQ ID NO: 1523355 - RNA, 15 nt, Human
ccugguggcagcugc

SEQ ID NO: 1523356 - RNA, 16 nt, Human
ccugguggcagcugcg

SEQ ID NO: 1523357 - RNA, 17 nt, Human
ccugguggcagcugcgg

SEQ ID NO: 1523358 - RNA, 18 nt, Human
ccugguggcagcugcggu

SEQ ID NO: 1523359 - RNA, 15 nt, Human
ccuaacgaaguaucc

SEQ ID NO: 1523360 - RNA, 21 nt, Human
ccuacaguugaaaaacagcug

SEQ ID NO: 1523361 - RNA, 18 nt, Human
ccgugaggccagagacac

SEQ ID NO: 1523362 - RNA, 22 nt, Human
ccgggcucugccucccaucacc

SEQ ID NO: 1523363 - RNA, 18 nt, Human
ccgggcucugccucccau

SEQ ID NO: 1523364 - RNA, 14 nt, Human
ccgggcucugccuc

SEQ ID NO: 1523365 - RNA, 15 nt, Human
ccgggcucugccucc

SEQ ID NO: 1523366 - RNA, 16 nt, Human
ccggcuccaggcuccu

SEQ ID NO: 1523367 - RNA, 21 nt, Human
ccggcuccaggcuccuuuagc

SEQ ID NO: 1523368 - RNA, 22 nt, Human
ccgggcacucagaagacacuga

SEQ ID NO: 1523369 - RNA, 15 nt, Human
ccgggcagggugugg

SEQ ID NO: 1523370 - RNA, 13 nt, Human
ccgggccacagag

SEQ ID NO: 1523371 - RNA, 14 nt, Human
ccgcuggggccagu

SEQ ID NO: 1523372 - RNA, 11 nt, Human
ccgcuggggcc

SEQ ID NO: 1523373 - RNA, 18 nt, Human
ccgagauagccaaggcca

SEQ ID NO: 1523374 - RNA, 21 nt, Human
ccgagauugcaccacugcacu

SEQ ID NO: 1523375 - RNA, 15 nt, Human
ccgagauugcaccac

SEQ ID NO: 1523376 - RNA, 19 nt, Human
ccgagauugcaccacugca

SEQ ID NO: 1523377 - RNA, 15 nt, Human
ccgcagacaggacca

SEQ ID NO: 1523378 - RNA, 23 nt, Human
ccgcacugggcuuggggaccaga

SEQ ID NO: 1523379 - RNA, 19 nt, Human
ccgagcuuugaaaauucag

SEQ ID NO: 1523380 - RNA, 14 nt, Human
ccgaguagcuggga

SEQ ID NO: 1523381 - RNA, 16 nt, Human
ccgaguagcugggacu

SEQ ID NO: 1523382 - RNA, 14 nt, Human
cccugccuccuuug

SEQ ID NO: 1523383 - RNA, 11 nt, Human
cccugccuccu

SEQ ID NO: 1523384 - RNA, 12 nt, Human
cccugaggccca

SEQ ID NO: 1523385 - RNA, 22 nt, Human
cccugcucuccgaccagacacc

SEQ ID NO: 1523386 - RNA, 21 nt, Human
cccugcucuccgaccagacac

SEQ ID NO: 1523387 - RNA, 15 nt, Human
cccuugaugaagaag

SEQ ID NO: 1523388 - RNA, 12 nt, Human
cccuuccaugga

SEQ ID NO: 1523389 - RNA, 23 nt, Human
cccuuagcagggaaacagcuaau

SEQ ID NO: 1523390 - RNA, 14 nt, Human
cccuuagcagggaa

SEQ ID NO: 1523391 - RNA, 15 nt, Human
cccuuacgugagucc

SEQ ID NO: 1523392 - RNA, 17 nt, Human
cccuuacgugaguccug

SEQ ID NO: 1523393 - RNA, 13 nt, Human
cccuguucuggca

SEQ ID NO: 1523394 - RNA, 14 nt, Human
cccuguucuggcag

SEQ ID NO: 1523395 - RNA, 19 nt, Human
cccuguuuguuucugaaag

SEQ ID NO: 1523396 - RNA, 17 nt, Human
cccuuaccugccaggaa

SEQ ID NO: 1523397 - RNA, 20 nt, Human
cccuuaccugccaggaagcc

SEQ ID NO: 1523398 - RNA, 23 nt, Human
cccuuaccugccaggaagccagc

SEQ ID NO: 1523399 - RNA, 21 nt, Human
cccugguggcagcucaccucu

SEQ ID NO: 1523400 - RNA, 13 nt, Human
cccugguggcagu

SEQ ID NO: 1523401 - RNA, 14 nt, Human
cccugguggcagug

SEQ ID NO: 1523402 - RNA, 15 nt, Human
cccugguggcagugg

SEQ ID NO: 1523403 - RNA, 23 nt, Human
cccucccucuuucccucccuucc

SEQ ID NO: 1523404 - RNA, 12 nt, Human
cccucuuucccu

SEQ ID NO: 1523405 - RNA, 17 nt, Human
cccucuuucccucccuu

SEQ ID NO: 1523406 - RNA, 20 nt, Human
cccucuuucccucccuuccu

SEQ ID NO: 1523407 - RNA, 12 nt, Human
cccucuggggcu

SEQ ID NO: 1523408 - RNA, 19 nt, Human
cccucugcccacucccugc

SEQ ID NO: 1523409 - RNA, 11 nt, Human
cccucugccca

SEQ ID NO: 1523410 - RNA, 15 nt, Human
cccucugcccacucc

SEQ ID NO: 1523411 - RNA, 18 nt, Human
cccucugcccacucccug

SEQ ID NO: 1523412 - RNA, 13 nt, Human
cccugaggcccag

SEQ ID NO: 1523413 - RNA, 20 nt, Human
ccccuguucuggcagaguug

SEQ ID NO: 1523414 - RNA, 13 nt, Human
ccccuuccaugga

SEQ ID NO: 1523415 - RNA, 20 nt, Human
ccccuuccauggacuuuguu

SEQ ID NO: 1523416 - RNA, 20 nt, Human
cccgcccaggcuuagucacu

SEQ ID NO: 1523417 - RNA, 22 nt, Human
cccgcccaggcuuagucacuga

SEQ ID NO: 1523418 - RNA, 23 nt, Human
cccgcuaagagggagggagggcu

SEQ ID NO: 1523419 - RNA, 17 nt, Human
ccccugcccggcugcgg

SEQ ID NO: 1523420 - RNA, 19 nt, Human
ccccugcccggcugcggaa

SEQ ID NO: 1523421 - RNA, 14 nt, Human
ccccugcugggugu

SEQ ID NO: 1523422 - RNA, 17 nt, Human
ccccugcuggguguggc

SEQ ID NO: 1523423 - RNA, 11 nt, Human
ccccugcuggu

SEQ ID NO: 1523424 - RNA, 13 nt, Human
ccccugcugguuc

SEQ ID NO: 1523425 - RNA, 15 nt, Human
ccccugcugguucag

SEQ ID NO: 1523426 - RNA, 20 nt, Human
ccccugcugguucaggguug

SEQ ID NO: 1523427 - RNA, 15 nt, Human
ccccuggaugcagcc

SEQ ID NO: 1523428 - RNA, 18 nt, Human
ccccuggaugcagccuca

SEQ ID NO: 1523429 - RNA, 19 nt, Human
ccccuggaugcagccucac

SEQ ID NO: 1523430 - RNA, 15 nt, Human
ccccucaacaccucu

SEQ ID NO: 1523431 - RNA, 16 nt, Human
ccccucaacaccucug

SEQ ID NO: 1523432 - RNA, 23 nt, Human
ccccucaacucuccuccagaguc

SEQ ID NO: 1523433 - RNA, 12 nt, Human
cccccagccugc

SEQ ID NO: 1523434 - RNA, 17 nt, Human
cccccugacaacacuca

SEQ ID NO: 1523435 - RNA, 19 nt, Human
cccccugacaacacucauu

SEQ ID NO: 1523436 - RNA, 14 nt, Human
ccccuccaaccugg

SEQ ID NO: 1523437 - RNA, 16 nt, Human
ccccucagggucccug

SEQ ID NO: 1523438 - RNA, 15 nt, Human
ccccucccuuucucc

SEQ ID NO: 1523439 - RNA, 12 nt, Human
ccccucccuuuc

SEQ ID NO: 1523440 - RNA, 12 nt, Human
ccccuccaugug

SEQ ID NO: 1523441 - RNA, 18 nt, Human
ccccuccuccacucuccc

SEQ ID NO: 1523442 - RNA, 12 nt, Human
ccccuccuccac

SEQ ID NO: 1523443 - RNA, 15 nt, Human
ccccuccuccacucu

SEQ ID NO: 1523444 - RNA, 15 nt, Human
ccccucggagaagag

SEQ ID NO: 1523445 - RNA, 12 nt, Human
cccccacccccu

SEQ ID NO: 1523446 - RNA, 15 nt, Human
cccccacuggugaca

SEQ ID NO: 1523447 - RNA, 11 nt, Human
cccccacuggu

SEQ ID NO: 1523448 - RNA, 13 nt, Human
cccccacugguga

SEQ ID NO: 1523449 - RNA, 14 nt, Human
ccccauccucugua

SEQ ID NO: 1523450 - RNA, 24 nt, Human
cccccacccaagggccuggccuga

SEQ ID NO: 1523451 - RNA, 17 nt, Human
ccccauccucuguacag

SEQ ID NO: 1523452 - RNA, 13 nt, Human
cccccacccaagg

SEQ ID NO: 1523453 - RNA, 14 nt, Human
ccccagugcccaca

SEQ ID NO: 1523454 - RNA, 15 nt, Human
ccccagugcccacag

SEQ ID NO: 1523455 - RNA, 16 nt, Human
ccccagugcccacagg

SEQ ID NO: 1523456 - RNA, 20 nt, Human
ccccagugcccacaggauca

SEQ ID NO: 1523457 - RNA, 14 nt, Human
cccaguugggugga

SEQ ID NO: 1523458 - RNA, 19 nt, Human
cccaucucuacaaaaagca

SEQ ID NO: 1523459 - RNA, 12 nt, Human
cccaucugugaa

SEQ ID NO: 1523460 - RNA, 14 nt, Human
cccaugagccucag

SEQ ID NO: 1523461 - RNA, 15 nt, Human
ccccaccgcagacag

SEQ ID NO: 1523462 - RNA, 19 nt, Human
ccccaccgcagacaggacc

SEQ ID NO: 1523463 - RNA, 14 nt, Human
cccacgcuggagug

SEQ ID NO: 1523464 - RNA, 16 nt, Human
cccaccuuggcugcag

SEQ ID NO: 1523465 - RNA, 17 nt, Human
cccacgcccccacuggu

SEQ ID NO: 1523466 - RNA, 19 nt, Human
cccacgcccccacugguga

SEQ ID NO: 1523467 - RNA, 15 nt, Human
cccaccuuggcucaa

SEQ ID NO: 1523468 - RNA, 22 nt, Human
cccaccuuggcucaaguccucu

SEQ ID NO: 1523469 - RNA, 14 nt, Human
cccaccuuggcugc

SEQ ID NO: 1523470 - RNA, 15 nt, Human
cccaccuuggcugca

SEQ ID NO: 1523471 - RNA, 12 nt, Human
cccaccucagcc

SEQ ID NO: 1523472 - RNA, 14 nt, Human
cccaccucagccuc

SEQ ID NO: 1523473 - RNA, 15 nt, Human
cccaccucagccucc

SEQ ID NO: 1523474 - RNA, 17 nt, Human
cccaccucagccucccg

SEQ ID NO: 1523475 - RNA, 19 nt, Human
cccaccucucucacuccuu

SEQ ID NO: 1523476 - RNA, 12 nt, Human
cccaccuuggcu

SEQ ID NO: 1523477 - RNA, 21 nt, Human
cccaccucagccucccaaagu

SEQ ID NO: 1523478 - RNA, 13 nt, Human
cccaccucucuca

SEQ ID NO: 1523479 - RNA, 14 nt, Human
cccaccucucucac

SEQ ID NO: 1523480 - RNA, 17 nt, Human
cccaccucucucacucc

SEQ ID NO: 1523481 - RNA, 20 nt, Human
ccauuuugcugucccuuuuc

SEQ ID NO: 1523482 - RNA, 23 nt, Human
ccauuuuggauucuuauggacaa

SEQ ID NO: 1523483 - RNA, 21 nt, Human
ccauuuuguauuuuacuaaua

SEQ ID NO: 1523484 - RNA, 12 nt, Human
cccaagggccug

SEQ ID NO: 1523485 - RNA, 14 nt, Human
cccaagggccuggc

SEQ ID NO: 1523486 - RNA, 17 nt, Human
cccaagggccuggccug

SEQ ID NO: 1523487 - RNA, 16 nt, Human
cccaagggccuggccu

SEQ ID NO: 1523488 - RNA, 17 nt, Human
cccacaggaucagucug

SEQ ID NO: 1523489 - RNA, 13 nt, Human
cccacaggaucag

SEQ ID NO: 1523490 - RNA, 17 nt, Human
ccaucugaaagugguac

SEQ ID NO: 1523491 - RNA, 17 nt, Human
ccauuaugaagaagaga

SEQ ID NO: 1523492 - RNA, 14 nt, Human
ccauucuccaccug

SEQ ID NO: 1523493 - RNA, 13 nt, Human
ccauuugcuccuu

SEQ ID NO: 1523494 - RNA, 16 nt, Human
ccauucugccugccca

SEQ ID NO: 1523495 - RNA, 15 nt, Human
ccauucugccugccc

SEQ ID NO: 1523496 - RNA, 15 nt, Human
ccaggcccucugccc

SEQ ID NO: 1523497 - RNA, 16 nt, Human
ccaggcccucugccca

SEQ ID NO: 1523498 - RNA, 14 nt, Human
ccaggcuggucuca

SEQ ID NO: 1523499 - RNA, 21 nt, Human
ccaggcuuagucacugagaca

SEQ ID NO: 1523500 - RNA, 22 nt, Human
ccaggcuuagucacugagacag

SEQ ID NO: 1523501 - RNA, 23 nt, Human
ccaggcuuagucacugagacagc

SEQ ID NO: 1523502 - RNA, 19 nt, Human
ccaggccccugccacccug

SEQ ID NO: 1523503 - RNA, 13 nt, Human
ccaggcccucugc

SEQ ID NO: 1523504 - RNA, 14 nt, Human
ccaggcccucugcc

SEQ ID NO: 1523505 - RNA, 12 nt, Human
ccaggccagagg

SEQ ID NO: 1523506 - RNA, 14 nt, Human
ccaggccccugcca

SEQ ID NO: 1523507 - RNA, 15 nt, Human
ccaggccccugccac

SEQ ID NO: 1523508 - RNA, 16 nt, Human
ccaggccccugccacc

SEQ ID NO: 1523509 - RNA, 15 nt, Human
ccaggaggccagccu

SEQ ID NO: 1523510 - RNA, 18 nt, Human
ccaggaggccagccuuga

SEQ ID NO: 1523511 - RNA, 20 nt, Human
ccaggaggccagccuugacc

SEQ ID NO: 1523512 - RNA, 20 nt, Human
ccagguagaggguguguaag

SEQ ID NO: 1523513 - RNA, 23 nt, Human
ccagugcccacaggaucagucug

SEQ ID NO: 1523514 - RNA, 20 nt, Human
ccauccugaggcuccacuug

SEQ ID NO: 1523515 - RNA, 18 nt, Human
ccauccugaggcuccacu

SEQ ID NO: 1523516 - RNA, 17 nt, Human
ccaucauugaaaucuuu

SEQ ID NO: 1523517 - RNA, 14 nt, Human
ccaucauugaaauc

SEQ ID NO: 1523518 - RNA, 16 nt, Human
ccaucauugaaaucuu

SEQ ID NO: 1523519 - RNA, 14 nt, Human
ccaucucacacaug

SEQ ID NO: 1523520 - RNA, 15 nt, Human
ccaucucacacauga

SEQ ID NO: 1523521 - RNA, 17 nt, Human
ccaucucacacaugagc

SEQ ID NO: 1523522 - RNA, 18 nt, Human
ccaucucacacaugagca

SEQ ID NO: 1523523 - RNA, 20 nt, Human
ccaucucacacaugagcauc

SEQ ID NO: 1523524 - RNA, 21 nt, Human
ccaucucacacaugagcauca

SEQ ID NO: 1523525 - RNA, 15 nt, Human
ccaucucuccuccuu

SEQ ID NO: 1523526 - RNA, 19 nt, Human
ccauauuaccacagacaua

SEQ ID NO: 1523527 - RNA, 16 nt, Human
ccaucaagccaccaac

SEQ ID NO: 1523528 - RNA, 13 nt, Human
ccaucaagccacc

SEQ ID NO: 1523529 - RNA, 14 nt, Human
ccaucaagccacca

SEQ ID NO: 1523530 - RNA, 12 nt, Human
ccaucaugucug

SEQ ID NO: 1523531 - RNA, 13 nt, Human
ccaucaugucugg

SEQ ID NO: 1523532 - RNA, 12 nt, Human
ccaucauugaaa

SEQ ID NO: 1523533 - RNA, 15 nt, Human
ccauaugccugggca

SEQ ID NO: 1523534 - RNA, 14 nt, Human
ccagugugacaagg

SEQ ID NO: 1523535 - RNA, 23 nt, Human
ccagugugacaaggauugcuacu

SEQ ID NO: 1523536 - RNA, 14 nt, Human
ccagguagaacaca

SEQ ID NO: 1523537 - RNA, 12 nt, Human
ccaggugccagu

SEQ ID NO: 1523538 - RNA, 13 nt, Human
ccaggugccaguu

SEQ ID NO: 1523539 - RNA, 22 nt, Human
ccaguaaaugggggugcauuug

SEQ ID NO: 1523540 - RNA, 21 nt, Human
ccaguaaaugggggugcauuu

SEQ ID NO: 1523541 - RNA, 20 nt, Human
ccaguaaaugggggugcauu

SEQ ID NO: 1523542 - RNA, 13 nt, Human
ccagguuuaagcu

SEQ ID NO: 1523543 - RNA, 16 nt, Human
ccagguuucuaugugu

SEQ ID NO: 1523544 - RNA, 23 nt, Human
ccagugcaguuugguguguccuc

SEQ ID NO: 1523545 - RNA, 13 nt, Human
ccagugaggcucu

SEQ ID NO: 1523546 - RNA, 21 nt, Human
ccagugaugcuaaagguugua

SEQ ID NO: 1523547 - RNA, 17 nt, Human
ccaguggccuuccccag

SEQ ID NO: 1523548 - RNA, 19 nt, Human
ccaguggccuuccccagca

SEQ ID NO: 1523549 - RNA, 23 nt, Human
ccaguaaaugggggugcauuuga

SEQ ID NO: 1523550 - RNA, 23 nt, Human
ccagugaauucuugaaggaaaau

SEQ ID NO: 1523551 - RNA, 16 nt, Human
ccagacccggcugcgu

SEQ ID NO: 1523552 - RNA, 14 nt, Human
ccagacccggcugc

SEQ ID NO: 1523553 - RNA, 15 nt, Human
ccagacccggcugcg

SEQ ID NO: 1523554 - RNA, 14 nt, Human
ccagacaucaacag

SEQ ID NO: 1523555 - RNA, 22 nt, Human
ccagacacauguccaagaagcc

SEQ ID NO: 1523556 - RNA, 17 nt, Human
ccagacacauguccaag

SEQ ID NO: 1523557 - RNA, 20 nt, Human
ccagacacauguccaagaag

SEQ ID NO: 1523558 - RNA, 22 nt, Human
ccagaagaaaauagugguguga

SEQ ID NO: 1523559 - RNA, 19 nt, Human
ccacugugccaugugccag

SEQ ID NO: 1523560 - RNA, 15 nt, Human
ccacugugccaugug

SEQ ID NO: 1523561 - RNA, 16 nt, Human
ccacugugccaugugc

SEQ ID NO: 1523562 - RNA, 22 nt, Human
ccacugcuuuuggucuguguga

SEQ ID NO: 1523563 - RNA, 20 nt, Human
ccacugcuuuuggucugugu

SEQ ID NO: 1523564 - RNA, 12 nt, Human
ccacugcucugg

SEQ ID NO: 1523565 - RNA, 13 nt, Human
ccacugcucuggu

SEQ ID NO: 1523566 - RNA, 15 nt, Human
ccacugcucugguua

SEQ ID NO: 1523567 - RNA, 23 nt, Human
ccacuggugacaugucuuuucuu

SEQ ID NO: 1523568 - RNA, 15 nt, Human
ccacugguucuucuu

SEQ ID NO: 1523569 - RNA, 14 nt, Human
ccacugugaagaga

SEQ ID NO: 1523570 - RNA, 15 nt, Human
ccacugugaagagaa

SEQ ID NO: 1523571 - RNA, 21 nt, Human
ccacugcaucguuucaucuuc

SEQ ID NO: 1523572 - RNA, 23 nt, Human
ccacugcaucguuucaucuucca

SEQ ID NO: 1523573 - RNA, 14 nt, Human
ccacccuccuuuca

SEQ ID NO: 1523574 - RNA, 19 nt, Human
ccacccccacccaagggcc

SEQ ID NO: 1523575 - RNA, 14 nt, Human
ccaccucucucacu

SEQ ID NO: 1523576 - RNA, 16 nt, Human
ccaccucucucacucc

SEQ ID NO: 1523577 - RNA, 19 nt, Human
ccaccucucucacuccuug

SEQ ID NO: 1523578 - RNA, 20 nt, Human
ccaccucucucacuccuuga

SEQ ID NO: 1523579 - RNA, 11 nt, Human
ccacccugcuc

SEQ ID NO: 1523580 - RNA, 13 nt, Human
ccacccugcucuc

SEQ ID NO: 1523581 - RNA, 12 nt, Human
ccacccugcucu

SEQ ID NO: 1523582 - RNA, 14 nt, Human
ccaccuggccucug

SEQ ID NO: 1523583 - RNA, 13 nt, Human
ccaccuggccucu

SEQ ID NO: 1523584 - RNA, 20 nt, Human
ccaccuggccucugcacucc

SEQ ID NO: 1523585 - RNA, 13 nt, Human
ccaccugccaggg

SEQ ID NO: 1523586 - RNA, 14 nt, Human
ccaccugccaggga

SEQ ID NO: 1523587 - RNA, 15 nt, Human
ccaccugccagggac

SEQ ID NO: 1523588 - RNA, 16 nt, Human
ccaccugccagggaca

SEQ ID NO: 1523589 - RNA, 13 nt, Human
ccaccuuggcuca

SEQ ID NO: 1523590 - RNA, 23 nt, Human
ccagccuugaccauucuccaccu

SEQ ID NO: 1523591 - RNA, 13 nt, Human
ccagcgagcccug

SEQ ID NO: 1523592 - RNA, 13 nt, Human
ccagccuggguga

SEQ ID NO: 1523593 - RNA, 19 nt, Human
ccagcaggcucucaggcca

SEQ ID NO: 1523594 - RNA, 20 nt, Human
ccagcaggcucucaggccag

SEQ ID NO: 1523595 - RNA, 21 nt, Human
ccagcaggcucucaggccagc

SEQ ID NO: 1523596 - RNA, 23 nt, Human
ccagcaggcucucaggccagcug

SEQ ID NO: 1523597 - RNA, 16 nt, Human
ccagcccacuucugcc

SEQ ID NO: 1523598 - RNA, 17 nt, Human
ccagcccacuucugcca

SEQ ID NO: 1523599 - RNA, 17 nt, Human
ccagccgagauagccaa

SEQ ID NO: 1523600 - RNA, 20 nt, Human
ccagccgagauagccaaggc

SEQ ID NO: 1523601 - RNA, 22 nt, Human
ccagccgagauagccaaggcca

SEQ ID NO: 1523602 - RNA, 23 nt, Human
ccagccgagauagccaaggccaa

SEQ ID NO: 1523603 - RNA, 19 nt, Human
ccagccccaaaacucuccu

SEQ ID NO: 1523604 - RNA, 17 nt, Human
ccagcaccaucucuccu

SEQ ID NO: 1523605 - RNA, 18 nt, Human
ccagcaccaucucuccuc

SEQ ID NO: 1523606 - RNA, 16 nt, Human
ccagcaggcucucagg

SEQ ID NO: 1523607 - RNA, 17 nt, Human
ccagcaggcucucaggc

SEQ ID NO: 1523608 - RNA, 18 nt, Human
ccagcaggcucucaggcc

SEQ ID NO: 1523609 - RNA, 17 nt, Human
ccagcaagugagagcug

SEQ ID NO: 1523610 - RNA, 18 nt, Human
ccagcaagugagagcugg

SEQ ID NO: 1523611 - RNA, 19 nt, Human
ccagcaagugagagcuggg

SEQ ID NO: 1523612 - RNA, 20 nt, Human
ccagcaagugagagcugggu

SEQ ID NO: 1523613 - RNA, 14 nt, Human
ccagagcccaccuu

SEQ ID NO: 1523614 - RNA, 14 nt, Human
ccagauugcaacag

SEQ ID NO: 1523615 - RNA, 16 nt, Human
ccagauugcaacaggc

SEQ ID NO: 1523616 - RNA, 16 nt, Human
ccagauuggcucacac

SEQ ID NO: 1523617 - RNA, 23 nt, Human
ccagauugcaacaggcugggcuu

SEQ ID NO: 1523618 - RNA, 18 nt, Human
ccagauugcaacaggcug

SEQ ID NO: 1523619 - RNA, 22 nt, Human
ccagauugcaacaggcugggcu

SEQ ID NO: 1523620 - RNA, 18 nt, Human
ccagauuucacucuccuu

SEQ ID NO: 1523621 - RNA, 19 nt, Human
ccagauuucacucuccuug

SEQ ID NO: 1523622 - RNA, 19 nt, Human
ccagauuggcucacacuga

SEQ ID NO: 1523623 - RNA, 20 nt, Human
ccagauuggcucacacugag

SEQ ID NO: 1523624 - RNA, 21 nt, Human
ccagauuggcucacacugaga

SEQ ID NO: 1523625 - RNA, 22 nt, Human
ccagauuggcucacacugagaa

SEQ ID NO: 1523626 - RNA, 15 nt, Human
caaccuccugggcua

SEQ ID NO: 1523627 - RNA, 14 nt, Human
caaccuccugggcu

SEQ ID NO: 1523628 - RNA, 13 nt, Human
caacgucugugcc

SEQ ID NO: 1523629 - RNA, 14 nt, Human
caacgucugugcca

SEQ ID NO: 1523630 - RNA, 18 nt, Human
caacacucauugaccuga

SEQ ID NO: 1523631 - RNA, 20 nt, Human
caacacucauugaccugagg

SEQ ID NO: 1523632 - RNA, 22 nt, Human
caacacucauugaccugaggcc

SEQ ID NO: 1523633 - RNA, 19 nt, Human
caagacugcacaucaaaau

SEQ ID NO: 1523634 - RNA, 18 nt, Human
caagacucuuuggacacu

SEQ ID NO: 1523635 - RNA, 14 nt, Human
caagagcccaggcc

SEQ ID NO: 1523636 - RNA, 15 nt, Human
caagagcccaggccu

SEQ ID NO: 1523637 - RNA, 19 nt, Human
caagacgcugugcugcccu

SEQ ID NO: 1523638 - RNA, 18 nt, Human
caagacgcugugcugccc

SEQ ID NO: 1523639 - RNA, 16 nt, Human
caagagcccaggccuc

SEQ ID NO: 1523640 - RNA, 17 nt, Human
caagagcccaggccucc

SEQ ID NO: 1523641 - RNA, 15 nt, Human
caagcaccuccugcc

SEQ ID NO: 1523642 - RNA, 16 nt, Human
caagcaccuccugccu

SEQ ID NO: 1523643 - RNA, 17 nt, Human
caagcaccuccugccuc

SEQ ID NO: 1523644 - RNA, 18 nt, Human
caagaaaacaacuucaau

SEQ ID NO: 1523645 - RNA, 15 nt, Human
caagaaaacaacuuc

SEQ ID NO: 1523646 - RNA, 20 nt, Human
caagaacuuuccaggaaggc

SEQ ID NO: 1523647 - RNA, 16 nt, Human
caagaccuucuccuuc

SEQ ID NO: 1523648 - RNA, 17 nt, Human
caagaccuucuccuuca

SEQ ID NO: 1523649 - RNA, 18 nt, Human
caagaccuucuccuucac

SEQ ID NO: 1523650 - RNA, 16 nt, Human
caagacgcugugcugc

SEQ ID NO: 1523651 - RNA, 17 nt, Human
caagacgcugugcugcc

SEQ ID NO: 1523652 - RNA, 21 nt, Human
caagccagauuuuccugaaaa

SEQ ID NO: 1523653 - RNA, 18 nt, Human
caagcaccuccugccucg

SEQ ID NO: 1523654 - RNA, 14 nt, Human
caagcaggacaugg

SEQ ID NO: 1523655 - RNA, 18 nt, Human
caagcaggacauggacaa

SEQ ID NO: 1523656 - RNA, 19 nt, Human
caagcgauucuucugcuuc

SEQ ID NO: 1523657 - RNA, 20 nt, Human
caagcgauucuucugcuuca

SEQ ID NO: 1523658 - RNA, 22 nt, Human
caagcgauucuucugcuucagc

SEQ ID NO: 1523659 - RNA, 17 nt, Human
caaggcugauuaaacca

SEQ ID NO: 1523660 - RNA, 17 nt, Human
caagcuggucccacuca

SEQ ID NO: 1523661 - RNA, 19 nt, Human
caagcuggucccacucagu

SEQ ID NO: 1523662 - RNA, 14 nt, Human
caaguccucuuuuc

SEQ ID NO: 1523663 - RNA, 20 nt, Human
caaggucauuuuuuuuaaga

SEQ ID NO: 1523664 - RNA, 14 nt, Human
caaggucauuuuuu

SEQ ID NO: 1523665 - RNA, 18 nt, Human
caaggggcccaaauucuu

SEQ ID NO: 1523666 - RNA, 12 nt, Human
caaggcugcagu

SEQ ID NO: 1523667 - RNA, 15 nt, Human
caaggcugcagugag

SEQ ID NO: 1523668 - RNA, 23 nt, Human
caaggcugucaauuacaggaagu

SEQ ID NO: 1523669 - RNA, 14 nt, Human
caaguuaaauaaau

SEQ ID NO: 1523670 - RNA, 18 nt, Human
caagugagagcugggugu

SEQ ID NO: 1523671 - RNA, 21 nt, Human
caaguccucuuuucugagagg

SEQ ID NO: 1523672 - RNA, 14 nt, Human
caagugagagcugg

SEQ ID NO: 1523673 - RNA, 15 nt, Human
caagugagagcuggg

SEQ ID NO: 1523674 - RNA, 17 nt, Human
caagugagagcugggug

SEQ ID NO: 1523675 - RNA, 15 nt, Human
caaugugauaaaacc

SEQ ID NO: 1523676 - RNA, 17 nt, Human
caaugugauaaaacccc

SEQ ID NO: 1523677 - RNA, 16 nt, Human
caauuacaggaaguac

SEQ ID NO: 1523678 - RNA, 17 nt, Human
caauuacaggaaguacu

SEQ ID NO: 1523679 - RNA, 23 nt, Human
caauucucauuugucacacacuu

SEQ ID NO: 1523680 - RNA, 17 nt, Human
caaugcacuuuguucug

SEQ ID NO: 1523681 - RNA, 22 nt, Human
caaugcacuuuguucuggcucu

SEQ ID NO: 1523682 - RNA, 20 nt, Human
caaugcacuuuguucuggcu

SEQ ID NO: 1523683 - RNA, 21 nt, Human
caaugcacuuuguucuggcuc

SEQ ID NO: 1523684 - RNA, 23 nt, Human
caaugaccuuucaauaggaaaaa

SEQ ID NO: 1523685 - RNA, 18 nt, Human
caaugacuuacuguacau

SEQ ID NO: 1523686 - RNA, 17 nt, Human
caaugacuuacuguaca

SEQ ID NO: 1523687 - RNA, 15 nt, Human
caaugacuuacugua

SEQ ID NO: 1523688 - RNA, 17 nt, Human
caauauucgcuguguca

SEQ ID NO: 1523689 - RNA, 23 nt, Human
caauacaucccuuaccugggaaa

SEQ ID NO: 1523690 - RNA, 12 nt, Human
caauaggaaaaa

SEQ ID NO: 1523691 - RNA, 13 nt, Human
caauaggaaaaac

SEQ ID NO: 1523692 - RNA, 14 nt, Human
caauguucucucuu

SEQ ID NO: 1523693 - RNA, 14 nt, Human
caauaggaaaaacu

SEQ ID NO: 1523694 - RNA, 21 nt, Human
caaauacgugggcauucaaau

SEQ ID NO: 1523695 - RNA, 22 nt, Human
caaauacgugggcauucaaaug

SEQ ID NO: 1523696 - RNA, 20 nt, Human
caaauacgugggcauucaaa

SEQ ID NO: 1523697 - RNA, 22 nt, Human
caaagggggaggcuaaagccca

SEQ ID NO: 1523698 - RNA, 23 nt, Human
caaagugcugggauuacaggugu

SEQ ID NO: 1523699 - RNA, 19 nt, Human
caaagugcugggauuacag

SEQ ID NO: 1523700 - RNA, 19 nt, Human
caaaggguaucaggugcug

SEQ ID NO: 1523701 - RNA, 21 nt, Human
caaauaugcaaagcacugacu

SEQ ID NO: 1523702 - RNA, 15 nt, Human
caaaugucuauaaac

SEQ ID NO: 1523703 - RNA, 14 nt, Human
caaaugucuauaaa

SEQ ID NO: 1523704 - RNA, 15 nt, Human
caaauugugugaaag

SEQ ID NO: 1523705 - RNA, 14 nt, Human
caaauuucuaaauc

SEQ ID NO: 1523706 - RNA, 12 nt, Human
caaauuucuaaa

SEQ ID NO: 1523707 - RNA, 11 nt, Human
caaauuucuaa

SEQ ID NO: 1523708 - RNA, 14 nt, Human
caaaggaagcacau

SEQ ID NO: 1523709 - RNA, 16 nt, Human
caaaggguaucaggug

SEQ ID NO: 1523710 - RNA, 18 nt, Human
caaaggguaucaggugcu

SEQ ID NO: 1523711 - RNA, 13 nt, Human
caaaggaagcaca

SEQ ID NO: 1523712 - RNA, 19 nt, Human
caaagcugaugacaacuuc

SEQ ID NO: 1523713 - RNA, 13 nt, Human
caaagcuaggccu

SEQ ID NO: 1523714 - RNA, 14 nt, Human
caaagcuaggccug

SEQ ID NO: 1523715 - RNA, 19 nt, Human
caaagcuaggccuggccag

SEQ ID NO: 1523716 - RNA, 15 nt, Human
caaagcuaggccugg

SEQ ID NO: 1523717 - RNA, 17 nt, Human
caaagccuccuccagcc

SEQ ID NO: 1523718 - RNA, 18 nt, Human
caaagccuccuccagccg

SEQ ID NO: 1523719 - RNA, 17 nt, Human
caaacucaccugccccu

SEQ ID NO: 1523720 - RNA, 16 nt, Human
caaaauuuuuucucua

SEQ ID NO: 1523721 - RNA, 21 nt, Human
caaaauuuuuucucuaggaaa

SEQ ID NO: 1523722 - RNA, 22 nt, Human
caaaauuuuuucucuaggaaau

SEQ ID NO: 1523723 - RNA, 15 nt, Human
caaacacauacagga

SEQ ID NO: 1523724 - RNA, 20 nt, Human
caaacccuucagugccaaaa

SEQ ID NO: 1523725 - RNA, 22 nt, Human
caaaauugauguguuuauuuau

SEQ ID NO: 1523726 - RNA, 15 nt, Human
caaaauugauguguu

SEQ ID NO: 1523727 - RNA, 16 nt, Human
caaaauugauguguuu

SEQ ID NO: 1523728 - RNA, 14 nt, Human
caaaauaaaacuuu

SEQ ID NO: 1523729 - RNA, 12 nt, Human
caaaauaaaacu

SEQ ID NO: 1523730 - RNA, 15 nt, Human
caaaauguaggguua

SEQ ID NO: 1523731 - RNA, 19 nt, Human
caaaaaucucaauauuuca

SEQ ID NO: 1523732 - RNA, 17 nt, Human
caaaauaaaaaugaggu

SEQ ID NO: 1523733 - RNA, 23 nt, Human
caaaacuucagacauagaauuaa

SEQ ID NO: 1523734 - RNA, 23 nt, Human
caaaacucuccucugcugcuggc

SEQ ID NO: 1523735 - RNA, 22 nt, Human
caaaacucuccucugcugcugg

SEQ ID NO: 1523736 - RNA, 20 nt, Human
caaaacucuccucugcugcu

SEQ ID NO: 1523737 - RNA, 21 nt, Human
caaaacucuccucugcugcug

SEQ ID NO: 1523738 - RNA, 13 nt, Human
caaaaaggcagga

SEQ ID NO: 1523739 - RNA, 20 nt, Human
caaaaacauggccuuugcuu

SEQ ID NO: 1523740 - RNA, 15 nt, Human
caaaaacacagcaag

SEQ ID NO: 1523741 - RNA, 17 nt, Human
caaaaacacagcaaggg

SEQ ID NO: 1523742 - RNA, 13 nt, Human
caaaaacacagca

SEQ ID NO: 1523743 - RNA, 14 nt, Human
caaaaacacagcaa

SEQ ID NO: 1523744 - RNA, 13 nt, Human
auuuuccugaaaa

SEQ ID NO: 1523745 - RNA, 21 nt, Human
auuuugggguacccacugcuc

SEQ ID NO: 1523746 - RNA, 22 nt, Human
auuuugggguacccacugcucu

SEQ ID NO: 1523747 - RNA, 23 nt, Human
auuuugggguacccacugcucug

SEQ ID NO: 1523748 - RNA, 17 nt, Human
auuuugguuuuguuccc

SEQ ID NO: 1523749 - RNA, 21 nt, Human
auuuugguuuuguuccccucc

SEQ ID NO: 1523750 - RNA, 22 nt, Human
auuuugguuuuguuccccuccu

SEQ ID NO: 1523751 - RNA, 23 nt, Human
auuuugguuuuguuccccuccuc

SEQ ID NO: 1523752 - RNA, 16 nt, Human
auuuugguuuuguucc

SEQ ID NO: 1523753 - RNA, 19 nt, Human
cacagugaucaaguuauuu

SEQ ID NO: 1523754 - RNA, 19 nt, Human
cacaggcagguccaggguu

SEQ ID NO: 1523755 - RNA, 22 nt, Human
cacagugagucgaggacaggga

SEQ ID NO: 1523756 - RNA, 13 nt, Human
cacaguccuuacc

SEQ ID NO: 1523757 - RNA, 15 nt, Human
cacaguccuuaccag

SEQ ID NO: 1523758 - RNA, 21 nt, Human
cacaguccuuaccagcagagc

SEQ ID NO: 1523759 - RNA, 22 nt, Human
cacaguccuuaccagcagagca

SEQ ID NO: 1523760 - RNA, 14 nt, Human
cacaguucucuccu

SEQ ID NO: 1523761 - RNA, 15 nt, Human
cacaguucucuccuu

SEQ ID NO: 1523762 - RNA, 11 nt, Human
cacaggcaggu

SEQ ID NO: 1523763 - RNA, 14 nt, Human
cacaggcaggucca

SEQ ID NO: 1523764 - RNA, 15 nt, Human
cacaggcagguccag

SEQ ID NO: 1523765 - RNA, 21 nt, Human
cacagcuucauuuccuguguc

SEQ ID NO: 1523766 - RNA, 22 nt, Human
cacagcuucauuuccugugucu

SEQ ID NO: 1523767 - RNA, 22 nt, Human
cacagcugggguggggaccuca

SEQ ID NO: 1523768 - RNA, 23 nt, Human
cacagcugggguggggaccucag

SEQ ID NO: 1523769 - RNA, 16 nt, Human
cacaguuuucugagaa

SEQ ID NO: 1523770 - RNA, 17 nt, Human
cacaguuuucugagaaa

SEQ ID NO: 1523771 - RNA, 19 nt, Human
cacaguuuucugagaaaga

SEQ ID NO: 1523772 - RNA, 20 nt, Human
cacaguuuucugagaaagac

SEQ ID NO: 1523773 - RNA, 16 nt, Human
auugucaaagugguga

SEQ ID NO: 1523774 - RNA, 17 nt, Human
auuguccccgacccuug

SEQ ID NO: 1523775 - RNA, 19 nt, Human
auuguccccgacccuugcc

SEQ ID NO: 1523776 - RNA, 20 nt, Human
auuguccccgacccuugccg

SEQ ID NO: 1523777 - RNA, 18 nt, Human
auugugucucuugguccu

SEQ ID NO: 1523778 - RNA, 14 nt, Human
auugugucucuugg

SEQ ID NO: 1523779 - RNA, 17 nt, Human
auucuccuuguguuacu

SEQ ID NO: 1523780 - RNA, 23 nt, Human
auucuccuucagcccucaccccu

SEQ ID NO: 1523781 - RNA, 14 nt, Human
auucuuauuuaaug

SEQ ID NO: 1523782 - RNA, 18 nt, Human
auucuuauuuaaugaaag

SEQ ID NO: 1523783 - RNA, 13 nt, Human
auucuuauuuaau

SEQ ID NO: 1523784 - RNA, 22 nt, Human
auucuuccucccucccucuuuc

SEQ ID NO: 1523785 - RNA, 13 nt, Human
auucuucuccacu

SEQ ID NO: 1523786 - RNA, 18 nt, Human
auugacccacaagaaaug

SEQ ID NO: 1523787 - RNA, 21 nt, Human
auugacccacaagaaaugaaa

SEQ ID NO: 1523788 - RNA, 14 nt, Human
auuugaaauauuga

SEQ ID NO: 1523789 - RNA, 15 nt, Human
auuugaaaauuuuga

SEQ ID NO: 1523790 - RNA, 14 nt, Human
auuugaaaauuuug

SEQ ID NO: 1523791 - RNA, 17 nt, Human
auuuccguuaaaauacc

SEQ ID NO: 1523792 - RNA, 16 nt, Human
auuuccguuaaaauac

SEQ ID NO: 1523793 - RNA, 15 nt, Human
auuuccguuaaaaua

SEQ ID NO: 1523794 - RNA, 19 nt, Human
auuuauuuuaauaauguuu

SEQ ID NO: 1523795 - RNA, 20 nt, Human
auuuauuuuaauaauguuuc

SEQ ID NO: 1523796 - RNA, 12 nt, Human
auuucauuucuu

SEQ ID NO: 1523797 - RNA, 17 nt, Human
auuuccagccaaagccu

SEQ ID NO: 1523798 - RNA, 17 nt, Human
auuuauuuuaauaaugu

SEQ ID NO: 1523799 - RNA, 13 nt, Human
auuuauucugcuc

SEQ ID NO: 1523800 - RNA, 13 nt, Human
auuuagauguaua

SEQ ID NO: 1523801 - RNA, 18 nt, Human
auuuaguauuuuguuuca

SEQ ID NO: 1523802 - RNA, 12 nt, Human
auuuaacagaaa

SEQ ID NO: 1523803 - RNA, 14 nt, Human
auuuaacagaaaug

SEQ ID NO: 1523804 - RNA, 15 nt, Human
auuuaacagaaaugu

SEQ ID NO: 1523805 - RNA, 17 nt, Human
auuuacuucuuauacau

SEQ ID NO: 1523806 - RNA, 14 nt, Human
auuuacuucuuaua

SEQ ID NO: 1523807 - RNA, 16 nt, Human
auuuacuucuuauaca

SEQ ID NO: 1523808 - RNA, 15 nt, Human
auuuagaaauauaau

SEQ ID NO: 1523809 - RNA, 14 nt, Human
auuuauucugcuca

SEQ ID NO: 1523810 - RNA, 22 nt, Human
auuuucaguuauuauauuuaca

SEQ ID NO: 1523811 - RNA, 14 nt, Human
auuuucagaaaaua

SEQ ID NO: 1523812 - RNA, 17 nt, Human
auuuucagaaaauauua

SEQ ID NO: 1523813 - RNA, 18 nt, Human
auuuuaaaagaaugauua

SEQ ID NO: 1523814 - RNA, 22 nt, Human
auuuuaaaagaaugauuaugaa

SEQ ID NO: 1523815 - RNA, 16 nt, Human
auuuuacauaaauuua

SEQ ID NO: 1523816 - RNA, 17 nt, Human
auuuuacauaaauuuag

SEQ ID NO: 1523817 - RNA, 15 nt, Human
auuuuaauucaguug

SEQ ID NO: 1523818 - RNA, 18 nt, Human
auuuguauaaaauaauuu

SEQ ID NO: 1523819 - RNA, 19 nt, Human
auuuguauaaaauaauuuu

SEQ ID NO: 1523820 - RNA, 21 nt, Human
auuuguauaaaauaauuuuua

SEQ ID NO: 1523821 - RNA, 17 nt, Human
auuuuaaaagaaugauu

SEQ ID NO: 1523822 - RNA, 15 nt, Human
auuugugauacaaug

SEQ ID NO: 1523823 - RNA, 14 nt, Human
auuugugauacaau

SEQ ID NO: 1523824 - RNA, 20 nt, Human
augugcuaguaauuggaaag

SEQ ID NO: 1523825 - RNA, 24 nt, Human
auguggaguucaucuugaauugua

SEQ ID NO: 1523826 - RNA, 20 nt, Human
auguggaguucaucuugaau

SEQ ID NO: 1523827 - RNA, 19 nt, Human
augugcuaguaauuggaaa

SEQ ID NO: 1523828 - RNA, 20 nt, Human
uuuuaauaauguuucaaaca

SEQ ID NO: 1523829 - RNA, 16 nt, Human
uuuuaauaauguuuca

SEQ ID NO: 1523830 - RNA, 22 nt, Human
augugccagguuuuuggucuga

SEQ ID NO: 1523831 - RNA, 12 nt, Human
uuuuaauaaugu

SEQ ID NO: 1523832 - RNA, 13 nt, Human
uuuuaauaauguu

SEQ ID NO: 1523833 - RNA, 14 nt, Human
uuuuaauaauguuu

SEQ ID NO: 1523834 - RNA, 20 nt, Human
auggggcccugccuccuuug

SEQ ID NO: 1523835 - RNA, 12 nt, Human
auggggcugcac

SEQ ID NO: 1523836 - RNA, 20 nt, Human
auguugcccaggcaggucuu

SEQ ID NO: 1523837 - RNA, 18 nt, Human
auguucaucaaugaauga

SEQ ID NO: 1523838 - RNA, 17 nt, Human
auguugcccaggcaggu

SEQ ID NO: 1523839 - RNA, 12 nt, Human
auguugcccagg

SEQ ID NO: 1523840 - RNA, 14 nt, Human
uuuucucuaggaaa

SEQ ID NO: 1523841 - RNA, 16 nt, Human
uuuucucuaggaaaua

SEQ ID NO: 1523842 - RNA, 15 nt, Human
uuuucugagaaagac

SEQ ID NO: 1523843 - RNA, 18 nt, Human
uuuucugagaaagacuau

SEQ ID NO: 1523844 - RNA, 15 nt, Human
uuuuccaaaauaauu

SEQ ID NO: 1523845 - RNA, 20 nt, Human
uuuucauuuaggugaggaag

SEQ ID NO: 1523846 - RNA, 11 nt, Human
uuuuauuuuau

SEQ ID NO: 1523847 - RNA, 13 nt, Human
uuuuauuaugcau

SEQ ID NO: 1523848 - RNA, 15 nt, Human
auguuuucaggcuag

SEQ ID NO: 1523849 - RNA, 17 nt, Human
auguuuucaggcuagau

SEQ ID NO: 1523850 - RNA, 21 nt, Human
auguuuucaggcuagauguau

SEQ ID NO: 1523851 - RNA, 16 nt, Human
auuaaacuuaaucuaa

SEQ ID NO: 1523852 - RNA, 15 nt, Human
auuaaaagaauauuu

SEQ ID NO: 1523853 - RNA, 22 nt, Human
auuaaaaaucucaaauuucuaa

SEQ ID NO: 1523854 - RNA, 20 nt, Human
auuaaaaaucucaaauuucu

SEQ ID NO: 1523855 - RNA, 19 nt, Human
auuaaaaaucucaaauuuc

SEQ ID NO: 1523856 - RNA, 15 nt, Human
auuaaaaaucucaaa

SEQ ID NO: 1523857 - RNA, 14 nt, Human
uuuuguucauacau

SEQ ID NO: 1523858 - RNA, 23 nt, Human
uuuugugcauuaucuagauacug

SEQ ID NO: 1523859 - RNA, 20 nt, Human
uuuugugcauuaucuagaua

SEQ ID NO: 1523860 - RNA, 17 nt, Human
uuuugugcauuaucuag

SEQ ID NO: 1523861 - RNA, 21 nt, Human
uuuuguuccacaaguuaaaua

SEQ ID NO: 1523862 - RNA, 17 nt, Human
uuuuguucauacauauu

SEQ ID NO: 1523863 - RNA, 15 nt, Human
uuuuguuccacaagu

SEQ ID NO: 1523864 - RNA, 20 nt, Human
uuuuuaucgucacugcuuaa

SEQ ID NO: 1523865 - RNA, 12 nt, Human
uuuuuauggcuu

SEQ ID NO: 1523866 - RNA, 19 nt, Human
uuuuuauauuugaaauauu

SEQ ID NO: 1523867 - RNA, 23 nt, Human
uuuuuauacauaaacaagaccac

SEQ ID NO: 1523868 - RNA, 21 nt, Human
uuuuguuugguuauaucgaaa

SEQ ID NO: 1523869 - RNA, 11 nt, Human
uuuuuacuaau

SEQ ID NO: 1523870 - RNA, 13 nt, Human
uuuuguuugguua

SEQ ID NO: 1523871 - RNA, 16 nt, Human
uuuuguuugguuauau

SEQ ID NO: 1523872 - RNA, 22 nt, Human
uuuuuagacagagucucacugu

SEQ ID NO: 1523873 - RNA, 23 nt, Human
uuuugccauguuggccaggcugg

SEQ ID NO: 1523874 - RNA, 14 nt, Human
uuuugaguucuaca

SEQ ID NO: 1523875 - RNA, 15 nt, Human
uuuugauauaugaaa

SEQ ID NO: 1523876 - RNA, 17 nt, Human
uuuugauccaagcuggu

SEQ ID NO: 1523877 - RNA, 17 nt, Human
uuuugagugccuuacac

SEQ ID NO: 1523878 - RNA, 17 nt, Human
auuacauuuguauaaaa

SEQ ID NO: 1523879 - RNA, 18 nt, Human
auuacauuuguauaaaau

SEQ ID NO: 1523880 - RNA, 20 nt, Human
auuacauuuguauaaaauaa

SEQ ID NO: 1523881 - RNA, 21 nt, Human
auuacaguggggaaugaagau

SEQ ID NO: 1523882 - RNA, 14 nt, Human
auuaaguacuaugu

SEQ ID NO: 1523883 - RNA, 16 nt, Human
auuaaguacuauguau

SEQ ID NO: 1523884 - RNA, 15 nt, Human
uuuuuguguauuugu

SEQ ID NO: 1523885 - RNA, 17 nt, Human
uuuuuguagcacugaca

SEQ ID NO: 1523886 - RNA, 23 nt, Human
auuaaguaaugauaacuggaaac

SEQ ID NO: 1523887 - RNA, 22 nt, Human
uuuuuguuccacaaguuaaaua

SEQ ID NO: 1523888 - RNA, 19 nt, Human
uuuuugugaaaagcuccau

SEQ ID NO: 1523889 - RNA, 19 nt, Human
uuuuuguagagccaggguc

SEQ ID NO: 1523890 - RNA, 20 nt, Human
uuuuuguagagccagggucu

SEQ ID NO: 1523891 - RNA, 22 nt, Human
uuuuuauggcuuuugugcauua

SEQ ID NO: 1523892 - RNA, 21 nt, Human
uuuuuauggcuuuugugcauu

SEQ ID NO: 1523893 - RNA, 20 nt, Human
uuuuuauggcuuuugugcau

SEQ ID NO: 1523894 - RNA, 24 nt, Human
auuacuuacguauguuuguacuug

SEQ ID NO: 1523895 - RNA, 12 nt, Human
auuacuucugcu

SEQ ID NO: 1523896 - RNA, 20 nt, Human
auuauauaaguauucuaaau

SEQ ID NO: 1523897 - RNA, 14 nt, Human
auuauauaaguauu

SEQ ID NO: 1523898 - RNA, 17 nt, Human
auuauauaaguauucua

SEQ ID NO: 1523899 - RNA, 20 nt, Human
auucagauaugauucaaaug

SEQ ID NO: 1523900 - RNA, 18 nt, Human
auucagauaugauucaaa

SEQ ID NO: 1523901 - RNA, 20 nt, Human
auucaggaagcucagggccu

SEQ ID NO: 1523902 - RNA, 17 nt, Human
auucaggaagcucaggg

SEQ ID NO: 1523903 - RNA, 19 nt, Human
auucaggaagcucagggcc

SEQ ID NO: 1523904 - RNA, 15 nt, Human
auucaguaauaacuc

SEQ ID NO: 1523905 - RNA, 19 nt, Human
auucaguaauaacucuacc

SEQ ID NO: 1523906 - RNA, 14 nt, Human
auucaggaagcuca

SEQ ID NO: 1523907 - RNA, 17 nt, Human
auucccaagcucugcuc

SEQ ID NO: 1523908 - RNA, 16 nt, Human
auucccaagcucugcu

SEQ ID NO: 1523909 - RNA, 14 nt, Human
auucccaagcucug

SEQ ID NO: 1523910 - RNA, 15 nt, Human
auucccaagcucugc

SEQ ID NO: 1523911 - RNA, 20 nt, Human
auucuccugccucagccucc

SEQ ID NO: 1523912 - RNA, 19 nt, Human
auucuccugccucagccuc

SEQ ID NO: 1523913 - RNA, 15 nt, Human
auucuccugccucag

SEQ ID NO: 1523914 - RNA, 17 nt, Human
auucuccugccucagcc

SEQ ID NO: 1523915 - RNA, 16 nt, Human
auucuccuuguguuac

SEQ ID NO: 1523916 - RNA, 16 nt, Human
auucuccuucagcccu

SEQ ID NO: 1523917 - RNA, 17 nt, Human
auucuccuucagcccuc

SEQ ID NO: 1523918 - RNA, 18 nt, Human
auucuccuucagcccuca

SEQ ID NO: 1523919 - RNA, 22 nt, Human
auucuccuucagcccucacccc

SEQ ID NO: 1523920 - RNA, 13 nt, Human
auucuccuucagc

SEQ ID NO: 1523921 - RNA, 14 nt, Human
auucuccuucagcc

SEQ ID NO: 1523922 - RNA, 15 nt, Human
auucuccuucagccc

SEQ ID NO: 1523923 - RNA, 11 nt, Human
auucuccugcc

SEQ ID NO: 1523924 - RNA, 14 nt, Human
auucuccugccuca

SEQ ID NO: 1523925 - RNA, 13 nt, Human
auucuccugccuc

SEQ ID NO: 1523926 - RNA, 21 nt, Human
auucuccaccugccagggaca

SEQ ID NO: 1523927 - RNA, 14 nt, Human
auucuaaauuuuau

SEQ ID NO: 1523928 - RNA, 19 nt, Human
auucuccaccugccaggga

SEQ ID NO: 1523929 - RNA, 20 nt, Human
auucuccaccugccagggac

SEQ ID NO: 1523930 - RNA, 12 nt, Human
auugaaaucuuu

SEQ ID NO: 1523931 - RNA, 11 nt, Human
uugcucaugga

SEQ ID NO: 1523932 - RNA, 12 nt, Human
uugcucauggaa

SEQ ID NO: 1523933 - RNA, 19 nt, Human
uugcugaauacagaggcaa

SEQ ID NO: 1523934 - RNA, 20 nt, Human
uugcuaagugaggaugaaaa

SEQ ID NO: 1523935 - RNA, 17 nt, Human
uugcugauggugcaaug

SEQ ID NO: 1523936 - RNA, 18 nt, Human
uugcugauggugcaauga

SEQ ID NO: 1523937 - RNA, 19 nt, Human
uugcugauggugcaaugac

SEQ ID NO: 1523938 - RNA, 17 nt, Human
uuggaaagaguaggaag

SEQ ID NO: 1523939 - RNA, 21 nt, Human
augaaauauuauguuaaaacu

SEQ ID NO: 1523940 - RNA, 14 nt, Human
augaaaugagguca

SEQ ID NO: 1523941 - RNA, 20 nt, Human
augaaagacuguacaaagua

SEQ ID NO: 1523942 - RNA, 22 nt, Human
uuggcgcugccccuggcagccc

SEQ ID NO: 1523943 - RNA, 16 nt, Human
uuggcugcugaaggcu

SEQ ID NO: 1523944 - RNA, 18 nt, Human
uuggaaagaguaggaaga

SEQ ID NO: 1523945 - RNA, 23 nt, Human
uuggaaagaguaggaagacuuug

SEQ ID NO: 1523946 - RNA, 22 nt, Human
uuggcuagagguucaaagauau

SEQ ID NO: 1523947 - RNA, 22 nt, Human
uuggcuaggaccccuccaugug

SEQ ID NO: 1523948 - RNA, 21 nt, Human
uuggcuagagguucaaagaua

SEQ ID NO: 1523949 - RNA, 23 nt, Human
uuggcuauuagagaucaaccccu

SEQ ID NO: 1523950 - RNA, 14 nt, Human
uuggcugcagggag

SEQ ID NO: 1523951 - RNA, 11 nt, Human
uuggcugcuga

SEQ ID NO: 1523952 - RNA, 15 nt, Human
uuggcugcugaaggc

SEQ ID NO: 1523953 - RNA, 13 nt, Human
uuguauaaaauaa

SEQ ID NO: 1523954 - RNA, 15 nt, Human
uuguauaaaauaauu

SEQ ID NO: 1523955 - RNA, 20 nt, Human
uuguaaggaaugauuaauua

SEQ ID NO: 1523956 - RNA, 21 nt, Human
augaauuaguuuuauaugcuu

SEQ ID NO: 1523957 - RNA, 23 nt, Human
augaauuaguuuuauaugcuucu

SEQ ID NO: 1523958 - RNA, 19 nt, Human
augacacgaauauugcuga

SEQ ID NO: 1523959 - RNA, 20 nt, Human
augacacgaauauugcugau

SEQ ID NO: 1523960 - RNA, 19 nt, Human
uuggggaagaacgaagcca

SEQ ID NO: 1523961 - RNA, 17 nt, Human
uugggguacccacugcu

SEQ ID NO: 1523962 - RNA, 18 nt, Human
augaauuacauuuguaua

SEQ ID NO: 1523963 - RNA, 19 nt, Human
augaauuacauuuguauaa

SEQ ID NO: 1523964 - RNA, 22 nt, Human
augaauuacauuuguauaaaau

SEQ ID NO: 1523965 - RNA, 14 nt, Human
augaaaugacuucu

SEQ ID NO: 1523966 - RNA, 13 nt, Human
augaaccacaucu

SEQ ID NO: 1523967 - RNA, 20 nt, Human
augaaccacaucuugcucug

SEQ ID NO: 1523968 - RNA, 22 nt, Human
augaaccacaucuugcucugcu

SEQ ID NO: 1523969 - RNA, 14 nt, Human
uugguuuuguuccc

SEQ ID NO: 1523970 - RNA, 17 nt, Human
uugguuuuguuccccuc

SEQ ID NO: 1523971 - RNA, 19 nt, Human
uugguuaggcauuguggga

SEQ ID NO: 1523972 - RNA, 22 nt, Human
uugggguacccacugcucuggu

SEQ ID NO: 1523973 - RNA, 18 nt, Human
uugguuuuguuccccucc

SEQ ID NO: 1523974 - RNA, 14 nt, Human
uuguaaggaaugau

SEQ ID NO: 1523975 - RNA, 18 nt, Human
uugugaagcaaaauuuuu

SEQ ID NO: 1523976 - RNA, 13 nt, Human
uuguuccccuccu

SEQ ID NO: 1523977 - RNA, 14 nt, Human
uuguuccccuccuc

SEQ ID NO: 1523978 - RNA, 15 nt, Human
uuguuccccuccucc

SEQ ID NO: 1523979 - RNA, 23 nt, Human
uuguuccccuccuccacucuccc

SEQ ID NO: 1523980 - RNA, 16 nt, Human
uuguuccccuccucca

SEQ ID NO: 1523981 - RNA, 18 nt, Human
uuguuccccuccuccacu

SEQ ID NO: 1523982 - RNA, 19 nt, Human
uuguuccccuccuccacuc

SEQ ID NO: 1523983 - RNA, 20 nt, Human
uuguuccccuccuccacucu

SEQ ID NO: 1523984 - RNA, 23 nt, Human
augaucacggcucacugcagccu

SEQ ID NO: 1523985 - RNA, 16 nt, Human
augauccuaggcauuu

SEQ ID NO: 1523986 - RNA, 15 nt, Human
augaucuaggaagac

SEQ ID NO: 1523987 - RNA, 14 nt, Human
augaucuucuuuau

SEQ ID NO: 1523988 - RNA, 15 nt, Human
augaucacggcucac

SEQ ID NO: 1523989 - RNA, 18 nt, Human
augaucacggcucacugc

SEQ ID NO: 1523990 - RNA, 19 nt, Human
augaucacggcucacugca

SEQ ID NO: 1523991 - RNA, 16 nt, Human
augcaaggucauuuuu

SEQ ID NO: 1523992 - RNA, 14 nt, Human
augcaaggucauuu

SEQ ID NO: 1523993 - RNA, 14 nt, Human
augcaccuggaaua

SEQ ID NO: 1523994 - RNA, 16 nt, Human
augcaccuggaauaua

SEQ ID NO: 1523995 - RNA, 22 nt, Human
augcaaggucauuuuuuuuaag

SEQ ID NO: 1523996 - RNA, 15 nt, Human
augaucuucuuuaua

SEQ ID NO: 1523997 - RNA, 18 nt, Human
augaucuucuuuauaauu

SEQ ID NO: 1523998 - RNA, 16 nt, Human
augcaaaccaucauug

SEQ ID NO: 1523999 - RNA, 18 nt, Human
augcaaaccaucauugaa

SEQ ID NO: 1524000 - RNA, 19 nt, Human
augcaaaccaucauugaaa

SEQ ID NO: 1524001 - RNA, 20 nt, Human
augcaaaccaucauugaaau

SEQ ID NO: 1524002 - RNA, 21 nt, Human
augcaaaccaucauugaaauc

SEQ ID NO: 1524003 - RNA, 22 nt, Human
augcaaaccaucauugaaaucu

SEQ ID NO: 1524004 - RNA, 19 nt, Human
augcaccuggaauauauaa

SEQ ID NO: 1524005 - RNA, 14 nt, Human
augauaacuggaaa

SEQ ID NO: 1524006 - RNA, 15 nt, Human
augauaaaacacaaa

SEQ ID NO: 1524007 - RNA, 17 nt, Human
augaguggcuuuaauga

SEQ ID NO: 1524008 - RNA, 17 nt, Human
augagccucagcauccu

SEQ ID NO: 1524009 - RNA, 18 nt, Human
augagccucagcauccug

SEQ ID NO: 1524010 - RNA, 19 nt, Human
augagccucagcauccugg

SEQ ID NO: 1524011 - RNA, 15 nt, Human
augagcaucaggcca

SEQ ID NO: 1524012 - RNA, 16 nt, Human
augagcaucaggccag

SEQ ID NO: 1524013 - RNA, 17 nt, Human
augagcaucaggccagg

SEQ ID NO: 1524014 - RNA, 18 nt, Human
augagcaucaggccaggc

SEQ ID NO: 1524015 - RNA, 19 nt, Human
augagcaucaggccaggcc

SEQ ID NO: 1524016 - RNA, 20 nt, Human
augagcaucaggccaggccc

SEQ ID NO: 1524017 - RNA, 21 nt, Human
augagcaucaggccaggcccu

SEQ ID NO: 1524018 - RNA, 22 nt, Human
augagcaucaggccaggcccuc

SEQ ID NO: 1524019 - RNA, 12 nt, Human
augagccucagc

SEQ ID NO: 1524020 - RNA, 15 nt, Human
augagccucagcauc

SEQ ID NO: 1524021 - RNA, 16 nt, Human
augagccucagcaucc

SEQ ID NO: 1524022 - RNA, 16 nt, Human
augagaggaaaucacc

SEQ ID NO: 1524023 - RNA, 14 nt, Human
augagaggaaauca

SEQ ID NO: 1524024 - RNA, 15 nt, Human
augagaggaaaucac

SEQ ID NO: 1524025 - RNA, 19 nt, Human
augacauaaaaacaacuuu

SEQ ID NO: 1524026 - RNA, 12 nt, Human
augagaggaaau

SEQ ID NO: 1524027 - RNA, 13 nt, Human
augagaggaaauc

SEQ ID NO: 1524028 - RNA, 16 nt, Human
uuuaaagcuuccauug

SEQ ID NO: 1524029 - RNA, 24 nt, Human
uuuaaagcuuauuaaaacucauuu

SEQ ID NO: 1524030 - RNA, 18 nt, Human
augcuacacacugcaugu

SEQ ID NO: 1524031 - RNA, 17 nt, Human
augcuacacacugcaug

SEQ ID NO: 1524032 - RNA, 20 nt, Human
uuuaccuuuuuuauacauaa

SEQ ID NO: 1524033 - RNA, 19 nt, Human
uuuaccuuuuuuauacaua

SEQ ID NO: 1524034 - RNA, 14 nt, Human
uuuaccuuuuuuau

SEQ ID NO: 1524035 - RNA, 18 nt, Human
uuuacuaauagacaauuu

SEQ ID NO: 1524036 - RNA, 17 nt, Human
uuuacuaauagacaauu

SEQ ID NO: 1524037 - RNA, 14 nt, Human
uuuacuaauagaca

SEQ ID NO: 1524038 - RNA, 21 nt, Human
uuuaccuuuuuuauacauaaa

SEQ ID NO: 1524039 - RNA, 17 nt, Human
uuuauaugcuucuguuu

SEQ ID NO: 1524040 - RNA, 19 nt, Human
uuuauaugcuucuguuuua

SEQ ID NO: 1524041 - RNA, 19 nt, Human
uuuauuaaaugcccagccc

SEQ ID NO: 1524042 - RNA, 20 nt, Human
uuuagcuggaaaaguauguu

SEQ ID NO: 1524043 - RNA, 15 nt, Human
uuuaguagagacagg

SEQ ID NO: 1524044 - RNA, 13 nt, Human
uuuagauaauaca

SEQ ID NO: 1524045 - RNA, 18 nt, Human
uuuagaguugauacuaca

SEQ ID NO: 1524046 - RNA, 15 nt, Human
uuuagauaauacacc

SEQ ID NO: 1524047 - RNA, 23 nt, Human
auggaauuggagcucgugggaca

SEQ ID NO: 1524048 - RNA, 15 nt, Human
uuucauaugcuguau

SEQ ID NO: 1524049 - RNA, 19 nt, Human
uuuccagguuuaagcuguu

SEQ ID NO: 1524050 - RNA, 22 nt, Human
uuucagaaaauauuauguguuu

SEQ ID NO: 1524051 - RNA, 15 nt, Human
uuucacucuccuugg

SEQ ID NO: 1524052 - RNA, 24 nt, Human
uuucacucuuauugcccacgcugg

SEQ ID NO: 1524053 - RNA, 14 nt, Human
uuucacucuccuug

SEQ ID NO: 1524054 - RNA, 22 nt, Human
uuucaccccucccuuucucccc

SEQ ID NO: 1524055 - RNA, 13 nt, Human
uuucaccccuccc

SEQ ID NO: 1524056 - RNA, 14 nt, Human
uuucaccccucccu

SEQ ID NO: 1524057 - RNA, 15 nt, Human
uuucaccccucccuu

SEQ ID NO: 1524058 - RNA, 17 nt, Human
uuucaccccucccuuuc

SEQ ID NO: 1524059 - RNA, 18 nt, Human
uuucaccccucccuuucu

SEQ ID NO: 1524060 - RNA, 20 nt, Human
uuucaccccucccuuucucc

SEQ ID NO: 1524061 - RNA, 16 nt, Human
uuuauuuuaauaaugu

SEQ ID NO: 1524062 - RNA, 14 nt, Human
auggaauaacaugu

SEQ ID NO: 1524063 - RNA, 15 nt, Human
auggaauaacaugua

SEQ ID NO: 1524064 - RNA, 18 nt, Human
auggaacacucugagacu

SEQ ID NO: 1524065 - RNA, 17 nt, Human
auggaacacucugagac

SEQ ID NO: 1524066 - RNA, 16 nt, Human
auggaacauaaaauac

SEQ ID NO: 1524067 - RNA, 21 nt, Human
auggaaguacuauaauuuacc

SEQ ID NO: 1524068 - RNA, 19 nt, Human
uuuauuacuguaagaaaau

SEQ ID NO: 1524069 - RNA, 19 nt, Human
augcuguauauccuuucua

SEQ ID NO: 1524070 - RNA, 14 nt, Human
augcuguauuuuaa

SEQ ID NO: 1524071 - RNA, 19 nt, Human
augcuguauuuuaaaagaa

SEQ ID NO: 1524072 - RNA, 19 nt, Human
augcugugcccuaaagugu

SEQ ID NO: 1524073 - RNA, 21 nt, Human
uuucuaggacugaauuaugaa

SEQ ID NO: 1524074 - RNA, 17 nt, Human
uuucuaggacugaauua

SEQ ID NO: 1524075 - RNA, 22 nt, Human
uuucuaggacugaauuaugaaa

SEQ ID NO: 1524076 - RNA, 14 nt, Human
uuucuaaagcugcc

SEQ ID NO: 1524077 - RNA, 13 nt, Human
uuucuaugaaaua

SEQ ID NO: 1524078 - RNA, 14 nt, Human
uuucuaugaaauau

SEQ ID NO: 1524079 - RNA, 20 nt, Human
uuucuaugaaauauuauguu

SEQ ID NO: 1524080 - RNA, 21 nt, Human
uuucuaugacacaugcaaggu

SEQ ID NO: 1524081 - RNA, 15 nt, Human
uuucuaugacacaug

SEQ ID NO: 1524082 - RNA, 22 nt, Human
uuucuauuaaauuaaauuuugu

SEQ ID NO: 1524083 - RNA, 14 nt, Human
uuucugcaucagcu

SEQ ID NO: 1524084 - RNA, 17 nt, Human
uuucucccagucauuua

SEQ ID NO: 1524085 - RNA, 14 nt, Human
uuucugccgcagcc

SEQ ID NO: 1524086 - RNA, 16 nt, Human
uuucugccgcagcccu

SEQ ID NO: 1524087 - RNA, 14 nt, Human
uuugaaauauugac

SEQ ID NO: 1524088 - RNA, 15 nt, Human
uuugaaauauugacu

SEQ ID NO: 1524089 - RNA, 23 nt, Human
augggcuggguucuacccaggug

SEQ ID NO: 1524090 - RNA, 14 nt, Human
auggggcccugccu

SEQ ID NO: 1524091 - RNA, 13 nt, Human
auggggcccugcc

SEQ ID NO: 1524092 - RNA, 13 nt, Human
uuucuuuguggcu

SEQ ID NO: 1524093 - RNA, 22 nt, Human
augggacauuugcucauggaau

SEQ ID NO: 1524094 - RNA, 21 nt, Human
augggacauuugcucauggaa

SEQ ID NO: 1524095 - RNA, 21 nt, Human
auggcuauaggugcuacaaaa

SEQ ID NO: 1524096 - RNA, 23 nt, Human
auggcuauaggugcuacaaaaac

SEQ ID NO: 1524097 - RNA, 18 nt, Human
auggccucuucagaucuc

SEQ ID NO: 1524098 - RNA, 16 nt, Human
auggcuauaggugcua

SEQ ID NO: 1524099 - RNA, 19 nt, Human
auggcuauaggugcuacaa

SEQ ID NO: 1524100 - RNA, 21 nt, Human
auggacccaauauuuaccaga

SEQ ID NO: 1524101 - RNA, 17 nt, Human
auggaauuucucccagu

SEQ ID NO: 1524102 - RNA, 13 nt, Human
augggagcucaug

SEQ ID NO: 1524103 - RNA, 19 nt, Human
augggcaacccccagccug

SEQ ID NO: 1524104 - RNA, 21 nt, Human
augggcaacccccagccugcu

SEQ ID NO: 1524105 - RNA, 15 nt, Human
augggcagagcagag

SEQ ID NO: 1524106 - RNA, 13 nt, Human
augggcagagcag

SEQ ID NO: 1524107 - RNA, 14 nt, Human
augggcagagcaga

SEQ ID NO: 1524108 - RNA, 15 nt, Human
augggccuccugugu

SEQ ID NO: 1524109 - RNA, 11 nt, Human
uuuccuucagu

SEQ ID NO: 1524110 - RNA, 12 nt, Human
uuuccuucagug

SEQ ID NO: 1524111 - RNA, 15 nt, Human
uuuccuucagugccu

SEQ ID NO: 1524112 - RNA, 17 nt, Human
augggccuccugugugu

SEQ ID NO: 1524113 - RNA, 12 nt, Human
uuuccugugucu

SEQ ID NO: 1524114 - RNA, 23 nt, Human
uuuccuucauucaacccaccugc

SEQ ID NO: 1524115 - RNA, 18 nt, Human
uuuccuucagugccuuau

SEQ ID NO: 1524116 - RNA, 21 nt, Human
uuuccuucagugccuuaugga

SEQ ID NO: 1524117 - RNA, 22 nt, Human
uuuccuucagugccuuauggaa

SEQ ID NO: 1524118 - RNA, 21 nt, Human
uuuccuucauucaacccaccu

SEQ ID NO: 1524119 - RNA, 22 nt, Human
uuucgcaggauucuuccucccu

SEQ ID NO: 1524120 - RNA, 18 nt, Human
uuucgcaggauucuuccu

SEQ ID NO: 1524121 - RNA, 16 nt, Human
uucagauaugauucaa

SEQ ID NO: 1524122 - RNA, 17 nt, Human
uucagauaugauucaaa

SEQ ID NO: 1524123 - RNA, 18 nt, Human
uucagauaugauucaaau

SEQ ID NO: 1524124 - RNA, 19 nt, Human
uucagauaugauucaaaug

SEQ ID NO: 1524125 - RNA, 16 nt, Human
uucagaaauguguuau

SEQ ID NO: 1524126 - RNA, 13 nt, Human
uucagaaaauauu

SEQ ID NO: 1524127 - RNA, 17 nt, Human
uucagcgguuuauauaa

SEQ ID NO: 1524128 - RNA, 14 nt, Human
uucagccaagaauu

SEQ ID NO: 1524129 - RNA, 14 nt, Human
uucaggguuggccc

SEQ ID NO: 1524130 - RNA, 16 nt, Human
uucaggguuggccccu

SEQ ID NO: 1524131 - RNA, 17 nt, Human
uucaggguuggccccug

SEQ ID NO: 1524132 - RNA, 19 nt, Human
uucaggguuggccccugcc

SEQ ID NO: 1524133 - RNA, 22 nt, Human
uucaggguuggccccugcccgg

SEQ ID NO: 1524134 - RNA, 15 nt, Human
uucagguaacaggca

SEQ ID NO: 1524135 - RNA, 16 nt, Human
uucagguaacaggcag

SEQ ID NO: 1524136 - RNA, 13 nt, Human
auauaugcuaagu

SEQ ID NO: 1524137 - RNA, 15 nt, Human
uucaucaaugaauga

SEQ ID NO: 1524138 - RNA, 13 nt, Human
auauauuuuaauu

SEQ ID NO: 1524139 - RNA, 23 nt, Human
auauauuuauggccgggcagggu

SEQ ID NO: 1524140 - RNA, 21 nt, Human
auauauguuuuaagaggcagg

SEQ ID NO: 1524141 - RNA, 22 nt, Human
auauauguuuuaagaggcaggg

SEQ ID NO: 1524142 - RNA, 16 nt, Human
auauauuuaaugauaa

SEQ ID NO: 1524143 - RNA, 13 nt, Human
uucauaugcugua

SEQ ID NO: 1524144 - RNA, 16 nt, Human
uucagugaaagcauca

SEQ ID NO: 1524145 - RNA, 16 nt, Human
uucagugccaaaaaca

SEQ ID NO: 1524146 - RNA, 17 nt, Human
uucagguaacaggcaga

SEQ ID NO: 1524147 - RNA, 14 nt, Human
uucaguaagccgug

SEQ ID NO: 1524148 - RNA, 22 nt, Human
uucaugcuguucaugaaagauu

SEQ ID NO: 1524149 - RNA, 16 nt, Human
auauggggaugcagca

SEQ ID NO: 1524150 - RNA, 20 nt, Human
auauggggaugcagcauuau

SEQ ID NO: 1524151 - RNA, 23 nt, Human
auauguaccuaacgaaguauccu

SEQ ID NO: 1524152 - RNA, 20 nt, Human
auauguggaguucaucuuga

SEQ ID NO: 1524153 - RNA, 21 nt, Human
auauguggaguucaucuugaa

SEQ ID NO: 1524154 - RNA, 22 nt, Human
auaugagcuuccuucugugaaa

SEQ ID NO: 1524155 - RNA, 21 nt, Human
auaugagcuuccuucugugaa

SEQ ID NO: 1524156 - RNA, 15 nt, Human
auaugcaaagcacug

SEQ ID NO: 1524157 - RNA, 13 nt, Human
auaugcaaagcac

SEQ ID NO: 1524158 - RNA, 14 nt, Human
auaugcaaagcacu

SEQ ID NO: 1524159 - RNA, 15 nt, Human
uuccaggcugggaga

SEQ ID NO: 1524160 - RNA, 17 nt, Human
uuccaggcugggagagc

SEQ ID NO: 1524161 - RNA, 18 nt, Human
uuccagguuuaagcuguu

SEQ ID NO: 1524162 - RNA, 18 nt, Human
uuccaccaucaagccacc

SEQ ID NO: 1524163 - RNA, 22 nt, Human
uuccacaagagcccaggccucc

SEQ ID NO: 1524164 - RNA, 21 nt, Human
uuccacaagagcccaggccuc

SEQ ID NO: 1524165 - RNA, 22 nt, Human
uuccaauuuacauacucugcuu

SEQ ID NO: 1524166 - RNA, 14 nt, Human
uucauuaucucaaa

SEQ ID NO: 1524167 - RNA, 18 nt, Human
auauucucacagcuccaa

SEQ ID NO: 1524168 - RNA, 19 nt, Human
auauuaccacagacauacu

SEQ ID NO: 1524169 - RNA, 21 nt, Human
auauucucacagcuccaagaa

SEQ ID NO: 1524170 - RNA, 15 nt, Human
auauugauaugcuua

SEQ ID NO: 1524171 - RNA, 22 nt, Human
auauugcugauggugcaaugac

SEQ ID NO: 1524172 - RNA, 12 nt, Human
auauuuaaugau

SEQ ID NO: 1524173 - RNA, 13 nt, Human
auauuuaaugaua

SEQ ID NO: 1524174 - RNA, 23 nt, Human
auauuuaaugauaaguaaaugcu

SEQ ID NO: 1524175 - RNA, 13 nt, Human
auauuuacaaaug

SEQ ID NO: 1524176 - RNA, 14 nt, Human
auauuguuugcuaa

SEQ ID NO: 1524177 - RNA, 13 nt, Human
auauuguuuucag

SEQ ID NO: 1524178 - RNA, 17 nt, Human
auauuguuuucagugua

SEQ ID NO: 1524179 - RNA, 17 nt, Human
auauuaccacagacaua

SEQ ID NO: 1524180 - RNA, 16 nt, Human
auauuaagaaagacua

SEQ ID NO: 1524181 - RNA, 15 nt, Human
auauuaagaaagacu

SEQ ID NO: 1524182 - RNA, 17 nt, Human
auauuaagaaagacuau

SEQ ID NO: 1524183 - RNA, 22 nt, Human
auauuaagaaagacuaucuaaa

SEQ ID NO: 1524184 - RNA, 13 nt, Human
auauguuucaaac

SEQ ID NO: 1524185 - RNA, 14 nt, Human
auauguuucaaacu

SEQ ID NO: 1524186 - RNA, 16 nt, Human
auauguuucaaacuuu

SEQ ID NO: 1524187 - RNA, 17 nt, Human
auauguuucaaacuuug

SEQ ID NO: 1524188 - RNA, 17 nt, Human
uucccagugaauucuug

SEQ ID NO: 1524189 - RNA, 15 nt, Human
uuccagugaggcucu

SEQ ID NO: 1524190 - RNA, 16 nt, Human
uuccagugaggcucug

SEQ ID NO: 1524191 - RNA, 12 nt, Human
uuccugaacagg

SEQ ID NO: 1524192 - RNA, 22 nt, Human
uuccucuuuuuauuuaguuccu

SEQ ID NO: 1524193 - RNA, 20 nt, Human
uuccuggcacugcuuccagu

SEQ ID NO: 1524194 - RNA, 22 nt, Human
uuccuggcacugcuuccaguga

SEQ ID NO: 1524195 - RNA, 21 nt, Human
aucaaggguacacugccuucu

SEQ ID NO: 1524196 - RNA, 19 nt, Human
aucaauucuguauuccaga

SEQ ID NO: 1524197 - RNA, 13 nt, Human
aucaauuuaaaaa

SEQ ID NO: 1524198 - RNA, 15 nt, Human
aucacgccacugcac

SEQ ID NO: 1524199 - RNA, 17 nt, Human
aucacgccacugcacua

SEQ ID NO: 1524200 - RNA, 14 nt, Human
aucaauuuuucuua

SEQ ID NO: 1524201 - RNA, 19 nt, Human
aucaauuuuucuuauuuca

SEQ ID NO: 1524202 - RNA, 18 nt, Human
auauuuuucacauaucua

SEQ ID NO: 1524203 - RNA, 15 nt, Human
auauuuuuguagcac

SEQ ID NO: 1524204 - RNA, 16 nt, Human
auauuuuuguagcacu

SEQ ID NO: 1524205 - RNA, 23 nt, Human
auauuuuuguagcacugacagau

SEQ ID NO: 1524206 - RNA, 16 nt, Human
aucaaggguacacugc

SEQ ID NO: 1524207 - RNA, 21 nt, Human
aucaacugcaucaagauguga

SEQ ID NO: 1524208 - RNA, 16 nt, Human
aucaaauaugcaaagc

SEQ ID NO: 1524209 - RNA, 17 nt, Human
aucaaauaugcaaagca

SEQ ID NO: 1524210 - RNA, 18 nt, Human
aucaaauaugcaaagcac

SEQ ID NO: 1524211 - RNA, 23 nt, Human
aucacuugaacccgggaggcaga

SEQ ID NO: 1524212 - RNA, 15 nt, Human
aucaggugcugccau

SEQ ID NO: 1524213 - RNA, 17 nt, Human
aucaggugcugccaucc

SEQ ID NO: 1524214 - RNA, 19 nt, Human
aucaggugcugccauccag

SEQ ID NO: 1524215 - RNA, 23 nt, Human
aucagugugucuaaauuugaaug

SEQ ID NO: 1524216 - RNA, 19 nt, Human
aucagucugauucccaagc

SEQ ID NO: 1524217 - RNA, 16 nt, Human
aucauuaggugugacu

SEQ ID NO: 1524218 - RNA, 21 nt, Human
aucauccacugugccaugugc

SEQ ID NO: 1524219 - RNA, 23 nt, Human
aucauccacugugccaugugcca

SEQ ID NO: 1524220 - RNA, 15 nt, Human
aucauaaaacuugau

SEQ ID NO: 1524221 - RNA, 13 nt, Human
aucauugaaaucu

SEQ ID NO: 1524222 - RNA, 12 nt, Human
aucauugaaauc

SEQ ID NO: 1524223 - RNA, 15 nt, Human
uucuccccugccccc

SEQ ID NO: 1524224 - RNA, 16 nt, Human
uucuccccugccccca

SEQ ID NO: 1524225 - RNA, 17 nt, Human
uucuccccugcccccag

SEQ ID NO: 1524226 - RNA, 18 nt, Human
uucuccccugcccccagg

SEQ ID NO: 1524227 - RNA, 19 nt, Human
uucuccccugcccccagga

SEQ ID NO: 1524228 - RNA, 21 nt, Human
uucuccccugcccccaggacu

SEQ ID NO: 1524229 - RNA, 22 nt, Human
uucuccccugcccccaggacug

SEQ ID NO: 1524230 - RNA, 23 nt, Human
uucuccccugcccccaggacugg

SEQ ID NO: 1524231 - RNA, 16 nt, Human
uucugcaucagcugcu

SEQ ID NO: 1524232 - RNA, 21 nt, Human
uucucuaguuugauuaaauuc

SEQ ID NO: 1524233 - RNA, 12 nt, Human
uucucucaucuc

SEQ ID NO: 1524234 - RNA, 13 nt, Human
uucucucaucucu

SEQ ID NO: 1524235 - RNA, 17 nt, Human
uucucucaucucuuagc

SEQ ID NO: 1524236 - RNA, 20 nt, Human
uucucucaucucuuagcucc

SEQ ID NO: 1524237 - RNA, 23 nt, Human
uucucucaucucuuagcuccccu

SEQ ID NO: 1524238 - RNA, 17 nt, Human
uucugccugcccaggcc

SEQ ID NO: 1524239 - RNA, 15 nt, Human
uucugccugcccagg

SEQ ID NO: 1524240 - RNA, 16 nt, Human
uucugccugcccaggc

SEQ ID NO: 1524241 - RNA, 14 nt, Human
auccaguaucuuga

SEQ ID NO: 1524242 - RNA, 15 nt, Human
auccaguaucuugaa

SEQ ID NO: 1524243 - RNA, 17 nt, Human
auccagguucagcuugu

SEQ ID NO: 1524244 - RNA, 11 nt, Human
aucccagcccc

SEQ ID NO: 1524245 - RNA, 12 nt, Human
aucccagcccca

SEQ ID NO: 1524246 - RNA, 16 nt, Human
aucccaugagccucag

SEQ ID NO: 1524247 - RNA, 22 nt, Human
aucccugaaggccccgcccagg

SEQ ID NO: 1524248 - RNA, 17 nt, Human
aucccugaaggccccgc

SEQ ID NO: 1524249 - RNA, 17 nt, Human
aucccaugagccucagc

SEQ ID NO: 1524250 - RNA, 18 nt, Human
aucccaugagccucagca

SEQ ID NO: 1524251 - RNA, 16 nt, Human
uucuguuuuauaauuu

SEQ ID NO: 1524252 - RNA, 17 nt, Human
uucuguuuuauaauuuu

SEQ ID NO: 1524253 - RNA, 18 nt, Human
uucuguuuagauaauaca

SEQ ID NO: 1524254 - RNA, 13 nt, Human
uucuguuuagaua

SEQ ID NO: 1524255 - RNA, 12 nt, Human
uucuuucuggcu

SEQ ID NO: 1524256 - RNA, 20 nt, Human
uucuuucuggcuaugcauuu

SEQ ID NO: 1524257 - RNA, 17 nt, Human
uucuuucuggcuaugca

SEQ ID NO: 1524258 - RNA, 18 nt, Human
uucuugccucuguccccu

SEQ ID NO: 1524259 - RNA, 20 nt, Human
uucuugccucuguccccuuc

SEQ ID NO: 1524260 - RNA, 22 nt, Human
uucuucuccacuuucuagccag

SEQ ID NO: 1524261 - RNA, 11 nt, Human
uucuucucccu

SEQ ID NO: 1524262 - RNA, 15 nt, Human
auccuggaguucugg

SEQ ID NO: 1524263 - RNA, 17 nt, Human
auccuggcacccggccc

SEQ ID NO: 1524264 - RNA, 19 nt, Human
auccuggcacccggccccu

SEQ ID NO: 1524265 - RNA, 20 nt, Human
auccuggcacccggccccug

SEQ ID NO: 1524266 - RNA, 21 nt, Human
auccuggcacccggccccugc

SEQ ID NO: 1524267 - RNA, 22 nt, Human
auccuggcacccggccccugcu

SEQ ID NO: 1524268 - RNA, 23 nt, Human
auccuggcacccggccccugcug

SEQ ID NO: 1524269 - RNA, 16 nt, Human
auccugcaauuccacu

SEQ ID NO: 1524270 - RNA, 22 nt, Human
auccugaggcuccacuuggucu

SEQ ID NO: 1524271 - RNA, 13 nt, Human
auccugccccuga

SEQ ID NO: 1524272 - RNA, 11 nt, Human
auccugaggcu

SEQ ID NO: 1524273 - RNA, 13 nt, Human
auccugaggcucc

SEQ ID NO: 1524274 - RNA, 16 nt, Human
auccugaggcuccacu

SEQ ID NO: 1524275 - RNA, 18 nt, Human
auccugaggcuccacuug

SEQ ID NO: 1524276 - RNA, 14 nt, Human
auccugagccagau

SEQ ID NO: 1524277 - RNA, 15 nt, Human
auccugagccagauu

SEQ ID NO: 1524278 - RNA, 17 nt, Human
auccugagccagauuuc

SEQ ID NO: 1524279 - RNA, 21 nt, Human
auccugagccagauuucacuc

SEQ ID NO: 1524280 - RNA, 17 nt, Human
auccucuuugagugaag

SEQ ID NO: 1524281 - RNA, 11 nt, Human
auccugagcca

SEQ ID NO: 1524282 - RNA, 12 nt, Human
auccugagccag

SEQ ID NO: 1524283 - RNA, 13 nt, Human
auccugagccaga

SEQ ID NO: 1524284 - RNA, 18 nt, Human
auccucuguacagagccc

SEQ ID NO: 1524285 - RNA, 20 nt, Human
auccucuguacagagcccac

SEQ ID NO: 1524286 - RNA, 20 nt, Human
uucuuuugccguuauuaaaa

SEQ ID NO: 1524287 - RNA, 15 nt, Human
uugaauauaaacacu

SEQ ID NO: 1524288 - RNA, 16 nt, Human
uugaauauaaacacua

SEQ ID NO: 1524289 - RNA, 18 nt, Human
uugaauauaaacacuaua

SEQ ID NO: 1524290 - RNA, 17 nt, Human
uugacacuuaaaaaugg

SEQ ID NO: 1524291 - RNA, 17 nt, Human
uugaaggaaaaugauac

SEQ ID NO: 1524292 - RNA, 15 nt, Human
aucuaaauguugaaa

SEQ ID NO: 1524293 - RNA, 14 nt, Human
aucgucacugcuua

SEQ ID NO: 1524294 - RNA, 18 nt, Human
aucgucacugcuuaacuu

SEQ ID NO: 1524295 - RNA, 14 nt, Human
aucgugacaacacu

SEQ ID NO: 1524296 - RNA, 15 nt, Human
aucgugacaacacuu

SEQ ID NO: 1524297 - RNA, 17 nt, Human
uugauaaguucauacau

SEQ ID NO: 1524298 - RNA, 16 nt, Human
uugauaaguucauaca

SEQ ID NO: 1524299 - RNA, 12 nt, Human
uugauaaaguaa

SEQ ID NO: 1524300 - RNA, 15 nt, Human
uugagaucagccugg

SEQ ID NO: 1524301 - RNA, 16 nt, Human
uugaggucuguucuuu

SEQ ID NO: 1524302 - RNA, 14 nt, Human
uugagaguucuaaa

SEQ ID NO: 1524303 - RNA, 14 nt, Human
uugacccacaagaa

SEQ ID NO: 1524304 - RNA, 24 nt, Human
uugaccauucuccaccugccaggg

SEQ ID NO: 1524305 - RNA, 13 nt, Human
uugacaucaacug

SEQ ID NO: 1524306 - RNA, 18 nt, Human
uugaccauucuccaccug

SEQ ID NO: 1524307 - RNA, 19 nt, Human
uugaccauucuccaccugc

SEQ ID NO: 1524308 - RNA, 19 nt, Human
uugacacuuaaaaaugguu

SEQ ID NO: 1524309 - RNA, 20 nt, Human
aguuauuauauuuacaaaug

SEQ ID NO: 1524310 - RNA, 19 nt, Human
aguuauggcuauaggugcu

SEQ ID NO: 1524311 - RNA, 23 nt, Human
aguuauugauaaguucauacauu

SEQ ID NO: 1524312 - RNA, 17 nt, Human
aguuauugauaaguuca

SEQ ID NO: 1524313 - RNA, 19 nt, Human
aguuauugauaaguucaua

SEQ ID NO: 1524314 - RNA, 21 nt, Human
aguuauugauaaguucauaca

SEQ ID NO: 1524315 - RNA, 22 nt, Human
aguuauugauaaguucauacau

SEQ ID NO: 1524316 - RNA, 17 nt, Human
aguuacccaaauuaaga

SEQ ID NO: 1524317 - RNA, 18 nt, Human
aguuacccaaauuaagag

SEQ ID NO: 1524318 - RNA, 20 nt, Human
uguucuuuccaaaguacacu

SEQ ID NO: 1524319 - RNA, 18 nt, Human
uguucuuuccaaaguaca

SEQ ID NO: 1524320 - RNA, 17 nt, Human
aguuagggaauggcaca

SEQ ID NO: 1524321 - RNA, 21 nt, Human
aguucgaugggcccaauucuu

SEQ ID NO: 1524322 - RNA, 21 nt, Human
aguuauuuuuauuuauuuaaa

SEQ ID NO: 1524323 - RNA, 15 nt, Human
aguucuaaauuuugu

SEQ ID NO: 1524324 - RNA, 13 nt, Human
uguugggccagga

SEQ ID NO: 1524325 - RNA, 16 nt, Human
uguugggccaggagcc

SEQ ID NO: 1524326 - RNA, 13 nt, Human
uguugucagcuga

SEQ ID NO: 1524327 - RNA, 19 nt, Human
agugggggaguggccacag

SEQ ID NO: 1524328 - RNA, 20 nt, Human
agugggggaguggccacaga

SEQ ID NO: 1524329 - RNA, 18 nt, Human
agugggggaucacagccu

SEQ ID NO: 1524330 - RNA, 13 nt, Human
agugggugaauaa

SEQ ID NO: 1524331 - RNA, 18 nt, Human
agugggugaauaauacag

SEQ ID NO: 1524332 - RNA, 14 nt, Human
aguggcagcugcuu

SEQ ID NO: 1524333 - RNA, 20 nt, Human
aguggcagcugcuuuugucu

SEQ ID NO: 1524334 - RNA, 12 nt, Human
aguggcagcugc

SEQ ID NO: 1524335 - RNA, 13 nt, Human
aguggcagcugcu

SEQ ID NO: 1524336 - RNA, 16 nt, Human
aguggugcgaucuggg

SEQ ID NO: 1524337 - RNA, 21 nt, Human
agugguuccuaauccucuagg

SEQ ID NO: 1524338 - RNA, 19 nt, Human
agugggugaauaauacagu

SEQ ID NO: 1524339 - RNA, 14 nt, Human
agugggucccagau

SEQ ID NO: 1524340 - RNA, 21 nt, Human
aguguacauggaauaacaugu

SEQ ID NO: 1524341 - RNA, 22 nt, Human
aguguacauggaauaacaugua

SEQ ID NO: 1524342 - RNA, 13 nt, Human
agugguuuagaaa

SEQ ID NO: 1524343 - RNA, 23 nt, Human
aguguacauggaauaacauguaa

SEQ ID NO: 1524344 - RNA, 18 nt, Human
uguucuugguuuguaaau

SEQ ID NO: 1524345 - RNA, 17 nt, Human
uguucuugguuuguaaa

SEQ ID NO: 1524346 - RNA, 14 nt, Human
uguucuuuccaaag

SEQ ID NO: 1524347 - RNA, 13 nt, Human
uguucuuuccaaa

SEQ ID NO: 1524348 - RNA, 19 nt, Human
uguucuugguuuguaaauu

SEQ ID NO: 1524349 - RNA, 16 nt, Human
uguucuuaauucuuag

SEQ ID NO: 1524350 - RNA, 14 nt, Human
uguucuuaauucuu

SEQ ID NO: 1524351 - RNA, 14 nt, Human
uguucugggacaca

SEQ ID NO: 1524352 - RNA, 15 nt, Human
uguucugggacacag

SEQ ID NO: 1524353 - RNA, 13 nt, Human
uguucugggacac

SEQ ID NO: 1524354 - RNA, 13 nt, Human
uguuuuauaauuu

SEQ ID NO: 1524355 - RNA, 20 nt, Human
uguuuuauaauuuugugaag

SEQ ID NO: 1524356 - RNA, 15 nt, Human
uguuuucaguguaca

SEQ ID NO: 1524357 - RNA, 13 nt, Human
aguucucuccuuc

SEQ ID NO: 1524358 - RNA, 16 nt, Human
aguucucuccuucuuc

SEQ ID NO: 1524359 - RNA, 15 nt, Human
uguuuucucuugaga

SEQ ID NO: 1524360 - RNA, 17 nt, Human
uguuuucaguguacaug

SEQ ID NO: 1524361 - RNA, 19 nt, Human
uguuugcuaagcauuccaa

SEQ ID NO: 1524362 - RNA, 19 nt, Human
uguuuggggaugagaaagg

SEQ ID NO: 1524363 - RNA, 15 nt, Human
uguuuggggaugaga

SEQ ID NO: 1524364 - RNA, 15 nt, Human
uguuugcuaagcauu

SEQ ID NO: 1524365 - RNA, 16 nt, Human
uguuugccucugccuc

SEQ ID NO: 1524366 - RNA, 14 nt, Human
uguuugccucugcc

SEQ ID NO: 1524367 - RNA, 14 nt, Human
uguugucagcugaa

SEQ ID NO: 1524368 - RNA, 23 nt, Human
aguugauucagcucugcaagaau

SEQ ID NO: 1524369 - RNA, 14 nt, Human
aguugauucagcuc

SEQ ID NO: 1524370 - RNA, 15 nt, Human
aguugauucagcucu

SEQ ID NO: 1524371 - RNA, 17 nt, Human
aguugauucagcucugc

SEQ ID NO: 1524372 - RNA, 18 nt, Human
aguugauucagcucugca

SEQ ID NO: 1524373 - RNA, 21 nt, Human
aguugauaugccuuuucccaa

SEQ ID NO: 1524374 - RNA, 22 nt, Human
aguugauagcacagacccugcc

SEQ ID NO: 1524375 - RNA, 23 nt, Human
aguugauagcacagacccugccc

SEQ ID NO: 1524376 - RNA, 13 nt, Human
aguugauucagcu

SEQ ID NO: 1524377 - RNA, 13 nt, Human
aguucugaagaag

SEQ ID NO: 1524378 - RNA, 14 nt, Human
aguucugaagaaga

SEQ ID NO: 1524379 - RNA, 15 nt, Human
aguucugaagaagau

SEQ ID NO: 1524380 - RNA, 16 nt, Human
aguucugaagaagaug

SEQ ID NO: 1524381 - RNA, 15 nt, Human
aguugauagcacaga

SEQ ID NO: 1524382 - RNA, 19 nt, Human
aguugauagcacagacccu

SEQ ID NO: 1524383 - RNA, 20 nt, Human
aguugauagcacagacccug

SEQ ID NO: 1524384 - RNA, 21 nt, Human
aguugauagcacagacccugc

SEQ ID NO: 1524385 - RNA, 21 nt, Human
aguuucuccaagcaggacaug

SEQ ID NO: 1524386 - RNA, 13 nt, Human
aguuucuccaagc

SEQ ID NO: 1524387 - RNA, 15 nt, Human
aguuucuccaagcag

SEQ ID NO: 1524388 - RNA, 20 nt, Human
uuaaauucuugcaaaguauc

SEQ ID NO: 1524389 - RNA, 16 nt, Human
uuaaauucuugcaaag

SEQ ID NO: 1524390 - RNA, 13 nt, Human
uuaaauucuugca

SEQ ID NO: 1524391 - RNA, 22 nt, Human
aguuuucacucuuauugcccac

SEQ ID NO: 1524392 - RNA, 16 nt, Human
aguuugguguguccuc

SEQ ID NO: 1524393 - RNA, 19 nt, Human
uuaaaaaagaaacauuugg

SEQ ID NO: 1524394 - RNA, 18 nt, Human
uuaaaaaguggaaaaaua

SEQ ID NO: 1524395 - RNA, 17 nt, Human
uuaaaacaacacucaca

SEQ ID NO: 1524396 - RNA, 15 nt, Human
uuaaaaaagaaacau

SEQ ID NO: 1524397 - RNA, 18 nt, Human
uuaaaaaagaaacauuug

SEQ ID NO: 1524398 - RNA, 20 nt, Human
aguugccagucaccccggcc

SEQ ID NO: 1524399 - RNA, 14 nt, Human
uuaaaaucauuucu

SEQ ID NO: 1524400 - RNA, 17 nt, Human
uuaaaccgccaaggcug

SEQ ID NO: 1524401 - RNA, 22 nt, Human
uuaaauaaugugaaacuggauu

SEQ ID NO: 1524402 - RNA, 21 nt, Human
uuaaauaaugugaaacuggau

SEQ ID NO: 1524403 - RNA, 20 nt, Human
uuaaauaaugugaaacugga

SEQ ID NO: 1524404 - RNA, 13 nt, Human
uuaaauaaaucau

SEQ ID NO: 1524405 - RNA, 15 nt, Human
uuaaauaaaucauaa

SEQ ID NO: 1524406 - RNA, 22 nt, Human
uuaucaaagggugaaaauuauu

SEQ ID NO: 1524407 - RNA, 22 nt, Human
auaccacaggaaccacaagacu

SEQ ID NO: 1524408 - RNA, 19 nt, Human
auaccagccaguaaauggg

SEQ ID NO: 1524409 - RNA, 21 nt, Human
auacuaaccagcagaaaugcc

SEQ ID NO: 1524410 - RNA, 20 nt, Human
auacuacaguuuguuaguau

SEQ ID NO: 1524411 - RNA, 16 nt, Human
auacuacaguuuguua

SEQ ID NO: 1524412 - RNA, 15 nt, Human
auacuacaguuuguu

SEQ ID NO: 1524413 - RNA, 13 nt, Human
auacuacaguuug

SEQ ID NO: 1524414 - RNA, 20 nt, Human
auacaucccuuaccugggaa

SEQ ID NO: 1524415 - RNA, 19 nt, Human
auacauauuuuuguagcac

SEQ ID NO: 1524416 - RNA, 20 nt, Human
auacauaaacaagaccacgu

SEQ ID NO: 1524417 - RNA, 14 nt, Human
auacauuguacgaa

SEQ ID NO: 1524418 - RNA, 21 nt, Human
auacauuguacgaagaguauu

SEQ ID NO: 1524419 - RNA, 22 nt, Human
auacauuguacgaagaguauuu

SEQ ID NO: 1524420 - RNA, 19 nt, Human
auaccaaguugauacuuga

SEQ ID NO: 1524421 - RNA, 16 nt, Human
auacauuugauaaagu

SEQ ID NO: 1524422 - RNA, 21 nt, Human
auacaguucggugagcuacaa

SEQ ID NO: 1524423 - RNA, 15 nt, Human
auacaggucauauua

SEQ ID NO: 1524424 - RNA, 21 nt, Human
auacaggucauauuaauauau

SEQ ID NO: 1524425 - RNA, 14 nt, Human
auacaggaaaagcu

SEQ ID NO: 1524426 - RNA, 19 nt, Human
auacaggaaaagcugcuga

SEQ ID NO: 1524427 - RNA, 20 nt, Human
auacaggaaaagcugcugac

SEQ ID NO: 1524428 - RNA, 22 nt, Human
auacaggaaaagcugcugacag

SEQ ID NO: 1524429 - RNA, 16 nt, Human
uuauagccgaaaugau

SEQ ID NO: 1524430 - RNA, 18 nt, Human
uuauacuuuguaaagaca

SEQ ID NO: 1524431 - RNA, 23 nt, Human
uuauagaguguacuuaacuauuc

SEQ ID NO: 1524432 - RNA, 23 nt, Human
uuauacccagaaaguuauugaua

SEQ ID NO: 1524433 - RNA, 18 nt, Human
uuauacccagaaaguuau

SEQ ID NO: 1524434 - RNA, 19 nt, Human
uuauacccagaaaguuauu

SEQ ID NO: 1524435 - RNA, 18 nt, Human
uuauauaagcuuguauuc

SEQ ID NO: 1524436 - RNA, 13 nt, Human
uuauauaaguauu

SEQ ID NO: 1524437 - RNA, 14 nt, Human
uuauauaaguauuc

SEQ ID NO: 1524438 - RNA, 16 nt, Human
uuauauaaguauucua

SEQ ID NO: 1524439 - RNA, 22 nt, Human
uuauauauauuuuuuucugaaa

SEQ ID NO: 1524440 - RNA, 15 nt, Human
auaauuuuaagaaau

SEQ ID NO: 1524441 - RNA, 21 nt, Human
auaauuuuaagaaaucaaaga

SEQ ID NO: 1524442 - RNA, 13 nt, Human
auaauuuugugaa

SEQ ID NO: 1524443 - RNA, 14 nt, Human
auaauuuugugaag

SEQ ID NO: 1524444 - RNA, 15 nt, Human
auaauuuugugaagc

SEQ ID NO: 1524445 - RNA, 20 nt, Human
auaauuuugugaagcaaaau

SEQ ID NO: 1524446 - RNA, 14 nt, Human
auaauuuuuauauu

SEQ ID NO: 1524447 - RNA, 16 nt, Human
auaauuuuuauauuug

SEQ ID NO: 1524448 - RNA, 19 nt, Human
auaauuuuuauauuugaaa

SEQ ID NO: 1524449 - RNA, 21 nt, Human
auaauuuuuauauuugaaaua

SEQ ID NO: 1524450 - RNA, 22 nt, Human
auaauuuuuauauuugaaauau

SEQ ID NO: 1524451 - RNA, 15 nt, Human
auacaaaagcaugug

SEQ ID NO: 1524452 - RNA, 13 nt, Human
auacaaaagcaug

SEQ ID NO: 1524453 - RNA, 12 nt, Human
auacaaaagcau

SEQ ID NO: 1524454 - RNA, 22 nt, Human
auacaaaaaaaaaaaaaaauua

SEQ ID NO: 1524455 - RNA, 18 nt, Human
aguuuucugagaaagacu

SEQ ID NO: 1524456 - RNA, 14 nt, Human
aguuuucugagaaa

SEQ ID NO: 1524457 - RNA, 17 nt, Human
aguuuucugagaaagac

SEQ ID NO: 1524458 - RNA, 12 nt, Human
aguuuucugaga

SEQ ID NO: 1524459 - RNA, 13 nt, Human
aguuuucugagaa

SEQ ID NO: 1524460 - RNA, 16 nt, Human
auaaaccgaacugaug

SEQ ID NO: 1524461 - RNA, 16 nt, Human
auaaaccucaaaaugu

SEQ ID NO: 1524462 - RNA, 22 nt, Human
auaaaccuugucuaugaaauga

SEQ ID NO: 1524463 - RNA, 22 nt, Human
auaaacauuuguagcauccucu

SEQ ID NO: 1524464 - RNA, 15 nt, Human
auaaacgucuuaaau

SEQ ID NO: 1524465 - RNA, 16 nt, Human
auaaacgucuuaaaua

SEQ ID NO: 1524466 - RNA, 18 nt, Human
auaaacgucuuaaauauu

SEQ ID NO: 1524467 - RNA, 16 nt, Human
auaaacuuuaccuuuu

SEQ ID NO: 1524468 - RNA, 15 nt, Human
auaaacuuuaccuuu

SEQ ID NO: 1524469 - RNA, 13 nt, Human
auaaacuuuaccu

SEQ ID NO: 1524470 - RNA, 19 nt, Human
auaaaugugccuucauuuu

SEQ ID NO: 1524471 - RNA, 12 nt, Human
auaacuggaaac

SEQ ID NO: 1524472 - RNA, 20 nt, Human
auaaccaguguuguggauuu

SEQ ID NO: 1524473 - RNA, 23 nt, Human
uuaccauuuugggguacccacug

SEQ ID NO: 1524474 - RNA, 18 nt, Human
uuacaggaaguacuggag

SEQ ID NO: 1524475 - RNA, 22 nt, Human
uuacaggaaguacuggagaaaa

SEQ ID NO: 1524476 - RNA, 12 nt, Human
auaacugugaag

SEQ ID NO: 1524477 - RNA, 16 nt, Human
uuacaggaaguacugg

SEQ ID NO: 1524478 - RNA, 23 nt, Human
auaagaaccuuuugagugccuua

SEQ ID NO: 1524479 - RNA, 17 nt, Human
auaaguuaacuuccaau

SEQ ID NO: 1524480 - RNA, 12 nt, Human
uuaccugggaaa

SEQ ID NO: 1524481 - RNA, 22 nt, Human
auaagaaccuuuugagugccuu

SEQ ID NO: 1524482 - RNA, 22 nt, Human
auaaguuaacuuccaauuuaca

SEQ ID NO: 1524483 - RNA, 21 nt, Human
auaaguucauacauuguacga

SEQ ID NO: 1524484 - RNA, 11 nt, Human
auaaguucaua

SEQ ID NO: 1524485 - RNA, 13 nt, Human
auaaguucauaca

SEQ ID NO: 1524486 - RNA, 14 nt, Human
auaaguucauacau

SEQ ID NO: 1524487 - RNA, 15 nt, Human
auaaguucauacauu

SEQ ID NO: 1524488 - RNA, 23 nt, Human
auaauacaccacuacauucuguu

SEQ ID NO: 1524489 - RNA, 23 nt, Human
uuagaugcaguucugaagaagau

SEQ ID NO: 1524490 - RNA, 22 nt, Human
uuagaugcaguucugaagaaga

SEQ ID NO: 1524491 - RNA, 21 nt, Human
auaaucuuucacaggggacag

SEQ ID NO: 1524492 - RNA, 20 nt, Human
auaaucagugugucuaaauu

SEQ ID NO: 1524493 - RNA, 19 nt, Human
auaauacaguaucucaggg

SEQ ID NO: 1524494 - RNA, 14 nt, Human
auaaugaauacuuu

SEQ ID NO: 1524495 - RNA, 14 nt, Human
auaauucuacuuug

SEQ ID NO: 1524496 - RNA, 16 nt, Human
aggggauagagagaga

SEQ ID NO: 1524497 - RNA, 18 nt, Human
aggguaucaggugcugcc

SEQ ID NO: 1524498 - RNA, 16 nt, Human
aggguaucaggugcug

SEQ ID NO: 1524499 - RNA, 19 nt, Human
aggguacuaaggaaucuuu

SEQ ID NO: 1524500 - RNA, 15 nt, Human
ugguccauagagagc

SEQ ID NO: 1524501 - RNA, 16 nt, Human
ugguccauagagagca

SEQ ID NO: 1524502 - RNA, 23 nt, Human
uggucaccaaaucagcugcuacu

SEQ ID NO: 1524503 - RNA, 21 nt, Human
uggucaccaaaucagcugcua

SEQ ID NO: 1524504 - RNA, 24 nt, Human
agggugccguguccccugacaggg

SEQ ID NO: 1524505 - RNA, 15 nt, Human
agggugccguguccc

SEQ ID NO: 1524506 - RNA, 15 nt, Human
agggugaaaauuauu

SEQ ID NO: 1524507 - RNA, 21 nt, Human
agggugaugggaaagcauugu

SEQ ID NO: 1524508 - RNA, 22 nt, Human
agggugaugggaaagcauugua

SEQ ID NO: 1524509 - RNA, 23 nt, Human
uggguggaugccugguggcagcu

SEQ ID NO: 1524510 - RNA, 14 nt, Human
uggguggaugccug

SEQ ID NO: 1524511 - RNA, 22 nt, Human
ugguccaugggccauaugaaaa

SEQ ID NO: 1524512 - RNA, 19 nt, Human
ugguccauagagagcaaga

SEQ ID NO: 1524513 - RNA, 13 nt, Human
uggucccacccca

SEQ ID NO: 1524514 - RNA, 16 nt, Human
uggucuuauuuguaaa

SEQ ID NO: 1524515 - RNA, 22 nt, Human
uggucugugagaugcuagaacu

SEQ ID NO: 1524516 - RNA, 12 nt, Human
uggucuguguga

SEQ ID NO: 1524517 - RNA, 19 nt, Human
uggugaacagaacaaaagg

SEQ ID NO: 1524518 - RNA, 18 nt, Human
aggguggugaccucugcc

SEQ ID NO: 1524519 - RNA, 19 nt, Human
aggguggugaccucugccu

SEQ ID NO: 1524520 - RNA, 21 nt, Human
aggguggugaccucugccuga

SEQ ID NO: 1524521 - RNA, 13 nt, Human
aggguuggccccu

SEQ ID NO: 1524522 - RNA, 14 nt, Human
aggguuggccccug

SEQ ID NO: 1524523 - RNA, 17 nt, Human
aggguuggccccugccc

SEQ ID NO: 1524524 - RNA, 15 nt, Human
aggguugggcuggug

SEQ ID NO: 1524525 - RNA, 15 nt, Human
aggucagugcaaaua

SEQ ID NO: 1524526 - RNA, 21 nt, Human
aggucaaggcugcagugagcc

SEQ ID NO: 1524527 - RNA, 23 nt, Human
aggucauuuuuuuuaagaaaaag

SEQ ID NO: 1524528 - RNA, 22 nt, Human
aggucauuuuuuuuaagaaaaa

SEQ ID NO: 1524529 - RNA, 22 nt, Human
aggucuugaacuccuggccuca

SEQ ID NO: 1524530 - RNA, 16 nt, Human
aggucauauuaauaua

SEQ ID NO: 1524531 - RNA, 20 nt, Human
aggucuugaacuccuggccu

SEQ ID NO: 1524532 - RNA, 21 nt, Human
aggucuugaacuccuggccuc

SEQ ID NO: 1524533 - RNA, 22 nt, Human
agguaugaccuucuaggaagcu

SEQ ID NO: 1524534 - RNA, 23 nt, Human
agguaugaccuucuaggaagcuc

SEQ ID NO: 1524535 - RNA, 17 nt, Human
agguaugcaaucaaauc

SEQ ID NO: 1524536 - RNA, 20 nt, Human
agguaugaccuucuaggaag

SEQ ID NO: 1524537 - RNA, 14 nt, Human
aggguuggagcagu

SEQ ID NO: 1524538 - RNA, 17 nt, Human
aggguugggcugguguc

SEQ ID NO: 1524539 - RNA, 20 nt, Human
aggguuuauguuuaggaugu

SEQ ID NO: 1524540 - RNA, 12 nt, Human
ugguuuucuguu

SEQ ID NO: 1524541 - RNA, 15 nt, Human
ugguuugcaaggaag

SEQ ID NO: 1524542 - RNA, 17 nt, Human
ugguuugcaaggaagcc

SEQ ID NO: 1524543 - RNA, 15 nt, Human
ugguuucagaaaugu

SEQ ID NO: 1524544 - RNA, 14 nt, Human
ugguuucagaaaug

SEQ ID NO: 1524545 - RNA, 16 nt, Human
uguaaaggaauuuaaa

SEQ ID NO: 1524546 - RNA, 15 nt, Human
ugguuuucuguucuu

SEQ ID NO: 1524547 - RNA, 13 nt, Human
ugguuuucuguuc

SEQ ID NO: 1524548 - RNA, 23 nt, Human
aggugauccacccaccucagccu

SEQ ID NO: 1524549 - RNA, 15 nt, Human
ugguggcagagugga

SEQ ID NO: 1524550 - RNA, 12 nt, Human
ugguggcagcuc

SEQ ID NO: 1524551 - RNA, 16 nt, Human
ugguggcagcucaccu

SEQ ID NO: 1524552 - RNA, 19 nt, Human
ugguggcagcucaccucuc

SEQ ID NO: 1524553 - RNA, 20 nt, Human
ugguggcagcucaccucucc

SEQ ID NO: 1524554 - RNA, 23 nt, Human
ugguggcagcucaccucucccuu

SEQ ID NO: 1524555 - RNA, 12 nt, Human
ugguggcagcug

SEQ ID NO: 1524556 - RNA, 13 nt, Human
ugguggcagcugc

SEQ ID NO: 1524557 - RNA, 15 nt, Human
ugguguuuccuggca

SEQ ID NO: 1524558 - RNA, 17 nt, Human
ugguguuuccuggcacu

SEQ ID NO: 1524559 - RNA, 13 nt, Human
ugguuaaugccau

SEQ ID NO: 1524560 - RNA, 20 nt, Human
ugguucaggguuggccccug

SEQ ID NO: 1524561 - RNA, 22 nt, Human
ugguucaggguuggccccugcc

SEQ ID NO: 1524562 - RNA, 23 nt, Human
ugguucaggguuggccccugccc

SEQ ID NO: 1524563 - RNA, 21 nt, Human
uguagaagucacauuccugaa

SEQ ID NO: 1524564 - RNA, 20 nt, Human
uguacaugaaaacacauuuu

SEQ ID NO: 1524565 - RNA, 19 nt, Human
uguacaugaaaacacauuu

SEQ ID NO: 1524566 - RNA, 18 nt, Human
uguacaugaaaacacauu

SEQ ID NO: 1524567 - RNA, 17 nt, Human
uguacaugaaaacacau

SEQ ID NO: 1524568 - RNA, 15 nt, Human
uguacuuaacuauuc

SEQ ID NO: 1524569 - RNA, 16 nt, Human
uguaauuugugauaca

SEQ ID NO: 1524570 - RNA, 18 nt, Human
uguaaggaaugauuaauu

SEQ ID NO: 1524571 - RNA, 21 nt, Human
uguaauuugugauacaaugcu

SEQ ID NO: 1524572 - RNA, 17 nt, Human
uguaauuugugauacaa

SEQ ID NO: 1524573 - RNA, 19 nt, Human
uguacaaaguagaagucuu

SEQ ID NO: 1524574 - RNA, 23 nt, Human
uguacaaaguagaagucuuagau

SEQ ID NO: 1524575 - RNA, 18 nt, Human
uguaagaaaauaucacuu

SEQ ID NO: 1524576 - RNA, 18 nt, Human
uguaagaacuacaaacaa

SEQ ID NO: 1524577 - RNA, 13 nt, Human
uguaaggaaugau

SEQ ID NO: 1524578 - RNA, 14 nt, Human
uguaaggaaugauu

SEQ ID NO: 1524579 - RNA, 15 nt, Human
uguaaggaaugauua

SEQ ID NO: 1524580 - RNA, 16 nt, Human
agguggggcagcuuga

SEQ ID NO: 1524581 - RNA, 14 nt, Human
agguggggcagcuu

SEQ ID NO: 1524582 - RNA, 13 nt, Human
agguggggcagcu

SEQ ID NO: 1524583 - RNA, 18 nt, Human
aggugugacugaauuucu

SEQ ID NO: 1524584 - RNA, 23 nt, Human
aggugugaaccaccacacccagc

SEQ ID NO: 1524585 - RNA, 22 nt, Human
aggugugaaccaccacacccag

SEQ ID NO: 1524586 - RNA, 20 nt, Human
aggugugacugaauuucuuu

SEQ ID NO: 1524587 - RNA, 14 nt, Human
aggugugagucacc

SEQ ID NO: 1524588 - RNA, 20 nt, Human
aggugugagucaccaagccc

SEQ ID NO: 1524589 - RNA, 21 nt, Human
agugagcagucaggaaagaga

SEQ ID NO: 1524590 - RNA, 14 nt, Human
agugagagcugggu

SEQ ID NO: 1524591 - RNA, 16 nt, Human
agugagccgagauugu

SEQ ID NO: 1524592 - RNA, 15 nt, Human
ugugauggggcccug

SEQ ID NO: 1524593 - RNA, 16 nt, Human
ugugauggggcccugc

SEQ ID NO: 1524594 - RNA, 17 nt, Human
ugugauggggcccugcc

SEQ ID NO: 1524595 - RNA, 18 nt, Human
ugugauggggcccugccu

SEQ ID NO: 1524596 - RNA, 20 nt, Human
agugaaacucguuaauuugu

SEQ ID NO: 1524597 - RNA, 14 nt, Human
agugagacagcucu

SEQ ID NO: 1524598 - RNA, 22 nt, Human
agugaaagaggcagcuugaaac

SEQ ID NO: 1524599 - RNA, 16 nt, Human
agugaaagaggcagcu

SEQ ID NO: 1524600 - RNA, 22 nt, Human
agugagacucugucucaaaaaa

SEQ ID NO: 1524601 - RNA, 16 nt, Human
agugagacucugucuc

SEQ ID NO: 1524602 - RNA, 17 nt, Human
agugagacucugucuca

SEQ ID NO: 1524603 - RNA, 14 nt, Human
agugaaagcaucac

SEQ ID NO: 1524604 - RNA, 17 nt, Human
agugagacccugucuca

SEQ ID NO: 1524605 - RNA, 21 nt, Human
agugagacccugucucaaaaa

SEQ ID NO: 1524606 - RNA, 13 nt, Human
agugagacucugu

SEQ ID NO: 1524607 - RNA, 11 nt, Human
agugaaaaagg

SEQ ID NO: 1524608 - RNA, 17 nt, Human
agugaaaaaggaggaag

SEQ ID NO: 1524609 - RNA, 20 nt, Human
agugaaaaaggaggaagaga

SEQ ID NO: 1524610 - RNA, 23 nt, Human
agugaaaaaggaggaagagaaaa

SEQ ID NO: 1524611 - RNA, 14 nt, Human
ugugaagcaaaauu

SEQ ID NO: 1524612 - RNA, 19 nt, Human
ugugagcacaaagguagcu

SEQ ID NO: 1524613 - RNA, 13 nt, Human
ugucucugagagu

SEQ ID NO: 1524614 - RNA, 17 nt, Human
ugucucuacuaaaaaua

SEQ ID NO: 1524615 - RNA, 23 nt, Human
aguccccuguuuguuucugaaag

SEQ ID NO: 1524616 - RNA, 13 nt, Human
agucccugccaau

SEQ ID NO: 1524617 - RNA, 14 nt, Human
agucccugccaaug

SEQ ID NO: 1524618 - RNA, 16 nt, Human
agucccugccaaugga

SEQ ID NO: 1524619 - RNA, 13 nt, Human
ugucucugugaga

SEQ ID NO: 1524620 - RNA, 18 nt, Human
ugucucuugguccugcug

SEQ ID NO: 1524621 - RNA, 19 nt, Human
ugucucuugguccugcugc

SEQ ID NO: 1524622 - RNA, 20 nt, Human
ugucucuugguccugcugca

SEQ ID NO: 1524623 - RNA, 21 nt, Human
ugucucuugguccugcugcag

SEQ ID NO: 1524624 - RNA, 22 nt, Human
ugucucuuuaaugucacaggca

SEQ ID NO: 1524625 - RNA, 22 nt, Human
ugucucuugguccugcugcagu

SEQ ID NO: 1524626 - RNA, 21 nt, Human
ugucucuuuaaugucacaggc

SEQ ID NO: 1524627 - RNA, 14 nt, Human
ugucuuaauuaaaa

SEQ ID NO: 1524628 - RNA, 22 nt, Human
ugugaacaguuguguuugaagc

SEQ ID NO: 1524629 - RNA, 15 nt, Human
ugugaaccaccacac

SEQ ID NO: 1524630 - RNA, 16 nt, Human
ugugaaccaccacacc

SEQ ID NO: 1524631 - RNA, 17 nt, Human
ugugaaccaccacaccc

SEQ ID NO: 1524632 - RNA, 22 nt, Human
ugugaaccaccacacccagccc

SEQ ID NO: 1524633 - RNA, 23 nt, Human
ugugaaccaccacacccagccca

SEQ ID NO: 1524634 - RNA, 15 nt, Human
ugucuugcaauggca

SEQ ID NO: 1524635 - RNA, 17 nt, Human
ugucuugcaauggcagc

SEQ ID NO: 1524636 - RNA, 18 nt, Human
ugucuugcaauggcagcc

SEQ ID NO: 1524637 - RNA, 20 nt, Human
ugucuugcaauggcagccuu

SEQ ID NO: 1524638 - RNA, 21 nt, Human
ugucuugcaauggcagccuug

SEQ ID NO: 1524639 - RNA, 14 nt, Human
ugucuucacaacag

SEQ ID NO: 1524640 - RNA, 23 nt, Human
agguuuggacaaaauggaauacu

SEQ ID NO: 1524641 - RNA, 12 nt, Human
uguagagccagg

SEQ ID NO: 1524642 - RNA, 15 nt, Human
uguagagccaggguc

SEQ ID NO: 1524643 - RNA, 15 nt, Human
uguaucccaugagcc

SEQ ID NO: 1524644 - RNA, 16 nt, Human
uguaucccaugagccu

SEQ ID NO: 1524645 - RNA, 14 nt, Human
uguauguguaagua

SEQ ID NO: 1524646 - RNA, 13 nt, Human
aguagcugggacu

SEQ ID NO: 1524647 - RNA, 14 nt, Human
aguagcugggacua

SEQ ID NO: 1524648 - RNA, 16 nt, Human
ugucaaaguggugaga

SEQ ID NO: 1524649 - RNA, 19 nt, Human
ugucaaaguggugagaggc

SEQ ID NO: 1524650 - RNA, 14 nt, Human
ugucaaagugguga

SEQ ID NO: 1524651 - RNA, 15 nt, Human
ugucaaaguggugag

SEQ ID NO: 1524652 - RNA, 15 nt, Human
aguauuguccagguc

SEQ ID NO: 1524653 - RNA, 16 nt, Human
aguauuguccaggucu

SEQ ID NO: 1524654 - RNA, 20 nt, Human
agucacauuccaagccucau

SEQ ID NO: 1524655 - RNA, 15 nt, Human
agucacugagacagc

SEQ ID NO: 1524656 - RNA, 16 nt, Human
agucacugagacagcc

SEQ ID NO: 1524657 - RNA, 17 nt, Human
agucacugagacagccc

SEQ ID NO: 1524658 - RNA, 15 nt, Human
ugucagcauagaagu

SEQ ID NO: 1524659 - RNA, 18 nt, Human
aguauguuagugcaaauu

SEQ ID NO: 1524660 - RNA, 21 nt, Human
aguauguuagugcaaauuguc

SEQ ID NO: 1524661 - RNA, 22 nt, Human
aguagcugggacuacaggcacc

SEQ ID NO: 1524662 - RNA, 19 nt, Human
aguagcugggacuacaggc

SEQ ID NO: 1524663 - RNA, 21 nt, Human
aguagcugggacuacaggcac

SEQ ID NO: 1524664 - RNA, 15 nt, Human
aguauuauaccuuuu

SEQ ID NO: 1524665 - RNA, 14 nt, Human
aguauuauaccuuu

SEQ ID NO: 1524666 - RNA, 15 nt, Human
agucagucauucaga

SEQ ID NO: 1524667 - RNA, 21 nt, Human
agucagucauucagauaugau

SEQ ID NO: 1524668 - RNA, 14 nt, Human
ugucuaagauagua

SEQ ID NO: 1524669 - RNA, 15 nt, Human
ugucuaagauaguaa

SEQ ID NO: 1524670 - RNA, 18 nt, Human
ugucuaaauuugaauguu

SEQ ID NO: 1524671 - RNA, 23 nt, Human
aguccauauuucaauuuccaaga

SEQ ID NO: 1524672 - RNA, 14 nt, Human
aguccccuguuugu

SEQ ID NO: 1524673 - RNA, 19 nt, Human
aguccccuguuuguuucug

SEQ ID NO: 1524674 - RNA, 21 nt, Human
agucccaccuuggcugcaggg

SEQ ID NO: 1524675 - RNA, 23 nt, Human
agucccaccuuggcugcagggag

SEQ ID NO: 1524676 - RNA, 21 nt, Human
aguccauauuucaauuuccaa

SEQ ID NO: 1524677 - RNA, 17 nt, Human
ugucccuuuuccuuuuu

SEQ ID NO: 1524678 - RNA, 12 nt, Human
ugucccuuuucc

SEQ ID NO: 1524679 - RNA, 14 nt, Human
ugucccugcacuug

SEQ ID NO: 1524680 - RNA, 18 nt, Human
agucacugagacagcccg

SEQ ID NO: 1524681 - RNA, 16 nt, Human
ugucagccauuccugu

SEQ ID NO: 1524682 - RNA, 23 nt, Human
ugucagcuccccucggagaagag

SEQ ID NO: 1524683 - RNA, 20 nt, Human
ugucagcuccccucggagaa

SEQ ID NO: 1524684 - RNA, 21 nt, Human
ugucagcuccccucggagaag

SEQ ID NO: 1524685 - RNA, 23 nt, Human
agcugcuuuugucuaugggacuc

SEQ ID NO: 1524686 - RNA, 24 nt, Human
agcugcuuuugucuaugggacuca

SEQ ID NO: 1524687 - RNA, 13 nt, Human
agcugccuguuca

SEQ ID NO: 1524688 - RNA, 14 nt, Human
ugccucugacacac

SEQ ID NO: 1524689 - RNA, 16 nt, Human
ugccucugacacacag

SEQ ID NO: 1524690 - RNA, 11 nt, Human
ugccucugccu

SEQ ID NO: 1524691 - RNA, 20 nt, Human
ugccugcccaggccccugcc

SEQ ID NO: 1524692 - RNA, 12 nt, Human
ugccucugccuc

SEQ ID NO: 1524693 - RNA, 17 nt, Human
ugccugcccaggccccu

SEQ ID NO: 1524694 - RNA, 18 nt, Human
ugccugcccaggccccug

SEQ ID NO: 1524695 - RNA, 19 nt, Human
ugccugcccaggccccugc

SEQ ID NO: 1524696 - RNA, 17 nt, Human
ugccucucucaggccaa

SEQ ID NO: 1524697 - RNA, 18 nt, Human
ugccucagaaaacaagga

SEQ ID NO: 1524698 - RNA, 22 nt, Human
ugccucccaucacccgcuaaga

SEQ ID NO: 1524699 - RNA, 20 nt, Human
ugccgcagcccugcagaggg

SEQ ID NO: 1524700 - RNA, 15 nt, Human
ugccucaccccuugc

SEQ ID NO: 1524701 - RNA, 15 nt, Human
agcucuucuccaggc

SEQ ID NO: 1524702 - RNA, 16 nt, Human
agcucuucuccaggcu

SEQ ID NO: 1524703 - RNA, 17 nt, Human
agcucuucuccaggcug

SEQ ID NO: 1524704 - RNA, 19 nt, Human
ugcccuguuaaaagaugaa

SEQ ID NO: 1524705 - RNA, 22 nt, Human
ugcccuuaccugccaggaagcc

SEQ ID NO: 1524706 - RNA, 15 nt, Human
ugcccugugggcccc

SEQ ID NO: 1524707 - RNA, 18 nt, Human
ugcccugugggcccccaa

SEQ ID NO: 1524708 - RNA, 13 nt, Human
agcuccagcucac

SEQ ID NO: 1524709 - RNA, 17 nt, Human
agcuccagcucaccagc

SEQ ID NO: 1524710 - RNA, 14 nt, Human
ugcccugcccaccu

SEQ ID NO: 1524711 - RNA, 17 nt, Human
agcuccaagcucccagg

SEQ ID NO: 1524712 - RNA, 18 nt, Human
agcuccaagcucccaggc

SEQ ID NO: 1524713 - RNA, 19 nt, Human
agcuccaagcucccaggca

SEQ ID NO: 1524714 - RNA, 23 nt, Human
agcucugcccauccugccccuga

SEQ ID NO: 1524715 - RNA, 23 nt, Human
agcuccuucuguccuacucugug

SEQ ID NO: 1524716 - RNA, 21 nt, Human
agcuccagcucaccagcccca

SEQ ID NO: 1524717 - RNA, 18 nt, Human
agcuccagcucaccagcc

SEQ ID NO: 1524718 - RNA, 19 nt, Human
agcuccagcucaccagccc

SEQ ID NO: 1524719 - RNA, 19 nt, Human
ugcauuugaggucuguucu

SEQ ID NO: 1524720 - RNA, 20 nt, Human
ugcauuuaaaagauacaguu

SEQ ID NO: 1524721 - RNA, 23 nt, Human
agccuugaccauucuccaccugc

SEQ ID NO: 1524722 - RNA, 22 nt, Human
agcgauucuucugcuucagccu

SEQ ID NO: 1524723 - RNA, 22 nt, Human
agccuugaacuuugaccucugc

SEQ ID NO: 1524724 - RNA, 16 nt, Human
agccuugaacuuugac

SEQ ID NO: 1524725 - RNA, 23 nt, Human
agccuugaacuuugaccucugca

SEQ ID NO: 1524726 - RNA, 15 nt, Human
agccuugaacuuuga

SEQ ID NO: 1524727 - RNA, 18 nt, Human
agccuuccagggguggga

SEQ ID NO: 1524728 - RNA, 21 nt, Human
ugcauuugaggucuguucuuu

SEQ ID NO: 1524729 - RNA, 20 nt, Human
ugcauuugaggucuguucuu

SEQ ID NO: 1524730 - RNA, 18 nt, Human
ugccagcuuaucucaggg

SEQ ID NO: 1524731 - RNA, 13 nt, Human
agcggcuggcagc

SEQ ID NO: 1524732 - RNA, 22 nt, Human
agcggggacagcuccuucuguc

SEQ ID NO: 1524733 - RNA, 23 nt, Human
agcggcuggcagcccaccccuca

SEQ ID NO: 1524734 - RNA, 19 nt, Human
agcggggacagcuccuucu

SEQ ID NO: 1524735 - RNA, 20 nt, Human
agcggggacagcuccuucug

SEQ ID NO: 1524736 - RNA, 15 nt, Human
agcuccaagaauuuc

SEQ ID NO: 1524737 - RNA, 17 nt, Human
agcucaggugucccugc

SEQ ID NO: 1524738 - RNA, 18 nt, Human
agcuccaagaauuucuag

SEQ ID NO: 1524739 - RNA, 15 nt, Human
agcuccaagcuccca

SEQ ID NO: 1524740 - RNA, 16 nt, Human
agcuccaagcucccag

SEQ ID NO: 1524741 - RNA, 22 nt, Human
ugccauuuaaagcuuauuaaaa

SEQ ID NO: 1524742 - RNA, 20 nt, Human
agcucagggccuggcucagg

SEQ ID NO: 1524743 - RNA, 14 nt, Human
agcucagggccugg

SEQ ID NO: 1524744 - RNA, 19 nt, Human
agcucagggccuggcucag

SEQ ID NO: 1524745 - RNA, 19 nt, Human
agcuauucaguaauaacuc

SEQ ID NO: 1524746 - RNA, 12 nt, Human
agcucagggccu

SEQ ID NO: 1524747 - RNA, 13 nt, Human
agcucagggccug

SEQ ID NO: 1524748 - RNA, 17 nt, Human
agcuacccgcagaguuc

SEQ ID NO: 1524749 - RNA, 21 nt, Human
agcuaggccuggccagaugca

SEQ ID NO: 1524750 - RNA, 13 nt, Human
agcgugagccacu

SEQ ID NO: 1524751 - RNA, 16 nt, Human
ugccccauucaacauc

SEQ ID NO: 1524752 - RNA, 20 nt, Human
ugcccuaaaguguauuuuuu

SEQ ID NO: 1524753 - RNA, 23 nt, Human
ugccccgaacauguuuuucuucu

SEQ ID NO: 1524754 - RNA, 17 nt, Human
ugcccaaagaugcagcc

SEQ ID NO: 1524755 - RNA, 20 nt, Human
ugcccaaagaugcagccggu

SEQ ID NO: 1524756 - RNA, 13 nt, Human
ugcccagccccuu

SEQ ID NO: 1524757 - RNA, 16 nt, Human
ugcccagccccuucug

SEQ ID NO: 1524758 - RNA, 17 nt, Human
ugcccagccccuucuga

SEQ ID NO: 1524759 - RNA, 20 nt, Human
ugcccagccccuucugaccc

SEQ ID NO: 1524760 - RNA, 15 nt, Human
ugcccaggccccugc

SEQ ID NO: 1524761 - RNA, 17 nt, Human
ugcccaggccccugcca

SEQ ID NO: 1524762 - RNA, 18 nt, Human
ugcccaggccccugccac

SEQ ID NO: 1524763 - RNA, 17 nt, Human
agccucacaguccuuac

SEQ ID NO: 1524764 - RNA, 18 nt, Human
agccucacaguccuuacc

SEQ ID NO: 1524765 - RNA, 20 nt, Human
agccucaaccuccugggcua

SEQ ID NO: 1524766 - RNA, 18 nt, Human
agccgagaucacgccacu

SEQ ID NO: 1524767 - RNA, 21 nt, Human
ugcagccucaaccuccugggc

SEQ ID NO: 1524768 - RNA, 22 nt, Human
ugcagccucaaccuccugggcu

SEQ ID NO: 1524769 - RNA, 23 nt, Human
ugcagccucaaccuccugggcua

SEQ ID NO: 1524770 - RNA, 23 nt, Human
agccucugaaaaccaauguucuc

SEQ ID NO: 1524771 - RNA, 14 nt, Human
agccgaagcccagg

SEQ ID NO: 1524772 - RNA, 21 nt, Human
agccgagauagccaaggccaa

SEQ ID NO: 1524773 - RNA, 17 nt, Human
agccgagaucacgccac

SEQ ID NO: 1524774 - RNA, 17 nt, Human
agcccuugcauugcaga

SEQ ID NO: 1524775 - RNA, 21 nt, Human
agcccuuagcagggaaacagc

SEQ ID NO: 1524776 - RNA, 18 nt, Human
ugcagacucuacagaggc

SEQ ID NO: 1524777 - RNA, 16 nt, Human
ugcagacucuacagag

SEQ ID NO: 1524778 - RNA, 17 nt, Human
ugcagacucuacagagg

SEQ ID NO: 1524779 - RNA, 16 nt, Human
agcccuuagcagggaa

SEQ ID NO: 1524780 - RNA, 21 nt, Human
agcccugguggcagugggagc

SEQ ID NO: 1524781 - RNA, 19 nt, Human
ugcacuccccugcugggug

SEQ ID NO: 1524782 - RNA, 16 nt, Human
ugcacuccccugcugg

SEQ ID NO: 1524783 - RNA, 17 nt, Human
ugcacuccccugcuggg

SEQ ID NO: 1524784 - RNA, 15 nt, Human
ugcacacauuuuuua

SEQ ID NO: 1524785 - RNA, 13 nt, Human
ugcacacauuuuu

SEQ ID NO: 1524786 - RNA, 12 nt, Human
ugcacacauuuu

SEQ ID NO: 1524787 - RNA, 11 nt, Human
ugcacacauuu

SEQ ID NO: 1524788 - RNA, 22 nt, Human
ugcagaagacaguauggcagcu

SEQ ID NO: 1524789 - RNA, 14 nt, Human
ugcagaagacagua

SEQ ID NO: 1524790 - RNA, 15 nt, Human
ugcagaagacaguau

SEQ ID NO: 1524791 - RNA, 22 nt, Human
ugcagacaggcaagcaccuccu

SEQ ID NO: 1524792 - RNA, 13 nt, Human
agcccaggggccg

SEQ ID NO: 1524793 - RNA, 16 nt, Human
agccccaaaacucucc

SEQ ID NO: 1524794 - RNA, 17 nt, Human
agccccaaaacucuccu

SEQ ID NO: 1524795 - RNA, 18 nt, Human
agccccaaaacucuccuc

SEQ ID NO: 1524796 - RNA, 21 nt, Human
agccccauucugccugcccag

SEQ ID NO: 1524797 - RNA, 22 nt, Human
agccccauucugccugcccagg

SEQ ID NO: 1524798 - RNA, 21 nt, Human
ugcaaaccaucauugaaaucu

SEQ ID NO: 1524799 - RNA, 22 nt, Human
ugcacacaccagagcccaccuu

SEQ ID NO: 1524800 - RNA, 21 nt, Human
ugcacacaccagagcccaccu

SEQ ID NO: 1524801 - RNA, 18 nt, Human
ugcacacaccagagccca

SEQ ID NO: 1524802 - RNA, 14 nt, Human
agcccugguggcag

SEQ ID NO: 1524803 - RNA, 15 nt, Human
agcccugguggcagu

SEQ ID NO: 1524804 - RNA, 16 nt, Human
agcccugguggcagug

SEQ ID NO: 1524805 - RNA, 23 nt, Human
agccccauucugccugcccaggc

SEQ ID NO: 1524806 - RNA, 13 nt, Human
agcccacuucugc

SEQ ID NO: 1524807 - RNA, 14 nt, Human
agcccacuucugcc

SEQ ID NO: 1524808 - RNA, 15 nt, Human
agcccacuucugcca

SEQ ID NO: 1524809 - RNA, 22 nt, Human
agcccacuucugccauauucug

SEQ ID NO: 1524810 - RNA, 21 nt, Human
agccaguaaaugggggugcau

SEQ ID NO: 1524811 - RNA, 22 nt, Human
agccaguaaaugggggugcauu

SEQ ID NO: 1524812 - RNA, 13 nt, Human
agccaguaaaugg

SEQ ID NO: 1524813 - RNA, 22 nt, Human
ugauucccaagcucugcuccuc

SEQ ID NO: 1524814 - RNA, 23 nt, Human
ugauucccaagcucugcuccucu

SEQ ID NO: 1524815 - RNA, 13 nt, Human
ugauucuccugcc

SEQ ID NO: 1524816 - RNA, 14 nt, Human
agcccaggaaaggc

SEQ ID NO: 1524817 - RNA, 21 nt, Human
ugauucauaaugacuuaagca

SEQ ID NO: 1524818 - RNA, 18 nt, Human
agcccaggaaaggcucca

SEQ ID NO: 1524819 - RNA, 16 nt, Human
ugauucauaaugacuu

SEQ ID NO: 1524820 - RNA, 22 nt, Human
ugauuuccguuaaaauaccagc

SEQ ID NO: 1524821 - RNA, 13 nt, Human
ugauuucauucaa

SEQ ID NO: 1524822 - RNA, 17 nt, Human
ugauuuggggauauuuu

SEQ ID NO: 1524823 - RNA, 19 nt, Human
ugaugggaaagcauuguaa

SEQ ID NO: 1524824 - RNA, 21 nt, Human
ugaugggcaacccccagccug

SEQ ID NO: 1524825 - RNA, 15 nt, Human
ugauggggcccugcc

SEQ ID NO: 1524826 - RNA, 16 nt, Human
ugauggggcccugccu

SEQ ID NO: 1524827 - RNA, 19 nt, Human
ugauggggcccugccuccu

SEQ ID NO: 1524828 - RNA, 13 nt, Human
ugaugagaggaaa

SEQ ID NO: 1524829 - RNA, 14 nt, Human
ugaugagaggaaau

SEQ ID NO: 1524830 - RNA, 15 nt, Human
ugaugagaggaaauc

SEQ ID NO: 1524831 - RNA, 16 nt, Human
ugaugagaggaaauca

SEQ ID NO: 1524832 - RNA, 11 nt, Human
ugaugaagaag

SEQ ID NO: 1524833 - RNA, 12 nt, Human
ugaugaagaagu

SEQ ID NO: 1524834 - RNA, 16 nt, Human
ugauccuaguuccacc

SEQ ID NO: 1524835 - RNA, 15 nt, Human
ugauccucccaccuc

SEQ ID NO: 1524836 - RNA, 22 nt, Human
ugauccucccaccucagccucc

SEQ ID NO: 1524837 - RNA, 16 nt, Human
ugauccucccaccuca

SEQ ID NO: 1524838 - RNA, 21 nt, Human
ugauccucccaccucagccuc

SEQ ID NO: 1524839 - RNA, 23 nt, Human
ugauuaaguaaugauaacuggaa

SEQ ID NO: 1524840 - RNA, 20 nt, Human
ugauuaaccacuucagcuga

SEQ ID NO: 1524841 - RNA, 15 nt, Human
ugauuaauuaaaaca

SEQ ID NO: 1524842 - RNA, 18 nt, Human
ugauuaaguaaugauaac

SEQ ID NO: 1524843 - RNA, 19 nt, Human
ugauuaaccacuucagcug

SEQ ID NO: 1524844 - RNA, 20 nt, Human
ugauuaaauucuugcaaagu

SEQ ID NO: 1524845 - RNA, 19 nt, Human
ugauuaaauucuugcaaag

SEQ ID NO: 1524846 - RNA, 15 nt, Human
ugauggugcaaugac

SEQ ID NO: 1524847 - RNA, 13 nt, Human
ugauggugcaaug

SEQ ID NO: 1524848 - RNA, 20 nt, Human
agccacugcaccgggccaca

SEQ ID NO: 1524849 - RNA, 18 nt, Human
agccacugcaccgggcca

SEQ ID NO: 1524850 - RNA, 19 nt, Human
agccacugcaccgggccac

SEQ ID NO: 1524851 - RNA, 10 nt, Human
agccagagga

SEQ ID NO: 1524852 - RNA, 11 nt, Human
agccagaggag

SEQ ID NO: 1524853 - RNA, 18 nt, Human
uggcugccaaugggagcu

SEQ ID NO: 1524854 - RNA, 20 nt, Human
uggcugccaaugggagcuca

SEQ ID NO: 1524855 - RNA, 15 nt, Human
uggcugcagggaguc

SEQ ID NO: 1524856 - RNA, 13 nt, Human
uggcugcagggag

SEQ ID NO: 1524857 - RNA, 14 nt, Human
uggcugcagggagu

SEQ ID NO: 1524858 - RNA, 12 nt, Human
uggcugcaaagg

SEQ ID NO: 1524859 - RNA, 18 nt, Human
uggcucaaguccucuuuu

SEQ ID NO: 1524860 - RNA, 20 nt, Human
uggcucuuccaggcugggag

SEQ ID NO: 1524861 - RNA, 21 nt, Human
uggcucuuccaggcugggaga

SEQ ID NO: 1524862 - RNA, 18 nt, Human
aggcuggcgugcaguggu

SEQ ID NO: 1524863 - RNA, 20 nt, Human
aggcuggcgugcaguggugc

SEQ ID NO: 1524864 - RNA, 22 nt, Human
uggcuagagguucaaagauauu

SEQ ID NO: 1524865 - RNA, 14 nt, Human
aggcugggagagcc

SEQ ID NO: 1524866 - RNA, 22 nt, Human
uggcuauuagagaucaaccccu

SEQ ID NO: 1524867 - RNA, 19 nt, Human
uggcuaugcauuugaaaau

SEQ ID NO: 1524868 - RNA, 14 nt, Human
uggcuaugcauuug

SEQ ID NO: 1524869 - RNA, 17 nt, Human
uggcuaugcauuugaaa

SEQ ID NO: 1524870 - RNA, 15 nt, Human
uggcuaugcauuuga

SEQ ID NO: 1524871 - RNA, 16 nt, Human
ugggaaaggggaaguu

SEQ ID NO: 1524872 - RNA, 23 nt, Human
uggcuucacggaagagccuugcg

SEQ ID NO: 1524873 - RNA, 14 nt, Human
uggcugugucuccc

SEQ ID NO: 1524874 - RNA, 13 nt, Human
uggcuguuggcug

SEQ ID NO: 1524875 - RNA, 15 nt, Human
uggcuguuggcuggg

SEQ ID NO: 1524876 - RNA, 17 nt, Human
uggcuuaaaacaacacu

SEQ ID NO: 1524877 - RNA, 11 nt, Human
uggcugcugaa

SEQ ID NO: 1524878 - RNA, 16 nt, Human
aggcucugcccuuggu

SEQ ID NO: 1524879 - RNA, 13 nt, Human
aggcuggcgugca

SEQ ID NO: 1524880 - RNA, 17 nt, Human
aggcuggcgugcagugg

SEQ ID NO: 1524881 - RNA, 19 nt, Human
aggcuccuuuagcgcccag

SEQ ID NO: 1524882 - RNA, 12 nt, Human
aggcucgagcau

SEQ ID NO: 1524883 - RNA, 21 nt, Human
aggcucgagcaugccuggaug

SEQ ID NO: 1524884 - RNA, 15 nt, Human
aggcucgagcaugcc

SEQ ID NO: 1524885 - RNA, 17 nt, Human
aggcucgagcaugccug

SEQ ID NO: 1524886 - RNA, 18 nt, Human
aggcucgagcaugccugg

SEQ ID NO: 1524887 - RNA, 19 nt, Human
aggcucgagcaugccugga

SEQ ID NO: 1524888 - RNA, 21 nt, Human
aggcucucaggccagcugcuu

SEQ ID NO: 1524889 - RNA, 11 nt, Human
aggcucugccc

SEQ ID NO: 1524890 - RNA, 12 nt, Human
aggcucugcccu

SEQ ID NO: 1524891 - RNA, 13 nt, Human
aggcucugcccuu

SEQ ID NO: 1524892 - RNA, 14 nt, Human
aggcucugcccuug

SEQ ID NO: 1524893 - RNA, 15 nt, Human
aggcucugcccuugg

SEQ ID NO: 1524894 - RNA, 11 nt, Human
aggcucucagg

SEQ ID NO: 1524895 - RNA, 12 nt, Human
aggcucucaggc

SEQ ID NO: 1524896 - RNA, 14 nt, Human
aggcucucaggcca

SEQ ID NO: 1524897 - RNA, 15 nt, Human
aggcucucaggccag

SEQ ID NO: 1524898 - RNA, 16 nt, Human
aggcucucaggccagc

SEQ ID NO: 1524899 - RNA, 18 nt, Human
aggcucucaggccagcug

SEQ ID NO: 1524900 - RNA, 19 nt, Human
aggcucucaggccagcugc

SEQ ID NO: 1524901 - RNA, 20 nt, Human
aggcucucaggccagcugcu

SEQ ID NO: 1524902 - RNA, 18 nt, Human
uggacgagaaaacaauaa

SEQ ID NO: 1524903 - RNA, 16 nt, Human
aggccaaacucaccug

SEQ ID NO: 1524904 - RNA, 18 nt, Human
aggcauuuguuugaacug

SEQ ID NO: 1524905 - RNA, 23 nt, Human
aggccaaaggaagcacaugccuc

SEQ ID NO: 1524906 - RNA, 20 nt, Human
aggccaaacucaccugcccc

SEQ ID NO: 1524907 - RNA, 14 nt, Human
aggccaaaggaagc

SEQ ID NO: 1524908 - RNA, 15 nt, Human
aggccaaaggaagca

SEQ ID NO: 1524909 - RNA, 15 nt, Human
aggccacaagacccu

SEQ ID NO: 1524910 - RNA, 16 nt, Human
aggccacaagacccuu

SEQ ID NO: 1524911 - RNA, 20 nt, Human
uggaugccugguggcagcug

SEQ ID NO: 1524912 - RNA, 18 nt, Human
uggaugccugguggcagc

SEQ ID NO: 1524913 - RNA, 19 nt, Human
uggaugccugguggcagcu

SEQ ID NO: 1524914 - RNA, 16 nt, Human
uggaguucaucuugaa

SEQ ID NO: 1524915 - RNA, 17 nt, Human
uggaguucaucuugaau

SEQ ID NO: 1524916 - RNA, 20 nt, Human
uggaguucaucuugaauugu

SEQ ID NO: 1524917 - RNA, 12 nt, Human
aggccagagaca

SEQ ID NO: 1524918 - RNA, 13 nt, Human
uggcagccuuggc

SEQ ID NO: 1524919 - RNA, 20 nt, Human
aggccacaagacccuugugg

SEQ ID NO: 1524920 - RNA, 12 nt, Human
uggcagccccug

SEQ ID NO: 1524921 - RNA, 20 nt, Human
uggcacaucagcacgauuuc

SEQ ID NO: 1524922 - RNA, 22 nt, Human
uggcacaguuuucugagaaaga

SEQ ID NO: 1524923 - RNA, 22 nt, Human
uggauuaaacuuaaucuaaaug

SEQ ID NO: 1524924 - RNA, 12 nt, Human
uggauguucuga

SEQ ID NO: 1524925 - RNA, 21 nt, Human
uggcacaucagcacgauuucu

SEQ ID NO: 1524926 - RNA, 15 nt, Human
uggcacccggccccu

SEQ ID NO: 1524927 - RNA, 16 nt, Human
uggcacccggccccug

SEQ ID NO: 1524928 - RNA, 21 nt, Human
uggcagaguugaagacagagc

SEQ ID NO: 1524929 - RNA, 22 nt, Human
uggcagaguugaagacagagcu

SEQ ID NO: 1524930 - RNA, 17 nt, Human
uggccaggcuggucuca

SEQ ID NO: 1524931 - RNA, 22 nt, Human
uggcaugggaaugaaugucagu

SEQ ID NO: 1524932 - RNA, 12 nt, Human
uggcaugggaau

SEQ ID NO: 1524933 - RNA, 15 nt, Human
uggcaugggaaugaa

SEQ ID NO: 1524934 - RNA, 17 nt, Human
aggccugccuccagggc

SEQ ID NO: 1524935 - RNA, 19 nt, Human
aggccugccuccagggcug

SEQ ID NO: 1524936 - RNA, 20 nt, Human
aggccugccuccagggcugg

SEQ ID NO: 1524937 - RNA, 21 nt, Human
aggccugccuccagggcugga

SEQ ID NO: 1524938 - RNA, 13 nt, Human
aggcccucugccc

SEQ ID NO: 1524939 - RNA, 14 nt, Human
aggcccucugccca

SEQ ID NO: 1524940 - RNA, 15 nt, Human
aggcccucugcccac

SEQ ID NO: 1524941 - RNA, 14 nt, Human
uggccucugcacuc

SEQ ID NO: 1524942 - RNA, 15 nt, Human
uggccucugcacucc

SEQ ID NO: 1524943 - RNA, 17 nt, Human
uggccucugcacucccc

SEQ ID NO: 1524944 - RNA, 23 nt, Human
uggccgggcgcgguggcucacgc

SEQ ID NO: 1524945 - RNA, 18 nt, Human
uggccucugcacuccccu

SEQ ID NO: 1524946 - RNA, 12 nt, Human
uggccuggcccc

SEQ ID NO: 1524947 - RNA, 23 nt, Human
aggccugggggcugggcagagga

SEQ ID NO: 1524948 - RNA, 22 nt, Human
aggccuggccagaugcaccagc

SEQ ID NO: 1524949 - RNA, 23 nt, Human
aggccuggccagaugcaccagcc

SEQ ID NO: 1524950 - RNA, 16 nt, Human
aggccuggccagaugc

SEQ ID NO: 1524951 - RNA, 17 nt, Human
aggccuggccagaugca

SEQ ID NO: 1524952 - RNA, 21 nt, Human
aggccuggccagaugcaccag

SEQ ID NO: 1524953 - RNA, 12 nt, Human
uggccgggcagg

SEQ ID NO: 1524954 - RNA, 13 nt, Human
uggccgggcaggg

SEQ ID NO: 1524955 - RNA, 21 nt, Human
uggccgcgccaaauaaugucu

SEQ ID NO: 1524956 - RNA, 22 nt, Human
uggccgcgccaaauaaugucuc

SEQ ID NO: 1524957 - RNA, 23 nt, Human
uggccgcgccaaauaaugucucu

SEQ ID NO: 1524958 - RNA, 21 nt, Human
uggccccugcccggcugcgga

SEQ ID NO: 1524959 - RNA, 18 nt, Human
uggaauuggagcucgugg

SEQ ID NO: 1524960 - RNA, 19 nt, Human
aggcaacugcauuggcuuu

SEQ ID NO: 1524961 - RNA, 22 nt, Human
uggaauuucucccagucauuua

SEQ ID NO: 1524962 - RNA, 17 nt, Human
aggcaacucaucuuagg

SEQ ID NO: 1524963 - RNA, 19 nt, Human
aggaugcccaaagaugcag

SEQ ID NO: 1524964 - RNA, 20 nt, Human
aggaugaucuaggaagacuu

SEQ ID NO: 1524965 - RNA, 14 nt, Human
aggaugcccaaaga

SEQ ID NO: 1524966 - RNA, 19 nt, Human
aggauuuugauccaagcug

SEQ ID NO: 1524967 - RNA, 15 nt, Human
uggacacagcucuuc

SEQ ID NO: 1524968 - RNA, 16 nt, Human
uggacacagcucuucu

SEQ ID NO: 1524969 - RNA, 18 nt, Human
uggacacagcucuucucc

SEQ ID NO: 1524970 - RNA, 21 nt, Human
uggacacagcucuucuccagg

SEQ ID NO: 1524971 - RNA, 15 nt, Human
uggacccugaggccc

SEQ ID NO: 1524972 - RNA, 14 nt, Human
uggacccugaggcc

SEQ ID NO: 1524973 - RNA, 12 nt, Human
uggacccugagg

SEQ ID NO: 1524974 - RNA, 13 nt, Human
uggacccugaggc

SEQ ID NO: 1524975 - RNA, 20 nt, Human
uggaaauauuaagaaagacu

SEQ ID NO: 1524976 - RNA, 23 nt, Human
uggaaaugggcagagcagagacc

SEQ ID NO: 1524977 - RNA, 21 nt, Human
aggauacaaaagcaugugaga

SEQ ID NO: 1524978 - RNA, 15 nt, Human
aggauccugagccag

SEQ ID NO: 1524979 - RNA, 16 nt, Human
aggauccugagccaga

SEQ ID NO: 1524980 - RNA, 22 nt, Human
aggagggaggcaggggaggggu

SEQ ID NO: 1524981 - RNA, 17 nt, Human
aggauccugagccagau

SEQ ID NO: 1524982 - RNA, 18 nt, Human
aggauccugagccagauu

SEQ ID NO: 1524983 - RNA, 21 nt, Human
aggaucucuugagccugggag

SEQ ID NO: 1524984 - RNA, 22 nt, Human
aggaucucuugagccugggagg

SEQ ID NO: 1524985 - RNA, 16 nt, Human
aggaugaucuaggaag

SEQ ID NO: 1524986 - RNA, 17 nt, Human
aggaugaucuaggaaga

SEQ ID NO: 1524987 - RNA, 19 nt, Human
aggacugaauuaugaaacu

SEQ ID NO: 1524988 - RNA, 20 nt, Human
aggacugaauuaugaaacuu

SEQ ID NO: 1524989 - RNA, 19 nt, Human
aggacauugcggacagcca

SEQ ID NO: 1524990 - RNA, 23 nt, Human
aggacauugcggacagccacggc

SEQ ID NO: 1524991 - RNA, 15 nt, Human
aggacauugcggaca

SEQ ID NO: 1524992 - RNA, 17 nt, Human
aggacauugcggacagc

SEQ ID NO: 1524993 - RNA, 18 nt, Human
aggacauugcggacagcc

SEQ ID NO: 1524994 - RNA, 22 nt, Human
aggagccccgaggccuucucug

SEQ ID NO: 1524995 - RNA, 11 nt, Human
aggagaaacug

SEQ ID NO: 1524996 - RNA, 17 nt, Human
aggagauuggaaggaac

SEQ ID NO: 1524997 - RNA, 17 nt, Human
aggagaaacuggaacuc

SEQ ID NO: 1524998 - RNA, 21 nt, Human
ugcuuggaggaaggaaaccca

SEQ ID NO: 1524999 - RNA, 12 nt, Human
ugcuugggcuuc

SEQ ID NO: 1525000 - RNA, 16 nt, Human
ugcuugggcuucaucc

SEQ ID NO: 1525001 - RNA, 13 nt, Human
uggaaaggcagcu

SEQ ID NO: 1525002 - RNA, 15 nt, Human
uggaaauauuaagaa

SEQ ID NO: 1525003 - RNA, 19 nt, Human
ugcuugggcuucauccucc

SEQ ID NO: 1525004 - RNA, 15 nt, Human
ugcugcccugugagu

SEQ ID NO: 1525005 - RNA, 13 nt, Human
ugcuggagcucug

SEQ ID NO: 1525006 - RNA, 14 nt, Human
ugcuggagcucugc

SEQ ID NO: 1525007 - RNA, 13 nt, Human
ugcugcccuguga

SEQ ID NO: 1525008 - RNA, 14 nt, Human
ugcugcccugugag

SEQ ID NO: 1525009 - RNA, 16 nt, Human
ugcuggcugguuagag

SEQ ID NO: 1525010 - RNA, 18 nt, Human
ugcuggcuguuggcuggg

SEQ ID NO: 1525011 - RNA, 14 nt, Human
aggacacugauaug

SEQ ID NO: 1525012 - RNA, 23 nt, Human
aggacacuaaccacgcuggaccu

SEQ ID NO: 1525013 - RNA, 17 nt, Human
aggacacugauaugggu

SEQ ID NO: 1525014 - RNA, 22 nt, Human
aggacagggaggugaccccagg

SEQ ID NO: 1525015 - RNA, 16 nt, Human
ugcuucaaggauccug

SEQ ID NO: 1525016 - RNA, 18 nt, Human
ugcuucaaggauccugag

SEQ ID NO: 1525017 - RNA, 19 nt, Human
ugcuucaaggauccugagc

SEQ ID NO: 1525018 - RNA, 20 nt, Human
ugcuucaaggauccugagcc

SEQ ID NO: 1525019 - RNA, 13 nt, Human
ugcuucagccucc

SEQ ID NO: 1525020 - RNA, 14 nt, Human
ugcuucagccuccc

SEQ ID NO: 1525021 - RNA, 13 nt, Human
ugcuuauacacuu

SEQ ID NO: 1525022 - RNA, 19 nt, Human
agcugggacuacaggcacc

SEQ ID NO: 1525023 - RNA, 16 nt, Human
agcugggacuacaggc

SEQ ID NO: 1525024 - RNA, 18 nt, Human
agcugggacuacaggcac

SEQ ID NO: 1525025 - RNA, 16 nt, Human
ugcuccagcuguucag

SEQ ID NO: 1525026 - RNA, 19 nt, Human
ugcuccagcuguucagcug

SEQ ID NO: 1525027 - RNA, 20 nt, Human
ugcuccagcuguucagcugg

SEQ ID NO: 1525028 - RNA, 21 nt, Human
ugcucugcugacagacacagg

SEQ ID NO: 1525029 - RNA, 22 nt, Human
ugcucugcugacagacacaggc

SEQ ID NO: 1525030 - RNA, 15 nt, Human
ugcugagucugaagg

SEQ ID NO: 1525031 - RNA, 11 nt, Human
aggaauuuaaa

SEQ ID NO: 1525032 - RNA, 19 nt, Human
aggaaggaaacccagcucu

SEQ ID NO: 1525033 - RNA, 15 nt, Human
aggaaggagaggaga

SEQ ID NO: 1525034 - RNA, 18 nt, Human
aggaaggaaacccagcuc

SEQ ID NO: 1525035 - RNA, 17 nt, Human
aggaagccagcaggcuc

SEQ ID NO: 1525036 - RNA, 18 nt, Human
aggaagccagcaggcucu

SEQ ID NO: 1525037 - RNA, 14 nt, Human
aggaagccagcagg

SEQ ID NO: 1525038 - RNA, 15 nt, Human
aggaagccagcaggc

SEQ ID NO: 1525039 - RNA, 13 nt, Human
aggaagacuuugg

SEQ ID NO: 1525040 - RNA, 14 nt, Human
aggaagacuuugga

SEQ ID NO: 1525041 - RNA, 23 nt, Human
aggaagcacaugccucucucagg

SEQ ID NO: 1525042 - RNA, 24 nt, Human
aggaagcacaugccucucucaggc

SEQ ID NO: 1525043 - RNA, 16 nt, Human
ugcugagucugaaggc

SEQ ID NO: 1525044 - RNA, 17 nt, Human
ugcugagucugaaggcu

SEQ ID NO: 1525045 - RNA, 18 nt, Human
ugcugagucugaaggcug

SEQ ID NO: 1525046 - RNA, 21 nt, Human
ugcugagucugaaggcugggu

SEQ ID NO: 1525047 - RNA, 22 nt, Human
ugcugagucugaaggcuggguu

SEQ ID NO: 1525048 - RNA, 23 nt, Human
ugcugagucugaaggcuggguuc

SEQ ID NO: 1525049 - RNA, 13 nt, Human
aggaagacuucau

SEQ ID NO: 1525050 - RNA, 19 nt, Human
aggaagacuucaucccucu

SEQ ID NO: 1525051 - RNA, 21 nt, Human
ugagagacacacugaagaagc

SEQ ID NO: 1525052 - RNA, 22 nt, Human
ugagagacacacugaagaagca

SEQ ID NO: 1525053 - RNA, 14 nt, Human
ugagagcugggugu

SEQ ID NO: 1525054 - RNA, 10 nt, Human
ugagaggaaa

SEQ ID NO: 1525055 - RNA, 11 nt, Human
ugagaggaaau

SEQ ID NO: 1525056 - RNA, 12 nt, Human
ugagaggaaauc

SEQ ID NO: 1525057 - RNA, 13 nt, Human
ugagaggaaauca

SEQ ID NO: 1525058 - RNA, 14 nt, Human
ugagaggaaaucac

SEQ ID NO: 1525059 - RNA, 13 nt, Human
ugagauuucaucu

SEQ ID NO: 1525060 - RNA, 24 nt, Human
ugagaugugaacacaucagcuugc

SEQ ID NO: 1525061 - RNA, 18 nt, Human
ugagaugugaacacauca

SEQ ID NO: 1525062 - RNA, 19 nt, Human
ugagaugugaacacaucag

SEQ ID NO: 1525063 - RNA, 13 nt, Human
ugagaugugaaca

SEQ ID NO: 1525064 - RNA, 17 nt, Human
ugagaggaaaucaccga

SEQ ID NO: 1525065 - RNA, 23 nt, Human
ugagaggacuuuucuuuguggcu

SEQ ID NO: 1525066 - RNA, 16 nt, Human
ugagagacacacugaa

SEQ ID NO: 1525067 - RNA, 17 nt, Human
ugagagacacacugaag

SEQ ID NO: 1525068 - RNA, 19 nt, Human
ugagagacacacugaagaa

SEQ ID NO: 1525069 - RNA, 20 nt, Human
ugagagacacacugaagaag

SEQ ID NO: 1525070 - RNA, 20 nt, Human
ugagacucugucucagucca

SEQ ID NO: 1525071 - RNA, 20 nt, Human
ugagacucugucucaaaaaa

SEQ ID NO: 1525072 - RNA, 12 nt, Human
ugagacagcucu

SEQ ID NO: 1525073 - RNA, 22 nt, Human
ugagacagcccgggcucugccu

SEQ ID NO: 1525074 - RNA, 17 nt, Human
ugagacagcccgggcuc

SEQ ID NO: 1525075 - RNA, 18 nt, Human
ugagacagcccgggcucu

SEQ ID NO: 1525076 - RNA, 19 nt, Human
ugagacagcccgggcucug

SEQ ID NO: 1525077 - RNA, 20 nt, Human
ugagacagcccgggcucugc

SEQ ID NO: 1525078 - RNA, 15 nt, Human
agauuuuccugaaaa

SEQ ID NO: 1525079 - RNA, 16 nt, Human
agauuuuccugaaaac

SEQ ID NO: 1525080 - RNA, 12 nt, Human
ugagaauuaccc

SEQ ID NO: 1525081 - RNA, 15 nt, Human
ugagaauguaagaac

SEQ ID NO: 1525082 - RNA, 11 nt, Human
ugagacagagu

SEQ ID NO: 1525083 - RNA, 21 nt, Human
ugagacagaguuuucacucuu

SEQ ID NO: 1525084 - RNA, 13 nt, Human
ugagacagcccgg

SEQ ID NO: 1525085 - RNA, 20 nt, Human
agcaagggugaugggaaagc

SEQ ID NO: 1525086 - RNA, 22 nt, Human
agcaagggugaugggaaagcau

SEQ ID NO: 1525087 - RNA, 14 nt, Human
agcaagucaggguu

SEQ ID NO: 1525088 - RNA, 16 nt, Human
agcaagugagacccug

SEQ ID NO: 1525089 - RNA, 15 nt, Human
agcaagugagagcug

SEQ ID NO: 1525090 - RNA, 16 nt, Human
agcaagugagagcugg

SEQ ID NO: 1525091 - RNA, 14 nt, Human
agcaaggagauuua

SEQ ID NO: 1525092 - RNA, 19 nt, Human
agcaaggagauuuacaacu

SEQ ID NO: 1525093 - RNA, 17 nt, Human
agcaaggagauuuacaa

SEQ ID NO: 1525094 - RNA, 16 nt, Human
agcaagggugauggga

SEQ ID NO: 1525095 - RNA, 20 nt, Human
ugagccagauuucacucucc

SEQ ID NO: 1525096 - RNA, 21 nt, Human
ugagccagauuucacucuccu

SEQ ID NO: 1525097 - RNA, 14 nt, Human
ugagccacugcacc

SEQ ID NO: 1525098 - RNA, 18 nt, Human
ugagccacugcaccgggc

SEQ ID NO: 1525099 - RNA, 18 nt, Human
ugagccagauuucacucu

SEQ ID NO: 1525100 - RNA, 19 nt, Human
ugagccagauuucacucuc

SEQ ID NO: 1525101 - RNA, 22 nt, Human
ugagauuucaucugcucuccuu

SEQ ID NO: 1525102 - RNA, 14 nt, Human
ugagauuucaucug

SEQ ID NO: 1525103 - RNA, 18 nt, Human
ugagauuucaucugcucu

SEQ ID NO: 1525104 - RNA, 19 nt, Human
ugagauuucaucugcucuc

SEQ ID NO: 1525105 - RNA, 21 nt, Human
ugagauuucaucugcucuccu

SEQ ID NO: 1525106 - RNA, 12 nt, Human
ugagccacugca

SEQ ID NO: 1525107 - RNA, 13 nt, Human
ugagccacugcac

SEQ ID NO: 1525108 - RNA, 13 nt, Human
agcaccuccugcc

SEQ ID NO: 1525109 - RNA, 14 nt, Human
agcaccuccugccu

SEQ ID NO: 1525110 - RNA, 16 nt, Human
agcaccuccugccucg

SEQ ID NO: 1525111 - RNA, 22 nt, Human
agcaccaaaagcuuaccaaggg

SEQ ID NO: 1525112 - RNA, 23 nt, Human
agcacaugccucucucaggccaa

SEQ ID NO: 1525113 - RNA, 16 nt, Human
agcaccaucucuccuc

SEQ ID NO: 1525114 - RNA, 18 nt, Human
agcacaugccucucucag

SEQ ID NO: 1525115 - RNA, 19 nt, Human
agcacaugccucucucagg

SEQ ID NO: 1525116 - RNA, 20 nt, Human
agcacaugccucucucaggc

SEQ ID NO: 1525117 - RNA, 21 nt, Human
agcacaugccucucucaggcc

SEQ ID NO: 1525118 - RNA, 22 nt, Human
agcacaugccucucucaggcca

SEQ ID NO: 1525119 - RNA, 21 nt, Human
agcacagcuucauuuccugug

SEQ ID NO: 1525120 - RNA, 17 nt, Human
agcaagugagagcuggg

SEQ ID NO: 1525121 - RNA, 18 nt, Human
agcaagugagagcugggu

SEQ ID NO: 1525122 - RNA, 21 nt, Human
agaugcaguucugaagaagau

SEQ ID NO: 1525123 - RNA, 19 nt, Human
agaugcuagaacucccuuu

SEQ ID NO: 1525124 - RNA, 21 nt, Human
agaugcuagaacucccuuuca

SEQ ID NO: 1525125 - RNA, 22 nt, Human
agaugcuagaacucccuuucaa

SEQ ID NO: 1525126 - RNA, 13 nt, Human
agauccuggaaau

SEQ ID NO: 1525127 - RNA, 14 nt, Human
agauccuggaaauc

SEQ ID NO: 1525128 - RNA, 18 nt, Human
agaucucuaacuucacca

SEQ ID NO: 1525129 - RNA, 16 nt, Human
ugacagggccagugca

SEQ ID NO: 1525130 - RNA, 19 nt, Human
ugacagggccagugcaguu

SEQ ID NO: 1525131 - RNA, 22 nt, Human
ugacagggcacaccgggcacuc

SEQ ID NO: 1525132 - RNA, 17 nt, Human
ugacaggcaaugcuggc

SEQ ID NO: 1525133 - RNA, 19 nt, Human
ugacaggcaaugcuggcug

SEQ ID NO: 1525134 - RNA, 16 nt, Human
ugacacgaauauugcu

SEQ ID NO: 1525135 - RNA, 19 nt, Human
ugacacgaauauugcugau

SEQ ID NO: 1525136 - RNA, 15 nt, Human
ugacacuuaaaaaug

SEQ ID NO: 1525137 - RNA, 16 nt, Human
ugacacuuaaaaaugg

SEQ ID NO: 1525138 - RNA, 20 nt, Human
ugacuuacuguacaugaaaa

SEQ ID NO: 1525139 - RNA, 12 nt, Human
ugacuuacugua

SEQ ID NO: 1525140 - RNA, 13 nt, Human
agauucauauuua

SEQ ID NO: 1525141 - RNA, 16 nt, Human
agauucauauuuacuu

SEQ ID NO: 1525142 - RNA, 23 nt, Human
agauuucaucugcucuccuuccu

SEQ ID NO: 1525143 - RNA, 19 nt, Human
agauuucacucuccuuggu

SEQ ID NO: 1525144 - RNA, 13 nt, Human
agauuucaucugc

SEQ ID NO: 1525145 - RNA, 15 nt, Human
agauuucaucugcuc

SEQ ID NO: 1525146 - RNA, 18 nt, Human
agauuucaucugcucucc

SEQ ID NO: 1525147 - RNA, 19 nt, Human
agauuucaucugcucuccu

SEQ ID NO: 1525148 - RNA, 20 nt, Human
agauuucaucugcucuccuu

SEQ ID NO: 1525149 - RNA, 21 nt, Human
agauuucaucugcucuccuuc

SEQ ID NO: 1525150 - RNA, 19 nt, Human
agauucauauuuacuucuu

SEQ ID NO: 1525151 - RNA, 22 nt, Human
agaugugaacacaucagcuugc

SEQ ID NO: 1525152 - RNA, 22 nt, Human
agauguauguacuucaugcugu

SEQ ID NO: 1525153 - RNA, 17 nt, Human
agaugugaacacaucag

SEQ ID NO: 1525154 - RNA, 15 nt, Human
ugaccuuuaagagaa

SEQ ID NO: 1525155 - RNA, 14 nt, Human
ugacuaugacauaa

SEQ ID NO: 1525156 - RNA, 12 nt, Human
ugaccuuucaau

SEQ ID NO: 1525157 - RNA, 13 nt, Human
ugaccuuucaaua

SEQ ID NO: 1525158 - RNA, 14 nt, Human
ucuuuguggcuucc

SEQ ID NO: 1525159 - RNA, 16 nt, Human
agagacacacugaaga

SEQ ID NO: 1525160 - RNA, 14 nt, Human
agagacagaaagca

SEQ ID NO: 1525161 - RNA, 15 nt, Human
agagacagaaagcag

SEQ ID NO: 1525162 - RNA, 14 nt, Human
ucuuuguacagaca

SEQ ID NO: 1525163 - RNA, 15 nt, Human
ucuuuguacagacaa

SEQ ID NO: 1525164 - RNA, 20 nt, Human
ucuuuguacagacaacaaac

SEQ ID NO: 1525165 - RNA, 15 nt, Human
agacuuuuccaaccc

SEQ ID NO: 1525166 - RNA, 19 nt, Human
agacuuuggaaagaguagg

SEQ ID NO: 1525167 - RNA, 19 nt, Human
agacuuuucuuucagccaa

SEQ ID NO: 1525168 - RNA, 16 nt, Human
agagacacaagccuuc

SEQ ID NO: 1525169 - RNA, 19 nt, Human
agagacacaagccuucggc

SEQ ID NO: 1525170 - RNA, 20 nt, Human
agacugguuccauggccucu

SEQ ID NO: 1525171 - RNA, 14 nt, Human
agacuguacaaagu

SEQ ID NO: 1525172 - RNA, 17 nt, Human
agacuuuggaaagacuu

SEQ ID NO: 1525173 - RNA, 15 nt, Human
agacuuuggaaagag

SEQ ID NO: 1525174 - RNA, 12 nt, Human
ucuuuccugagg

SEQ ID NO: 1525175 - RNA, 18 nt, Human
ucuuuaaugucacaggca

SEQ ID NO: 1525176 - RNA, 19 nt, Human
ucuuuaaugucacaggcag

SEQ ID NO: 1525177 - RNA, 20 nt, Human
agacaggcaagcaccuccug

SEQ ID NO: 1525178 - RNA, 22 nt, Human
agacaggcaagcaccuccugcc

SEQ ID NO: 1525179 - RNA, 15 nt, Human
ucuuuaaugucacag

SEQ ID NO: 1525180 - RNA, 23 nt, Human
agacuggcacaguuuucugagaa

SEQ ID NO: 1525181 - RNA, 13 nt, Human
agacucugucuca

SEQ ID NO: 1525182 - RNA, 20 nt, Human
agacuggcacaguuuucuga

SEQ ID NO: 1525183 - RNA, 21 nt, Human
agacuggcacaguuuucugag

SEQ ID NO: 1525184 - RNA, 13 nt, Human
agacuccugcagg

SEQ ID NO: 1525185 - RNA, 14 nt, Human
agacuccugcaggc

SEQ ID NO: 1525186 - RNA, 18 nt, Human
ugaaaauuaacacugcuu

SEQ ID NO: 1525187 - RNA, 14 nt, Human
ugaaaauuaacacu

SEQ ID NO: 1525188 - RNA, 15 nt, Human
ugaaaauuaacacug

SEQ ID NO: 1525189 - RNA, 16 nt, Human
ugaaaauuaacacugc

SEQ ID NO: 1525190 - RNA, 13 nt, Human
ugaaagaaaauaa

SEQ ID NO: 1525191 - RNA, 18 nt, Human
ugaaacuggauuaaacuu

SEQ ID NO: 1525192 - RNA, 17 nt, Human
ugaaacuggauuaaacu

SEQ ID NO: 1525193 - RNA, 23 nt, Human
ugaaaaugcaacaacauguauaa

SEQ ID NO: 1525194 - RNA, 20 nt, Human
ugaaaaugcaacaacaugua

SEQ ID NO: 1525195 - RNA, 21 nt, Human
ugaaaaugcaacaacauguau

SEQ ID NO: 1525196 - RNA, 18 nt, Human
ugaaaaugcaacaacaug

SEQ ID NO: 1525197 - RNA, 16 nt, Human
ugaaaaucgugacaac

SEQ ID NO: 1525198 - RNA, 21 nt, Human
ugaaaauauuuguaucacaaa

SEQ ID NO: 1525199 - RNA, 22 nt, Human
ugaaaauauuuguaucacaaau

SEQ ID NO: 1525200 - RNA, 17 nt, Human
ugaaaauauuuguauca

SEQ ID NO: 1525201 - RNA, 20 nt, Human
ugaaaacacauuuuucuuag

SEQ ID NO: 1525202 - RNA, 19 nt, Human
ugaaaacacauuuuucuua

SEQ ID NO: 1525203 - RNA, 17 nt, Human
ugaaaacacauuuuucu

SEQ ID NO: 1525204 - RNA, 15 nt, Human
ugaaaacacauuuuu

SEQ ID NO: 1525205 - RNA, 13 nt, Human
ugaaaacacauuu

SEQ ID NO: 1525206 - RNA, 12 nt, Human
ugaaaacacauu

SEQ ID NO: 1525207 - RNA, 14 nt, Human
ugaaaacacauuuu

SEQ ID NO: 1525208 - RNA, 18 nt, Human
ugaaagaggaaugaagua

SEQ ID NO: 1525209 - RNA, 19 nt, Human
agagaccaucccugaaggc

SEQ ID NO: 1525210 - RNA, 21 nt, Human
agagaccaucccugaaggccc

SEQ ID NO: 1525211 - RNA, 22 nt, Human
agagaccaucccugaaggcccc

SEQ ID NO: 1525212 - RNA, 23 nt, Human
agagaccaucccugaaggccccg

SEQ ID NO: 1525213 - RNA, 17 nt, Human
ugaaagaggaaugaagu

SEQ ID NO: 1525214 - RNA, 22 nt, Human
ugaaagacuguacaaaguagaa

SEQ ID NO: 1525215 - RNA, 18 nt, Human
ugaaagacuguacaaagu

SEQ ID NO: 1525216 - RNA, 19 nt, Human
ugaaagacuguacaaagua

SEQ ID NO: 1525217 - RNA, 22 nt, Human
ugaaagaaaauaccaaggaaca

SEQ ID NO: 1525218 - RNA, 16 nt, Human
ugaaagacuguacaaa

SEQ ID NO: 1525219 - RNA, 15 nt, Human
agagacuccugcagg

SEQ ID NO: 1525220 - RNA, 12 nt, Human
agagacuccugc

SEQ ID NO: 1525221 - RNA, 13 nt, Human
agagacuccugca

SEQ ID NO: 1525222 - RNA, 14 nt, Human
agagacuccugcag

SEQ ID NO: 1525223 - RNA, 15 nt, Human
ugaaauuuccuggga

SEQ ID NO: 1525224 - RNA, 19 nt, Human
ugaaauuuccuaauuuauu

SEQ ID NO: 1525225 - RNA, 19 nt, Human
ugaaauuuuuauuaaauua

SEQ ID NO: 1525226 - RNA, 21 nt, Human
ugaaauuuccugggagcuuuu

SEQ ID NO: 1525227 - RNA, 20 nt, Human
ugaaauuuuuauuaaauuau

SEQ ID NO: 1525228 - RNA, 13 nt, Human
ugaaauaaacguc

SEQ ID NO: 1525229 - RNA, 18 nt, Human
ugaaauaaacgucuuaaa

SEQ ID NO: 1525230 - RNA, 22 nt, Human
ugaaauaaacgucuuaaauauu

SEQ ID NO: 1525231 - RNA, 23 nt, Human
ugaaauaaacgucuuaaauauuc

SEQ ID NO: 1525232 - RNA, 17 nt, Human
ugaaauaacauggccuu

SEQ ID NO: 1525233 - RNA, 16 nt, Human
ugaaauaacauggccu

SEQ ID NO: 1525234 - RNA, 14 nt, Human
ugaaauaagccaga

SEQ ID NO: 1525235 - RNA, 16 nt, Human
agagauugugguuuca

SEQ ID NO: 1525236 - RNA, 23 nt, Human
ugaacuagaguuuagcuggaaaa

SEQ ID NO: 1525237 - RNA, 22 nt, Human
ugaaccgaugagaaauaaaguu

SEQ ID NO: 1525238 - RNA, 22 nt, Human
ugaacccauauuuguacaccaa

SEQ ID NO: 1525239 - RNA, 18 nt, Human
ugaacccgggaggcagag

SEQ ID NO: 1525240 - RNA, 18 nt, Human
ugaacaaauuuacagaga

SEQ ID NO: 1525241 - RNA, 22 nt, Human
ugaaccaccacacccagcccac

SEQ ID NO: 1525242 - RNA, 13 nt, Human
ugaacaaauuuac

SEQ ID NO: 1525243 - RNA, 13 nt, Human
ugaagacagagcu

SEQ ID NO: 1525244 - RNA, 23 nt, Human
ugaagacaaugacuuacuguaca

SEQ ID NO: 1525245 - RNA, 22 nt, Human
ugaagacaaugacuuacuguac

SEQ ID NO: 1525246 - RNA, 11 nt, Human
ugaacuccugg

SEQ ID NO: 1525247 - RNA, 20 nt, Human
agagguucaaagauauuuug

SEQ ID NO: 1525248 - RNA, 19 nt, Human
agagguucaaagauauuuu

SEQ ID NO: 1525249 - RNA, 16 nt, Human
agagguucaaagauau

SEQ ID NO: 1525250 - RNA, 13 nt, Human
agagguucaaaga

SEQ ID NO: 1525251 - RNA, 20 nt, Human
agagggagugacagaggcag

SEQ ID NO: 1525252 - RNA, 15 nt, Human
agagggagugacaga

SEQ ID NO: 1525253 - RNA, 22 nt, Human
agaggcugccucucccaucacu

SEQ ID NO: 1525254 - RNA, 24 nt, Human
agaggcagccccauucugccugcc

SEQ ID NO: 1525255 - RNA, 20 nt, Human
agaggccugccuccagggcu

SEQ ID NO: 1525256 - RNA, 21 nt, Human
agaggccugccuccagggcug

SEQ ID NO: 1525257 - RNA, 22 nt, Human
agaggccugccuccagggcugg

SEQ ID NO: 1525258 - RNA, 18 nt, Human
agagcuguucacagccag

SEQ ID NO: 1525259 - RNA, 19 nt, Human
agagcuguucacagccaga

SEQ ID NO: 1525260 - RNA, 22 nt, Human
agaggcagccccauucugccug

SEQ ID NO: 1525261 - RNA, 23 nt, Human
agaggcagccccauucugccugc

SEQ ID NO: 1525262 - RNA, 13 nt, Human
ugaauaauacagu

SEQ ID NO: 1525263 - RNA, 17 nt, Human
ugaaguacucauacaug

SEQ ID NO: 1525264 - RNA, 13 nt, Human
ugaagucacacag

SEQ ID NO: 1525265 - RNA, 12 nt, Human
ugaauaauacag

SEQ ID NO: 1525266 - RNA, 17 nt, Human
ugaagauuuaccacuug

SEQ ID NO: 1525267 - RNA, 20 nt, Human
ugaagauuuaccacuugugu

SEQ ID NO: 1525268 - RNA, 18 nt, Human
ugaagguuucugaaaauu

SEQ ID NO: 1525269 - RNA, 22 nt, Human
ugaaguaauaugcacacauuuu

SEQ ID NO: 1525270 - RNA, 21 nt, Human
ugaaguaauaugcacacauuu

SEQ ID NO: 1525271 - RNA, 20 nt, Human
ugaaguaauaugcacacauu

SEQ ID NO: 1525272 - RNA, 16 nt, Human
ugaaguaauaugcaca

SEQ ID NO: 1525273 - RNA, 15 nt, Human
ugaaguaauaugcac

SEQ ID NO: 1525274 - RNA, 13 nt, Human
agaauauguuuca

SEQ ID NO: 1525275 - RNA, 17 nt, Human
agaauauguuucaaacu

SEQ ID NO: 1525276 - RNA, 18 nt, Human
agaauauguuucaaacuu

SEQ ID NO: 1525277 - RNA, 19 nt, Human
agaauauguuucaaacuuu

SEQ ID NO: 1525278 - RNA, 21 nt, Human
agaauauguuucaaacuuugg

SEQ ID NO: 1525279 - RNA, 14 nt, Human
ucugcuuguguuaa

SEQ ID NO: 1525280 - RNA, 21 nt, Human
agaaguuucugccgcagcccu

SEQ ID NO: 1525281 - RNA, 22 nt, Human
agaaguuucugccgcagcccug

SEQ ID NO: 1525282 - RNA, 23 nt, Human
agaaguuucugccgcagcccugc

SEQ ID NO: 1525283 - RNA, 23 nt, Human
agaauuaacacaugauccugcaa

SEQ ID NO: 1525284 - RNA, 15 nt, Human
agaauuaacacauga

SEQ ID NO: 1525285 - RNA, 15 nt, Human
agaauguaagaacua

SEQ ID NO: 1525286 - RNA, 16 nt, Human
agaauguaagaacuac

SEQ ID NO: 1525287 - RNA, 15 nt, Human
agaauggggugcaug

SEQ ID NO: 1525288 - RNA, 22 nt, Human
agaauuugauaugugaacaguu

SEQ ID NO: 1525289 - RNA, 21 nt, Human
agaauuugauaugugaacagu

SEQ ID NO: 1525290 - RNA, 12 nt, Human
agacacacauga

SEQ ID NO: 1525291 - RNA, 15 nt, Human
agacacacaugaagu

SEQ ID NO: 1525292 - RNA, 12 nt, Human
agacacaggccc

SEQ ID NO: 1525293 - RNA, 13 nt, Human
agacacaggcccg

SEQ ID NO: 1525294 - RNA, 16 nt, Human
agacacaggcccggcu

SEQ ID NO: 1525295 - RNA, 13 nt, Human
agacagagcuaca

SEQ ID NO: 1525296 - RNA, 19 nt, Human
agacaccuugacagggcac

SEQ ID NO: 1525297 - RNA, 18 nt, Human
agacaccuugacagggca

SEQ ID NO: 1525298 - RNA, 17 nt, Human
agacaccuugacagggc

SEQ ID NO: 1525299 - RNA, 16 nt, Human
agacacauguccaaga

SEQ ID NO: 1525300 - RNA, 20 nt, Human
agacacauguccaagaagcc

SEQ ID NO: 1525301 - RNA, 13 nt, Human
ucuguucuuucca

SEQ ID NO: 1525302 - RNA, 22 nt, Human
ucuguucuuuccaaaguacacu

SEQ ID NO: 1525303 - RNA, 12 nt, Human
ucuguuggccag

SEQ ID NO: 1525304 - RNA, 17 nt, Human
ucuguuggccaguguga

SEQ ID NO: 1525305 - RNA, 13 nt, Human
ucuguuuagauaa

SEQ ID NO: 1525306 - RNA, 17 nt, Human
ucugugagacucgagaa

SEQ ID NO: 1525307 - RNA, 21 nt, Human
ucugugagacucgagaacuuu

SEQ ID NO: 1525308 - RNA, 23 nt, Human
ucugugagaugcuagaacucccu

SEQ ID NO: 1525309 - RNA, 17 nt, Human
ucugugagaugcuagaa

SEQ ID NO: 1525310 - RNA, 22 nt, Human
ucugugagaugcuagaacuccc

SEQ ID NO: 1525311 - RNA, 14 nt, Human
ucugugagaugcua

SEQ ID NO: 1525312 - RNA, 16 nt, Human
ucugugaaaguacauu

SEQ ID NO: 1525313 - RNA, 18 nt, Human
agaagaugguaccaccag

SEQ ID NO: 1525314 - RNA, 13 nt, Human
agaagaacugaaa

SEQ ID NO: 1525315 - RNA, 14 nt, Human
agaagaacugaaau

SEQ ID NO: 1525316 - RNA, 22 nt, Human
agaacugccuuuggcagaguuc

SEQ ID NO: 1525317 - RNA, 16 nt, Human
agaagccacaggccug

SEQ ID NO: 1525318 - RNA, 17 nt, Human
agaagccacaggccuga

SEQ ID NO: 1525319 - RNA, 18 nt, Human
agaagccacaggccugag

SEQ ID NO: 1525320 - RNA, 18 nt, Human
agaagauuuugaaauuuu

SEQ ID NO: 1525321 - RNA, 19 nt, Human
agaagcaacccaaauguuc

SEQ ID NO: 1525322 - RNA, 12 nt, Human
agaagcccagga

SEQ ID NO: 1525323 - RNA, 16 nt, Human
agaagcccaggaaagg

SEQ ID NO: 1525324 - RNA, 18 nt, Human
agaagcccaggaaaggcu

SEQ ID NO: 1525325 - RNA, 20 nt, Human
agaagcccaggaaaggcucc

SEQ ID NO: 1525326 - RNA, 21 nt, Human
agaagcccaggaaaggcucca

SEQ ID NO: 1525327 - RNA, 22 nt, Human
agaagcccaggaaaggcuccag

SEQ ID NO: 1525328 - RNA, 23 nt, Human
agaagcccaggaaaggcuccagg

SEQ ID NO: 1525329 - RNA, 17 nt, Human
ucugcccacucccugca

SEQ ID NO: 1525330 - RNA, 19 nt, Human
ucugcucacauaucuguca

SEQ ID NO: 1525331 - RNA, 20 nt, Human
ucugcucacauaucugucau

SEQ ID NO: 1525332 - RNA, 14 nt, Human
ucugcuucagccuc

SEQ ID NO: 1525333 - RNA, 15 nt, Human
ucugcuucagccucc

SEQ ID NO: 1525334 - RNA, 14 nt, Human
ucugccgcagcccu

SEQ ID NO: 1525335 - RNA, 15 nt, Human
ucugccgcagcccug

SEQ ID NO: 1525336 - RNA, 18 nt, Human
ucugcccacucccugcaa

SEQ ID NO: 1525337 - RNA, 21 nt, Human
ucugcccacucccugcaaccu

SEQ ID NO: 1525338 - RNA, 23 nt, Human
ucugcccacucccugcaaccuga

SEQ ID NO: 1525339 - RNA, 19 nt, Human
ucugcccuccaagaccuuc

SEQ ID NO: 1525340 - RNA, 23 nt, Human
ucugccgcagcccugcagagggc

SEQ ID NO: 1525341 - RNA, 22 nt, Human
ucugccgcagcccugcagaggg

SEQ ID NO: 1525342 - RNA, 21 nt, Human
ucugccugcccaggccccugc

SEQ ID NO: 1525343 - RNA, 22 nt, Human
ucugccugcccaggccccugcc

SEQ ID NO: 1525344 - RNA, 20 nt, Human
ucugcgucgguccuggugcc

SEQ ID NO: 1525345 - RNA, 15 nt, Human
agaaauguacagcaa

SEQ ID NO: 1525346 - RNA, 14 nt, Human
agaaauguacagca

SEQ ID NO: 1525347 - RNA, 17 nt, Human
ucugcagcaauaaagca

SEQ ID NO: 1525348 - RNA, 18 nt, Human
ucugcagcaauaaagcag

SEQ ID NO: 1525349 - RNA, 18 nt, Human
ucugcagauaaacaguag

SEQ ID NO: 1525350 - RNA, 17 nt, Human
ucugcacuccccugcug

SEQ ID NO: 1525351 - RNA, 16 nt, Human
ucugcacuccccugcu

SEQ ID NO: 1525352 - RNA, 14 nt, Human
ucugcacuccccug

SEQ ID NO: 1525353 - RNA, 15 nt, Human
ucugcacuccccugc

SEQ ID NO: 1525354 - RNA, 22 nt, Human
ucugagacucgcgacaaugcaa

SEQ ID NO: 1525355 - RNA, 21 nt, Human
ucugagacucgcgacaaugca

SEQ ID NO: 1525356 - RNA, 17 nt, Human
ucugaucauccacugug

SEQ ID NO: 1525357 - RNA, 21 nt, Human
ucugaucauccacugugccau

SEQ ID NO: 1525358 - RNA, 13 nt, Human
ucugacacacagc

SEQ ID NO: 1525359 - RNA, 14 nt, Human
ucugacacacagcu

SEQ ID NO: 1525360 - RNA, 15 nt, Human
ucugacacacagcuc

SEQ ID NO: 1525361 - RNA, 22 nt, Human
ucugaaggacauugcggacagc

SEQ ID NO: 1525362 - RNA, 21 nt, Human
ucugaaggacauugcggacag

SEQ ID NO: 1525363 - RNA, 17 nt, Human
ucuaggaaauauuuauu

SEQ ID NO: 1525364 - RNA, 16 nt, Human
ucuaggaaauauuuau

SEQ ID NO: 1525365 - RNA, 13 nt, Human
ucuagccagagga

SEQ ID NO: 1525366 - RNA, 22 nt, Human
ucuaguuguuugauucagacag

SEQ ID NO: 1525367 - RNA, 12 nt, Human
ucuaggaagacu

SEQ ID NO: 1525368 - RNA, 13 nt, Human
ucuauaaaccgaa

SEQ ID NO: 1525369 - RNA, 23 nt, Human
ucuaguuguuugauucagacagc

SEQ ID NO: 1525370 - RNA, 21 nt, Human
ucuaguuugauuaaauucuug

SEQ ID NO: 1525371 - RNA, 22 nt, Human
ucuaguuugauuaaauucuugc

SEQ ID NO: 1525372 - RNA, 13 nt, Human
ucuagauacugua

SEQ ID NO: 1525373 - RNA, 21 nt, Human
ucuagcauggcauauuuuuca

SEQ ID NO: 1525374 - RNA, 18 nt, Human
ucuagcauggcugccaau

SEQ ID NO: 1525375 - RNA, 22 nt, Human
ucuagcauggcauauuuuucac

SEQ ID NO: 1525376 - RNA, 23 nt, Human
ucuagcauggcauauuuuucaca

SEQ ID NO: 1525377 - RNA, 14 nt, Human
acuucccuuucugc

SEQ ID NO: 1525378 - RNA, 16 nt, Human
acuucaucccucuggg

SEQ ID NO: 1525379 - RNA, 17 nt, Human
ucucacuauguugccca

SEQ ID NO: 1525380 - RNA, 19 nt, Human
ucucacuauguugcccagg

SEQ ID NO: 1525381 - RNA, 23 nt, Human
acuuaacuauucaggagaguaga

SEQ ID NO: 1525382 - RNA, 12 nt, Human
acuguugcccag

SEQ ID NO: 1525383 - RNA, 20 nt, Human
acuuaaauaaugugaaacug

SEQ ID NO: 1525384 - RNA, 16 nt, Human
acuuacacuuuaugca

SEQ ID NO: 1525385 - RNA, 22 nt, Human
acuuaaucuaaauggaaccacu

SEQ ID NO: 1525386 - RNA, 19 nt, Human
acuuaaucuaaauggaacc

SEQ ID NO: 1525387 - RNA, 17 nt, Human
acuuaaucuaaauggaa

SEQ ID NO: 1525388 - RNA, 13 nt, Human
acuuaagcacacu

SEQ ID NO: 1525389 - RNA, 15 nt, Human
acuuagguguggggg

SEQ ID NO: 1525390 - RNA, 21 nt, Human
acuuacuguacaugaaaacac

SEQ ID NO: 1525391 - RNA, 17 nt, Human
acuuacacuuuaugcac

SEQ ID NO: 1525392 - RNA, 22 nt, Human
acuuacuguacaugaaaacaca

SEQ ID NO: 1525393 - RNA, 19 nt, Human
ucuacccagcgagcccugg

SEQ ID NO: 1525394 - RNA, 21 nt, Human
ucuacagaggccaugggccuc

SEQ ID NO: 1525395 - RNA, 18 nt, Human
uccugggagugagcuggu

SEQ ID NO: 1525396 - RNA, 20 nt, Human
ucuaaguaaaaccacagcag

SEQ ID NO: 1525397 - RNA, 19 nt, Human
ucuaaguaaaaccacagca

SEQ ID NO: 1525398 - RNA, 14 nt, Human
ucuaaguaaaacca

SEQ ID NO: 1525399 - RNA, 15 nt, Human
ucuaaguaaaaccac

SEQ ID NO: 1525400 - RNA, 21 nt, Human
ucuacccuggcacuauaaugu

SEQ ID NO: 1525401 - RNA, 20 nt, Human
ucuacccagcgagcccuggu

SEQ ID NO: 1525402 - RNA, 14 nt, Human
ucuacccaggugcu

SEQ ID NO: 1525403 - RNA, 19 nt, Human
ucuacccuggcacuauaau

SEQ ID NO: 1525404 - RNA, 16 nt, Human
acuguucucugcccuc

SEQ ID NO: 1525405 - RNA, 17 nt, Human
acuguucucugcccucc

SEQ ID NO: 1525406 - RNA, 19 nt, Human
acuguucucugcccuccaa

SEQ ID NO: 1525407 - RNA, 18 nt, Human
acuguucucugcccucca

SEQ ID NO: 1525408 - RNA, 22 nt, Human
acuuuuuauggcacuaguauuu

SEQ ID NO: 1525409 - RNA, 23 nt, Human
acuuuuguucuugguuuguaaau

SEQ ID NO: 1525410 - RNA, 15 nt, Human
acuuuuguucuuggu

SEQ ID NO: 1525411 - RNA, 21 nt, Human
ucuccuuguguuacuaaguuu

SEQ ID NO: 1525412 - RNA, 13 nt, Human
ucuccuuguguua

SEQ ID NO: 1525413 - RNA, 16 nt, Human
ucuccuucaccuuugu

SEQ ID NO: 1525414 - RNA, 19 nt, Human
agaaaaaauauuuucccua

SEQ ID NO: 1525415 - RNA, 18 nt, Human
ucuccuucaccuuugucc

SEQ ID NO: 1525416 - RNA, 17 nt, Human
agaaaaaauauuuuccc

SEQ ID NO: 1525417 - RNA, 14 nt, Human
ucuccuucaccuuu

SEQ ID NO: 1525418 - RNA, 15 nt, Human
ucuccuucaccuuug

SEQ ID NO: 1525419 - RNA, 13 nt, Human
acuuugaccucug

SEQ ID NO: 1525420 - RNA, 12 nt, Human
acuuugaccucu

SEQ ID NO: 1525421 - RNA, 13 nt, Human
acuuuuguucuug

SEQ ID NO: 1525422 - RNA, 12 nt, Human
acuuuuguucuu

SEQ ID NO: 1525423 - RNA, 21 nt, Human
acuuuguuaguuucuccaagc

SEQ ID NO: 1525424 - RNA, 14 nt, Human
acuuuguucuggcu

SEQ ID NO: 1525425 - RNA, 20 nt, Human
acuuuguuaguuucuccaag

SEQ ID NO: 1525426 - RNA, 12 nt, Human
acuuuaccuuuu

SEQ ID NO: 1525427 - RNA, 20 nt, Human
acuuucugaaauaacauggc

SEQ ID NO: 1525428 - RNA, 17 nt, Human
ucuccucugcugcuggc

SEQ ID NO: 1525429 - RNA, 18 nt, Human
ucuccucugcugcuggcu

SEQ ID NO: 1525430 - RNA, 15 nt, Human
ucuccuccagaguca

SEQ ID NO: 1525431 - RNA, 16 nt, Human
ucuccucugcugcugg

SEQ ID NO: 1525432 - RNA, 23 nt, Human
ucuccccagcaagugagagcugg

SEQ ID NO: 1525433 - RNA, 12 nt, Human
ucuccacccugc

SEQ ID NO: 1525434 - RNA, 18 nt, Human
ucuccaagcaggacaugg

SEQ ID NO: 1525435 - RNA, 19 nt, Human
ucuccaagcaggacaugga

SEQ ID NO: 1525436 - RNA, 17 nt, Human
ucuccgaccagacaccu

SEQ ID NO: 1525437 - RNA, 23 nt, Human
ucuccgaccagacaccuugacag

SEQ ID NO: 1525438 - RNA, 15 nt, Human
acuugucaauaaaau

SEQ ID NO: 1525439 - RNA, 19 nt, Human
acuuguggacacagcucuu

SEQ ID NO: 1525440 - RNA, 22 nt, Human
acuuguggacacagcucuucuc

SEQ ID NO: 1525441 - RNA, 20 nt, Human
acuugucuuuggacccugag

SEQ ID NO: 1525442 - RNA, 21 nt, Human
acuugucuuuggacccugagg

SEQ ID NO: 1525443 - RNA, 23 nt, Human
acuugcagacucuacagaggcca

SEQ ID NO: 1525444 - RNA, 19 nt, Human
acuugcagacucuacagag

SEQ ID NO: 1525445 - RNA, 22 nt, Human
acuugcagacucuacagaggcc

SEQ ID NO: 1525446 - RNA, 20 nt, Human
ucucacuauguugcccaggc

SEQ ID NO: 1525447 - RNA, 21 nt, Human
ucucacuauguugcccaggca

SEQ ID NO: 1525448 - RNA, 22 nt, Human
ucucacuauguugcccaggcag

SEQ ID NO: 1525449 - RNA, 23 nt, Human
ucucacuauguugcccaggcagg

SEQ ID NO: 1525450 - RNA, 15 nt, Human
ucucauuuccaagca

SEQ ID NO: 1525451 - RNA, 16 nt, Human
ucucauuucaccccuc

SEQ ID NO: 1525452 - RNA, 17 nt, Human
ucucauuucaccccucc

SEQ ID NO: 1525453 - RNA, 19 nt, Human
ucucauuucaccccucccu

SEQ ID NO: 1525454 - RNA, 22 nt, Human
ucucauuucaccccucccuuuc

SEQ ID NO: 1525455 - RNA, 14 nt, Human
ucucauuugucaca

SEQ ID NO: 1525456 - RNA, 16 nt, Human
ucucauuugucacaca

SEQ ID NO: 1525457 - RNA, 13 nt, Human
ucuccaaaauaaa

SEQ ID NO: 1525458 - RNA, 16 nt, Human
ucuccaagcaggacau

SEQ ID NO: 1525459 - RNA, 21 nt, Human
ucucaggccagcugcuugggc

SEQ ID NO: 1525460 - RNA, 17 nt, Human
ucucaggccagcugcuu

SEQ ID NO: 1525461 - RNA, 18 nt, Human
ucucaggccagcugcuug

SEQ ID NO: 1525462 - RNA, 23 nt, Human
ucucaggaaaucaaauaugcaaa

SEQ ID NO: 1525463 - RNA, 14 nt, Human
ucucaggaaaucaa

SEQ ID NO: 1525464 - RNA, 21 nt, Human
ucucaggaaaucaaauaugca

SEQ ID NO: 1525465 - RNA, 10 nt, Human
ucucaggcca

SEQ ID NO: 1525466 - RNA, 12 nt, Human
ucucaggccaaa

SEQ ID NO: 1525467 - RNA, 12 nt, Human
ucucaggccagc

SEQ ID NO: 1525468 - RNA, 13 nt, Human
ucucaggccagcu

SEQ ID NO: 1525469 - RNA, 22 nt, Human
uccuggaauaucuccgucaacu

SEQ ID NO: 1525470 - RNA, 16 nt, Human
uccuggaaaucagggu

SEQ ID NO: 1525471 - RNA, 15 nt, Human
uccuggaaauauuaa

SEQ ID NO: 1525472 - RNA, 15 nt, Human
uccugggagcuuuug

SEQ ID NO: 1525473 - RNA, 12 nt, Human
uccugggaguga

SEQ ID NO: 1525474 - RNA, 14 nt, Human
uccugggagugagc

SEQ ID NO: 1525475 - RNA, 17 nt, Human
uccugggagugagcugg

SEQ ID NO: 1525476 - RNA, 17 nt, Human
uccugcagccugcagga

SEQ ID NO: 1525477 - RNA, 12 nt, Human
uccugcaggcag

SEQ ID NO: 1525478 - RNA, 13 nt, Human
uccugcaggcagc

SEQ ID NO: 1525479 - RNA, 14 nt, Human
uccugcaggcagcc

SEQ ID NO: 1525480 - RNA, 15 nt, Human
uccugcaggcagcca

SEQ ID NO: 1525481 - RNA, 13 nt, Human
acugcacuguuuu

SEQ ID NO: 1525482 - RNA, 19 nt, Human
uccugaugcuucuucagag

SEQ ID NO: 1525483 - RNA, 20 nt, Human
uccugaugcuucuucagaga

SEQ ID NO: 1525484 - RNA, 21 nt, Human
uccugaugcuucuucagagac

SEQ ID NO: 1525485 - RNA, 21 nt, Human
acugcacuauagccuagguga

SEQ ID NO: 1525486 - RNA, 14 nt, Human
acugcacuccagcc

SEQ ID NO: 1525487 - RNA, 17 nt, Human
acugcacuccagccugg

SEQ ID NO: 1525488 - RNA, 18 nt, Human
acugcacuccagccuggg

SEQ ID NO: 1525489 - RNA, 19 nt, Human
acugcacuccagccugggu

SEQ ID NO: 1525490 - RNA, 20 nt, Human
acugcacuccagccugggug

SEQ ID NO: 1525491 - RNA, 21 nt, Human
acugauaaagaugagugagca

SEQ ID NO: 1525492 - RNA, 13 nt, Human
acugauaaagaug

SEQ ID NO: 1525493 - RNA, 14 nt, Human
acugcaccgggcca

SEQ ID NO: 1525494 - RNA, 16 nt, Human
acugcaccgggccaca

SEQ ID NO: 1525495 - RNA, 20 nt, Human
acugcacuauagccuaggug

SEQ ID NO: 1525496 - RNA, 12 nt, Human
acugaagaagca

SEQ ID NO: 1525497 - RNA, 13 nt, Human
acugacucuuaag

SEQ ID NO: 1525498 - RNA, 14 nt, Human
acugacucuuaaga

SEQ ID NO: 1525499 - RNA, 15 nt, Human
acugacucuuaagaa

SEQ ID NO: 1525500 - RNA, 16 nt, Human
acugacucuuaagaag

SEQ ID NO: 1525501 - RNA, 17 nt, Human
acugacucuuaagaaga

SEQ ID NO: 1525502 - RNA, 18 nt, Human
acugacucuuaagaagac

SEQ ID NO: 1525503 - RNA, 20 nt, Human
acugacucuuaagaagacug

SEQ ID NO: 1525504 - RNA, 13 nt, Human
acugacuucuaag

SEQ ID NO: 1525505 - RNA, 15 nt, Human
acugacuucuaagua

SEQ ID NO: 1525506 - RNA, 16 nt, Human
acugacuucuaaguaa

SEQ ID NO: 1525507 - RNA, 22 nt, Human
acugacuucuaaguaaaaccac

SEQ ID NO: 1525508 - RNA, 19 nt, Human
acugagaauguaagaacua

SEQ ID NO: 1525509 - RNA, 20 nt, Human
acugagaauguaagaacuac

SEQ ID NO: 1525510 - RNA, 15 nt, Human
acugagacagcccgg

SEQ ID NO: 1525511 - RNA, 18 nt, Human
acugagacagcccgggcu

SEQ ID NO: 1525512 - RNA, 21 nt, Human
acugagacagcccgggcucug

SEQ ID NO: 1525513 - RNA, 18 nt, Human
acugagagugaacaaauu

SEQ ID NO: 1525514 - RNA, 22 nt, Human
acugagacagcccgggcucugc

SEQ ID NO: 1525515 - RNA, 23 nt, Human
acugagacagcccgggcucugcc

SEQ ID NO: 1525516 - RNA, 22 nt, Human
acugagaugugaacacaucagc

SEQ ID NO: 1525517 - RNA, 20 nt, Human
acugagauccuuccuuuuga

SEQ ID NO: 1525518 - RNA, 17 nt, Human
acugagaugugaacaca

SEQ ID NO: 1525519 - RNA, 19 nt, Human
acucuuucuauuguuucuu

SEQ ID NO: 1525520 - RNA, 22 nt, Human
uccucuuuggucuacacugugc

SEQ ID NO: 1525521 - RNA, 23 nt, Human
uccucuuuggucuacacugugcu

SEQ ID NO: 1525522 - RNA, 19 nt, Human
uccucuuuccaucuacccu

SEQ ID NO: 1525523 - RNA, 19 nt, Human
uccucuuuggucuacacug

SEQ ID NO: 1525524 - RNA, 21 nt, Human
uccucuuuggucuacacugug

SEQ ID NO: 1525525 - RNA, 11 nt, Human
uccucccuccc

SEQ ID NO: 1525526 - RNA, 14 nt, Human
uccucccucccucu

SEQ ID NO: 1525527 - RNA, 11 nt, Human
uccucuuucca

SEQ ID NO: 1525528 - RNA, 12 nt, Human
uccucuuuccau

SEQ ID NO: 1525529 - RNA, 23 nt, Human
ucccuuuuuuggcugcugaaggc

SEQ ID NO: 1525530 - RNA, 20 nt, Human
ucccuuuuuuggcugcugaa

SEQ ID NO: 1525531 - RNA, 22 nt, Human
ucccuuuuuuggcugcugaagg

SEQ ID NO: 1525532 - RNA, 21 nt, Human
ucccuuugacgccaucccagc

SEQ ID NO: 1525533 - RNA, 19 nt, Human
ucccuuugacgccauccca

SEQ ID NO: 1525534 - RNA, 17 nt, Human
ucccuuuuuuggcugcu

SEQ ID NO: 1525535 - RNA, 19 nt, Human
ucccuuuuuuggcugcuga

SEQ ID NO: 1525536 - RNA, 12 nt, Human
acuccuggccuc

SEQ ID NO: 1525537 - RNA, 16 nt, Human
ucccuuugacgccauc

SEQ ID NO: 1525538 - RNA, 18 nt, Human
ucccuuugacgccauccc

SEQ ID NO: 1525539 - RNA, 22 nt, Human
ucccugguggcagcucaccucu

SEQ ID NO: 1525540 - RNA, 23 nt, Human
ucccugguggcagcucaccucuc

SEQ ID NO: 1525541 - RNA, 19 nt, Human
ucccuuggauuguccccga

SEQ ID NO: 1525542 - RNA, 20 nt, Human
ucccuuggauuguccccgac

SEQ ID NO: 1525543 - RNA, 13 nt, Human
uccuacucugugu

SEQ ID NO: 1525544 - RNA, 14 nt, Human
uccuacucuguguc

SEQ ID NO: 1525545 - RNA, 15 nt, Human
uccuacucuguguca

SEQ ID NO: 1525546 - RNA, 13 nt, Human
uccuaggcauuug

SEQ ID NO: 1525547 - RNA, 13 nt, Human
acuccuggccuca

SEQ ID NO: 1525548 - RNA, 14 nt, Human
acuccuggccucaa

SEQ ID NO: 1525549 - RNA, 13 nt, Human
acucaccccagcc

SEQ ID NO: 1525550 - RNA, 16 nt, Human
acucaccccagcccca

SEQ ID NO: 1525551 - RNA, 14 nt, Human
acucaccccagccc

SEQ ID NO: 1525552 - RNA, 15 nt, Human
acucaccccagcccc

SEQ ID NO: 1525553 - RNA, 14 nt, Human
acuccugcaggcag

SEQ ID NO: 1525554 - RNA, 17 nt, Human
acuccugcaggcagcca

SEQ ID NO: 1525555 - RNA, 22 nt, Human
acuccugcaggcagccaggcca

SEQ ID NO: 1525556 - RNA, 15 nt, Human
acuccugcaggcagc

SEQ ID NO: 1525557 - RNA, 16 nt, Human
acuccugcaggcagcc

SEQ ID NO: 1525558 - RNA, 18 nt, Human
ucccugguggcagcucac

SEQ ID NO: 1525559 - RNA, 19 nt, Human
ucccugguggcagcucacc

SEQ ID NO: 1525560 - RNA, 20 nt, Human
ucccugguggcagcucaccu

SEQ ID NO: 1525561 - RNA, 21 nt, Human
ucccugguggcagcucaccuc

SEQ ID NO: 1525562 - RNA, 16 nt, Human
ucccugguggcagcuc

SEQ ID NO: 1525563 - RNA, 17 nt, Human
ucccugguggcagcuca

SEQ ID NO: 1525564 - RNA, 11 nt, Human
acuccuggccu

SEQ ID NO: 1525565 - RNA, 21 nt, Human
acucuuaagaagacugcauua

SEQ ID NO: 1525566 - RNA, 16 nt, Human
acucuuauaucuauau

SEQ ID NO: 1525567 - RNA, 17 nt, Human
acucuuauaucuauauu

SEQ ID NO: 1525568 - RNA, 18 nt, Human
acucuuauaucuauauuu

SEQ ID NO: 1525569 - RNA, 22 nt, Human
acucuuauaucuauauuuuaca

SEQ ID NO: 1525570 - RNA, 14 nt, Human
acucuugaccucag

SEQ ID NO: 1525571 - RNA, 19 nt, Human
acucuuauaucuauauuuu

SEQ ID NO: 1525572 - RNA, 15 nt, Human
acucuugaccucagg

SEQ ID NO: 1525573 - RNA, 16 nt, Human
acucuugaccucaggu

SEQ ID NO: 1525574 - RNA, 22 nt, Human
uccucauaguaugguggcuggg

SEQ ID NO: 1525575 - RNA, 21 nt, Human
uccucaggagccgaagcccag

SEQ ID NO: 1525576 - RNA, 22 nt, Human
uccucaggagccgaagcccagg

SEQ ID NO: 1525577 - RNA, 23 nt, Human
uccucauacccacccccacccaa

SEQ ID NO: 1525578 - RNA, 11 nt, Human
acucugagacu

SEQ ID NO: 1525579 - RNA, 22 nt, Human
acucugagacucgcgacaaugc

SEQ ID NO: 1525580 - RNA, 16 nt, Human
acucuccuuggugucg

SEQ ID NO: 1525581 - RNA, 23 nt, Human
acucuccuuggugucgggcauga

SEQ ID NO: 1525582 - RNA, 13 nt, Human
acucuggcagcuc

SEQ ID NO: 1525583 - RNA, 15 nt, Human
acucuggcagcucag

SEQ ID NO: 1525584 - RNA, 23 nt, Human
acuccuugaaaacacuguucucu

SEQ ID NO: 1525585 - RNA, 24 nt, Human
acuccuugaaaacacuguucucug

SEQ ID NO: 1525586 - RNA, 22 nt, Human
acucucccccacccccuccccg

SEQ ID NO: 1525587 - RNA, 14 nt, Human
acucuccuccagag

SEQ ID NO: 1525588 - RNA, 17 nt, Human
acucuccuccagaguca

SEQ ID NO: 1525589 - RNA, 12 nt, Human
acucuccucugc

SEQ ID NO: 1525590 - RNA, 13 nt, Human
acucuccucugcu

SEQ ID NO: 1525591 - RNA, 14 nt, Human
acucuccucugcug

SEQ ID NO: 1525592 - RNA, 16 nt, Human
acucuccucugcugcu

SEQ ID NO: 1525593 - RNA, 18 nt, Human
acucuccuggaaauauua

SEQ ID NO: 1525594 - RNA, 15 nt, Human
acucuccuugguguc

SEQ ID NO: 1525595 - RNA, 11 nt, Human
uccagccuggg

SEQ ID NO: 1525596 - RNA, 16 nt, Human
uccagaauuucccaaa

SEQ ID NO: 1525597 - RNA, 14 nt, Human
uccagaauuuccca

SEQ ID NO: 1525598 - RNA, 15 nt, Human
uccagaauuucccaa

SEQ ID NO: 1525599 - RNA, 14 nt, Human
uccaggcuguaucc

SEQ ID NO: 1525600 - RNA, 23 nt, Human
uccaggcugggagagccuuccag

SEQ ID NO: 1525601 - RNA, 11 nt, Human
uccaggcuggu

SEQ ID NO: 1525602 - RNA, 13 nt, Human
uccaggcugguuc

SEQ ID NO: 1525603 - RNA, 15 nt, Human
acgaauauugcugau

SEQ ID NO: 1525604 - RNA, 18 nt, Human
acgaauauugcugauggu

SEQ ID NO: 1525605 - RNA, 10 nt, Human
uccaggcucc

SEQ ID NO: 1525606 - RNA, 12 nt, Human
uccaggcuccuu

SEQ ID NO: 1525607 - RNA, 22 nt, Human
uccaggcuccuuuagcgcccag

SEQ ID NO: 1525608 - RNA, 20 nt, Human
uccaggcugggagagccuuc

SEQ ID NO: 1525609 - RNA, 21 nt, Human
uccaggcugggagagccuucc

SEQ ID NO: 1525610 - RNA, 18 nt, Human
accuuuggagcaaagcug

SEQ ID NO: 1525611 - RNA, 18 nt, Human
accuuuguccccaccgca

SEQ ID NO: 1525612 - RNA, 17 nt, Human
accuuuguccccaccgc

SEQ ID NO: 1525613 - RNA, 19 nt, Human
accuugaaaacuuuaugcu

SEQ ID NO: 1525614 - RNA, 20 nt, Human
accuugaacuggguacuugu

SEQ ID NO: 1525615 - RNA, 13 nt, Human
accuuuuuuauac

SEQ ID NO: 1525616 - RNA, 20 nt, Human
accuuuuggucuggagggaa

SEQ ID NO: 1525617 - RNA, 12 nt, Human
uccacucucccc

SEQ ID NO: 1525618 - RNA, 22 nt, Human
uccacugguucuucuuggucuc

SEQ ID NO: 1525619 - RNA, 13 nt, Human
uccacucuccccc

SEQ ID NO: 1525620 - RNA, 14 nt, Human
uccacucuccccca

SEQ ID NO: 1525621 - RNA, 16 nt, Human
uccacucucccccacc

SEQ ID NO: 1525622 - RNA, 18 nt, Human
uccacucucccccacccc

SEQ ID NO: 1525623 - RNA, 21 nt, Human
uccacugugccaugugccagg

SEQ ID NO: 1525624 - RNA, 22 nt, Human
uccagugaggcucugcccuugg

SEQ ID NO: 1525625 - RNA, 23 nt, Human
uccagugaggcucugcccuuggu

SEQ ID NO: 1525626 - RNA, 18 nt, Human
uccagugagacagcucug

SEQ ID NO: 1525627 - RNA, 15 nt, Human
uccagugaggcucug

SEQ ID NO: 1525628 - RNA, 16 nt, Human
uccagugaggcucugc

SEQ ID NO: 1525629 - RNA, 17 nt, Human
uccagugaggcucugcc

SEQ ID NO: 1525630 - RNA, 16 nt, Human
uccaguaucuugaaga

SEQ ID NO: 1525631 - RNA, 18 nt, Human
uccaguaucuugaagacu

SEQ ID NO: 1525632 - RNA, 12 nt, Human
acggccaggcca

SEQ ID NO: 1525633 - RNA, 13 nt, Human
acggccaggccag

SEQ ID NO: 1525634 - RNA, 16 nt, Human
acggcucacugcagcc

SEQ ID NO: 1525635 - RNA, 17 nt, Human
acggcucacugcagccu

SEQ ID NO: 1525636 - RNA, 18 nt, Human
acggcucacugcagccuc

SEQ ID NO: 1525637 - RNA, 18 nt, Human
acggcuuuuacuuaaacc

SEQ ID NO: 1525638 - RNA, 14 nt, Human
uccaguaucuugaa

SEQ ID NO: 1525639 - RNA, 15 nt, Human
uccaguaucuugaag

SEQ ID NO: 1525640 - RNA, 20 nt, Human
acgcgugcacacaccagagc

SEQ ID NO: 1525641 - RNA, 21 nt, Human
acgcuacccgggaagggggcu

SEQ ID NO: 1525642 - RNA, 21 nt, Human
acgaauauugcugauggugca

SEQ ID NO: 1525643 - RNA, 23 nt, Human
acggagucccaccuuggcugcag

SEQ ID NO: 1525644 - RNA, 17 nt, Human
acgcuggagugcaguga

SEQ ID NO: 1525645 - RNA, 18 nt, Human
acgcuggagugcagugag

SEQ ID NO: 1525646 - RNA, 20 nt, Human
acgcuggaccuugaacuggg

SEQ ID NO: 1525647 - RNA, 23 nt, Human
acgcuggaccuugaacuggguac

SEQ ID NO: 1525648 - RNA, 15 nt, Human
acgcuggagugcagu

SEQ ID NO: 1525649 - RNA, 16 nt, Human
acgcuggagugcagug

SEQ ID NO: 1525650 - RNA, 13 nt, Human
acgcuggaccuug

SEQ ID NO: 1525651 - RNA, 11 nt, Human
acgcucucugg

SEQ ID NO: 1525652 - RNA, 14 nt, Human
acgcucucuggccu

SEQ ID NO: 1525653 - RNA, 16 nt, Human
ucccagauacuugggg

SEQ ID NO: 1525654 - RNA, 18 nt, Human
ucccagauacuugggggg

SEQ ID NO: 1525655 - RNA, 22 nt, Human
ucccagauuggcucacacugag

SEQ ID NO: 1525656 - RNA, 18 nt, Human
ucccagauuggcucacac

SEQ ID NO: 1525657 - RNA, 19 nt, Human
ucccagauuggcucacacu

SEQ ID NO: 1525658 - RNA, 20 nt, Human
ucccagauuggcucacacug

SEQ ID NO: 1525659 - RNA, 21 nt, Human
ucccagauuggcucacacuga

SEQ ID NO: 1525660 - RNA, 15 nt, Human
acuaauuuuaaaaug

SEQ ID NO: 1525661 - RNA, 15 nt, Human
acuaauuuuacuucu

SEQ ID NO: 1525662 - RNA, 18 nt, Human
acuacaaacaaaauuucu

SEQ ID NO: 1525663 - RNA, 20 nt, Human
acuacaaacaaaauuucuau

SEQ ID NO: 1525664 - RNA, 22 nt, Human
acguuucuaaaggcuaccuuug

SEQ ID NO: 1525665 - RNA, 18 nt, Human
acguggcugcuucaagga

SEQ ID NO: 1525666 - RNA, 23 nt, Human
acguggcugcuucaaggauccug

SEQ ID NO: 1525667 - RNA, 19 nt, Human
acguggcugcuucaaggau

SEQ ID NO: 1525668 - RNA, 21 nt, Human
acguggcugcuucaaggaucc

SEQ ID NO: 1525669 - RNA, 13 nt, Human
acguugugcauuu

SEQ ID NO: 1525670 - RNA, 15 nt, Human
acguugugcauuugg

SEQ ID NO: 1525671 - RNA, 14 nt, Human
acguugugcauuug

SEQ ID NO: 1525672 - RNA, 16 nt, Human
acguuucuaaaggcua

SEQ ID NO: 1525673 - RNA, 19 nt, Human
uccauccugaggcuccacu

SEQ ID NO: 1525674 - RNA, 12 nt, Human
uccauccugagg

SEQ ID NO: 1525675 - RNA, 15 nt, Human
uccauccugaggcuc

SEQ ID NO: 1525676 - RNA, 16 nt, Human
acuaucucauuuccaa

SEQ ID NO: 1525677 - RNA, 17 nt, Human
acuaucucauuuccaag

SEQ ID NO: 1525678 - RNA, 15 nt, Human
acuaucucauuucca

SEQ ID NO: 1525679 - RNA, 21 nt, Human
acuaucuaaauguugaaagau

SEQ ID NO: 1525680 - RNA, 17 nt, Human
acuauauuguuugcuaa

SEQ ID NO: 1525681 - RNA, 22 nt, Human
acuauauuguuugcuaagcauu

SEQ ID NO: 1525682 - RNA, 20 nt, Human
acuauagccuaggugacaga

SEQ ID NO: 1525683 - RNA, 22 nt, Human
acuauagccuaggugacagagu

SEQ ID NO: 1525684 - RNA, 17 nt, Human
acuauguugcccaggca

SEQ ID NO: 1525685 - RNA, 15 nt, Human
acuauguugcccagg

SEQ ID NO: 1525686 - RNA, 16 nt, Human
acuauguugcccaggc

SEQ ID NO: 1525687 - RNA, 22 nt, Human
acuauggcccuggccuagcaua

SEQ ID NO: 1525688 - RNA, 14 nt, Human
acuauguugcccag

SEQ ID NO: 1525689 - RNA, 16 nt, Human
acucaaugcacugaca

SEQ ID NO: 1525690 - RNA, 23 nt, Human
uccccacccugaaagcccugagc

SEQ ID NO: 1525691 - RNA, 15 nt, Human
uccccaccgcagaca

SEQ ID NO: 1525692 - RNA, 16 nt, Human
uccccaccgcagacag

SEQ ID NO: 1525693 - RNA, 18 nt, Human
uccccaggaggccagccu

SEQ ID NO: 1525694 - RNA, 10 nt, Human
ucccagcucc

SEQ ID NO: 1525695 - RNA, 16 nt, Human
ucccccagccccaucc

SEQ ID NO: 1525696 - RNA, 13 nt, Human
ucccccagcccca

SEQ ID NO: 1525697 - RNA, 15 nt, Human
ucccccagccccauc

SEQ ID NO: 1525698 - RNA, 23 nt, Human
uccccaggaggccagccuugacc

SEQ ID NO: 1525699 - RNA, 20 nt, Human
uccccaggaggccagccuug

SEQ ID NO: 1525700 - RNA, 21 nt, Human
uccccaggaggccagccuuga

SEQ ID NO: 1525701 - RNA, 20 nt, Human
ucacagaugggugcuuggag

SEQ ID NO: 1525702 - RNA, 13 nt, Human
ucacagccucuga

SEQ ID NO: 1525703 - RNA, 16 nt, Human
ucacaguucucuccuu

SEQ ID NO: 1525704 - RNA, 20 nt, Human
ucacaguucucuccuucuuc

SEQ ID NO: 1525705 - RNA, 16 nt, Human
ucaauucuugccaaau

SEQ ID NO: 1525706 - RNA, 13 nt, Human
ucaauuuccaaga

SEQ ID NO: 1525707 - RNA, 18 nt, Human
ucaauuuccaagagcuga

SEQ ID NO: 1525708 - RNA, 20 nt, Human
ucaauuuccaagagcugagg

SEQ ID NO: 1525709 - RNA, 17 nt, Human
ucacaaaggaugcccaa

SEQ ID NO: 1525710 - RNA, 15 nt, Human
accaccacacccagc

SEQ ID NO: 1525711 - RNA, 20 nt, Human
accaccacacccagcccacu

SEQ ID NO: 1525712 - RNA, 18 nt, Human
accacaugugcacaugca

SEQ ID NO: 1525713 - RNA, 17 nt, Human
accacaucuugcucugc

SEQ ID NO: 1525714 - RNA, 18 nt, Human
accacaucuugcucugcu

SEQ ID NO: 1525715 - RNA, 19 nt, Human
accacaucuugcucugcug

SEQ ID NO: 1525716 - RNA, 14 nt, Human
ucacauaucuagua

SEQ ID NO: 1525717 - RNA, 12 nt, Human
ucaccucaugga

SEQ ID NO: 1525718 - RNA, 13 nt, Human
ucaccucauggaa

SEQ ID NO: 1525719 - RNA, 14 nt, Human
ucaccucauggaau

SEQ ID NO: 1525720 - RNA, 22 nt, Human
accagcgugugacuacuccccc

SEQ ID NO: 1525721 - RNA, 16 nt, Human
accacuacauucuguu

SEQ ID NO: 1525722 - RNA, 17 nt, Human
accacuacauucuguua

SEQ ID NO: 1525723 - RNA, 14 nt, Human
accagucugacugu

SEQ ID NO: 1525724 - RNA, 17 nt, Human
accaguguuguggauuu

SEQ ID NO: 1525725 - RNA, 15 nt, Human
accaguguuguggau

SEQ ID NO: 1525726 - RNA, 10 nt, Human
ucacuugagu

SEQ ID NO: 1525727 - RNA, 23 nt, Human
ucacuugaacccgggaggcagag

SEQ ID NO: 1525728 - RNA, 23 nt, Human
ucacuguugcccaggcuggcgug

SEQ ID NO: 1525729 - RNA, 15 nt, Human
ucacugcagccucaa

SEQ ID NO: 1525730 - RNA, 17 nt, Human
ucacuauguugcccagg

SEQ ID NO: 1525731 - RNA, 17 nt, Human
ucacugagacagcccgg

SEQ ID NO: 1525732 - RNA, 21 nt, Human
ucacugagacagcccgggcuc

SEQ ID NO: 1525733 - RNA, 22 nt, Human
ucacugagacagcccgggcucu

SEQ ID NO: 1525734 - RNA, 14 nt, Human
ucacugcagccuca

SEQ ID NO: 1525735 - RNA, 18 nt, Human
ucaaauugugugaaaggu

SEQ ID NO: 1525736 - RNA, 14 nt, Human
acauuccugaacag

SEQ ID NO: 1525737 - RNA, 15 nt, Human
acauuccugaacagg

SEQ ID NO: 1525738 - RNA, 14 nt, Human
acauuccugaugcu

SEQ ID NO: 1525739 - RNA, 19 nt, Human
acauguccaagaagcccag

SEQ ID NO: 1525740 - RNA, 15 nt, Human
acauguccaagaagc

SEQ ID NO: 1525741 - RNA, 23 nt, Human
acauguaauuaaguacuauguau

SEQ ID NO: 1525742 - RNA, 13 nt, Human
ucaaauuucuaaa

SEQ ID NO: 1525743 - RNA, 14 nt, Human
ucaaauuucuaaau

SEQ ID NO: 1525744 - RNA, 20 nt, Human
ucaacugcaucaagauguga

SEQ ID NO: 1525745 - RNA, 14 nt, Human
ucaaccagcagaug

SEQ ID NO: 1525746 - RNA, 15 nt, Human
acaugggacauuugc

SEQ ID NO: 1525747 - RNA, 20 nt, Human
acaugggacauuugcucaug

SEQ ID NO: 1525748 - RNA, 21 nt, Human
acaugggacauuugcucaugg

SEQ ID NO: 1525749 - RNA, 11 nt, Human
acaugggacau

SEQ ID NO: 1525750 - RNA, 14 nt, Human
acaugggacauuug

SEQ ID NO: 1525751 - RNA, 14 nt, Human
acauggaaguacua

SEQ ID NO: 1525752 - RNA, 15 nt, Human
acauguaauuaagua

SEQ ID NO: 1525753 - RNA, 17 nt, Human
acauguaauuaaguacu

SEQ ID NO: 1525754 - RNA, 19 nt, Human
acauguaauuaaguacuau

SEQ ID NO: 1525755 - RNA, 21 nt, Human
acauguaauuaaguacuaugu

SEQ ID NO: 1525756 - RNA, 22 nt, Human
acauguaauuaaguacuaugua

SEQ ID NO: 1525757 - RNA, 22 nt, Human
acaugcuacacacugcauguuu

SEQ ID NO: 1525758 - RNA, 21 nt, Human
acaugcuacacacugcauguu

SEQ ID NO: 1525759 - RNA, 15 nt, Human
acaugcuacacacug

SEQ ID NO: 1525760 - RNA, 23 nt, Human
acaugagguacugagagugaaca

SEQ ID NO: 1525761 - RNA, 12 nt, Human
acagucccugcc

SEQ ID NO: 1525762 - RNA, 20 nt, Human
acaugagguacugagaguga

SEQ ID NO: 1525763 - RNA, 15 nt, Human
ucaauauuucagaua

SEQ ID NO: 1525764 - RNA, 19 nt, Human
ucaauauuucagauaauca

SEQ ID NO: 1525765 - RNA, 23 nt, Human
ucaaugaaugaaugaauggcuaa

SEQ ID NO: 1525766 - RNA, 19 nt, Human
acauucuuccaaaaagauu

SEQ ID NO: 1525767 - RNA, 22 nt, Human
ucaauaucuuuuuuuuaauaaa

SEQ ID NO: 1525768 - RNA, 18 nt, Human
ucaauauccaaaccaaau

SEQ ID NO: 1525769 - RNA, 17 nt, Human
ucaagaaaacaacuuca

SEQ ID NO: 1525770 - RNA, 21 nt, Human
acauuuuuuaaaugcaccugg

SEQ ID NO: 1525771 - RNA, 17 nt, Human
acauuuuuuaaaugcac

SEQ ID NO: 1525772 - RNA, 16 nt, Human
acauuuuuuaaaugca

SEQ ID NO: 1525773 - RNA, 14 nt, Human
acauuuuuuaaaug

SEQ ID NO: 1525774 - RNA, 23 nt, Human
acauuuuuaagugcugcauuuaa

SEQ ID NO: 1525775 - RNA, 22 nt, Human
acauuuuuaagugcugcauuua

SEQ ID NO: 1525776 - RNA, 21 nt, Human
acauuuuuaagugcugcauuu

SEQ ID NO: 1525777 - RNA, 20 nt, Human
acauuuuauuuuauuaugca

SEQ ID NO: 1525778 - RNA, 19 nt, Human
acauuuuauuuuauuaugc

SEQ ID NO: 1525779 - RNA, 14 nt, Human
acauuuuauuuuau

SEQ ID NO: 1525780 - RNA, 18 nt, Human
acauuuuauuuuauuaug

SEQ ID NO: 1525781 - RNA, 21 nt, Human
ucagauuugaacucuucaauc

SEQ ID NO: 1525782 - RNA, 12 nt, Human
ucagauuugaac

SEQ ID NO: 1525783 - RNA, 18 nt, Human
accaguguuguggauuua

SEQ ID NO: 1525784 - RNA, 15 nt, Human
ucagcaaaagaugcu

SEQ ID NO: 1525785 - RNA, 23 nt, Human
acccaggagccccgaggccuucu

SEQ ID NO: 1525786 - RNA, 17 nt, Human
accccacacacgccaga

SEQ ID NO: 1525787 - RNA, 13 nt, Human
accccagccccaa

SEQ ID NO: 1525788 - RNA, 22 nt, Human
accccagccccaaaacucuccu

SEQ ID NO: 1525789 - RNA, 18 nt, Human
accccaucucuacaaaaa

SEQ ID NO: 1525790 - RNA, 14 nt, Human
accccugcuucuga

SEQ ID NO: 1525791 - RNA, 12 nt, Human
ucagcuccagcu

SEQ ID NO: 1525792 - RNA, 18 nt, Human
ucagcuccacuuucagug

SEQ ID NO: 1525793 - RNA, 19 nt, Human
ucagcggggacagcuccuu

SEQ ID NO: 1525794 - RNA, 20 nt, Human
ucagcggggacagcuccuuc

SEQ ID NO: 1525795 - RNA, 21 nt, Human
ucagcggggacagcuccuucu

SEQ ID NO: 1525796 - RNA, 23 nt, Human
ucagcggggacagcuccuucugu

SEQ ID NO: 1525797 - RNA, 16 nt, Human
acccugaaagcccuga

SEQ ID NO: 1525798 - RNA, 18 nt, Human
acccugaaagcccugagc

SEQ ID NO: 1525799 - RNA, 14 nt, Human
acccugaggcccag

SEQ ID NO: 1525800 - RNA, 15 nt, Human
accgaaaacguggcu

SEQ ID NO: 1525801 - RNA, 17 nt, Human
acccuugccgucuaccu

SEQ ID NO: 1525802 - RNA, 23 nt, Human
acccuuguggucccaccccacac

SEQ ID NO: 1525803 - RNA, 17 nt, Human
acccugcccugugggcc

SEQ ID NO: 1525804 - RNA, 22 nt, Human
acccugcccugugggcccccaa

SEQ ID NO: 1525805 - RNA, 15 nt, Human
acccugaggcccaga

SEQ ID NO: 1525806 - RNA, 16 nt, Human
acccugaggcccagag

SEQ ID NO: 1525807 - RNA, 17 nt, Human
acccugaggcccagagg

SEQ ID NO: 1525808 - RNA, 15 nt, Human
acccugcccuguggg

SEQ ID NO: 1525809 - RNA, 17 nt, Human
ucaggguuggccccugc

SEQ ID NO: 1525810 - RNA, 23 nt, Human
ucagguaacaggcagauacagga

SEQ ID NO: 1525811 - RNA, 21 nt, Human
ucagguaacaggcagauacag

SEQ ID NO: 1525812 - RNA, 22 nt, Human
ucagguaacaggcagauacagg

SEQ ID NO: 1525813 - RNA, 14 nt, Human
acccggccccugcu

SEQ ID NO: 1525814 - RNA, 15 nt, Human
acccggccccugcug

SEQ ID NO: 1525815 - RNA, 16 nt, Human
acccggccccugcugg

SEQ ID NO: 1525816 - RNA, 22 nt, Human
acccggccccugcugguucagg

SEQ ID NO: 1525817 - RNA, 17 nt, Human
acccggccccugcuggu

SEQ ID NO: 1525818 - RNA, 20 nt, Human
acccggccccugcugguuca

SEQ ID NO: 1525819 - RNA, 17 nt, Human
acccgggaggcagaggu

SEQ ID NO: 1525820 - RNA, 12 nt, Human
acccgggaaggg

SEQ ID NO: 1525821 - RNA, 13 nt, Human
acccgggaagggg

SEQ ID NO: 1525822 - RNA, 21 nt, Human
ucaggccaggcccucugccca

SEQ ID NO: 1525823 - RNA, 22 nt, Human
ucaggccaggcccucugcccac

SEQ ID NO: 1525824 - RNA, 14 nt, Human
ucagcuccagcuca

SEQ ID NO: 1525825 - RNA, 15 nt, Human
ucagcuccagcucac

SEQ ID NO: 1525826 - RNA, 21 nt, Human
ucagcuuguaaauagcucagg

SEQ ID NO: 1525827 - RNA, 22 nt, Human
ucagcuuguaaauagcucaggu

SEQ ID NO: 1525828 - RNA, 23 nt, Human
ucaggccaggcccucugcccacu

SEQ ID NO: 1525829 - RNA, 19 nt, Human
ucagggucccugguggcag

SEQ ID NO: 1525830 - RNA, 16 nt, Human
ucaggguuggccccug

SEQ ID NO: 1525831 - RNA, 16 nt, Human
accucaaaaugucuaa

SEQ ID NO: 1525832 - RNA, 16 nt, Human
accuagggugauauua

SEQ ID NO: 1525833 - RNA, 17 nt, Human
accgcagacaggaccag

SEQ ID NO: 1525834 - RNA, 12 nt, Human
accgcagacagg

SEQ ID NO: 1525835 - RNA, 16 nt, Human
accgcagacaggacca

SEQ ID NO: 1525836 - RNA, 20 nt, Human
accucccacaaaggagagcu

SEQ ID NO: 1525837 - RNA, 16 nt, Human
ucaugaaagauucaau

SEQ ID NO: 1525838 - RNA, 17 nt, Human
ucaugaaagauucaaug

SEQ ID NO: 1525839 - RNA, 15 nt, Human
ucaguuuuugugaaa

SEQ ID NO: 1525840 - RNA, 17 nt, Human
ucaguuuuugugaaaag

SEQ ID NO: 1525841 - RNA, 22 nt, Human
ucauaaaaagccugcaauuuca

SEQ ID NO: 1525842 - RNA, 12 nt, Human
ucaguggcagcu

SEQ ID NO: 1525843 - RNA, 13 nt, Human
ucaguggcagcug

SEQ ID NO: 1525844 - RNA, 16 nt, Human
ucagugccuuauggaa

SEQ ID NO: 1525845 - RNA, 18 nt, Human
ucagugccuuauggaaca

SEQ ID NO: 1525846 - RNA, 11 nt, Human
ucaguggcagc

SEQ ID NO: 1525847 - RNA, 12 nt, Human
ucagugccacua

SEQ ID NO: 1525848 - RNA, 17 nt, Human
accgaaaacguggcugc

SEQ ID NO: 1525849 - RNA, 19 nt, Human
accgaaaacguggcugcuu

SEQ ID NO: 1525850 - RNA, 20 nt, Human
accgaaaacguggcugcuuc

SEQ ID NO: 1525851 - RNA, 9 nt, Human
ucagugccu

SEQ ID NO: 1525852 - RNA, 10 nt, Human
ucagugccuu

SEQ ID NO: 1525853 - RNA, 11 nt, Human
ucagugccuua

SEQ ID NO: 1525854 - RNA, 12 nt, Human
ucagugccuuau

SEQ ID NO: 1525855 - RNA, 14 nt, Human
ucagugccuuaugg

SEQ ID NO: 1525856 - RNA, 15 nt, Human
ucagugccuuaugga

SEQ ID NO: 1525857 - RNA, 15 nt, Human
ucauauuuucaugcu

SEQ ID NO: 1525858 - RNA, 16 nt, Human
ucauauuuacuucuua

SEQ ID NO: 1525859 - RNA, 15 nt, Human
ucauauuuacuucuu

SEQ ID NO: 1525860 - RNA, 23 nt, Human
ucauauuuacuucuuauacauuu

SEQ ID NO: 1525861 - RNA, 21 nt, Human
ucauaguaugguggcuggguu

SEQ ID NO: 1525862 - RNA, 18 nt, Human
ucauauaagauucauauu

SEQ ID NO: 1525863 - RNA, 14 nt, Human
ucauaaccuagccu

SEQ ID NO: 1525864 - RNA, 15 nt, Human
ucauaguaugguggc

SEQ ID NO: 1525865 - RNA, 18 nt, Human
ucauaguaugguggcugg

SEQ ID NO: 1525866 - RNA, 19 nt, Human
ucauaguaugguggcuggg

SEQ ID NO: 1525867 - RNA, 20 nt, Human
uaacgauaaaagacagugaa

SEQ ID NO: 1525868 - RNA, 14 nt, Human
uaacuucaccauau

SEQ ID NO: 1525869 - RNA, 17 nt, Human
uaacuuccaauuuacau

SEQ ID NO: 1525870 - RNA, 21 nt, Human
uaacuucacauauugauuucc

SEQ ID NO: 1525871 - RNA, 16 nt, Human
uaacuuucugaaauaa

SEQ ID NO: 1525872 - RNA, 22 nt, Human
aauaucacuugucaauaaaauc

SEQ ID NO: 1525873 - RNA, 13 nt, Human
aauaucagacuuu

SEQ ID NO: 1525874 - RNA, 18 nt, Human
uaacauggacaugaucuu

SEQ ID NO: 1525875 - RNA, 23 nt, Human
uaacauggacaugaucuucuuua

SEQ ID NO: 1525876 - RNA, 17 nt, Human
uaacauguaauuaagua

SEQ ID NO: 1525877 - RNA, 16 nt, Human
aauagucaaauugugu

SEQ ID NO: 1525878 - RNA, 20 nt, Human
aauaguauuugagaguucua

SEQ ID NO: 1525879 - RNA, 22 nt, Human
aauaguauuugagaguucuaaa

SEQ ID NO: 1525880 - RNA, 19 nt, Human
aauagucaaauugugugaa

SEQ ID NO: 1525881 - RNA, 23 nt, Human
aauaguauuugagaguucuaaau

SEQ ID NO: 1525882 - RNA, 16 nt, Human
aauaguggugugauuu

SEQ ID NO: 1525883 - RNA, 22 nt, Human
aauaguggugugauuuggggau

SEQ ID NO: 1525884 - RNA, 13 nt, Human
aauaguuggcuag

SEQ ID NO: 1525885 - RNA, 18 nt, Human
aauauuuauuuuaauaau

SEQ ID NO: 1525886 - RNA, 19 nt, Human
aauauuuauuuuaauaaug

SEQ ID NO: 1525887 - RNA, 14 nt, Human
aauauuucagauaa

SEQ ID NO: 1525888 - RNA, 17 nt, Human
aauauuguguugugaau

SEQ ID NO: 1525889 - RNA, 18 nt, Human
aauauuguguugugaaug

SEQ ID NO: 1525890 - RNA, 17 nt, Human
aauauugauaugcuuau

SEQ ID NO: 1525891 - RNA, 21 nt, Human
aauaugccccauucaacaucu

SEQ ID NO: 1525892 - RNA, 24 nt, Human
aauaugccccauucaacaucuagu

SEQ ID NO: 1525893 - RNA, 15 nt, Human
uaagagaaaugagcu

SEQ ID NO: 1525894 - RNA, 17 nt, Human
aauaugcacacauuuuu

SEQ ID NO: 1525895 - RNA, 16 nt, Human
aauaugcacacauuuu

SEQ ID NO: 1525896 - RNA, 22 nt, Human
aauaugcacacauuuuuuaaau

SEQ ID NO: 1525897 - RNA, 22 nt, Human
aaucaggguuaguauuguccag

SEQ ID NO: 1525898 - RNA, 16 nt, Human
aaucaggguuaguauu

SEQ ID NO: 1525899 - RNA, 21 nt, Human
aaucaggguuaguauugucca

SEQ ID NO: 1525900 - RNA, 22 nt, Human
uaagcagauggaaugcuguguu

SEQ ID NO: 1525901 - RNA, 22 nt, Human
uaagcuguuacugucuucagua

SEQ ID NO: 1525902 - RNA, 21 nt, Human
uaagcaaguuaaguguccucc

SEQ ID NO: 1525903 - RNA, 18 nt, Human
uaagcacacuugacauca

SEQ ID NO: 1525904 - RNA, 13 nt, Human
uaauguacugcau

SEQ ID NO: 1525905 - RNA, 18 nt, Human
uaaugucacaggcagguc

SEQ ID NO: 1525906 - RNA, 11 nt, Human
uaaugucucug

SEQ ID NO: 1525907 - RNA, 19 nt, Human
uaaugucucugugagacuc

SEQ ID NO: 1525908 - RNA, 17 nt, Human
aaugaaacauuuuguca

SEQ ID NO: 1525909 - RNA, 19 nt, Human
aaugaaacacucaguuguu

SEQ ID NO: 1525910 - RNA, 16 nt, Human
aaugaaagacuguaca

SEQ ID NO: 1525911 - RNA, 17 nt, Human
aaugaaagacuguacaa

SEQ ID NO: 1525912 - RNA, 17 nt, Human
aaugaaaccugugucuc

SEQ ID NO: 1525913 - RNA, 22 nt, Human
aaugaaugucagugugacugau

SEQ ID NO: 1525914 - RNA, 22 nt, Human
aaugaauggcuaagcaaaaugu

SEQ ID NO: 1525915 - RNA, 14 nt, Human
aaugaaugucagug

SEQ ID NO: 1525916 - RNA, 18 nt, Human
aaugaaagacuguacaaa

SEQ ID NO: 1525917 - RNA, 13 nt, Human
aaugaaugucagu

SEQ ID NO: 1525918 - RNA, 15 nt, Human
uaauauuuuuaauua

SEQ ID NO: 1525919 - RNA, 14 nt, Human
uaauauuuuuaauu

SEQ ID NO: 1525920 - RNA, 17 nt, Human
uaaugaaugaaacauuu

SEQ ID NO: 1525921 - RNA, 12 nt, Human
uaauagagcaaa

SEQ ID NO: 1525922 - RNA, 21 nt, Human
uaauagagcaaaauugaugug

SEQ ID NO: 1525923 - RNA, 22 nt, Human
uaauagacaauuuauuauggca

SEQ ID NO: 1525924 - RNA, 18 nt, Human
uaauagacaauuuauuau

SEQ ID NO: 1525925 - RNA, 16 nt, Human
uaauagacaauuuauu

SEQ ID NO: 1525926 - RNA, 21 nt, Human
uaauacaccacuacauucugu

SEQ ID NO: 1525927 - RNA, 19 nt, Human
uaauacaccacuacauucu

SEQ ID NO: 1525928 - RNA, 18 nt, Human
uaauacaccacuacauuc

SEQ ID NO: 1525929 - RNA, 16 nt, Human
uaauacaccacuacau

SEQ ID NO: 1525930 - RNA, 12 nt, Human
aaucaugaauua

SEQ ID NO: 1525931 - RNA, 15 nt, Human
aaucaugaauuaguu

SEQ ID NO: 1525932 - RNA, 16 nt, Human
uaagcuuguauuccuu

SEQ ID NO: 1525933 - RNA, 19 nt, Human
uaaguaaugauaacuggaa

SEQ ID NO: 1525934 - RNA, 13 nt, Human
uaaguaaaugcua

SEQ ID NO: 1525935 - RNA, 21 nt, Human
uaaguauucuuauuuaaugaa

SEQ ID NO: 1525936 - RNA, 20 nt, Human
uaaguauucuuauuuaauga

SEQ ID NO: 1525937 - RNA, 16 nt, Human
uaaguauucuaaauuu

SEQ ID NO: 1525938 - RNA, 19 nt, Human
uaaguauucuuauuuaaug

SEQ ID NO: 1525939 - RNA, 13 nt, Human
uaaguacuaugua

SEQ ID NO: 1525940 - RNA, 16 nt, Human
uaaguacuauguauca

SEQ ID NO: 1525941 - RNA, 17 nt, Human
uaaguacuauguaucaa

SEQ ID NO: 1525942 - RNA, 19 nt, Human
uaaguacuauguaucaaug

SEQ ID NO: 1525943 - RNA, 19 nt, Human
aaucuuauaauuuaaaaua

SEQ ID NO: 1525944 - RNA, 19 nt, Human
aaucuacacuccagugaga

SEQ ID NO: 1525945 - RNA, 23 nt, Human
aaucauuaggugugacugaauuu

SEQ ID NO: 1525946 - RNA, 17 nt, Human
aaucauuaggugugacu

SEQ ID NO: 1525947 - RNA, 15 nt, Human
aaucauuagguguga

SEQ ID NO: 1525948 - RNA, 19 nt, Human
aauguauguguaaguauuc

SEQ ID NO: 1525949 - RNA, 22 nt, Human
aauguauuacaguggggaauga

SEQ ID NO: 1525950 - RNA, 20 nt, Human
aauguauguguaaguauucu

SEQ ID NO: 1525951 - RNA, 14 nt, Human
aaugugaaacugga

SEQ ID NO: 1525952 - RNA, 19 nt, Human
aaugugaaaagaaaaauga

SEQ ID NO: 1525953 - RNA, 15 nt, Human
aaugugaaacuggau

SEQ ID NO: 1525954 - RNA, 20 nt, Human
uacaucccuuaccugggaaa

SEQ ID NO: 1525955 - RNA, 24 nt, Human
uacauaaugcgugcauaccacuuu

SEQ ID NO: 1525956 - RNA, 23 nt, Human
uacauaaugcgugcauaccacuu

SEQ ID NO: 1525957 - RNA, 23 nt, Human
uacaggucauauuaauauauuuc

SEQ ID NO: 1525958 - RNA, 16 nt, Human
uacaggugugagucac

SEQ ID NO: 1525959 - RNA, 15 nt, Human
aauuaagagagucua

SEQ ID NO: 1525960 - RNA, 13 nt, Human
uacauucuguuaa

SEQ ID NO: 1525961 - RNA, 17 nt, Human
uacauuguaaauaguau

SEQ ID NO: 1525962 - RNA, 13 nt, Human
aauguuaagcaga

SEQ ID NO: 1525963 - RNA, 11 nt, Human
aauuaacuuuu

SEQ ID NO: 1525964 - RNA, 14 nt, Human
uacacuaagagaga

SEQ ID NO: 1525965 - RNA, 18 nt, Human
uacacuaagagagaauga

SEQ ID NO: 1525966 - RNA, 23 nt, Human
uacacauuuuauuuuauuaugca

SEQ ID NO: 1525967 - RNA, 15 nt, Human
uacacuaaaagguga

SEQ ID NO: 1525968 - RNA, 19 nt, Human
uacacauuuuauuuuauua

SEQ ID NO: 1525969 - RNA, 22 nt, Human
uacacauuuuauuuuauuaugc

SEQ ID NO: 1525970 - RNA, 21 nt, Human
uacacauuuuauuuuauuaug

SEQ ID NO: 1525971 - RNA, 22 nt, Human
uacagacaacaaaccuguuucu

SEQ ID NO: 1525972 - RNA, 19 nt, Human
aauggcacagcccaaagaa

SEQ ID NO: 1525973 - RNA, 16 nt, Human
aauggcagccuuggca

SEQ ID NO: 1525974 - RNA, 12 nt, Human
aauggcagccuu

SEQ ID NO: 1525975 - RNA, 17 nt, Human
aauggcacagcccaaag

SEQ ID NO: 1525976 - RNA, 20 nt, Human
aauggcacagcccaaagaag

SEQ ID NO: 1525977 - RNA, 20 nt, Human
aauggaaaugggcagagcag

SEQ ID NO: 1525978 - RNA, 21 nt, Human
aauggaaaugggcagagcaga

SEQ ID NO: 1525979 - RNA, 14 nt, Human
aauggaaccacucu

SEQ ID NO: 1525980 - RNA, 23 nt, Human
aauggacguguuaugacuccaga

SEQ ID NO: 1525981 - RNA, 20 nt, Human
aauggacuaacuugucuuug

SEQ ID NO: 1525982 - RNA, 16 nt, Human
aaugcuguauuuuaaa

SEQ ID NO: 1525983 - RNA, 13 nt, Human
aaugcuguguuaa

SEQ ID NO: 1525984 - RNA, 13 nt, Human
aaugcccagcccc

SEQ ID NO: 1525985 - RNA, 11 nt, Human
aaugcccagcc

SEQ ID NO: 1525986 - RNA, 12 nt, Human
aaugcccagccc

SEQ ID NO: 1525987 - RNA, 21 nt, Human
aaugccauggacagaagaagg

SEQ ID NO: 1525988 - RNA, 22 nt, Human
aaugcacuuuguucuggcucuu

SEQ ID NO: 1525989 - RNA, 21 nt, Human
uacaaugcugugcccuaaagu

SEQ ID NO: 1525990 - RNA, 18 nt, Human
aaugaccuuucaauagga

SEQ ID NO: 1525991 - RNA, 16 nt, Human
aaugaccuuucaauag

SEQ ID NO: 1525992 - RNA, 17 nt, Human
aaugaccuuucaauagg

SEQ ID NO: 1525993 - RNA, 20 nt, Human
aaugaccuuucaauaggaaa

SEQ ID NO: 1525994 - RNA, 21 nt, Human
aaugcacuuuguucuggcucu

SEQ ID NO: 1525995 - RNA, 11 nt, Human
aauuacaggaa

SEQ ID NO: 1525996 - RNA, 15 nt, Human
aauuagccaagugug

SEQ ID NO: 1525997 - RNA, 10 nt, Human
uaccuguccc

SEQ ID NO: 1525998 - RNA, 13 nt, Human
uaccugucccccu

SEQ ID NO: 1525999 - RNA, 14 nt, Human
uaccugucccccug

SEQ ID NO: 1526000 - RNA, 16 nt, Human
uaccugucccccugac

SEQ ID NO: 1526001 - RNA, 17 nt, Human
uaccugucccccugaca

SEQ ID NO: 1526002 - RNA, 23 nt, Human
uaccugccaggaagccagcaggc

SEQ ID NO: 1526003 - RNA, 18 nt, Human
uaccugccaggaagccag

SEQ ID NO: 1526004 - RNA, 20 nt, Human
uaccugccaggaagccagca

SEQ ID NO: 1526005 - RNA, 19 nt, Human
uacauuguacgaagaguau

SEQ ID NO: 1526006 - RNA, 21 nt, Human
aauuaguacagaaauauccau

SEQ ID NO: 1526007 - RNA, 21 nt, Human
aauuauuuuguucauacauau

SEQ ID NO: 1526008 - RNA, 22 nt, Human
aauuauuuuguucauacauauu

SEQ ID NO: 1526009 - RNA, 16 nt, Human
aauuauuuuguucaua

SEQ ID NO: 1526010 - RNA, 18 nt, Human
aauuauuuuguucauaca

SEQ ID NO: 1526011 - RNA, 19 nt, Human
aauuauuuuguucauacau

SEQ ID NO: 1526012 - RNA, 20 nt, Human
aauuauuuuguucauacaua

SEQ ID NO: 1526013 - RNA, 18 nt, Human
aauuccaagugauugaaa

SEQ ID NO: 1526014 - RNA, 15 nt, Human
aauucagaaggaucu

SEQ ID NO: 1526015 - RNA, 22 nt, Human
aauuccacuuauaggaauugac

SEQ ID NO: 1526016 - RNA, 14 nt, Human
aauuccccacccug

SEQ ID NO: 1526017 - RNA, 12 nt, Human
aauuccccagau

SEQ ID NO: 1526018 - RNA, 13 nt, Human
aauugauguguuu

SEQ ID NO: 1526019 - RNA, 14 nt, Human
aauugauguguuua

SEQ ID NO: 1526020 - RNA, 22 nt, Human
aauugacccacaagaaaugaaa

SEQ ID NO: 1526021 - RNA, 22 nt, Human
uacuguacaugaaaacacauuu

SEQ ID NO: 1526022 - RNA, 21 nt, Human
uacuguacaugaaaacacauu

SEQ ID NO: 1526023 - RNA, 23 nt, Human
uacuguaauuugugauacaaugc

SEQ ID NO: 1526024 - RNA, 14 nt, Human
uacuguaagaaaau

SEQ ID NO: 1526025 - RNA, 18 nt, Human
uacuguaauuugugauac

SEQ ID NO: 1526026 - RNA, 20 nt, Human
uacuguaauuugugauacaa

SEQ ID NO: 1526027 - RNA, 19 nt, Human
uacuguaauuugugauaca

SEQ ID NO: 1526028 - RNA, 21 nt, Human
uacucugugucagguggggca

SEQ ID NO: 1526029 - RNA, 12 nt, Human
uacucuguguca

SEQ ID NO: 1526030 - RNA, 16 nt, Human
uacuggagaaaaugga

SEQ ID NO: 1526031 - RNA, 17 nt, Human
uacuacuccuguaggaa

SEQ ID NO: 1526032 - RNA, 23 nt, Human
uacuauggcccuggccuagcaua

SEQ ID NO: 1526033 - RNA, 12 nt, Human
uacuauguauca

SEQ ID NO: 1526034 - RNA, 13 nt, Human
uacuauguaucaa

SEQ ID NO: 1526035 - RNA, 14 nt, Human
uacuauguaucaau

SEQ ID NO: 1526036 - RNA, 22 nt, Human
uacucuccuggaaauauuaaga

SEQ ID NO: 1526037 - RNA, 23 nt, Human
uacucuccuggaaauauuaagaa

SEQ ID NO: 1526038 - RNA, 16 nt, Human
uacguugugcauuugg

SEQ ID NO: 1526039 - RNA, 15 nt, Human
uacguugugcauuug

SEQ ID NO: 1526040 - RNA, 14 nt, Human
uacguacacauuuu

SEQ ID NO: 1526041 - RNA, 13 nt, Human
uacguacacauuu

SEQ ID NO: 1526042 - RNA, 12 nt, Human
uacguacacauu

SEQ ID NO: 1526043 - RNA, 22 nt, Human
uacgccaggggaaaaucagccu

SEQ ID NO: 1526044 - RNA, 16 nt, Human
acagccucuuagaugc

SEQ ID NO: 1526045 - RNA, 23 nt, Human
uauggcuuuugugcauuaucuag

SEQ ID NO: 1526046 - RNA, 17 nt, Human
uauggcuuuugugcauu

SEQ ID NO: 1526047 - RNA, 21 nt, Human
uauggcuuuugugcauuaucu

SEQ ID NO: 1526048 - RNA, 18 nt, Human
uauggcuuuugugcauua

SEQ ID NO: 1526049 - RNA, 15 nt, Human
uaugcuuauacacuu

SEQ ID NO: 1526050 - RNA, 19 nt, Human
uaugccccauucaacaucu

SEQ ID NO: 1526051 - RNA, 17 nt, Human
uaugccugggcagaagg

SEQ ID NO: 1526052 - RNA, 16 nt, Human
uaugauuaaguaauga

SEQ ID NO: 1526053 - RNA, 20 nt, Human
uaugauuaaguaaugauaac

SEQ ID NO: 1526054 - RNA, 21 nt, Human
uaugauuaaguaaugauaacu

SEQ ID NO: 1526055 - RNA, 11 nt, Human
uaugcauuuga

SEQ ID NO: 1526056 - RNA, 24 nt, Human
uaugcauuugaaaauuuugauguu

SEQ ID NO: 1526057 - RNA, 23 nt, Human
uaugcauuugaaaauuuugaugu

SEQ ID NO: 1526058 - RNA, 19 nt, Human
uaugaaauuauauaaguau

SEQ ID NO: 1526059 - RNA, 22 nt, Human
uaucuuugauucuccuucagcc

SEQ ID NO: 1526060 - RNA, 19 nt, Human
uaucuuugauucuccuuca

SEQ ID NO: 1526061 - RNA, 21 nt, Human
acagcaaggagauuuacaacu

SEQ ID NO: 1526062 - RNA, 17 nt, Human
acagcccgggcucugcc

SEQ ID NO: 1526063 - RNA, 18 nt, Human
acagcaagggugauggga

SEQ ID NO: 1526064 - RNA, 18 nt, Human
acagcccgggcucugccu

SEQ ID NO: 1526065 - RNA, 19 nt, Human
acagcccgggcucugccuc

SEQ ID NO: 1526066 - RNA, 20 nt, Human
acagcccgggcucugccucc

SEQ ID NO: 1526067 - RNA, 20 nt, Human
acagauuuccauccuaguca

SEQ ID NO: 1526068 - RNA, 17 nt, Human
acagcaaggagauuuac

SEQ ID NO: 1526069 - RNA, 20 nt, Human
acagagcccacgcccccacu

SEQ ID NO: 1526070 - RNA, 15 nt, Human
acagagcccacgccc

SEQ ID NO: 1526071 - RNA, 18 nt, Human
acagagcccacgccccca

SEQ ID NO: 1526072 - RNA, 19 nt, Human
acagagcccacgcccccac

SEQ ID NO: 1526073 - RNA, 23 nt, Human
uaucuauauuuuacauaaauuua

SEQ ID NO: 1526074 - RNA, 17 nt, Human
uaucucaaaacugcacu

SEQ ID NO: 1526075 - RNA, 13 nt, Human
uaucucccccagc

SEQ ID NO: 1526076 - RNA, 16 nt, Human
uaucucccccagcccc

SEQ ID NO: 1526077 - RNA, 14 nt, Human
uaucucccccagcc

SEQ ID NO: 1526078 - RNA, 11 nt, Human
acagagaaagu

SEQ ID NO: 1526079 - RNA, 18 nt, Human
acagagaaaguacuucuc

SEQ ID NO: 1526080 - RNA, 19 nt, Human
uauccaaaccaaauaaaaa

SEQ ID NO: 1526081 - RNA, 18 nt, Human
uaucaaguauuauaccuu

SEQ ID NO: 1526082 - RNA, 17 nt, Human
acagaaauguacagcaa

SEQ ID NO: 1526083 - RNA, 16 nt, Human
acagaaauguacagca

SEQ ID NO: 1526084 - RNA, 14 nt, Human
acagaaauguacag

SEQ ID NO: 1526085 - RNA, 20 nt, Human
acagaaaauggaagacagcu

SEQ ID NO: 1526086 - RNA, 17 nt, Human
acagaaaauucuucucc

SEQ ID NO: 1526087 - RNA, 18 nt, Human
acagaaaauucuucucca

SEQ ID NO: 1526088 - RNA, 15 nt, Human
uauauuguuugcuaa

SEQ ID NO: 1526089 - RNA, 13 nt, Human
acagacccugccc

SEQ ID NO: 1526090 - RNA, 14 nt, Human
acagacccugcccu

SEQ ID NO: 1526091 - RNA, 15 nt, Human
acagacccugcccug

SEQ ID NO: 1526092 - RNA, 14 nt, Human
uauguuuuugugua

SEQ ID NO: 1526093 - RNA, 18 nt, Human
uauguuuuuguguauuug

SEQ ID NO: 1526094 - RNA, 12 nt, Human
uaugugaacagu

SEQ ID NO: 1526095 - RNA, 22 nt, Human
uaugugaacaguuguguuugaa

SEQ ID NO: 1526096 - RNA, 20 nt, Human
uauguggaguucaucuugaa

SEQ ID NO: 1526097 - RNA, 22 nt, Human
acaggcauguucucugaggaca

SEQ ID NO: 1526098 - RNA, 15 nt, Human
acaggcauguucucu

SEQ ID NO: 1526099 - RNA, 18 nt, Human
acaggcauguucucugag

SEQ ID NO: 1526100 - RNA, 19 nt, Human
acaggcauguucucugagg

SEQ ID NO: 1526101 - RNA, 20 nt, Human
acaggcauguucucugagga

SEQ ID NO: 1526102 - RNA, 14 nt, Human
acaggcauguucuc

SEQ ID NO: 1526103 - RNA, 14 nt, Human
acaggcagguccag

SEQ ID NO: 1526104 - RNA, 16 nt, Human
acaggcagguccaggg

SEQ ID NO: 1526105 - RNA, 16 nt, Human
acaggagugagcacua

SEQ ID NO: 1526106 - RNA, 14 nt, Human
acaggaucagucug

SEQ ID NO: 1526107 - RNA, 15 nt, Human
acaggaucagucuga

SEQ ID NO: 1526108 - RNA, 23 nt, Human
acaggaccagggauuuccaugau

SEQ ID NO: 1526109 - RNA, 12 nt, Human
acaggaccccag

SEQ ID NO: 1526110 - RNA, 13 nt, Human
acaggaccccagc

SEQ ID NO: 1526111 - RNA, 14 nt, Human
acaggaccccagcu

SEQ ID NO: 1526112 - RNA, 15 nt, Human
acaggaccccagcuc

SEQ ID NO: 1526113 - RNA, 16 nt, Human
acaggaccccagcucu

SEQ ID NO: 1526114 - RNA, 17 nt, Human
acaggaccccagcucug

SEQ ID NO: 1526115 - RNA, 19 nt, Human
acaggaccccagcucugcg

SEQ ID NO: 1526116 - RNA, 18 nt, Human
acaggaccccagcucugc

SEQ ID NO: 1526117 - RNA, 13 nt, Human
acaggaaguacug

SEQ ID NO: 1526118 - RNA, 17 nt, Human
acaggaaguagaggagg

SEQ ID NO: 1526119 - RNA, 15 nt, Human
acaggaaaagcugcu

SEQ ID NO: 1526120 - RNA, 16 nt, Human
acaggaaaagcugcug

SEQ ID NO: 1526121 - RNA, 17 nt, Human
acaggaaaagcugcuga

SEQ ID NO: 1526122 - RNA, 18 nt, Human
acaggaaaagcugcugac

SEQ ID NO: 1526123 - RNA, 13 nt, Human
acagcuaacaugg

SEQ ID NO: 1526124 - RNA, 16 nt, Human
acagucaccucaugga

SEQ ID NO: 1526125 - RNA, 17 nt, Human
acagucaccucauggaa

SEQ ID NO: 1526126 - RNA, 18 nt, Human
acagucaccucauggaau

SEQ ID NO: 1526127 - RNA, 12 nt, Human
acagggcacacc

SEQ ID NO: 1526128 - RNA, 20 nt, Human
acagggcacaccgggcacuc

SEQ ID NO: 1526129 - RNA, 16 nt, Human
acaggcuuagggacag

SEQ ID NO: 1526130 - RNA, 23 nt, Human
acaggcugggcuucaguggcagc

SEQ ID NO: 1526131 - RNA, 12 nt, Human
acaggcugggcu

SEQ ID NO: 1526132 - RNA, 22 nt, Human
acaggcugggcuucaguggcag

SEQ ID NO: 1526133 - RNA, 20 nt, Human
acagggaggacgcucucugg

SEQ ID NO: 1526134 - RNA, 21 nt, Human
acagggaggacgcucucuggc

SEQ ID NO: 1526135 - RNA, 16 nt, Human
uauucaggaagcucag

SEQ ID NO: 1526136 - RNA, 14 nt, Human
uauucaggaagcuc

SEQ ID NO: 1526137 - RNA, 20 nt, Human
uauucaguaauaacucuacc

SEQ ID NO: 1526138 - RNA, 23 nt, Human
uauucaaacagucucaggaaauc

SEQ ID NO: 1526139 - RNA, 15 nt, Human
uauucaaacagucuc

SEQ ID NO: 1526140 - RNA, 15 nt, Human
uauuagaauaccaca

SEQ ID NO: 1526141 - RNA, 14 nt, Human
uauuacuguaagaa

SEQ ID NO: 1526142 - RNA, 14 nt, Human
uauuacuucugcua

SEQ ID NO: 1526143 - RNA, 13 nt, Human
uauuacuucugcu

SEQ ID NO: 1526144 - RNA, 20 nt, Human
acacucacauuuauucugcu

SEQ ID NO: 1526145 - RNA, 22 nt, Human
acacucacauuuauucugcuca

SEQ ID NO: 1526146 - RNA, 13 nt, Human
acacuaagagaga

SEQ ID NO: 1526147 - RNA, 14 nt, Human
acacuaagagagaa

SEQ ID NO: 1526148 - RNA, 15 nt, Human
acacucaaaagcugg

SEQ ID NO: 1526149 - RNA, 19 nt, Human
acacucaaaucaagaaacu

SEQ ID NO: 1526150 - RNA, 15 nt, Human
acaccuuauauuuac

SEQ ID NO: 1526151 - RNA, 12 nt, Human
acacgaauauug

SEQ ID NO: 1526152 - RNA, 21 nt, Human
acaccucugcacaagcugcac

SEQ ID NO: 1526153 - RNA, 16 nt, Human
acaccgggcacucaga

SEQ ID NO: 1526154 - RNA, 22 nt, Human
acacaucagcuugcccuguuaa

SEQ ID NO: 1526155 - RNA, 21 nt, Human
acacauuuuauuuuauuaugc

SEQ ID NO: 1526156 - RNA, 15 nt, Human
acacaugaaguccaa

SEQ ID NO: 1526157 - RNA, 15 nt, Human
acacaucagcuugcc

SEQ ID NO: 1526158 - RNA, 18 nt, Human
acacaugauccugcaauu

SEQ ID NO: 1526159 - RNA, 21 nt, Human
acacaugagcaucaggccagg

SEQ ID NO: 1526160 - RNA, 20 nt, Human
acacauuuuauuuuauuaug

SEQ ID NO: 1526161 - RNA, 19 nt, Human
acacauuuuauuuuauuau

SEQ ID NO: 1526162 - RNA, 14 nt, Human
acacauuuuauuuu

SEQ ID NO: 1526163 - RNA, 18 nt, Human
acacaugcaaggucauuu

SEQ ID NO: 1526164 - RNA, 15 nt, Human
uaguucccaggugau

SEQ ID NO: 1526165 - RNA, 20 nt, Human
uaguuccaccaucaagccac

SEQ ID NO: 1526166 - RNA, 19 nt, Human
acacacagcucuguccugg

SEQ ID NO: 1526167 - RNA, 17 nt, Human
acacacagcucuguccu

SEQ ID NO: 1526168 - RNA, 13 nt, Human
acacacagcucug

SEQ ID NO: 1526169 - RNA, 14 nt, Human
acacacagcucugu

SEQ ID NO: 1526170 - RNA, 22 nt, Human
acacacacgcgugcacacacca

SEQ ID NO: 1526171 - RNA, 21 nt, Human
acacacugcauguuugugauu

SEQ ID NO: 1526172 - RNA, 20 nt, Human
acacacucaaaucaagaaac

SEQ ID NO: 1526173 - RNA, 15 nt, Human
acacacucaaaucaa

SEQ ID NO: 1526174 - RNA, 14 nt, Human
acacaccagagccc

SEQ ID NO: 1526175 - RNA, 15 nt, Human
acacaccagagccca

SEQ ID NO: 1526176 - RNA, 20 nt, Human
acacaccagagcccaccuug

SEQ ID NO: 1526177 - RNA, 21 nt, Human
acacacgcgugcacacaccag

SEQ ID NO: 1526178 - RNA, 19 nt, Human
acaaugugaaaagaaaaau

SEQ ID NO: 1526179 - RNA, 17 nt, Human
acaaugugaaaagaaaa

SEQ ID NO: 1526180 - RNA, 24 nt, Human
acaaugcugugcccuaaaguguau

SEQ ID NO: 1526181 - RNA, 23 nt, Human
acaaugcugugcccuaaagugua

SEQ ID NO: 1526182 - RNA, 22 nt, Human
acaaugcugugcccuaaagugu

SEQ ID NO: 1526183 - RNA, 22 nt, Human
acaaugcuguauuuuaaaagaa

SEQ ID NO: 1526184 - RNA, 21 nt, Human
acaaugcugugcccuaaagug

SEQ ID NO: 1526185 - RNA, 22 nt, Human
uagugaaacucguuaauuugua

SEQ ID NO: 1526186 - RNA, 23 nt, Human
uaguguuggagaagaacugaaau

SEQ ID NO: 1526187 - RNA, 19 nt, Human
acacaguauuacuucugcu

SEQ ID NO: 1526188 - RNA, 22 nt, Human
acacaguauuacuucugcuaca

SEQ ID NO: 1526189 - RNA, 18 nt, Human
acacaguauuacuucugc

SEQ ID NO: 1526190 - RNA, 19 nt, Human
uaggaaauauuuauuuuaa

SEQ ID NO: 1526191 - RNA, 18 nt, Human
uaggaaauauuuauuuua

SEQ ID NO: 1526192 - RNA, 21 nt, Human
uagggaauggcacagcccaaa

SEQ ID NO: 1526193 - RNA, 19 nt, Human
uagggacaggaccccagcu

SEQ ID NO: 1526194 - RNA, 20 nt, Human
uagggacaggaccccagcuc

SEQ ID NO: 1526195 - RNA, 22 nt, Human
uagggacaggaccccagcucug

SEQ ID NO: 1526196 - RNA, 21 nt, Human
uagggacaggaccccagcucu

SEQ ID NO: 1526197 - RNA, 14 nt, Human
uagggagagaagau

SEQ ID NO: 1526198 - RNA, 15 nt, Human
uagggagagaagaua

SEQ ID NO: 1526199 - RNA, 14 nt, Human
uaggcauuguggga

SEQ ID NO: 1526200 - RNA, 16 nt, Human
uaggcauuugcugaau

SEQ ID NO: 1526201 - RNA, 20 nt, Human
uaggcauuugcugaauacag

SEQ ID NO: 1526202 - RNA, 13 nt, Human
acaagacugcaca

SEQ ID NO: 1526203 - RNA, 14 nt, Human
acaagacugcacau

SEQ ID NO: 1526204 - RNA, 23 nt, Human
acaauacaucccuuaccugggaa

SEQ ID NO: 1526205 - RNA, 19 nt, Human
acaaugacuuacuguacau

SEQ ID NO: 1526206 - RNA, 18 nt, Human
acaaugacuuacuguaca

SEQ ID NO: 1526207 - RNA, 17 nt, Human
acaaugacuuacuguac

SEQ ID NO: 1526208 - RNA, 12 nt, Human
acaaugacuuac

SEQ ID NO: 1526209 - RNA, 12 nt, Human
uagcuaauguaa

SEQ ID NO: 1526210 - RNA, 19 nt, Human
uagcuaauguaauaacugu

SEQ ID NO: 1526211 - RNA, 19 nt, Human
uagauauaugcucugcaug

SEQ ID NO: 1526212 - RNA, 22 nt, Human
uagaggagaaacuggaacucuc

SEQ ID NO: 1526213 - RNA, 15 nt, Human
uagauauaugcucug

SEQ ID NO: 1526214 - RNA, 22 nt, Human
uagagcaaaauugauguguuua

SEQ ID NO: 1526215 - RNA, 14 nt, Human
uagagcaaaauuga

SEQ ID NO: 1526216 - RNA, 21 nt, Human
uagagcaaaauugauguguuu

SEQ ID NO: 1526217 - RNA, 18 nt, Human
acaaaaggauaaugaaua

SEQ ID NO: 1526218 - RNA, 22 nt, Human
acaaaagcaugugagacugguu

SEQ ID NO: 1526219 - RNA, 11 nt, Human
acaaaagcaug

SEQ ID NO: 1526220 - RNA, 22 nt, Human
acaaaggaugcccaaagaugca

SEQ ID NO: 1526221 - RNA, 11 nt, Human
uagccagagga

SEQ ID NO: 1526222 - RNA, 15 nt, Human
uagccagaggagaga

SEQ ID NO: 1526223 - RNA, 19 nt, Human
acaaauuuacagagacaga

SEQ ID NO: 1526224 - RNA, 18 nt, Human
acaaauuuacagagacag

SEQ ID NO: 1526225 - RNA, 23 nt, Human
acaacacucauugaccugaggcc

SEQ ID NO: 1526226 - RNA, 21 nt, Human
acaacacucauugaccugagg

SEQ ID NO: 1526227 - RNA, 19 nt, Human
acaagaccacguuucuaaa

SEQ ID NO: 1526228 - RNA, 20 nt, Human
acaagacccaaaaggcagaa

SEQ ID NO: 1526229 - RNA, 19 nt, Human
acaagacccuugugguccc

SEQ ID NO: 1526230 - RNA, 18 nt, Human
uagcaugucgucaaagcu

SEQ ID NO: 1526231 - RNA, 16 nt, Human
uagcauuuugcuaaau

SEQ ID NO: 1526232 - RNA, 21 nt, Human
uagccaaggccaaaggaagca

SEQ ID NO: 1526233 - RNA, 22 nt, Human
uagcauuuugcuaaaugugaau

SEQ ID NO: 1526234 - RNA, 15 nt, Human
uagaugcaguucuga

SEQ ID NO: 1526235 - RNA, 19 nt, Human
uagcauggcugccaauggg

SEQ ID NO: 1526236 - RNA, 22 nt, Human
uagcauggcauauuuuucacau

SEQ ID NO: 1526237 - RNA, 12 nt, Human
guguuugaagca

SEQ ID NO: 1526238 - RNA, 16 nt, Human
aagcacacuugacauc

SEQ ID NO: 1526239 - RNA, 14 nt, Human
aagcacaugccucu

SEQ ID NO: 1526240 - RNA, 15 nt, Human
aagcacaugccucuc

SEQ ID NO: 1526241 - RNA, 16 nt, Human
aagcacaugccucucu

SEQ ID NO: 1526242 - RNA, 19 nt, Human
aagcacaugccucucucag

SEQ ID NO: 1526243 - RNA, 20 nt, Human
aagcacaugccucucucagg

SEQ ID NO: 1526244 - RNA, 16 nt, Human
aagcacuaaacaaaga

SEQ ID NO: 1526245 - RNA, 17 nt, Human
aagcaccuccugccucg

SEQ ID NO: 1526246 - RNA, 16 nt, Human
aagcacugacuucuaa

SEQ ID NO: 1526247 - RNA, 17 nt, Human
aagcacugacuucuaag

SEQ ID NO: 1526248 - RNA, 21 nt, Human
aagcacaugccucucucaggc

SEQ ID NO: 1526249 - RNA, 13 nt, Human
aagcaccuccugc

SEQ ID NO: 1526250 - RNA, 14 nt, Human
aagcaccuccugcc

SEQ ID NO: 1526251 - RNA, 15 nt, Human
aagcaccuccugccu

SEQ ID NO: 1526252 - RNA, 16 nt, Human
aagcaccuccugccuc

SEQ ID NO: 1526253 - RNA, 12 nt, Human
aagcaugugaga

SEQ ID NO: 1526254 - RNA, 19 nt, Human
aagcacugacuucuaagua

SEQ ID NO: 1526255 - RNA, 20 nt, Human
aagcacugacuucuaaguaa

SEQ ID NO: 1526256 - RNA, 16 nt, Human
aagcauuuacuuugug

SEQ ID NO: 1526257 - RNA, 19 nt, Human
aagcauuguaaaugugcuu

SEQ ID NO: 1526258 - RNA, 17 nt, Human
aagccaaagcuaggccu

SEQ ID NO: 1526259 - RNA, 18 nt, Human
aagccaaagcuaggccug

SEQ ID NO: 1526260 - RNA, 20 nt, Human
aagccaaagcuaggccuggc

SEQ ID NO: 1526261 - RNA, 13 nt, Human
aagcaaaauguga

SEQ ID NO: 1526262 - RNA, 17 nt, Human
aagcaacccaaauguuc

SEQ ID NO: 1526263 - RNA, 23 nt, Human
aagaucaaaagguuaauaaagua

SEQ ID NO: 1526264 - RNA, 20 nt, Human
aagaucaaaagguuaauaaa

SEQ ID NO: 1526265 - RNA, 20 nt, Human
gugucagguggggcagcuug

SEQ ID NO: 1526266 - RNA, 19 nt, Human
gugucagguggggcagcuu

SEQ ID NO: 1526267 - RNA, 22 nt, Human
gugucuuaauuaaaagaauauu

SEQ ID NO: 1526268 - RNA, 23 nt, Human
gugugaaccaccacacccagccc

SEQ ID NO: 1526269 - RNA, 14 nt, Human
gugucaccugaaga

SEQ ID NO: 1526270 - RNA, 22 nt, Human
gugucaccugaagacucauucu

SEQ ID NO: 1526271 - RNA, 14 nt, Human
gugucagguggggc

SEQ ID NO: 1526272 - RNA, 18 nt, Human
gugucagguggggcagcu

SEQ ID NO: 1526273 - RNA, 15 nt, Human
aagauagcagggcau

SEQ ID NO: 1526274 - RNA, 11 nt, Human
aagaggcaggg

SEQ ID NO: 1526275 - RNA, 14 nt, Human
aagaggcagggucu

SEQ ID NO: 1526276 - RNA, 21 nt, Human
aagagggagggagggcuccag

SEQ ID NO: 1526277 - RNA, 22 nt, Human
aagagggagggagggcuccaga

SEQ ID NO: 1526278 - RNA, 15 nt, Human
guguaaaaugugaag

SEQ ID NO: 1526279 - RNA, 18 nt, Human
gugcugcccugcccaccu

SEQ ID NO: 1526280 - RNA, 23 nt, Human
gugcugcccugcccaccuggccu

SEQ ID NO: 1526281 - RNA, 15 nt, Human
gugguuucagaaaug

SEQ ID NO: 1526282 - RNA, 21 nt, Human
aagccuuggggcugaugcagu

SEQ ID NO: 1526283 - RNA, 16 nt, Human
aagccucccacgacug

SEQ ID NO: 1526284 - RNA, 15 nt, Human
aagccuccuccagcc

SEQ ID NO: 1526285 - RNA, 19 nt, Human
aagccuccuccagccgcca

SEQ ID NO: 1526286 - RNA, 17 nt, Human
guucagguaacaggcag

SEQ ID NO: 1526287 - RNA, 18 nt, Human
guucagguaacaggcaga

SEQ ID NO: 1526288 - RNA, 21 nt, Human
aagccgugauuuucauugcug

SEQ ID NO: 1526289 - RNA, 21 nt, Human
guucaggguuggccccugccc

SEQ ID NO: 1526290 - RNA, 22 nt, Human
guucaggguuggccccugcccg

SEQ ID NO: 1526291 - RNA, 23 nt, Human
guucagcuuguaaauagcucagg

SEQ ID NO: 1526292 - RNA, 20 nt, Human
guuauuauauuuacaaaugg

SEQ ID NO: 1526293 - RNA, 21 nt, Human
guuauugauaaguucauacau

SEQ ID NO: 1526294 - RNA, 22 nt, Human
guuauugauaaguucauacauu

SEQ ID NO: 1526295 - RNA, 19 nt, Human
guuauuauauuuacaaaug

SEQ ID NO: 1526296 - RNA, 19 nt, Human
guuagagguucccuuugac

SEQ ID NO: 1526297 - RNA, 19 nt, Human
guuaauuccaauuauauga

SEQ ID NO: 1526298 - RNA, 18 nt, Human
guuaaucauuagguguga

SEQ ID NO: 1526299 - RNA, 23 nt, Human
aagcuuguauuccuuuuucucuc

SEQ ID NO: 1526300 - RNA, 18 nt, Human
aagcuuauuaaaacucau

SEQ ID NO: 1526301 - RNA, 18 nt, Human
guucccuugaugaagaag

SEQ ID NO: 1526302 - RNA, 22 nt, Human
guucuagcauggcauauuuuuc

SEQ ID NO: 1526303 - RNA, 21 nt, Human
guucccuuuuuuggcugcuga

SEQ ID NO: 1526304 - RNA, 22 nt, Human
guucccuuuuuuggcugcugaa

SEQ ID NO: 1526305 - RNA, 19 nt, Human
guugacuugacagaacacu

SEQ ID NO: 1526306 - RNA, 20 nt, Human
guugacuugacagaacacug

SEQ ID NO: 1526307 - RNA, 22 nt, Human
guugauagcacagacccugccc

SEQ ID NO: 1526308 - RNA, 14 nt, Human
guugauagcacaga

SEQ ID NO: 1526309 - RNA, 19 nt, Human
guugauagcacagacccug

SEQ ID NO: 1526310 - RNA, 18 nt, Human
guucuugguuuguaaauu

SEQ ID NO: 1526311 - RNA, 15 nt, Human
guucuugguuuguaa

SEQ ID NO: 1526312 - RNA, 14 nt, Human
guucuugguuugua

SEQ ID NO: 1526313 - RNA, 19 nt, Human
guucuagcauggcugccaa

SEQ ID NO: 1526314 - RNA, 15 nt, Human
guucucucuucucca

SEQ ID NO: 1526315 - RNA, 12 nt, Human
guucucugagga

SEQ ID NO: 1526316 - RNA, 14 nt, Human
guucucugaggaca

SEQ ID NO: 1526317 - RNA, 15 nt, Human
guucucugcccucca

SEQ ID NO: 1526318 - RNA, 13 nt, Human
guucuuaauucuu

SEQ ID NO: 1526319 - RNA, 17 nt, Human
guucucugcccuccaag

SEQ ID NO: 1526320 - RNA, 18 nt, Human
guucucugcccuccaaga

SEQ ID NO: 1526321 - RNA, 17 nt, Human
guucuuaauucuuagcu

SEQ ID NO: 1526322 - RNA, 14 nt, Human
guucuuaauucuua

SEQ ID NO: 1526323 - RNA, 18 nt, Human
aaguauguuagugcaaau

SEQ ID NO: 1526324 - RNA, 19 nt, Human
aaguauguuagugcaaauu

SEQ ID NO: 1526325 - RNA, 21 nt, Human
aaguauguuagugcaaauugu

SEQ ID NO: 1526326 - RNA, 19 nt, Human
aaguauguguaaaauguga

SEQ ID NO: 1526327 - RNA, 15 nt, Human
aaguauuauaccuuu

SEQ ID NO: 1526328 - RNA, 15 nt, Human
aaguacuauguauca

SEQ ID NO: 1526329 - RNA, 18 nt, Human
aaguacuucuccacccug

SEQ ID NO: 1526330 - RNA, 19 nt, Human
aaguacuucuccacccugc

SEQ ID NO: 1526331 - RNA, 20 nt, Human
aaguacuucuccacccugcu

SEQ ID NO: 1526332 - RNA, 14 nt, Human
aaguacuauaauuu

SEQ ID NO: 1526333 - RNA, 17 nt, Human
aaguacuauaauuuacc

SEQ ID NO: 1526334 - RNA, 13 nt, Human
aaguacuauguau

SEQ ID NO: 1526335 - RNA, 23 nt, Human
aaguauucuuauuuaaugaaaga

SEQ ID NO: 1526336 - RNA, 19 nt, Human
aaguauuauaccuuuuuua

SEQ ID NO: 1526337 - RNA, 16 nt, Human
aaguauuauaccuuuu

SEQ ID NO: 1526338 - RNA, 21 nt, Human
aaguauucuuauuuaaugaaa

SEQ ID NO: 1526339 - RNA, 19 nt, Human
guuuggacaaaauggaaua

SEQ ID NO: 1526340 - RNA, 15 nt, Human
guuuuaaagcuucca

SEQ ID NO: 1526341 - RNA, 20 nt, Human
aaguaauaugcacacauuuu

SEQ ID NO: 1526342 - RNA, 18 nt, Human
aaguaauaugcacacauu

SEQ ID NO: 1526343 - RNA, 17 nt, Human
aaguaauaugcacacau

SEQ ID NO: 1526344 - RNA, 21 nt, Human
aaguaauaugcacacauuuuu

SEQ ID NO: 1526345 - RNA, 19 nt, Human
guuuucuguucuuucuggc

SEQ ID NO: 1526346 - RNA, 16 nt, Human
guuuucuguucuuucu

SEQ ID NO: 1526347 - RNA, 15 nt, Human
guuuucuguucuuuc

SEQ ID NO: 1526348 - RNA, 14 nt, Human
guuuucuguucuuu

SEQ ID NO: 1526349 - RNA, 22 nt, Human
guuuuaaggaugcuuguacaua

SEQ ID NO: 1526350 - RNA, 16 nt, Human
aagguuucugaaaauu

SEQ ID NO: 1526351 - RNA, 13 nt, Human
aaggggagaguaa

SEQ ID NO: 1526352 - RNA, 12 nt, Human
aagggggcuggg

SEQ ID NO: 1526353 - RNA, 23 nt, Human
aagggggcugggacaugggaaag

SEQ ID NO: 1526354 - RNA, 17 nt, Human
aaggggguggugucucc

SEQ ID NO: 1526355 - RNA, 15 nt, Human
aagggcuguuauaau

SEQ ID NO: 1526356 - RNA, 17 nt, Human
aagggcuguuauaaucu

SEQ ID NO: 1526357 - RNA, 16 nt, Human
aaggcugggggaagaa

SEQ ID NO: 1526358 - RNA, 13 nt, Human
guuucagaaaugu

SEQ ID NO: 1526359 - RNA, 11 nt, Human
guuucagaaau

SEQ ID NO: 1526360 - RNA, 19 nt, Human
aaggcugggggaagaagcu

SEQ ID NO: 1526361 - RNA, 22 nt, Human
aaggcugggggaagaagcucuc

SEQ ID NO: 1526362 - RNA, 20 nt, Human
aaggcugucaauuacaggaa

SEQ ID NO: 1526363 - RNA, 21 nt, Human
guuuaagugacugauggcuaa

SEQ ID NO: 1526364 - RNA, 23 nt, Human
guuguuugauucagacagcugcc

SEQ ID NO: 1526365 - RNA, 12 nt, Human
aaggaaaaugau

SEQ ID NO: 1526366 - RNA, 17 nt, Human
aaggaaacccagcucug

SEQ ID NO: 1526367 - RNA, 22 nt, Human
aaggaaacccagcucuggucca

SEQ ID NO: 1526368 - RNA, 14 nt, Human
guuuaugauuccac

SEQ ID NO: 1526369 - RNA, 13 nt, Human
aagugugguagag

SEQ ID NO: 1526370 - RNA, 23 nt, Human
aaguguauuuuuuuacuaauaga

SEQ ID NO: 1526371 - RNA, 19 nt, Human
aaguuauuuuuaauuuggu

SEQ ID NO: 1526372 - RNA, 19 nt, Human
aaguuucugccgcagcccu

SEQ ID NO: 1526373 - RNA, 21 nt, Human
aaguuucugccgcagcccugc

SEQ ID NO: 1526374 - RNA, 13 nt, Human
uaaaaugugaagu

SEQ ID NO: 1526375 - RNA, 11 nt, Human
uaaaaugugaa

SEQ ID NO: 1526376 - RNA, 9 nt, Human
uaaaauggu

SEQ ID NO: 1526377 - RNA, 20 nt, Human
aaguuugagaucagccuggg

SEQ ID NO: 1526378 - RNA, 22 nt, Human
uaaaauaauuuuuauauuugaa

SEQ ID NO: 1526379 - RNA, 21 nt, Human
uaaaauacacacucaaaucaa

SEQ ID NO: 1526380 - RNA, 13 nt, Human
uaaaagucuugug

SEQ ID NO: 1526381 - RNA, 13 nt, Human
uaaaagaauauuu

SEQ ID NO: 1526382 - RNA, 16 nt, Human
uaaaagaauauuuuaa

SEQ ID NO: 1526383 - RNA, 21 nt, Human
uaaaauaccagccaguaaaug

SEQ ID NO: 1526384 - RNA, 13 nt, Human
aagugauccuccc

SEQ ID NO: 1526385 - RNA, 19 nt, Human
aagugauccucccaccuca

SEQ ID NO: 1526386 - RNA, 20 nt, Human
aagugauccucccaccucag

SEQ ID NO: 1526387 - RNA, 23 nt, Human
aagugauccucccaccucagccu

SEQ ID NO: 1526388 - RNA, 14 nt, Human
uaaaaauauugugu

SEQ ID NO: 1526389 - RNA, 22 nt, Human
uaaaaagccugcaauuucauau

SEQ ID NO: 1526390 - RNA, 21 nt, Human
uaaaaaaaaaccugagcccca

SEQ ID NO: 1526391 - RNA, 13 nt, Human
uaaaacccaagug

SEQ ID NO: 1526392 - RNA, 15 nt, Human
uaaaacuuuuuaaaa

SEQ ID NO: 1526393 - RNA, 12 nt, Human
uaaaacuuuuua

SEQ ID NO: 1526394 - RNA, 23 nt, Human
uaaaaaucucaaauuucuaaauc

SEQ ID NO: 1526395 - RNA, 21 nt, Human
uaaaaauauuguguugugaau

SEQ ID NO: 1526396 - RNA, 22 nt, Human
uaaaaauauuguguugugaaug

SEQ ID NO: 1526397 - RNA, 15 nt, Human
uaaaaaugagguacu

SEQ ID NO: 1526398 - RNA, 15 nt, Human
uaaaaccacagcagu

SEQ ID NO: 1526399 - RNA, 22 nt, Human
uaaaaaugagguacucuccugg

SEQ ID NO: 1526400 - RNA, 14 nt, Human
uaaaaccacagcag

SEQ ID NO: 1526401 - RNA, 11 nt, Human
gugauuaccag

SEQ ID NO: 1526402 - RNA, 16 nt, Human
gugauuaccagggacu

SEQ ID NO: 1526403 - RNA, 17 nt, Human
gugauuaccagggacug

SEQ ID NO: 1526404 - RNA, 22 nt, Human
gugcaaugaccuuucaauagga

SEQ ID NO: 1526405 - RNA, 23 nt, Human
gugcacaagcuccaagcucccag

SEQ ID NO: 1526406 - RNA, 21 nt, Human
gugcacaugcacgugugugca

SEQ ID NO: 1526407 - RNA, 18 nt, Human
gugcaaugaccuuucaau

SEQ ID NO: 1526408 - RNA, 13 nt, Human
gugcacaagcucc

SEQ ID NO: 1526409 - RNA, 16 nt, Human
gugcacaagcuccaag

SEQ ID NO: 1526410 - RNA, 21 nt, Human
gugcacaagcuccaagcuccc

SEQ ID NO: 1526411 - RNA, 20 nt, Human
gugcauuugaggucuguucu

SEQ ID NO: 1526412 - RNA, 21 nt, Human
gugcauuuggugguuucagaa

SEQ ID NO: 1526413 - RNA, 23 nt, Human
gugccaaaaacaacaacaaaaug

SEQ ID NO: 1526414 - RNA, 19 nt, Human
gugcauuugaggucuguuc

SEQ ID NO: 1526415 - RNA, 17 nt, Human
gugcauuugaggucugu

SEQ ID NO: 1526416 - RNA, 18 nt, Human
aacuucagcgguuuauau

SEQ ID NO: 1526417 - RNA, 13 nt, Human
aacuucagacaua

SEQ ID NO: 1526418 - RNA, 21 nt, Human
aacuucagcgguuuauauaag

SEQ ID NO: 1526419 - RNA, 23 nt, Human
aacuuccuuggacucauuuuaaa

SEQ ID NO: 1526420 - RNA, 17 nt, Human
aacugugaaguuuacau

SEQ ID NO: 1526421 - RNA, 19 nt, Human
aacugugaaguuuacauug

SEQ ID NO: 1526422 - RNA, 22 nt, Human
aacuucaccauauuaccacaga

SEQ ID NO: 1526423 - RNA, 22 nt, Human
aacuucacauauugauuuccgu

SEQ ID NO: 1526424 - RNA, 14 nt, Human
aacuucacauauug

SEQ ID NO: 1526425 - RNA, 19 nt, Human
gugcuaucucccccagccc

SEQ ID NO: 1526426 - RNA, 16 nt, Human
gugcucugaucaucca

SEQ ID NO: 1526427 - RNA, 13 nt, Human
gugcucuggacag

SEQ ID NO: 1526428 - RNA, 14 nt, Human
gugcucuggacagg

SEQ ID NO: 1526429 - RNA, 13 nt, Human
gugcugcccugcc

SEQ ID NO: 1526430 - RNA, 14 nt, Human
gugcugcccugccc

SEQ ID NO: 1526431 - RNA, 15 nt, Human
gugcugcccugccca

SEQ ID NO: 1526432 - RNA, 22 nt, Human
aagaagcaccaaucaugaauua

SEQ ID NO: 1526433 - RNA, 22 nt, Human
gugcuacaaaaacacagcaagg

SEQ ID NO: 1526434 - RNA, 17 nt, Human
gugcuaggaacacuccu

SEQ ID NO: 1526435 - RNA, 15 nt, Human
gugcuaucuccccca

SEQ ID NO: 1526436 - RNA, 18 nt, Human
gugcuaucucccccagcc

SEQ ID NO: 1526437 - RNA, 11 nt, Human
aagaaacauuu

SEQ ID NO: 1526438 - RNA, 14 nt, Human
aagaaacaacagaa

SEQ ID NO: 1526439 - RNA, 22 nt, Human
aagaaaauaguggugugauuug

SEQ ID NO: 1526440 - RNA, 21 nt, Human
aagaaaauaguggugugauuu

SEQ ID NO: 1526441 - RNA, 15 nt, Human
aagaaaauaguggug

SEQ ID NO: 1526442 - RNA, 14 nt, Human
aagaaagaaaauca

SEQ ID NO: 1526443 - RNA, 16 nt, Human
aagaaagaaaaucagg

SEQ ID NO: 1526444 - RNA, 23 nt, Human
aacuuuaccuuuuuuauacauaa

SEQ ID NO: 1526445 - RNA, 22 nt, Human
aacuuuaccuuuuuuauacaua

SEQ ID NO: 1526446 - RNA, 21 nt, Human
aacuuuaccuuuuuuauacau

SEQ ID NO: 1526447 - RNA, 17 nt, Human
aagaaaaaugagccugg

SEQ ID NO: 1526448 - RNA, 18 nt, Human
aagaaaaaugagccuggc

SEQ ID NO: 1526449 - RNA, 14 nt, Human
aagaaaacaacuuc

SEQ ID NO: 1526450 - RNA, 19 nt, Human
aagaaaaaauauuuucccu

SEQ ID NO: 1526451 - RNA, 13 nt, Human
aagaaaaagaaaa

SEQ ID NO: 1526452 - RNA, 18 nt, Human
aagaaaaagaaaaagaaa

SEQ ID NO: 1526453 - RNA, 12 nt, Human
aacgucuuaaau

SEQ ID NO: 1526454 - RNA, 14 nt, Human
aacgucuuaaauau

SEQ ID NO: 1526455 - RNA, 15 nt, Human
aacgucuuaaauauu

SEQ ID NO: 1526456 - RNA, 12 nt, Human
aaccuggggggc

SEQ ID NO: 1526457 - RNA, 21 nt, Human
aacucauuuuuguuuucauua

SEQ ID NO: 1526458 - RNA, 23 nt, Human
aacuauucaggagaguagaacag

SEQ ID NO: 1526459 - RNA, 24 nt, Human
aacucauuuuuguuuucauuaucu

SEQ ID NO: 1526460 - RNA, 17 nt, Human
aacuagggaagauaaua

SEQ ID NO: 1526461 - RNA, 12 nt, Human
aacguggcugcu

SEQ ID NO: 1526462 - RNA, 13 nt, Human
aacguggcugcuu

SEQ ID NO: 1526463 - RNA, 13 nt, Human
gucuucacaacag

SEQ ID NO: 1526464 - RNA, 14 nt, Human
gucuuaauuaaaag

SEQ ID NO: 1526465 - RNA, 19 nt, Human
gucuuaauuaaaagaauau

SEQ ID NO: 1526466 - RNA, 18 nt, Human
gucuggaaugcaguggua

SEQ ID NO: 1526467 - RNA, 15 nt, Human
gucuggaaugcagug

SEQ ID NO: 1526468 - RNA, 16 nt, Human
gucuggaaugcagugg

SEQ ID NO: 1526469 - RNA, 14 nt, Human
gucugaaggcuggg

SEQ ID NO: 1526470 - RNA, 14 nt, Human
gucucaaaaaaaca

SEQ ID NO: 1526471 - RNA, 17 nt, Human
gucucaaaaaaagaaaa

SEQ ID NO: 1526472 - RNA, 19 nt, Human
gucucaaaaaaagaaaaag

SEQ ID NO: 1526473 - RNA, 20 nt, Human
gucugacaggcaaugcuggc

SEQ ID NO: 1526474 - RNA, 15 nt, Human
gucugacaggcaaug

SEQ ID NO: 1526475 - RNA, 18 nt, Human
gucugacaggcaaugcug

SEQ ID NO: 1526476 - RNA, 12 nt, Human
gucugacaggca

SEQ ID NO: 1526477 - RNA, 13 nt, Human
gucugacaggcaa

SEQ ID NO: 1526478 - RNA, 14 nt, Human
gucugacaggcaau

SEQ ID NO: 1526479 - RNA, 22 nt, Human
gugagacccugucucaaaaaaa

SEQ ID NO: 1526480 - RNA, 17 nt, Human
gugagacucgagaacuu

SEQ ID NO: 1526481 - RNA, 20 nt, Human
gugagacucgagaacuuuca

SEQ ID NO: 1526482 - RNA, 22 nt, Human
gugagacucgagaacuuucauu

SEQ ID NO: 1526483 - RNA, 14 nt, Human
gugagacucugucu

SEQ ID NO: 1526484 - RNA, 16 nt, Human
gugagacucugucuca

SEQ ID NO: 1526485 - RNA, 19 nt, Human
gugacaugucuuuucuugc

SEQ ID NO: 1526486 - RNA, 20 nt, Human
gugacagagugagacucugu

SEQ ID NO: 1526487 - RNA, 22 nt, Human
gugacagagugagacucugucu

SEQ ID NO: 1526488 - RNA, 12 nt, Human
aacuccuggccu

SEQ ID NO: 1526489 - RNA, 14 nt, Human
gugaaguuuacauu

SEQ ID NO: 1526490 - RNA, 23 nt, Human
gugaauaauacaguaucucaggg

SEQ ID NO: 1526491 - RNA, 18 nt, Human
gugaggcucugcccuugg

SEQ ID NO: 1526492 - RNA, 23 nt, Human
gugaguacuacaguccucccauc

SEQ ID NO: 1526493 - RNA, 17 nt, Human
gugagucaccaagccca

SEQ ID NO: 1526494 - RNA, 19 nt, Human
gugagucaccaagcccagu

SEQ ID NO: 1526495 - RNA, 19 nt, Human
aacucuccucugcugcugg

SEQ ID NO: 1526496 - RNA, 21 nt, Human
aacucuccucugcugcuggcu

SEQ ID NO: 1526497 - RNA, 18 nt, Human
gugagacucugucucaaa

SEQ ID NO: 1526498 - RNA, 12 nt, Human
gugaggcucugc

SEQ ID NO: 1526499 - RNA, 13 nt, Human
gugaggcucugcc

SEQ ID NO: 1526500 - RNA, 14 nt, Human
gugaggcucugccc

SEQ ID NO: 1526501 - RNA, 15 nt, Human
gugaggcucugcccu

SEQ ID NO: 1526502 - RNA, 16 nt, Human
gugaggcucugcccuu

SEQ ID NO: 1526503 - RNA, 17 nt, Human
gugaggcucugcccuug

SEQ ID NO: 1526504 - RNA, 22 nt, Human
aacucuccucugcugcuggcug

SEQ ID NO: 1526505 - RNA, 23 nt, Human
aacucuccucugcugcuggcugg

SEQ ID NO: 1526506 - RNA, 21 nt, Human
aacugauuuuuuuuuccuuca

SEQ ID NO: 1526507 - RNA, 22 nt, Human
aacugauuuuuuuuuccuucag

SEQ ID NO: 1526508 - RNA, 23 nt, Human
aacugauuuuuuuuuccuucagu

SEQ ID NO: 1526509 - RNA, 16 nt, Human
aacugcauuggcuuug

SEQ ID NO: 1526510 - RNA, 22 nt, Human
guccccuguuuguuucugaaag

SEQ ID NO: 1526511 - RNA, 14 nt, Human
guccccugacaggg

SEQ ID NO: 1526512 - RNA, 18 nt, Human
guccccuguuuguuucug

SEQ ID NO: 1526513 - RNA, 18 nt, Human
gucccugguggcagcuca

SEQ ID NO: 1526514 - RNA, 19 nt, Human
gucccugguggcagcucac

SEQ ID NO: 1526515 - RNA, 18 nt, Human
gucccuuacgugaguccu

SEQ ID NO: 1526516 - RNA, 19 nt, Human
gucccuuacgugaguccug

SEQ ID NO: 1526517 - RNA, 22 nt, Human
guccaugaagauguagaggaga

SEQ ID NO: 1526518 - RNA, 23 nt, Human
guccaugaagauguagaggagaa

SEQ ID NO: 1526519 - RNA, 19 nt, Human
gucauuugagcagggcuca

SEQ ID NO: 1526520 - RNA, 15 nt, Human
gucccaccccacaca

SEQ ID NO: 1526521 - RNA, 22 nt, Human
guccccaccgcagacaggacca

SEQ ID NO: 1526522 - RNA, 20 nt, Human
gucccaccccacacacgcca

SEQ ID NO: 1526523 - RNA, 18 nt, Human
guccccaccgcagacagg

SEQ ID NO: 1526524 - RNA, 17 nt, Human
aacacucauugaccuga

SEQ ID NO: 1526525 - RNA, 21 nt, Human
aacacucacauuuauucugcu

SEQ ID NO: 1526526 - RNA, 17 nt, Human
gucauuugagcagggcu

SEQ ID NO: 1526527 - RNA, 19 nt, Human
aacacuguucucugcccuc

SEQ ID NO: 1526528 - RNA, 17 nt, Human
aacacuguucucugccc

SEQ ID NO: 1526529 - RNA, 18 nt, Human
aacacuguucucugcccu

SEQ ID NO: 1526530 - RNA, 20 nt, Human
aacacagcaagggugauggg

SEQ ID NO: 1526531 - RNA, 19 nt, Human
aacacaaacgggcucagca

SEQ ID NO: 1526532 - RNA, 19 nt, Human
aaauuucuaaaucuccaaa

SEQ ID NO: 1526533 - RNA, 20 nt, Human
gucuauuuacggaacucaaa

SEQ ID NO: 1526534 - RNA, 22 nt, Human
gucuaugggacucaaugcacug

SEQ ID NO: 1526535 - RNA, 16 nt, Human
gucgcugugccacagg

SEQ ID NO: 1526536 - RNA, 14 nt, Human
gucuaccugagggg

SEQ ID NO: 1526537 - RNA, 17 nt, Human
gucgcugugccacaggc

SEQ ID NO: 1526538 - RNA, 15 nt, Human
gucuaccugaggggc

SEQ ID NO: 1526539 - RNA, 16 nt, Human
gucuaccugaggggcc

SEQ ID NO: 1526540 - RNA, 16 nt, Human
gucgaggacagggagg

SEQ ID NO: 1526541 - RNA, 12 nt, Human
gucgaggcagga

SEQ ID NO: 1526542 - RNA, 14 nt, Human
guccucuuuucuga

SEQ ID NO: 1526543 - RNA, 19 nt, Human
guccugcugcaguugccag

SEQ ID NO: 1526544 - RNA, 16 nt, Human
guccuggcaugggaau

SEQ ID NO: 1526545 - RNA, 17 nt, Human
aacauguauaauauuuu

SEQ ID NO: 1526546 - RNA, 14 nt, Human
aacauaaaauacaa

SEQ ID NO: 1526547 - RNA, 14 nt, Human
aacagucucaggaa

SEQ ID NO: 1526548 - RNA, 12 nt, Human
aacauauauaac

SEQ ID NO: 1526549 - RNA, 18 nt, Human
aacaguccauugaaaggg

SEQ ID NO: 1526550 - RNA, 13 nt, Human
aacagucucagga

SEQ ID NO: 1526551 - RNA, 18 nt, Human
gucacauuccugaacagg

SEQ ID NO: 1526552 - RNA, 22 nt, Human
gucaccaaaucagcugcuacua

SEQ ID NO: 1526553 - RNA, 20 nt, Human
gucacaggaaguagaggagg

SEQ ID NO: 1526554 - RNA, 12 nt, Human
gucacaggcagg

SEQ ID NO: 1526555 - RNA, 22 nt, Human
gucaauuacaggaaguacugga

SEQ ID NO: 1526556 - RNA, 21 nt, Human
gucaauuuuguuauguauauu

SEQ ID NO: 1526557 - RNA, 13 nt, Human
gucacaggaagua

SEQ ID NO: 1526558 - RNA, 15 nt, Human
gucacaggaaguaga

SEQ ID NO: 1526559 - RNA, 10 nt, Human
gucacugcuu

SEQ ID NO: 1526560 - RNA, 17 nt, Human
gucacugagacagcccg

SEQ ID NO: 1526561 - RNA, 18 nt, Human
gucacugagacagcccgg

SEQ ID NO: 1526562 - RNA, 21 nt, Human
gucacugagacagcccgggcu

SEQ ID NO: 1526563 - RNA, 23 nt, Human
gucacugagacagcccgggcucu

SEQ ID NO: 1526564 - RNA, 14 nt, Human
gucacugagacagc

SEQ ID NO: 1526565 - RNA, 15 nt, Human
gucacugagacagcc

SEQ ID NO: 1526566 - RNA, 16 nt, Human
gucacugagacagccc

SEQ ID NO: 1526567 - RNA, 12 nt, Human
gucaccaagccc

SEQ ID NO: 1526568 - RNA, 15 nt, Human
gucaccaagcccagu

SEQ ID NO: 1526569 - RNA, 23 nt, Human
gucacucuggcagcucagagagg

SEQ ID NO: 1526570 - RNA, 14 nt, Human
gucaggaaagagaa

SEQ ID NO: 1526571 - RNA, 23 nt, Human
gucagaaguuucugccgcagccc

SEQ ID NO: 1526572 - RNA, 21 nt, Human
gucagaaguuucugccgcagc

SEQ ID NO: 1526573 - RNA, 21 nt, Human
gucacugcuuaacuucacaua

SEQ ID NO: 1526574 - RNA, 15 nt, Human
gucacugcuuaacuu

SEQ ID NO: 1526575 - RNA, 15 nt, Human
aaauuucuaaaucuc

SEQ ID NO: 1526576 - RNA, 13 nt, Human
aaauuucuaaauc

SEQ ID NO: 1526577 - RNA, 15 nt, Human
gucagugugacugau

SEQ ID NO: 1526578 - RNA, 16 nt, Human
gucagguggggcagcu

SEQ ID NO: 1526579 - RNA, 17 nt, Human
gucagguggggcagcuu

SEQ ID NO: 1526580 - RNA, 18 nt, Human
gucagguggggcagcuug

SEQ ID NO: 1526581 - RNA, 22 nt, Human
gucagguggggcagcuugaggg

SEQ ID NO: 1526582 - RNA, 18 nt, Human
aaaugugccuucauuuuu

SEQ ID NO: 1526583 - RNA, 15 nt, Human
aaaugugcuuuuaaa

SEQ ID NO: 1526584 - RNA, 17 nt, Human
aaauuguauuacaaauc

SEQ ID NO: 1526585 - RNA, 17 nt, Human
aaauuccaagugauuga

SEQ ID NO: 1526586 - RNA, 16 nt, Human
aaauuccccacccuga

SEQ ID NO: 1526587 - RNA, 11 nt, Human
aaaucauuucu

SEQ ID NO: 1526588 - RNA, 21 nt, Human
guauucucuccuguaccucuu

SEQ ID NO: 1526589 - RNA, 18 nt, Human
guauucucuccuguaccu

SEQ ID NO: 1526590 - RNA, 24 nt, Human
guauucuaaauuuuauaucuugua

SEQ ID NO: 1526591 - RNA, 19 nt, Human
guauucuagcuaauguaau

SEQ ID NO: 1526592 - RNA, 18 nt, Human
aaauguaugauuacauca

SEQ ID NO: 1526593 - RNA, 21 nt, Human
aaaugucucuuuaaugucaca

SEQ ID NO: 1526594 - RNA, 19 nt, Human
cuucugaacuuggcgcugc

SEQ ID NO: 1526595 - RNA, 22 nt, Human
cuucugaacuuggcgcugcccc

SEQ ID NO: 1526596 - RNA, 12 nt, Human
cuuccucccucc

SEQ ID NO: 1526597 - RNA, 13 nt, Human
cuuccucccuccc

SEQ ID NO: 1526598 - RNA, 14 nt, Human
cuuccucccucccu

SEQ ID NO: 1526599 - RNA, 18 nt, Human
cuuccucccucccucuuu

SEQ ID NO: 1526600 - RNA, 21 nt, Human
cuuccucuuuccaucuacccu

SEQ ID NO: 1526601 - RNA, 23 nt, Human
cuucugaacuuggcgcugccccu

SEQ ID NO: 1526602 - RNA, 18 nt, Human
cuucugacccaugcugcc

SEQ ID NO: 1526603 - RNA, 16 nt, Human
cuucugacccaugcug

SEQ ID NO: 1526604 - RNA, 17 nt, Human
cuucugacccaugcugc

SEQ ID NO: 1526605 - RNA, 13 nt, Human
cuucuuauacauu

SEQ ID NO: 1526606 - RNA, 16 nt, Human
cuucuuauacauuuga

SEQ ID NO: 1526607 - RNA, 21 nt, Human
cuuggcgcugccccuggcagc

SEQ ID NO: 1526608 - RNA, 22 nt, Human
cuuggcgcugccccuggcagcc

SEQ ID NO: 1526609 - RNA, 23 nt, Human
cuuggcgcugccccuggcagccc

SEQ ID NO: 1526610 - RNA, 17 nt, Human
cuugccucuguccccuu

SEQ ID NO: 1526611 - RNA, 22 nt, Human
cuuggauuguccccgacccuug

SEQ ID NO: 1526612 - RNA, 18 nt, Human
cuuggauuguccccgacc

SEQ ID NO: 1526613 - RNA, 20 nt, Human
cuuggauuguccccgacccu

SEQ ID NO: 1526614 - RNA, 15 nt, Human
cuuggauuguccccg

SEQ ID NO: 1526615 - RNA, 19 nt, Human
cuugauucauaaugacuua

SEQ ID NO: 1526616 - RNA, 19 nt, Human
cuugccgucuaccugaggg

SEQ ID NO: 1526617 - RNA, 18 nt, Human
cuugccgucuaccugagg

SEQ ID NO: 1526618 - RNA, 15 nt, Human
cuugauguguuaucu

SEQ ID NO: 1526619 - RNA, 17 nt, Human
cuuucaauaggaaaaac

SEQ ID NO: 1526620 - RNA, 18 nt, Human
cuuucaauaggaaaaacu

SEQ ID NO: 1526621 - RNA, 21 nt, Human
cuugucuuuggacccugaggc

SEQ ID NO: 1526622 - RNA, 22 nt, Human
cuugucuuuggacccugaggcc

SEQ ID NO: 1526623 - RNA, 23 nt, Human
cuuuaaugucacaggcaggucca

SEQ ID NO: 1526624 - RNA, 22 nt, Human
cuuuaaugucacaggcaggucc

SEQ ID NO: 1526625 - RNA, 14 nt, Human
cuuucaauaggaaa

SEQ ID NO: 1526626 - RNA, 15 nt, Human
cuuucaauaggaaaa

SEQ ID NO: 1526627 - RNA, 17 nt, Human
cuuuaaugucacaggca

SEQ ID NO: 1526628 - RNA, 18 nt, Human
cuuuaaugucacaggcag

SEQ ID NO: 1526629 - RNA, 19 nt, Human
cuuuaaugucacaggcagg

SEQ ID NO: 1526630 - RNA, 20 nt, Human
cuuuaaugucacaggcaggu

SEQ ID NO: 1526631 - RNA, 20 nt, Human
cuugucucccagcucagggc

SEQ ID NO: 1526632 - RNA, 20 nt, Human
cuugucuuuggacccugagg

SEQ ID NO: 1526633 - RNA, 13 nt, Human
cuugucuguagau

SEQ ID NO: 1526634 - RNA, 23 nt, Human
cuuggucucagugucaaugcagc

SEQ ID NO: 1526635 - RNA, 22 nt, Human
cuugguccugcugcaguugcca

SEQ ID NO: 1526636 - RNA, 20 nt, Human
cuugguucccauuugcuccu

SEQ ID NO: 1526637 - RNA, 16 nt, Human
cuugguucccauuugc

SEQ ID NO: 1526638 - RNA, 16 nt, Human
cuugguccugcugcag

SEQ ID NO: 1526639 - RNA, 17 nt, Human
cuugguccugcugcagu

SEQ ID NO: 1526640 - RNA, 18 nt, Human
cuugguccugcugcaguu

SEQ ID NO: 1526641 - RNA, 20 nt, Human
cuugguccugcugcaguugc

SEQ ID NO: 1526642 - RNA, 19 nt, Human
gaaaaaauauuuuccugcc

SEQ ID NO: 1526643 - RNA, 21 nt, Human
cuuuuuuuuuuuuuuugacaa

SEQ ID NO: 1526644 - RNA, 18 nt, Human
cuuuugugcauuaucuag

SEQ ID NO: 1526645 - RNA, 14 nt, Human
cuuuugugcauuau

SEQ ID NO: 1526646 - RNA, 18 nt, Human
cuuuugccguuauuaaaa

SEQ ID NO: 1526647 - RNA, 15 nt, Human
cuuuuggucugugug

SEQ ID NO: 1526648 - RNA, 16 nt, Human
cuuuuggucuguguga

SEQ ID NO: 1526649 - RNA, 17 nt, Human
cuuuugucuaugggacu

SEQ ID NO: 1526650 - RNA, 15 nt, Human
gaaaauuaacacugc

SEQ ID NO: 1526651 - RNA, 13 nt, Human
gaaaauuaacacu

SEQ ID NO: 1526652 - RNA, 20 nt, Human
gaaaagacuccaaagaaaug

SEQ ID NO: 1526653 - RNA, 21 nt, Human
gaaaagacuccaaagaaaugu

SEQ ID NO: 1526654 - RNA, 18 nt, Human
gaaaauuuugauguuuua

SEQ ID NO: 1526655 - RNA, 14 nt, Human
gaaagacagagcug

SEQ ID NO: 1526656 - RNA, 16 nt, Human
gaaagacagagcuggg

SEQ ID NO: 1526657 - RNA, 23 nt, Human
gaaacuucagcgguuuauauaag

SEQ ID NO: 1526658 - RNA, 23 nt, Human
gaaaucaaauaugcaaagcacug

SEQ ID NO: 1526659 - RNA, 17 nt, Human
gaaaucaccgaaaacgu

SEQ ID NO: 1526660 - RNA, 19 nt, Human
gaaaucaccgaaaacgugg

SEQ ID NO: 1526661 - RNA, 18 nt, Human
gaaaugaaagcagggacu

SEQ ID NO: 1526662 - RNA, 18 nt, Human
gaaauuuuuauuaaauua

SEQ ID NO: 1526663 - RNA, 23 nt, Human
gaacaaauuuacagagacagaaa

SEQ ID NO: 1526664 - RNA, 16 nt, Human
gaacaagaugguucua

SEQ ID NO: 1526665 - RNA, 17 nt, Human
gaacaaauuuacagaga

SEQ ID NO: 1526666 - RNA, 18 nt, Human
gaacaaauuuacagagac

SEQ ID NO: 1526667 - RNA, 19 nt, Human
gaaauuuuuauuaaauuau

SEQ ID NO: 1526668 - RNA, 22 nt, Human
gaaaguacuucuccacccugcu

SEQ ID NO: 1526669 - RNA, 21 nt, Human
gaaaguacuucuccacccugc

SEQ ID NO: 1526670 - RNA, 19 nt, Human
gaaaucaaagagagaaaau

SEQ ID NO: 1526671 - RNA, 16 nt, Human
gaaaucaaauaugcaa

SEQ ID NO: 1526672 - RNA, 17 nt, Human
gaaaucaaauaugcaaa

SEQ ID NO: 1526673 - RNA, 18 nt, Human
gaaagacuaucuaaaugu

SEQ ID NO: 1526674 - RNA, 17 nt, Human
gaaaggcuccaggagca

SEQ ID NO: 1526675 - RNA, 18 nt, Human
gaaaggcuccaggagcag

SEQ ID NO: 1526676 - RNA, 19 nt, Human
gaaaggcuccaggagcagc

SEQ ID NO: 1526677 - RNA, 20 nt, Human
gaaaggcuccaggagcagcc

SEQ ID NO: 1526678 - RNA, 14 nt, Human
gaacaaggcaaggc

SEQ ID NO: 1526679 - RNA, 15 nt, Human
gaacaaggcaaggcu

SEQ ID NO: 1526680 - RNA, 17 nt, Human
gaacaaggcaaggcugu

SEQ ID NO: 1526681 - RNA, 18 nt, Human
gaacaaggcaaggcuguc

SEQ ID NO: 1526682 - RNA, 21 nt, Human
gaacaaggcaaggcugucaau

SEQ ID NO: 1526683 - RNA, 21 nt, Human
cuuaaaaaugguuuaaauggu

SEQ ID NO: 1526684 - RNA, 13 nt, Human
cuuaaaaaugguu

SEQ ID NO: 1526685 - RNA, 20 nt, Human
cuuaaaaaugguuuaaaugg

SEQ ID NO: 1526686 - RNA, 19 nt, Human
cuuaaauaaugugaaacug

SEQ ID NO: 1526687 - RNA, 16 nt, Human
cuuaaauaaugugaaa

SEQ ID NO: 1526688 - RNA, 14 nt, Human
cuuaaauaauguga

SEQ ID NO: 1526689 - RNA, 12 nt, Human
cuguuggccagu

SEQ ID NO: 1526690 - RNA, 15 nt, Human
cuguuggccagugug

SEQ ID NO: 1526691 - RNA, 19 nt, Human
cuguucacagccagacugg

SEQ ID NO: 1526692 - RNA, 22 nt, Human
cuguucacagccagacuggcac

SEQ ID NO: 1526693 - RNA, 15 nt, Human
cuguucagcuccagc

SEQ ID NO: 1526694 - RNA, 16 nt, Human
cuguucagcuccagcu

SEQ ID NO: 1526695 - RNA, 18 nt, Human
cuguucagcuccagcuca

SEQ ID NO: 1526696 - RNA, 19 nt, Human
cuguucagcuccagcucac

SEQ ID NO: 1526697 - RNA, 22 nt, Human
cuguucagcuccagcucaccag

SEQ ID NO: 1526698 - RNA, 12 nt, Human
cuguucagcugg

SEQ ID NO: 1526699 - RNA, 18 nt, Human
cuguucagcugguugagg

SEQ ID NO: 1526700 - RNA, 18 nt, Human
cugugcucuggacaggca

SEQ ID NO: 1526701 - RNA, 19 nt, Human
cugugcucuggacaggcau

SEQ ID NO: 1526702 - RNA, 17 nt, Human
cuguuacugucuucagu

SEQ ID NO: 1526703 - RNA, 17 nt, Human
cugugcucuggacaggc

SEQ ID NO: 1526704 - RNA, 23 nt, Human
cugugagaugcuagaacucccuu

SEQ ID NO: 1526705 - RNA, 23 nt, Human
cugugaaguuuacauuguaaaua

SEQ ID NO: 1526706 - RNA, 20 nt, Human
cugucuacacuaagagagaa

SEQ ID NO: 1526707 - RNA, 22 nt, Human
cugucuaaugaaaccugugucu

SEQ ID NO: 1526708 - RNA, 18 nt, Human
cuguaggaagguuaaugu

SEQ ID NO: 1526709 - RNA, 14 nt, Human
cugucauuugagca

SEQ ID NO: 1526710 - RNA, 13 nt, Human
cuguccugggagu

SEQ ID NO: 1526711 - RNA, 14 nt, Human
cuguccugggagug

SEQ ID NO: 1526712 - RNA, 20 nt, Human
cuguccugggagugagcugg

SEQ ID NO: 1526713 - RNA, 16 nt, Human
cugucauuugagcagg

SEQ ID NO: 1526714 - RNA, 21 nt, Human
cuguccugggagugagcuggu

SEQ ID NO: 1526715 - RNA, 20 nt, Human
cuguaagaaaauaucacuug

SEQ ID NO: 1526716 - RNA, 15 nt, Human
cuguagagugggagc

SEQ ID NO: 1526717 - RNA, 18 nt, Human
cuggucuuauuuguaaag

SEQ ID NO: 1526718 - RNA, 17 nt, Human
cuggugcccuggaugcc

SEQ ID NO: 1526719 - RNA, 20 nt, Human
cuggugcccuggaugcccag

SEQ ID NO: 1526720 - RNA, 21 nt, Human
cuggugcccuggaugcccagg

SEQ ID NO: 1526721 - RNA, 12 nt, Human
cuggugccucac

SEQ ID NO: 1526722 - RNA, 23 nt, Human
cuggaaaaguauguuagugcaaa

SEQ ID NO: 1526723 - RNA, 14 nt, Human
cugcuuccagugag

SEQ ID NO: 1526724 - RNA, 14 nt, Human
cugcuucaaggauc

SEQ ID NO: 1526725 - RNA, 16 nt, Human
cugcuucaaggauccu

SEQ ID NO: 1526726 - RNA, 19 nt, Human
cugcuucaaggauccugag

SEQ ID NO: 1526727 - RNA, 20 nt, Human
cugcuucaaggauccugagc

SEQ ID NO: 1526728 - RNA, 23 nt, Human
cuggagugugaggguccugcagc

SEQ ID NO: 1526729 - RNA, 21 nt, Human
cuggagaaaauggacguguua

SEQ ID NO: 1526730 - RNA, 16 nt, Human
cuggaugcagccucac

SEQ ID NO: 1526731 - RNA, 17 nt, Human
cuggaugcagccucaca

SEQ ID NO: 1526732 - RNA, 18 nt, Human
cuggaugcagccucacag

SEQ ID NO: 1526733 - RNA, 22 nt, Human
cuggaugcagccucacaguccu

SEQ ID NO: 1526734 - RNA, 23 nt, Human
cuggcagccccuguucuggcaga

SEQ ID NO: 1526735 - RNA, 22 nt, Human
cuggcagaguugaagacagagc

SEQ ID NO: 1526736 - RNA, 20 nt, Human
cuggcagaguugaagacaga

SEQ ID NO: 1526737 - RNA, 21 nt, Human
cuggcagaguugaagacagag

SEQ ID NO: 1526738 - RNA, 13 nt, Human
cuggcucuuccag

SEQ ID NO: 1526739 - RNA, 14 nt, Human
cuggcucuuccagg

SEQ ID NO: 1526740 - RNA, 15 nt, Human
cuggcucuuccaggc

SEQ ID NO: 1526741 - RNA, 17 nt, Human
cugggacuacaggcacc

SEQ ID NO: 1526742 - RNA, 21 nt, Human
cugggacuacaggcacccacc

SEQ ID NO: 1526743 - RNA, 17 nt, Human
cugggacuacaggugug

SEQ ID NO: 1526744 - RNA, 16 nt, Human
cuggcagcucagagag

SEQ ID NO: 1526745 - RNA, 17 nt, Human
cuggcagcucagagagg

SEQ ID NO: 1526746 - RNA, 19 nt, Human
cuggcagcucagagagggu

SEQ ID NO: 1526747 - RNA, 18 nt, Human
cuggccgcgccaaauaau

SEQ ID NO: 1526748 - RNA, 22 nt, Human
cugcccuuaccugccaggaagc

SEQ ID NO: 1526749 - RNA, 23 nt, Human
cugcccuuaccugccaggaagcc

SEQ ID NO: 1526750 - RNA, 14 nt, Human
cugcccugugggcc

SEQ ID NO: 1526751 - RNA, 19 nt, Human
cugcccuuaccugccagga

SEQ ID NO: 1526752 - RNA, 11 nt, Human
cugcccugugg

SEQ ID NO: 1526753 - RNA, 12 nt, Human
cugcccuguggg

SEQ ID NO: 1526754 - RNA, 24 nt, Human
cugcccugugaguacuacaguccu

SEQ ID NO: 1526755 - RNA, 14 nt, Human
cugcucacauaucu

SEQ ID NO: 1526756 - RNA, 24 nt, Human
cugcugaaggcucgagcaugccug

SEQ ID NO: 1526757 - RNA, 23 nt, Human
cugcugaaggcucgagcaugccu

SEQ ID NO: 1526758 - RNA, 18 nt, Human
cugcugaaggcucgagca

SEQ ID NO: 1526759 - RNA, 14 nt, Human
cugccuguugggcc

SEQ ID NO: 1526760 - RNA, 23 nt, Human
cugccuguucagcuccagcucac

SEQ ID NO: 1526761 - RNA, 20 nt, Human
cugccucgaacuggcugcaa

SEQ ID NO: 1526762 - RNA, 14 nt, Human
cugccuccuuugug

SEQ ID NO: 1526763 - RNA, 17 nt, Human
cugccuccuuugugagg

SEQ ID NO: 1526764 - RNA, 21 nt, Human
cugccuccuuugugaggaagc

SEQ ID NO: 1526765 - RNA, 23 nt, Human
cugccuccuuugugaggaagccg

SEQ ID NO: 1526766 - RNA, 14 nt, Human
cugccucgaacugg

SEQ ID NO: 1526767 - RNA, 17 nt, Human
gcaaaagaugcuucuca

SEQ ID NO: 1526768 - RNA, 22 nt, Human
gcaaaagaugcuucucacugcc

SEQ ID NO: 1526769 - RNA, 14 nt, Human
gcaaaaaggcagga

SEQ ID NO: 1526770 - RNA, 21 nt, Human
gauuuuuuuuuccuucagugc

SEQ ID NO: 1526771 - RNA, 11 nt, Human
gauuucacucu

SEQ ID NO: 1526772 - RNA, 12 nt, Human
gauuucacucuc

SEQ ID NO: 1526773 - RNA, 17 nt, Human
gauuuuuuuuuccuuca

SEQ ID NO: 1526774 - RNA, 18 nt, Human
gauuuuuuuuuccuucag

SEQ ID NO: 1526775 - RNA, 18 nt, Human
gauuuaacagaaauguac

SEQ ID NO: 1526776 - RNA, 17 nt, Human
gauuuaacagaaaugua

SEQ ID NO: 1526777 - RNA, 16 nt, Human
gauuuaacagaaaugu

SEQ ID NO: 1526778 - RNA, 20 nt, Human
gauucuucugcuucagccuc

SEQ ID NO: 1526779 - RNA, 19 nt, Human
gauuuaacagaaauguaca

SEQ ID NO: 1526780 - RNA, 13 nt, Human
gauucuucugcuu

SEQ ID NO: 1526781 - RNA, 15 nt, Human
gauucuucugcuuca

SEQ ID NO: 1526782 - RNA, 16 nt, Human
gcaagugagagcuggg

SEQ ID NO: 1526783 - RNA, 17 nt, Human
gcaaaauugauguguuu

SEQ ID NO: 1526784 - RNA, 13 nt, Human
gcaacaggcuggg

SEQ ID NO: 1526785 - RNA, 14 nt, Human
gcaacaggcugggc

SEQ ID NO: 1526786 - RNA, 15 nt, Human
gcaacaggcugggcu

SEQ ID NO: 1526787 - RNA, 16 nt, Human
gcaacaggcugggcuu

SEQ ID NO: 1526788 - RNA, 19 nt, Human
gcaacaggcugggcuucag

SEQ ID NO: 1526789 - RNA, 13 nt, Human
gcaaccaccacca

SEQ ID NO: 1526790 - RNA, 16 nt, Human
gcaaccaccaccaacc

SEQ ID NO: 1526791 - RNA, 18 nt, Human
gcaaccaccaccaaccac

SEQ ID NO: 1526792 - RNA, 14 nt, Human
gcaacccccagccu

SEQ ID NO: 1526793 - RNA, 15 nt, Human
gcaacccccagccug

SEQ ID NO: 1526794 - RNA, 16 nt, Human
gcaacccccagccugc

SEQ ID NO: 1526795 - RNA, 17 nt, Human
gcaacccccagccugcu

SEQ ID NO: 1526796 - RNA, 20 nt, Human
gcaaccuccgccucuugggu

SEQ ID NO: 1526797 - RNA, 19 nt, Human
gaucucuugagccugggag

SEQ ID NO: 1526798 - RNA, 22 nt, Human
gaugauuggaggggggaggugg

SEQ ID NO: 1526799 - RNA, 13 nt, Human
gaugauccuaggc

SEQ ID NO: 1526800 - RNA, 14 nt, Human
gaugauccuaggca

SEQ ID NO: 1526801 - RNA, 17 nt, Human
gaugcuucuucagagac

SEQ ID NO: 1526802 - RNA, 20 nt, Human
gaugcuucuucagagacucc

SEQ ID NO: 1526803 - RNA, 21 nt, Human
gaugcuucuucagagacuccu

SEQ ID NO: 1526804 - RNA, 22 nt, Human
gauccacccaccucagccuccc

SEQ ID NO: 1526805 - RNA, 20 nt, Human
gauccacccaccucagccuc

SEQ ID NO: 1526806 - RNA, 21 nt, Human
gauccacccaccucagccucc

SEQ ID NO: 1526807 - RNA, 21 nt, Human
gauccaagcuggucccacuca

SEQ ID NO: 1526808 - RNA, 18 nt, Human
gauccacccaccucagcc

SEQ ID NO: 1526809 - RNA, 19 nt, Human
gauccacccaccucagccu

SEQ ID NO: 1526810 - RNA, 21 nt, Human
gaucaaccccuucgcuccugu

SEQ ID NO: 1526811 - RNA, 17 nt, Human
gaucaacaucuuuucuu

SEQ ID NO: 1526812 - RNA, 20 nt, Human
gaucaacaucuuuucuugcc

SEQ ID NO: 1526813 - RNA, 14 nt, Human
gaucaacaucuuuu

SEQ ID NO: 1526814 - RNA, 16 nt, Human
gaucaacaucuuuucu

SEQ ID NO: 1526815 - RNA, 12 nt, Human
gauccaagcugg

SEQ ID NO: 1526816 - RNA, 16 nt, Human
gauccaagcugguccc

SEQ ID NO: 1526817 - RNA, 17 nt, Human
gauccaagcugguccca

SEQ ID NO: 1526818 - RNA, 19 nt, Human
gauccaagcuggucccacu

SEQ ID NO: 1526819 - RNA, 16 nt, Human
gauacuugaauaacca

SEQ ID NO: 1526820 - RNA, 23 nt, Human
gaucaaaagguuaauaaaguaau

SEQ ID NO: 1526821 - RNA, 17 nt, Human
gaucaaaggcacacagc

SEQ ID NO: 1526822 - RNA, 15 nt, Human
gauauuuugcuuugu

SEQ ID NO: 1526823 - RNA, 20 nt, Human
gaucaaaagguuaauaaagu

SEQ ID NO: 1526824 - RNA, 12 nt, Human
gauacugaaaua

SEQ ID NO: 1526825 - RNA, 21 nt, Human
gauacuguaucaugacaaaga

SEQ ID NO: 1526826 - RNA, 17 nt, Human
gauacuguaucaugaca

SEQ ID NO: 1526827 - RNA, 23 nt, Human
gauacaguuacucagaauucucu

SEQ ID NO: 1526828 - RNA, 19 nt, Human
gauacaguuacucagaauu

SEQ ID NO: 1526829 - RNA, 16 nt, Human
gauacaguuacucaga

SEQ ID NO: 1526830 - RNA, 20 nt, Human
gcaucuagcaugucgucaaa

SEQ ID NO: 1526831 - RNA, 14 nt, Human
gcauccuggcaccc

SEQ ID NO: 1526832 - RNA, 13 nt, Human
gcauccuggcacc

SEQ ID NO: 1526833 - RNA, 21 nt, Human
gcauggcugccaaugggagcu

SEQ ID NO: 1526834 - RNA, 13 nt, Human
gcaugggaaugaa

SEQ ID NO: 1526835 - RNA, 19 nt, Human
gcaugugaugagaggaaau

SEQ ID NO: 1526836 - RNA, 21 nt, Human
gcaugugaugagaggaaauca

SEQ ID NO: 1526837 - RNA, 13 nt, Human
gcauugugggaag

SEQ ID NO: 1526838 - RNA, 15 nt, Human
gcauugugggaaggg

SEQ ID NO: 1526839 - RNA, 17 nt, Human
gcauuuaaaagauacag

SEQ ID NO: 1526840 - RNA, 16 nt, Human
gcauuuaaaagauaca

SEQ ID NO: 1526841 - RNA, 16 nt, Human
gcauugugggaagggg

SEQ ID NO: 1526842 - RNA, 18 nt, Human
gcauugugggaaggggag

SEQ ID NO: 1526843 - RNA, 22 nt, Human
gcauuuaaaagauacaguuacu

SEQ ID NO: 1526844 - RNA, 18 nt, Human
gcauuuaaaagauacagu

SEQ ID NO: 1526845 - RNA, 15 nt, Human
gcauuuacuuugugu

SEQ ID NO: 1526846 - RNA, 18 nt, Human
gcauccaguaucuugaag

SEQ ID NO: 1526847 - RNA, 14 nt, Human
gcauccaguaucuu

SEQ ID NO: 1526848 - RNA, 17 nt, Human
gcauccaguaucuugaa

SEQ ID NO: 1526849 - RNA, 22 nt, Human
gcaguuguugcccacagcugua

SEQ ID NO: 1526850 - RNA, 13 nt, Human
gcagugaugucac

SEQ ID NO: 1526851 - RNA, 17 nt, Human
gcauacguacacauuuu

SEQ ID NO: 1526852 - RNA, 16 nt, Human
gcauacguacacauuu

SEQ ID NO: 1526853 - RNA, 15 nt, Human
gcauacguacacauu

SEQ ID NO: 1526854 - RNA, 18 nt, Human
gcauacguacacauuuua

SEQ ID NO: 1526855 - RNA, 18 nt, Human
gcagaacagugauuacca

SEQ ID NO: 1526856 - RNA, 22 nt, Human
gcagaacagugauuaccaggga

SEQ ID NO: 1526857 - RNA, 21 nt, Human
gcagaggaaagcaaaggagau

SEQ ID NO: 1526858 - RNA, 13 nt, Human
gcagaggaaagca

SEQ ID NO: 1526859 - RNA, 14 nt, Human
gcagaggaaagcaa

SEQ ID NO: 1526860 - RNA, 18 nt, Human
gcagaggaaagcaaagga

SEQ ID NO: 1526861 - RNA, 20 nt, Human
gcagaggaaagcaaaggaga

SEQ ID NO: 1526862 - RNA, 14 nt, Human
gcagagggcacaga

SEQ ID NO: 1526863 - RNA, 17 nt, Human
gcagcauauucaggaag

SEQ ID NO: 1526864 - RNA, 18 nt, Human
gcagcauauucaggaagc

SEQ ID NO: 1526865 - RNA, 19 nt, Human
gcagcauauucaggaagcu

SEQ ID NO: 1526866 - RNA, 23 nt, Human
gcagcauauucaggaagcucagg

SEQ ID NO: 1526867 - RNA, 22 nt, Human
gcacuuuguucuggcucuucca

SEQ ID NO: 1526868 - RNA, 12 nt, Human
gcagaacaguga

SEQ ID NO: 1526869 - RNA, 13 nt, Human
gcagaacagugau

SEQ ID NO: 1526870 - RNA, 14 nt, Human
gcacuccagccugg

SEQ ID NO: 1526871 - RNA, 15 nt, Human
gcacuccagccuggg

SEQ ID NO: 1526872 - RNA, 13 nt, Human
gcacuccccugcu

SEQ ID NO: 1526873 - RNA, 14 nt, Human
gcacuccccugcug

SEQ ID NO: 1526874 - RNA, 15 nt, Human
gcacuccccugcugg

SEQ ID NO: 1526875 - RNA, 16 nt, Human
gcacuccccugcuggg

SEQ ID NO: 1526876 - RNA, 18 nt, Human
gcacuuuguucuggcucu

SEQ ID NO: 1526877 - RNA, 19 nt, Human
gcacuuuguucuggcucuu

SEQ ID NO: 1526878 - RNA, 20 nt, Human
gcacucagaagacacugaug

SEQ ID NO: 1526879 - RNA, 18 nt, Human
gcaagugagagcugggug

SEQ ID NO: 1526880 - RNA, 19 nt, Human
gcaagugagagcugggugu

SEQ ID NO: 1526881 - RNA, 18 nt, Human
gcagcccaccccucaaca

SEQ ID NO: 1526882 - RNA, 15 nt, Human
gcagccacauuccug

SEQ ID NO: 1526883 - RNA, 18 nt, Human
gagacgggggcagagagg

SEQ ID NO: 1526884 - RNA, 16 nt, Human
gagacggagucccacc

SEQ ID NO: 1526885 - RNA, 19 nt, Human
gagacggagucccaccuug

SEQ ID NO: 1526886 - RNA, 14 nt, Human
gagacggaguccca

SEQ ID NO: 1526887 - RNA, 15 nt, Human
gagaaugaaagggcc

SEQ ID NO: 1526888 - RNA, 23 nt, Human
gagaaugaaagggcccagagagg

SEQ ID NO: 1526889 - RNA, 22 nt, Human
gacuuuuuauggcacuaguauu

SEQ ID NO: 1526890 - RNA, 19 nt, Human
gacuuuuccaacccucauc

SEQ ID NO: 1526891 - RNA, 14 nt, Human
gacuuuuccaaccc

SEQ ID NO: 1526892 - RNA, 20 nt, Human
gacuuuuccaacccucauca

SEQ ID NO: 1526893 - RNA, 19 nt, Human
gacuuuuuuuuuuuauaau

SEQ ID NO: 1526894 - RNA, 13 nt, Human
gagacuccugcag

SEQ ID NO: 1526895 - RNA, 14 nt, Human
gagacuccugcagg

SEQ ID NO: 1526896 - RNA, 15 nt, Human
gagagccuuccaggg

SEQ ID NO: 1526897 - RNA, 16 nt, Human
gagagccuuccagggg

SEQ ID NO: 1526898 - RNA, 13 nt, Human
gagagcugggugu

SEQ ID NO: 1526899 - RNA, 15 nt, Human
gagagcuagcagcag

SEQ ID NO: 1526900 - RNA, 21 nt, Human
gagagcuagcagcagggaggg

SEQ ID NO: 1526901 - RNA, 18 nt, Human
gagagccuuccaggggug

SEQ ID NO: 1526902 - RNA, 20 nt, Human
gagagccuuccagggguggg

SEQ ID NO: 1526903 - RNA, 15 nt, Human
gagaggacccccuga

SEQ ID NO: 1526904 - RNA, 12 nt, Human
gagaggaaauca

SEQ ID NO: 1526905 - RNA, 20 nt, Human
gagagcugggugucaagagg

SEQ ID NO: 1526906 - RNA, 20 nt, Human
gagaugcuagaacucccuuu

SEQ ID NO: 1526907 - RNA, 16 nt, Human
gagaugcuagaacucc

SEQ ID NO: 1526908 - RNA, 21 nt, Human
gagauugugccccugcacucc

SEQ ID NO: 1526909 - RNA, 14 nt, Human
gagauuggaaggaa

SEQ ID NO: 1526910 - RNA, 21 nt, Human
gaggacgcucucuggccuucg

SEQ ID NO: 1526911 - RNA, 16 nt, Human
gaggacuuuucuuugu

SEQ ID NO: 1526912 - RNA, 20 nt, Human
gaggacuuuucuuuguggcu

SEQ ID NO: 1526913 - RNA, 23 nt, Human
gaggacuuuucuuuguggcuucc

SEQ ID NO: 1526914 - RNA, 12 nt, Human
gaggagaaacug

SEQ ID NO: 1526915 - RNA, 14 nt, Human
gaggagaaacugga

SEQ ID NO: 1526916 - RNA, 12 nt, Human
gaggagagagga

SEQ ID NO: 1526917 - RNA, 14 nt, Human
gaggagagaggacc

SEQ ID NO: 1526918 - RNA, 15 nt, Human
gaggagagaggaccc

SEQ ID NO: 1526919 - RNA, 22 nt, Human
gaggcagggucucacucugucg

SEQ ID NO: 1526920 - RNA, 19 nt, Human
gaggcagggucucacucug

SEQ ID NO: 1526921 - RNA, 20 nt, Human
gaggcagggucucacucugu

SEQ ID NO: 1526922 - RNA, 18 nt, Human
gaggcugagaugggagaa

SEQ ID NO: 1526923 - RNA, 17 nt, Human
gaggcuccacuuggucu

SEQ ID NO: 1526924 - RNA, 18 nt, Human
gaggcuccacuuggucug

SEQ ID NO: 1526925 - RNA, 19 nt, Human
gaggcauuuguuugaacug

SEQ ID NO: 1526926 - RNA, 22 nt, Human
gaggcaugugaugagaggaaau

SEQ ID NO: 1526927 - RNA, 20 nt, Human
gaggcaugugaugagaggaa

SEQ ID NO: 1526928 - RNA, 21 nt, Human
gaggcaugugaugagaggaaa

SEQ ID NO: 1526929 - RNA, 21 nt, Human
gaggcauuuguuugaacugau

SEQ ID NO: 1526930 - RNA, 15 nt, Human
gaggcuccacuuggu

SEQ ID NO: 1526931 - RNA, 17 nt, Human
gaggccaaggugggagg

SEQ ID NO: 1526932 - RNA, 14 nt, Human
gagggccugcaagg

SEQ ID NO: 1526933 - RNA, 17 nt, Human
gagggccugcaagggag

SEQ ID NO: 1526934 - RNA, 21 nt, Human
gagggccugcaagggagugag

SEQ ID NO: 1526935 - RNA, 14 nt, Human
gagccccgaggccu

SEQ ID NO: 1526936 - RNA, 17 nt, Human
gagccccgaggccuucu

SEQ ID NO: 1526937 - RNA, 14 nt, Human
gagcagucaggaaa

SEQ ID NO: 1526938 - RNA, 14 nt, Human
gagcaucaggccag

SEQ ID NO: 1526939 - RNA, 17 nt, Human
gagcaucaggccaggcc

SEQ ID NO: 1526940 - RNA, 15 nt, Human
gagcaucaggccagg

SEQ ID NO: 1526941 - RNA, 16 nt, Human
gagcaucaggccaggc

SEQ ID NO: 1526942 - RNA, 21 nt, Human
gagcaugccuggauggggcug

SEQ ID NO: 1526943 - RNA, 13 nt, Human
gagcaugccugga

SEQ ID NO: 1526944 - RNA, 13 nt, Human
gagcccugguggc

SEQ ID NO: 1526945 - RNA, 14 nt, Human
gagcccugguggca

SEQ ID NO: 1526946 - RNA, 20 nt, Human
gagcuguucacagccagacu

SEQ ID NO: 1526947 - RNA, 23 nt, Human
gagcuggccgcgccaaauaaugu

SEQ ID NO: 1526948 - RNA, 22 nt, Human
gagcuguucacagccagacugg

SEQ ID NO: 1526949 - RNA, 14 nt, Human
gaaugauuaugaau

SEQ ID NO: 1526950 - RNA, 14 nt, Human
gaaugauuaauuaa

SEQ ID NO: 1526951 - RNA, 20 nt, Human
gaaugaugauccuaggcauu

SEQ ID NO: 1526952 - RNA, 14 nt, Human
gaaugaugccauga

SEQ ID NO: 1526953 - RNA, 15 nt, Human
gaaugaauggcuaag

SEQ ID NO: 1526954 - RNA, 20 nt, Human
gaaugaauggcuaagcaaaa

SEQ ID NO: 1526955 - RNA, 22 nt, Human
gaaugauuaugaauuacauuug

SEQ ID NO: 1526956 - RNA, 18 nt, Human
gaaugcacaaacagaggc

SEQ ID NO: 1526957 - RNA, 19 nt, Human
gaaugcacaaacagaggcc

SEQ ID NO: 1526958 - RNA, 16 nt, Human
gaauguuugccucugc

SEQ ID NO: 1526959 - RNA, 17 nt, Human
gaauguuugccucugcc

SEQ ID NO: 1526960 - RNA, 13 nt, Human
gaauuacauuugu

SEQ ID NO: 1526961 - RNA, 18 nt, Human
gaauuaaguuagggaaug

SEQ ID NO: 1526962 - RNA, 21 nt, Human
gaauuaaguuagggaauggca

SEQ ID NO: 1526963 - RNA, 15 nt, Human
gaauuacauuuguau

SEQ ID NO: 1526964 - RNA, 18 nt, Human
gaauuacauuuguauaaa

SEQ ID NO: 1526965 - RNA, 20 nt, Human
gaauuacauuuguauaaaau

SEQ ID NO: 1526966 - RNA, 14 nt, Human
gaauuaacacauga

SEQ ID NO: 1526967 - RNA, 15 nt, Human
gaauuaacacaugau

SEQ ID NO: 1526968 - RNA, 18 nt, Human
gaauguuugccucugccu

SEQ ID NO: 1526969 - RNA, 19 nt, Human
gaauguuugccucugccuc

SEQ ID NO: 1526970 - RNA, 14 nt, Human
gacaaaaagcuacu

SEQ ID NO: 1526971 - RNA, 14 nt, Human
gaauuaugaaacuu

SEQ ID NO: 1526972 - RNA, 12 nt, Human
gacacagcucuu

SEQ ID NO: 1526973 - RNA, 19 nt, Human
gacacagcucuucuccagg

SEQ ID NO: 1526974 - RNA, 20 nt, Human
gacacagcucuucuccaggc

SEQ ID NO: 1526975 - RNA, 21 nt, Human
gacacagcucuucuccaggcu

SEQ ID NO: 1526976 - RNA, 13 nt, Human
gacacagcucuuc

SEQ ID NO: 1526977 - RNA, 22 nt, Human
gaauaucuccgucaacucauau

SEQ ID NO: 1526978 - RNA, 11 nt, Human
gaauauugcug

SEQ ID NO: 1526979 - RNA, 12 nt, Human
gaauauugcuga

SEQ ID NO: 1526980 - RNA, 13 nt, Human
gaauauugcugau

SEQ ID NO: 1526981 - RNA, 15 nt, Human
gaauauauaaccagu

SEQ ID NO: 1526982 - RNA, 22 nt, Human
gaauauugcuuuggucauauga

SEQ ID NO: 1526983 - RNA, 24 nt, Human
gaauauugcugauggugcaaugac

SEQ ID NO: 1526984 - RNA, 22 nt, Human
gaauauugcugauggugcaaug

SEQ ID NO: 1526985 - RNA, 23 nt, Human
gaauauugcugauggugcaauga

SEQ ID NO: 1526986 - RNA, 14 nt, Human
gaaugaauggcuaa

SEQ ID NO: 1526987 - RNA, 18 nt, Human
gacagucaccucauggaa

SEQ ID NO: 1526988 - RNA, 11 nt, Human
gacagcucuua

SEQ ID NO: 1526989 - RNA, 12 nt, Human
gacagucccugc

SEQ ID NO: 1526990 - RNA, 12 nt, Human
gacagcucugca

SEQ ID NO: 1526991 - RNA, 19 nt, Human
gacagcuccuucuguccua

SEQ ID NO: 1526992 - RNA, 10 nt, Human
gacagcucuu

SEQ ID NO: 1526993 - RNA, 14 nt, Human
gacagucccugcca

SEQ ID NO: 1526994 - RNA, 15 nt, Human
gacagucccugccaa

SEQ ID NO: 1526995 - RNA, 16 nt, Human
gacagucccugccaau

SEQ ID NO: 1526996 - RNA, 20 nt, Human
gacagucccugccaauggac

SEQ ID NO: 1526997 - RNA, 14 nt, Human
gacagcccgggcuc

SEQ ID NO: 1526998 - RNA, 16 nt, Human
gacagcccgggcucug

SEQ ID NO: 1526999 - RNA, 17 nt, Human
gacagcuccuucugucc

SEQ ID NO: 1527000 - RNA, 18 nt, Human
gacagcuccuucuguccu

SEQ ID NO: 1527001 - RNA, 23 nt, Human
gacauugcggacagccacggcca

SEQ ID NO: 1527002 - RNA, 22 nt, Human
gacgcuacccgggaagggggcu

SEQ ID NO: 1527003 - RNA, 14 nt, Human
gacgcucucuggcc

SEQ ID NO: 1527004 - RNA, 23 nt, Human
gacgcuacccgggaagggggcug

SEQ ID NO: 1527005 - RNA, 15 nt, Human
gacgcucucuggccu

SEQ ID NO: 1527006 - RNA, 21 nt, Human
gacgcugugcugcccugccca

SEQ ID NO: 1527007 - RNA, 18 nt, Human
gacgcugugcugcccugc

SEQ ID NO: 1527008 - RNA, 16 nt, Human
gacgcugugcugcccu

SEQ ID NO: 1527009 - RNA, 17 nt, Human
gacgcugugcugcccug

SEQ ID NO: 1527010 - RNA, 22 nt, Human
gaccucugcagcaauaaagcag

SEQ ID NO: 1527011 - RNA, 18 nt, Human
gaccucugcagcaauaaa

SEQ ID NO: 1527012 - RNA, 16 nt, Human
gaccucugcagcaaua

SEQ ID NO: 1527013 - RNA, 15 nt, Human
gacgccaucccagcc

SEQ ID NO: 1527014 - RNA, 21 nt, Human
gacgccaucccagccccaaug

SEQ ID NO: 1527015 - RNA, 13 nt, Human
gaccucugccuga

SEQ ID NO: 1527016 - RNA, 12 nt, Human
gacgccauccca

SEQ ID NO: 1527017 - RNA, 13 nt, Human
gacgccaucccag

SEQ ID NO: 1527018 - RNA, 10 nt, Human
gacccugagg

SEQ ID NO: 1527019 - RNA, 14 nt, Human
gaccucaggccugg

SEQ ID NO: 1527020 - RNA, 19 nt, Human
gaccucaggccugggggcu

SEQ ID NO: 1527021 - RNA, 18 nt, Human
gaccucaggugagaagca

SEQ ID NO: 1527022 - RNA, 19 nt, Human
gaccucaggugagaagcag

SEQ ID NO: 1527023 - RNA, 21 nt, Human
gaccucaggugagaagcagag

SEQ ID NO: 1527024 - RNA, 19 nt, Human
gaccucaggugauccaccc

SEQ ID NO: 1527025 - RNA, 20 nt, Human
gaccucaggugauccaccca

SEQ ID NO: 1527026 - RNA, 21 nt, Human
gaccucaggugauccacccac

SEQ ID NO: 1527027 - RNA, 13 nt, Human
gcauuuagaugua

SEQ ID NO: 1527028 - RNA, 19 nt, Human
gcauuuaggccaugggaca

SEQ ID NO: 1527029 - RNA, 12 nt, Human
gcauuuagaugu

SEQ ID NO: 1527030 - RNA, 18 nt, Human
gcauuuacuuuguguuca

SEQ ID NO: 1527031 - RNA, 16 nt, Human
gcccacgcccccacug

SEQ ID NO: 1527032 - RNA, 17 nt, Human
gcccacgcccccacugg

SEQ ID NO: 1527033 - RNA, 21 nt, Human
gcccacgcccccacuggugac

SEQ ID NO: 1527034 - RNA, 23 nt, Human
gcccacgcuggagugcagugagc

SEQ ID NO: 1527035 - RNA, 19 nt, Human
gcccacgcuggagugcagu

SEQ ID NO: 1527036 - RNA, 21 nt, Human
gcccacgcuggagugcaguga

SEQ ID NO: 1527037 - RNA, 13 nt, Human
gcccacuucugcc

SEQ ID NO: 1527038 - RNA, 24 nt, Human
gcccaggaaaggcuccaggagcag

SEQ ID NO: 1527039 - RNA, 22 nt, Human
gcccaggaaaggcuccaggagc

SEQ ID NO: 1527040 - RNA, 23 nt, Human
gcccaggaaaggcuccaggagca

SEQ ID NO: 1527041 - RNA, 11 nt, Human
gcccaggcccc

SEQ ID NO: 1527042 - RNA, 12 nt, Human
gcccaggccccu

SEQ ID NO: 1527043 - RNA, 20 nt, Human
gcccaggccccugccacccu

SEQ ID NO: 1527044 - RNA, 21 nt, Human
gcccaggccccugccacccug

SEQ ID NO: 1527045 - RNA, 22 nt, Human
gcccaggccccugccacccugg

SEQ ID NO: 1527046 - RNA, 12 nt, Human
gcccaggcaggu

SEQ ID NO: 1527047 - RNA, 11 nt, Human
gcccaggcagg

SEQ ID NO: 1527048 - RNA, 12 nt, Human
gcccccaggacu

SEQ ID NO: 1527049 - RNA, 13 nt, Human
gcccccaggacug

SEQ ID NO: 1527050 - RNA, 14 nt, Human
gcccccaggacugg

SEQ ID NO: 1527051 - RNA, 15 nt, Human
gcccccaggacuggg

SEQ ID NO: 1527052 - RNA, 16 nt, Human
gcccccaggacugggc

SEQ ID NO: 1527053 - RNA, 12 nt, Human
gccccugcuggu

SEQ ID NO: 1527054 - RNA, 17 nt, Human
gcccccaggacugggcc

SEQ ID NO: 1527055 - RNA, 15 nt, Human
gccccugcugguuca

SEQ ID NO: 1527056 - RNA, 16 nt, Human
gccccugcugguucag

SEQ ID NO: 1527057 - RNA, 12 nt, Human
gccccuggcagc

SEQ ID NO: 1527058 - RNA, 15 nt, Human
gccccuggcagcccc

SEQ ID NO: 1527059 - RNA, 11 nt, Human
gccccaaaagg

SEQ ID NO: 1527060 - RNA, 21 nt, Human
gccccaaaacucuccucugcu

SEQ ID NO: 1527061 - RNA, 20 nt, Human
gccccaaaacucuccucugc

SEQ ID NO: 1527062 - RNA, 16 nt, Human
gccuacaggagugagc

SEQ ID NO: 1527063 - RNA, 14 nt, Human
gcccugcccaccug

SEQ ID NO: 1527064 - RNA, 15 nt, Human
gcccugcccaccugg

SEQ ID NO: 1527065 - RNA, 19 nt, Human
gcccuuagcagggaaacag

SEQ ID NO: 1527066 - RNA, 23 nt, Human
gcccuuaccugccaggaagccag

SEQ ID NO: 1527067 - RNA, 21 nt, Human
gcccugugggcccccaaaugg

SEQ ID NO: 1527068 - RNA, 16 nt, Human
gcccugugggccccca

SEQ ID NO: 1527069 - RNA, 17 nt, Human
gcccugugggcccccaa

SEQ ID NO: 1527070 - RNA, 22 nt, Human
gcccuuaccugccaggaagcca

SEQ ID NO: 1527071 - RNA, 21 nt, Human
gccccugcugguucaggguug

SEQ ID NO: 1527072 - RNA, 16 nt, Human
gccccuggcagccccu

SEQ ID NO: 1527073 - RNA, 17 nt, Human
gccccuggcagccccug

SEQ ID NO: 1527074 - RNA, 17 nt, Human
gccuacaggagugagca

SEQ ID NO: 1527075 - RNA, 19 nt, Human
gccuagcauacguacacau

SEQ ID NO: 1527076 - RNA, 12 nt, Human
gccuagcauacg

SEQ ID NO: 1527077 - RNA, 16 nt, Human
gccucgaacuggcugc

SEQ ID NO: 1527078 - RNA, 22 nt, Human
gccuccuuugugaggaagccgc

SEQ ID NO: 1527079 - RNA, 13 nt, Human
gccucgaacuggc

SEQ ID NO: 1527080 - RNA, 18 nt, Human
gccuccugcccuuaccug

SEQ ID NO: 1527081 - RNA, 13 nt, Human
gccuccauccuga

SEQ ID NO: 1527082 - RNA, 14 nt, Human
gccuccauccugag

SEQ ID NO: 1527083 - RNA, 15 nt, Human
gccuccauccugagg

SEQ ID NO: 1527084 - RNA, 22 nt, Human
gccucauguccacugguucuuc

SEQ ID NO: 1527085 - RNA, 13 nt, Human
gcucaggaguuug

SEQ ID NO: 1527086 - RNA, 18 nt, Human
gcucagggccuggcucag

SEQ ID NO: 1527087 - RNA, 19 nt, Human
gcucagggccuggcucagg

SEQ ID NO: 1527088 - RNA, 20 nt, Human
gcucagggccuggcucaggu

SEQ ID NO: 1527089 - RNA, 22 nt, Human
gcuaggaccccuccaugugggc

SEQ ID NO: 1527090 - RNA, 20 nt, Human
gcuaggaccccuccaugugg

SEQ ID NO: 1527091 - RNA, 18 nt, Human
gcuauucaguaauaacuc

SEQ ID NO: 1527092 - RNA, 21 nt, Human
gcuaguugggcuuccucauag

SEQ ID NO: 1527093 - RNA, 14 nt, Human
gcuaguugggcuuc

SEQ ID NO: 1527094 - RNA, 16 nt, Human
gcuaguugggcuuccu

SEQ ID NO: 1527095 - RNA, 18 nt, Human
gcuaagugauccucccac

SEQ ID NO: 1527096 - RNA, 22 nt, Human
gcuaagugauccucccaccuca

SEQ ID NO: 1527097 - RNA, 14 nt, Human
gccuugaacuuuga

SEQ ID NO: 1527098 - RNA, 15 nt, Human
gccuucucugaagga

SEQ ID NO: 1527099 - RNA, 16 nt, Human
gccuucucugaaggac

SEQ ID NO: 1527100 - RNA, 15 nt, Human
gccuguucagcucca

SEQ ID NO: 1527101 - RNA, 16 nt, Human
gccuguucagcuccag

SEQ ID NO: 1527102 - RNA, 17 nt, Human
gccuguucagcuccagc

SEQ ID NO: 1527103 - RNA, 15 nt, Human
gccucuguccccuuc

SEQ ID NO: 1527104 - RNA, 18 nt, Human
gccucuguccccuucucu

SEQ ID NO: 1527105 - RNA, 19 nt, Human
gccucuguccccuucucuc

SEQ ID NO: 1527106 - RNA, 20 nt, Human
gccucuguccccuucucuca

SEQ ID NO: 1527107 - RNA, 21 nt, Human
gccucuguccccuucucucau

SEQ ID NO: 1527108 - RNA, 22 nt, Human
gccucuguccccuucucucauc

SEQ ID NO: 1527109 - RNA, 23 nt, Human
gccugggaucccucauccucaua

SEQ ID NO: 1527110 - RNA, 11 nt, Human
gccugggcaga

SEQ ID NO: 1527111 - RNA, 19 nt, Human
gccugugccucugggacug

SEQ ID NO: 1527112 - RNA, 21 nt, Human
gcgcagcauauucaggaagcu

SEQ ID NO: 1527113 - RNA, 23 nt, Human
gcgauucuucugcuucagccucc

SEQ ID NO: 1527114 - RNA, 23 nt, Human
gccuugaacuuugaccucugcag

SEQ ID NO: 1527115 - RNA, 16 nt, Human
gccuugaccauucucc

SEQ ID NO: 1527116 - RNA, 22 nt, Human
gccuugaccauucuccaccugc

SEQ ID NO: 1527117 - RNA, 22 nt, Human
gcgauucuucugcuucagccuc

SEQ ID NO: 1527118 - RNA, 23 nt, Human
gccuugaccauucuccaccugcc

SEQ ID NO: 1527119 - RNA, 14 nt, Human
gcggcggucccagc

SEQ ID NO: 1527120 - RNA, 16 nt, Human
gcggcggucccagcuc

SEQ ID NO: 1527121 - RNA, 17 nt, Human
gcggcggucccagcucc

SEQ ID NO: 1527122 - RNA, 20 nt, Human
gcgggaggauguucugggac

SEQ ID NO: 1527123 - RNA, 15 nt, Human
gcggcuggcagccca

SEQ ID NO: 1527124 - RNA, 20 nt, Human
gcugccccuggcagccccug

SEQ ID NO: 1527125 - RNA, 18 nt, Human
gcugccccuggcagcccc

SEQ ID NO: 1527126 - RNA, 19 nt, Human
gcugccccuggcagccccu

SEQ ID NO: 1527127 - RNA, 20 nt, Human
gcugccugggaucccucauc

SEQ ID NO: 1527128 - RNA, 16 nt, Human
gcugccucucccauca

SEQ ID NO: 1527129 - RNA, 21 nt, Human
gcugccugggaucccucaucc

SEQ ID NO: 1527130 - RNA, 17 nt, Human
gcugccuguucagcucc

SEQ ID NO: 1527131 - RNA, 12 nt, Human
gcugccuguuca

SEQ ID NO: 1527132 - RNA, 13 nt, Human
gcugccuguucag

SEQ ID NO: 1527133 - RNA, 18 nt, Human
gcugcacccucaggcagg

SEQ ID NO: 1527134 - RNA, 19 nt, Human
gcugcacccucaggcaggu

SEQ ID NO: 1527135 - RNA, 13 nt, Human
gcugcaccggcug

SEQ ID NO: 1527136 - RNA, 14 nt, Human
gcugcaccggcugg

SEQ ID NO: 1527137 - RNA, 15 nt, Human
gcugaggugggagga

SEQ ID NO: 1527138 - RNA, 23 nt, Human
gcugagggugagugggugaauaa

SEQ ID NO: 1527139 - RNA, 14 nt, Human
gcugaggugggagg

SEQ ID NO: 1527140 - RNA, 15 nt, Human
gcugaggcaauucua

SEQ ID NO: 1527141 - RNA, 14 nt, Human
gcugaggcaauucu

SEQ ID NO: 1527142 - RNA, 20 nt, Human
gcuguauuuuaaaagaauga

SEQ ID NO: 1527143 - RNA, 18 nt, Human
gcuguauuuuaaaagaau

SEQ ID NO: 1527144 - RNA, 21 nt, Human
gcuguauuuuaaaagaaugau

SEQ ID NO: 1527145 - RNA, 17 nt, Human
gcuguaucccaugagcc

SEQ ID NO: 1527146 - RNA, 19 nt, Human
gcuguaucccaugagccuc

SEQ ID NO: 1527147 - RNA, 18 nt, Human
gcugugcucuggacaggc

SEQ ID NO: 1527148 - RNA, 15 nt, Human
gcugugcucuggaca

SEQ ID NO: 1527149 - RNA, 16 nt, Human
gcugugcucuggacag

SEQ ID NO: 1527150 - RNA, 13 nt, Human
gcugugcucugga

SEQ ID NO: 1527151 - RNA, 16 nt, Human
gcuguuggcugggggc

SEQ ID NO: 1527152 - RNA, 20 nt, Human
gcuguuggcugggggccuca

SEQ ID NO: 1527153 - RNA, 15 nt, Human
gcugugcugcccugc

SEQ ID NO: 1527154 - RNA, 16 nt, Human
gcugugcugcccugcc

SEQ ID NO: 1527155 - RNA, 17 nt, Human
gcugugcugcccugccc

SEQ ID NO: 1527156 - RNA, 15 nt, Human
gcuguuggcuggggg

SEQ ID NO: 1527157 - RNA, 20 nt, Human
gcuggcuguuggcugggggc

SEQ ID NO: 1527158 - RNA, 23 nt, Human
gcuggcuguuggcugggggccuc

SEQ ID NO: 1527159 - RNA, 17 nt, Human
gcugggguggggaccuc

SEQ ID NO: 1527160 - RNA, 19 nt, Human
gcugggguggggaccucag

SEQ ID NO: 1527161 - RNA, 22 nt, Human
gcugggguggggaccucaggcc

SEQ ID NO: 1527162 - RNA, 23 nt, Human
gcugggguggggaccucaggccu

SEQ ID NO: 1527163 - RNA, 18 nt, Human
gcuggguucuacccaggu

SEQ ID NO: 1527164 - RNA, 20 nt, Human
gcuggguucuacccaggugc

SEQ ID NO: 1527165 - RNA, 21 nt, Human
gcuggguucuacccaggugcu

SEQ ID NO: 1527166 - RNA, 13 nt, Human
gcugcugaaacaa

SEQ ID NO: 1527167 - RNA, 12 nt, Human
gcugcugaaggc

SEQ ID NO: 1527168 - RNA, 20 nt, Human
gcuggcgugcaguggugcga

SEQ ID NO: 1527169 - RNA, 15 nt, Human
gcuggcgugcagugg

SEQ ID NO: 1527170 - RNA, 18 nt, Human
gcuggcgugcaguggugc

SEQ ID NO: 1527171 - RNA, 18 nt, Human
gcuggcuguuggcugggg

SEQ ID NO: 1527172 - RNA, 19 nt, Human
gcuggcuguuggcuggggg

SEQ ID NO: 1527173 - RNA, 14 nt, Human
gcuggcgugcagug

SEQ ID NO: 1527174 - RNA, 14 nt, Human
ggacauggacaagg

SEQ ID NO: 1527175 - RNA, 13 nt, Human
ggacauggacaag

SEQ ID NO: 1527176 - RNA, 17 nt, Human
ggacagucaccucaugg

SEQ ID NO: 1527177 - RNA, 18 nt, Human
ggacagucaccucaugga

SEQ ID NO: 1527178 - RNA, 21 nt, Human
ggacagucaccucauggaauu

SEQ ID NO: 1527179 - RNA, 13 nt, Human
ggacacccuguga

SEQ ID NO: 1527180 - RNA, 23 nt, Human
ggacacccugugauggggcccug

SEQ ID NO: 1527181 - RNA, 17 nt, Human
ggacagggaggugaccc

SEQ ID NO: 1527182 - RNA, 12 nt, Human
ggacacccugug

SEQ ID NO: 1527183 - RNA, 14 nt, Human
ggacacagcucuuc

SEQ ID NO: 1527184 - RNA, 13 nt, Human
ggacacagcucuu

SEQ ID NO: 1527185 - RNA, 14 nt, Human
ggaaugauuaauua

SEQ ID NO: 1527186 - RNA, 12 nt, Human
ggacacagcucu

SEQ ID NO: 1527187 - RNA, 19 nt, Human
ggaaugaaugucaguguga

SEQ ID NO: 1527188 - RNA, 19 nt, Human
ggaauacucuuauaucuau

SEQ ID NO: 1527189 - RNA, 16 nt, Human
ggaauaccuguccccc

SEQ ID NO: 1527190 - RNA, 19 nt, Human
ggaauaccugucccccuga

SEQ ID NO: 1527191 - RNA, 16 nt, Human
ggaauauauaaccagu

SEQ ID NO: 1527192 - RNA, 16 nt, Human
ggaagcucagggccug

SEQ ID NO: 1527193 - RNA, 17 nt, Human
ggaagcucagggccugg

SEQ ID NO: 1527194 - RNA, 22 nt, Human
ggaagcucagggccuggcucag

SEQ ID NO: 1527195 - RNA, 21 nt, Human
ggaagcucagggccuggcuca

SEQ ID NO: 1527196 - RNA, 15 nt, Human
ggaauaccugucccc

SEQ ID NO: 1527197 - RNA, 19 nt, Human
ggaaaucaggguuaguauu

SEQ ID NO: 1527198 - RNA, 23 nt, Human
ggaaaucaccgaaaacguggcug

SEQ ID NO: 1527199 - RNA, 18 nt, Human
ggaagccgcuggggccag

SEQ ID NO: 1527200 - RNA, 22 nt, Human
ggaagccagcaggcucucaggc

SEQ ID NO: 1527201 - RNA, 23 nt, Human
ggaagccagcaggcucucaggcc

SEQ ID NO: 1527202 - RNA, 21 nt, Human
ggaagccagcaggcucucagg

SEQ ID NO: 1527203 - RNA, 20 nt, Human
ggaaagacuuuuccaacccu

SEQ ID NO: 1527204 - RNA, 14 nt, Human
ggaaagaggcucug

SEQ ID NO: 1527205 - RNA, 19 nt, Human
ggaaagcaaaggagauugg

SEQ ID NO: 1527206 - RNA, 16 nt, Human
ggaaagaguaggaaga

SEQ ID NO: 1527207 - RNA, 17 nt, Human
ggaaagaguaggaagac

SEQ ID NO: 1527208 - RNA, 16 nt, Human
ggaaaaaauaacaaug

SEQ ID NO: 1527209 - RNA, 19 nt, Human
gcuuuugugcauuaucuag

SEQ ID NO: 1527210 - RNA, 13 nt, Human
gcuuuugugcauu

SEQ ID NO: 1527211 - RNA, 15 nt, Human
gcuuuuuaauauuga

SEQ ID NO: 1527212 - RNA, 15 nt, Human
ggaaacccagcucug

SEQ ID NO: 1527213 - RNA, 20 nt, Human
ggaaacagcuaaugggacac

SEQ ID NO: 1527214 - RNA, 17 nt, Human
ggaaacuggaugagguc

SEQ ID NO: 1527215 - RNA, 13 nt, Human
ggaaacugccagc

SEQ ID NO: 1527216 - RNA, 20 nt, Human
gcuugaccgugaggccagag

SEQ ID NO: 1527217 - RNA, 22 nt, Human
gcuuggggaccagagcugccac

SEQ ID NO: 1527218 - RNA, 17 nt, Human
gcuuggggaccagagcu

SEQ ID NO: 1527219 - RNA, 18 nt, Human
gcuuggggaccagagcug

SEQ ID NO: 1527220 - RNA, 20 nt, Human
gcuuggggaccagagcugcc

SEQ ID NO: 1527221 - RNA, 21 nt, Human
gcuuggggaccagagcugcca

SEQ ID NO: 1527222 - RNA, 13 nt, Human
gcuuucuacccag

SEQ ID NO: 1527223 - RNA, 19 nt, Human
gcuuucuacccagcgagcc

SEQ ID NO: 1527224 - RNA, 22 nt, Human
gcuuucuacccagcgagcccug

SEQ ID NO: 1527225 - RNA, 23 nt, Human
gcuuucuacccagcgagcccugg

SEQ ID NO: 1527226 - RNA, 16 nt, Human
gcuucuucagagacuc

SEQ ID NO: 1527227 - RNA, 17 nt, Human
gcuuaacuucacauauu

SEQ ID NO: 1527228 - RNA, 16 nt, Human
gcuuaacuucacauau

SEQ ID NO: 1527229 - RNA, 19 nt, Human
gcuucuucagagacuccug

SEQ ID NO: 1527230 - RNA, 21 nt, Human
gcuucuucagagacuccugca

SEQ ID NO: 1527231 - RNA, 23 nt, Human
gcuucuucagagacuccugcagg

SEQ ID NO: 1527232 - RNA, 17 nt, Human
gcuugaccgugaggcca

SEQ ID NO: 1527233 - RNA, 18 nt, Human
gcuugaccgugaggccag

SEQ ID NO: 1527234 - RNA, 19 nt, Human
gcuugaccgugaggccaga

SEQ ID NO: 1527235 - RNA, 23 nt, Human
gcuugggcuucauccuccucaga

SEQ ID NO: 1527236 - RNA, 16 nt, Human
gcuuggggaccagagc

SEQ ID NO: 1527237 - RNA, 17 nt, Human
gguuuucacauuggaaa

SEQ ID NO: 1527238 - RNA, 19 nt, Human
gguuuuauuguuuaaaauc

SEQ ID NO: 1527239 - RNA, 20 nt, Human
gguuuguaaauuaacuuuua

SEQ ID NO: 1527240 - RNA, 22 nt, Human
gguuucuaaagcugccagccga

SEQ ID NO: 1527241 - RNA, 16 nt, Human
gguuucuaaagcugcc

SEQ ID NO: 1527242 - RNA, 17 nt, Human
aaaguauguuagugcaa

SEQ ID NO: 1527243 - RNA, 14 nt, Human
aaagugguacuuga

SEQ ID NO: 1527244 - RNA, 20 nt, Human
aaagugguacuugaucauuu

SEQ ID NO: 1527245 - RNA, 21 nt, Human
aaaguguauuuuuuuacuaau

SEQ ID NO: 1527246 - RNA, 14 nt, Human
aaaguguauuuuuu

SEQ ID NO: 1527247 - RNA, 21 nt, Human
aaaguaucccuacuguaauuu

SEQ ID NO: 1527248 - RNA, 20 nt, Human
aaaguagaagucuuagaugu

SEQ ID NO: 1527249 - RNA, 22 nt, Human
aaaguagaagucuuagauguau

SEQ ID NO: 1527250 - RNA, 18 nt, Human
aaaguacacuguuucaaa

SEQ ID NO: 1527251 - RNA, 19 nt, Human
aaaguacacuguuucaaac

SEQ ID NO: 1527252 - RNA, 17 nt, Human
gguguugacaugugcuu

SEQ ID NO: 1527253 - RNA, 11 nt, Human
gguguggggga

SEQ ID NO: 1527254 - RNA, 13 nt, Human
ggugugggggaag

SEQ ID NO: 1527255 - RNA, 13 nt, Human
ggugggggccucg

SEQ ID NO: 1527256 - RNA, 14 nt, Human
gguguggagaagcg

SEQ ID NO: 1527257 - RNA, 23 nt, Human
gguguggagaagcggcuggcagc

SEQ ID NO: 1527258 - RNA, 17 nt, Human
gguucccauuugcuccu

SEQ ID NO: 1527259 - RNA, 17 nt, Human
gguguuuuaaaaaaucu

SEQ ID NO: 1527260 - RNA, 17 nt, Human
gguguuuccuggcacug

SEQ ID NO: 1527261 - RNA, 19 nt, Human
gguguuuccuggcacugcu

SEQ ID NO: 1527262 - RNA, 23 nt, Human
gguucccuuugacgccaucccag

SEQ ID NO: 1527263 - RNA, 22 nt, Human
gguucccuuuuuuggcugcuga

SEQ ID NO: 1527264 - RNA, 20 nt, Human
gguucggauuugggguggau

SEQ ID NO: 1527265 - RNA, 20 nt, Human
gguucuagcauggcauauuu

SEQ ID NO: 1527266 - RNA, 18 nt, Human
gguggcuggguuggaggg

SEQ ID NO: 1527267 - RNA, 19 nt, Human
gguggggaccucaggccug

SEQ ID NO: 1527268 - RNA, 13 nt, Human
ggugggacacccu

SEQ ID NO: 1527269 - RNA, 16 nt, Human
ggugggacacccugug

SEQ ID NO: 1527270 - RNA, 17 nt, Human
ggugggacacccuguga

SEQ ID NO: 1527271 - RNA, 20 nt, Human
ggugggaggaucucuugagc

SEQ ID NO: 1527272 - RNA, 20 nt, Human
aaagggcuguuauaaucuuu

SEQ ID NO: 1527273 - RNA, 22 nt, Human
aaagggcuguuauaaucuuuca

SEQ ID NO: 1527274 - RNA, 13 nt, Human
aaagcuuauuaaa

SEQ ID NO: 1527275 - RNA, 20 nt, Human
aaagggcccagagagggugg

SEQ ID NO: 1527276 - RNA, 16 nt, Human
aaagcagaacagugau

SEQ ID NO: 1527277 - RNA, 14 nt, Human
gguggcaccagcag

SEQ ID NO: 1527278 - RNA, 20 nt, Human
gguggcaccagcagccugga

SEQ ID NO: 1527279 - RNA, 12 nt, Human
aaacuuuaugcu

SEQ ID NO: 1527280 - RNA, 19 nt, Human
aaacuuuaugcuaagugaa

SEQ ID NO: 1527281 - RNA, 22 nt, Human
aaagcugccagccgagauagcc

SEQ ID NO: 1527282 - RNA, 17 nt, Human
aaagcuaggccuggcca

SEQ ID NO: 1527283 - RNA, 12 nt, Human
aaagcugccagc

SEQ ID NO: 1527284 - RNA, 13 nt, Human
aaagcugccagcc

SEQ ID NO: 1527285 - RNA, 15 nt, Human
aaagcagcguuucua

SEQ ID NO: 1527286 - RNA, 13 nt, Human
aaagcagugcaug

SEQ ID NO: 1527287 - RNA, 16 nt, Human
aaagcagugcaugcug

SEQ ID NO: 1527288 - RNA, 14 nt, Human
aaagcuaggccugg

SEQ ID NO: 1527289 - RNA, 16 nt, Human
aaagcuaggccuggcc

SEQ ID NO: 1527290 - RNA, 18 nt, Human
aaauauaugcuaagucuu

SEQ ID NO: 1527291 - RNA, 14 nt, Human
aaauauauuuaaug

SEQ ID NO: 1527292 - RNA, 15 nt, Human
aaauauauuuaauga

SEQ ID NO: 1527293 - RNA, 22 nt, Human
aaauaucacuugucaauaaaau

SEQ ID NO: 1527294 - RNA, 20 nt, Human
aaauacgugggcauucaaau

SEQ ID NO: 1527295 - RNA, 21 nt, Human
aaauacgugggcauucaaaug

SEQ ID NO: 1527296 - RNA, 15 nt, Human
aaauauaggaacuua

SEQ ID NO: 1527297 - RNA, 19 nt, Human
aaauaccagccaguaaaug

SEQ ID NO: 1527298 - RNA, 16 nt, Human
guacacacacauacac

SEQ ID NO: 1527299 - RNA, 21 nt, Human
aaauaccaugccauuuaaagc

SEQ ID NO: 1527300 - RNA, 21 nt, Human
aaauaccagccaguaaauggg

SEQ ID NO: 1527301 - RNA, 20 nt, Human
aaauaccagccaguaaaugg

SEQ ID NO: 1527302 - RNA, 13 nt, Human
aaauaugcaaagc

SEQ ID NO: 1527303 - RNA, 15 nt, Human
aaauaugcaaagcac

SEQ ID NO: 1527304 - RNA, 16 nt, Human
aaauaugcaaagcacu

SEQ ID NO: 1527305 - RNA, 17 nt, Human
aaauaugcaaagcacug

SEQ ID NO: 1527306 - RNA, 12 nt, Human
aaauaucugaaa

SEQ ID NO: 1527307 - RNA, 14 nt, Human
aaauaucugaaaau

SEQ ID NO: 1527308 - RNA, 17 nt, Human
aaauaucugaaaaugua

SEQ ID NO: 1527309 - RNA, 18 nt, Human
aaauaucugaaaauguau

SEQ ID NO: 1527310 - RNA, 19 nt, Human
aaauaucugaaaauguaug

SEQ ID NO: 1527311 - RNA, 21 nt, Human
aaauaucugaaaauguaugug

SEQ ID NO: 1527312 - RNA, 22 nt, Human
aaauaucugaaaauguaugugu

SEQ ID NO: 1527313 - RNA, 23 nt, Human
aaauaucugaaaauguaugugua

SEQ ID NO: 1527314 - RNA, 16 nt, Human
aaaucagcugcuacua

SEQ ID NO: 1527315 - RNA, 20 nt, Human
aaauauuguguugugaaugu

SEQ ID NO: 1527316 - RNA, 23 nt, Human
aaaucagccugcuccagcuguuc

SEQ ID NO: 1527317 - RNA, 19 nt, Human
aaaucagccugcuccagcu

SEQ ID NO: 1527318 - RNA, 21 nt, Human
aaaucagccugcuccagcugu

SEQ ID NO: 1527319 - RNA, 19 nt, Human
aaauauuaagaaagacuau

SEQ ID NO: 1527320 - RNA, 16 nt, Human
guaacaagccacccca

SEQ ID NO: 1527321 - RNA, 19 nt, Human
guaacaggaaaauuuuaaa

SEQ ID NO: 1527322 - RNA, 20 nt, Human
guaacaggaaaauuuuaaaa

SEQ ID NO: 1527323 - RNA, 22 nt, Human
aaauaaugugaaacuggauuaa

SEQ ID NO: 1527324 - RNA, 12 nt, Human
aaaguggugaga

SEQ ID NO: 1527325 - RNA, 23 nt, Human
aaagugguacuugaucauuuuua

SEQ ID NO: 1527326 - RNA, 22 nt, Human
aaaguguauuuuuuuacuaaua

SEQ ID NO: 1527327 - RNA, 19 nt, Human
guaauagagcaaaauugau

SEQ ID NO: 1527328 - RNA, 15 nt, Human
guaauagagcaaaau

SEQ ID NO: 1527329 - RNA, 22 nt, Human
guaauuugugauacaaugcugu

SEQ ID NO: 1527330 - RNA, 23 nt, Human
guaauccuagcacuuugggaggc

SEQ ID NO: 1527331 - RNA, 13 nt, Human
guaauccuaaauu

SEQ ID NO: 1527332 - RNA, 20 nt, Human
guaauuugugauacaaugcu

SEQ ID NO: 1527333 - RNA, 17 nt, Human
guaauuugugauacaau

SEQ ID NO: 1527334 - RNA, 15 nt, Human
guaauuugugauaca

SEQ ID NO: 1527335 - RNA, 14 nt, Human
ggucagugcaaaua

SEQ ID NO: 1527336 - RNA, 16 nt, Human
ggucauagcagugcuu

SEQ ID NO: 1527337 - RNA, 18 nt, Human
ggucauauuaauauauuu

SEQ ID NO: 1527338 - RNA, 19 nt, Human
gguaucaggugcugccauc

SEQ ID NO: 1527339 - RNA, 22 nt, Human
aaacuugauguguuaucucuua

SEQ ID NO: 1527340 - RNA, 21 nt, Human
aaacuucccuuucugcuugug

SEQ ID NO: 1527341 - RNA, 14 nt, Human
gguaucaggugcug

SEQ ID NO: 1527342 - RNA, 20 nt, Human
gguaggguaagugagagagg

SEQ ID NO: 1527343 - RNA, 20 nt, Human
gguaaggaauaccugucccc

SEQ ID NO: 1527344 - RNA, 13 nt, Human
gguaacaggcaga

SEQ ID NO: 1527345 - RNA, 19 nt, Human
gggugggacacccugugau

SEQ ID NO: 1527346 - RNA, 23 nt, Human
ggguuuugccauguuggccaggc

SEQ ID NO: 1527347 - RNA, 20 nt, Human
ggguuuugccauguuggcca

SEQ ID NO: 1527348 - RNA, 21 nt, Human
aaacguggcugcuucaaggau

SEQ ID NO: 1527349 - RNA, 14 nt, Human
aaacuuaaucuaaa

SEQ ID NO: 1527350 - RNA, 19 nt, Human
aaacuucagacauagaauu

SEQ ID NO: 1527351 - RNA, 15 nt, Human
gggugggacacccug

SEQ ID NO: 1527352 - RNA, 18 nt, Human
gggugggacacccuguga

SEQ ID NO: 1527353 - RNA, 22 nt, Human
aaaccugugucucugagaguag

SEQ ID NO: 1527354 - RNA, 12 nt, Human
gggucaaggaau

SEQ ID NO: 1527355 - RNA, 22 nt, Human
gggucacucuggcagcucagag

SEQ ID NO: 1527356 - RNA, 14 nt, Human
gggucacucuggca

SEQ ID NO: 1527357 - RNA, 20 nt, Human
gggucacucuggcagcucag

SEQ ID NO: 1527358 - RNA, 19 nt, Human
aaacauuuugucauauaag

SEQ ID NO: 1527359 - RNA, 18 nt, Human
ggguccugcagccugcag

SEQ ID NO: 1527360 - RNA, 23 nt, Human
ggguccugcagccugcaggaccu

SEQ ID NO: 1527361 - RNA, 19 nt, Human
ggguccugcagccugcagg

SEQ ID NO: 1527362 - RNA, 11 nt, Human
gggggcuggga

SEQ ID NO: 1527363 - RNA, 15 nt, Human
ggggcccugccuccu

SEQ ID NO: 1527364 - RNA, 21 nt, Human
ggggucacucuggcagcucag

SEQ ID NO: 1527365 - RNA, 13 nt, Human
ggggguggccucc

SEQ ID NO: 1527366 - RNA, 15 nt, Human
gggggcugggcagag

SEQ ID NO: 1527367 - RNA, 14 nt, Human
ggggccaugccucc

SEQ ID NO: 1527368 - RNA, 17 nt, Human
ggggccaugccuccuca

SEQ ID NO: 1527369 - RNA, 19 nt, Human
ggggccaugccuccucagg

SEQ ID NO: 1527370 - RNA, 14 nt, Human
ggggaccagagcug

SEQ ID NO: 1527371 - RNA, 15 nt, Human
ggggaccagagcugc

SEQ ID NO: 1527372 - RNA, 17 nt, Human
ggggcccaugaaagagg

SEQ ID NO: 1527373 - RNA, 23 nt, Human
ggggccaugccuccucaggagcc

SEQ ID NO: 1527374 - RNA, 18 nt, Human
aaaauguauguguaagua

SEQ ID NO: 1527375 - RNA, 12 nt, Human
ggggaccagagc

SEQ ID NO: 1527376 - RNA, 13 nt, Human
ggggaccagagcu

SEQ ID NO: 1527377 - RNA, 16 nt, Human
aaaauauuuuccugcc

SEQ ID NO: 1527378 - RNA, 16 nt, Human
aaaauauauuuaauga

SEQ ID NO: 1527379 - RNA, 18 nt, Human
aaaaugcaacaacaugua

SEQ ID NO: 1527380 - RNA, 22 nt, Human
gggccacuucuggguggggcag

SEQ ID NO: 1527381 - RNA, 20 nt, Human
aaaauggaagacagcucuua

SEQ ID NO: 1527382 - RNA, 11 nt, Human
aaaauaauuuu

SEQ ID NO: 1527383 - RNA, 16 nt, Human
aaaauaauuuuuauau

SEQ ID NO: 1527384 - RNA, 17 nt, Human
aaaauaauuuuuauauu

SEQ ID NO: 1527385 - RNA, 20 nt, Human
aaaauaauuuuuauauuuga

SEQ ID NO: 1527386 - RNA, 14 nt, Human
aaaauacacacuca

SEQ ID NO: 1527387 - RNA, 14 nt, Human
aaaauaccaaggaa

SEQ ID NO: 1527388 - RNA, 13 nt, Human
aaaauaccaagga

SEQ ID NO: 1527389 - RNA, 13 nt, Human
aaaaggaugcaca

SEQ ID NO: 1527390 - RNA, 22 nt, Human
aaaaggagccaauuuaaagaaa

SEQ ID NO: 1527391 - RNA, 22 nt, Human
aaaaggaugcacagaguuguua

SEQ ID NO: 1527392 - RNA, 19 nt, Human
aaaaggaugcacagaguug

SEQ ID NO: 1527393 - RNA, 15 nt, Human
aaaaggaugcacaga

SEQ ID NO: 1527394 - RNA, 14 nt, Human
aaaaggaugcacag

SEQ ID NO: 1527395 - RNA, 16 nt, Human
aaaagguuaauaaagu

SEQ ID NO: 1527396 - RNA, 17 nt, Human
aaaagguuaauaaagua

SEQ ID NO: 1527397 - RNA, 11 nt, Human
aaaaggcagga

SEQ ID NO: 1527398 - RNA, 16 nt, Human
aaaaugguuuaaaugg

SEQ ID NO: 1527399 - RNA, 18 nt, Human
aaaaugguuuaaaugguc

SEQ ID NO: 1527400 - RNA, 17 nt, Human
gggcuggguucuaccca

SEQ ID NO: 1527401 - RNA, 20 nt, Human
gggcugcaccggcuggccug

SEQ ID NO: 1527402 - RNA, 21 nt, Human
gggcugcaccggcuggccugg

SEQ ID NO: 1527403 - RNA, 15 nt, Human
gggcugggcagagga

SEQ ID NO: 1527404 - RNA, 19 nt, Human
gggcugcaccggcuggccu

SEQ ID NO: 1527405 - RNA, 21 nt, Human
gggcucagcggggacagcucc

SEQ ID NO: 1527406 - RNA, 10 nt, Human
gggcuccaga

SEQ ID NO: 1527407 - RNA, 13 nt, Human
gggcuccagacac

SEQ ID NO: 1527408 - RNA, 15 nt, Human
gggcuaguugggcuu

SEQ ID NO: 1527409 - RNA, 18 nt, Human
gggcuaguugggcuuccu

SEQ ID NO: 1527410 - RNA, 22 nt, Human
gggcucagcaaaagaugcuucu

SEQ ID NO: 1527411 - RNA, 17 nt, Human
gggcucagcggggacag

SEQ ID NO: 1527412 - RNA, 19 nt, Human
gggcucagcggggacagcu

SEQ ID NO: 1527413 - RNA, 13 nt, Human
gggccaggagccu

SEQ ID NO: 1527414 - RNA, 14 nt, Human
gggccaggagccuc

SEQ ID NO: 1527415 - RNA, 17 nt, Human
gggccggccaguggccu

SEQ ID NO: 1527416 - RNA, 15 nt, Human
gggcgugguggugag

SEQ ID NO: 1527417 - RNA, 21 nt, Human
gggcggugagaggggaacaga

SEQ ID NO: 1527418 - RNA, 15 nt, Human
gggccucagugccac

SEQ ID NO: 1527419 - RNA, 13 nt, Human
gggccucagugcc

SEQ ID NO: 1527420 - RNA, 14 nt, Human
gggccucagugcca

SEQ ID NO: 1527421 - RNA, 19 nt, Human
gggccucuuaugggcuggg

SEQ ID NO: 1527422 - RNA, 18 nt, Human
gggccucuuaugggcugg

SEQ ID NO: 1527423 - RNA, 22 nt, Human
gggccucgguguggagaagcgg

SEQ ID NO: 1527424 - RNA, 16 nt, Human
ggcuagagguucaaag

SEQ ID NO: 1527425 - RNA, 14 nt, Human
ggcuaccuuuguau

SEQ ID NO: 1527426 - RNA, 13 nt, Human
ggcuaccuuugua

SEQ ID NO: 1527427 - RNA, 20 nt, Human
ggcuaagugauccucccacc

SEQ ID NO: 1527428 - RNA, 16 nt, Human
ggcuaauguacugcau

SEQ ID NO: 1527429 - RNA, 20 nt, Human
ggcuaagcuucacuguaaaa

SEQ ID NO: 1527430 - RNA, 14 nt, Human
ggcgugcaguggug

SEQ ID NO: 1527431 - RNA, 16 nt, Human
ggccuucggccuccau

SEQ ID NO: 1527432 - RNA, 14 nt, Human
ggccuuccccagca

SEQ ID NO: 1527433 - RNA, 13 nt, Human
ggccuuccccagc

SEQ ID NO: 1527434 - RNA, 18 nt, Human
ggccuucggccuccaucc

SEQ ID NO: 1527435 - RNA, 22 nt, Human
ggccuucggccuccauccugag

SEQ ID NO: 1527436 - RNA, 16 nt, Human
ggccugcaagggagug

SEQ ID NO: 1527437 - RNA, 16 nt, Human
ggccuggccagaugca

SEQ ID NO: 1527438 - RNA, 12 nt, Human
ggccuggccaga

SEQ ID NO: 1527439 - RNA, 15 nt, Human
ggccuggccagaugc

SEQ ID NO: 1527440 - RNA, 18 nt, Human
ggccugccuccagggcug

SEQ ID NO: 1527441 - RNA, 19 nt, Human
ggccugccuccagggcugg

SEQ ID NO: 1527442 - RNA, 20 nt, Human
ggccugccuccagggcugga

SEQ ID NO: 1527443 - RNA, 17 nt, Human
ggccagaugcaccagcc

SEQ ID NO: 1527444 - RNA, 22 nt, Human
ggccagagggagugacagaggc

SEQ ID NO: 1527445 - RNA, 15 nt, Human
ggccagaugcaccag

SEQ ID NO: 1527446 - RNA, 16 nt, Human
ggccagaugcaccagc

SEQ ID NO: 1527447 - RNA, 23 nt, Human
ggccucccaacucaccccagccc

SEQ ID NO: 1527448 - RNA, 20 nt, Human
ggccucccaacucaccccag

SEQ ID NO: 1527449 - RNA, 22 nt, Human
ggccucccaacucaccccagcc

SEQ ID NO: 1527450 - RNA, 13 nt, Human
ggccucagugcca

SEQ ID NO: 1527451 - RNA, 17 nt, Human
ggccucccaacucaccc

SEQ ID NO: 1527452 - RNA, 18 nt, Human
ggccucccaacucacccc

SEQ ID NO: 1527453 - RNA, 19 nt, Human
ggccucccaacucacccca

SEQ ID NO: 1527454 - RNA, 22 nt, Human
ggccgcgccaaauaaugucucu

SEQ ID NO: 1527455 - RNA, 11 nt, Human
aaaaaguuugu

SEQ ID NO: 1527456 - RNA, 18 nt, Human
aaaaaguuugucuuaguu

SEQ ID NO: 1527457 - RNA, 20 nt, Human
aaaaagccugcaauuucaua

SEQ ID NO: 1527458 - RNA, 14 nt, Human
aaaaaggaggaaga

SEQ ID NO: 1527459 - RNA, 21 nt, Human
aaaaaggaugcacagaguugu

SEQ ID NO: 1527460 - RNA, 12 nt, Human
aaaaaggcagga

SEQ ID NO: 1527461 - RNA, 13 nt, Human
aaaaauacaaaaa

SEQ ID NO: 1527462 - RNA, 14 nt, Human
ggcuggguuggagg

SEQ ID NO: 1527463 - RNA, 23 nt, Human
aaaaagauuuucagaaaauauua

SEQ ID NO: 1527464 - RNA, 22 nt, Human
aaaaaacugcugacuguuuucu

SEQ ID NO: 1527465 - RNA, 13 nt, Human
ggcuggccuggcc

SEQ ID NO: 1527466 - RNA, 14 nt, Human
ggcuggccuggccc

SEQ ID NO: 1527467 - RNA, 15 nt, Human
ggcuggccuggcccc

SEQ ID NO: 1527468 - RNA, 13 nt, Human
ggcucccuuccca

SEQ ID NO: 1527469 - RNA, 15 nt, Human
ggcucuuccaggcug

SEQ ID NO: 1527470 - RNA, 17 nt, Human
ggcucuuccaggcuggg

SEQ ID NO: 1527471 - RNA, 18 nt, Human
ggcucuuccaggcuggga

SEQ ID NO: 1527472 - RNA, 20 nt, Human
ggcucuuccaggcugggaga

SEQ ID NO: 1527473 - RNA, 15 nt, Human
ggcucacugcagccu

SEQ ID NO: 1527474 - RNA, 13 nt, Human
ggcucacugcagc

SEQ ID NO: 1527475 - RNA, 14 nt, Human
ggcucacugcagcc

SEQ ID NO: 1527476 - RNA, 13 nt, Human
ggauuguccccga

SEQ ID NO: 1527477 - RNA, 14 nt, Human
ggaugaaaaaauaa

SEQ ID NO: 1527478 - RNA, 17 nt, Human
ggauuuaacagaaaugu

SEQ ID NO: 1527479 - RNA, 16 nt, Human
ggauuuaacagaaaug

SEQ ID NO: 1527480 - RNA, 22 nt, Human
ggauuuaacagaaauguacagc

SEQ ID NO: 1527481 - RNA, 12 nt, Human
ggauuuaacaga

SEQ ID NO: 1527482 - RNA, 16 nt, Human
ggauuguccccgaccc

SEQ ID NO: 1527483 - RNA, 20 nt, Human
ggauuguccccgacccuugc

SEQ ID NO: 1527484 - RNA, 18 nt, Human
ggaucucuugagccuggg

SEQ ID NO: 1527485 - RNA, 23 nt, Human
ggaucuucaucugacuaugacau

SEQ ID NO: 1527486 - RNA, 16 nt, Human
ggaguucaucuugaau

SEQ ID NO: 1527487 - RNA, 15 nt, Human
ggauccugagccaga

SEQ ID NO: 1527488 - RNA, 16 nt, Human
ggauccugagccagau

SEQ ID NO: 1527489 - RNA, 18 nt, Human
ggauccugagccagauuu

SEQ ID NO: 1527490 - RNA, 19 nt, Human
ggauccugagccagauuuc

SEQ ID NO: 1527491 - RNA, 20 nt, Human
ggauccugagccagauuuca

SEQ ID NO: 1527492 - RNA, 23 nt, Human
ggauccugagccagauuucacuc

SEQ ID NO: 1527493 - RNA, 20 nt, Human
ggagugugaggguccugcag

SEQ ID NO: 1527494 - RNA, 16 nt, Human
ggaguggccacagaaa

SEQ ID NO: 1527495 - RNA, 12 nt, Human
ggagugggccca

SEQ ID NO: 1527496 - RNA, 22 nt, Human
ggagugggcccaaugcacuuug

SEQ ID NO: 1527497 - RNA, 15 nt, Human
ggaguggccacagaa

SEQ ID NO: 1527498 - RNA, 20 nt, Human
ggaggcuaaagcccagagac

SEQ ID NO: 1527499 - RNA, 13 nt, Human
ggaggggggaggu

SEQ ID NO: 1527500 - RNA, 14 nt, Human
ggaggggggaggug

SEQ ID NO: 1527501 - RNA, 22 nt, Human
ggagguaaggaauaccuguccc

SEQ ID NO: 1527502 - RNA, 21 nt, Human
ggagggugacgggggugaacu

SEQ ID NO: 1527503 - RNA, 22 nt, Human
ggaggugggauccuccaggugc

SEQ ID NO: 1527504 - RNA, 23 nt, Human
ggaggugggauccuccaggugca

SEQ ID NO: 1527505 - RNA, 14 nt, Human
ggcauuugcugaau

SEQ ID NO: 1527506 - RNA, 17 nt, Human
ggccagagacacaagcc

SEQ ID NO: 1527507 - RNA, 18 nt, Human
ggccagagacacaagccu

SEQ ID NO: 1527508 - RNA, 17 nt, Human
ggccagagggagugaca

SEQ ID NO: 1527509 - RNA, 19 nt, Human
ggccagagggagugacaga

SEQ ID NO: 1527510 - RNA, 17 nt, Human
ggcauuuguuugaacug

SEQ ID NO: 1527511 - RNA, 14 nt, Human
ggccaaaggaagca

SEQ ID NO: 1527512 - RNA, 16 nt, Human
ggccaaaggaagcaca

SEQ ID NO: 1527513 - RNA, 21 nt, Human
ggccaaaggaagcacaugccu

SEQ ID NO: 1527514 - RNA, 19 nt, Human
ggccaaaggaagcacaugc

SEQ ID NO: 1527515 - RNA, 18 nt, Human
ggcaggaggaucacuuga

SEQ ID NO: 1527516 - RNA, 14 nt, Human
ggcagccaggccac

SEQ ID NO: 1527517 - RNA, 13 nt, Human
ggcagccaggcca

SEQ ID NO: 1527518 - RNA, 22 nt, Human
ggcacugcuuccagugaggcuc

SEQ ID NO: 1527519 - RNA, 20 nt, Human
ggcacugcuuccagugaggc

SEQ ID NO: 1527520 - RNA, 23 nt, Human
ggcagccccauucugccugccca

SEQ ID NO: 1527521 - RNA, 22 nt, Human
ggcagccccauucugccugccc

SEQ ID NO: 1527522 - RNA, 16 nt, Human
ggcagccccauucugc

SEQ ID NO: 1527523 - RNA, 20 nt, Human
ggcagccccauucugccugc

SEQ ID NO: 1527524 - RNA, 21 nt, Human
ggcagccccauucugccugcc

SEQ ID NO: 1527525 - RNA, 15 nt, Human
ggcaaaaaggcagga

SEQ ID NO: 1527526 - RNA, 18 nt, Human
ggcacaucagcacgauuu

SEQ ID NO: 1527527 - RNA, 19 nt, Human
ggcacagaaaauggaagac

SEQ ID NO: 1527528 - RNA, 16 nt, Human
ggcacugcuuccagug

SEQ ID NO: 1527529 - RNA, 18 nt, Human
ggcacaccgggcacucag

SEQ ID NO: 1527530 - RNA, 18 nt, Human
caggcagauacaggaaaa

SEQ ID NO: 1527531 - RNA, 13 nt, Human
caggccagaggga

SEQ ID NO: 1527532 - RNA, 15 nt, Human
caggccagagggagu

SEQ ID NO: 1527533 - RNA, 19 nt, Human
caggccagcugcuugggcu

SEQ ID NO: 1527534 - RNA, 21 nt, Human
caggccagcugcuugggcuuc

SEQ ID NO: 1527535 - RNA, 23 nt, Human
caggccagcugcuugggcuucau

SEQ ID NO: 1527536 - RNA, 17 nt, Human
caggccaggcccucugc

SEQ ID NO: 1527537 - RNA, 18 nt, Human
caggccaggcccucugcc

SEQ ID NO: 1527538 - RNA, 19 nt, Human
caggccaggcccucugccc

SEQ ID NO: 1527539 - RNA, 16 nt, Human
caggccagagggagug

SEQ ID NO: 1527540 - RNA, 20 nt, Human
caggccaggcccucugccca

SEQ ID NO: 1527541 - RNA, 14 nt, Human
cagggcuggacuga

SEQ ID NO: 1527542 - RNA, 15 nt, Human
cagggcuggacugag

SEQ ID NO: 1527543 - RNA, 18 nt, Human
cagggcuggacugaggcc

SEQ ID NO: 1527544 - RNA, 20 nt, Human
caggggaaaaucagccugcu

SEQ ID NO: 1527545 - RNA, 19 nt, Human
caggggaaaaucagccugc

SEQ ID NO: 1527546 - RNA, 16 nt, Human
cagggcuggacugagg

SEQ ID NO: 1527547 - RNA, 17 nt, Human
cagggcuggacugaggc

SEQ ID NO: 1527548 - RNA, 19 nt, Human
cagggcuggacugaggccu

SEQ ID NO: 1527549 - RNA, 21 nt, Human
cagggcucagcggggacagcu

SEQ ID NO: 1527550 - RNA, 23 nt, Human
cagggcucagcggggacagcucc

SEQ ID NO: 1527551 - RNA, 23 nt, Human
caggcugggcuucaguggcagcu

SEQ ID NO: 1527552 - RNA, 21 nt, Human
caggcugggcuucaguggcag

SEQ ID NO: 1527553 - RNA, 22 nt, Human
caggcugggcuucaguggcagc

SEQ ID NO: 1527554 - RNA, 12 nt, Human
caggcugggaga

SEQ ID NO: 1527555 - RNA, 14 nt, Human
caggcugggagagc

SEQ ID NO: 1527556 - RNA, 15 nt, Human
caggcugggagagcc

SEQ ID NO: 1527557 - RNA, 20 nt, Human
caggcugggcuucaguggca

SEQ ID NO: 1527558 - RNA, 20 nt, Human
cagucugacuguuuccauca

SEQ ID NO: 1527559 - RNA, 13 nt, Human
cagugcaugcugu

SEQ ID NO: 1527560 - RNA, 14 nt, Human
cagugcaugcuguc

SEQ ID NO: 1527561 - RNA, 18 nt, Human
cagucuggaaugcagugg

SEQ ID NO: 1527562 - RNA, 17 nt, Human
cagucuggaaugcagug

SEQ ID NO: 1527563 - RNA, 15 nt, Human
cagucuggaaugcag

SEQ ID NO: 1527564 - RNA, 14 nt, Human
caguggggaaugaa

SEQ ID NO: 1527565 - RNA, 18 nt, Human
caguggugguuuucuguu

SEQ ID NO: 1527566 - RNA, 21 nt, Human
caguggugcgaucuggguuca

SEQ ID NO: 1527567 - RNA, 16 nt, Human
cagugcaugcuguccc

SEQ ID NO: 1527568 - RNA, 17 nt, Human
cagugcaugcugucccu

SEQ ID NO: 1527569 - RNA, 13 nt, Human
cagugcccacagg

SEQ ID NO: 1527570 - RNA, 15 nt, Human
cagugcccacaggau

SEQ ID NO: 1527571 - RNA, 17 nt, Human
cagugcccacaggauca

SEQ ID NO: 1527572 - RNA, 20 nt, Human
cagugggagcugccuguuca

SEQ ID NO: 1527573 - RNA, 23 nt, Human
cagugggagcugccuguucagcu

SEQ ID NO: 1527574 - RNA, 18 nt, Human
cagugcccacaggaucag

SEQ ID NO: 1527575 - RNA, 16 nt, Human
cagucaccucauggaa

SEQ ID NO: 1527576 - RNA, 15 nt, Human
cagucacauuccaag

SEQ ID NO: 1527577 - RNA, 19 nt, Human
cagucaccucauggaauug

SEQ ID NO: 1527578 - RNA, 14 nt, Human
cagucaccccggcc

SEQ ID NO: 1527579 - RNA, 14 nt, Human
cagguuuaagcugu

SEQ ID NO: 1527580 - RNA, 12 nt, Human
cagguuuuccug

SEQ ID NO: 1527581 - RNA, 16 nt, Human
cagguuuuccugaaga

SEQ ID NO: 1527582 - RNA, 21 nt, Human
caggugcacaagcuccaagcu

SEQ ID NO: 1527583 - RNA, 19 nt, Human
caggugccaguuauggcua

SEQ ID NO: 1527584 - RNA, 22 nt, Human
caggugcacaagcuccaagcuc

SEQ ID NO: 1527585 - RNA, 21 nt, Human
caggugauccacccaccucag

SEQ ID NO: 1527586 - RNA, 15 nt, Human
caggugcacaagcuc

SEQ ID NO: 1527587 - RNA, 22 nt, Human
caggugauccacccaccucagc

SEQ ID NO: 1527588 - RNA, 23 nt, Human
caggugauccacccaccucagcc

SEQ ID NO: 1527589 - RNA, 17 nt, Human
caggugcacaagcucca

SEQ ID NO: 1527590 - RNA, 18 nt, Human
caggugcacaagcuccaa

SEQ ID NO: 1527591 - RNA, 19 nt, Human
caggugcacaagcuccaag

SEQ ID NO: 1527592 - RNA, 20 nt, Human
caggugcacaagcuccaagc

SEQ ID NO: 1527593 - RNA, 13 nt, Human
cagauccuggaaa

SEQ ID NO: 1527594 - RNA, 12 nt, Human
cagauccuggaa

SEQ ID NO: 1527595 - RNA, 17 nt, Human
cagagguugcagugagc

SEQ ID NO: 1527596 - RNA, 22 nt, Human
cagaggggguggccucccaacu

SEQ ID NO: 1527597 - RNA, 23 nt, Human
cagaggggguggccucccaacuc

SEQ ID NO: 1527598 - RNA, 17 nt, Human
cagauucuuuccugagg

SEQ ID NO: 1527599 - RNA, 18 nt, Human
cagauucuuuccugaggc

SEQ ID NO: 1527600 - RNA, 19 nt, Human
cagauucuuuccugaggcu

SEQ ID NO: 1527601 - RNA, 17 nt, Human
cagcauagaaguaacuu

SEQ ID NO: 1527602 - RNA, 20 nt, Human
cagcacgauuucuguuuaga

SEQ ID NO: 1527603 - RNA, 19 nt, Human
cagcacgauuucuguuuag

SEQ ID NO: 1527604 - RNA, 18 nt, Human
cagcacgauuucuguuua

SEQ ID NO: 1527605 - RNA, 16 nt, Human
cagcacgauuucuguu

SEQ ID NO: 1527606 - RNA, 17 nt, Human
cagauugcaacaggcug

SEQ ID NO: 1527607 - RNA, 20 nt, Human
cagauucuuuccugaggcug

SEQ ID NO: 1527608 - RNA, 22 nt, Human
cagauucuuuccugaggcuggg

SEQ ID NO: 1527609 - RNA, 20 nt, Human
cagcaucauggagguuugaa

SEQ ID NO: 1527610 - RNA, 13 nt, Human
cagccaguaaaug

SEQ ID NO: 1527611 - RNA, 19 nt, Human
cagccgagauagccaaggc

SEQ ID NO: 1527612 - RNA, 20 nt, Human
cagccgagauagccaaggcc

SEQ ID NO: 1527613 - RNA, 19 nt, Human
cagccugcuaauuccccag

SEQ ID NO: 1527614 - RNA, 15 nt, Human
cagccugcuccagcu

SEQ ID NO: 1527615 - RNA, 12 nt, Human
cagccugcucca

SEQ ID NO: 1527616 - RNA, 18 nt, Human
cagcggggacagcuccuu

SEQ ID NO: 1527617 - RNA, 19 nt, Human
cagcggggacagcuccuuc

SEQ ID NO: 1527618 - RNA, 21 nt, Human
cagcggggacagcuccuucug

SEQ ID NO: 1527619 - RNA, 24 nt, Human
cagcugugcucuggacaggcaugu

SEQ ID NO: 1527620 - RNA, 15 nt, Human
cagcugccugggauc

SEQ ID NO: 1527621 - RNA, 20 nt, Human
cagcugugcucuggacaggc

SEQ ID NO: 1527622 - RNA, 12 nt, Human
cagcugccuggg

SEQ ID NO: 1527623 - RNA, 13 nt, Human
cagcugccuggga

SEQ ID NO: 1527624 - RNA, 14 nt, Human
cagcugccugggau

SEQ ID NO: 1527625 - RNA, 21 nt, Human
cagcuccccucggagaagagc

SEQ ID NO: 1527626 - RNA, 22 nt, Human
cagcuccccucggagaagagcu

SEQ ID NO: 1527627 - RNA, 18 nt, Human
caggaaaagcugcugaca

SEQ ID NO: 1527628 - RNA, 15 nt, Human
caggaaaagcugcug

SEQ ID NO: 1527629 - RNA, 16 nt, Human
caggaaaagcugcuga

SEQ ID NO: 1527630 - RNA, 17 nt, Human
cauggcugccaauggga

SEQ ID NO: 1527631 - RNA, 14 nt, Human
caugggaaugaaug

SEQ ID NO: 1527632 - RNA, 15 nt, Human
caugggaaugaaugu

SEQ ID NO: 1527633 - RNA, 16 nt, Human
caugggaaugaauguc

SEQ ID NO: 1527634 - RNA, 17 nt, Human
caugggaaugaauguca

SEQ ID NO: 1527635 - RNA, 14 nt, Human
caugauguuuagaa

SEQ ID NO: 1527636 - RNA, 14 nt, Human
caugcuacacacug

SEQ ID NO: 1527637 - RNA, 23 nt, Human
caugcuacacacugcauguuugu

SEQ ID NO: 1527638 - RNA, 20 nt, Human
caugcuacacacugcauguu

SEQ ID NO: 1527639 - RNA, 13 nt, Human
caugauguuuucc

SEQ ID NO: 1527640 - RNA, 19 nt, Human
cauuauauuuauuacugua

SEQ ID NO: 1527641 - RNA, 13 nt, Human
cauucuccaccug

SEQ ID NO: 1527642 - RNA, 14 nt, Human
cauucuccaccugc

SEQ ID NO: 1527643 - RNA, 16 nt, Human
cauucuccaccugcca

SEQ ID NO: 1527644 - RNA, 16 nt, Human
cauguuggccaggcug

SEQ ID NO: 1527645 - RNA, 14 nt, Human
cauguuggccaggc

SEQ ID NO: 1527646 - RNA, 15 nt, Human
cauguuggccaggcu

SEQ ID NO: 1527647 - RNA, 12 nt, Human
cauccuggaaua

SEQ ID NO: 1527648 - RNA, 23 nt, Human
cauccuggcacccggccccugcu

SEQ ID NO: 1527649 - RNA, 22 nt, Human
cauccuggcacccggccccugc

SEQ ID NO: 1527650 - RNA, 16 nt, Human
caucugcucuccuucc

SEQ ID NO: 1527651 - RNA, 18 nt, Human
caucugcucuccuuccug

SEQ ID NO: 1527652 - RNA, 20 nt, Human
caucugcucuccuuccugga

SEQ ID NO: 1527653 - RNA, 15 nt, Human
cauccuggcacccgg

SEQ ID NO: 1527654 - RNA, 12 nt, Human
caucacuucccu

SEQ ID NO: 1527655 - RNA, 14 nt, Human
caucacuucccuac

SEQ ID NO: 1527656 - RNA, 16 nt, Human
cauauuaccacagaca

SEQ ID NO: 1527657 - RNA, 17 nt, Human
cauauucuguuggccag

SEQ ID NO: 1527658 - RNA, 18 nt, Human
cauauucuguuggccagu

SEQ ID NO: 1527659 - RNA, 14 nt, Human
cauauuaauauauu

SEQ ID NO: 1527660 - RNA, 15 nt, Human
cauauuaauauauuu

SEQ ID NO: 1527661 - RNA, 19 nt, Human
cauauuaauauauuuccau

SEQ ID NO: 1527662 - RNA, 22 nt, Human
caguggugguuuucuguucuuu

SEQ ID NO: 1527663 - RNA, 21 nt, Human
caguggugguuuucuguucuu

SEQ ID NO: 1527664 - RNA, 20 nt, Human
caguggugguuuucuguucu

SEQ ID NO: 1527665 - RNA, 19 nt, Human
caguggugguuuucuguuc

SEQ ID NO: 1527666 - RNA, 23 nt, Human
cauaugcuguauauccuuucuaa

SEQ ID NO: 1527667 - RNA, 13 nt, Human
ccaccgcagacag

SEQ ID NO: 1527668 - RNA, 22 nt, Human
ccaccgcagacaggaccaggga

SEQ ID NO: 1527669 - RNA, 21 nt, Human
ccaccuuugaagaaguaagga

SEQ ID NO: 1527670 - RNA, 18 nt, Human
ccacgcccccacugguga

SEQ ID NO: 1527671 - RNA, 19 nt, Human
ccacgcccccacuggugac

SEQ ID NO: 1527672 - RNA, 16 nt, Human
ccacgcccccacuggu

SEQ ID NO: 1527673 - RNA, 17 nt, Human
ccacgcccccacuggug

SEQ ID NO: 1527674 - RNA, 13 nt, Human
ccaccaucaagcc

SEQ ID NO: 1527675 - RNA, 14 nt, Human
ccaccaucaagcca

SEQ ID NO: 1527676 - RNA, 15 nt, Human
ccaccaucaagccac

SEQ ID NO: 1527677 - RNA, 23 nt, Human
ccacagcaguugaaaagacucca

SEQ ID NO: 1527678 - RNA, 17 nt, Human
ccacagcaguugaaaag

SEQ ID NO: 1527679 - RNA, 18 nt, Human
ccacagcaguugaaaaga

SEQ ID NO: 1527680 - RNA, 12 nt, Human
ccacagcaguug

SEQ ID NO: 1527681 - RNA, 19 nt, Human
cauuuguauaaaauaauuu

SEQ ID NO: 1527682 - RNA, 20 nt, Human
cauuuguauaaaauaauuuu

SEQ ID NO: 1527683 - RNA, 16 nt, Human
cauuuguguugaagag

SEQ ID NO: 1527684 - RNA, 18 nt, Human
cauuuuuuuccaggcugg

SEQ ID NO: 1527685 - RNA, 15 nt, Human
cauuuuuuuccaggc

SEQ ID NO: 1527686 - RNA, 17 nt, Human
cauuuuuuuccaggcug

SEQ ID NO: 1527687 - RNA, 20 nt, Human
cauuuguguugaagagguuu

SEQ ID NO: 1527688 - RNA, 22 nt, Human
cauuuuuuuuaagaaaaaggau

SEQ ID NO: 1527689 - RNA, 21 nt, Human
ccaaaacucuccucugcugcu

SEQ ID NO: 1527690 - RNA, 17 nt, Human
ccaaugggagcucaugg

SEQ ID NO: 1527691 - RNA, 17 nt, Human
ccaauauuuaccagacc

SEQ ID NO: 1527692 - RNA, 15 nt, Human
ccaaugauggucacc

SEQ ID NO: 1527693 - RNA, 14 nt, Human
ccaaugcacuuugu

SEQ ID NO: 1527694 - RNA, 18 nt, Human
ccaagcucugcuccucuc

SEQ ID NO: 1527695 - RNA, 12 nt, Human
ccaagcucugcu

SEQ ID NO: 1527696 - RNA, 13 nt, Human
ccaagcucugcuc

SEQ ID NO: 1527697 - RNA, 18 nt, Human
ccaaauguucaucaauga

SEQ ID NO: 1527698 - RNA, 18 nt, Human
ccaacucaccccagcccc

SEQ ID NO: 1527699 - RNA, 16 nt, Human
ccaacucaccccagcc

SEQ ID NO: 1527700 - RNA, 17 nt, Human
ccaacucaccccagccc

SEQ ID NO: 1527701 - RNA, 17 nt, Human
ccaaauguucaucaaug

SEQ ID NO: 1527702 - RNA, 23 nt, Human
ccaaauggaaaugggcagagcag

SEQ ID NO: 1527703 - RNA, 13 nt, Human
auuccugaacagg

SEQ ID NO: 1527704 - RNA, 21 nt, Human
auucucuccuguaccucuuga

SEQ ID NO: 1527705 - RNA, 19 nt, Human
auucucuccuguaccucuu

SEQ ID NO: 1527706 - RNA, 21 nt, Human
auuccugaugcuucuucagag

SEQ ID NO: 1527707 - RNA, 17 nt, Human
auucuugccaaauauaa

SEQ ID NO: 1527708 - RNA, 17 nt, Human
auucuuuccugaggcug

SEQ ID NO: 1527709 - RNA, 22 nt, Human
auucuuuccugaggcugggcuc

SEQ ID NO: 1527710 - RNA, 20 nt, Human
auuaaauuuugaguucuaca

SEQ ID NO: 1527711 - RNA, 18 nt, Human
auuaaauucuugcaaagu

SEQ ID NO: 1527712 - RNA, 14 nt, Human
auuaaauucuugca

SEQ ID NO: 1527713 - RNA, 20 nt, Human
auuaaauucuugcaaaguau

SEQ ID NO: 1527714 - RNA, 18 nt, Human
auuaaauuuugaguucua

SEQ ID NO: 1527715 - RNA, 22 nt, Human
auucaagaaaacaacuucaaua

SEQ ID NO: 1527716 - RNA, 18 nt, Human
auucacaagacccaaaag

SEQ ID NO: 1527717 - RNA, 17 nt, Human
auucaucucucuuuaau

SEQ ID NO: 1527718 - RNA, 22 nt, Human
auucaucucucuuuaauauaaa

SEQ ID NO: 1527719 - RNA, 20 nt, Human
auucauauuuacuucuuaua

SEQ ID NO: 1527720 - RNA, 18 nt, Human
auucauauuuacuucuua

SEQ ID NO: 1527721 - RNA, 19 nt, Human
auucauauuuacuucuuau

SEQ ID NO: 1527722 - RNA, 13 nt, Human
auuguaaaauggu

SEQ ID NO: 1527723 - RNA, 23 nt, Human
auuguaauaggcguaacuaauuu

SEQ ID NO: 1527724 - RNA, 16 nt, Human
auuguaaggaaugauu

SEQ ID NO: 1527725 - RNA, 15 nt, Human
auuguaaggaaugau

SEQ ID NO: 1527726 - RNA, 14 nt, Human
auuguaaaugugcu

SEQ ID NO: 1527727 - RNA, 15 nt, Human
auuguaaaugugcuu

SEQ ID NO: 1527728 - RNA, 17 nt, Human
auuguaaaugugcuuuu

SEQ ID NO: 1527729 - RNA, 19 nt, Human
auuguucuuaguuugcagu

SEQ ID NO: 1527730 - RNA, 19 nt, Human
auuguacacaccuuauauu

SEQ ID NO: 1527731 - RNA, 19 nt, Human
auuguuuaaaaucauuucu

SEQ ID NO: 1527732 - RNA, 15 nt, Human
auuucuaugaaauau

SEQ ID NO: 1527733 - RNA, 18 nt, Human
auuucuaugaaauauuau

SEQ ID NO: 1527734 - RNA, 11 nt, Human
auuucaucugc

SEQ ID NO: 1527735 - RNA, 14 nt, Human
auuucaucugcucu

SEQ ID NO: 1527736 - RNA, 15 nt, Human
auuucaucugcucuc

SEQ ID NO: 1527737 - RNA, 16 nt, Human
auuucaucugcucucc

SEQ ID NO: 1527738 - RNA, 17 nt, Human
auuucaucugcucuccu

SEQ ID NO: 1527739 - RNA, 20 nt, Human
auuucuaugaaauauuaugu

SEQ ID NO: 1527740 - RNA, 16 nt, Human
auuucuguuuagauaa

SEQ ID NO: 1527741 - RNA, 14 nt, Human
auuucuguuuagau

SEQ ID NO: 1527742 - RNA, 12 nt, Human
auuucuguuuag

SEQ ID NO: 1527743 - RNA, 19 nt, Human
auuucuguuuagauaauac

SEQ ID NO: 1527744 - RNA, 16 nt, Human
auuucagcagcugcag

SEQ ID NO: 1527745 - RNA, 19 nt, Human
auuuauacaggucauauua

SEQ ID NO: 1527746 - RNA, 15 nt, Human
auuuaaugaaagacu

SEQ ID NO: 1527747 - RNA, 22 nt, Human
auuuaaugauaaguaaaugcua

SEQ ID NO: 1527748 - RNA, 14 nt, Human
auuuaaugaaagac

SEQ ID NO: 1527749 - RNA, 17 nt, Human
caaaucagcugcuacua

SEQ ID NO: 1527750 - RNA, 20 nt, Human
caaaguacacuguuucaaac

SEQ ID NO: 1527751 - RNA, 16 nt, Human
caaaguacacuguuuc

SEQ ID NO: 1527752 - RNA, 21 nt, Human
caaaguacacuguuucaaacu

SEQ ID NO: 1527753 - RNA, 13 nt, Human
caaagaugcagcc

SEQ ID NO: 1527754 - RNA, 14 nt, Human
caaagaugcagccg

SEQ ID NO: 1527755 - RNA, 21 nt, Human
caaaucugcuuuuuaaagaau

SEQ ID NO: 1527756 - RNA, 23 nt, Human
caacaaaccuguuucugcagcca

SEQ ID NO: 1527757 - RNA, 22 nt, Human
caacaccucugcacaagcugca

SEQ ID NO: 1527758 - RNA, 20 nt, Human
caacaccuuguuucccucuc

SEQ ID NO: 1527759 - RNA, 15 nt, Human
caacacgagcaggcu

SEQ ID NO: 1527760 - RNA, 23 nt, Human
caagaauuucuaggacugaauua

SEQ ID NO: 1527761 - RNA, 23 nt, Human
caagacccuuguggucccacccc

SEQ ID NO: 1527762 - RNA, 22 nt, Human
caagacccuuguggucccaccc

SEQ ID NO: 1527763 - RNA, 18 nt, Human
caagacccuugugguccc

SEQ ID NO: 1527764 - RNA, 19 nt, Human
caagacccuugugguccca

SEQ ID NO: 1527765 - RNA, 17 nt, Human
caacucaccccagcccc

SEQ ID NO: 1527766 - RNA, 16 nt, Human
caacucaccccagccc

SEQ ID NO: 1527767 - RNA, 13 nt, Human
caacucaccccag

SEQ ID NO: 1527768 - RNA, 15 nt, Human
caacucaccccagcc

SEQ ID NO: 1527769 - RNA, 21 nt, Human
caacuaucucauuuccaagca

SEQ ID NO: 1527770 - RNA, 15 nt, Human
caacccccagccugc

SEQ ID NO: 1527771 - RNA, 16 nt, Human
caacccccagccugcu

SEQ ID NO: 1527772 - RNA, 17 nt, Human
caacccccagccugcua

SEQ ID NO: 1527773 - RNA, 19 nt, Human
caacccaaauguucaucaa

SEQ ID NO: 1527774 - RNA, 18 nt, Human
caaccacugcgaccacaa

SEQ ID NO: 1527775 - RNA, 15 nt, Human
caaaagcugggcagg

SEQ ID NO: 1527776 - RNA, 19 nt, Human
caaaagcugggcagguugg

SEQ ID NO: 1527777 - RNA, 18 nt, Human
caaaaaaauauauuuaau

SEQ ID NO: 1527778 - RNA, 17 nt, Human
auuuuuuuuuccuucag

SEQ ID NO: 1527779 - RNA, 13 nt, Human
auuuuuuuuuccu

SEQ ID NO: 1527780 - RNA, 16 nt, Human
auuuuuuuuuccuuca

SEQ ID NO: 1527781 - RNA, 13 nt, Human
auuuuuaagugcu

SEQ ID NO: 1527782 - RNA, 17 nt, Human
auuuuauagcuacuaau

SEQ ID NO: 1527783 - RNA, 16 nt, Human
auuuguuugaacugau

SEQ ID NO: 1527784 - RNA, 14 nt, Human
auuuguuugaacug

SEQ ID NO: 1527785 - RNA, 20 nt, Human
auuuguuugaacugauaaag

SEQ ID NO: 1527786 - RNA, 13 nt, Human
auuuguuugaacu

SEQ ID NO: 1527787 - RNA, 13 nt, Human
auuuuaucuuuga

SEQ ID NO: 1527788 - RNA, 15 nt, Human
auuuuaucuuugauu

SEQ ID NO: 1527789 - RNA, 20 nt, Human
auuuuaucuuugauucuccu

SEQ ID NO: 1527790 - RNA, 21 nt, Human
auuuuaucuuugauucuccuu

SEQ ID NO: 1527791 - RNA, 22 nt, Human
auuuuaucuuugauucuccuuc

SEQ ID NO: 1527792 - RNA, 23 nt, Human
auuuuaucuuugauucuccuuca

SEQ ID NO: 1527793 - RNA, 18 nt, Human
auuuugauccaagcuggu

SEQ ID NO: 1527794 - RNA, 11 nt, Human
cacugaagaag

SEQ ID NO: 1527795 - RNA, 17 nt, Human
cacucuuauugcccacg

SEQ ID NO: 1527796 - RNA, 18 nt, Human
cacucuuauugcccacgc

SEQ ID NO: 1527797 - RNA, 19 nt, Human
cacucuuauugcccacgcu

SEQ ID NO: 1527798 - RNA, 14 nt, Human
cacggccaggccag

SEQ ID NO: 1527799 - RNA, 15 nt, Human
cacggccaggccaga

SEQ ID NO: 1527800 - RNA, 16 nt, Human
cacggccaggccagag

SEQ ID NO: 1527801 - RNA, 20 nt, Human
cacggagggugacgggggug

SEQ ID NO: 1527802 - RNA, 17 nt, Human
cacggccaggccagagg

SEQ ID NO: 1527803 - RNA, 15 nt, Human
cacuaauacaccagg

SEQ ID NO: 1527804 - RNA, 23 nt, Human
cacuacggaauaguuggcuagga

SEQ ID NO: 1527805 - RNA, 17 nt, Human
caccuuuguccccaccg

SEQ ID NO: 1527806 - RNA, 14 nt, Human
caccuuugucccca

SEQ ID NO: 1527807 - RNA, 15 nt, Human
caccuuuguccccac

SEQ ID NO: 1527808 - RNA, 17 nt, Human
caccugccagggacaga

SEQ ID NO: 1527809 - RNA, 19 nt, Human
caccuugacagggcacacc

SEQ ID NO: 1527810 - RNA, 14 nt, Human
caccuuggcucaag

SEQ ID NO: 1527811 - RNA, 13 nt, Human
caccuuggcucaa

SEQ ID NO: 1527812 - RNA, 21 nt, Human
caccuacaugagguacugaga

SEQ ID NO: 1527813 - RNA, 14 nt, Human
caccugccagggac

SEQ ID NO: 1527814 - RNA, 16 nt, Human
caccugccagggacag

SEQ ID NO: 1527815 - RNA, 23 nt, Human
caccucaaaauaccaugccauuu

SEQ ID NO: 1527816 - RNA, 17 nt, Human
cacuggugacaugucuu

SEQ ID NO: 1527817 - RNA, 15 nt, Human
cacuguugcccaggc

SEQ ID NO: 1527818 - RNA, 16 nt, Human
cacuguugcccaggcu

SEQ ID NO: 1527819 - RNA, 23 nt, Human
cacugggcuuggggaccagagcu

SEQ ID NO: 1527820 - RNA, 22 nt, Human
cacugggcuuggggaccagagc

SEQ ID NO: 1527821 - RNA, 20 nt, Human
cacuuggucugugagaugcu

SEQ ID NO: 1527822 - RNA, 17 nt, Human
cacuguugcccaggcug

SEQ ID NO: 1527823 - RNA, 19 nt, Human
cacuguuucaaacuuuacu

SEQ ID NO: 1527824 - RNA, 17 nt, Human
cacuuucagugaaagca

SEQ ID NO: 1527825 - RNA, 18 nt, Human
cacuuucagugaaagcau

SEQ ID NO: 1527826 - RNA, 19 nt, Human
cacuuucagugaaagcauc

SEQ ID NO: 1527827 - RNA, 23 nt, Human
cagaaguuucugccgcagcccug

SEQ ID NO: 1527828 - RNA, 22 nt, Human
cagaaguuucugccgcagcccu

SEQ ID NO: 1527829 - RNA, 20 nt, Human
cagaaguuucugccgcagcc

SEQ ID NO: 1527830 - RNA, 21 nt, Human
cagaaguuucugccgcagccc

SEQ ID NO: 1527831 - RNA, 20 nt, Human
cagaauaaucaaauacauuu

SEQ ID NO: 1527832 - RNA, 12 nt, Human
cagaauauguuu

SEQ ID NO: 1527833 - RNA, 13 nt, Human
cagaauauugcuu

SEQ ID NO: 1527834 - RNA, 18 nt, Human
cagaauauguuucaaacu

SEQ ID NO: 1527835 - RNA, 20 nt, Human
cagaauauguuucaaacuuu

SEQ ID NO: 1527836 - RNA, 13 nt, Human
cagaauauguuuc

SEQ ID NO: 1527837 - RNA, 14 nt, Human
cagaauauguuuca

SEQ ID NO: 1527838 - RNA, 15 nt, Human
cagaauauguuucaa

SEQ ID NO: 1527839 - RNA, 17 nt, Human
cagaauauguuucaaac

SEQ ID NO: 1527840 - RNA, 11 nt, Human
cagaacacugu

SEQ ID NO: 1527841 - RNA, 23 nt, Human
cacagguaugaccuucuaggaag

SEQ ID NO: 1527842 - RNA, 22 nt, Human
cacagcuaacauggaaguacua

SEQ ID NO: 1527843 - RNA, 20 nt, Human
cacagcucuguccugggagu

SEQ ID NO: 1527844 - RNA, 23 nt, Human
cacagcucuguccugggagugag

SEQ ID NO: 1527845 - RNA, 10 nt, Human
cacagcucuu

SEQ ID NO: 1527846 - RNA, 19 nt, Human
cacagacccugcccugugg

SEQ ID NO: 1527847 - RNA, 20 nt, Human
cacagacccugcccuguggg

SEQ ID NO: 1527848 - RNA, 21 nt, Human
cacagacccugcccugugggc

SEQ ID NO: 1527849 - RNA, 18 nt, Human
cacagacauacuaaccag

SEQ ID NO: 1527850 - RNA, 22 nt, Human
cacagacccugcccugugggcc

SEQ ID NO: 1527851 - RNA, 15 nt, Human
cacagcuaacaugga

SEQ ID NO: 1527852 - RNA, 16 nt, Human
cacagcuaacauggaa

SEQ ID NO: 1527853 - RNA, 16 nt, Human
cacaguauuacuucug

SEQ ID NO: 1527854 - RNA, 18 nt, Human
cacaguauuacuucugcu

SEQ ID NO: 1527855 - RNA, 19 nt, Human
cacaguauuacuucugcua

SEQ ID NO: 1527856 - RNA, 17 nt, Human
cacccagcccacuucug

SEQ ID NO: 1527857 - RNA, 23 nt, Human
caccaacauacucccaucuguga

SEQ ID NO: 1527858 - RNA, 14 nt, Human
caccagcagccugg

SEQ ID NO: 1527859 - RNA, 15 nt, Human
caccagcagccugga

SEQ ID NO: 1527860 - RNA, 24 nt, Human
cacccaggagccccgaggccuucu

SEQ ID NO: 1527861 - RNA, 19 nt, Human
cacccagcccacuucugcc

SEQ ID NO: 1527862 - RNA, 20 nt, Human
cacccaggagccccgaggcc

SEQ ID NO: 1527863 - RNA, 23 nt, Human
cacccaggagccccgaggccuuc

SEQ ID NO: 1527864 - RNA, 15 nt, Human
cacauuuuauuuuau

SEQ ID NO: 1527865 - RNA, 19 nt, Human
cacaucuugcucugcugac

SEQ ID NO: 1527866 - RNA, 18 nt, Human
cacaucuugcucugcuga

SEQ ID NO: 1527867 - RNA, 21 nt, Human
cacauuuuuuaaaugcaccug

SEQ ID NO: 1527868 - RNA, 17 nt, Human
cacauuuuuuaaaugca

SEQ ID NO: 1527869 - RNA, 14 nt, Human
cacauuuuucuuag

SEQ ID NO: 1527870 - RNA, 13 nt, Human
cacauuuuucuua

SEQ ID NO: 1527871 - RNA, 20 nt, Human
caccaacauacucccaucug

SEQ ID NO: 1527872 - RNA, 21 nt, Human
caccaacauacucccaucugu

SEQ ID NO: 1527873 - RNA, 17 nt, Human
cacaucuugcucugcug

SEQ ID NO: 1527874 - RNA, 22 nt, Human
cacaucagcacgauuucuguuu

SEQ ID NO: 1527875 - RNA, 24 nt, Human
cacaucagcuccacuuucagugaa

SEQ ID NO: 1527876 - RNA, 13 nt, Human
cacaucagcuugc

SEQ ID NO: 1527877 - RNA, 21 nt, Human
cacaucagcacgauuucuguu

SEQ ID NO: 1527878 - RNA, 20 nt, Human
cacaucagcacgauuucugu

SEQ ID NO: 1527879 - RNA, 14 nt, Human
caaguauuagaaua

SEQ ID NO: 1527880 - RNA, 20 nt, Human
caaguauuagaauaccacag

SEQ ID NO: 1527881 - RNA, 13 nt, Human
caaguauuauacc

SEQ ID NO: 1527882 - RNA, 16 nt, Human
cacaagacugcacauc

SEQ ID NO: 1527883 - RNA, 12 nt, Human
caauuuaaagca

SEQ ID NO: 1527884 - RNA, 12 nt, Human
caauuuaaaaaa

SEQ ID NO: 1527885 - RNA, 14 nt, Human
cacaagacccuugu

SEQ ID NO: 1527886 - RNA, 16 nt, Human
cacaagacccuugugg

SEQ ID NO: 1527887 - RNA, 14 nt, Human
cacaagccuucggc

SEQ ID NO: 1527888 - RNA, 12 nt, Human
caauauuucaga

SEQ ID NO: 1527889 - RNA, 20 nt, Human
caauauuucagauaaucaca

SEQ ID NO: 1527890 - RNA, 21 nt, Human
caauauuucagauaaucacaa

SEQ ID NO: 1527891 - RNA, 14 nt, Human
caaugcuguauuuu

SEQ ID NO: 1527892 - RNA, 23 nt, Human
caaugcuguauuuuaaaagaaug

SEQ ID NO: 1527893 - RNA, 22 nt, Human
caaugcuggcuguuggcugggg

SEQ ID NO: 1527894 - RNA, 23 nt, Human
caaugcuggcuguuggcuggggg

SEQ ID NO: 1527895 - RNA, 17 nt, Human
caauucuuacaaacaug

SEQ ID NO: 1527896 - RNA, 18 nt, Human
caauucuuacaaacaugu

SEQ ID NO: 1527897 - RNA, 19 nt, Human
caauucuuacaaacaugug

SEQ ID NO: 1527898 - RNA, 22 nt, Human
caaugcugugcccuaaagugua

SEQ ID NO: 1527899 - RNA, 16 nt, Human
ccauccccuguagagu

SEQ ID NO: 1527900 - RNA, 22 nt, Human
ccauccccuguagagugggagc

SEQ ID NO: 1527901 - RNA, 14 nt, Human
ccaugagccucagc

SEQ ID NO: 1527902 - RNA, 18 nt, Human
ccaugagccucagcaucc

SEQ ID NO: 1527903 - RNA, 19 nt, Human
ccaugagccucagcauccu

SEQ ID NO: 1527904 - RNA, 14 nt, Human
ccaugaguccccug

SEQ ID NO: 1527905 - RNA, 15 nt, Human
ccaugaguccccugu

SEQ ID NO: 1527906 - RNA, 16 nt, Human
ccaugaguccccuguu

SEQ ID NO: 1527907 - RNA, 13 nt, Human
ccaugggccuccu

SEQ ID NO: 1527908 - RNA, 13 nt, Human
ccauacauuugug

SEQ ID NO: 1527909 - RNA, 14 nt, Human
ccauacauuugugu

SEQ ID NO: 1527910 - RNA, 23 nt, Human
ccaucccaaacccuucagugcca

SEQ ID NO: 1527911 - RNA, 12 nt, Human
ccaucccagccc

SEQ ID NO: 1527912 - RNA, 13 nt, Human
ccaucccagcccc

SEQ ID NO: 1527913 - RNA, 22 nt, Human
ccauuuaaagcuuauuaaaacu

SEQ ID NO: 1527914 - RNA, 17 nt, Human
ccaugggccuccugugu

SEQ ID NO: 1527915 - RNA, 14 nt, Human
ccaugggccuccug

SEQ ID NO: 1527916 - RNA, 15 nt, Human
ccaugggccuccugu

SEQ ID NO: 1527917 - RNA, 12 nt, Human
ccagucaccccg

SEQ ID NO: 1527918 - RNA, 13 nt, Human
ccagucaccccgg

SEQ ID NO: 1527919 - RNA, 20 nt, Human
ccagucaccccggccaccug

SEQ ID NO: 1527920 - RNA, 21 nt, Human
ccagucaccccggccaccugc

SEQ ID NO: 1527921 - RNA, 21 nt, Human
ccaggagggaggcaggggagg

SEQ ID NO: 1527922 - RNA, 13 nt, Human
ccaggcugggaga

SEQ ID NO: 1527923 - RNA, 14 nt, Human
ccaggcugggagag

SEQ ID NO: 1527924 - RNA, 23 nt, Human
ccaggcugggagagccuuccagg

SEQ ID NO: 1527925 - RNA, 22 nt, Human
ccaggcugggagagccuuccag

SEQ ID NO: 1527926 - RNA, 19 nt, Human
ccaggggccggccaguggc

SEQ ID NO: 1527927 - RNA, 15 nt, Human
ccaggcugggagagc

SEQ ID NO: 1527928 - RNA, 17 nt, Human
ccaggcugggagagccu

SEQ ID NO: 1527929 - RNA, 18 nt, Human
ccaggcugggagagccuu

SEQ ID NO: 1527930 - RNA, 21 nt, Human
ccaggcugggagagccuucca

SEQ ID NO: 1527931 - RNA, 15 nt, Human
ccaggagggaggcag

SEQ ID NO: 1527932 - RNA, 22 nt, Human
ccaggagggaggcaggggaggg

SEQ ID NO: 1527933 - RNA, 21 nt, Human
ccagccccuggaugcagccuc

SEQ ID NO: 1527934 - RNA, 10 nt, Human
ccagccccuu

SEQ ID NO: 1527935 - RNA, 15 nt, Human
ccagcagccuggacc

SEQ ID NO: 1527936 - RNA, 19 nt, Human
ccagcagccuggacccugu

SEQ ID NO: 1527937 - RNA, 20 nt, Human
ccagcagccuggacccugug

SEQ ID NO: 1527938 - RNA, 21 nt, Human
ccaggaaaggcuccaggagca

SEQ ID NO: 1527939 - RNA, 22 nt, Human
ccaggaaaggcuccaggagcag

SEQ ID NO: 1527940 - RNA, 23 nt, Human
ccaggaaaggcuccaggagcagc

SEQ ID NO: 1527941 - RNA, 20 nt, Human
ccacucucccccacccccuc

SEQ ID NO: 1527942 - RNA, 23 nt, Human
ccagcagagcaccuuagacaguc

SEQ ID NO: 1527943 - RNA, 19 nt, Human
ccagcagagcaccuuagac

SEQ ID NO: 1527944 - RNA, 17 nt, Human
ccccuucugacccaugc

SEQ ID NO: 1527945 - RNA, 12 nt, Human
cccgggaagggg

SEQ ID NO: 1527946 - RNA, 12 nt, Human
cccggcugcgga

SEQ ID NO: 1527947 - RNA, 18 nt, Human
ccccugcacuccagccug

SEQ ID NO: 1527948 - RNA, 13 nt, Human
ccccuucucucau

SEQ ID NO: 1527949 - RNA, 16 nt, Human
ccccuucucucaucuc

SEQ ID NO: 1527950 - RNA, 19 nt, Human
ccccuucgcuccugugucu

SEQ ID NO: 1527951 - RNA, 14 nt, Human
ccccuucgcuccug

SEQ ID NO: 1527952 - RNA, 15 nt, Human
ccccuucgcuccugu

SEQ ID NO: 1527953 - RNA, 17 nt, Human
ccccuucgcuccugugu

SEQ ID NO: 1527954 - RNA, 15 nt, Human
ccccauucugccugc

SEQ ID NO: 1527955 - RNA, 13 nt, Human
ccccauucugccu

SEQ ID NO: 1527956 - RNA, 14 nt, Human
ccccauucugccug

SEQ ID NO: 1527957 - RNA, 23 nt, Human
cccauucugccugcccaggcccc

SEQ ID NO: 1527958 - RNA, 22 nt, Human
ccccagauugcaacaggcuggg

SEQ ID NO: 1527959 - RNA, 23 nt, Human
ccccagauugcaacaggcugggc

SEQ ID NO: 1527960 - RNA, 17 nt, Human
ccccagcaagugagagc

SEQ ID NO: 1527961 - RNA, 22 nt, Human
ccccauccucuguacagagccc

SEQ ID NO: 1527962 - RNA, 19 nt, Human
ccccauccucuguacagag

SEQ ID NO: 1527963 - RNA, 21 nt, Human
ccccauccucuguacagagcc

SEQ ID NO: 1527964 - RNA, 19 nt, Human
ccccagcaagugagagcug

SEQ ID NO: 1527965 - RNA, 20 nt, Human
ccccagcaagugagagcugg

SEQ ID NO: 1527966 - RNA, 21 nt, Human
ccccagcaagugagagcuggg

SEQ ID NO: 1527967 - RNA, 21 nt, Human
cccauucugccugcccaggcc

SEQ ID NO: 1527968 - RNA, 22 nt, Human
cccauucugccugcccaggccc

SEQ ID NO: 1527969 - RNA, 24 nt, Human
cccagcacugaggaagaacggggc

SEQ ID NO: 1527970 - RNA, 17 nt, Human
cccagcccacuucugcc

SEQ ID NO: 1527971 - RNA, 14 nt, Human
cccagcccacuucu

SEQ ID NO: 1527972 - RNA, 15 nt, Human
cccagcacugaggaa

SEQ ID NO: 1527973 - RNA, 23 nt, Human
cccaggaaaggcuccaggagcag

SEQ ID NO: 1527974 - RNA, 21 nt, Human
cccaggaaaggcuccaggagc

SEQ ID NO: 1527975 - RNA, 22 nt, Human
cccaggaaaggcuccaggagca

SEQ ID NO: 1527976 - RNA, 22 nt, Human
cccagcuuaaaggggcuagagu

SEQ ID NO: 1527977 - RNA, 19 nt, Human
cccaggaaaggcuccagga

SEQ ID NO: 1527978 - RNA, 21 nt, Human
cccagcugugcucuggacagg

SEQ ID NO: 1527979 - RNA, 23 nt, Human
cccagcugugcucuggacaggca

SEQ ID NO: 1527980 - RNA, 15 nt, Human
cccaggcuuagucac

SEQ ID NO: 1527981 - RNA, 20 nt, Human
cccaggcuuagucacugaga

SEQ ID NO: 1527982 - RNA, 23 nt, Human
ccucauggaauuggagcucgugg

SEQ ID NO: 1527983 - RNA, 21 nt, Human
ccucaggagccgaagcccagg

SEQ ID NO: 1527984 - RNA, 12 nt, Human
ccucaggagccg

SEQ ID NO: 1527985 - RNA, 19 nt, Human
ccucaggagccgaagccca

SEQ ID NO: 1527986 - RNA, 22 nt, Human
ccucaggagccgaagcccaggg

SEQ ID NO: 1527987 - RNA, 16 nt, Human
ccucccaucucacaca

SEQ ID NO: 1527988 - RNA, 13 nt, Human
ccucccaucucac

SEQ ID NO: 1527989 - RNA, 15 nt, Human
ccucauguccacugg

SEQ ID NO: 1527990 - RNA, 19 nt, Human
ccuccaaccuggggggcag

SEQ ID NO: 1527991 - RNA, 15 nt, Human
ccucccaccucagcc

SEQ ID NO: 1527992 - RNA, 17 nt, Human
ccucccaccucagccuc

SEQ ID NO: 1527993 - RNA, 15 nt, Human
ccggccccugcuggu

SEQ ID NO: 1527994 - RNA, 14 nt, Human
ccggccccugcugg

SEQ ID NO: 1527995 - RNA, 17 nt, Human
cccugugauggggcccu

SEQ ID NO: 1527996 - RNA, 18 nt, Human
cccugugauggggcccug

SEQ ID NO: 1527997 - RNA, 19 nt, Human
cccugugauggggcccugc

SEQ ID NO: 1527998 - RNA, 20 nt, Human
cccugugauggggcccugcc

SEQ ID NO: 1527999 - RNA, 13 nt, Human
cccuucgcuccug

SEQ ID NO: 1528000 - RNA, 16 nt, Human
cccugucuaaugaaac

SEQ ID NO: 1528001 - RNA, 20 nt, Human
cccugucucaaaaaaagaaa

SEQ ID NO: 1528002 - RNA, 23 nt, Human
cccugucucaaaaaaagaaaaag

SEQ ID NO: 1528003 - RNA, 13 nt, Human
ccggccccugcug

SEQ ID NO: 1528004 - RNA, 14 nt, Human
cccuucgcuccugu

SEQ ID NO: 1528005 - RNA, 15 nt, Human
cccuucgcuccugug

SEQ ID NO: 1528006 - RNA, 21 nt, Human
cccuucucuccagccccugga

SEQ ID NO: 1528007 - RNA, 22 nt, Human
cccuucucuccagccccuggau

SEQ ID NO: 1528008 - RNA, 15 nt, Human
ccugucuaaugaaac

SEQ ID NO: 1528009 - RNA, 22 nt, Human
ccugucuaaugaaaccuguguc

SEQ ID NO: 1528010 - RNA, 15 nt, Human
ccuguaaucacagcu

SEQ ID NO: 1528011 - RNA, 14 nt, Human
ccugguucucaucu

SEQ ID NO: 1528012 - RNA, 15 nt, Human
ccugguucucaucuu

SEQ ID NO: 1528013 - RNA, 16 nt, Human
ccugguucucaucuuu

SEQ ID NO: 1528014 - RNA, 18 nt, Human
ccugggggcugggcagag

SEQ ID NO: 1528015 - RNA, 21 nt, Human
ccugguggcagugggagcugc

SEQ ID NO: 1528016 - RNA, 22 nt, Human
ccuggccuagcauacguacaca

SEQ ID NO: 1528017 - RNA, 22 nt, Human
ccuggccucaagugauucuccu

SEQ ID NO: 1528018 - RNA, 20 nt, Human
ccuggccucugcacuccccu

SEQ ID NO: 1528019 - RNA, 21 nt, Human
ccuggccucugcacuccccug

SEQ ID NO: 1528020 - RNA, 22 nt, Human
ccuggccucugcacuccccugc

SEQ ID NO: 1528021 - RNA, 19 nt, Human
ccugccucgaacuggcugc

SEQ ID NO: 1528022 - RNA, 15 nt, Human
ccugccuccagggcu

SEQ ID NO: 1528023 - RNA, 16 nt, Human
ccugccuccagggcug

SEQ ID NO: 1528024 - RNA, 17 nt, Human
ccugccuccagggcugg

SEQ ID NO: 1528025 - RNA, 20 nt, Human
ccugccuccagggcuggacu

SEQ ID NO: 1528026 - RNA, 21 nt, Human
ccugccuccagggcuggacug

SEQ ID NO: 1528027 - RNA, 23 nt, Human
ccugccuccagggcuggacugag

SEQ ID NO: 1528028 - RNA, 21 nt, Human
ccugccucgaacuggcugcaa

SEQ ID NO: 1528029 - RNA, 23 nt, Human
ccugccucgaacuggcugcaaag

SEQ ID NO: 1528030 - RNA, 17 nt, Human
ccugcugcaguugccag

SEQ ID NO: 1528031 - RNA, 19 nt, Human
ccugcugcaguugccaguc

SEQ ID NO: 1528032 - RNA, 21 nt, Human
ccugcugcaguugccagucac

SEQ ID NO: 1528033 - RNA, 20 nt, Human
ccugcugcaguugccaguca

SEQ ID NO: 1528034 - RNA, 13 nt, Human
ccugcccaggccc

SEQ ID NO: 1528035 - RNA, 12 nt, Human
ccugccuccagg

SEQ ID NO: 1528036 - RNA, 12 nt, Human
ccugcccaccug

SEQ ID NO: 1528037 - RNA, 13 nt, Human
ccugcccaccugg

SEQ ID NO: 1528038 - RNA, 14 nt, Human
ccugcccaccuggc

SEQ ID NO: 1528039 - RNA, 20 nt, Human
ccugcccaccuggccucugc

SEQ ID NO: 1528040 - RNA, 17 nt, Human
ccugcacuugcagacuc

SEQ ID NO: 1528041 - RNA, 18 nt, Human
ccugcacuugcagacucu

SEQ ID NO: 1528042 - RNA, 19 nt, Human
ccugcacuugcagacucua

SEQ ID NO: 1528043 - RNA, 16 nt, Human
ccucuuucccucccuu

SEQ ID NO: 1528044 - RNA, 13 nt, Human
ccucuuucccucc

SEQ ID NO: 1528045 - RNA, 19 nt, Human
ccugcagccugcaggaccu

SEQ ID NO: 1528046 - RNA, 16 nt, Human
ccugcagccugcagga

SEQ ID NO: 1528047 - RNA, 11 nt, Human
ccucuuucccu

SEQ ID NO: 1528048 - RNA, 23 nt, Human
cuaaguuuuuauggcuuuugugc

SEQ ID NO: 1528049 - RNA, 20 nt, Human
cuaaguuuuuauggcuuuug

SEQ ID NO: 1528050 - RNA, 21 nt, Human
cuaagugguacuaacuuuccu

SEQ ID NO: 1528051 - RNA, 23 nt, Human
cuaagugauccucccaccucagc

SEQ ID NO: 1528052 - RNA, 22 nt, Human
cuaaguaaaaccacagcaguug

SEQ ID NO: 1528053 - RNA, 23 nt, Human
cuaaguaaaaccacagcaguuga

SEQ ID NO: 1528054 - RNA, 17 nt, Human
cuaauuuauucuaaauu

SEQ ID NO: 1528055 - RNA, 19 nt, Human
cuacaguccucccaucuca

SEQ ID NO: 1528056 - RNA, 18 nt, Human
cuacaaaaacacagcaag

SEQ ID NO: 1528057 - RNA, 16 nt, Human
cuacaaaaacacagca

SEQ ID NO: 1528058 - RNA, 17 nt, Human
cuacaaaaacacagcaa

SEQ ID NO: 1528059 - RNA, 20 nt, Human
cuacaaaaacacagcaaggg

SEQ ID NO: 1528060 - RNA, 20 nt, Human
cuacaguccucccaucucac

SEQ ID NO: 1528061 - RNA, 21 nt, Human
cuacaguugaaaaacagcuga

SEQ ID NO: 1528062 - RNA, 18 nt, Human
cuacauacuauggaauuu

SEQ ID NO: 1528063 - RNA, 22 nt, Human
cuacaguugaaaaacagcugag

SEQ ID NO: 1528064 - RNA, 20 nt, Human
cuacaugagguacugagagu

SEQ ID NO: 1528065 - RNA, 17 nt, Human
cuaccuuuguauucucu

SEQ ID NO: 1528066 - RNA, 23 nt, Human
cuagaauuugauaugugaacagu

SEQ ID NO: 1528067 - RNA, 23 nt, Human
cuagcauacguacacauuuuauu

SEQ ID NO: 1528068 - RNA, 21 nt, Human
cuagcauacguacacauuuua

SEQ ID NO: 1528069 - RNA, 12 nt, Human
cuagaacucccu

SEQ ID NO: 1528070 - RNA, 13 nt, Human
cuagaacucccuu

SEQ ID NO: 1528071 - RNA, 22 nt, Human
cuagaagauuuugaaauuuuua

SEQ ID NO: 1528072 - RNA, 14 nt, Human
cuaucuaaauguug

SEQ ID NO: 1528073 - RNA, 15 nt, Human
cuaucucccccagcc

SEQ ID NO: 1528074 - RNA, 22 nt, Human
cuaguuugauuaaauucuugca

SEQ ID NO: 1528075 - RNA, 15 nt, Human
cuaguuugauuaaau

SEQ ID NO: 1528076 - RNA, 13 nt, Human
cuaguuugauuaa

SEQ ID NO: 1528077 - RNA, 22 nt, Human
cuaguuguuugauucagacagc

SEQ ID NO: 1528078 - RNA, 23 nt, Human
cuaguuguuugauucagacagcu

SEQ ID NO: 1528079 - RNA, 12 nt, Human
cuagccagagga

SEQ ID NO: 1528080 - RNA, 13 nt, Human
cuagccagaggag

SEQ ID NO: 1528081 - RNA, 15 nt, Human
cuagccagaggagag

SEQ ID NO: 1528082 - RNA, 17 nt, Human
cucaaaaaaagaaaaag

SEQ ID NO: 1528083 - RNA, 18 nt, Human
cucaaaagcugggcaggu

SEQ ID NO: 1528084 - RNA, 23 nt, Human
cucaaaauaccaugccauuuaaa

SEQ ID NO: 1528085 - RNA, 18 nt, Human
cuaucucccccagcccca

SEQ ID NO: 1528086 - RNA, 16 nt, Human
cuaucucccccagccc

SEQ ID NO: 1528087 - RNA, 17 nt, Human
cuaucucccccagcccc

SEQ ID NO: 1528088 - RNA, 11 nt, Human
cucaauauuuu

SEQ ID NO: 1528089 - RNA, 20 nt, Human
cucaaacucuugaccucagg

SEQ ID NO: 1528090 - RNA, 13 nt, Human
cucaauauuuucc

SEQ ID NO: 1528091 - RNA, 13 nt, Human
cucaaugcacuga

SEQ ID NO: 1528092 - RNA, 15 nt, Human
cucaaugcacugaca

SEQ ID NO: 1528093 - RNA, 19 nt, Human
cgacccuugccgucuaccu

SEQ ID NO: 1528094 - RNA, 20 nt, Human
cgacccuugccgucuaccug

SEQ ID NO: 1528095 - RNA, 17 nt, Human
cgacugcccggcagggu

SEQ ID NO: 1528096 - RNA, 21 nt, Human
ccuuuuuuagaguugauacua

SEQ ID NO: 1528097 - RNA, 13 nt, Human
cgacaaugcaaac

SEQ ID NO: 1528098 - RNA, 12 nt, Human
cgacaaugcaaa

SEQ ID NO: 1528099 - RNA, 16 nt, Human
ccuugccgucuaccug

SEQ ID NO: 1528100 - RNA, 17 nt, Human
ccuugccgucuaccuga

SEQ ID NO: 1528101 - RNA, 21 nt, Human
ccuuucaauaggaaaaacuga

SEQ ID NO: 1528102 - RNA, 15 nt, Human
ccuuuugagugccuu

SEQ ID NO: 1528103 - RNA, 17 nt, Human
ccuuuugagugccuuac

SEQ ID NO: 1528104 - RNA, 17 nt, Human
cgccagauucuuuccug

SEQ ID NO: 1528105 - RNA, 23 nt, Human
cgccacuguuuugaaucucauaa

SEQ ID NO: 1528106 - RNA, 17 nt, Human
cgccaaauaaugucucu

SEQ ID NO: 1528107 - RNA, 19 nt, Human
cgccaaauaaugucucugu

SEQ ID NO: 1528108 - RNA, 14 nt, Human
cgauagugguggug

SEQ ID NO: 1528109 - RNA, 22 nt, Human
cgcaggauucuuccucccuccc

SEQ ID NO: 1528110 - RNA, 18 nt, Human
cgcaggcccccaggugcc

SEQ ID NO: 1528111 - RNA, 16 nt, Human
cggagucccaccuugg

SEQ ID NO: 1528112 - RNA, 13 nt, Human
cgcugccccuggc

SEQ ID NO: 1528113 - RNA, 14 nt, Human
cggggacagcuccu

SEQ ID NO: 1528114 - RNA, 17 nt, Human
cgggcucugccucccau

SEQ ID NO: 1528115 - RNA, 15 nt, Human
cggggacagcuccuu

SEQ ID NO: 1528116 - RNA, 22 nt, Human
cggggacagcuccuucuguccu

SEQ ID NO: 1528117 - RNA, 18 nt, Human
cgguguggagaagcggcu

SEQ ID NO: 1528118 - RNA, 17 nt, Human
cgggccacagagaaagu

SEQ ID NO: 1528119 - RNA, 11 nt, Human
cgggcucagca

SEQ ID NO: 1528120 - RNA, 15 nt, Human
cgggcucagcaaaag

SEQ ID NO: 1528121 - RNA, 14 nt, Human
cgggcucugccucc

SEQ ID NO: 1528122 - RNA, 16 nt, Human
cgggcucugccuccca

SEQ ID NO: 1528123 - RNA, 12 nt, Human
cgggccacagag

SEQ ID NO: 1528124 - RNA, 14 nt, Human
cgggccacagagaa

SEQ ID NO: 1528125 - RNA, 13 nt, Human
cggcuccaggcuc

SEQ ID NO: 1528126 - RNA, 14 nt, Human
cggcuccaggcucc

SEQ ID NO: 1528127 - RNA, 15 nt, Human
cggcuccaggcuccu

SEQ ID NO: 1528128 - RNA, 16 nt, Human
cggcuccaggcuccuu

SEQ ID NO: 1528129 - RNA, 18 nt, Human
cggagucccaccuuggcu

SEQ ID NO: 1528130 - RNA, 20 nt, Human
cggagucccaccuuggcugc

SEQ ID NO: 1528131 - RNA, 15 nt, Human
cggcucacugcagcc

SEQ ID NO: 1528132 - RNA, 16 nt, Human
cggcucacugcagccu

SEQ ID NO: 1528133 - RNA, 17 nt, Human
cggcucacugcagccuc

SEQ ID NO: 1528134 - RNA, 12 nt, Human
cggcuccaggcu

SEQ ID NO: 1528135 - RNA, 14 nt, Human
cgugcacacaccag

SEQ ID NO: 1528136 - RNA, 20 nt, Human
cguguaaccauggacccaau

SEQ ID NO: 1528137 - RNA, 18 nt, Human
cgugaguccuggcauggg

SEQ ID NO: 1528138 - RNA, 17 nt, Human
cgugaguccuggcaugg

SEQ ID NO: 1528139 - RNA, 17 nt, Human
cgugaggccagagacac

SEQ ID NO: 1528140 - RNA, 16 nt, Human
cgugaguccuggcaug

SEQ ID NO: 1528141 - RNA, 16 nt, Human
cgguuuuacugcagcu

SEQ ID NO: 1528142 - RNA, 13 nt, Human
cuccaagaauuuc

SEQ ID NO: 1528143 - RNA, 18 nt, Human
cuccaaccuggggggcag

SEQ ID NO: 1528144 - RNA, 14 nt, Human
cuccaagaauuucu

SEQ ID NO: 1528145 - RNA, 15 nt, Human
cuccaagaccuucuc

SEQ ID NO: 1528146 - RNA, 22 nt, Human
cuccaagaccuucuccuucacc

SEQ ID NO: 1528147 - RNA, 13 nt, Human
cuccaagcaggac

SEQ ID NO: 1528148 - RNA, 14 nt, Human
cuccaagcaggaca

SEQ ID NO: 1528149 - RNA, 22 nt, Human
cuccaagcaggacauggacaag

SEQ ID NO: 1528150 - RNA, 24 nt, Human
cuccaagcaggacauggacaagga

SEQ ID NO: 1528151 - RNA, 17 nt, Human
cuccaagcucccaggca

SEQ ID NO: 1528152 - RNA, 13 nt, Human
cuccacuuggucu

SEQ ID NO: 1528153 - RNA, 15 nt, Human
cuccacuuggucugu

SEQ ID NO: 1528154 - RNA, 16 nt, Human
cuccacuuggucugug

SEQ ID NO: 1528155 - RNA, 17 nt, Human
cuccacuuggucuguga

SEQ ID NO: 1528156 - RNA, 21 nt, Human
cuccacuuggucugugagaug

SEQ ID NO: 1528157 - RNA, 22 nt, Human
cuccacuuggucugugagaugc

SEQ ID NO: 1528158 - RNA, 13 nt, Human
cuccaagcuccca

SEQ ID NO: 1528159 - RNA, 14 nt, Human
cuccaagcucccag

SEQ ID NO: 1528160 - RNA, 15 nt, Human
cuccaagcucccagg

SEQ ID NO: 1528161 - RNA, 16 nt, Human
cuccaagcucccaggc

SEQ ID NO: 1528162 - RNA, 23 nt, Human
cuccacuuggucugugagaugcu

SEQ ID NO: 1528163 - RNA, 16 nt, Human
cuccacuuucuagcca

SEQ ID NO: 1528164 - RNA, 19 nt, Human
cuccacuuucuagccagag

SEQ ID NO: 1528165 - RNA, 20 nt, Human
cuccacuuucuagccagagg

SEQ ID NO: 1528166 - RNA, 21 nt, Human
cuccagggcuggacugaggcc

SEQ ID NO: 1528167 - RNA, 17 nt, Human
cuccagggcuggacuga

SEQ ID NO: 1528168 - RNA, 18 nt, Human
cuccagggcuggacugag

SEQ ID NO: 1528169 - RNA, 19 nt, Human
cuccagggcuggacugagg

SEQ ID NO: 1528170 - RNA, 20 nt, Human
cuccagggcuggacugaggc

SEQ ID NO: 1528171 - RNA, 12 nt, Human
cuccagggcugg

SEQ ID NO: 1528172 - RNA, 13 nt, Human
cuccagggcugga

SEQ ID NO: 1528173 - RNA, 14 nt, Human
cuccagggcuggac

SEQ ID NO: 1528174 - RNA, 15 nt, Human
cuccagggcuggacu

SEQ ID NO: 1528175 - RNA, 16 nt, Human
cuccagggcuggacug

SEQ ID NO: 1528176 - RNA, 14 nt, Human
cucguuaauuugua

SEQ ID NO: 1528177 - RNA, 13 nt, Human
cucgaacuggcug

SEQ ID NO: 1528178 - RNA, 14 nt, Human
cucgaacuggcugc

SEQ ID NO: 1528179 - RNA, 15 nt, Human
cucgaacuggcugca

SEQ ID NO: 1528180 - RNA, 16 nt, Human
cucgaacuggcugcaa

SEQ ID NO: 1528181 - RNA, 16 nt, Human
cuccucugcugcuggc

SEQ ID NO: 1528182 - RNA, 18 nt, Human
cuccucugcugcuggcug

SEQ ID NO: 1528183 - RNA, 16 nt, Human
cuccuggcccacugca

SEQ ID NO: 1528184 - RNA, 18 nt, Human
cuccuggcccacugcauc

SEQ ID NO: 1528185 - RNA, 22 nt, Human
cucccccagccccauccucugu

SEQ ID NO: 1528186 - RNA, 15 nt, Human
cucccccagccccau

SEQ ID NO: 1528187 - RNA, 20 nt, Human
cucccccagccccauccucu

SEQ ID NO: 1528188 - RNA, 15 nt, Human
cugaaacaacaaaua

SEQ ID NO: 1528189 - RNA, 13 nt, Human
cugaaacuucccu

SEQ ID NO: 1528190 - RNA, 23 nt, Human
cugaaggacauugcggacagcca

SEQ ID NO: 1528191 - RNA, 22 nt, Human
cugacaacacucauugaccuga

SEQ ID NO: 1528192 - RNA, 23 nt, Human
cugacaacacucauugaccugag

SEQ ID NO: 1528193 - RNA, 19 nt, Human
cugaaggccccgcccaggc

SEQ ID NO: 1528194 - RNA, 17 nt, Human
cugaaggcuggguucug

SEQ ID NO: 1528195 - RNA, 21 nt, Human
cugaaggccccgcccaggcuu

SEQ ID NO: 1528196 - RNA, 23 nt, Human
cucuugagccuugaacuuugacc

SEQ ID NO: 1528197 - RNA, 18 nt, Human
cucuugagccuugaacuu

SEQ ID NO: 1528198 - RNA, 17 nt, Human
cucuugagccuugaacu

SEQ ID NO: 1528199 - RNA, 16 nt, Human
cucuugagccuugaac

SEQ ID NO: 1528200 - RNA, 22 nt, Human
cucuuagaugcaguucugaaga

SEQ ID NO: 1528201 - RNA, 13 nt, Human
cucuuauugccca

SEQ ID NO: 1528202 - RNA, 14 nt, Human
cucuuauugcccac

SEQ ID NO: 1528203 - RNA, 15 nt, Human
cucuuauugcccacg

SEQ ID NO: 1528204 - RNA, 19 nt, Human
cucuuauugcccacgcugg

SEQ ID NO: 1528205 - RNA, 20 nt, Human
cucuuauugcccacgcugga

SEQ ID NO: 1528206 - RNA, 19 nt, Human
cucuuagcuccccuccaac

SEQ ID NO: 1528207 - RNA, 18 nt, Human
cucuuagcuccccuccaa

SEQ ID NO: 1528208 - RNA, 15 nt, Human
cucuuagcuccccuc

SEQ ID NO: 1528209 - RNA, 17 nt, Human
cucuuagcuccccucca

SEQ ID NO: 1528210 - RNA, 14 nt, Human
cucuucaaucucuu

SEQ ID NO: 1528211 - RNA, 19 nt, Human
cucuucagaucucuaacuu

SEQ ID NO: 1528212 - RNA, 18 nt, Human
cucuucagaucucuaacu

SEQ ID NO: 1528213 - RNA, 13 nt, Human
cucugcuccucuc

SEQ ID NO: 1528214 - RNA, 18 nt, Human
cucugcuccucuccccag

SEQ ID NO: 1528215 - RNA, 20 nt, Human
cucugcuccucuccccagca

SEQ ID NO: 1528216 - RNA, 13 nt, Human
cucugcagcaaua

SEQ ID NO: 1528217 - RNA, 21 nt, Human
cucugcacuccccugcugggu

SEQ ID NO: 1528218 - RNA, 20 nt, Human
cucugcacuccccugcuggg

SEQ ID NO: 1528219 - RNA, 14 nt, Human
cucugguccauaga

SEQ ID NO: 1528220 - RNA, 13 nt, Human
cucugcugacaga

SEQ ID NO: 1528221 - RNA, 14 nt, Human
cucugcugacagac

SEQ ID NO: 1528222 - RNA, 16 nt, Human
cucugcugacagacac

SEQ ID NO: 1528223 - RNA, 15 nt, Human
cucugguuaucuaau

SEQ ID NO: 1528224 - RNA, 15 nt, Human
cucugguccauagag

SEQ ID NO: 1528225 - RNA, 21 nt, Human
cugagaucaaaacgguuuuac

SEQ ID NO: 1528226 - RNA, 14 nt, Human
cugagcuuucugcu

SEQ ID NO: 1528227 - RNA, 16 nt, Human
cugagaugugaacaca

SEQ ID NO: 1528228 - RNA, 15 nt, Human
cugagcuuucugcua

SEQ ID NO: 1528229 - RNA, 23 nt, Human
cugaggacacuaaccacgcugga

SEQ ID NO: 1528230 - RNA, 21 nt, Human
cugaggaauccagacccggcu

SEQ ID NO: 1528231 - RNA, 20 nt, Human
cugaggacacuaaccacgcu

SEQ ID NO: 1528232 - RNA, 17 nt, Human
cugaggaauccagaccc

SEQ ID NO: 1528233 - RNA, 20 nt, Human
cugaggaauccagacccggc

SEQ ID NO: 1528234 - RNA, 20 nt, Human
cugaguacguugugcauuug

SEQ ID NO: 1528235 - RNA, 19 nt, Human
cugaguacguugugcauuu

SEQ ID NO: 1528236 - RNA, 17 nt, Human
cugaguacguugugcau

SEQ ID NO: 1528237 - RNA, 18 nt, Human
cugaguacguugugcauu

SEQ ID NO: 1528238 - RNA, 21 nt, Human
cugaguacguugugcauuugg

SEQ ID NO: 1528239 - RNA, 12 nt, Human
cugaggugggag

SEQ ID NO: 1528240 - RNA, 17 nt, Human
cugagaguagagucacu

SEQ ID NO: 1528241 - RNA, 21 nt, Human
cugagaggacuuuucuuugug

SEQ ID NO: 1528242 - RNA, 22 nt, Human
cugagaggacuuuucuuugugg

SEQ ID NO: 1528243 - RNA, 22 nt, Human
cugagacucgcgacaaugcaaa

SEQ ID NO: 1528244 - RNA, 21 nt, Human
cugagacucgcgacaaugcaa

SEQ ID NO: 1528245 - RNA, 23 nt, Human
cugagacagcccgggcucugccu

SEQ ID NO: 1528246 - RNA, 21 nt, Human
cugacccaugcugcccuguga

SEQ ID NO: 1528247 - RNA, 22 nt, Human
cugacccaugcugcccugugag

SEQ ID NO: 1528248 - RNA, 15 nt, Human
aguugaauuuuacau

SEQ ID NO: 1528249 - RNA, 19 nt, Human
aguuguaccgcaaugugac

SEQ ID NO: 1528250 - RNA, 18 nt, Human
aguuacagacaaagcgug

SEQ ID NO: 1528251 - RNA, 15 nt, Human
aguuguuacauuuuu

SEQ ID NO: 1528252 - RNA, 13 nt, Human
aguuguuacauuu

SEQ ID NO: 1528253 - RNA, 16 nt, Human
aguuguuacauuuuua

SEQ ID NO: 1528254 - RNA, 19 nt, Human
aguuguuacauuuuuaagu

SEQ ID NO: 1528255 - RNA, 23 nt, Human
agugugacaaggauugcuacugu

SEQ ID NO: 1528256 - RNA, 18 nt, Human
agugauuaccagggacug

SEQ ID NO: 1528257 - RNA, 16 nt, Human
aguccaagcauuuaga

SEQ ID NO: 1528258 - RNA, 21 nt, Human
aguccaagcauuuagauguau

SEQ ID NO: 1528259 - RNA, 15 nt, Human
agucauucagauaug

SEQ ID NO: 1528260 - RNA, 20 nt, Human
agucauucagauaugauuca

SEQ ID NO: 1528261 - RNA, 23 nt, Human
agucauucagauaugauucaaau

SEQ ID NO: 1528262 - RNA, 15 nt, Human
agucaaauuguguga

SEQ ID NO: 1528263 - RNA, 17 nt, Human
agucaaauugugugaaa

SEQ ID NO: 1528264 - RNA, 16 nt, Human
agucaagugaaaaagg

SEQ ID NO: 1528265 - RNA, 13 nt, Human
agucaaauugugu

SEQ ID NO: 1528266 - RNA, 20 nt, Human
agucaagugaaaaaggagga

SEQ ID NO: 1528267 - RNA, 13 nt, Human
agugauccuccca

SEQ ID NO: 1528268 - RNA, 18 nt, Human
auaucacuugucaauaaa

SEQ ID NO: 1528269 - RNA, 15 nt, Human
auauccuuucuaaca

SEQ ID NO: 1528270 - RNA, 16 nt, Human
auauccuuucuaacaa

SEQ ID NO: 1528271 - RNA, 22 nt, Human
auaugccugggcagaaggaaga

SEQ ID NO: 1528272 - RNA, 21 nt, Human
auaugcuuauacacuuacacu

SEQ ID NO: 1528273 - RNA, 14 nt, Human
auaugcuuauacac

SEQ ID NO: 1528274 - RNA, 16 nt, Human
auaugcuuauacacuu

SEQ ID NO: 1528275 - RNA, 19 nt, Human
auaugcuuauacacuuaca

SEQ ID NO: 1528276 - RNA, 23 nt, Human
auauuucagauaaucacaauaca

SEQ ID NO: 1528277 - RNA, 14 nt, Human
auauuuauuacugu

SEQ ID NO: 1528278 - RNA, 19 nt, Human
auauuuauuacuguaagaa

SEQ ID NO: 1528279 - RNA, 18 nt, Human
auauuuauuuuaauaaug

SEQ ID NO: 1528280 - RNA, 22 nt, Human
auauuuauuacuguaagaaaau

SEQ ID NO: 1528281 - RNA, 17 nt, Human
auauucaggaagcucag

SEQ ID NO: 1528282 - RNA, 14 nt, Human
auauucaggaagcu

SEQ ID NO: 1528283 - RNA, 16 nt, Human
auauucaggaagcuca

SEQ ID NO: 1528284 - RNA, 13 nt, Human
auauucaggaagc

SEQ ID NO: 1528285 - RNA, 16 nt, Human
auauaggaacuuaaau

SEQ ID NO: 1528286 - RNA, 16 nt, Human
auaguaugguggcugg

SEQ ID NO: 1528287 - RNA, 22 nt, Human
auauaaguauucuaaauuuuau

SEQ ID NO: 1528288 - RNA, 15 nt, Human
auaguaugguggcug

SEQ ID NO: 1528289 - RNA, 18 nt, Human
auaaugugaaacuggauu

SEQ ID NO: 1528290 - RNA, 21 nt, Human
auaaugugaaacuggauuaaa

SEQ ID NO: 1528291 - RNA, 19 nt, Human
auaaugugaaacuggauua

SEQ ID NO: 1528292 - RNA, 14 nt, Human
auaauuacuauguc

SEQ ID NO: 1528293 - RNA, 17 nt, Human
auaccugggauacugug

SEQ ID NO: 1528294 - RNA, 20 nt, Human
auaccugggauacugugccc

SEQ ID NO: 1528295 - RNA, 13 nt, Human
auaccuguccccc

SEQ ID NO: 1528296 - RNA, 12 nt, Human
auaccugucccc

SEQ ID NO: 1528297 - RNA, 20 nt, Human
auguucuuucacccuuuucu

SEQ ID NO: 1528298 - RNA, 15 nt, Human
auguucuuaauucuu

SEQ ID NO: 1528299 - RNA, 20 nt, Human
auguucuuaguggauguucu

SEQ ID NO: 1528300 - RNA, 22 nt, Human
auguucugacccugcuucaaau

SEQ ID NO: 1528301 - RNA, 18 nt, Human
auguucucugaggacacu

SEQ ID NO: 1528302 - RNA, 14 nt, Human
auguuugccucugc

SEQ ID NO: 1528303 - RNA, 16 nt, Human
auguuuuaagaggcag

SEQ ID NO: 1528304 - RNA, 18 nt, Human
auguuuuaagaggcaggg

SEQ ID NO: 1528305 - RNA, 14 nt, Human
auuaaaugcccagc

SEQ ID NO: 1528306 - RNA, 15 nt, Human
auuaaaugcccagcc

SEQ ID NO: 1528307 - RNA, 16 nt, Human
auuaaaugcccagccc

SEQ ID NO: 1528308 - RNA, 13 nt, Human
auuaaauucuugc

SEQ ID NO: 1528309 - RNA, 16 nt, Human
augugggucaaggaau

SEQ ID NO: 1528310 - RNA, 16 nt, Human
auguaaguaaacgguc

SEQ ID NO: 1528311 - RNA, 17 nt, Human
auguaauaacugugaag

SEQ ID NO: 1528312 - RNA, 17 nt, Human
auguaagcucuacugag

SEQ ID NO: 1528313 - RNA, 21 nt, Human
auguaagggaaacugccagca

SEQ ID NO: 1528314 - RNA, 22 nt, Human
auguaagggaaacugccagcaa

SEQ ID NO: 1528315 - RNA, 16 nt, Human
augucaaucagccuag

SEQ ID NO: 1528316 - RNA, 15 nt, Human
augucacaggcaggu

SEQ ID NO: 1528317 - RNA, 16 nt, Human
augucacaggcagguc

SEQ ID NO: 1528318 - RNA, 17 nt, Human
augucacaggcaggucc

SEQ ID NO: 1528319 - RNA, 18 nt, Human
auggcuggagcuagaauu

SEQ ID NO: 1528320 - RNA, 23 nt, Human
auggcugccaaugggagcucaug

SEQ ID NO: 1528321 - RNA, 21 nt, Human
augggaaugaaugucagugug

SEQ ID NO: 1528322 - RNA, 15 nt, Human
augggaaugaauguc

SEQ ID NO: 1528323 - RNA, 11 nt, Human
auggaacacuc

SEQ ID NO: 1528324 - RNA, 19 nt, Human
auggaaaugggcagagcag

SEQ ID NO: 1528325 - RNA, 20 nt, Human
auggaaaugggcagagcaga

SEQ ID NO: 1528326 - RNA, 14 nt, Human
augccuuuucccaa

SEQ ID NO: 1528327 - RNA, 14 nt, Human
augccuuuuauuuc

SEQ ID NO: 1528328 - RNA, 23 nt, Human
augcaugaaguaauaugcacaca

SEQ ID NO: 1528329 - RNA, 18 nt, Human
augcauuugaaaauuuug

SEQ ID NO: 1528330 - RNA, 12 nt, Human
augcauuugaaa

SEQ ID NO: 1528331 - RNA, 10 nt, Human
augcauuuga

SEQ ID NO: 1528332 - RNA, 21 nt, Human
augccuggauggggcugcacc

SEQ ID NO: 1528333 - RNA, 23 nt, Human
augccuggauggggcugcaccgg

SEQ ID NO: 1528334 - RNA, 17 nt, Human
augccugggcagaagga

SEQ ID NO: 1528335 - RNA, 11 nt, Human
augccuggugg

SEQ ID NO: 1528336 - RNA, 15 nt, Human
augccugguggcagc

SEQ ID NO: 1528337 - RNA, 16 nt, Human
augccugguggcagcu

SEQ ID NO: 1528338 - RNA, 17 nt, Human
augccugguggcagcug

SEQ ID NO: 1528339 - RNA, 18 nt, Human
augccugguggcagcugc

SEQ ID NO: 1528340 - RNA, 21 nt, Human
augcacagcuaacauggaagu

SEQ ID NO: 1528341 - RNA, 23 nt, Human
augcacacauuuuuuaaaugcac

SEQ ID NO: 1528342 - RNA, 14 nt, Human
augcacagcuaaca

SEQ ID NO: 1528343 - RNA, 22 nt, Human
augcacacauuuuuuaaaugca

SEQ ID NO: 1528344 - RNA, 19 nt, Human
augcacacauuuuuuaaau

SEQ ID NO: 1528345 - RNA, 17 nt, Human
augcacacauuuuuuaa

SEQ ID NO: 1528346 - RNA, 19 nt, Human
augaugugggucaaggaau

SEQ ID NO: 1528347 - RNA, 20 nt, Human
augaaacacucaguuguuca

SEQ ID NO: 1528348 - RNA, 14 nt, Human
augacucagaauau

SEQ ID NO: 1528349 - RNA, 17 nt, Human
augacuccagaauuucc

SEQ ID NO: 1528350 - RNA, 12 nt, Human
augacuccagaa

SEQ ID NO: 1528351 - RNA, 16 nt, Human
augacuccagaauuuc

SEQ ID NO: 1528352 - RNA, 12 nt, Human
augacccagugg

SEQ ID NO: 1528353 - RNA, 13 nt, Human
augagccuggcaa

SEQ ID NO: 1528354 - RNA, 14 nt, Human
augagccuggcaag

SEQ ID NO: 1528355 - RNA, 22 nt, Human
aucuuauaauuuaaaauaugcu

SEQ ID NO: 1528356 - RNA, 19 nt, Human
aucuuccaacucaaacucu

SEQ ID NO: 1528357 - RNA, 22 nt, Human
aucucucgugauugauaagaac

SEQ ID NO: 1528358 - RNA, 17 nt, Human
aucucucuuuaauauaa

SEQ ID NO: 1528359 - RNA, 13 nt, Human
aucugcucuccuu

SEQ ID NO: 1528360 - RNA, 14 nt, Human
aucugcucuccuuc

SEQ ID NO: 1528361 - RNA, 15 nt, Human
aucugcucuccuucc

SEQ ID NO: 1528362 - RNA, 16 nt, Human
aucugcucuccuuccu

SEQ ID NO: 1528363 - RNA, 17 nt, Human
aucugcucuccuuccug

SEQ ID NO: 1528364 - RNA, 20 nt, Human
aucugcucuccuuccuggag

SEQ ID NO: 1528365 - RNA, 21 nt, Human
aucugcucuccuuccuggagc

SEQ ID NO: 1528366 - RNA, 17 nt, Human
aucuugaagacuuuucu

SEQ ID NO: 1528367 - RNA, 22 nt, Human
aucuucugaacuuggcgcugcc

SEQ ID NO: 1528368 - RNA, 17 nt, Human
aucuucuuuauaauucu

SEQ ID NO: 1528369 - RNA, 17 nt, Human
aucagccugcuccagcu

SEQ ID NO: 1528370 - RNA, 17 nt, Human
aucagcugcugaaacaa

SEQ ID NO: 1528371 - RNA, 13 nt, Human
aucagcugcuacu

SEQ ID NO: 1528372 - RNA, 23 nt, Human
aucagcugcuacuacuccuguag

SEQ ID NO: 1528373 - RNA, 11 nt, Human
aucagccuggg

SEQ ID NO: 1528374 - RNA, 20 nt, Human
aucagccugggcaaugugau

SEQ ID NO: 1528375 - RNA, 21 nt, Human
aucagccugggcaaugugaua

SEQ ID NO: 1528376 - RNA, 12 nt, Human
aucagcugcuac

SEQ ID NO: 1528377 - RNA, 18 nt, Human
auccacccaccucagccu

SEQ ID NO: 1528378 - RNA, 20 nt, Human
auccacccaccucagccucc

SEQ ID NO: 1528379 - RNA, 15 nt, Human
aucccuacuguaauu

SEQ ID NO: 1528380 - RNA, 13 nt, Human
aucccucauccuc

SEQ ID NO: 1528381 - RNA, 18 nt, Human
auccucauacccaccccc

SEQ ID NO: 1528382 - RNA, 19 nt, Human
auccucauacccaccccca

SEQ ID NO: 1528383 - RNA, 22 nt, Human
auccucauacccacccccaccc

SEQ ID NO: 1528384 - RNA, 13 nt, Human
aucgaugcagugc

SEQ ID NO: 1528385 - RNA, 14 nt, Human
auccuccucagauc

SEQ ID NO: 1528386 - RNA, 13 nt, Human
auccuuucuaaca

SEQ ID NO: 1528387 - RNA, 23 nt, Human
auccucauacccacccccaccca

SEQ ID NO: 1528388 - RNA, 11 nt, Human
auccuccucag

SEQ ID NO: 1528389 - RNA, 14 nt, Human
auccuccaggugca

SEQ ID NO: 1528390 - RNA, 19 nt, Human
auccuccaggugcacaagc

SEQ ID NO: 1528391 - RNA, 22 nt, Human
auccuccaggugcacaagcucc

SEQ ID NO: 1528392 - RNA, 14 nt, Human
aggaccucgugcca

SEQ ID NO: 1528393 - RNA, 14 nt, Human
aggaccucagguga

SEQ ID NO: 1528394 - RNA, 20 nt, Human
aggaccucaggugagaagca

SEQ ID NO: 1528395 - RNA, 15 nt, Human
aggagagcuagcagc

SEQ ID NO: 1528396 - RNA, 15 nt, Human
aggagaggagagggg

SEQ ID NO: 1528397 - RNA, 16 nt, Human
aggagaggggcacagg

SEQ ID NO: 1528398 - RNA, 18 nt, Human
aggagaggggcacagggu

SEQ ID NO: 1528399 - RNA, 14 nt, Human
aggaccccagcucu

SEQ ID NO: 1528400 - RNA, 16 nt, Human
aggaccccagcucugc

SEQ ID NO: 1528401 - RNA, 20 nt, Human
aggaccccuccaugugggcu

SEQ ID NO: 1528402 - RNA, 17 nt, Human
aggaccccagcucugcg

SEQ ID NO: 1528403 - RNA, 17 nt, Human
aggagaguagaacagau

SEQ ID NO: 1528404 - RNA, 17 nt, Human
aggaggggauagagaga

SEQ ID NO: 1528405 - RNA, 17 nt, Human
aggauguugaaaaaguu

SEQ ID NO: 1528406 - RNA, 14 nt, Human
aggauguugaaaaa

SEQ ID NO: 1528407 - RNA, 20 nt, Human
aggauguucugggacacagu

SEQ ID NO: 1528408 - RNA, 16 nt, Human
aggauucuuccucccu

SEQ ID NO: 1528409 - RNA, 12 nt, Human
aggauucuuccu

SEQ ID NO: 1528410 - RNA, 14 nt, Human
agcuguaugauucc

SEQ ID NO: 1528411 - RNA, 13 nt, Human
aggaaaaacugau

SEQ ID NO: 1528412 - RNA, 15 nt, Human
aggaaaaacugauuu

SEQ ID NO: 1528413 - RNA, 19 nt, Human
agcuuccuucugugaaagu

SEQ ID NO: 1528414 - RNA, 17 nt, Human
agcugggugucaagagg

SEQ ID NO: 1528415 - RNA, 22 nt, Human
agcugggugucaagagggucug

SEQ ID NO: 1528416 - RNA, 21 nt, Human
agcuggucccacucaguccau

SEQ ID NO: 1528417 - RNA, 15 nt, Human
aggggcacagggucu

SEQ ID NO: 1528418 - RNA, 21 nt, Human
aggggauagagagagaccacu

SEQ ID NO: 1528419 - RNA, 19 nt, Human
agggcgggaggauguucug

SEQ ID NO: 1528420 - RNA, 18 nt, Human
agggccuggccugagcug

SEQ ID NO: 1528421 - RNA, 17 nt, Human
agggcacaccgggcacu

SEQ ID NO: 1528422 - RNA, 22 nt, Human
agggcacagaaaauggaagaca

SEQ ID NO: 1528423 - RNA, 20 nt, Human
agggcacaccgggcacucag

SEQ ID NO: 1528424 - RNA, 21 nt, Human
agggcacaccgggcacucaga

SEQ ID NO: 1528425 - RNA, 15 nt, Human
agggccuggccugag

SEQ ID NO: 1528426 - RNA, 16 nt, Human
agggccuggccugagc

SEQ ID NO: 1528427 - RNA, 17 nt, Human
agggccuggccugagcu

SEQ ID NO: 1528428 - RNA, 23 nt, Human
aggcuagugugguguuuccuggc

SEQ ID NO: 1528429 - RNA, 18 nt, Human
aggcugccucucccauca

SEQ ID NO: 1528430 - RNA, 21 nt, Human
agggacgcuacccgggaaggg

SEQ ID NO: 1528431 - RNA, 12 nt, Human
agggacagaggg

SEQ ID NO: 1528432 - RNA, 13 nt, Human
agggacagagggg

SEQ ID NO: 1528433 - RNA, 20 nt, Human
agggacagaggggguggccu

SEQ ID NO: 1528434 - RNA, 14 nt, Human
aggucgaggcagga

SEQ ID NO: 1528435 - RNA, 16 nt, Human
aggugcugccauccag

SEQ ID NO: 1528436 - RNA, 17 nt, Human
aggugcugccauccagg

SEQ ID NO: 1528437 - RNA, 13 nt, Human
agguucagcuugu

SEQ ID NO: 1528438 - RNA, 13 nt, Human
agguucccuuuga

SEQ ID NO: 1528439 - RNA, 17 nt, Human
agguucaaagauauuuu

SEQ ID NO: 1528440 - RNA, 14 nt, Human
agguuaauguucau

SEQ ID NO: 1528441 - RNA, 15 nt, Human
agguuaauuccaauu

SEQ ID NO: 1528442 - RNA, 22 nt, Human
agguuaauuccaauuauaugag

SEQ ID NO: 1528443 - RNA, 22 nt, Human
agguacgaaaagaggggaagag

SEQ ID NO: 1528444 - RNA, 17 nt, Human
agguaaggaauaccugu

SEQ ID NO: 1528445 - RNA, 15 nt, Human
agccagauuuuccug

SEQ ID NO: 1528446 - RNA, 19 nt, Human
agccagauuuuccugaaaa

SEQ ID NO: 1528447 - RNA, 16 nt, Human
agcccaaagaaggaaa

SEQ ID NO: 1528448 - RNA, 22 nt, Human
agccaaggccaaaggaagcaca

SEQ ID NO: 1528449 - RNA, 23 nt, Human
agccaaggccaaaggaagcacau

SEQ ID NO: 1528450 - RNA, 15 nt, Human
agcaugcaccacggg

SEQ ID NO: 1528451 - RNA, 20 nt, Human
agccagaggagagaggaccc

SEQ ID NO: 1528452 - RNA, 12 nt, Human
agcaugccugga

SEQ ID NO: 1528453 - RNA, 20 nt, Human
agcaugccuggauggggcug

SEQ ID NO: 1528454 - RNA, 19 nt, Human
agccaaagcuaggccuggc

SEQ ID NO: 1528455 - RNA, 20 nt, Human
agccaaagcuaggccuggcc

SEQ ID NO: 1528456 - RNA, 23 nt, Human
agccaaagcuaggccuggccaga

SEQ ID NO: 1528457 - RNA, 21 nt, Human
agcagccacauuccugaugcu

SEQ ID NO: 1528458 - RNA, 20 nt, Human
agcacuaaggugugcucuga

SEQ ID NO: 1528459 - RNA, 19 nt, Human
agcacuaaggugugcucug

SEQ ID NO: 1528460 - RNA, 23 nt, Human
agcaguugaaaagacuccaaaga

SEQ ID NO: 1528461 - RNA, 14 nt, Human
agauguagaggaga

SEQ ID NO: 1528462 - RNA, 21 nt, Human
agaugggagaaucacuugaac

SEQ ID NO: 1528463 - RNA, 16 nt, Human
agauguagaggagaaa

SEQ ID NO: 1528464 - RNA, 20 nt, Human
agccucccaaagugcuggga

SEQ ID NO: 1528465 - RNA, 18 nt, Human
agccucccgaauagcugg

SEQ ID NO: 1528466 - RNA, 19 nt, Human
agccucccgaauagcuggg

SEQ ID NO: 1528467 - RNA, 20 nt, Human
agccucccgaauagcuggga

SEQ ID NO: 1528468 - RNA, 22 nt, Human
agccucccgaauagcugggacu

SEQ ID NO: 1528469 - RNA, 17 nt, Human
agccucccgaguagcug

SEQ ID NO: 1528470 - RNA, 18 nt, Human
agccucccaaagugcugg

SEQ ID NO: 1528471 - RNA, 19 nt, Human
agccucccaaagugcuggg

SEQ ID NO: 1528472 - RNA, 14 nt, Human
agccgcuggggcca

SEQ ID NO: 1528473 - RNA, 22 nt, Human
agccgcuggggccaguuggucc

SEQ ID NO: 1528474 - RNA, 20 nt, Human
agccgagauugcaccacugc

SEQ ID NO: 1528475 - RNA, 21 nt, Human
agccgagaucacgccacugca

SEQ ID NO: 1528476 - RNA, 19 nt, Human
agccgagauugcaccacug

SEQ ID NO: 1528477 - RNA, 16 nt, Human
agccccagugcccaca

SEQ ID NO: 1528478 - RNA, 20 nt, Human
agccccaucccaaacccuuc

SEQ ID NO: 1528479 - RNA, 11 nt, Human
agccccauccu

SEQ ID NO: 1528480 - RNA, 15 nt, Human
agcccugagcuuucu

SEQ ID NO: 1528481 - RNA, 19 nt, Human
agccgagaucacgccacug

SEQ ID NO: 1528482 - RNA, 20 nt, Human
agccgagaucacgccacugc

SEQ ID NO: 1528483 - RNA, 13 nt, Human
agacggggcugga

SEQ ID NO: 1528484 - RNA, 18 nt, Human
agacgggggcagagaggg

SEQ ID NO: 1528485 - RNA, 19 nt, Human
agacggagucccaccuugg

SEQ ID NO: 1528486 - RNA, 21 nt, Human
agacagcccgggcucugccuc

SEQ ID NO: 1528487 - RNA, 17 nt, Human
agacagcccgggcucug

SEQ ID NO: 1528488 - RNA, 14 nt, Human
agacacaacuauuu

SEQ ID NO: 1528489 - RNA, 19 nt, Human
agacacaacuauuuuucca

SEQ ID NO: 1528490 - RNA, 18 nt, Human
agacagcccgggcucugc

SEQ ID NO: 1528491 - RNA, 20 nt, Human
agacagcccgggcucugccu

SEQ ID NO: 1528492 - RNA, 13 nt, Human
agaccaucccuga

SEQ ID NO: 1528493 - RNA, 14 nt, Human
agaccaucccugaa

SEQ ID NO: 1528494 - RNA, 17 nt, Human
agaccaucccugaaggc

SEQ ID NO: 1528495 - RNA, 18 nt, Human
agaccaucccugaaggcc

SEQ ID NO: 1528496 - RNA, 21 nt, Human
agaccaucccugaaggccccg

SEQ ID NO: 1528497 - RNA, 21 nt, Human
agacaauuuauuauggcacau

SEQ ID NO: 1528498 - RNA, 15 nt, Human
agacaauuuauuaug

SEQ ID NO: 1528499 - RNA, 19 nt, Human
agacaaugacuuacuguac

SEQ ID NO: 1528500 - RNA, 17 nt, Human
agacaaugacuuacugu

SEQ ID NO: 1528501 - RNA, 13 nt, Human
agacaaugacuua

SEQ ID NO: 1528502 - RNA, 17 nt, Human
agacugcauuauauuua

SEQ ID NO: 1528503 - RNA, 21 nt, Human
agacugcauuauauuuauuac

SEQ ID NO: 1528504 - RNA, 18 nt, Human
agagaaaguacuucucca

SEQ ID NO: 1528505 - RNA, 10 nt, Human
agagaagaga

SEQ ID NO: 1528506 - RNA, 21 nt, Human
agagaagagauugugguuuca

SEQ ID NO: 1528507 - RNA, 21 nt, Human
agauaggucagugcaaauacu

SEQ ID NO: 1528508 - RNA, 15 nt, Human
agauagccaaggcca

SEQ ID NO: 1528509 - RNA, 16 nt, Human
agauagccaaggccaa

SEQ ID NO: 1528510 - RNA, 14 nt, Human
agaucuucuguggg

SEQ ID NO: 1528511 - RNA, 13 nt, Human
agauagccaaggc

SEQ ID NO: 1528512 - RNA, 22 nt, Human
agauacuuggggggcugaggug

SEQ ID NO: 1528513 - RNA, 13 nt, Human
agaggagaggggc

SEQ ID NO: 1528514 - RNA, 16 nt, Human
agaggggaagagacuu

SEQ ID NO: 1528515 - RNA, 22 nt, Human
agaggggaacagacuggaagca

SEQ ID NO: 1528516 - RNA, 14 nt, Human
aauuaguuuuauau

SEQ ID NO: 1528517 - RNA, 17 nt, Human
aauuaguuuuauaugcu

SEQ ID NO: 1528518 - RNA, 20 nt, Human
aauuaguuuuauaugcuucu

SEQ ID NO: 1528519 - RNA, 18 nt, Human
aauuaguggcacuugcuu

SEQ ID NO: 1528520 - RNA, 14 nt, Human
aauuaaauuuugag

SEQ ID NO: 1528521 - RNA, 22 nt, Human
aauuaaauuuugaguucuacau

SEQ ID NO: 1528522 - RNA, 18 nt, Human
aauguuugccucugccuc

SEQ ID NO: 1528523 - RNA, 19 nt, Human
aauguuugccucugccucu

SEQ ID NO: 1528524 - RNA, 18 nt, Human
aauuaaaacacaacaucu

SEQ ID NO: 1528525 - RNA, 15 nt, Human
aaugucagugugacu

SEQ ID NO: 1528526 - RNA, 16 nt, Human
aaugucagugugacug

SEQ ID NO: 1528527 - RNA, 13 nt, Human
aaugucaguguga

SEQ ID NO: 1528528 - RNA, 20 nt, Human
aaugucucuuuaaugucaca

SEQ ID NO: 1528529 - RNA, 17 nt, Human
aaugucucugugagacu

SEQ ID NO: 1528530 - RNA, 18 nt, Human
aaugucucugugagacuc

SEQ ID NO: 1528531 - RNA, 22 nt, Human
aaugucuaguuguaacaccaug

SEQ ID NO: 1528532 - RNA, 17 nt, Human
aaugucagugugacuga

SEQ ID NO: 1528533 - RNA, 21 nt, Human
aaugucagugugacugaucuc

SEQ ID NO: 1528534 - RNA, 15 nt, Human
aaugggcagagcaga

SEQ ID NO: 1528535 - RNA, 13 nt, Human
aaugggcagagca

SEQ ID NO: 1528536 - RNA, 12 nt, Human
aaugaagauacu

SEQ ID NO: 1528537 - RNA, 17 nt, Human
aaugauaacuggaaacu

SEQ ID NO: 1528538 - RNA, 20 nt, Human
aaugauaacuggaaacuuca

SEQ ID NO: 1528539 - RNA, 17 nt, Human
aaugaagauacugaaau

SEQ ID NO: 1528540 - RNA, 18 nt, Human
aaugauaaguaaaugcua

SEQ ID NO: 1528541 - RNA, 21 nt, Human
aaugauaaguaaaugcuaggu

SEQ ID NO: 1528542 - RNA, 21 nt, Human
aaugaugauccuaggcauuug

SEQ ID NO: 1528543 - RNA, 16 nt, Human
aaugaaccacaucuug

SEQ ID NO: 1528544 - RNA, 17 nt, Human
aaugaaccacaucuugc

SEQ ID NO: 1528545 - RNA, 23 nt, Human
aaugaaccacaucuugcucugcu

SEQ ID NO: 1528546 - RNA, 22 nt, Human
aaucugcuuuuuaaagaaugcu

SEQ ID NO: 1528547 - RNA, 13 nt, Human
aauccauacauuu

SEQ ID NO: 1528548 - RNA, 14 nt, Human
aauccauacauuug

SEQ ID NO: 1528549 - RNA, 18 nt, Human
aaucuccaaaauaaaacu

SEQ ID NO: 1528550 - RNA, 14 nt, Human
aaucuccaaaauaa

SEQ ID NO: 1528551 - RNA, 13 nt, Human
aaucuccaaaaua

SEQ ID NO: 1528552 - RNA, 18 nt, Human
aaucucauaauuuauaca

SEQ ID NO: 1528553 - RNA, 17 nt, Human
aaugaucuuuucaaguu

SEQ ID NO: 1528554 - RNA, 19 nt, Human
aaugaugccaugaggaaca

SEQ ID NO: 1528555 - RNA, 13 nt, Human
aaucacaauacau

SEQ ID NO: 1528556 - RNA, 15 nt, Human
aaucaagaaacuuaa

SEQ ID NO: 1528557 - RNA, 16 nt, Human
aauauuauguuaaaac

SEQ ID NO: 1528558 - RNA, 14 nt, Human
aauauuauguguuu

SEQ ID NO: 1528559 - RNA, 18 nt, Human
aauaugguguacauucuu

SEQ ID NO: 1528560 - RNA, 21 nt, Human
aauauaggaacuuaaauaaug

SEQ ID NO: 1528561 - RNA, 20 nt, Human
aauauaggaacuuaaauaau

SEQ ID NO: 1528562 - RNA, 18 nt, Human
aauauaggaacuuaaaua

SEQ ID NO: 1528563 - RNA, 17 nt, Human
aauaaacgucuuaaaua

SEQ ID NO: 1528564 - RNA, 16 nt, Human
aauaaacgucuuaaau

SEQ ID NO: 1528565 - RNA, 21 nt, Human
aauaauccuaaacauaugaau

SEQ ID NO: 1528566 - RNA, 16 nt, Human
aauaaugugaaacugg

SEQ ID NO: 1528567 - RNA, 11 nt, Human
aauaaugucuc

SEQ ID NO: 1528568 - RNA, 12 nt, Human
aauaaugucucu

SEQ ID NO: 1528569 - RNA, 13 nt, Human
aauaaugucucug

SEQ ID NO: 1528570 - RNA, 18 nt, Human
aaguauguguaaaaugug

SEQ ID NO: 1528571 - RNA, 17 nt, Human
aaguaucccuacuguaa

SEQ ID NO: 1528572 - RNA, 16 nt, Human
aaguaucccuacugua

SEQ ID NO: 1528573 - RNA, 11 nt, Human
aaguacuucuu

SEQ ID NO: 1528574 - RNA, 15 nt, Human
aagguuaauaaagua

SEQ ID NO: 1528575 - RNA, 16 nt, Human
aagguuaauaaaguaa

SEQ ID NO: 1528576 - RNA, 20 nt, Human
aagguuaauguucaucaucc

SEQ ID NO: 1528577 - RNA, 13 nt, Human
aagguuguauugc

SEQ ID NO: 1528578 - RNA, 17 nt, Human
aagguuguauugcauau

SEQ ID NO: 1528579 - RNA, 11 nt, Human
aaggugggagg

SEQ ID NO: 1528580 - RNA, 17 nt, Human
aagucuuagauguauau

SEQ ID NO: 1528581 - RNA, 16 nt, Human
aagucuuagauguaua

SEQ ID NO: 1528582 - RNA, 11 nt, Human
aagcugggcag

SEQ ID NO: 1528583 - RNA, 15 nt, Human
aagcugggcagguug

SEQ ID NO: 1528584 - RNA, 13 nt, Human
aagcugggcaggu

SEQ ID NO: 1528585 - RNA, 18 nt, Human
aaggacauugcggacagc

SEQ ID NO: 1528586 - RNA, 22 nt, Human
aagcugcacccucaggcaggug

SEQ ID NO: 1528587 - RNA, 21 nt, Human
aagcugcacccucaggcaggu

SEQ ID NO: 1528588 - RNA, 20 nt, Human
aagcugcacccucaggcagg

SEQ ID NO: 1528589 - RNA, 12 nt, Human
aagcguggugga

SEQ ID NO: 1528590 - RNA, 17 nt, Human
aaggcaaggcugucaau

SEQ ID NO: 1528591 - RNA, 18 nt, Human
aaggcaaggcugucaauu

SEQ ID NO: 1528592 - RNA, 16 nt, Human
aagauuuaccacuugu

SEQ ID NO: 1528593 - RNA, 13 nt, Human
aagccagauuuuc

SEQ ID NO: 1528594 - RNA, 19 nt, Human
aagccagauuuuccugaaa

SEQ ID NO: 1528595 - RNA, 14 nt, Human
aagcagaggaagga

SEQ ID NO: 1528596 - RNA, 13 nt, Human
aagauuuucagaa

SEQ ID NO: 1528597 - RNA, 21 nt, Human
aagcagaggaaggagaggaga

SEQ ID NO: 1528598 - RNA, 12 nt, Human
aaauaacaauga

SEQ ID NO: 1528599 - RNA, 11 nt, Human
aaagugcuggg

SEQ ID NO: 1528600 - RNA, 14 nt, Human
aaagugcugggauu

SEQ ID NO: 1528601 - RNA, 18 nt, Human
aaauggcuuccuggcaau

SEQ ID NO: 1528602 - RNA, 20 nt, Human
aaauggacguguuaugacuc

SEQ ID NO: 1528603 - RNA, 21 nt, Human
aaauggacguguuaugacucc

SEQ ID NO: 1528604 - RNA, 22 nt, Human
aaauggacguguuaugacucca

SEQ ID NO: 1528605 - RNA, 16 nt, Human
aaauggaaaugggcag

SEQ ID NO: 1528606 - RNA, 18 nt, Human
aaauggaagacagcucuu

SEQ ID NO: 1528607 - RNA, 18 nt, Human
aaaucaaauaugcaaagc

SEQ ID NO: 1528608 - RNA, 19 nt, Human
aaaucaaauaugcaaagca

SEQ ID NO: 1528609 - RNA, 14 nt, Human
aaauaguauuugag

SEQ ID NO: 1528610 - RNA, 19 nt, Human
aaauaguggugugauuugg

SEQ ID NO: 1528611 - RNA, 14 nt, Human
aaauauaauugaca

SEQ ID NO: 1528612 - RNA, 18 nt, Human
aaacacuguucucugccc

SEQ ID NO: 1528613 - RNA, 13 nt, Human
aaaauucagugga

SEQ ID NO: 1528614 - RNA, 15 nt, Human
aaaacacauuuuucu

SEQ ID NO: 1528615 - RNA, 13 nt, Human
aaaacacauuuuu

SEQ ID NO: 1528616 - RNA, 19 nt, Human
aaacacuguucucugcccu

SEQ ID NO: 1528617 - RNA, 22 nt, Human
aaacacuguucucugcccucca

SEQ ID NO: 1528618 - RNA, 19 nt, Human
aaacugccagcaacgcagg

SEQ ID NO: 1528619 - RNA, 16 nt, Human
aaacugacucuuaaga

SEQ ID NO: 1528620 - RNA, 17 nt, Human
aaacugacucuuaagaa

SEQ ID NO: 1528621 - RNA, 14 nt, Human
aaacugccagcaac

SEQ ID NO: 1528622 - RNA, 15 nt, Human
aaacugccagcaacg

SEQ ID NO: 1528623 - RNA, 17 nt, Human
aaagaugaaaauauuug

SEQ ID NO: 1528624 - RNA, 13 nt, Human
aaagaugaaaaua

SEQ ID NO: 1528625 - RNA, 16 nt, Human
aaagaugaaaauauuu

SEQ ID NO: 1528626 - RNA, 16 nt, Human
aacuuuggaacaagau

SEQ ID NO: 1528627 - RNA, 20 nt, Human
aacuuugaccucugcagcaa

SEQ ID NO: 1528628 - RNA, 19 nt, Human
aacuuugaccucugcagca

SEQ ID NO: 1528629 - RNA, 15 nt, Human
aacuuuuauaaacuu

SEQ ID NO: 1528630 - RNA, 12 nt, Human
aacuuuuauaaa

SEQ ID NO: 1528631 - RNA, 17 nt, Human
aacuuugaccucugcag

SEQ ID NO: 1528632 - RNA, 14 nt, Human
aacuuugaccucug

SEQ ID NO: 1528633 - RNA, 13 nt, Human
aacuuugaccucu

SEQ ID NO: 1528634 - RNA, 13 nt, Human
aagaaauguaagg

SEQ ID NO: 1528635 - RNA, 14 nt, Human
aagaaauguaaggg

SEQ ID NO: 1528636 - RNA, 19 nt, Human
aacuuuuauaaacuuuacc

SEQ ID NO: 1528637 - RNA, 16 nt, Human
aacuuuuauaaacuuu

SEQ ID NO: 1528638 - RNA, 17 nt, Human
aacugauuuuuuuuucc

SEQ ID NO: 1528639 - RNA, 20 nt, Human
aacugauuuuuuuuuccuuc

SEQ ID NO: 1528640 - RNA, 19 nt, Human
aacugauuuuuuuuuccuu

SEQ ID NO: 1528641 - RNA, 17 nt, Human
aacuuaaauaaugugaa

SEQ ID NO: 1528642 - RNA, 19 nt, Human
aacuuaaauaaugugaaac

SEQ ID NO: 1528643 - RNA, 12 nt, Human
aacucaccccag

SEQ ID NO: 1528644 - RNA, 14 nt, Human
aacucaauauuuuc

SEQ ID NO: 1528645 - RNA, 20 nt, Human
aacucaauauuuuccaugaa

SEQ ID NO: 1528646 - RNA, 21 nt, Human
aacucaauauuuuccaugaaa

SEQ ID NO: 1528647 - RNA, 12 nt, Human
aacucaauauuu

SEQ ID NO: 1528648 - RNA, 13 nt, Human
aacucaauauuuu

SEQ ID NO: 1528649 - RNA, 15 nt, Human
aacucaccccagccc

SEQ ID NO: 1528650 - RNA, 15 nt, Human
aacucaccugccccu

SEQ ID NO: 1528651 - RNA, 16 nt, Human
aacucaccugccccuc

SEQ ID NO: 1528652 - RNA, 13 nt, Human
aacuucacauauu

SEQ ID NO: 1528653 - RNA, 22 nt, Human
aaccacuggaaaguuuaugguu

SEQ ID NO: 1528654 - RNA, 22 nt, Human
aaccacucuaucaaguauuaua

SEQ ID NO: 1528655 - RNA, 23 nt, Human
aacauguaauuaaguacuaugua

SEQ ID NO: 1528656 - RNA, 14 nt, Human
aacauguaauuaag

SEQ ID NO: 1528657 - RNA, 21 nt, Human
aacauguaauuaaguacuaug

SEQ ID NO: 1528658 - RNA, 17 nt, Human
aaccaguguuguggauu

SEQ ID NO: 1528659 - RNA, 22 nt, Human
aacaugcuacacacugcauguu

SEQ ID NO: 1528660 - RNA, 14 nt, Human
aacccuggugacca

SEQ ID NO: 1528661 - RNA, 15 nt, Human
aacacgagcaggcua

SEQ ID NO: 1528662 - RNA, 19 nt, Human
aacacauuuuucuuaggga

SEQ ID NO: 1528663 - RNA, 14 nt, Human
acuagcuauggugu

SEQ ID NO: 1528664 - RNA, 13 nt, Human
acuccccugcugg

SEQ ID NO: 1528665 - RNA, 17 nt, Human
acuccccugcugggugu

SEQ ID NO: 1528666 - RNA, 14 nt, Human
acucccccaggugg

SEQ ID NO: 1528667 - RNA, 21 nt, Human
acucauaaaaagccugcaauu

SEQ ID NO: 1528668 - RNA, 17 nt, Human
acucaaacucuuaaaac

SEQ ID NO: 1528669 - RNA, 16 nt, Human
acucaaacucuuaaaa

SEQ ID NO: 1528670 - RNA, 11 nt, Human
acuauaaugua

SEQ ID NO: 1528671 - RNA, 14 nt, Human
acucaaaucaagaa

SEQ ID NO: 1528672 - RNA, 11 nt, Human
acucuuaaaac

SEQ ID NO: 1528673 - RNA, 18 nt, Human
acucuuaaaacccaagug

SEQ ID NO: 1528674 - RNA, 19 nt, Human
acucugugucagguggggc

SEQ ID NO: 1528675 - RNA, 16 nt, Human
acucugugucaggugg

SEQ ID NO: 1528676 - RNA, 21 nt, Human
acucuaucaaguauuauaccu

SEQ ID NO: 1528677 - RNA, 16 nt, Human
acucuaucaaguauua

SEQ ID NO: 1528678 - RNA, 14 nt, Human
acucuaucaaguau

SEQ ID NO: 1528679 - RNA, 21 nt, Human
acucuacccucuuagaaaaac

SEQ ID NO: 1528680 - RNA, 18 nt, Human
acucuacccucuuagaaa

SEQ ID NO: 1528681 - RNA, 12 nt, Human
acucccuuucaa

SEQ ID NO: 1528682 - RNA, 13 nt, Human
acucccuuucaac

SEQ ID NO: 1528683 - RNA, 16 nt, Human
acuaagagagaaugag

SEQ ID NO: 1528684 - RNA, 17 nt, Human
acguggcugcuucaagg

SEQ ID NO: 1528685 - RNA, 13 nt, Human
acguggcugcuuc

SEQ ID NO: 1528686 - RNA, 14 nt, Human
acguggcugcuuca

SEQ ID NO: 1528687 - RNA, 15 nt, Human
acguggcugcuucaa

SEQ ID NO: 1528688 - RNA, 17 nt, Human
acgccagauucuuuccu

SEQ ID NO: 1528689 - RNA, 16 nt, Human
acgcugugcugcccug

SEQ ID NO: 1528690 - RNA, 17 nt, Human
acgcugugcugcccugc

SEQ ID NO: 1528691 - RNA, 18 nt, Human
acgcugugcugcccugcc

SEQ ID NO: 1528692 - RNA, 22 nt, Human
acuaaguuuuuauggcuuuugu

SEQ ID NO: 1528693 - RNA, 15 nt, Human
acuaaguuuuuaugg

SEQ ID NO: 1528694 - RNA, 19 nt, Human
acgauuucuguuuagauaa

SEQ ID NO: 1528695 - RNA, 18 nt, Human
acgccacugcacuauagc

SEQ ID NO: 1528696 - RNA, 17 nt, Human
acgauuucuguuuagau

SEQ ID NO: 1528697 - RNA, 14 nt, Human
acgauuucuguuua

SEQ ID NO: 1528698 - RNA, 13 nt, Human
acgauuucuguuu

SEQ ID NO: 1528699 - RNA, 12 nt, Human
acgauuucuguu

SEQ ID NO: 1528700 - RNA, 14 nt, Human
accuuggcucaagu

SEQ ID NO: 1528701 - RNA, 12 nt, Human
accuuggcugca

SEQ ID NO: 1528702 - RNA, 16 nt, Human
accuuucaauaggaaa

SEQ ID NO: 1528703 - RNA, 14 nt, Human
accuuggcugcagg

SEQ ID NO: 1528704 - RNA, 17 nt, Human
accuuucaauaggaaaa

SEQ ID NO: 1528705 - RNA, 21 nt, Human
accuuucaauaggaaaaacug

SEQ ID NO: 1528706 - RNA, 23 nt, Human
accuuucaauaggaaaaacugau

SEQ ID NO: 1528707 - RNA, 23 nt, Human
accugccccucaacucuccucca

SEQ ID NO: 1528708 - RNA, 15 nt, Human
accucugcagcaaua

SEQ ID NO: 1528709 - RNA, 21 nt, Human
accucugcacaagcugcaccc

SEQ ID NO: 1528710 - RNA, 16 nt, Human
accucugcacaagcug

SEQ ID NO: 1528711 - RNA, 18 nt, Human
accucugcacaagcugca

SEQ ID NO: 1528712 - RNA, 20 nt, Human
acuuauuguagcauccugga

SEQ ID NO: 1528713 - RNA, 23 nt, Human
acuuauuguagcauccuggaaua

SEQ ID NO: 1528714 - RNA, 12 nt, Human
acuguuuugaau

SEQ ID NO: 1528715 - RNA, 19 nt, Human
acuucacauauugauuucc

SEQ ID NO: 1528716 - RNA, 13 nt, Human
acuguuucaaacu

SEQ ID NO: 1528717 - RNA, 20 nt, Human
acuuguaaaggaauuuaaaa

SEQ ID NO: 1528718 - RNA, 19 nt, Human
acuuguaaaggaauuuaaa

SEQ ID NO: 1528719 - RNA, 14 nt, Human
acuuggucugugag

SEQ ID NO: 1528720 - RNA, 15 nt, Human
acuuggucugugaga

SEQ ID NO: 1528721 - RNA, 18 nt, Human
acuucugccauauucugu

SEQ ID NO: 1528722 - RNA, 23 nt, Human
acuucacauauugauuuccguua

SEQ ID NO: 1528723 - RNA, 19 nt, Human
acuucugccauauucuguu

SEQ ID NO: 1528724 - RNA, 21 nt, Human
acuuggucugugagaugcuag

SEQ ID NO: 1528725 - RNA, 14 nt, Human
acuggagaaaaugg

SEQ ID NO: 1528726 - RNA, 16 nt, Human
acuggaagcacagcuu

SEQ ID NO: 1528727 - RNA, 15 nt, Human
acuggaagcacagcu

SEQ ID NO: 1528728 - RNA, 14 nt, Human
acuggaagcacagc

SEQ ID NO: 1528729 - RNA, 16 nt, Human
acugugccaugugcca

SEQ ID NO: 1528730 - RNA, 12 nt, Human
acugucuucagu

SEQ ID NO: 1528731 - RNA, 18 nt, Human
agaaaaguugaauuuuac

SEQ ID NO: 1528732 - RNA, 21 nt, Human
agaaaaguugaauuuuacaug

SEQ ID NO: 1528733 - RNA, 22 nt, Human
acuuuuauaaacuuuaccuuuu

SEQ ID NO: 1528734 - RNA, 19 nt, Human
acuuuuauaaacuuuaccu

SEQ ID NO: 1528735 - RNA, 23 nt, Human
agaaaauauuauguguuuccaua

SEQ ID NO: 1528736 - RNA, 22 nt, Human
agaaaauggacguguuaugacu

SEQ ID NO: 1528737 - RNA, 23 nt, Human
agaaaauggacguguuaugacuc

SEQ ID NO: 1528738 - RNA, 14 nt, Human
agaaaauaacaaua

SEQ ID NO: 1528739 - RNA, 23 nt, Human
agaaaauggaagacagcucuuau

SEQ ID NO: 1528740 - RNA, 15 nt, Human
agaaaauggacgugu

SEQ ID NO: 1528741 - RNA, 20 nt, Human
agaaaauggacguguuauga

SEQ ID NO: 1528742 - RNA, 18 nt, Human
acuuucagugaaagcauc

SEQ ID NO: 1528743 - RNA, 19 nt, Human
acuuuauacccagaaaguu

SEQ ID NO: 1528744 - RNA, 17 nt, Human
acuuucauuuuuuucca

SEQ ID NO: 1528745 - RNA, 20 nt, Human
acuuucauuuuuuuccaggc

SEQ ID NO: 1528746 - RNA, 16 nt, Human
acuuucuagccagagg

SEQ ID NO: 1528747 - RNA, 23 nt, Human
acuuuguucuggcucuuccaggc

SEQ ID NO: 1528748 - RNA, 21 nt, Human
acuuucauuuuuuuccaggcu

SEQ ID NO: 1528749 - RNA, 23 nt, Human
acuuucauuuuuuuccaggcugg

SEQ ID NO: 1528750 - RNA, 23 nt, Human
acuuuccuucauucaacccaccu

SEQ ID NO: 1528751 - RNA, 15 nt, Human
agaaauaaaguuucu

SEQ ID NO: 1528752 - RNA, 18 nt, Human
agaaauaaaguuucuguu

SEQ ID NO: 1528753 - RNA, 20 nt, Human
agaaaggaggggauagagag

SEQ ID NO: 1528754 - RNA, 23 nt, Human
agaaaggaggggauagagagaga

SEQ ID NO: 1528755 - RNA, 15 nt, Human
accccggccaccugc

SEQ ID NO: 1528756 - RNA, 15 nt, Human
accccgagggcugag

SEQ ID NO: 1528757 - RNA, 19 nt, Human
acccaugcugcccugugag

SEQ ID NO: 1528758 - RNA, 17 nt, Human
acccaugcugcccugug

SEQ ID NO: 1528759 - RNA, 18 nt, Human
acccaugcugcccuguga

SEQ ID NO: 1528760 - RNA, 16 nt, Human
acccaaguccaagcau

SEQ ID NO: 1528761 - RNA, 13 nt, Human
acccaagggccug

SEQ ID NO: 1528762 - RNA, 16 nt, Human
acccaagggccuggcc

SEQ ID NO: 1528763 - RNA, 15 nt, Human
acccacaagaaauga

SEQ ID NO: 1528764 - RNA, 14 nt, Human
accaucaugucugg

SEQ ID NO: 1528765 - RNA, 21 nt, Human
accaucccugaaggccccgcc

SEQ ID NO: 1528766 - RNA, 22 nt, Human
accaucccugaaggccccgccc

SEQ ID NO: 1528767 - RNA, 16 nt, Human
accaucaugucuggcu

SEQ ID NO: 1528768 - RNA, 17 nt, Human
accaucaugucuggcua

SEQ ID NO: 1528769 - RNA, 12 nt, Human
accaucauugaa

SEQ ID NO: 1528770 - RNA, 18 nt, Human
accaucccugaaggcccc

SEQ ID NO: 1528771 - RNA, 20 nt, Human
accccucaacaccucugcac

SEQ ID NO: 1528772 - RNA, 23 nt, Human
acauaaacaagaccacguuucua

SEQ ID NO: 1528773 - RNA, 20 nt, Human
acauaaauuuaguauuuugu

SEQ ID NO: 1528774 - RNA, 22 nt, Human
acaucagcacgauuucuguuua

SEQ ID NO: 1528775 - RNA, 21 nt, Human
acaucagcacgauuucuguuu

SEQ ID NO: 1528776 - RNA, 20 nt, Human
acaucagcacgauuucuguu

SEQ ID NO: 1528777 - RNA, 21 nt, Human
acauguuuuucuucucccuca

SEQ ID NO: 1528778 - RNA, 13 nt, Human
acauguuacaaca

SEQ ID NO: 1528779 - RNA, 19 nt, Human
acaugcaaggucauuuuuu

SEQ ID NO: 1528780 - RNA, 20 nt, Human
acaugcacagcuaacaugga

SEQ ID NO: 1528781 - RNA, 23 nt, Human
acaugcacagcuaacauggaagu

SEQ ID NO: 1528782 - RNA, 18 nt, Human
acauuugcucauggaauu

SEQ ID NO: 1528783 - RNA, 14 nt, Human
acauuuguauaaaa

SEQ ID NO: 1528784 - RNA, 21 nt, Human
acauuuguagcauccucuuua

SEQ ID NO: 1528785 - RNA, 14 nt, Human
accacgcuggaccu

SEQ ID NO: 1528786 - RNA, 14 nt, Human
accacuacauucug

SEQ ID NO: 1528787 - RNA, 19 nt, Human
accacguuucuaaaggcua

SEQ ID NO: 1528788 - RNA, 15 nt, Human
accacguuucuaaag

SEQ ID NO: 1528789 - RNA, 15 nt, Human
accacuacauucugu

SEQ ID NO: 1528790 - RNA, 14 nt, Human
accagcagccugga

SEQ ID NO: 1528791 - RNA, 17 nt, Human
accagcagccuggaccc

SEQ ID NO: 1528792 - RNA, 20 nt, Human
acaagucagucauucagaua

SEQ ID NO: 1528793 - RNA, 13 nt, Human
acaacuuuauacc

SEQ ID NO: 1528794 - RNA, 14 nt, Human
acaacuuuauaccc

SEQ ID NO: 1528795 - RNA, 17 nt, Human
acaacuucaauauccaa

SEQ ID NO: 1528796 - RNA, 18 nt, Human
acaacuucccagugaauu

SEQ ID NO: 1528797 - RNA, 16 nt, Human
acaacuauuuuuccaa

SEQ ID NO: 1528798 - RNA, 15 nt, Human
aauuuuauaucuugu

SEQ ID NO: 1528799 - RNA, 15 nt, Human
acaaaauggaauacu

SEQ ID NO: 1528800 - RNA, 19 nt, Human
acaaaauggaauacucuua

SEQ ID NO: 1528801 - RNA, 20 nt, Human
aauuuugaguucuacauaag

SEQ ID NO: 1528802 - RNA, 20 nt, Human
acaaaauggaauacucuuau

SEQ ID NO: 1528803 - RNA, 20 nt, Human
acaaaauguaggguuauaau

SEQ ID NO: 1528804 - RNA, 13 nt, Human
acaacuauauugu

SEQ ID NO: 1528805 - RNA, 13 nt, Human
acaaagacugagu

SEQ ID NO: 1528806 - RNA, 21 nt, Human
acaaaccuguuucugcagcca

SEQ ID NO: 1528807 - RNA, 15 nt, Human
acaaacgggcucagc

SEQ ID NO: 1528808 - RNA, 15 nt, Human
acacggacacucaaa

SEQ ID NO: 1528809 - RNA, 14 nt, Human
acacuaaccacgcu

SEQ ID NO: 1528810 - RNA, 15 nt, Human
acacuaaccacgcug

SEQ ID NO: 1528811 - RNA, 14 nt, Human
acacagcucugucc

SEQ ID NO: 1528812 - RNA, 11 nt, Human
acacagcucug

SEQ ID NO: 1528813 - RNA, 12 nt, Human
acacagcucugu

SEQ ID NO: 1528814 - RNA, 12 nt, Human
acaccagagccc

SEQ ID NO: 1528815 - RNA, 13 nt, Human
acaccagagccca

SEQ ID NO: 1528816 - RNA, 14 nt, Human
acaccacuacauuc

SEQ ID NO: 1528817 - RNA, 15 nt, Human
acaauuuauuauggc

SEQ ID NO: 1528818 - RNA, 16 nt, Human
acaauuuauuauggca

SEQ ID NO: 1528819 - RNA, 18 nt, Human
acacaaacgggcucagca

SEQ ID NO: 1528820 - RNA, 16 nt, Human
acagaagaaggcagca

SEQ ID NO: 1528821 - RNA, 12 nt, Human
acagaacacugu

SEQ ID NO: 1528822 - RNA, 14 nt, Human
acagaacacugucu

SEQ ID NO: 1528823 - RNA, 20 nt, Human
acagaagaaggcagcaggug

SEQ ID NO: 1528824 - RNA, 17 nt, Human
acacugugcugagucug

SEQ ID NO: 1528825 - RNA, 13 nt, Human
acacugucuugaa

SEQ ID NO: 1528826 - RNA, 19 nt, Human
acacugagaauguaagaac

SEQ ID NO: 1528827 - RNA, 20 nt, Human
acacugagaauguaagaacu

SEQ ID NO: 1528828 - RNA, 22 nt, Human
acacugagaauguaagaacuac

SEQ ID NO: 1528829 - RNA, 22 nt, Human
acagaggggguggccucccaac

SEQ ID NO: 1528830 - RNA, 12 nt, Human
acagagucucac

SEQ ID NO: 1528831 - RNA, 14 nt, Human
acagagucucacug

SEQ ID NO: 1528832 - RNA, 16 nt, Human
acagaauauguuucaa

SEQ ID NO: 1528833 - RNA, 17 nt, Human
acagaauauguuucaaa

SEQ ID NO: 1528834 - RNA, 19 nt, Human
acagaauauguuucaaacu

SEQ ID NO: 1528835 - RNA, 21 nt, Human
acagaauauguuucaaacuuu

SEQ ID NO: 1528836 - RNA, 15 nt, Human
acagcaguugaaaag

SEQ ID NO: 1528837 - RNA, 18 nt, Human
acagcaguugaaaagacu

SEQ ID NO: 1528838 - RNA, 17 nt, Human
acagagucucacuguug

SEQ ID NO: 1528839 - RNA, 19 nt, Human
acagagucucacuguugcc

SEQ ID NO: 1528840 - RNA, 23 nt, Human
acagagucucacuguugcccagg

SEQ ID NO: 1528841 - RNA, 16 nt, Human
acagccagacuggcac

SEQ ID NO: 1528842 - RNA, 13 nt, Human
acagccagacugg

SEQ ID NO: 1528843 - RNA, 15 nt, Human
acagccagacuggca

SEQ ID NO: 1528844 - RNA, 15 nt, Human
acagccaugauucuu

SEQ ID NO: 1528845 - RNA, 16 nt, Human
acagcccaaagaagga

SEQ ID NO: 1528846 - RNA, 17 nt, Human
acagcccaaagaaggaa

SEQ ID NO: 1528847 - RNA, 18 nt, Human
acagcccaaagaaggaaa

SEQ ID NO: 1528848 - RNA, 19 nt, Human
acaggucauauuaauauau

SEQ ID NO: 1528849 - RNA, 20 nt, Human
acaggugugaaccaccacac

SEQ ID NO: 1528850 - RNA, 23 nt, Human
acaggugugaaccaccacaccca

SEQ ID NO: 1528851 - RNA, 19 nt, Human
acaggcaagcaccuccugc

SEQ ID NO: 1528852 - RNA, 18 nt, Human
acaggcaagcaccuccug

SEQ ID NO: 1528853 - RNA, 16 nt, Human
acaggcaagcaccucc

SEQ ID NO: 1528854 - RNA, 23 nt, Human
acagcugccugggaucccucauc

SEQ ID NO: 1528855 - RNA, 13 nt, Human
acagcucuguccu

SEQ ID NO: 1528856 - RNA, 14 nt, Human
acagcugccuggga

SEQ ID NO: 1528857 - RNA, 20 nt, Human
acagcucugcauacucauua

SEQ ID NO: 1528858 - RNA, 15 nt, Human
acagcuccuucuguc

SEQ ID NO: 1528859 - RNA, 12 nt, Human
acagcuccuucu

SEQ ID NO: 1528860 - RNA, 13 nt, Human
acagcuccuucug

SEQ ID NO: 1528861 - RNA, 14 nt, Human
acagcuccuucugu

SEQ ID NO: 1528862 - RNA, 14 nt, Human
aaaacaaggaugaa

SEQ ID NO: 1528863 - RNA, 12 nt, Human
aaaacaacuuua

SEQ ID NO: 1528864 - RNA, 13 nt, Human
aaaaauuuuuguu

SEQ ID NO: 1528865 - RNA, 14 nt, Human
aaaaauuuuuguuu

SEQ ID NO: 1528866 - RNA, 17 nt, Human
aaaacaaggaugaauua

SEQ ID NO: 1528867 - RNA, 12 nt, Human
aaaacacauuuu

SEQ ID NO: 1528868 - RNA, 18 nt, Human
aaaacacagcaaggguga

SEQ ID NO: 1528869 - RNA, 12 nt, Human
aaaacacagcaa

SEQ ID NO: 1528870 - RNA, 13 nt, Human
aaaacacagcaag

SEQ ID NO: 1528871 - RNA, 15 nt, Human
aaaaacugauuuuuu

SEQ ID NO: 1528872 - RNA, 14 nt, Human
aaaaacauggccuu

SEQ ID NO: 1528873 - RNA, 13 nt, Human
aaaaacugauuuu

SEQ ID NO: 1528874 - RNA, 12 nt, Human
aaaaagaggcua

SEQ ID NO: 1528875 - RNA, 12 nt, Human
aaaaacaacuuu

SEQ ID NO: 1528876 - RNA, 12 nt, Human
aaaaacacagca

SEQ ID NO: 1528877 - RNA, 14 nt, Human
aaaaacacaaaagu

SEQ ID NO: 1528878 - RNA, 17 nt, Human
uuuucaaaauaaaaaug

SEQ ID NO: 1528879 - RNA, 18 nt, Human
uuuuauuuuuagacagag

SEQ ID NO: 1528880 - RNA, 13 nt, Human
uuuuauauuugaa

SEQ ID NO: 1528881 - RNA, 18 nt, Human
uuuuauauuugaaauauu

SEQ ID NO: 1528882 - RNA, 21 nt, Human
uuuuauacauaaacaagacca

SEQ ID NO: 1528883 - RNA, 13 nt, Human
uuuuauacauaaa

SEQ ID NO: 1528884 - RNA, 21 nt, Human
uuuuaaaguaacccuacaaaa

SEQ ID NO: 1528885 - RNA, 23 nt, Human
uuuuauaauuuugugaagcaaaa

SEQ ID NO: 1528886 - RNA, 21 nt, Human
uuuuauaauuuugugaagcaa

SEQ ID NO: 1528887 - RNA, 15 nt, Human
uuuuacuaauagaca

SEQ ID NO: 1528888 - RNA, 16 nt, Human
uuuucacauuggaaac

SEQ ID NO: 1528889 - RNA, 18 nt, Human
uuuucccuauuagagaag

SEQ ID NO: 1528890 - RNA, 22 nt, Human
uuuucccuauuagagaagagau

SEQ ID NO: 1528891 - RNA, 23 nt, Human
uuuucagaaaauauuauguguuu

SEQ ID NO: 1528892 - RNA, 16 nt, Human
uuuucuuucagccaag

SEQ ID NO: 1528893 - RNA, 14 nt, Human
uuuucuucucccuc

SEQ ID NO: 1528894 - RNA, 22 nt, Human
uuuucuuguguguuuauuguca

SEQ ID NO: 1528895 - RNA, 13 nt, Human
uuuucuucucccu

SEQ ID NO: 1528896 - RNA, 23 nt, Human
uuuucuacucgaguuacagacaa

SEQ ID NO: 1528897 - RNA, 13 nt, Human
uuuucuuauuuca

SEQ ID NO: 1528898 - RNA, 20 nt, Human
uuuucuacucgaguuacaga

SEQ ID NO: 1528899 - RNA, 22 nt, Human
uuuucuacucgaguuacagaca

SEQ ID NO: 1528900 - RNA, 13 nt, Human
uuuucuacucgag

SEQ ID NO: 1528901 - RNA, 13 nt, Human
uuuggacccugag

SEQ ID NO: 1528902 - RNA, 15 nt, Human
uuuccacagaagcuc

SEQ ID NO: 1528903 - RNA, 17 nt, Human
uuuccguuaaaauacca

SEQ ID NO: 1528904 - RNA, 15 nt, Human
uuuccguuaaaauac

SEQ ID NO: 1528905 - RNA, 21 nt, Human
uuugagugccuuacacaaugg

SEQ ID NO: 1528906 - RNA, 12 nt, Human
uuugaguucuac

SEQ ID NO: 1528907 - RNA, 16 nt, Human
uuuguugucagcugaa

SEQ ID NO: 1528908 - RNA, 15 nt, Human
uuuguugucagcuga

SEQ ID NO: 1528909 - RNA, 22 nt, Human
uuuguuaguaugaggcauuugu

SEQ ID NO: 1528910 - RNA, 18 nt, Human
uuuguauaaaauaauuuu

SEQ ID NO: 1528911 - RNA, 19 nt, Human
uuuguauaaaauaauuuuu

SEQ ID NO: 1528912 - RNA, 17 nt, Human
uuuguauaaaauaauuu

SEQ ID NO: 1528913 - RNA, 17 nt, Human
uuuggucuacacugugc

SEQ ID NO: 1528914 - RNA, 12 nt, Human
uuuuuccaggcu

SEQ ID NO: 1528915 - RNA, 23 nt, Human
uuuugacagaauauguuucaaac

SEQ ID NO: 1528916 - RNA, 22 nt, Human
uuuugacagaauauguuucaaa

SEQ ID NO: 1528917 - RNA, 23 nt, Human
uuuuuaagugcugcauuuaaaag

SEQ ID NO: 1528918 - RNA, 22 nt, Human
uuuuuaagugcugcauuuaaaa

SEQ ID NO: 1528919 - RNA, 19 nt, Human
uuuuuaagugcugcauuua

SEQ ID NO: 1528920 - RNA, 18 nt, Human
uuuuuaagugcugcauuu

SEQ ID NO: 1528921 - RNA, 17 nt, Human
uuuuuaagugcugcauu

SEQ ID NO: 1528922 - RNA, 16 nt, Human
uuuuuaagugcugcau

SEQ ID NO: 1528923 - RNA, 23 nt, Human
uuuuuaagaaaaaggaugcacag

SEQ ID NO: 1528924 - RNA, 22 nt, Human
uuuuuaacucaauauuuuccau

SEQ ID NO: 1528925 - RNA, 12 nt, Human
uuuuuaagaaaa

SEQ ID NO: 1528926 - RNA, 12 nt, Human
uuuuuuacuaau

SEQ ID NO: 1528927 - RNA, 12 nt, Human
uuuuuuuuaaga

SEQ ID NO: 1528928 - RNA, 17 nt, Human
uuuuuuccuucagugcc

SEQ ID NO: 1528929 - RNA, 11 nt, Human
uuuuuuuacua

SEQ ID NO: 1528930 - RNA, 13 nt, Human
uuuuuuuugacaa

SEQ ID NO: 1528931 - RNA, 20 nt, Human
uuccugaggcugggcucccu

SEQ ID NO: 1528932 - RNA, 15 nt, Human
uuccugaggcugggc

SEQ ID NO: 1528933 - RNA, 16 nt, Human
uuccauggccucuuca

SEQ ID NO: 1528934 - RNA, 12 nt, Human
uuccauggccuc

SEQ ID NO: 1528935 - RNA, 18 nt, Human
uucggugagcuacaaaug

SEQ ID NO: 1528936 - RNA, 17 nt, Human
uuccuuggacucauuuu

SEQ ID NO: 1528937 - RNA, 21 nt, Human
uuccuugaguugauucagcuc

SEQ ID NO: 1528938 - RNA, 22 nt, Human
uucuacucgaguuacagacaaa

SEQ ID NO: 1528939 - RNA, 14 nt, Human
uucuacccaggugc

SEQ ID NO: 1528940 - RNA, 20 nt, Human
uucuacccagcgagcccugg

SEQ ID NO: 1528941 - RNA, 21 nt, Human
uucuacccagcgagcccuggu

SEQ ID NO: 1528942 - RNA, 13 nt, Human
uucuacgccaggg

SEQ ID NO: 1528943 - RNA, 22 nt, Human
uucuacauaaguaauucaagaa

SEQ ID NO: 1528944 - RNA, 12 nt, Human
uucuacccagcg

SEQ ID NO: 1528945 - RNA, 19 nt, Human
uucuacccagcgagcccug

SEQ ID NO: 1528946 - RNA, 15 nt, Human
uucuacauacuaugg

SEQ ID NO: 1528947 - RNA, 13 nt, Human
uucucuccagccc

SEQ ID NO: 1528948 - RNA, 14 nt, Human
uucucuccagcccc

SEQ ID NO: 1528949 - RNA, 18 nt, Human
uucucuccuguaccucuu

SEQ ID NO: 1528950 - RNA, 14 nt, Human
uucucuccuguacc

SEQ ID NO: 1528951 - RNA, 15 nt, Human
uucucuccagccccu

SEQ ID NO: 1528952 - RNA, 16 nt, Human
uucucuccagccccug

SEQ ID NO: 1528953 - RNA, 19 nt, Human
uucucuccuguaccucuug

SEQ ID NO: 1528954 - RNA, 22 nt, Human
uucucuccuguaccucuugagc

SEQ ID NO: 1528955 - RNA, 14 nt, Human
uucucugaggacac

SEQ ID NO: 1528956 - RNA, 20 nt, Human
uucucugaggacacuaacca

SEQ ID NO: 1528957 - RNA, 11 nt, Human
uucucugcccu

SEQ ID NO: 1528958 - RNA, 12 nt, Human
uucucugcccuc

SEQ ID NO: 1528959 - RNA, 14 nt, Human
uucuaugaaauauu

SEQ ID NO: 1528960 - RNA, 21 nt, Human
uucuaugaaauauuauguuaa

SEQ ID NO: 1528961 - RNA, 19 nt, Human
uucucauuucaccccuccc

SEQ ID NO: 1528962 - RNA, 15 nt, Human
uucucauuucacccc

SEQ ID NO: 1528963 - RNA, 16 nt, Human
uucucauuucaccccu

SEQ ID NO: 1528964 - RNA, 20 nt, Human
uucuccaccugccagggaca

SEQ ID NO: 1528965 - RNA, 16 nt, Human
uucuccaccugccagg

SEQ ID NO: 1528966 - RNA, 18 nt, Human
uucuccaccugccaggga

SEQ ID NO: 1528967 - RNA, 21 nt, Human
uucuccaccucccacaaagga

SEQ ID NO: 1528968 - RNA, 12 nt, Human
uucuccaccugc

SEQ ID NO: 1528969 - RNA, 14 nt, Human
uucuccaccugcca

SEQ ID NO: 1528970 - RNA, 15 nt, Human
uucuccaccugccag

SEQ ID NO: 1528971 - RNA, 19 nt, Human
uucugcucacauaucuguc

SEQ ID NO: 1528972 - RNA, 19 nt, Human
uucugauccuaguuccacc

SEQ ID NO: 1528973 - RNA, 16 nt, Human
uucucugcccuccaag

SEQ ID NO: 1528974 - RNA, 17 nt, Human
uucucugcccuccaaga

SEQ ID NO: 1528975 - RNA, 23 nt, Human
uucugacccaugcugcccuguga

SEQ ID NO: 1528976 - RNA, 22 nt, Human
uucugacccaugcugcccugug

SEQ ID NO: 1528977 - RNA, 18 nt, Human
uucugacccugcuucaaa

SEQ ID NO: 1528978 - RNA, 21 nt, Human
uucugacccugcuucaaauau

SEQ ID NO: 1528979 - RNA, 16 nt, Human
uucugagaaagacuau

SEQ ID NO: 1528980 - RNA, 21 nt, Human
uucugagaaagacuauucaaa

SEQ ID NO: 1528981 - RNA, 16 nt, Human
uugaaaagacuccaaa

SEQ ID NO: 1528982 - RNA, 15 nt, Human
uugaacuccuggccu

SEQ ID NO: 1528983 - RNA, 16 nt, Human
uugaacuccuggccuc

SEQ ID NO: 1528984 - RNA, 23 nt, Human
uugaaaacacuguucucugcccu

SEQ ID NO: 1528985 - RNA, 18 nt, Human
uucuuuccacagaagcuc

SEQ ID NO: 1528986 - RNA, 21 nt, Human
uucuuuccaaaguacacuguu

SEQ ID NO: 1528987 - RNA, 20 nt, Human
uugaaaaaccauuuugcugu

SEQ ID NO: 1528988 - RNA, 14 nt, Human
uucuuuccaaagua

SEQ ID NO: 1528989 - RNA, 12 nt, Human
uucuuucagcca

SEQ ID NO: 1528990 - RNA, 23 nt, Human
uucuuccucccucccucuuuccc

SEQ ID NO: 1528991 - RNA, 13 nt, Human
uucuuccucccuc

SEQ ID NO: 1528992 - RNA, 21 nt, Human
uucuuguguguuuauugucaa

SEQ ID NO: 1528993 - RNA, 21 nt, Human
uucuuauacauuugauaaagu

SEQ ID NO: 1528994 - RNA, 17 nt, Human
uucuuccaaaaagauuu

SEQ ID NO: 1528995 - RNA, 21 nt, Human
uucuuccacaagagcccaggc

SEQ ID NO: 1528996 - RNA, 18 nt, Human
uucuguauuuuguuuuug

SEQ ID NO: 1528997 - RNA, 17 nt, Human
uucugucuucacaacag

SEQ ID NO: 1528998 - RNA, 14 nt, Human
uucugcuucagccu

SEQ ID NO: 1528999 - RNA, 18 nt, Human
uucugcuuguguuaagua

SEQ ID NO: 1529000 - RNA, 19 nt, Human
uucugcuucagccucccga

SEQ ID NO: 1529001 - RNA, 15 nt, Human
uucugcuucagccuc

SEQ ID NO: 1529002 - RNA, 16 nt, Human
uucugcuucagccucc

SEQ ID NO: 1529003 - RNA, 12 nt, Human
uugaauuuuaca

SEQ ID NO: 1529004 - RNA, 13 nt, Human
uugaacuuugacc

SEQ ID NO: 1529005 - RNA, 18 nt, Human
uugaacuggguacuugug

SEQ ID NO: 1529006 - RNA, 15 nt, Human
uugaccucugcagca

SEQ ID NO: 1529007 - RNA, 14 nt, Human
uugaccucugcagc

SEQ ID NO: 1529008 - RNA, 17 nt, Human
uugacccacaagaaaug

SEQ ID NO: 1529009 - RNA, 17 nt, Human
uugaccgugaggccaga

SEQ ID NO: 1529010 - RNA, 16 nt, Human
uugaccucugcagcaa

SEQ ID NO: 1529011 - RNA, 17 nt, Human
uugacgccaucccagcc

SEQ ID NO: 1529012 - RNA, 18 nt, Human
uugacgccaucccagccc

SEQ ID NO: 1529013 - RNA, 19 nt, Human
uugacgccaucccagcccc

SEQ ID NO: 1529014 - RNA, 20 nt, Human
uugacgccaucccagcccca

SEQ ID NO: 1529015 - RNA, 14 nt, Human
uugaugaagaaguu

SEQ ID NO: 1529016 - RNA, 23 nt, Human
uugaugaagaaguugauaugccu

SEQ ID NO: 1529017 - RNA, 15 nt, Human
uugaggucuguucuu

SEQ ID NO: 1529018 - RNA, 23 nt, Human
uugauauccucuuugagugaagc

SEQ ID NO: 1529019 - RNA, 16 nt, Human
uugaggguugggcugg

SEQ ID NO: 1529020 - RNA, 14 nt, Human
uugagccugggagg

SEQ ID NO: 1529021 - RNA, 13 nt, Human
uugaggguugggc

SEQ ID NO: 1529022 - RNA, 11 nt, Human
uugagccuggg

SEQ ID NO: 1529023 - RNA, 21 nt, Human
uugcaaaguaucccuacugua

SEQ ID NO: 1529024 - RNA, 16 nt, Human
uugaugaucuuugcag

SEQ ID NO: 1529025 - RNA, 22 nt, Human
uuauaucuuguagcuuuaucaa

SEQ ID NO: 1529026 - RNA, 15 nt, Human
uuauaucuuguagcu

SEQ ID NO: 1529027 - RNA, 21 nt, Human
uuauaucgaaauaguuacagg

SEQ ID NO: 1529028 - RNA, 16 nt, Human
uuauaauuuugugaag

SEQ ID NO: 1529029 - RNA, 17 nt, Human
uuauaauuuugugaagc

SEQ ID NO: 1529030 - RNA, 18 nt, Human
uuauaauuuugugaagca

SEQ ID NO: 1529031 - RNA, 14 nt, Human
uuauacaggucaua

SEQ ID NO: 1529032 - RNA, 19 nt, Human
uuauaucuauauuuuacau

SEQ ID NO: 1529033 - RNA, 23 nt, Human
uuauaucuauauuuuacauaaau

SEQ ID NO: 1529034 - RNA, 11 nt, Human
uuauacauaaa

SEQ ID NO: 1529035 - RNA, 22 nt, Human
uuauacaggucauauuaauaua

SEQ ID NO: 1529036 - RNA, 13 nt, Human
uuauacauaaaca

SEQ ID NO: 1529037 - RNA, 12 nt, Human
uuauaauuuaaa

SEQ ID NO: 1529038 - RNA, 14 nt, Human
uuauaauuuuguga

SEQ ID NO: 1529039 - RNA, 15 nt, Human
uuauaauuuugugaa

SEQ ID NO: 1529040 - RNA, 11 nt, Human
uuauaaucuuu

SEQ ID NO: 1529041 - RNA, 15 nt, Human
uuauaaugaaugaaa

SEQ ID NO: 1529042 - RNA, 18 nt, Human
uuauaauaauguuaacau

SEQ ID NO: 1529043 - RNA, 15 nt, Human
uuauaauaauguuaa

SEQ ID NO: 1529044 - RNA, 21 nt, Human
ugugaaaagaaaaaugagccu

SEQ ID NO: 1529045 - RNA, 17 nt, Human
ugugaaaagaaaaauga

SEQ ID NO: 1529046 - RNA, 13 nt, Human
ugugaaaagaaaa

SEQ ID NO: 1529047 - RNA, 15 nt, Human
ugugaaaagaaaaau

SEQ ID NO: 1529048 - RNA, 23 nt, Human
uuauguuguuguuguuuuuggau

SEQ ID NO: 1529049 - RNA, 17 nt, Human
uuauggcuuuugugcau

SEQ ID NO: 1529050 - RNA, 18 nt, Human
uuauggcuuuugugcauu

SEQ ID NO: 1529051 - RNA, 16 nt, Human
uuauggcuuuugugca

SEQ ID NO: 1529052 - RNA, 14 nt, Human
uuauggcacaucag

SEQ ID NO: 1529053 - RNA, 17 nt, Human
uuauggaacacucugag

SEQ ID NO: 1529054 - RNA, 21 nt, Human
uuauggacaaugacccagugg

SEQ ID NO: 1529055 - RNA, 18 nt, Human
uuauggaacacucugaga

SEQ ID NO: 1529056 - RNA, 20 nt, Human
uuauggaacacucugagacu

SEQ ID NO: 1529057 - RNA, 23 nt, Human
uuauuaaaaaucucaaauuucua

SEQ ID NO: 1529058 - RNA, 19 nt, Human
uuauuaaaugcccagcccc

SEQ ID NO: 1529059 - RNA, 21 nt, Human
uuauuaaaugcccagccccuu

SEQ ID NO: 1529060 - RNA, 19 nt, Human
uuauuagaaaaauauuaua

SEQ ID NO: 1529061 - RNA, 16 nt, Human
uuauauuuacaaaugg

SEQ ID NO: 1529062 - RNA, 20 nt, Human
uuauauuuauuacuguaaga

SEQ ID NO: 1529063 - RNA, 12 nt, Human
uuauauuugaaa

SEQ ID NO: 1529064 - RNA, 13 nt, Human
uuauauuugaaau

SEQ ID NO: 1529065 - RNA, 15 nt, Human
uuauauuugaaauau

SEQ ID NO: 1529066 - RNA, 11 nt, Human
uuaucucaaaa

SEQ ID NO: 1529067 - RNA, 14 nt, Human
uuaucuagauacug

SEQ ID NO: 1529068 - RNA, 18 nt, Human
uucaaauguauuacagug

SEQ ID NO: 1529069 - RNA, 16 nt, Human
uucaauaauaaauauu

SEQ ID NO: 1529070 - RNA, 14 nt, Human
uuauuuuguucaua

SEQ ID NO: 1529071 - RNA, 16 nt, Human
uuauuuuguucauaca

SEQ ID NO: 1529072 - RNA, 18 nt, Human
uucaaaugcuguaacuuu

SEQ ID NO: 1529073 - RNA, 22 nt, Human
uuauuuuggaaaauaaauuauu

SEQ ID NO: 1529074 - RNA, 19 nt, Human
uuauuuuaauaauguuuca

SEQ ID NO: 1529075 - RNA, 20 nt, Human
uuauuuuaauaauguuucaa

SEQ ID NO: 1529076 - RNA, 17 nt, Human
uuauuuuaauucaguug

SEQ ID NO: 1529077 - RNA, 18 nt, Human
uuauuuuauuaugcauga

SEQ ID NO: 1529078 - RNA, 19 nt, Human
uuauuucuuaaacaaaugu

SEQ ID NO: 1529079 - RNA, 21 nt, Human
uucaauaggaaaaacugauuu

SEQ ID NO: 1529080 - RNA, 22 nt, Human
uucaauaggaaaaacugauuuu

SEQ ID NO: 1529081 - RNA, 14 nt, Human
uucaccuuuguccc

SEQ ID NO: 1529082 - RNA, 19 nt, Human
uucaccuuuguccccaccg

SEQ ID NO: 1529083 - RNA, 20 nt, Human
uucaccuuuguccccaccgc

SEQ ID NO: 1529084 - RNA, 16 nt, Human
uucaccccucccuuuc

SEQ ID NO: 1529085 - RNA, 22 nt, Human
uucacaagacccaaaaggcaga

SEQ ID NO: 1529086 - RNA, 13 nt, Human
uucacccuuuucu

SEQ ID NO: 1529087 - RNA, 17 nt, Human
uucaccccucccuuucu

SEQ ID NO: 1529088 - RNA, 18 nt, Human
uucaccccucccuuucuc

SEQ ID NO: 1529089 - RNA, 20 nt, Human
uucaccccucccuuucuccc

SEQ ID NO: 1529090 - RNA, 22 nt, Human
uucaccccucccuuucuccccu

SEQ ID NO: 1529091 - RNA, 13 nt, Human
uucacggaagagc

SEQ ID NO: 1529092 - RNA, 22 nt, Human
uucaccuuuguccccaccgcag

SEQ ID NO: 1529093 - RNA, 17 nt, Human
uucacggaagagccuug

SEQ ID NO: 1529094 - RNA, 15 nt, Human
uucagacagcugccu

SEQ ID NO: 1529095 - RNA, 16 nt, Human
uucagacagcugccug

SEQ ID NO: 1529096 - RNA, 17 nt, Human
uucagacagcugccugg

SEQ ID NO: 1529097 - RNA, 21 nt, Human
uucaucugcucuccuuccugg

SEQ ID NO: 1529098 - RNA, 20 nt, Human
uucaugcuguucaugaaaga

SEQ ID NO: 1529099 - RNA, 14 nt, Human
uucauuuuuuucca

SEQ ID NO: 1529100 - RNA, 17 nt, Human
uucauuuuuuuccaggc

SEQ ID NO: 1529101 - RNA, 16 nt, Human
uuccaaaguacacugu

SEQ ID NO: 1529102 - RNA, 13 nt, Human
uuccaaaguacac

SEQ ID NO: 1529103 - RNA, 18 nt, Human
uucauuuuuuuccaggcu

SEQ ID NO: 1529104 - RNA, 21 nt, Human
uuccaaaaagauuuucagaaa

SEQ ID NO: 1529105 - RNA, 18 nt, Human
uuccagauccuggaaauc

SEQ ID NO: 1529106 - RNA, 19 nt, Human
uuccaacccucaucaccaa

SEQ ID NO: 1529107 - RNA, 19 nt, Human
uuccagauccuggaaauca

SEQ ID NO: 1529108 - RNA, 14 nt, Human
uuccauggacuuug

SEQ ID NO: 1529109 - RNA, 15 nt, Human
uuccauggacuuugu

SEQ ID NO: 1529110 - RNA, 23 nt, Human
uucaguuauuauauuuacaaaug

SEQ ID NO: 1529111 - RNA, 13 nt, Human
uucaucugcucuc

SEQ ID NO: 1529112 - RNA, 15 nt, Human
uucaucugcucuccu

SEQ ID NO: 1529113 - RNA, 16 nt, Human
uucaucugcucuccuu

SEQ ID NO: 1529114 - RNA, 19 nt, Human
uucaucugcucuccuuccu

SEQ ID NO: 1529115 - RNA, 15 nt, Human
uucauaaccuagccu

SEQ ID NO: 1529116 - RNA, 15 nt, Human
uucauccuccucaga

SEQ ID NO: 1529117 - RNA, 19 nt, Human
uucauccuccucagaucuu

SEQ ID NO: 1529118 - RNA, 22 nt, Human
uucagcuuguaaauagcucagg

SEQ ID NO: 1529119 - RNA, 14 nt, Human
uucaguggcagcug

SEQ ID NO: 1529120 - RNA, 22 nt, Human
uucagcuccagcucaccagccc

SEQ ID NO: 1529121 - RNA, 12 nt, Human
uucagcuccagc

SEQ ID NO: 1529122 - RNA, 15 nt, Human
uucagcuccagcuca

SEQ ID NO: 1529123 - RNA, 13 nt, Human
uucaguguacaug

SEQ ID NO: 1529124 - RNA, 12 nt, Human
uucaguguacau

SEQ ID NO: 1529125 - RNA, 17 nt, Human
uucaguggcagcugcuu

SEQ ID NO: 1529126 - RNA, 15 nt, Human
uucaguggcagcugc

SEQ ID NO: 1529127 - RNA, 16 nt, Human
uucaguggcagcugcu

SEQ ID NO: 1529128 - RNA, 22 nt, Human
uuuauaauuuugugaagcaaaa

SEQ ID NO: 1529129 - RNA, 13 nt, Human
uuuauuauggcac

SEQ ID NO: 1529130 - RNA, 13 nt, Human
uuuauuaugcaug

SEQ ID NO: 1529131 - RNA, 20 nt, Human
uuuauggcuuuugugcauua

SEQ ID NO: 1529132 - RNA, 16 nt, Human
uuuauggcuuuugugc

SEQ ID NO: 1529133 - RNA, 14 nt, Human
uuuauggcuuuugu

SEQ ID NO: 1529134 - RNA, 19 nt, Human
uuuauuuaguuccuugagu

SEQ ID NO: 1529135 - RNA, 13 nt, Human
uuuccaagagcug

SEQ ID NO: 1529136 - RNA, 14 nt, Human
uuuccaagagcuga

SEQ ID NO: 1529137 - RNA, 16 nt, Human
uuuccaagagcugagg

SEQ ID NO: 1529138 - RNA, 14 nt, Human
uuucauuuagguga

SEQ ID NO: 1529139 - RNA, 18 nt, Human
uuucauuuaggugaggaa

SEQ ID NO: 1529140 - RNA, 13 nt, Human
uuucaguguacau

SEQ ID NO: 1529141 - RNA, 14 nt, Human
uuucaguguacaug

SEQ ID NO: 1529142 - RNA, 12 nt, Human
uuucaauaggaa

SEQ ID NO: 1529143 - RNA, 14 nt, Human
uuucaauaggaaaa

SEQ ID NO: 1529144 - RNA, 17 nt, Human
uuucaauaggaaaaacu

SEQ ID NO: 1529145 - RNA, 19 nt, Human
uuucaauaggaaaaacuga

SEQ ID NO: 1529146 - RNA, 19 nt, Human
uuucaauuuccaagagcug

SEQ ID NO: 1529147 - RNA, 13 nt, Human
uuuaccacuugug

SEQ ID NO: 1529148 - RNA, 14 nt, Human
uuuaauaauguuuc

SEQ ID NO: 1529149 - RNA, 21 nt, Human
uuuaauagguuuggacaaaau

SEQ ID NO: 1529150 - RNA, 21 nt, Human
uuuacaccaguuccuuucaau

SEQ ID NO: 1529151 - RNA, 12 nt, Human
uuuagacagagu

SEQ ID NO: 1529152 - RNA, 14 nt, Human
uuuagaaauauaau

SEQ ID NO: 1529153 - RNA, 19 nt, Human
uuuacuucuuauacauuug

SEQ ID NO: 1529154 - RNA, 22 nt, Human
uuuacuucuuauacauuugaua

SEQ ID NO: 1529155 - RNA, 19 nt, Human
uuuaacucuauaauguguu

SEQ ID NO: 1529156 - RNA, 24 nt, Human
uuuaacucaauauuuuccaugaaa

SEQ ID NO: 1529157 - RNA, 18 nt, Human
uuuaacagaaauguacag

SEQ ID NO: 1529158 - RNA, 13 nt, Human
uuuaauaauguuu

SEQ ID NO: 1529159 - RNA, 18 nt, Human
uuuaagaaaaaggaugca

SEQ ID NO: 1529160 - RNA, 22 nt, Human
uuuaagaaaaaggaugcacaga

SEQ ID NO: 1529161 - RNA, 20 nt, Human
uuguguugaagagguuuuaa

SEQ ID NO: 1529162 - RNA, 13 nt, Human
uuguguugugaau

SEQ ID NO: 1529163 - RNA, 21 nt, Human
uuguguuuauauauaagccaa

SEQ ID NO: 1529164 - RNA, 23 nt, Human
uuguggauuuaacagaaauguac

SEQ ID NO: 1529165 - RNA, 22 nt, Human
uuguggauuuaacagaaaugua

SEQ ID NO: 1529166 - RNA, 17 nt, Human
uuguggacacagcucuu

SEQ ID NO: 1529167 - RNA, 16 nt, Human
uuguggacacagcucu

SEQ ID NO: 1529168 - RNA, 22 nt, Human
uuguggaggagcucaggacacu

SEQ ID NO: 1529169 - RNA, 21 nt, Human
uuguggauuuaacagaaaugu

SEQ ID NO: 1529170 - RNA, 20 nt, Human
uuguggauuuaacagaaaug

SEQ ID NO: 1529171 - RNA, 12 nt, Human
uugugcauuugg

SEQ ID NO: 1529172 - RNA, 23 nt, Human
uugugcauuaucuagauacugua

SEQ ID NO: 1529173 - RNA, 22 nt, Human
uugugcauuaucuagauacugu

SEQ ID NO: 1529174 - RNA, 17 nt, Human
uugugcauuaucuagau

SEQ ID NO: 1529175 - RNA, 12 nt, Human
uugugccccugc

SEQ ID NO: 1529176 - RNA, 18 nt, Human
uuguguuuugcaagccag

SEQ ID NO: 1529177 - RNA, 19 nt, Human
uuguuaaugguuugaauau

SEQ ID NO: 1529178 - RNA, 14 nt, Human
uuguuacauuuuua

SEQ ID NO: 1529179 - RNA, 21 nt, Human
uuguuaguaugaggcauuugu

SEQ ID NO: 1529180 - RNA, 19 nt, Human
uuguuaguaugaggcauuu

SEQ ID NO: 1529181 - RNA, 14 nt, Human
uuguuuaaaaucau

SEQ ID NO: 1529182 - RNA, 17 nt, Human
uuguuuaaaaucauuuc

SEQ ID NO: 1529183 - RNA, 22 nt, Human
uuguuaguaugaggcauuuguu

SEQ ID NO: 1529184 - RNA, 20 nt, Human
uuguuagugugucuuagugu

SEQ ID NO: 1529185 - RNA, 14 nt, Human
uuguauuacaaauc

SEQ ID NO: 1529186 - RNA, 16 nt, Human
uuguauucucuccugu

SEQ ID NO: 1529187 - RNA, 15 nt, Human
uuguauucucuccug

SEQ ID NO: 1529188 - RNA, 19 nt, Human
uuguauucucuccuguacc

SEQ ID NO: 1529189 - RNA, 21 nt, Human
uuguacgaagaguauuuuuga

SEQ ID NO: 1529190 - RNA, 23 nt, Human
uuguacgaagaguauuuuugaca

SEQ ID NO: 1529191 - RNA, 12 nt, Human
uugugauuuuug

SEQ ID NO: 1529192 - RNA, 17 nt, Human
uugugauuuuuguaauu

SEQ ID NO: 1529193 - RNA, 16 nt, Human
uugugauuuuuguaau

SEQ ID NO: 1529194 - RNA, 20 nt, Human
uugugaaaggaaagaggcuc

SEQ ID NO: 1529195 - RNA, 22 nt, Human
uugucuuaaaaaguggaaaaau

SEQ ID NO: 1529196 - RNA, 15 nt, Human
uugucuagugaaacu

SEQ ID NO: 1529197 - RNA, 15 nt, Human
uugucuuaaaaagug

SEQ ID NO: 1529198 - RNA, 18 nt, Human
uuguacauaaugcgugca

SEQ ID NO: 1529199 - RNA, 23 nt, Human
uuguaaauuaacuuuuauaaacu

SEQ ID NO: 1529200 - RNA, 18 nt, Human
uuguaaauuaacuuuuau

SEQ ID NO: 1529201 - RNA, 16 nt, Human
uuguaaauuaacuuuu

SEQ ID NO: 1529202 - RNA, 15 nt, Human
uuguaaauuaacuuu

SEQ ID NO: 1529203 - RNA, 17 nt, Human
uuguaaauaguauuuga

SEQ ID NO: 1529204 - RNA, 17 nt, Human
uuguaaauagcucaggu

SEQ ID NO: 1529205 - RNA, 16 nt, Human
uuggucugugagaugc

SEQ ID NO: 1529206 - RNA, 13 nt, Human
uuggucuguguga

SEQ ID NO: 1529207 - RNA, 16 nt, Human
uuggucccccuuccau

SEQ ID NO: 1529208 - RNA, 22 nt, Human
uuggguucaagcgauucuucug

SEQ ID NO: 1529209 - RNA, 14 nt, Human
uguacagacaacaa

SEQ ID NO: 1529210 - RNA, 11 nt, Human
uguacagagcc

SEQ ID NO: 1529211 - RNA, 14 nt, Human
uguaacaagccacc

SEQ ID NO: 1529212 - RNA, 17 nt, Human
uguaacaagccacccca

SEQ ID NO: 1529213 - RNA, 14 nt, Human
uguaauaacuguga

SEQ ID NO: 1529214 - RNA, 22 nt, Human
uguaauaacugugaaguuuaca

SEQ ID NO: 1529215 - RNA, 16 nt, Human
ugguuuucuguucuuu

SEQ ID NO: 1529216 - RNA, 19 nt, Human
ugguuuucuuguguguuua

SEQ ID NO: 1529217 - RNA, 16 nt, Human
ugguuuuguuccccuc

SEQ ID NO: 1529218 - RNA, 21 nt, Human
ugguuuuuaaaaaacugcuga

SEQ ID NO: 1529219 - RNA, 17 nt, Human
ugguuuuguuccccucc

SEQ ID NO: 1529220 - RNA, 20 nt, Human
ugguuuuguuccccuccucc

SEQ ID NO: 1529221 - RNA, 23 nt, Human
ugguuuuuaaaaaacugcugacu

SEQ ID NO: 1529222 - RNA, 11 nt, Human
uguaaaauggu

SEQ ID NO: 1529223 - RNA, 20 nt, Human
uguaaaaugugaagugaaug

SEQ ID NO: 1529224 - RNA, 12 nt, Human
uguaaaauggug

SEQ ID NO: 1529225 - RNA, 16 nt, Human
ugguucccuugaugaa

SEQ ID NO: 1529226 - RNA, 17 nt, Human
ugguucccuugaugaag

SEQ ID NO: 1529227 - RNA, 20 nt, Human
ugguucccuugaugaagaag

SEQ ID NO: 1529228 - RNA, 11 nt, Human
ugguucucauc

SEQ ID NO: 1529229 - RNA, 13 nt, Human
ugguucucaucuu

SEQ ID NO: 1529230 - RNA, 17 nt, Human
ugguucucaucuuucuu

SEQ ID NO: 1529231 - RNA, 14 nt, Human
ugguucucaucuuu

SEQ ID NO: 1529232 - RNA, 15 nt, Human
ugguucucaucuuuc

SEQ ID NO: 1529233 - RNA, 18 nt, Human
ugguugaugaucuuugca

SEQ ID NO: 1529234 - RNA, 16 nt, Human
uggugucaccugaaga

SEQ ID NO: 1529235 - RNA, 15 nt, Human
uggugucgggcauga

SEQ ID NO: 1529236 - RNA, 18 nt, Human
uggugucgggcaugacac

SEQ ID NO: 1529237 - RNA, 19 nt, Human
uggugucgggcaugacacg

SEQ ID NO: 1529238 - RNA, 15 nt, Human
uggugguaucugagu

SEQ ID NO: 1529239 - RNA, 18 nt, Human
uggugguuucagaaaugu

SEQ ID NO: 1529240 - RNA, 17 nt, Human
uggugguuucagaaaug

SEQ ID NO: 1529241 - RNA, 19 nt, Human
uggugguuuucuguucuuu

SEQ ID NO: 1529242 - RNA, 13 nt, Human
ugguggcuggguu

SEQ ID NO: 1529243 - RNA, 16 nt, Human
uggugggggccucggu

SEQ ID NO: 1529244 - RNA, 18 nt, Human
uggugggggccucggugu

SEQ ID NO: 1529245 - RNA, 14 nt, Human
uggguagacacaca

SEQ ID NO: 1529246 - RNA, 20 nt, Human
uggguacuuguggacacagc

SEQ ID NO: 1529247 - RNA, 23 nt, Human
uggguacuuguggacacagcucu

SEQ ID NO: 1529248 - RNA, 14 nt, Human
uggugagaggcauc

SEQ ID NO: 1529249 - RNA, 20 nt, Human
ugguggcagugggagcugcc

SEQ ID NO: 1529250 - RNA, 13 nt, Human
ugguggcaguggg

SEQ ID NO: 1529251 - RNA, 18 nt, Human
ugguggcagugggagcug

SEQ ID NO: 1529252 - RNA, 14 nt, Human
uggugcaaugaccu

SEQ ID NO: 1529253 - RNA, 19 nt, Human
uggugcaaugaccuuucaa

SEQ ID NO: 1529254 - RNA, 20 nt, Human
uggugcaaugaccuuucaau

SEQ ID NO: 1529255 - RNA, 17 nt, Human
ugucuacacuaagagag

SEQ ID NO: 1529256 - RNA, 22 nt, Human
ugucuacacuaagagagaauga

SEQ ID NO: 1529257 - RNA, 14 nt, Human
ugucuaaugaaacc

SEQ ID NO: 1529258 - RNA, 12 nt, Human
uguccugggagu

SEQ ID NO: 1529259 - RNA, 19 nt, Human
uguccugggagugagcugg

SEQ ID NO: 1529260 - RNA, 20 nt, Human
uguccugggagugagcuggu

SEQ ID NO: 1529261 - RNA, 17 nt, Human
uguccccgcacugggcu

SEQ ID NO: 1529262 - RNA, 19 nt, Human
uguccccgcacugggcuug

SEQ ID NO: 1529263 - RNA, 23 nt, Human
ugucuuuggacccugaggcccag

SEQ ID NO: 1529264 - RNA, 12 nt, Human
ugucuuaauuaa

SEQ ID NO: 1529265 - RNA, 16 nt, Human
ugucuuuucuugcaug

SEQ ID NO: 1529266 - RNA, 14 nt, Human
ugucuaugggacuc

SEQ ID NO: 1529267 - RNA, 15 nt, Human
ugucuaugggacuca

SEQ ID NO: 1529268 - RNA, 16 nt, Human
ugucuaugggacucaa

SEQ ID NO: 1529269 - RNA, 15 nt, Human
ugucuaguuguuuga

SEQ ID NO: 1529270 - RNA, 23 nt, Human
ugucuaguuguuugauucagaca

SEQ ID NO: 1529271 - RNA, 21 nt, Human
ugucucaaaaaaagaaaaaga

SEQ ID NO: 1529272 - RNA, 18 nt, Human
uguauuuuaaaagaauga

SEQ ID NO: 1529273 - RNA, 19 nt, Human
uguauuuuaaaagaaugau

SEQ ID NO: 1529274 - RNA, 19 nt, Human
uguauuuuacuaauaaaau

SEQ ID NO: 1529275 - RNA, 21 nt, Human
ugucaauuacaggaaguacug

SEQ ID NO: 1529276 - RNA, 13 nt, Human
ugucacacacuuu

SEQ ID NO: 1529277 - RNA, 14 nt, Human
ugucacaggcaggu

SEQ ID NO: 1529278 - RNA, 15 nt, Human
ugucacaggcagguc

SEQ ID NO: 1529279 - RNA, 16 nt, Human
ugucacaggcaggucc

SEQ ID NO: 1529280 - RNA, 17 nt, Human
ugucacaggcaggucca

SEQ ID NO: 1529281 - RNA, 21 nt, Human
ugucacaggcagguccagggu

SEQ ID NO: 1529282 - RNA, 16 nt, Human
ugucagugugacugau

SEQ ID NO: 1529283 - RNA, 19 nt, Human
ugucagugugacugaucuc

SEQ ID NO: 1529284 - RNA, 15 nt, Human
ugucagugugacuga

SEQ ID NO: 1529285 - RNA, 14 nt, Human
ugucagugugacug

SEQ ID NO: 1529286 - RNA, 20 nt, Human
uguaguguuggagaagaacu

SEQ ID NO: 1529287 - RNA, 21 nt, Human
uguaguguuggagaagaacug

SEQ ID NO: 1529288 - RNA, 14 nt, Human
uguauaaaauaauu

SEQ ID NO: 1529289 - RNA, 13 nt, Human
uguauaaaauaau

SEQ ID NO: 1529290 - RNA, 18 nt, Human
uguaggaagguuaauguu

SEQ ID NO: 1529291 - RNA, 14 nt, Human
uguagcuuuaucaa

SEQ ID NO: 1529292 - RNA, 15 nt, Human
uguagcuuuaucaaa

SEQ ID NO: 1529293 - RNA, 23 nt, Human
uguacagcaaggagauuuacaac

SEQ ID NO: 1529294 - RNA, 22 nt, Human
uguacagcaaggagauuuacaa

SEQ ID NO: 1529295 - RNA, 13 nt, Human
uguacagagccca

SEQ ID NO: 1529296 - RNA, 12 nt, Human
uguacagagccc

SEQ ID NO: 1529297 - RNA, 13 nt, Human
uguaucugagcag

SEQ ID NO: 1529298 - RNA, 18 nt, Human
ugggcagagcagagacca

SEQ ID NO: 1529299 - RNA, 14 nt, Human
ugggcagagcagag

SEQ ID NO: 1529300 - RNA, 15 nt, Human
ugggcagagcagaga

SEQ ID NO: 1529301 - RNA, 17 nt, Human
ugggcagagcagagacc

SEQ ID NO: 1529302 - RNA, 16 nt, Human
ugggaggaucucuuga

SEQ ID NO: 1529303 - RNA, 14 nt, Human
ugggacagggagga

SEQ ID NO: 1529304 - RNA, 16 nt, Human
ugggaaugaaugucag

SEQ ID NO: 1529305 - RNA, 21 nt, Human
ugggaaugaaugucaguguga

SEQ ID NO: 1529306 - RNA, 14 nt, Human
ugggacacccugug

SEQ ID NO: 1529307 - RNA, 15 nt, Human
ugggacacccuguga

SEQ ID NO: 1529308 - RNA, 18 nt, Human
ugggaggaucucuugagc

SEQ ID NO: 1529309 - RNA, 18 nt, Human
ugggaugauuggaggggg

SEQ ID NO: 1529310 - RNA, 19 nt, Human
uggggggcugaggugggag

SEQ ID NO: 1529311 - RNA, 16 nt, Human
ugggggccucagugcc

SEQ ID NO: 1529312 - RNA, 22 nt, Human
ugggcuucauccuccucagauc

SEQ ID NO: 1529313 - RNA, 15 nt, Human
ugggcuucauccucc

SEQ ID NO: 1529314 - RNA, 22 nt, Human
ugggcuucaguggcagcugcuu

SEQ ID NO: 1529315 - RNA, 13 nt, Human
uggggcagcuuga

SEQ ID NO: 1529316 - RNA, 23 nt, Human
ugggcuuggggaccagagcugcc

SEQ ID NO: 1529317 - RNA, 17 nt, Human
ugggcuugucuguagau

SEQ ID NO: 1529318 - RNA, 21 nt, Human
ugggcuugucuguagauuuua

SEQ ID NO: 1529319 - RNA, 14 nt, Human
uggcuuuaaugaau

SEQ ID NO: 1529320 - RNA, 22 nt, Human
uggcuuccuaaaauucagugga

SEQ ID NO: 1529321 - RNA, 13 nt, Human
uggccucugcacu

SEQ ID NO: 1529322 - RNA, 23 nt, Human
uggccuucggccuccauccugag

SEQ ID NO: 1529323 - RNA, 22 nt, Human
uggccuucggccuccauccuga

SEQ ID NO: 1529324 - RNA, 13 nt, Human
uggcugcugaagg

SEQ ID NO: 1529325 - RNA, 14 nt, Human
uggcugcugaaggc

SEQ ID NO: 1529326 - RNA, 16 nt, Human
uggcugcugaaggcuc

SEQ ID NO: 1529327 - RNA, 20 nt, Human
uggccuagcauacguacaca

SEQ ID NO: 1529328 - RNA, 14 nt, Human
uggccccugcccgg

SEQ ID NO: 1529329 - RNA, 21 nt, Human
uggccccucagggucccuggu

SEQ ID NO: 1529330 - RNA, 22 nt, Human
uggccccucagggucccuggug

SEQ ID NO: 1529331 - RNA, 17 nt, Human
uggcagcugcgguccac

SEQ ID NO: 1529332 - RNA, 19 nt, Human
uggcagcugcgguccaccc

SEQ ID NO: 1529333 - RNA, 13 nt, Human
uggccccucaggg

SEQ ID NO: 1529334 - RNA, 20 nt, Human
uggccccucagggucccugg

SEQ ID NO: 1529335 - RNA, 23 nt, Human
uggccuagcauacguacacauuu

SEQ ID NO: 1529336 - RNA, 18 nt, Human
uggccucaagugauucuc

SEQ ID NO: 1529337 - RNA, 23 nt, Human
uggccucaagugauucuccugcc

SEQ ID NO: 1529338 - RNA, 11 nt, Human
uggccucccaa

SEQ ID NO: 1529339 - RNA, 14 nt, Human
uggccucccaacuc

SEQ ID NO: 1529340 - RNA, 23 nt, Human
uggccucccaacucaccccagcc

SEQ ID NO: 1529341 - RNA, 19 nt, Human
uggccucccaacucacccc

SEQ ID NO: 1529342 - RNA, 20 nt, Human
uggccucccaacucacccca

SEQ ID NO: 1529343 - RNA, 21 nt, Human
uggccucccaacucaccccag

SEQ ID NO: 1529344 - RNA, 22 nt, Human
uggccucccaacucaccccagc

SEQ ID NO: 1529345 - RNA, 22 nt, Human
ugcuucuguuuuauaauuuugu

SEQ ID NO: 1529346 - RNA, 13 nt, Human
ugcuucuucagag

SEQ ID NO: 1529347 - RNA, 18 nt, Human
ugcuugugaaaggaaaga

SEQ ID NO: 1529348 - RNA, 12 nt, Human
ugcuuguguuaa

SEQ ID NO: 1529349 - RNA, 15 nt, Human
ugcuuguguuaagua

SEQ ID NO: 1529350 - RNA, 21 nt, Human
uggaaacuggaugaggucaua

SEQ ID NO: 1529351 - RNA, 22 nt, Human
uggaaaaguauguuagugcaaa

SEQ ID NO: 1529352 - RNA, 15 nt, Human
uggaacacucugaga

SEQ ID NO: 1529353 - RNA, 17 nt, Human
uggaacacucugagacu

SEQ ID NO: 1529354 - RNA, 17 nt, Human
ugcuucuguuuuauaau

SEQ ID NO: 1529355 - RNA, 22 nt, Human
ugcuuccagugaggcucugccc

SEQ ID NO: 1529356 - RNA, 23 nt, Human
ugcuuccagugaggcucugcccu

SEQ ID NO: 1529357 - RNA, 19 nt, Human
ugcuuaacuucacauauug

SEQ ID NO: 1529358 - RNA, 18 nt, Human
ugcuuaacuucacauauu

SEQ ID NO: 1529359 - RNA, 17 nt, Human
ugcuuaacuucacauau

SEQ ID NO: 1529360 - RNA, 14 nt, Human
ugcuuaacuucaca

SEQ ID NO: 1529361 - RNA, 13 nt, Human
ugcuuaacuucac

SEQ ID NO: 1529362 - RNA, 22 nt, Human
uggaugcagccucacaguccuu

SEQ ID NO: 1529363 - RNA, 13 nt, Human
uggaugcagccuc

SEQ ID NO: 1529364 - RNA, 21 nt, Human
uggaugcagccucacaguccu

SEQ ID NO: 1529365 - RNA, 23 nt, Human
uggaggggggaggugggauccuc

SEQ ID NO: 1529366 - RNA, 17 nt, Human
uggauuuaacagaaaug

SEQ ID NO: 1529367 - RNA, 15 nt, Human
uggauuuaacagaaa

SEQ ID NO: 1529368 - RNA, 21 nt, Human
uggcacuauaauguaagcucu

SEQ ID NO: 1529369 - RNA, 19 nt, Human
uggcacugcuuccagugag

SEQ ID NO: 1529370 - RNA, 22 nt, Human
uggcacuauaauguaagcucua

SEQ ID NO: 1529371 - RNA, 22 nt, Human
uggcacugcuuccagugaggcu

SEQ ID NO: 1529372 - RNA, 17 nt, Human
uggagacacaacuauuu

SEQ ID NO: 1529373 - RNA, 19 nt, Human
uggacuaacuugucuuugg

SEQ ID NO: 1529374 - RNA, 20 nt, Human
uggacuaacuugucuuugga

SEQ ID NO: 1529375 - RNA, 19 nt, Human
uggacguguuaugacucca

SEQ ID NO: 1529376 - RNA, 23 nt, Human
uggacguguuaugacuccagaau

SEQ ID NO: 1529377 - RNA, 18 nt, Human
uggacaggcauguucucu

SEQ ID NO: 1529378 - RNA, 22 nt, Human
uggacaggcauguucucugagg

SEQ ID NO: 1529379 - RNA, 23 nt, Human
uggacaggcauguucucugagga

SEQ ID NO: 1529380 - RNA, 23 nt, Human
ugaugcuucuucagagacuccug

SEQ ID NO: 1529381 - RNA, 13 nt, Human
ugauguauucuag

SEQ ID NO: 1529382 - RNA, 14 nt, Human
ugauguauucuagc

SEQ ID NO: 1529383 - RNA, 20 nt, Human
ugauguauucuagcuaaugu

SEQ ID NO: 1529384 - RNA, 21 nt, Human
ugauguauucuagcuaaugua

SEQ ID NO: 1529385 - RNA, 19 nt, Human
ugaugcuucuucagagacu

SEQ ID NO: 1529386 - RNA, 21 nt, Human
ugaugcuucuucagagacucc

SEQ ID NO: 1529387 - RNA, 22 nt, Human
ugaugcuucuucagagacuccu

SEQ ID NO: 1529388 - RNA, 23 nt, Human
ugaugaucuuugcagacaggcaa

SEQ ID NO: 1529389 - RNA, 20 nt, Human
ugaugaugaaaugaggucag

SEQ ID NO: 1529390 - RNA, 14 nt, Human
ugaugccaugagga

SEQ ID NO: 1529391 - RNA, 21 nt, Human
ugaucuuugcagacaggcaag

SEQ ID NO: 1529392 - RNA, 23 nt, Human
ugaucuuugcagacaggcaagca

SEQ ID NO: 1529393 - RNA, 19 nt, Human
ugaucuuugcagacaggca

SEQ ID NO: 1529394 - RNA, 20 nt, Human
ugaucuuugcagacaggcaa

SEQ ID NO: 1529395 - RNA, 24 nt, Human
ugauaguuguaccgcaaugugacu

SEQ ID NO: 1529396 - RNA, 22 nt, Human
ugaucacggcucacugcagccu

SEQ ID NO: 1529397 - RNA, 21 nt, Human
ugauccacccaccucagccuc

SEQ ID NO: 1529398 - RNA, 22 nt, Human
ugauccacccaccucagccucc

SEQ ID NO: 1529399 - RNA, 19 nt, Human
ugaucuaggaagacuuugg

SEQ ID NO: 1529400 - RNA, 21 nt, Human
ugaucuaggaagacuuuggaa

SEQ ID NO: 1529401 - RNA, 13 nt, Human
ugaucauccacug

SEQ ID NO: 1529402 - RNA, 24 nt, Human
ugaucauccacugugccaugugcc

SEQ ID NO: 1529403 - RNA, 21 nt, Human
ugauccaagcuggucccacuc

SEQ ID NO: 1529404 - RNA, 15 nt, Human
ugauccacccaccuc

SEQ ID NO: 1529405 - RNA, 16 nt, Human
ugauccacccaccuca

SEQ ID NO: 1529406 - RNA, 20 nt, Human
ugauccacccaccucagccu

SEQ ID NO: 1529407 - RNA, 20 nt, Human
ugaguugguguugacaugug

SEQ ID NO: 1529408 - RNA, 15 nt, Human
ugagucgaggacagg

SEQ ID NO: 1529409 - RNA, 16 nt, Human
ugagucgaggacaggg

SEQ ID NO: 1529410 - RNA, 23 nt, Human
ugaguugauagcacagacccugc

SEQ ID NO: 1529411 - RNA, 16 nt, Human
ugaguugauucagcuc

SEQ ID NO: 1529412 - RNA, 19 nt, Human
ugaguugauucagcucugc

SEQ ID NO: 1529413 - RNA, 18 nt, Human
ugagucgaggacagggag

SEQ ID NO: 1529414 - RNA, 22 nt, Human
ugauagcacagacccugcccug

SEQ ID NO: 1529415 - RNA, 23 nt, Human
ugauagcacagacccugcccugu

SEQ ID NO: 1529416 - RNA, 15 nt, Human
ugauagcacagaccc

SEQ ID NO: 1529417 - RNA, 16 nt, Human
ugauagcacagacccu

SEQ ID NO: 1529418 - RNA, 17 nt, Human
ugauagcacagacccug

SEQ ID NO: 1529419 - RNA, 18 nt, Human
ugauagcacagacccugc

SEQ ID NO: 1529420 - RNA, 20 nt, Human
ugauagcacagacccugccc

SEQ ID NO: 1529421 - RNA, 21 nt, Human
ugauagcacagacccugcccu

SEQ ID NO: 1529422 - RNA, 11 nt, Human
ugaggcugggc

SEQ ID NO: 1529423 - RNA, 15 nt, Human
ugaggucuguucuuu

SEQ ID NO: 1529424 - RNA, 14 nt, Human
ugaggucuguucuu

SEQ ID NO: 1529425 - RNA, 20 nt, Human
ugaggucuguucuuuccaaa

SEQ ID NO: 1529426 - RNA, 14 nt, Human
ugagucgaggacag

SEQ ID NO: 1529427 - RNA, 19 nt, Human
ugaguccuggcaugggaau

SEQ ID NO: 1529428 - RNA, 22 nt, Human
ugaguccuggcaugggaaugaa

SEQ ID NO: 1529429 - RNA, 11 nt, Human
ugaguccuggc

SEQ ID NO: 1529430 - RNA, 18 nt, Human
ugaguccuggcaugggaa

SEQ ID NO: 1529431 - RNA, 19 nt, Human
ugagguuucaaaccucccu

SEQ ID NO: 1529432 - RNA, 21 nt, Human
ugaguccccuguuuguuucug

SEQ ID NO: 1529433 - RNA, 16 nt, Human
ugaggugcuauguucu

SEQ ID NO: 1529434 - RNA, 17 nt, Human
ugagcagucaggaaaga

SEQ ID NO: 1529435 - RNA, 15 nt, Human
ugagcagucaggaaa

SEQ ID NO: 1529436 - RNA, 20 nt, Human
ugagcagucaggaaagagaa

SEQ ID NO: 1529437 - RNA, 13 nt, Human
ugagcaucaggcc

SEQ ID NO: 1529438 - RNA, 14 nt, Human
ugagaugcuagaac

SEQ ID NO: 1529439 - RNA, 16 nt, Human
ugagaugcuagaacuc

SEQ ID NO: 1529440 - RNA, 20 nt, Human
ugagaugcuagaacucccuu

SEQ ID NO: 1529441 - RNA, 16 nt, Human
ugagcaucaggccagg

SEQ ID NO: 1529442 - RNA, 14 nt, Human
ugagcaucaggcca

SEQ ID NO: 1529443 - RNA, 15 nt, Human
ugagcaucaggccag

SEQ ID NO: 1529444 - RNA, 13 nt, Human
ugagccccaaaag

SEQ ID NO: 1529445 - RNA, 13 nt, Human
ugagccucagcau

SEQ ID NO: 1529446 - RNA, 15 nt, Human
ugagccucagcaucc

SEQ ID NO: 1529447 - RNA, 20 nt, Human
ugagaaagacuauucaaaca

SEQ ID NO: 1529448 - RNA, 18 nt, Human
ugagaaagacuauucaaa

SEQ ID NO: 1529449 - RNA, 16 nt, Human
ugagaaagacuauuca

SEQ ID NO: 1529450 - RNA, 17 nt, Human
ugagaaagacuauucaa

SEQ ID NO: 1529451 - RNA, 14 nt, Human
ugagacagcucugc

SEQ ID NO: 1529452 - RNA, 16 nt, Human
ugagacagcucugcau

SEQ ID NO: 1529453 - RNA, 12 nt, Human
ugagacccuguc

SEQ ID NO: 1529454 - RNA, 12 nt, Human
ugagacucuguc

SEQ ID NO: 1529455 - RNA, 13 nt, Human
ugagacucugucu

SEQ ID NO: 1529456 - RNA, 14 nt, Human
ugagacucugucuc

SEQ ID NO: 1529457 - RNA, 23 nt, Human
ugagaggcauccaguaucuugaa

SEQ ID NO: 1529458 - RNA, 22 nt, Human
ugagaggcauccaguaucuuga

SEQ ID NO: 1529459 - RNA, 17 nt, Human
ugagaguagagucacug

SEQ ID NO: 1529460 - RNA, 18 nt, Human
ugagauccuuccuuuuga

SEQ ID NO: 1529461 - RNA, 13 nt, Human
ugacucuuaagaa

SEQ ID NO: 1529462 - RNA, 15 nt, Human
ugacugaauuucuuu

SEQ ID NO: 1529463 - RNA, 14 nt, Human
ugacugaauuucuu

SEQ ID NO: 1529464 - RNA, 12 nt, Human
ugacucuuaaga

SEQ ID NO: 1529465 - RNA, 13 nt, Human
ugacugaauuucu

SEQ ID NO: 1529466 - RNA, 18 nt, Human
ugaccuuucaauaggaaa

SEQ ID NO: 1529467 - RNA, 22 nt, Human
ugaccuuucaauaggaaaaacu

SEQ ID NO: 1529468 - RNA, 13 nt, Human
ugacgccauccca

SEQ ID NO: 1529469 - RNA, 14 nt, Human
ugacgccaucccag

SEQ ID NO: 1529470 - RNA, 15 nt, Human
ugacgccaucccagc

SEQ ID NO: 1529471 - RNA, 16 nt, Human
ugacgccaucccagcc

SEQ ID NO: 1529472 - RNA, 17 nt, Human
ugacgccaucccagccc

SEQ ID NO: 1529473 - RNA, 18 nt, Human
ugacgccaucccagcccc

SEQ ID NO: 1529474 - RNA, 19 nt, Human
ugacgccaucccagcccca

SEQ ID NO: 1529475 - RNA, 20 nt, Human
ugacgccaucccagccccaa

SEQ ID NO: 1529476 - RNA, 15 nt, Human
ucuugaacuccuggc

SEQ ID NO: 1529477 - RNA, 17 nt, Human
ucuugaauuguaaggaa

SEQ ID NO: 1529478 - RNA, 20 nt, Human
ugaccauucuccaccugcca

SEQ ID NO: 1529479 - RNA, 21 nt, Human
ugaccauucuccaccugccag

SEQ ID NO: 1529480 - RNA, 22 nt, Human
ugaccauucuccaccugccagg

SEQ ID NO: 1529481 - RNA, 23 nt, Human
ugaccauucuccaccugccaggg

SEQ ID NO: 1529482 - RNA, 16 nt, Human
ugaccucugcagcaau

SEQ ID NO: 1529483 - RNA, 13 nt, Human
ugaccucugcagc

SEQ ID NO: 1529484 - RNA, 22 nt, Human
ugaccucaggugauccacccac

SEQ ID NO: 1529485 - RNA, 23 nt, Human
ugaccucugcagcaauaaagcag

SEQ ID NO: 1529486 - RNA, 12 nt, Human
ugaccucugccu

SEQ ID NO: 1529487 - RNA, 21 nt, Human
ugaccucugcagcaauaaagc

SEQ ID NO: 1529488 - RNA, 18 nt, Human
ugaccucugcagcaauaa

SEQ ID NO: 1529489 - RNA, 14 nt, Human
ugaccuuucaauag

SEQ ID NO: 1529490 - RNA, 15 nt, Human
ugaccuuucaauagg

SEQ ID NO: 1529491 - RNA, 16 nt, Human
ugaccuuucaauagga

SEQ ID NO: 1529492 - RNA, 14 nt, Human
ugcauuauauuuau

SEQ ID NO: 1529493 - RNA, 12 nt, Human
ugcauuaucuag

SEQ ID NO: 1529494 - RNA, 18 nt, Human
ugcauuaucuagauacug

SEQ ID NO: 1529495 - RNA, 17 nt, Human
ugcauuaucuagauacu

SEQ ID NO: 1529496 - RNA, 17 nt, Human
ugccacaggcuuaggga

SEQ ID NO: 1529497 - RNA, 21 nt, Human
ugccacaggcuuagggacagg

SEQ ID NO: 1529498 - RNA, 20 nt, Human
ugccacaggcuuagggacag

SEQ ID NO: 1529499 - RNA, 19 nt, Human
ugcagauaaacaguaguga

SEQ ID NO: 1529500 - RNA, 15 nt, Human
ugcauguuugugauu

SEQ ID NO: 1529501 - RNA, 14 nt, Human
ugccaugugccagg

SEQ ID NO: 1529502 - RNA, 15 nt, Human
ugccaugugccaggu

SEQ ID NO: 1529503 - RNA, 23 nt, Human
ugccaugaggaacaaggcaaggc

SEQ ID NO: 1529504 - RNA, 20 nt, Human
ugccaugaggaacaaggcaa

SEQ ID NO: 1529505 - RNA, 18 nt, Human
ugcccacgcuggagugca

SEQ ID NO: 1529506 - RNA, 13 nt, Human
ugcccacucccug

SEQ ID NO: 1529507 - RNA, 12 nt, Human
ugccauguuggc

SEQ ID NO: 1529508 - RNA, 15 nt, Human
ugccauguuggccag

SEQ ID NO: 1529509 - RNA, 16 nt, Human
ugccauguuggccagg

SEQ ID NO: 1529510 - RNA, 20 nt, Human
ugcccaccuggccucugcac

SEQ ID NO: 1529511 - RNA, 12 nt, Human
ugccaggaagcc

SEQ ID NO: 1529512 - RNA, 16 nt, Human
ugccaggaagccagca

SEQ ID NO: 1529513 - RNA, 18 nt, Human
ugccaggaagccagcagg

SEQ ID NO: 1529514 - RNA, 19 nt, Human
ugccaggaagccagcaggc

SEQ ID NO: 1529515 - RNA, 17 nt, Human
ugccagguuuuuggucu

SEQ ID NO: 1529516 - RNA, 15 nt, Human
ugccauccagguuca

SEQ ID NO: 1529517 - RNA, 20 nt, Human
ugccauccagguucagcuug

SEQ ID NO: 1529518 - RNA, 12 nt, Human
ugccauccaggu

SEQ ID NO: 1529519 - RNA, 19 nt, Human
ugcccuaaaguguauuuuu

SEQ ID NO: 1529520 - RNA, 17 nt, Human
ugcccuaaaguguauuu

SEQ ID NO: 1529521 - RNA, 22 nt, Human
ugcccugcccaccuggccucug

SEQ ID NO: 1529522 - RNA, 23 nt, Human
ugcccugcccaccuggccucugc

SEQ ID NO: 1529523 - RNA, 21 nt, Human
ugccguguccccugacagggc

SEQ ID NO: 1529524 - RNA, 17 nt, Human
ugccgucuaccugaggg

SEQ ID NO: 1529525 - RNA, 19 nt, Human
ugccgucuaccugaggggc

SEQ ID NO: 1529526 - RNA, 15 nt, Human
ugccgucuaccugag

SEQ ID NO: 1529527 - RNA, 16 nt, Human
ugccgucuaccugagg

SEQ ID NO: 1529528 - RNA, 16 nt, Human
ugcccuggaugcccag

SEQ ID NO: 1529529 - RNA, 18 nt, Human
ugcccuggaugcccagga

SEQ ID NO: 1529530 - RNA, 21 nt, Human
ugccucuucucuacucuaggg

SEQ ID NO: 1529531 - RNA, 13 nt, Human
ugccugcccaggc

SEQ ID NO: 1529532 - RNA, 17 nt, Human
ugccugguggcagcugc

SEQ ID NO: 1529533 - RNA, 18 nt, Human
ugccugguggcagcugcg

SEQ ID NO: 1529534 - RNA, 19 nt, Human
ugccugguggcagcugcgg

SEQ ID NO: 1529535 - RNA, 22 nt, Human
ugccuccuuugugaggaagccg

SEQ ID NO: 1529536 - RNA, 21 nt, Human
ugccuccuuugugaggaagcc

SEQ ID NO: 1529537 - RNA, 12 nt, Human
ugccuccucagg

SEQ ID NO: 1529538 - RNA, 14 nt, Human
ugccucugggacug

SEQ ID NO: 1529539 - RNA, 13 nt, Human
ugccucugggacu

SEQ ID NO: 1529540 - RNA, 22 nt, Human
ugauuuuuuuuuccuucagugc

SEQ ID NO: 1529541 - RNA, 23 nt, Human
ugauuuuuuuuuccuucagugcc

SEQ ID NO: 1529542 - RNA, 16 nt, Human
ugauuuuuuuuuccuu

SEQ ID NO: 1529543 - RNA, 17 nt, Human
ugauuuuuuuuuccuuc

SEQ ID NO: 1529544 - RNA, 19 nt, Human
ugauuuuuuuuuccuucag

SEQ ID NO: 1529545 - RNA, 20 nt, Human
ugauuuuuuuuuccuucagu

SEQ ID NO: 1529546 - RNA, 15 nt, Human
ugauuuucauugcug

SEQ ID NO: 1529547 - RNA, 13 nt, Human
ugauuuucauugc

SEQ ID NO: 1529548 - RNA, 22 nt, Human
ugcaacucugaaggguaauuau

SEQ ID NO: 1529549 - RNA, 22 nt, Human
ugcaaccugauugugucucuug

SEQ ID NO: 1529550 - RNA, 19 nt, Human
ugcaaccugauugugucuc

SEQ ID NO: 1529551 - RNA, 20 nt, Human
ugcaaccugauugugucucu

SEQ ID NO: 1529552 - RNA, 18 nt, Human
ugcaaccuccgccucuug

SEQ ID NO: 1529553 - RNA, 20 nt, Human
ugcaaccuccgccucuuggg

SEQ ID NO: 1529554 - RNA, 21 nt, Human
ugcaaccuccgccucuugggu

SEQ ID NO: 1529555 - RNA, 13 nt, Human
ugcaaccuccgcc

SEQ ID NO: 1529556 - RNA, 14 nt, Human
ugcaaccuccgccu

SEQ ID NO: 1529557 - RNA, 19 nt, Human
ugcaacaggcugggcuuca

SEQ ID NO: 1529558 - RNA, 20 nt, Human
ugcaacaggcugggcuucag

SEQ ID NO: 1529559 - RNA, 14 nt, Human
ugcaacaggcuggg

SEQ ID NO: 1529560 - RNA, 15 nt, Human
ugcaacaggcugggc

SEQ ID NO: 1529561 - RNA, 16 nt, Human
ugcaacaggcugggcu

SEQ ID NO: 1529562 - RNA, 17 nt, Human
ugcaacaggcugggcuu

SEQ ID NO: 1529563 - RNA, 20 nt, Human
ugcacagaguuguuacauuu

SEQ ID NO: 1529564 - RNA, 19 nt, Human
ugcaccggcuggccuggcc

SEQ ID NO: 1529565 - RNA, 20 nt, Human
ugcaccggcuggccuggccc

SEQ ID NO: 1529566 - RNA, 22 nt, Human
ugcaccuggaauauauaaccag

SEQ ID NO: 1529567 - RNA, 20 nt, Human
ugcaccuggaauauauaacc

SEQ ID NO: 1529568 - RNA, 17 nt, Human
ugcaccuggaauauaua

SEQ ID NO: 1529569 - RNA, 21 nt, Human
ugcaccggcuggccuggcccc

SEQ ID NO: 1529570 - RNA, 18 nt, Human
ugcacugacauuguuggc

SEQ ID NO: 1529571 - RNA, 21 nt, Human
ugcacugacauuguuggccaa

SEQ ID NO: 1529572 - RNA, 16 nt, Human
ugcacuugcagacucu

SEQ ID NO: 1529573 - RNA, 13 nt, Human
ugcaauggcagcc

SEQ ID NO: 1529574 - RNA, 14 nt, Human
ugcaauggcagccu

SEQ ID NO: 1529575 - RNA, 15 nt, Human
ugcaauggcagccuu

SEQ ID NO: 1529576 - RNA, 16 nt, Human
ugcaauggcagccuug

SEQ ID NO: 1529577 - RNA, 13 nt, Human
ugcaaugaccuuu

SEQ ID NO: 1529578 - RNA, 16 nt, Human
ugcaaugaccuuucaa

SEQ ID NO: 1529579 - RNA, 17 nt, Human
ugcaaugaccuuucaau

SEQ ID NO: 1529580 - RNA, 19 nt, Human
ugcaaugaccuuucaauag

SEQ ID NO: 1529581 - RNA, 22 nt, Human
ugcaaugaccuuucaauaggaa

SEQ ID NO: 1529582 - RNA, 23 nt, Human
ugcaaugaccuuucaauaggaaa

SEQ ID NO: 1529583 - RNA, 19 nt, Human
ugcacagaguuguuacauu

SEQ ID NO: 1529584 - RNA, 18 nt, Human
ugcacagaguuguuacau

SEQ ID NO: 1529585 - RNA, 17 nt, Human
ugcacagaguuguuaca

SEQ ID NO: 1529586 - RNA, 20 nt, Human
ugcacaaacagaggccgcca

SEQ ID NO: 1529587 - RNA, 17 nt, Human
ugcacaaacagaggccg

SEQ ID NO: 1529588 - RNA, 19 nt, Human
ugcacaaacagaggccgcc

SEQ ID NO: 1529589 - RNA, 15 nt, Human
ugcacaaacagaggc

SEQ ID NO: 1529590 - RNA, 16 nt, Human
ugcacaaacagaggcc

SEQ ID NO: 1529591 - RNA, 14 nt, Human
ugcaauuucauaug

SEQ ID NO: 1529592 - RNA, 20 nt, Human
ugcaauuucauaugcuguau

SEQ ID NO: 1529593 - RNA, 16 nt, Human
ucugucgcccagucug

SEQ ID NO: 1529594 - RNA, 14 nt, Human
ucugucgcccaguc

SEQ ID NO: 1529595 - RNA, 20 nt, Human
ucuguccuacucugugucag

SEQ ID NO: 1529596 - RNA, 15 nt, Human
ucuguccuacucugu

SEQ ID NO: 1529597 - RNA, 19 nt, Human
ucuguccuacucuguguca

SEQ ID NO: 1529598 - RNA, 22 nt, Human
ucuggcuaugcauuugaaaauu

SEQ ID NO: 1529599 - RNA, 19 nt, Human
ucuggcuaugcauuugaaa

SEQ ID NO: 1529600 - RNA, 17 nt, Human
ucuggccuucggccucc

SEQ ID NO: 1529601 - RNA, 18 nt, Human
ucuggccuucggccucca

SEQ ID NO: 1529602 - RNA, 23 nt, Human
ucuggccuucggccuccauccug

SEQ ID NO: 1529603 - RNA, 23 nt, Human
ucuggcucuuccaggcugggaga

SEQ ID NO: 1529604 - RNA, 23 nt, Human
ucuggugacuuuccucuuugguc

SEQ ID NO: 1529605 - RNA, 14 nt, Human
ucugggacacaguu

SEQ ID NO: 1529606 - RNA, 18 nt, Human
ucugccauauucuguugg

SEQ ID NO: 1529607 - RNA, 14 nt, Human
ucugccugcccagg

SEQ ID NO: 1529608 - RNA, 15 nt, Human
ucugccugcccaggc

SEQ ID NO: 1529609 - RNA, 16 nt, Human
ucugccugcccaggcc

SEQ ID NO: 1529610 - RNA, 18 nt, Human
ucugcuccucuccccagc

SEQ ID NO: 1529611 - RNA, 21 nt, Human
ucugcuccucuccccagcaag

SEQ ID NO: 1529612 - RNA, 18 nt, Human
ucugcugacagacacagg

SEQ ID NO: 1529613 - RNA, 21 nt, Human
ucuggacaggcauguucucug

SEQ ID NO: 1529614 - RNA, 16 nt, Human
ucuggaaugcaguggu

SEQ ID NO: 1529615 - RNA, 14 nt, Human
ucuggacaggcaug

SEQ ID NO: 1529616 - RNA, 15 nt, Human
ucuggaaugcagugg

SEQ ID NO: 1529617 - RNA, 19 nt, Human
ucuggaauaaggagaauga

SEQ ID NO: 1529618 - RNA, 19 nt, Human
ucugcugacagacacaggc

SEQ ID NO: 1529619 - RNA, 20 nt, Human
ucugcugacagacacaggcc

SEQ ID NO: 1529620 - RNA, 21 nt, Human
ucugcugacagacacaggccc

SEQ ID NO: 1529621 - RNA, 22 nt, Human
ucugcugacagacacaggcccg

SEQ ID NO: 1529622 - RNA, 12 nt, Human
ucuuaagaagac

SEQ ID NO: 1529623 - RNA, 18 nt, Human
ucuuaagaagacugcauu

SEQ ID NO: 1529624 - RNA, 17 nt, Human
ucuuagcuccccuccaa

SEQ ID NO: 1529625 - RNA, 22 nt, Human
ucuuaaauauguggaguucauc

SEQ ID NO: 1529626 - RNA, 15 nt, Human
ucugucuucacaaca

SEQ ID NO: 1529627 - RNA, 17 nt, Human
ucuuaaacaaauguaug

SEQ ID NO: 1529628 - RNA, 13 nt, Human
ucuuaaaaagugg

SEQ ID NO: 1529629 - RNA, 10 nt, Human
ucuucucauu

SEQ ID NO: 1529630 - RNA, 22 nt, Human
ucuucucauuucaccccucccu

SEQ ID NO: 1529631 - RNA, 23 nt, Human
ucuucucauuucaccccucccuu

SEQ ID NO: 1529632 - RNA, 15 nt, Human
ucuucucauuucacc

SEQ ID NO: 1529633 - RNA, 18 nt, Human
ucuucucauuucaccccu

SEQ ID NO: 1529634 - RNA, 19 nt, Human
ucuucucauuucaccccuc

SEQ ID NO: 1529635 - RNA, 20 nt, Human
ucuucucauuucaccccucc

SEQ ID NO: 1529636 - RNA, 12 nt, Human
ucuugaacuccu

SEQ ID NO: 1529637 - RNA, 22 nt, Human
ucuuaggguuaugauuaaguaa

SEQ ID NO: 1529638 - RNA, 23 nt, Human
ucuucagaucucuaacuucacca

SEQ ID NO: 1529639 - RNA, 18 nt, Human
ucuucagaucucuaacuu

SEQ ID NO: 1529640 - RNA, 19 nt, Human
ucuucaucugacuaugaca

SEQ ID NO: 1529641 - RNA, 19 nt, Human
ucucugugagacucgagaa

SEQ ID NO: 1529642 - RNA, 22 nt, Human
ucucugugagacucgagaacuu

SEQ ID NO: 1529643 - RNA, 14 nt, Human
ucucugugagacuc

SEQ ID NO: 1529644 - RNA, 15 nt, Human
ucucugauacagaaa

SEQ ID NO: 1529645 - RNA, 17 nt, Human
ucucugaggacacuaac

SEQ ID NO: 1529646 - RNA, 15 nt, Human
ucucuaguuugauua

SEQ ID NO: 1529647 - RNA, 16 nt, Human
ucucuaguuugauuaa

SEQ ID NO: 1529648 - RNA, 21 nt, Human
ucuccuggaaauauuaagaaa

SEQ ID NO: 1529649 - RNA, 15 nt, Human
ucuccuguaccucuu

SEQ ID NO: 1529650 - RNA, 19 nt, Human
ucuccugccucagccuccc

SEQ ID NO: 1529651 - RNA, 17 nt, Human
ucuccugccucagccuc

SEQ ID NO: 1529652 - RNA, 15 nt, Human
ucuccugccucagcc

SEQ ID NO: 1529653 - RNA, 17 nt, Human
ucuccuguaccucuuga

SEQ ID NO: 1529654 - RNA, 16 nt, Human
ucuccuguaccucuug

SEQ ID NO: 1529655 - RNA, 19 nt, Human
ucuccuguaccucuugagc

SEQ ID NO: 1529656 - RNA, 14 nt, Human
ucucgugauugaua

SEQ ID NO: 1529657 - RNA, 22 nt, Human
ucucgugauugauaagaaccuu

SEQ ID NO: 1529658 - RNA, 12 nt, Human
ucucuaacuuca

SEQ ID NO: 1529659 - RNA, 19 nt, Human
ucucuaacuucaccauauu

SEQ ID NO: 1529660 - RNA, 14 nt, Human
ucugcaacucugaa

SEQ ID NO: 1529661 - RNA, 15 nt, Human
ucugcaacucugaag

SEQ ID NO: 1529662 - RNA, 20 nt, Human
ucugcaagaauugaagcagg

SEQ ID NO: 1529663 - RNA, 21 nt, Human
ucugcaagaauugaagcagga

SEQ ID NO: 1529664 - RNA, 14 nt, Human
ucugacccacugcu

SEQ ID NO: 1529665 - RNA, 15 nt, Human
ucugacccacugcuu

SEQ ID NO: 1529666 - RNA, 19 nt, Human
ucugcaucagcugcugaaa

SEQ ID NO: 1529667 - RNA, 21 nt, Human
ucugcaucagcugcugaaaca

SEQ ID NO: 1529668 - RNA, 17 nt, Human
ucugaaauuuccuggga

SEQ ID NO: 1529669 - RNA, 18 nt, Human
ucugaaauuuccugggag

SEQ ID NO: 1529670 - RNA, 20 nt, Human
ucugaaauuuccugggagcu

SEQ ID NO: 1529671 - RNA, 16 nt, Human
ucugacacacagcucu

SEQ ID NO: 1529672 - RNA, 17 nt, Human
ucugacacacagcucug

SEQ ID NO: 1529673 - RNA, 18 nt, Human
ucugacacacagcucugu

SEQ ID NO: 1529674 - RNA, 19 nt, Human
ucugacacacagcucuguc

SEQ ID NO: 1529675 - RNA, 13 nt, Human
ucugacccacugc

SEQ ID NO: 1529676 - RNA, 12 nt, Human
ucugacaggcaa

SEQ ID NO: 1529677 - RNA, 21 nt, Human
ucugacaggcaaugcuggcug

SEQ ID NO: 1529678 - RNA, 22 nt, Human
ucugacaggcaaugcuggcugu

SEQ ID NO: 1529679 - RNA, 14 nt, Human
ucugaaaauguaug

SEQ ID NO: 1529680 - RNA, 13 nt, Human
ucugaaaauguau

SEQ ID NO: 1529681 - RNA, 16 nt, Human
ucucuuagcuccccuc

SEQ ID NO: 1529682 - RNA, 17 nt, Human
ucucuuagcuccccucc

SEQ ID NO: 1529683 - RNA, 18 nt, Human
ucucuuagcuccccucca

SEQ ID NO: 1529684 - RNA, 19 nt, Human
ucucuuagcuccccuccaa

SEQ ID NO: 1529685 - RNA, 13 nt, Human
ucguuaauuugua

SEQ ID NO: 1529686 - RNA, 21 nt, Human
ucuaaaucuccaaaauaaaac

SEQ ID NO: 1529687 - RNA, 22 nt, Human
ucuaaaucuccaaaauaaaacu

SEQ ID NO: 1529688 - RNA, 21 nt, Human
ucguggaacaguuaccucugc

SEQ ID NO: 1529689 - RNA, 22 nt, Human
ucgugggacagucaccucaugg

SEQ ID NO: 1529690 - RNA, 22 nt, Human
ucgugccaccccgagggcugag

SEQ ID NO: 1529691 - RNA, 16 nt, Human
ucgugauugauaagaa

SEQ ID NO: 1529692 - RNA, 18 nt, Human
ucggccuccauccugagg

SEQ ID NO: 1529693 - RNA, 23 nt, Human
ucuaggacugaauuaugaaacuu

SEQ ID NO: 1529694 - RNA, 16 nt, Human
ucuaggacugaauuau

SEQ ID NO: 1529695 - RNA, 22 nt, Human
ucuagugagcagucaggaaaga

SEQ ID NO: 1529696 - RNA, 19 nt, Human
ucuagugagcagucaggaa

SEQ ID NO: 1529697 - RNA, 18 nt, Human
ucuaggaggucucuaaga

SEQ ID NO: 1529698 - RNA, 14 nt, Human
ucuaauauguaaca

SEQ ID NO: 1529699 - RNA, 14 nt, Human
ucuaugaaauauua

SEQ ID NO: 1529700 - RNA, 17 nt, Human
ucuaugaaauauuaugu

SEQ ID NO: 1529701 - RNA, 18 nt, Human
ucuaugaaauauuauguu

SEQ ID NO: 1529702 - RNA, 15 nt, Human
ucuaucaaguauuau

SEQ ID NO: 1529703 - RNA, 22 nt, Human
ucuaucaaguauuauaccuuuu

SEQ ID NO: 1529704 - RNA, 21 nt, Human
ucuaucaaguauuauaccuuu

SEQ ID NO: 1529705 - RNA, 17 nt, Human
ucucaaauaacuaaaag

SEQ ID NO: 1529706 - RNA, 16 nt, Human
uccuuggacucauuuu

SEQ ID NO: 1529707 - RNA, 23 nt, Human
uccuuuucacaguucucuccuuc

SEQ ID NO: 1529708 - RNA, 13 nt, Human
ucgaacuggcugc

SEQ ID NO: 1529709 - RNA, 18 nt, Human
uccuuuucgcaggauucu

SEQ ID NO: 1529710 - RNA, 21 nt, Human
uccuucaccuuuguccccacc

SEQ ID NO: 1529711 - RNA, 22 nt, Human
uccuucaccuuuguccccaccg

SEQ ID NO: 1529712 - RNA, 16 nt, Human
uccuuaccagcagagc

SEQ ID NO: 1529713 - RNA, 17 nt, Human
uccuuaccagcagagca

SEQ ID NO: 1529714 - RNA, 18 nt, Human
uccuuaccagcagagcac

SEQ ID NO: 1529715 - RNA, 18 nt, Human
uccuucacagaugggugc

SEQ ID NO: 1529716 - RNA, 19 nt, Human
uccuucacagaugggugcu

SEQ ID NO: 1529717 - RNA, 20 nt, Human
uccuuaccagcagagcaccu

SEQ ID NO: 1529718 - RNA, 18 nt, Human
uccuucaccuuugucccc

SEQ ID NO: 1529719 - RNA, 20 nt, Human
uccuucaccuuuguccccac

SEQ ID NO: 1529720 - RNA, 17 nt, Human
uccugccucagccuccc

SEQ ID NO: 1529721 - RNA, 16 nt, Human
uccugccucagccucc

SEQ ID NO: 1529722 - RNA, 13 nt, Human
uccugccucagcc

SEQ ID NO: 1529723 - RNA, 15 nt, Human
uccugccucagccuc

SEQ ID NO: 1529724 - RNA, 14 nt, Human
uccuggcacccggc

SEQ ID NO: 1529725 - RNA, 16 nt, Human
uccuggcacccggccc

SEQ ID NO: 1529726 - RNA, 19 nt, Human
uccuggcacccggccccug

SEQ ID NO: 1529727 - RNA, 14 nt, Human
uccugccucagccu

SEQ ID NO: 1529728 - RNA, 20 nt, Human
uccugccuaagugcagcccc

SEQ ID NO: 1529729 - RNA, 14 nt, Human
uccugagccagauu

SEQ ID NO: 1529730 - RNA, 13 nt, Human
uccugagccagau

SEQ ID NO: 1529731 - RNA, 20 nt, Human
uccuguaccucuugagccuu

SEQ ID NO: 1529732 - RNA, 22 nt, Human
uccuguaccucuugagccuuga

SEQ ID NO: 1529733 - RNA, 18 nt, Human
uccuggcacugcuuccag

SEQ ID NO: 1529734 - RNA, 22 nt, Human
uccuggcacugcuuccagugag

SEQ ID NO: 1529735 - RNA, 20 nt, Human
uccuggcacccggccccugc

SEQ ID NO: 1529736 - RNA, 21 nt, Human
uccuggcacccggccccugcu

SEQ ID NO: 1529737 - RNA, 22 nt, Human
uccuggcacccggccccugcug

SEQ ID NO: 1529738 - RNA, 16 nt, Human
ucccuauuagagaaga

SEQ ID NO: 1529739 - RNA, 17 nt, Human
uccagguuuaagcuguu

SEQ ID NO: 1529740 - RNA, 18 nt, Human
uccagguuuaagcuguua

SEQ ID NO: 1529741 - RNA, 20 nt, Human
uccccuguuuguuucugaaa

SEQ ID NO: 1529742 - RNA, 21 nt, Human
uccccuguuuguuucugaaag

SEQ ID NO: 1529743 - RNA, 15 nt, Human
ucccuugaugaagaa

SEQ ID NO: 1529744 - RNA, 16 nt, Human
ucccuugaugaagaag

SEQ ID NO: 1529745 - RNA, 14 nt, Human
ucccuucccaccuc

SEQ ID NO: 1529746 - RNA, 13 nt, Human
ucccuucccaccu

SEQ ID NO: 1529747 - RNA, 13 nt, Human
ucccugcacuugc

SEQ ID NO: 1529748 - RNA, 20 nt, Human
ucccugcacuugcagacucu

SEQ ID NO: 1529749 - RNA, 14 nt, Human
ucccugcacuugca

SEQ ID NO: 1529750 - RNA, 16 nt, Human
uccuaaucuucugaac

SEQ ID NO: 1529751 - RNA, 13 nt, Human
uccgaccagacac

SEQ ID NO: 1529752 - RNA, 17 nt, Human
uccgaccagacaccuug

SEQ ID NO: 1529753 - RNA, 18 nt, Human
uccuacccacccuccuuu

SEQ ID NO: 1529754 - RNA, 17 nt, Human
uccucauuagcauuuug

SEQ ID NO: 1529755 - RNA, 21 nt, Human
uccuauauuguuuucagugua

SEQ ID NO: 1529756 - RNA, 18 nt, Human
uccuauauuguuuucagu

SEQ ID NO: 1529757 - RNA, 23 nt, Human
uccuccacucucccccacccccu

SEQ ID NO: 1529758 - RNA, 16 nt, Human
uccuccacucuccccc

SEQ ID NO: 1529759 - RNA, 19 nt, Human
uccuccacucucccccacc

SEQ ID NO: 1529760 - RNA, 19 nt, Human
uccuccuuuucacaguucu

SEQ ID NO: 1529761 - RNA, 14 nt, Human
uccucuaggagguc

SEQ ID NO: 1529762 - RNA, 16 nt, Human
uccucuguacagagcc

SEQ ID NO: 1529763 - RNA, 17 nt, Human
uccucuguacagagccc

SEQ ID NO: 1529764 - RNA, 18 nt, Human
uccucuguacagagccca

SEQ ID NO: 1529765 - RNA, 19 nt, Human
uccucuguacagagcccac

SEQ ID NO: 1529766 - RNA, 17 nt, Human
uccucugcugcuggcug

SEQ ID NO: 1529767 - RNA, 17 nt, Human
uccucuaggaggucucu

SEQ ID NO: 1529768 - RNA, 14 nt, Human
uccucugcugcugg

SEQ ID NO: 1529769 - RNA, 15 nt, Human
uccucugcugcuggc

SEQ ID NO: 1529770 - RNA, 16 nt, Human
uccucugcugcuggcu

SEQ ID NO: 1529771 - RNA, 20 nt, Human
uauucuaaauuuuauaucuu

SEQ ID NO: 1529772 - RNA, 15 nt, Human
uauucuaaauuuuau

SEQ ID NO: 1529773 - RNA, 19 nt, Human
uauucuaaauuuuauaucu

SEQ ID NO: 1529774 - RNA, 19 nt, Human
uauucuagcuaauguaaua

SEQ ID NO: 1529775 - RNA, 14 nt, Human
uauucuaaauuuua

SEQ ID NO: 1529776 - RNA, 16 nt, Human
uauuauucccauucua

SEQ ID NO: 1529777 - RNA, 22 nt, Human
uauuccagacuugggaggaugu

SEQ ID NO: 1529778 - RNA, 22 nt, Human
uauuguuuucaguguacaugga

SEQ ID NO: 1529779 - RNA, 18 nt, Human
uauuguuuucaguguaca

SEQ ID NO: 1529780 - RNA, 20 nt, Human
uauuguuuucaguguacaug

SEQ ID NO: 1529781 - RNA, 12 nt, Human
uauuguuuucag

SEQ ID NO: 1529782 - RNA, 17 nt, Human
uauucucuccuguaccu

SEQ ID NO: 1529783 - RNA, 18 nt, Human
uauucucuccuguaccuc

SEQ ID NO: 1529784 - RNA, 17 nt, Human
uauugcugauggugcaa

SEQ ID NO: 1529785 - RNA, 22 nt, Human
uauugcugauggugcaaugacc

SEQ ID NO: 1529786 - RNA, 22 nt, Human
uauuggaaauuuguuauaauga

SEQ ID NO: 1529787 - RNA, 13 nt, Human
uauguacuucaug

SEQ ID NO: 1529788 - RNA, 17 nt, Human
uauguacuucaugcugu

SEQ ID NO: 1529789 - RNA, 13 nt, Human
gggaguggccaca

SEQ ID NO: 1529790 - RNA, 15 nt, Human
gggaguggccacaga

SEQ ID NO: 1529791 - RNA, 13 nt, Human
uauguugcccagg

SEQ ID NO: 1529792 - RNA, 16 nt, Human
uauguugcccaggcag

SEQ ID NO: 1529793 - RNA, 19 nt, Human
uauguugcccaggcagguc

SEQ ID NO: 1529794 - RNA, 20 nt, Human
uauguugcccaggcaggucu

SEQ ID NO: 1529795 - RNA, 13 nt, Human
uauguuucaaacu

SEQ ID NO: 1529796 - RNA, 15 nt, Human
uauguuucaaacuuu

SEQ ID NO: 1529797 - RNA, 16 nt, Human
uauguuucaaacuuug

SEQ ID NO: 1529798 - RNA, 12 nt, Human
uauuaauauauu

SEQ ID NO: 1529799 - RNA, 12 nt, Human
uauuaaauuaug

SEQ ID NO: 1529800 - RNA, 19 nt, Human
uauuaaauuaaauuuugug

SEQ ID NO: 1529801 - RNA, 21 nt, Human
uauuaaauuaaauuuuguguc

SEQ ID NO: 1529802 - RNA, 16 nt, Human
ucaaauaugcaaagca

SEQ ID NO: 1529803 - RNA, 14 nt, Human
ucaaauaugcaaag

SEQ ID NO: 1529804 - RNA, 20 nt, Human
ucaaaucaagaaacuuaagg

SEQ ID NO: 1529805 - RNA, 15 nt, Human
ucaaauccuugaaga

SEQ ID NO: 1529806 - RNA, 14 nt, Human
ucaaauugugugaa

SEQ ID NO: 1529807 - RNA, 15 nt, Human
ucaaauugugugaaa

SEQ ID NO: 1529808 - RNA, 23 nt, Human
ucaaccccuucgcuccugugucu

SEQ ID NO: 1529809 - RNA, 22 nt, Human
uauuuucccuauuagagaagag

SEQ ID NO: 1529810 - RNA, 17 nt, Human
uauuuuuuucuuuucuu

SEQ ID NO: 1529811 - RNA, 14 nt, Human
uauuuuuuuacuaa

SEQ ID NO: 1529812 - RNA, 14 nt, Human
ucaaaaaaagaaaa

SEQ ID NO: 1529813 - RNA, 15 nt, Human
ucaaaaaaagaaaaa

SEQ ID NO: 1529814 - RNA, 16 nt, Human
uauuuuccaugaaaau

SEQ ID NO: 1529815 - RNA, 20 nt, Human
uauuuuccaugaaaaugcaa

SEQ ID NO: 1529816 - RNA, 17 nt, Human
uauuuuauuaugcauga

SEQ ID NO: 1529817 - RNA, 14 nt, Human
uauuuuauuaugca

SEQ ID NO: 1529818 - RNA, 17 nt, Human
ucaaugccccugaauuu

SEQ ID NO: 1529819 - RNA, 18 nt, Human
ucaaugccccugaauuua

SEQ ID NO: 1529820 - RNA, 20 nt, Human
ucaaugccccugaauuuaaa

SEQ ID NO: 1529821 - RNA, 22 nt, Human
ucaaugccccugaauuuaaaua

SEQ ID NO: 1529822 - RNA, 18 nt, Human
ucaaugguuugcaaggaa

SEQ ID NO: 1529823 - RNA, 19 nt, Human
ucaaugguuugcaaggaag

SEQ ID NO: 1529824 - RNA, 21 nt, Human
ucaauuacaggaaguacugga

SEQ ID NO: 1529825 - RNA, 23 nt, Human
ucaauuacaggaaguacuggaga

SEQ ID NO: 1529826 - RNA, 21 nt, Human
ucaauaaaauccauacauuug

SEQ ID NO: 1529827 - RNA, 20 nt, Human
ucaagugauucuccugccuc

SEQ ID NO: 1529828 - RNA, 21 nt, Human
ucaagugauucuccugccuca

SEQ ID NO: 1529829 - RNA, 16 nt, Human
ucaccacaugugcaca

SEQ ID NO: 1529830 - RNA, 14 nt, Human
ucaccaaggcugau

SEQ ID NO: 1529831 - RNA, 21 nt, Human
ucaccaaaucagcugcuacua

SEQ ID NO: 1529832 - RNA, 19 nt, Human
ucaccaaaucagcugcuac

SEQ ID NO: 1529833 - RNA, 20 nt, Human
ucaccaaaucagcugcuacu

SEQ ID NO: 1529834 - RNA, 18 nt, Human
ucacauuuauucugcuca

SEQ ID NO: 1529835 - RNA, 19 nt, Human
ucacauuuauucugcucac

SEQ ID NO: 1529836 - RNA, 17 nt, Human
ucacauuuauucugcuc

SEQ ID NO: 1529837 - RNA, 13 nt, Human
ucacaagacccaa

SEQ ID NO: 1529838 - RNA, 17 nt, Human
ucacaagacccaaaagg

SEQ ID NO: 1529839 - RNA, 18 nt, Human
ucacaagacccaaaaggc

SEQ ID NO: 1529840 - RNA, 16 nt, Human
ucacagucacauucca

SEQ ID NO: 1529841 - RNA, 19 nt, Human
ucacaguccuuaccagcag

SEQ ID NO: 1529842 - RNA, 22 nt, Human
ucacaguccuuaccagcagagc

SEQ ID NO: 1529843 - RNA, 23 nt, Human
ucacaguccuuaccagcagagca

SEQ ID NO: 1529844 - RNA, 17 nt, Human
ucacaggcagguccagg

SEQ ID NO: 1529845 - RNA, 18 nt, Human
ucacaggcagguccaggg

SEQ ID NO: 1529846 - RNA, 19 nt, Human
ucacaggcagguccagggu

SEQ ID NO: 1529847 - RNA, 21 nt, Human
ucauucaacccaccugcgucu

SEQ ID NO: 1529848 - RNA, 19 nt, Human
ucauuaucucaaaacugca

SEQ ID NO: 1529849 - RNA, 20 nt, Human
ucauuaucucaaaacugcac

SEQ ID NO: 1529850 - RNA, 13 nt, Human
ucauuaucucaaa

SEQ ID NO: 1529851 - RNA, 23 nt, Human
ucauuucaccccucccuuucucc

SEQ ID NO: 1529852 - RNA, 14 nt, Human
ucauuucaccccuc

SEQ ID NO: 1529853 - RNA, 15 nt, Human
ucauuucaccccucc

SEQ ID NO: 1529854 - RNA, 16 nt, Human
ucauuucaccccuccc

SEQ ID NO: 1529855 - RNA, 21 nt, Human
ucauuucaccccucccuuucu

SEQ ID NO: 1529856 - RNA, 13 nt, Human
ucauuuccaagca

SEQ ID NO: 1529857 - RNA, 16 nt, Human
ucauuuccaagcaagu

SEQ ID NO: 1529858 - RNA, 13 nt, Human
ucauuuccugugu

SEQ ID NO: 1529859 - RNA, 16 nt, Human
ucauuuccugugucuu

SEQ ID NO: 1529860 - RNA, 15 nt, Human
ucauacucaccucac

SEQ ID NO: 1529861 - RNA, 19 nt, Human
ucaucaccaacgucugugc

SEQ ID NO: 1529862 - RNA, 20 nt, Human
ucaucaccaacgucugugcc

SEQ ID NO: 1529863 - RNA, 21 nt, Human
ucaucaccaacgucugugcca

SEQ ID NO: 1529864 - RNA, 15 nt, Human
ucaggugcugccauc

SEQ ID NO: 1529865 - RNA, 18 nt, Human
ucauaccuaucaucuuaa

SEQ ID NO: 1529866 - RNA, 21 nt, Human
ucaggugagaagcagaggaag

SEQ ID NO: 1529867 - RNA, 23 nt, Human
ucaggugagaagcagaggaagga

SEQ ID NO: 1529868 - RNA, 13 nt, Human
ucaggugcugcca

SEQ ID NO: 1529869 - RNA, 14 nt, Human
ucaggugcugccau

SEQ ID NO: 1529870 - RNA, 21 nt, Human
ucaucugcucuccuuccugga

SEQ ID NO: 1529871 - RNA, 17 nt, Human
ucaucugcucuccuucc

SEQ ID NO: 1529872 - RNA, 18 nt, Human
ucaucugcucuccuuccu

SEQ ID NO: 1529873 - RNA, 23 nt, Human
ucaucuuagguuggcaaaaaggc

SEQ ID NO: 1529874 - RNA, 12 nt, Human
ucaucugcucuc

SEQ ID NO: 1529875 - RNA, 14 nt, Human
ucaucugcucuccu

SEQ ID NO: 1529876 - RNA, 15 nt, Human
ucaucugcucuccuu

SEQ ID NO: 1529877 - RNA, 16 nt, Human
ucaucugcucuccuuc

SEQ ID NO: 1529878 - RNA, 19 nt, Human
ucaucuugaauuguaagga

SEQ ID NO: 1529879 - RNA, 17 nt, Human
ucaucugacuaugacau

SEQ ID NO: 1529880 - RNA, 18 nt, Human
ucaucugacuaugacaua

SEQ ID NO: 1529881 - RNA, 15 nt, Human
uccaggugcacaagc

SEQ ID NO: 1529882 - RNA, 23 nt, Human
uccaggggugggacacccuguga

SEQ ID NO: 1529883 - RNA, 22 nt, Human
uccaggagcagccacauuccug

SEQ ID NO: 1529884 - RNA, 17 nt, Human
uccaggagcagccacau

SEQ ID NO: 1529885 - RNA, 18 nt, Human
uccaggagcagccacauu

SEQ ID NO: 1529886 - RNA, 15 nt, Human
uccagguucagcuug

SEQ ID NO: 1529887 - RNA, 16 nt, Human
uccagguucagcuugu

SEQ ID NO: 1529888 - RNA, 18 nt, Human
uccaggugcacaagcucc

SEQ ID NO: 1529889 - RNA, 20 nt, Human
uccaggugcacaagcuccaa

SEQ ID NO: 1529890 - RNA, 21 nt, Human
uccaggugcacaagcuccaag

SEQ ID NO: 1529891 - RNA, 22 nt, Human
uccaggugcacaagcuccaagc

SEQ ID NO: 1529892 - RNA, 17 nt, Human
uccacuuggucugugag

SEQ ID NO: 1529893 - RNA, 15 nt, Human
uccacuuggucugug

SEQ ID NO: 1529894 - RNA, 16 nt, Human
uccacuuggucuguga

SEQ ID NO: 1529895 - RNA, 18 nt, Human
uccagcucaccagcccca

SEQ ID NO: 1529896 - RNA, 16 nt, Human
uccagcucaccagccc

SEQ ID NO: 1529897 - RNA, 17 nt, Human
uccagcucaccagcccc

SEQ ID NO: 1529898 - RNA, 17 nt, Human
uccagcuguucagcugg

SEQ ID NO: 1529899 - RNA, 16 nt, Human
uccaggagcagccaca

SEQ ID NO: 1529900 - RNA, 19 nt, Human
uccacagaagcuccaggua

SEQ ID NO: 1529901 - RNA, 12 nt, Human
uccacccugcuc

SEQ ID NO: 1529902 - RNA, 13 nt, Human
uccacccugcucu

SEQ ID NO: 1529903 - RNA, 18 nt, Human
uccaccugccagggacag

SEQ ID NO: 1529904 - RNA, 21 nt, Human
uccaccugccagggacagagg

SEQ ID NO: 1529905 - RNA, 17 nt, Human
uccaccugccagggaca

SEQ ID NO: 1529906 - RNA, 15 nt, Human
uccaccugccaggga

SEQ ID NO: 1529907 - RNA, 19 nt, Human
uccaaaauaauuuuaagaa

SEQ ID NO: 1529908 - RNA, 15 nt, Human
uccaaaauaauuuua

SEQ ID NO: 1529909 - RNA, 18 nt, Human
uccaaaauaaaacuuuuu

SEQ ID NO: 1529910 - RNA, 20 nt, Human
uccaaaauaaaacuuuuuaa

SEQ ID NO: 1529911 - RNA, 17 nt, Human
uccaauuuacauacucu

SEQ ID NO: 1529912 - RNA, 18 nt, Human
uccaauuuacauacucug

SEQ ID NO: 1529913 - RNA, 17 nt, Human
uccacaaguuaaauaaa

SEQ ID NO: 1529914 - RNA, 18 nt, Human
uccacaaguuaaauaaau

SEQ ID NO: 1529915 - RNA, 16 nt, Human
uccacaagagcccagg

SEQ ID NO: 1529916 - RNA, 17 nt, Human
uccacaagagcccaggc

SEQ ID NO: 1529917 - RNA, 18 nt, Human
uccacaagagcccaggcc

SEQ ID NO: 1529918 - RNA, 19 nt, Human
uccacaagagcccaggccu

SEQ ID NO: 1529919 - RNA, 13 nt, Human
ucagacagcugcc

SEQ ID NO: 1529920 - RNA, 14 nt, Human
ucagacagcugccu

SEQ ID NO: 1529921 - RNA, 20 nt, Human
ucacuuguuuuauuuaaccu

SEQ ID NO: 1529922 - RNA, 10 nt, Human
ucagaaaugu

SEQ ID NO: 1529923 - RNA, 23 nt, Human
ucagaauucucuaguuugauuaa

SEQ ID NO: 1529924 - RNA, 15 nt, Human
ucagaaauguguuau

SEQ ID NO: 1529925 - RNA, 20 nt, Human
ucacucuuauugcccacgcu

SEQ ID NO: 1529926 - RNA, 18 nt, Human
ucacugccaugccagcuu

SEQ ID NO: 1529927 - RNA, 19 nt, Human
ucaccccugguucucaucu

SEQ ID NO: 1529928 - RNA, 17 nt, Human
ucacucuuauugcccac

SEQ ID NO: 1529929 - RNA, 14 nt, Human
ucaccccucccuuu

SEQ ID NO: 1529930 - RNA, 17 nt, Human
ucaccccucccuuucuc

SEQ ID NO: 1529931 - RNA, 18 nt, Human
ucaccccucccuuucucc

SEQ ID NO: 1529932 - RNA, 20 nt, Human
ucaccccucccuuucucccc

SEQ ID NO: 1529933 - RNA, 15 nt, Human
ucaccccugguucuc

SEQ ID NO: 1529934 - RNA, 18 nt, Human
ucaccccugguucucauc

SEQ ID NO: 1529935 - RNA, 13 nt, Human
ucaccagccccag

SEQ ID NO: 1529936 - RNA, 16 nt, Human
ucaccagccccagugc

SEQ ID NO: 1529937 - RNA, 14 nt, Human
ucacugcuuaacuu

SEQ ID NO: 1529938 - RNA, 15 nt, Human
ucagauaugauucaa

SEQ ID NO: 1529939 - RNA, 20 nt, Human
ucagccucccgaguagcugg

SEQ ID NO: 1529940 - RNA, 18 nt, Human
ucagccucccgaguagcu

SEQ ID NO: 1529941 - RNA, 21 nt, Human
ucagccucccgaauagcuggg

SEQ ID NO: 1529942 - RNA, 22 nt, Human
ucagccucccgaauagcuggga

SEQ ID NO: 1529943 - RNA, 14 nt, Human
ucagccucccaaag

SEQ ID NO: 1529944 - RNA, 19 nt, Human
ucagccucccaaagugcug

SEQ ID NO: 1529945 - RNA, 21 nt, Human
ucagccucccaaagugcuggg

SEQ ID NO: 1529946 - RNA, 21 nt, Human
ucagccucccgaguagcuggg

SEQ ID NO: 1529947 - RNA, 22 nt, Human
ucagccucccgaguagcuggga

SEQ ID NO: 1529948 - RNA, 18 nt, Human
ucagccugcuccagcugu

SEQ ID NO: 1529949 - RNA, 19 nt, Human
ucagccugcuccagcuguu

SEQ ID NO: 1529950 - RNA, 17 nt, Human
ucagcuccccucggaga

SEQ ID NO: 1529951 - RNA, 15 nt, Human
ucagcugaaccuggg

SEQ ID NO: 1529952 - RNA, 16 nt, Human
ucagcugaaccugggu

SEQ ID NO: 1529953 - RNA, 18 nt, Human
ucagcuccccucggagaa

SEQ ID NO: 1529954 - RNA, 21 nt, Human
ucagcuccccucggagaagag

SEQ ID NO: 1529955 - RNA, 23 nt, Human
ucaggagccgaagcccaggggcc

SEQ ID NO: 1529956 - RNA, 13 nt, Human
ucaggcuagaugu

SEQ ID NO: 1529957 - RNA, 17 nt, Human
ucaggcuagauguaugu

SEQ ID NO: 1529958 - RNA, 14 nt, Human
ucagggccuggcuc

SEQ ID NO: 1529959 - RNA, 16 nt, Human
ucagggccuggcucag

SEQ ID NO: 1529960 - RNA, 15 nt, Human
ucaggugagaagcag

SEQ ID NO: 1529961 - RNA, 16 nt, Human
ucaggugagaagcaga

SEQ ID NO: 1529962 - RNA, 17 nt, Human
gggaggacgcucucugg

SEQ ID NO: 1529963 - RNA, 20 nt, Human
gggaggacgcucucuggccu

SEQ ID NO: 1529964 - RNA, 23 nt, Human
gggaggaucucuugagccuggga

SEQ ID NO: 1529965 - RNA, 22 nt, Human
gggaggauguucugggacacag

SEQ ID NO: 1529966 - RNA, 21 nt, Human
gggaggauugcuugagcucag

SEQ ID NO: 1529967 - RNA, 21 nt, Human
gggagugaguugauagcacag

SEQ ID NO: 1529968 - RNA, 17 nt, Human
gggagugacagaggcag

SEQ ID NO: 1529969 - RNA, 11 nt, Human
gggaggcagag

SEQ ID NO: 1529970 - RNA, 20 nt, Human
gggaggugggauccuccagg

SEQ ID NO: 1529971 - RNA, 23 nt, Human
gggaggauugcuugagcucagga

SEQ ID NO: 1529972 - RNA, 13 nt, Human
gggagcugccugu

SEQ ID NO: 1529973 - RNA, 21 nt, Human
gggagcugccuguucagcucc

SEQ ID NO: 1529974 - RNA, 22 nt, Human
gggagcugccuguucagcucca

SEQ ID NO: 1529975 - RNA, 14 nt, Human
gggaauugaggaca

SEQ ID NO: 1529976 - RNA, 19 nt, Human
gggaauguuugccucugcc

SEQ ID NO: 1529977 - RNA, 21 nt, Human
gggaauguuugccucugccuc

SEQ ID NO: 1529978 - RNA, 14 nt, Human
gggacacccuguga

SEQ ID NO: 1529979 - RNA, 23 nt, Human
gggacucaaugcacugacauugu

SEQ ID NO: 1529980 - RNA, 21 nt, Human
gggacugaggggaggggagca

SEQ ID NO: 1529981 - RNA, 17 nt, Human
gggacucaaugcacuga

SEQ ID NO: 1529982 - RNA, 19 nt, Human
gggacucaaugcacugaca

SEQ ID NO: 1529983 - RNA, 21 nt, Human
ggcuucacggaagagccuugc

SEQ ID NO: 1529984 - RNA, 22 nt, Human
ggcuuagggacaggaccccagc

SEQ ID NO: 1529985 - RNA, 14 nt, Human
ggcuuagucacuga

SEQ ID NO: 1529986 - RNA, 15 nt, Human
ggcuuagucacugag

SEQ ID NO: 1529987 - RNA, 20 nt, Human
ggcuucacggaagagccuug

SEQ ID NO: 1529988 - RNA, 17 nt, Human
ggcuuggggaccagagc

SEQ ID NO: 1529989 - RNA, 18 nt, Human
ggcuuggggaccagagcu

SEQ ID NO: 1529990 - RNA, 19 nt, Human
ggcuuggggaccagagcug

SEQ ID NO: 1529991 - RNA, 14 nt, Human
ggcuguuggcuggg

SEQ ID NO: 1529992 - RNA, 15 nt, Human
ggcuguuggcugggg

SEQ ID NO: 1529993 - RNA, 16 nt, Human
ggcuguuggcuggggg

SEQ ID NO: 1529994 - RNA, 20 nt, Human
ggcuguuggcugggggccuc

SEQ ID NO: 1529995 - RNA, 15 nt, Human
ggcuuaaaacaacac

SEQ ID NO: 1529996 - RNA, 20 nt, Human
ggcugggcucccuucccacc

SEQ ID NO: 1529997 - RNA, 21 nt, Human
ggcugggcucccuucccaccu

SEQ ID NO: 1529998 - RNA, 11 nt, Human
ggcugggcuuc

SEQ ID NO: 1529999 - RNA, 21 nt, Human
ggcugggcuucaguggcagcu

SEQ ID NO: 1530000 - RNA, 22 nt, Human
ggcugggcuucaguggcagcug

SEQ ID NO: 1530001 - RNA, 16 nt, Human
ggcugggggaagaagc

SEQ ID NO: 1530002 - RNA, 14 nt, Human
ggcugggggccuca

SEQ ID NO: 1530003 - RNA, 18 nt, Human
ggcuggagcuagaauuug

SEQ ID NO: 1530004 - RNA, 21 nt, Human
ggcugcuucaaggauccugag

SEQ ID NO: 1530005 - RNA, 20 nt, Human
ggcugcuucaaggauccuga

SEQ ID NO: 1530006 - RNA, 17 nt, Human
ggcuggacugaggccug

SEQ ID NO: 1530007 - RNA, 18 nt, Human
ggcuggacugaggccuga

SEQ ID NO: 1530008 - RNA, 13 nt, Human
ggcuggacugagg

SEQ ID NO: 1530009 - RNA, 14 nt, Human
ggcuggacugaggc

SEQ ID NO: 1530010 - RNA, 16 nt, Human
ggcuggacugaggccu

SEQ ID NO: 1530011 - RNA, 17 nt, Human
ggcucugccucccauca

SEQ ID NO: 1530012 - RNA, 15 nt, Human
ggcugcuucaaggau

SEQ ID NO: 1530013 - RNA, 19 nt, Human
ggcugcuucaaggauccug

SEQ ID NO: 1530014 - RNA, 14 nt, Human
ggcccagagggccu

SEQ ID NO: 1530015 - RNA, 17 nt, Human
ggcccagagggccugca

SEQ ID NO: 1530016 - RNA, 19 nt, Human
ggcccagagggccugcaag

SEQ ID NO: 1530017 - RNA, 20 nt, Human
ggcccagagggccugcaagg

SEQ ID NO: 1530018 - RNA, 23 nt, Human
ggccuagcauacguacacauuuu

SEQ ID NO: 1530019 - RNA, 22 nt, Human
ggccuagcauacguacacauuu

SEQ ID NO: 1530020 - RNA, 20 nt, Human
ggccuagcauacguacacau

SEQ ID NO: 1530021 - RNA, 14 nt, Human
ggccucaagugauu

SEQ ID NO: 1530022 - RNA, 22 nt, Human
ggccucaagugauucuccugcc

SEQ ID NO: 1530023 - RNA, 23 nt, Human
ggccucaagugauucuccugccu

SEQ ID NO: 1530024 - RNA, 14 nt, Human
ggccuccugugugu

SEQ ID NO: 1530025 - RNA, 20 nt, Human
ggccugagauuucaucugcu

SEQ ID NO: 1530026 - RNA, 22 nt, Human
ggccugagauuucaucugcucu

SEQ ID NO: 1530027 - RNA, 12 nt, Human
ggccugagcugg

SEQ ID NO: 1530028 - RNA, 13 nt, Human
ggccuggccccuc

SEQ ID NO: 1530029 - RNA, 22 nt, Human
ggccucugcacuccccugcugg

SEQ ID NO: 1530030 - RNA, 18 nt, Human
ggccucugcacuccccug

SEQ ID NO: 1530031 - RNA, 19 nt, Human
ggccucugcacuccccugc

SEQ ID NO: 1530032 - RNA, 14 nt, Human
ggccuggccccuca

SEQ ID NO: 1530033 - RNA, 15 nt, Human
ggccuggccccucag

SEQ ID NO: 1530034 - RNA, 17 nt, Human
ggccuggccccucaggg

SEQ ID NO: 1530035 - RNA, 18 nt, Human
ggccuggccccucagggu

SEQ ID NO: 1530036 - RNA, 23 nt, Human
ggccuggccccucagggucccug

SEQ ID NO: 1530037 - RNA, 10 nt, Human
ggccuggccu

SEQ ID NO: 1530038 - RNA, 13 nt, Human
ggccuggccugag

SEQ ID NO: 1530039 - RNA, 14 nt, Human
ggccuggccugagc

SEQ ID NO: 1530040 - RNA, 18 nt, Human
ggccugagcgcuccugcc

SEQ ID NO: 1530041 - RNA, 19 nt, Human
ggccuggccugagcuggga

SEQ ID NO: 1530042 - RNA, 15 nt, Human
ggccuggccugagcu

SEQ ID NO: 1530043 - RNA, 16 nt, Human
ggccuggccugagcug

SEQ ID NO: 1530044 - RNA, 23 nt, Human
ggccugggggcugggcagaggaa

SEQ ID NO: 1530045 - RNA, 23 nt, Human
ggcgcagcauauucaggaagcuc

SEQ ID NO: 1530046 - RNA, 24 nt, Human
ggcgcagcauauucaggaagcuca

SEQ ID NO: 1530047 - RNA, 16 nt, Human
ggcucugccucccauc

SEQ ID NO: 1530048 - RNA, 14 nt, Human
ggcucugcccuugg

SEQ ID NO: 1530049 - RNA, 15 nt, Human
ggcucugcccuuggu

SEQ ID NO: 1530050 - RNA, 13 nt, Human
ggcucugccuccc

SEQ ID NO: 1530051 - RNA, 15 nt, Human
ggcucugccucccau

SEQ ID NO: 1530052 - RNA, 12 nt, Human
ggcucugcccuu

SEQ ID NO: 1530053 - RNA, 17 nt, Human
ggcucccaugucaagag

SEQ ID NO: 1530054 - RNA, 15 nt, Human
ggcuccaggcuccuu

SEQ ID NO: 1530055 - RNA, 14 nt, Human
ggcuccaggcuccu

SEQ ID NO: 1530056 - RNA, 15 nt, Human
ggcucucaggccagc

SEQ ID NO: 1530057 - RNA, 16 nt, Human
ggcucucaggccagcu

SEQ ID NO: 1530058 - RNA, 17 nt, Human
ggcucucaggccagcug

SEQ ID NO: 1530059 - RNA, 18 nt, Human
ggcucucaggccagcugc

SEQ ID NO: 1530060 - RNA, 19 nt, Human
ggcucucaggccagcugcu

SEQ ID NO: 1530061 - RNA, 20 nt, Human
ggcucucaggccagcugcuu

SEQ ID NO: 1530062 - RNA, 9 nt, Human
ggcuccaga

SEQ ID NO: 1530063 - RNA, 14 nt, Human
ggcuaugcauuuga

SEQ ID NO: 1530064 - RNA, 15 nt, Human
ggcucacacugagaa

SEQ ID NO: 1530065 - RNA, 17 nt, Human
ggcucacacugagaaug

SEQ ID NO: 1530066 - RNA, 18 nt, Human
ggcucacacugagaaugu

SEQ ID NO: 1530067 - RNA, 13 nt, Human
ggcuaugcauuug

SEQ ID NO: 1530068 - RNA, 12 nt, Human
ggcuaugcauuu

SEQ ID NO: 1530069 - RNA, 10 nt, Human
ggcuccagac

SEQ ID NO: 1530070 - RNA, 14 nt, Human
ggcuccaggagcag

SEQ ID NO: 1530071 - RNA, 16 nt, Human
ggcuccaggagcagcc

SEQ ID NO: 1530072 - RNA, 18 nt, Human
ggcuccaggagcagccac

SEQ ID NO: 1530073 - RNA, 17 nt, Human
ggcuccaggagcagcca

SEQ ID NO: 1530074 - RNA, 12 nt, Human
ggcuccaggcuc

SEQ ID NO: 1530075 - RNA, 13 nt, Human
ggcuccaggcucc

SEQ ID NO: 1530076 - RNA, 14 nt, Human
ggcggucccagcuc

SEQ ID NO: 1530077 - RNA, 15 nt, Human
ggcggucccagcucc

SEQ ID NO: 1530078 - RNA, 20 nt, Human
ggcuaguaucaaaagaaaga

SEQ ID NO: 1530079 - RNA, 23 nt, Human
ggcuauaggugcuacaaaaacac

SEQ ID NO: 1530080 - RNA, 18 nt, Human
ggcgcugccccuggcagc

SEQ ID NO: 1530081 - RNA, 17 nt, Human
ggcgcugccccuggcag

SEQ ID NO: 1530082 - RNA, 11 nt, Human
ggcgcugcccc

SEQ ID NO: 1530083 - RNA, 14 nt, Human
ggagcuagaauuug

SEQ ID NO: 1530084 - RNA, 15 nt, Human
ggagccuccugcccu

SEQ ID NO: 1530085 - RNA, 14 nt, Human
ggagccuccugccc

SEQ ID NO: 1530086 - RNA, 21 nt, Human
ggagaccccuuggggagcagg

SEQ ID NO: 1530087 - RNA, 17 nt, Human
ggagggagggcuccaga

SEQ ID NO: 1530088 - RNA, 13 nt, Human
ggagggagggcuc

SEQ ID NO: 1530089 - RNA, 16 nt, Human
ggagggagggcuccag

SEQ ID NO: 1530090 - RNA, 19 nt, Human
ggaggacgcucucuggccu

SEQ ID NO: 1530091 - RNA, 16 nt, Human
ggaggacgcucucugg

SEQ ID NO: 1530092 - RNA, 18 nt, Human
ggaggauguucugggaca

SEQ ID NO: 1530093 - RNA, 21 nt, Human
ggaggauguucugggacacag

SEQ ID NO: 1530094 - RNA, 22 nt, Human
ggagucccaccuuggcugcagg

SEQ ID NO: 1530095 - RNA, 13 nt, Human
ggacugaggccug

SEQ ID NO: 1530096 - RNA, 14 nt, Human
ggacugaggccuga

SEQ ID NO: 1530097 - RNA, 11 nt, Human
ggagaagaacu

SEQ ID NO: 1530098 - RNA, 14 nt, Human
ggagaagaacugaa

SEQ ID NO: 1530099 - RNA, 15 nt, Human
ggagaagagcuguuc

SEQ ID NO: 1530100 - RNA, 19 nt, Human
ggagaagccacaggccuga

SEQ ID NO: 1530101 - RNA, 20 nt, Human
ggagaagccacaggccugag

SEQ ID NO: 1530102 - RNA, 23 nt, Human
ggagaagagcuguucacagccag

SEQ ID NO: 1530103 - RNA, 18 nt, Human
ggagaagccacaggccug

SEQ ID NO: 1530104 - RNA, 17 nt, Human
ggacugaauuaugaaac

SEQ ID NO: 1530105 - RNA, 19 nt, Human
ggacugaauuaugaaacuu

SEQ ID NO: 1530106 - RNA, 16 nt, Human
ggacgcucucuggccu

SEQ ID NO: 1530107 - RNA, 19 nt, Human
ggacgcucucuggccuucg

SEQ ID NO: 1530108 - RNA, 18 nt, Human
ggaccuugaacuggguac

SEQ ID NO: 1530109 - RNA, 17 nt, Human
ggacauuugcucaugga

SEQ ID NO: 1530110 - RNA, 20 nt, Human
ggacauuugcucauggaauu

SEQ ID NO: 1530111 - RNA, 19 nt, Human
ggaccagagcugccaccug

SEQ ID NO: 1530112 - RNA, 20 nt, Human
ggacagaggggguggccucc

SEQ ID NO: 1530113 - RNA, 11 nt, Human
ggacagcuccu

SEQ ID NO: 1530114 - RNA, 15 nt, Human
ggacagcuccuucug

SEQ ID NO: 1530115 - RNA, 16 nt, Human
ggacagcuccuucugu

SEQ ID NO: 1530116 - RNA, 17 nt, Human
ggacagcuccuucuguc

SEQ ID NO: 1530117 - RNA, 16 nt, Human
ggacagaggggguggc

SEQ ID NO: 1530118 - RNA, 14 nt, Human
ggacagaagaaggc

SEQ ID NO: 1530119 - RNA, 18 nt, Human
ggaugccugguggcagcu

SEQ ID NO: 1530120 - RNA, 19 nt, Human
ggaugccugguggcagcug

SEQ ID NO: 1530121 - RNA, 20 nt, Human
ggaugccugguggcagcugc

SEQ ID NO: 1530122 - RNA, 21 nt, Human
ggaugccugguggcagcugcg

SEQ ID NO: 1530123 - RNA, 18 nt, Human
ggaugcccaaagaugcag

SEQ ID NO: 1530124 - RNA, 19 nt, Human
ggaugcccaaagaugcagc

SEQ ID NO: 1530125 - RNA, 13 nt, Human
ggaugccuggugg

SEQ ID NO: 1530126 - RNA, 17 nt, Human
ggaugccugguggcagc

SEQ ID NO: 1530127 - RNA, 16 nt, Human
ggaugaucuaggaaga

SEQ ID NO: 1530128 - RNA, 18 nt, Human
ggaugaucuaggaagacu

SEQ ID NO: 1530129 - RNA, 22 nt, Human
ggaugaucuaggaagacuuugg

SEQ ID NO: 1530130 - RNA, 23 nt, Human
ggagucccaccuuggcugcaggg

SEQ ID NO: 1530131 - RNA, 21 nt, Human
ggcagagguugcagugagccg

SEQ ID NO: 1530132 - RNA, 20 nt, Human
ggcacccaccaucaugucug

SEQ ID NO: 1530133 - RNA, 18 nt, Human
ggcacccggccccugcug

SEQ ID NO: 1530134 - RNA, 19 nt, Human
ggcacccggccccugcugg

SEQ ID NO: 1530135 - RNA, 20 nt, Human
ggcacccggccccugcuggu

SEQ ID NO: 1530136 - RNA, 18 nt, Human
ggcacucagaagacacug

SEQ ID NO: 1530137 - RNA, 19 nt, Human
ggcacucagaagacacuga

SEQ ID NO: 1530138 - RNA, 20 nt, Human
ggcacucagaagacacugau

SEQ ID NO: 1530139 - RNA, 17 nt, Human
ggcaagcaccuccugcc

SEQ ID NO: 1530140 - RNA, 21 nt, Human
ggauucuuccucccucccucu

SEQ ID NO: 1530141 - RNA, 15 nt, Human
ggcaaggcugucaau

SEQ ID NO: 1530142 - RNA, 17 nt, Human
ggcaccagcagccugga

SEQ ID NO: 1530143 - RNA, 18 nt, Human
ggcaagcaccuccugccu

SEQ ID NO: 1530144 - RNA, 19 nt, Human
ggcaagcaccuccugccuc

SEQ ID NO: 1530145 - RNA, 22 nt, Human
ggccacagaaaauucuucucca

SEQ ID NO: 1530146 - RNA, 20 nt, Human
ggcauguucucugaggacac

SEQ ID NO: 1530147 - RNA, 15 nt, Human
ggccacuucugggug

SEQ ID NO: 1530148 - RNA, 20 nt, Human
ggccacugugaagagaacca

SEQ ID NO: 1530149 - RNA, 21 nt, Human
ggccacuucuggguggggcag

SEQ ID NO: 1530150 - RNA, 11 nt, Human
ggccaggagcc

SEQ ID NO: 1530151 - RNA, 13 nt, Human
ggccaggagccuc

SEQ ID NO: 1530152 - RNA, 14 nt, Human
ggccaggcccucug

SEQ ID NO: 1530153 - RNA, 17 nt, Human
ggccaggcccucugccc

SEQ ID NO: 1530154 - RNA, 15 nt, Human
ggccaggcccucugc

SEQ ID NO: 1530155 - RNA, 16 nt, Human
ggccaggcccucugcc

SEQ ID NO: 1530156 - RNA, 17 nt, Human
ggcagggucucacucug

SEQ ID NO: 1530157 - RNA, 18 nt, Human
ggcagggucucacucugu

SEQ ID NO: 1530158 - RNA, 23 nt, Human
ggcagcugcgguccacccaggag

SEQ ID NO: 1530159 - RNA, 24 nt, Human
ggcagcugcgguccacccaggagc

SEQ ID NO: 1530160 - RNA, 22 nt, Human
ggcagcugcuuuugucuauggg

SEQ ID NO: 1530161 - RNA, 12 nt, Human
ggcaggguccua

SEQ ID NO: 1530162 - RNA, 21 nt, Human
ggcagaguucuauaauguaaa

SEQ ID NO: 1530163 - RNA, 17 nt, Human
ggcagaguugaagacag

SEQ ID NO: 1530164 - RNA, 19 nt, Human
ggcagaguugaagacagag

SEQ ID NO: 1530165 - RNA, 21 nt, Human
ggcagaguugaagacagagcu

SEQ ID NO: 1530166 - RNA, 18 nt, Human
ggcaugugaugagaggaa

SEQ ID NO: 1530167 - RNA, 23 nt, Human
ggcaugugaugagaggaaaucac

SEQ ID NO: 1530168 - RNA, 21 nt, Human
gcucucaggccagcugcuugg

SEQ ID NO: 1530169 - RNA, 22 nt, Human
gcugacuguuuucucuugagag

SEQ ID NO: 1530170 - RNA, 20 nt, Human
gcugacagacacaggcccgg

SEQ ID NO: 1530171 - RNA, 18 nt, Human
gcugacagacacaggccc

SEQ ID NO: 1530172 - RNA, 19 nt, Human
gcugacagacacaggcccg

SEQ ID NO: 1530173 - RNA, 22 nt, Human
gcugcaaaggguaucaggugcu

SEQ ID NO: 1530174 - RNA, 23 nt, Human
gcugcaaaggguaucaggugcug

SEQ ID NO: 1530175 - RNA, 21 nt, Human
gcugauuaaaccaaggcuaga

SEQ ID NO: 1530176 - RNA, 19 nt, Human
gcugcauuuaaaagauaca

SEQ ID NO: 1530177 - RNA, 18 nt, Human
gcugcauuuaaaagauac

SEQ ID NO: 1530178 - RNA, 17 nt, Human
gcugcaguugccaguca

SEQ ID NO: 1530179 - RNA, 13 nt, Human
gcugcaguugcca

SEQ ID NO: 1530180 - RNA, 14 nt, Human
gcugcaguugccag

SEQ ID NO: 1530181 - RNA, 13 nt, Human
gcugccaccugcc

SEQ ID NO: 1530182 - RNA, 12 nt, Human
gcugccaccugc

SEQ ID NO: 1530183 - RNA, 16 nt, Human
gcuggaccuugaacug

SEQ ID NO: 1530184 - RNA, 15 nt, Human
gcuggaccuugaacu

SEQ ID NO: 1530185 - RNA, 21 nt, Human
gcuggaaaaguauguuagugc

SEQ ID NO: 1530186 - RNA, 23 nt, Human
gcuggaaaaguauguuagugcaa

SEQ ID NO: 1530187 - RNA, 22 nt, Human
gcugcuuuugucuaugggacuc

SEQ ID NO: 1530188 - RNA, 20 nt, Human
gcugccuguucagcuccagc

SEQ ID NO: 1530189 - RNA, 22 nt, Human
gcugccuguucagcuccagcuc

SEQ ID NO: 1530190 - RNA, 18 nt, Human
gcugccuguucagcucca

SEQ ID NO: 1530191 - RNA, 19 nt, Human
gcugccuguucagcuccag

SEQ ID NO: 1530192 - RNA, 14 nt, Human
gcugcgguccaccc

SEQ ID NO: 1530193 - RNA, 15 nt, Human
gcugcgguccaccca

SEQ ID NO: 1530194 - RNA, 22 nt, Human
gcugcgguccacccaggagccc

SEQ ID NO: 1530195 - RNA, 16 nt, Human
gcugcgguccacccag

SEQ ID NO: 1530196 - RNA, 21 nt, Human
gcugcgguccacccaggagcc

SEQ ID NO: 1530197 - RNA, 12 nt, Human
gcugcccugccc

SEQ ID NO: 1530198 - RNA, 13 nt, Human
gcugcccugccca

SEQ ID NO: 1530199 - RNA, 14 nt, Human
gcugcccugcccac

SEQ ID NO: 1530200 - RNA, 16 nt, Human
gcugcccugcccaccu

SEQ ID NO: 1530201 - RNA, 18 nt, Human
gcugcccugcccaccugg

SEQ ID NO: 1530202 - RNA, 20 nt, Human
gcugcccugcccaccuggcc

SEQ ID NO: 1530203 - RNA, 21 nt, Human
gcugcccugcccaccuggccu

SEQ ID NO: 1530204 - RNA, 22 nt, Human
gcugcccugcccaccuggccuc

SEQ ID NO: 1530205 - RNA, 23 nt, Human
gcugcccugcccaccuggccucu

SEQ ID NO: 1530206 - RNA, 24 nt, Human
gcugcccugcccaccuggccucug

SEQ ID NO: 1530207 - RNA, 15 nt, Human
gcugugucucccuuc

SEQ ID NO: 1530208 - RNA, 18 nt, Human
gcuguguuaaauaaaccu

SEQ ID NO: 1530209 - RNA, 16 nt, Human
gcuggugucaccugaa

SEQ ID NO: 1530210 - RNA, 17 nt, Human
gcugucagccauuccug

SEQ ID NO: 1530211 - RNA, 14 nt, Human
gcuggugucaccug

SEQ ID NO: 1530212 - RNA, 15 nt, Human
gcuggugucaccuga

SEQ ID NO: 1530213 - RNA, 23 nt, Human
gcugucccuuacgugaguccugg

SEQ ID NO: 1530214 - RNA, 16 nt, Human
gcugucccuuuuccuu

SEQ ID NO: 1530215 - RNA, 14 nt, Human
gcugggggccucag

SEQ ID NO: 1530216 - RNA, 15 nt, Human
gcugggggccucagu

SEQ ID NO: 1530217 - RNA, 18 nt, Human
gcugggggccucagugcc

SEQ ID NO: 1530218 - RNA, 14 nt, Human
gcuggucccacuca

SEQ ID NO: 1530219 - RNA, 21 nt, Human
gcugggcuucaguggcagcug

SEQ ID NO: 1530220 - RNA, 22 nt, Human
gcugggcuucaguggcagcugc

SEQ ID NO: 1530221 - RNA, 21 nt, Human
gcugggaugauuggagggggg

SEQ ID NO: 1530222 - RNA, 20 nt, Human
gcugggcuucaguggcagcu

SEQ ID NO: 1530223 - RNA, 16 nt, Human
gcuggccuggccccuc

SEQ ID NO: 1530224 - RNA, 19 nt, Human
gcugggaugauuggagggg

SEQ ID NO: 1530225 - RNA, 21 nt, Human
gcugggcucccuucccaccuc

SEQ ID NO: 1530226 - RNA, 13 nt, Human
gcuggccuggccc

SEQ ID NO: 1530227 - RNA, 14 nt, Human
gcuggccuggcccc

SEQ ID NO: 1530228 - RNA, 15 nt, Human
gcuggccuggccccu

SEQ ID NO: 1530229 - RNA, 12 nt, Human
gcuuguguuaag

SEQ ID NO: 1530230 - RNA, 18 nt, Human
gcuuggaaacuggaugag

SEQ ID NO: 1530231 - RNA, 19 nt, Human
gcuucuguuuuauaauuuu

SEQ ID NO: 1530232 - RNA, 22 nt, Human
gcuucucacugccaugccagcu

SEQ ID NO: 1530233 - RNA, 19 nt, Human
gcuucaguggcagcugcuu

SEQ ID NO: 1530234 - RNA, 20 nt, Human
gcuucaguggcagcugcuuu

SEQ ID NO: 1530235 - RNA, 13 nt, Human
gcuuaucucaggg

SEQ ID NO: 1530236 - RNA, 24 nt, Human
gcuccgcuuucuacccagcgagcc

SEQ ID NO: 1530237 - RNA, 12 nt, Human
gcuccugugucu

SEQ ID NO: 1530238 - RNA, 13 nt, Human
gcuccugugucuu

SEQ ID NO: 1530239 - RNA, 15 nt, Human
gcuccuucuguccua

SEQ ID NO: 1530240 - RNA, 13 nt, Human
gcuccuucugucc

SEQ ID NO: 1530241 - RNA, 17 nt, Human
gcuccuuuagcgcccag

SEQ ID NO: 1530242 - RNA, 19 nt, Human
gcucgagcaugccuggaug

SEQ ID NO: 1530243 - RNA, 21 nt, Human
gcucgagcaugccuggauggg

SEQ ID NO: 1530244 - RNA, 11 nt, Human
gcuccaggagc

SEQ ID NO: 1530245 - RNA, 12 nt, Human
gcuccaggagca

SEQ ID NO: 1530246 - RNA, 14 nt, Human
gcuccaggagcagc

SEQ ID NO: 1530247 - RNA, 21 nt, Human
gcuccagcuguucagcugguu

SEQ ID NO: 1530248 - RNA, 15 nt, Human
gcuccaggagcagcc

SEQ ID NO: 1530249 - RNA, 16 nt, Human
gcuccaggagcagcca

SEQ ID NO: 1530250 - RNA, 17 nt, Human
gcuccaggagcagccac

SEQ ID NO: 1530251 - RNA, 18 nt, Human
gcuccaggagcagccaca

SEQ ID NO: 1530252 - RNA, 12 nt, Human
gcuccaggcucc

SEQ ID NO: 1530253 - RNA, 13 nt, Human
gcuccaggcuccu

SEQ ID NO: 1530254 - RNA, 20 nt, Human
gcucccuucccaccucucuc

SEQ ID NO: 1530255 - RNA, 18 nt, Human
gcuccgcuuucuacccag

SEQ ID NO: 1530256 - RNA, 21 nt, Human
gcuccgcuuucuacccagcga

SEQ ID NO: 1530257 - RNA, 22 nt, Human
gcuccgcuuucuacccagcgag

SEQ ID NO: 1530258 - RNA, 23 nt, Human
gcuccgcuuucuacccagcgagc

SEQ ID NO: 1530259 - RNA, 17 nt, Human
gcucagcggggacagcu

SEQ ID NO: 1530260 - RNA, 18 nt, Human
gcucagcggggacagcuc

SEQ ID NO: 1530261 - RNA, 19 nt, Human
gcucagcggggacagcucc

SEQ ID NO: 1530262 - RNA, 23 nt, Human
gcucagcggggacagcuccuucu

SEQ ID NO: 1530263 - RNA, 16 nt, Human
gcucaccucucccuug

SEQ ID NO: 1530264 - RNA, 17 nt, Human
gcucaccucucccuugg

SEQ ID NO: 1530265 - RNA, 18 nt, Human
gcucaccucucccuugga

SEQ ID NO: 1530266 - RNA, 13 nt, Human
gcucacacugaga

SEQ ID NO: 1530267 - RNA, 14 nt, Human
gcucacacugagaa

SEQ ID NO: 1530268 - RNA, 22 nt, Human
gcucacacugagaauguaagaa

SEQ ID NO: 1530269 - RNA, 16 nt, Human
gcucacauaucuguca

SEQ ID NO: 1530270 - RNA, 12 nt, Human
gcucaccagccc

SEQ ID NO: 1530271 - RNA, 13 nt, Human
gcucaccagcccc

SEQ ID NO: 1530272 - RNA, 14 nt, Human
gcucaccagcccca

SEQ ID NO: 1530273 - RNA, 15 nt, Human
gcucaccagccccag

SEQ ID NO: 1530274 - RNA, 18 nt, Human
gcucaccagccccagugc

SEQ ID NO: 1530275 - RNA, 13 nt, Human
gcuaucuccccca

SEQ ID NO: 1530276 - RNA, 18 nt, Human
gcucaaguccucuuuucu

SEQ ID NO: 1530277 - RNA, 14 nt, Human
gcuaucucccccag

SEQ ID NO: 1530278 - RNA, 15 nt, Human
gcuaucucccccagc

SEQ ID NO: 1530279 - RNA, 19 nt, Human
gcucaaguccucuuuucug

SEQ ID NO: 1530280 - RNA, 22 nt, Human
gcucaaguccucuuuucugaga

SEQ ID NO: 1530281 - RNA, 19 nt, Human
gcuauccagcuauuuuuau

SEQ ID NO: 1530282 - RNA, 21 nt, Human
gcuauaggugcuacaaaaaca

SEQ ID NO: 1530283 - RNA, 14 nt, Human
gcuagauguaugua

SEQ ID NO: 1530284 - RNA, 16 nt, Human
gcuagauguauguacu

SEQ ID NO: 1530285 - RNA, 13 nt, Human
gcuagauguaugu

SEQ ID NO: 1530286 - RNA, 19 nt, Human
gcggugcuaucucccccag

SEQ ID NO: 1530287 - RNA, 22 nt, Human
gcggugcuaucucccccagccc

SEQ ID NO: 1530288 - RNA, 21 nt, Human
gcgccuuaaggauguucuagc

SEQ ID NO: 1530289 - RNA, 23 nt, Human
gcgcccaguuggguggaugccug

SEQ ID NO: 1530290 - RNA, 18 nt, Human
gcgccaaauaaugucucu

SEQ ID NO: 1530291 - RNA, 16 nt, Human
gcggagaaaggaaggg

SEQ ID NO: 1530292 - RNA, 19 nt, Human
gcggagacggagucccacc

SEQ ID NO: 1530293 - RNA, 14 nt, Human
gcggggacagcucc

SEQ ID NO: 1530294 - RNA, 18 nt, Human
gcgcugccccuggcagcc

SEQ ID NO: 1530295 - RNA, 21 nt, Human
gcgcugccccuggcagccccu

SEQ ID NO: 1530296 - RNA, 18 nt, Human
gcggggacagcuccuucu

SEQ ID NO: 1530297 - RNA, 15 nt, Human
gcggggacagcuccu

SEQ ID NO: 1530298 - RNA, 17 nt, Human
gcggggacagcuccuuc

SEQ ID NO: 1530299 - RNA, 19 nt, Human
gcggugagaggggaacaga

SEQ ID NO: 1530300 - RNA, 13 nt, Human
gcgguccacccag

SEQ ID NO: 1530301 - RNA, 14 nt, Human
gcgguccacccagg

SEQ ID NO: 1530302 - RNA, 15 nt, Human
gccuuacacaauggu

SEQ ID NO: 1530303 - RNA, 16 nt, Human
gccuuacacaaugguu

SEQ ID NO: 1530304 - RNA, 12 nt, Human
gcgacaaugcaa

SEQ ID NO: 1530305 - RNA, 13 nt, Human
gcgacaaugcaaa

SEQ ID NO: 1530306 - RNA, 20 nt, Human
gcgacaaugcaaaccaucau

SEQ ID NO: 1530307 - RNA, 21 nt, Human
gcgacaaugcaaaccaucauu

SEQ ID NO: 1530308 - RNA, 13 nt, Human
gccuggccccuca

SEQ ID NO: 1530309 - RNA, 14 nt, Human
gccuggccccucag

SEQ ID NO: 1530310 - RNA, 20 nt, Human
gccuggccagaugcaccagc

SEQ ID NO: 1530311 - RNA, 21 nt, Human
gccuggccagaugcaccagcc

SEQ ID NO: 1530312 - RNA, 22 nt, Human
gccuggccagaugcaccagccc

SEQ ID NO: 1530313 - RNA, 21 nt, Human
gccuggucccacgagggugcc

SEQ ID NO: 1530314 - RNA, 15 nt, Human
gccuguaauccuagc

SEQ ID NO: 1530315 - RNA, 20 nt, Human
gccuguaauccuagcacuuu

SEQ ID NO: 1530316 - RNA, 16 nt, Human
gccuggauggggcugc

SEQ ID NO: 1530317 - RNA, 18 nt, Human
gccuggauggggcugcac

SEQ ID NO: 1530318 - RNA, 20 nt, Human
gccuggauggggcugcaccg

SEQ ID NO: 1530319 - RNA, 14 nt, Human
gccuggacccugug

SEQ ID NO: 1530320 - RNA, 12 nt, Human
gccugagcuggg

SEQ ID NO: 1530321 - RNA, 22 nt, Human
gccugagcgcuccugccgcaga

SEQ ID NO: 1530322 - RNA, 23 nt, Human
gccugagcgcuccugccgcagag

SEQ ID NO: 1530323 - RNA, 17 nt, Human
gccugagcgacagugag

SEQ ID NO: 1530324 - RNA, 20 nt, Human
gccugagcgacagugagacu

SEQ ID NO: 1530325 - RNA, 17 nt, Human
gccugaagucacacagu

SEQ ID NO: 1530326 - RNA, 18 nt, Human
gccugaagucacacagug

SEQ ID NO: 1530327 - RNA, 19 nt, Human
gcccaguuggguggaugcc

SEQ ID NO: 1530328 - RNA, 21 nt, Human
gcccaguuggguggaugccug

SEQ ID NO: 1530329 - RNA, 22 nt, Human
gcccaguuggguggaugccugg

SEQ ID NO: 1530330 - RNA, 16 nt, Human
gccugaagucacacag

SEQ ID NO: 1530331 - RNA, 22 nt, Human
gccaccugcggugcuaucuccc

SEQ ID NO: 1530332 - RNA, 14 nt, Human
gccaccugcggugc

SEQ ID NO: 1530333 - RNA, 20 nt, Human
gccaccugcggugcuaucuc

SEQ ID NO: 1530334 - RNA, 19 nt, Human
gccacggccaggccagagg

SEQ ID NO: 1530335 - RNA, 18 nt, Human
gccacggccaggccagag

SEQ ID NO: 1530336 - RNA, 17 nt, Human
gccaccugccuguuggg

SEQ ID NO: 1530337 - RNA, 20 nt, Human
gccagagacacaagccuucg

SEQ ID NO: 1530338 - RNA, 10 nt, Human
gccagaggag

SEQ ID NO: 1530339 - RNA, 16 nt, Human
gccagagacacaagcc

SEQ ID NO: 1530340 - RNA, 19 nt, Human
gccagacuggcacaguuuu

SEQ ID NO: 1530341 - RNA, 17 nt, Human
gccagagacacaagccu

SEQ ID NO: 1530342 - RNA, 19 nt, Human
gccagagacacaagccuuc

SEQ ID NO: 1530343 - RNA, 20 nt, Human
gccacuauuguuagucucuu

SEQ ID NO: 1530344 - RNA, 15 nt, Human
gccagacuggcacag

SEQ ID NO: 1530345 - RNA, 18 nt, Human
gccagacuggcacaguuu

SEQ ID NO: 1530346 - RNA, 12 nt, Human
gccagaggagag

SEQ ID NO: 1530347 - RNA, 13 nt, Human
gccagaggagaga

SEQ ID NO: 1530348 - RNA, 15 nt, Human
gccagaggagagagg

SEQ ID NO: 1530349 - RNA, 17 nt, Human
gccagaggagagaggac

SEQ ID NO: 1530350 - RNA, 19 nt, Human
gccagaggagagaggaccc

SEQ ID NO: 1530351 - RNA, 22 nt, Human
gccagaggagagaggacccccu

SEQ ID NO: 1530352 - RNA, 21 nt, Human
gccagagggagugacagaggc

SEQ ID NO: 1530353 - RNA, 22 nt, Human
gccagagggagugacagaggca

SEQ ID NO: 1530354 - RNA, 23 nt, Human
gccagagggagugacagaggcag

SEQ ID NO: 1530355 - RNA, 16 nt, Human
gccagaugcaccagcc

SEQ ID NO: 1530356 - RNA, 17 nt, Human
gccagaugcaccagccc

SEQ ID NO: 1530357 - RNA, 18 nt, Human
gccagaugcaccagcccu

SEQ ID NO: 1530358 - RNA, 16 nt, Human
gccacaagacccuugu

SEQ ID NO: 1530359 - RNA, 22 nt, Human
gccacaagacccuugugguccc

SEQ ID NO: 1530360 - RNA, 12 nt, Human
gccacaggccug

SEQ ID NO: 1530361 - RNA, 13 nt, Human
gccacaggccuga

SEQ ID NO: 1530362 - RNA, 15 nt, Human
gccacaggccugaga

SEQ ID NO: 1530363 - RNA, 20 nt, Human
gccacaggccugagauuuca

SEQ ID NO: 1530364 - RNA, 22 nt, Human
gccacaggccugagauuucauc

SEQ ID NO: 1530365 - RNA, 23 nt, Human
gccacaggccugagauuucaucu

SEQ ID NO: 1530366 - RNA, 23 nt, Human
gccacagagaaaguacuucucca

SEQ ID NO: 1530367 - RNA, 13 nt, Human
gccacagagaaag

SEQ ID NO: 1530368 - RNA, 14 nt, Human
gccacagagaaagu

SEQ ID NO: 1530369 - RNA, 20 nt, Human
gccacagagaaaguacuucu

SEQ ID NO: 1530370 - RNA, 14 nt, Human
gccaaggugggagg

SEQ ID NO: 1530371 - RNA, 15 nt, Human
gccaaggugggagga

SEQ ID NO: 1530372 - RNA, 23 nt, Human
gccaaggugggaggauugcuuga

SEQ ID NO: 1530373 - RNA, 23 nt, Human
gcauuuggugguuucagaaaugu

SEQ ID NO: 1530374 - RNA, 22 nt, Human
gcauuuggugguuucagaaaug

SEQ ID NO: 1530375 - RNA, 20 nt, Human
gcauuugaggucuguucuuu

SEQ ID NO: 1530376 - RNA, 19 nt, Human
gcauuugaggucuguucuu

SEQ ID NO: 1530377 - RNA, 21 nt, Human
gcauuugaggucuguucuuuc

SEQ ID NO: 1530378 - RNA, 21 nt, Human
gccaaggcugggggaagaagc

SEQ ID NO: 1530379 - RNA, 19 nt, Human
gccaugggcacugugggua

SEQ ID NO: 1530380 - RNA, 23 nt, Human
gccaugggacagggaggacgcuc

SEQ ID NO: 1530381 - RNA, 18 nt, Human
gccauggacagaagaagg

SEQ ID NO: 1530382 - RNA, 15 nt, Human
gcccaaagaugcagc

SEQ ID NO: 1530383 - RNA, 19 nt, Human
gccaugccagcuuaucuca

SEQ ID NO: 1530384 - RNA, 13 nt, Human
gccaugccagcuu

SEQ ID NO: 1530385 - RNA, 18 nt, Human
gccaugccagcuuaucuc

SEQ ID NO: 1530386 - RNA, 18 nt, Human
gccaugaggaacaaggca

SEQ ID NO: 1530387 - RNA, 20 nt, Human
gccaugaggaacaaggcaag

SEQ ID NO: 1530388 - RNA, 19 nt, Human
gccagugaugcuaaagguu

SEQ ID NO: 1530389 - RNA, 20 nt, Human
gccagugaugcuaaagguug

SEQ ID NO: 1530390 - RNA, 12 nt, Human
gccaguaaaugg

SEQ ID NO: 1530391 - RNA, 17 nt, Human
gccagguuuuuggucug

SEQ ID NO: 1530392 - RNA, 21 nt, Human
gccagucaccccggccaccug

SEQ ID NO: 1530393 - RNA, 20 nt, Human
gccagucaccccggccaccu

SEQ ID NO: 1530394 - RNA, 17 nt, Human
gccagucaccccggcca

SEQ ID NO: 1530395 - RNA, 18 nt, Human
gccagucaccccggccac

SEQ ID NO: 1530396 - RNA, 13 nt, Human
gccagggacagag

SEQ ID NO: 1530397 - RNA, 16 nt, Human
gccagggacagagggg

SEQ ID NO: 1530398 - RNA, 18 nt, Human
gccagggacagagggggu

SEQ ID NO: 1530399 - RNA, 23 nt, Human
gccagggacagaggggguggccu

SEQ ID NO: 1530400 - RNA, 19 nt, Human
gccagauuuuccugaaaac

SEQ ID NO: 1530401 - RNA, 16 nt, Human
gccagauuucacucuc

SEQ ID NO: 1530402 - RNA, 18 nt, Human
gccagauuucacucuccu

SEQ ID NO: 1530403 - RNA, 21 nt, Human
gccagauuucacucuccuugg

SEQ ID NO: 1530404 - RNA, 22 nt, Human
gcccaauucuuacaaacaugug

SEQ ID NO: 1530405 - RNA, 21 nt, Human
gcccaaugcacuuuguucugg

SEQ ID NO: 1530406 - RNA, 15 nt, Human
gcccagagagggugg

SEQ ID NO: 1530407 - RNA, 16 nt, Human
gcccagaggagggcag

SEQ ID NO: 1530408 - RNA, 23 nt, Human
gcccagaggagggcagcagaagg

SEQ ID NO: 1530409 - RNA, 12 nt, Human
gcccagagggcc

SEQ ID NO: 1530410 - RNA, 14 nt, Human
gcccagagggccug

SEQ ID NO: 1530411 - RNA, 15 nt, Human
gcccagagggccugc

SEQ ID NO: 1530412 - RNA, 18 nt, Human
gcccagagggccugcaag

SEQ ID NO: 1530413 - RNA, 19 nt, Human
gcccagagggccugcaagg

SEQ ID NO: 1530414 - RNA, 22 nt, Human
gcccagagggccugcaagggag

SEQ ID NO: 1530415 - RNA, 20 nt, Human
gcccagagggccugcaaggg

SEQ ID NO: 1530416 - RNA, 21 nt, Human
gcccagagggccugcaaggga

SEQ ID NO: 1530417 - RNA, 9 nt, Human
gcccagccc

SEQ ID NO: 1530418 - RNA, 11 nt, Human
gcccagccccu

SEQ ID NO: 1530419 - RNA, 12 nt, Human
gcccagccccuu

SEQ ID NO: 1530420 - RNA, 20 nt, Human
gcccagccccuucugaccca

SEQ ID NO: 1530421 - RNA, 24 nt, Human
gcccagccccuucugacccaugcu

SEQ ID NO: 1530422 - RNA, 13 nt, Human
gcccagccccuuc

SEQ ID NO: 1530423 - RNA, 14 nt, Human
gcccagccccuucu

SEQ ID NO: 1530424 - RNA, 16 nt, Human
gcccagccccuucuga

SEQ ID NO: 1530425 - RNA, 17 nt, Human
gcccagccccuucugac

SEQ ID NO: 1530426 - RNA, 22 nt, Human
gcccaggcuggcgugcaguggu

SEQ ID NO: 1530427 - RNA, 19 nt, Human
gcccaggcuggcgugcagu

SEQ ID NO: 1530428 - RNA, 20 nt, Human
gcccaggcuggcgugcagug

SEQ ID NO: 1530429 - RNA, 18 nt, Human
gcccaggaaaggcuccag

SEQ ID NO: 1530430 - RNA, 19 nt, Human
gcccaggaaaggcuccagg

SEQ ID NO: 1530431 - RNA, 20 nt, Human
gcccaggaaaggcuccagga

SEQ ID NO: 1530432 - RNA, 21 nt, Human
gcccaggaaaggcuccaggag

SEQ ID NO: 1530433 - RNA, 23 nt, Human
gcccaggcuuagucacugagaca

SEQ ID NO: 1530434 - RNA, 19 nt, Human
gcccaggcuuagucacuga

SEQ ID NO: 1530435 - RNA, 21 nt, Human
gcccaggcuuagucacugaga

SEQ ID NO: 1530436 - RNA, 19 nt, Human
gcccagucuggaaugcagu

SEQ ID NO: 1530437 - RNA, 20 nt, Human
gcccagucuggaaugcagug

SEQ ID NO: 1530438 - RNA, 19 nt, Human
gcaggguccuagaaauucc

SEQ ID NO: 1530439 - RNA, 16 nt, Human
gcagggucucacucug

SEQ ID NO: 1530440 - RNA, 22 nt, Human
gcaggggaggguagagcggaga

SEQ ID NO: 1530441 - RNA, 12 nt, Human
gcaggggagggg

SEQ ID NO: 1530442 - RNA, 18 nt, Human
gcaggcagccaggccaca

SEQ ID NO: 1530443 - RNA, 17 nt, Human
gcagggucucacucugu

SEQ ID NO: 1530444 - RNA, 11 nt, Human
gcagugggagc

SEQ ID NO: 1530445 - RNA, 12 nt, Human
gcagugggagcu

SEQ ID NO: 1530446 - RNA, 18 nt, Human
gcaguggugcgaucuggg

SEQ ID NO: 1530447 - RNA, 19 nt, Human
gcaguggugcgaucugggu

SEQ ID NO: 1530448 - RNA, 21 nt, Human
gcaguggugguuuucuguucu

SEQ ID NO: 1530449 - RNA, 20 nt, Human
gcaguggugguuuucuguuc

SEQ ID NO: 1530450 - RNA, 19 nt, Human
gcaguggugguuuucuguu

SEQ ID NO: 1530451 - RNA, 22 nt, Human
gcaguggugcgaucuggguuca

SEQ ID NO: 1530452 - RNA, 20 nt, Human
gcaguggugcgaucuggguu

SEQ ID NO: 1530453 - RNA, 21 nt, Human
gcaguggugcgaucuggguuc

SEQ ID NO: 1530454 - RNA, 22 nt, Human
gcaguggugguuuucuguucuu

SEQ ID NO: 1530455 - RNA, 16 nt, Human
gcaguugaaaagacuc

SEQ ID NO: 1530456 - RNA, 19 nt, Human
gcaguugaaaagacuccaa

SEQ ID NO: 1530457 - RNA, 19 nt, Human
gcauacguacacauuuuau

SEQ ID NO: 1530458 - RNA, 21 nt, Human
gcaguugaaaagacuccaaag

SEQ ID NO: 1530459 - RNA, 22 nt, Human
gcaguugaaaagacuccaaaga

SEQ ID NO: 1530460 - RNA, 23 nt, Human
gcaucaggccaggcccucugccc

SEQ ID NO: 1530461 - RNA, 13 nt, Human
gcaucaggccagg

SEQ ID NO: 1530462 - RNA, 12 nt, Human
gcaucaggccag

SEQ ID NO: 1530463 - RNA, 23 nt, Human
gcaucagcugcugaaacaacaaa

SEQ ID NO: 1530464 - RNA, 22 nt, Human
gcaucagcugcugaaacaacaa

SEQ ID NO: 1530465 - RNA, 22 nt, Human
gcaugaaguaauaugcacacau

SEQ ID NO: 1530466 - RNA, 21 nt, Human
gcaugaaguaauaugcacaca

SEQ ID NO: 1530467 - RNA, 20 nt, Human
gcaugaaguaauaugcacac

SEQ ID NO: 1530468 - RNA, 23 nt, Human
gcaugaaguaauaugcacacauu

SEQ ID NO: 1530469 - RNA, 21 nt, Human
gcaugacacgaauauugcuga

SEQ ID NO: 1530470 - RNA, 22 nt, Human
gcaugacacgaauauugcugau

SEQ ID NO: 1530471 - RNA, 18 nt, Human
gcauuugaggucuguucu

SEQ ID NO: 1530472 - RNA, 22 nt, Human
gcauuccccaggaggccagccu

SEQ ID NO: 1530473 - RNA, 14 nt, Human
gcauuccccaggag

SEQ ID NO: 1530474 - RNA, 15 nt, Human
gcauuccccaggagg

SEQ ID NO: 1530475 - RNA, 16 nt, Human
gcauuccccaggaggc

SEQ ID NO: 1530476 - RNA, 17 nt, Human
gcauuccccaggaggcc

SEQ ID NO: 1530477 - RNA, 18 nt, Human
gcauuccccaggaggcca

SEQ ID NO: 1530478 - RNA, 19 nt, Human
gcauuccccaggaggccag

SEQ ID NO: 1530479 - RNA, 20 nt, Human
gcauuccccaggaggccagc

SEQ ID NO: 1530480 - RNA, 21 nt, Human
gcauuccccaggaggccagcc

SEQ ID NO: 1530481 - RNA, 24 nt, Human
gcauuaucuagauacuguaucaug

SEQ ID NO: 1530482 - RNA, 22 nt, Human
gcauuaucuagauacuguauca

SEQ ID NO: 1530483 - RNA, 15 nt, Human
gcaugccuggauggg

SEQ ID NO: 1530484 - RNA, 13 nt, Human
gcauguuacauaa

SEQ ID NO: 1530485 - RNA, 14 nt, Human
gcauguucucugag

SEQ ID NO: 1530486 - RNA, 14 nt, Human
gcaugccuggaugg

SEQ ID NO: 1530487 - RNA, 15 nt, Human
gcacagccucuuaga

SEQ ID NO: 1530488 - RNA, 17 nt, Human
gcacagcccaaagaagg

SEQ ID NO: 1530489 - RNA, 20 nt, Human
gauugugucucuugguccug

SEQ ID NO: 1530490 - RNA, 18 nt, Human
gcacagccucuuagaugc

SEQ ID NO: 1530491 - RNA, 23 nt, Human
gcacagcuucauuuccugugucu

SEQ ID NO: 1530492 - RNA, 17 nt, Human
gcaccaucucuccuccu

SEQ ID NO: 1530493 - RNA, 14 nt, Human
gcaccagcagccug

SEQ ID NO: 1530494 - RNA, 13 nt, Human
gcaccagcagccu

SEQ ID NO: 1530495 - RNA, 14 nt, Human
gcaccaucucuccu

SEQ ID NO: 1530496 - RNA, 15 nt, Human
gcaccaucucuccuc

SEQ ID NO: 1530497 - RNA, 12 nt, Human
gcacugggcuug

SEQ ID NO: 1530498 - RNA, 19 nt, Human
gcacuguuuuauuuuaauu

SEQ ID NO: 1530499 - RNA, 14 nt, Human
gcacugggcuuggg

SEQ ID NO: 1530500 - RNA, 22 nt, Human
gcacuauaauguaagcucuacu

SEQ ID NO: 1530501 - RNA, 20 nt, Human
gcacuauaauguaagcucua

SEQ ID NO: 1530502 - RNA, 14 nt, Human
gcacuauaauguaa

SEQ ID NO: 1530503 - RNA, 15 nt, Human
gcacuauaauguaag

SEQ ID NO: 1530504 - RNA, 12 nt, Human
gcacugcuucca

SEQ ID NO: 1530505 - RNA, 13 nt, Human
gcacugcuuccag

SEQ ID NO: 1530506 - RNA, 14 nt, Human
gcacugcuuccagu

SEQ ID NO: 1530507 - RNA, 15 nt, Human
gcacugcuuccagug

SEQ ID NO: 1530508 - RNA, 14 nt, Human
gcacgugugugcac

SEQ ID NO: 1530509 - RNA, 17 nt, Human
gcacuaaaguuaguaaa

SEQ ID NO: 1530510 - RNA, 20 nt, Human
gcacuaaggugugcucugau

SEQ ID NO: 1530511 - RNA, 16 nt, Human
gcacccucaggcaggu

SEQ ID NO: 1530512 - RNA, 19 nt, Human
gcacccucaggcagguggg

SEQ ID NO: 1530513 - RNA, 18 nt, Human
gcagcucagagagggugg

SEQ ID NO: 1530514 - RNA, 19 nt, Human
gcagcucagagaggguggg

SEQ ID NO: 1530515 - RNA, 16 nt, Human
gcagcucaccucuccc

SEQ ID NO: 1530516 - RNA, 17 nt, Human
gcagcucaccucucccu

SEQ ID NO: 1530517 - RNA, 20 nt, Human
gcagcucaccucucccuugg

SEQ ID NO: 1530518 - RNA, 21 nt, Human
gcagcucaccucucccuugga

SEQ ID NO: 1530519 - RNA, 14 nt, Human
gcagcucagagagg

SEQ ID NO: 1530520 - RNA, 20 nt, Human
gcagcagggagggcuucugc

SEQ ID NO: 1530521 - RNA, 18 nt, Human
gcagcagggagggcuucu

SEQ ID NO: 1530522 - RNA, 19 nt, Human
gcagcagggagggcuucug

SEQ ID NO: 1530523 - RNA, 15 nt, Human
gcagccucacagucc

SEQ ID NO: 1530524 - RNA, 17 nt, Human
gcagccucacaguccuu

SEQ ID NO: 1530525 - RNA, 19 nt, Human
gcagccucacaguccuuac

SEQ ID NO: 1530526 - RNA, 22 nt, Human
gcagagaccaucccugaaggcc

SEQ ID NO: 1530527 - RNA, 20 nt, Human
gcagagaccaucccugaagg

SEQ ID NO: 1530528 - RNA, 21 nt, Human
gcagagaccaucccugaaggc

SEQ ID NO: 1530529 - RNA, 22 nt, Human
gcacuucgggaggucgaggcag

SEQ ID NO: 1530530 - RNA, 14 nt, Human
gcacuugcagacuc

SEQ ID NO: 1530531 - RNA, 16 nt, Human
gcacuugcagacucua

SEQ ID NO: 1530532 - RNA, 18 nt, Human
gcagacucuacagaggcc

SEQ ID NO: 1530533 - RNA, 19 nt, Human
gcagacucuacagaggcca

SEQ ID NO: 1530534 - RNA, 22 nt, Human
gcagacucuacagaggccaugg

SEQ ID NO: 1530535 - RNA, 15 nt, Human
gcagcagaagggggu

SEQ ID NO: 1530536 - RNA, 22 nt, Human
gcagcagaaggggguggugucu

SEQ ID NO: 1530537 - RNA, 18 nt, Human
gcagauggagaccccuug

SEQ ID NO: 1530538 - RNA, 23 nt, Human
gcagagguugcagugagccgaga

SEQ ID NO: 1530539 - RNA, 18 nt, Human
gcagagguugcagugagc

SEQ ID NO: 1530540 - RNA, 19 nt, Human
gauucaacagguuuuccug

SEQ ID NO: 1530541 - RNA, 18 nt, Human
gauuaaccacuucagcug

SEQ ID NO: 1530542 - RNA, 19 nt, Human
gauuaaccacuucagcuga

SEQ ID NO: 1530543 - RNA, 21 nt, Human
gauuaaccacuucagcugacu

SEQ ID NO: 1530544 - RNA, 14 nt, Human
gauguuuuccauga

SEQ ID NO: 1530545 - RNA, 19 nt, Human
gauguugaaaaaguucugc

SEQ ID NO: 1530546 - RNA, 21 nt, Human
gauguucuuucacccuuuucu

SEQ ID NO: 1530547 - RNA, 19 nt, Human
gauuaaauucuugcaaagu

SEQ ID NO: 1530548 - RNA, 12 nt, Human
gauuaaauucuu

SEQ ID NO: 1530549 - RNA, 15 nt, Human
gauguuuuccaugag

SEQ ID NO: 1530550 - RNA, 23 nt, Human
gauguuuuccaugaguccccugu

SEQ ID NO: 1530551 - RNA, 16 nt, Human
gauguucugggacaca

SEQ ID NO: 1530552 - RNA, 23 nt, Human
gauggugcaaugaccuuucaaua

SEQ ID NO: 1530553 - RNA, 20 nt, Human
gauggugcaaugaccuuuca

SEQ ID NO: 1530554 - RNA, 16 nt, Human
gaugggcccaauucuu

SEQ ID NO: 1530555 - RNA, 12 nt, Human
gauucagacagc

SEQ ID NO: 1530556 - RNA, 22 nt, Human
gauucccaagcucugcuccucu

SEQ ID NO: 1530557 - RNA, 13 nt, Human
gauugugccccug

SEQ ID NO: 1530558 - RNA, 20 nt, Human
gauuguccccgacccuugcc

SEQ ID NO: 1530559 - RNA, 15 nt, Human
gauuguccccgaccc

SEQ ID NO: 1530560 - RNA, 23 nt, Human
gauugacgggacuguugguauug

SEQ ID NO: 1530561 - RNA, 11 nt, Human
gaugagaaagg

SEQ ID NO: 1530562 - RNA, 22 nt, Human
gaugagaaagguugaagcacca

SEQ ID NO: 1530563 - RNA, 23 nt, Human
gaugagaaauaaaguuucuguug

SEQ ID NO: 1530564 - RNA, 18 nt, Human
gaugcaguucugaagaag

SEQ ID NO: 1530565 - RNA, 21 nt, Human
gaugcacagaguuguuacauu

SEQ ID NO: 1530566 - RNA, 14 nt, Human
gaugccugguggca

SEQ ID NO: 1530567 - RNA, 16 nt, Human
gaugggaaagcauugu

SEQ ID NO: 1530568 - RNA, 22 nt, Human
gaugggcaacccccagccugcu

SEQ ID NO: 1530569 - RNA, 16 nt, Human
gaucacgccacugcac

SEQ ID NO: 1530570 - RNA, 11 nt, Human
gauccuccagg

SEQ ID NO: 1530571 - RNA, 15 nt, Human
gaucacgccacugca

SEQ ID NO: 1530572 - RNA, 18 nt, Human
gauccuaguuccaccauc

SEQ ID NO: 1530573 - RNA, 23 nt, Human
gaucaaccccuucgcuccugugu

SEQ ID NO: 1530574 - RNA, 13 nt, Human
gaucacgccacug

SEQ ID NO: 1530575 - RNA, 14 nt, Human
gaucacgccacugc

SEQ ID NO: 1530576 - RNA, 12 nt, Human
gauccuccaggu

SEQ ID NO: 1530577 - RNA, 19 nt, Human
gauccucccaccucagccu

SEQ ID NO: 1530578 - RNA, 20 nt, Human
gauccucccaccucagccuc

SEQ ID NO: 1530579 - RNA, 21 nt, Human
gauccucccaccucagccucc

SEQ ID NO: 1530580 - RNA, 14 nt, Human
gauccugagccaga

SEQ ID NO: 1530581 - RNA, 15 nt, Human
gauccugagccagau

SEQ ID NO: 1530582 - RNA, 19 nt, Human
gauccugagccagauuuca

SEQ ID NO: 1530583 - RNA, 17 nt, Human
gaucuuugcagacaggc

SEQ ID NO: 1530584 - RNA, 15 nt, Human
gaugaaaaaauaaca

SEQ ID NO: 1530585 - RNA, 16 nt, Human
gaucuuugcagacagg

SEQ ID NO: 1530586 - RNA, 23 nt, Human
gaucuucaucugacuaugacaua

SEQ ID NO: 1530587 - RNA, 14 nt, Human
gaucuuuaaaauac

SEQ ID NO: 1530588 - RNA, 21 nt, Human
gauccugagccagauuucacu

SEQ ID NO: 1530589 - RNA, 16 nt, Human
gaucuucaucugacua

SEQ ID NO: 1530590 - RNA, 21 nt, Human
gagucugaaggcuggguucug

SEQ ID NO: 1530591 - RNA, 22 nt, Human
gagucucacuguugcccaggcu

SEQ ID NO: 1530592 - RNA, 23 nt, Human
gagucucacuguugcccaggcug

SEQ ID NO: 1530593 - RNA, 13 nt, Human
gagucgcugugcc

SEQ ID NO: 1530594 - RNA, 17 nt, Human
gagucgaggacagggag

SEQ ID NO: 1530595 - RNA, 19 nt, Human
gagucucacuguugcccag

SEQ ID NO: 1530596 - RNA, 20 nt, Human
gagucucacuguugcccagg

SEQ ID NO: 1530597 - RNA, 21 nt, Human
gagucucacuguugcccaggc

SEQ ID NO: 1530598 - RNA, 18 nt, Human
gaguauuuuugacagaau

SEQ ID NO: 1530599 - RNA, 19 nt, Human
gaguagcugggacuacagg

SEQ ID NO: 1530600 - RNA, 14 nt, Human
gaguauuuuugaca

SEQ ID NO: 1530601 - RNA, 16 nt, Human
gaguauuuuugacaga

SEQ ID NO: 1530602 - RNA, 17 nt, Human
gaguauuuuugacagaa

SEQ ID NO: 1530603 - RNA, 12 nt, Human
gaguagcuggga

SEQ ID NO: 1530604 - RNA, 14 nt, Human
gaguagcugggacu

SEQ ID NO: 1530605 - RNA, 14 nt, Human
gaguccccuguuug

SEQ ID NO: 1530606 - RNA, 23 nt, Human
gaguccccuguuuguuucugaaa

SEQ ID NO: 1530607 - RNA, 12 nt, Human
gaguccccuguu

SEQ ID NO: 1530608 - RNA, 16 nt, Human
gaguacguugugcauu

SEQ ID NO: 1530609 - RNA, 19 nt, Human
gagguuuuaaaaaaauccc

SEQ ID NO: 1530610 - RNA, 19 nt, Human
gagguucaaagauauuuug

SEQ ID NO: 1530611 - RNA, 14 nt, Human
gagguucccuuuga

SEQ ID NO: 1530612 - RNA, 20 nt, Human
gaguacguugugcauuuggu

SEQ ID NO: 1530613 - RNA, 15 nt, Human
gaguacuacaguccu

SEQ ID NO: 1530614 - RNA, 18 nt, Human
gaguacguugugcauuug

SEQ ID NO: 1530615 - RNA, 17 nt, Human
gaguacguugugcauuu

SEQ ID NO: 1530616 - RNA, 18 nt, Human
gaguacuacaguccuccc

SEQ ID NO: 1530617 - RNA, 19 nt, Human
gaguacuacaguccuccca

SEQ ID NO: 1530618 - RNA, 22 nt, Human
gaggggggaggugggauccucc

SEQ ID NO: 1530619 - RNA, 15 nt, Human
gaggggguggccucc

SEQ ID NO: 1530620 - RNA, 15 nt, Human
gaggggggagguggg

SEQ ID NO: 1530621 - RNA, 21 nt, Human
gaggugggauccuccaggugc

SEQ ID NO: 1530622 - RNA, 22 nt, Human
gaggugggauccuccaggugca

SEQ ID NO: 1530623 - RNA, 18 nt, Human
gaggugggauccuccagg

SEQ ID NO: 1530624 - RNA, 21 nt, Human
gaguugaaaaucuuauaauuu

SEQ ID NO: 1530625 - RNA, 14 nt, Human
gaguugaagacaga

SEQ ID NO: 1530626 - RNA, 17 nt, Human
gagugugccugaagucc

SEQ ID NO: 1530627 - RNA, 23 nt, Human
gaguucaucuugaauuguaagga

SEQ ID NO: 1530628 - RNA, 12 nt, Human
gagugggcccaa

SEQ ID NO: 1530629 - RNA, 23 nt, Human
gagugggggaucacagccucuga

SEQ ID NO: 1530630 - RNA, 22 nt, Human
gagugaacaaauuuacagagac

SEQ ID NO: 1530631 - RNA, 23 nt, Human
gagugaacaaauuuacagagaca

SEQ ID NO: 1530632 - RNA, 19 nt, Human
gagugaacaaauuuacaga

SEQ ID NO: 1530633 - RNA, 13 nt, Human
gauagccaaggcc

SEQ ID NO: 1530634 - RNA, 14 nt, Human
gauagccaaggcca

SEQ ID NO: 1530635 - RNA, 12 nt, Human
gauagccaaggc

SEQ ID NO: 1530636 - RNA, 19 nt, Human
gauagcacagacccugccc

SEQ ID NO: 1530637 - RNA, 20 nt, Human
gauagcacagacccugcccu

SEQ ID NO: 1530638 - RNA, 22 nt, Human
gaucaaccccuucgcuccugug

SEQ ID NO: 1530639 - RNA, 23 nt, Human
gauauaugcucugcauguuacau

SEQ ID NO: 1530640 - RNA, 21 nt, Human
gauaaucagugugucuaaauu

SEQ ID NO: 1530641 - RNA, 14 nt, Human
gauagacugcuaca

SEQ ID NO: 1530642 - RNA, 18 nt, Human
gauacaaugcugugcccu

SEQ ID NO: 1530643 - RNA, 13 nt, Human
gauacaaugcugu

SEQ ID NO: 1530644 - RNA, 17 nt, Human
gauagcacagacccugc

SEQ ID NO: 1530645 - RNA, 18 nt, Human
gauagcacagacccugcc

SEQ ID NO: 1530646 - RNA, 18 nt, Human
gaggagcucaggacacua

SEQ ID NO: 1530647 - RNA, 13 nt, Human
gaggacagggagg

SEQ ID NO: 1530648 - RNA, 22 nt, Human
gaggacagggaggugaccccag

SEQ ID NO: 1530649 - RNA, 23 nt, Human
gaggacagggaggugaccccagg

SEQ ID NO: 1530650 - RNA, 15 nt, Human
gaggaauccagaccc

SEQ ID NO: 1530651 - RNA, 22 nt, Human
gaggaaggaaacccagcucugg

SEQ ID NO: 1530652 - RNA, 14 nt, Human
gaggaauccagacc

SEQ ID NO: 1530653 - RNA, 12 nt, Human
gaggauguucug

SEQ ID NO: 1530654 - RNA, 17 nt, Human
gaggauguucugggaca

SEQ ID NO: 1530655 - RNA, 20 nt, Human
gaggauguucugggacacag

SEQ ID NO: 1530656 - RNA, 16 nt, Human
gaggauugcuugagcu

SEQ ID NO: 1530657 - RNA, 23 nt, Human
gaggaguuugggguaugggagag

SEQ ID NO: 1530658 - RNA, 19 nt, Human
gaggagguaaugaauuaaa

SEQ ID NO: 1530659 - RNA, 13 nt, Human
gaggcagccccau

SEQ ID NO: 1530660 - RNA, 23 nt, Human
gaggcagccccauucugccugcc

SEQ ID NO: 1530661 - RNA, 18 nt, Human
gaggcagccccauucugc

SEQ ID NO: 1530662 - RNA, 22 nt, Human
gaggcagccccauucugccugc

SEQ ID NO: 1530663 - RNA, 12 nt, Human
gaggccagccuu

SEQ ID NO: 1530664 - RNA, 13 nt, Human
gaggccagccuug

SEQ ID NO: 1530665 - RNA, 14 nt, Human
gagggagggagggc

SEQ ID NO: 1530666 - RNA, 15 nt, Human
gagggagggagggcu

SEQ ID NO: 1530667 - RNA, 15 nt, Human
gagggagggcuccag

SEQ ID NO: 1530668 - RNA, 22 nt, Human
gaggggccucuuaugggcuggg

SEQ ID NO: 1530669 - RNA, 19 nt, Human
gagggcagcagaagggggu

SEQ ID NO: 1530670 - RNA, 21 nt, Human
gagggcagcagaagggggugg

SEQ ID NO: 1530671 - RNA, 22 nt, Human
gagggcagcagaaggggguggu

SEQ ID NO: 1530672 - RNA, 23 nt, Human
gagggcacagaaaauggaagaca

SEQ ID NO: 1530673 - RNA, 22 nt, Human
gagggcacagaaaauggaagac

SEQ ID NO: 1530674 - RNA, 13 nt, Human
gagggagugacag

SEQ ID NO: 1530675 - RNA, 14 nt, Human
gagggagugacaga

SEQ ID NO: 1530676 - RNA, 16 nt, Human
gagggagggcuccaga

SEQ ID NO: 1530677 - RNA, 16 nt, Human
gagggagugacagagg

SEQ ID NO: 1530678 - RNA, 13 nt, Human
gaggcugggcucc

SEQ ID NO: 1530679 - RNA, 14 nt, Human
gaggcugggcuccc

SEQ ID NO: 1530680 - RNA, 16 nt, Human
gaggcugggcucccuu

SEQ ID NO: 1530681 - RNA, 15 nt, Human
gaggcugggcucccu

SEQ ID NO: 1530682 - RNA, 14 nt, Human
gaggccuucucuga

SEQ ID NO: 1530683 - RNA, 20 nt, Human
gaggccugagcgcuccugcc

SEQ ID NO: 1530684 - RNA, 21 nt, Human
gaggccugccuccagggcugg

SEQ ID NO: 1530685 - RNA, 22 nt, Human
gaggccugccuccagggcugga

SEQ ID NO: 1530686 - RNA, 19 nt, Human
gaggccugccuccagggcu

SEQ ID NO: 1530687 - RNA, 20 nt, Human
gaggccugccuccagggcug

SEQ ID NO: 1530688 - RNA, 24 nt, Human
gaggcccuucucuccagccccugg

SEQ ID NO: 1530689 - RNA, 14 nt, Human
gaggcccuucucuc

SEQ ID NO: 1530690 - RNA, 23 nt, Human
gaggcccuucucuccagccccug

SEQ ID NO: 1530691 - RNA, 20 nt, Human
gaggccccugucucagggug

SEQ ID NO: 1530692 - RNA, 14 nt, Human
gagcuacaaaugca

SEQ ID NO: 1530693 - RNA, 23 nt, Human
gagcuacacaggggaaaagagga

SEQ ID NO: 1530694 - RNA, 18 nt, Human
gagcuacccgcagaguuc

SEQ ID NO: 1530695 - RNA, 17 nt, Human
gagcucaggacacuaau

SEQ ID NO: 1530696 - RNA, 14 nt, Human
gagcucaggacacu

SEQ ID NO: 1530697 - RNA, 13 nt, Human
gagcugccaccug

SEQ ID NO: 1530698 - RNA, 15 nt, Human
gagcugccaccugcc

SEQ ID NO: 1530699 - RNA, 16 nt, Human
gagcugccaccugccu

SEQ ID NO: 1530700 - RNA, 13 nt, Human
gagcuacaaaugc

SEQ ID NO: 1530701 - RNA, 12 nt, Human
gagcuacaaaug

SEQ ID NO: 1530702 - RNA, 15 nt, Human
gagccuggcaagaau

SEQ ID NO: 1530703 - RNA, 10 nt, Human
gagccuggca

SEQ ID NO: 1530704 - RNA, 19 nt, Human
gagccuggucccacgaggg

SEQ ID NO: 1530705 - RNA, 23 nt, Human
gagccuggucccacgagggugcc

SEQ ID NO: 1530706 - RNA, 13 nt, Human
gagccugggaggu

SEQ ID NO: 1530707 - RNA, 21 nt, Human
gagccugggaggucaaggcug

SEQ ID NO: 1530708 - RNA, 20 nt, Human
gagccuccugcccuuaccug

SEQ ID NO: 1530709 - RNA, 22 nt, Human
gagccuccugcccuuaccugcc

SEQ ID NO: 1530710 - RNA, 18 nt, Human
gagcccugguggcagugg

SEQ ID NO: 1530711 - RNA, 14 nt, Human
gagccuccugcccu

SEQ ID NO: 1530712 - RNA, 20 nt, Human
gagccucagcauccuggcac

SEQ ID NO: 1530713 - RNA, 21 nt, Human
gagccucagcauccuggcacc

SEQ ID NO: 1530714 - RNA, 15 nt, Human
gagcccugguggcag

SEQ ID NO: 1530715 - RNA, 16 nt, Human
gagcccugguggcagu

SEQ ID NO: 1530716 - RNA, 19 nt, Human
gagccucagcauccuggca

SEQ ID NO: 1530717 - RNA, 17 nt, Human
gagcccugguggcagug

SEQ ID NO: 1530718 - RNA, 13 nt, Human
gagaucagccugg

SEQ ID NO: 1530719 - RNA, 14 nt, Human
gagaucagccuggg

SEQ ID NO: 1530720 - RNA, 16 nt, Human
gagaucagccugggca

SEQ ID NO: 1530721 - RNA, 20 nt, Human
gagaucaaccccuucgcucc

SEQ ID NO: 1530722 - RNA, 19 nt, Human
gagcaccuuagacaguccc

SEQ ID NO: 1530723 - RNA, 17 nt, Human
gagcaccuuagacaguc

SEQ ID NO: 1530724 - RNA, 19 nt, Human
gagcaaaaucgaugcagug

SEQ ID NO: 1530725 - RNA, 13 nt, Human
gagcaaagcugau

SEQ ID NO: 1530726 - RNA, 21 nt, Human
gagcaagacgcugugcugccc

SEQ ID NO: 1530727 - RNA, 18 nt, Human
gagcaagacgcugugcug

SEQ ID NO: 1530728 - RNA, 22 nt, Human
gagcaagacgcugugcugcccu

SEQ ID NO: 1530729 - RNA, 23 nt, Human
gagcaagacgcugugcugcccug

SEQ ID NO: 1530730 - RNA, 18 nt, Human
gagcagccacauuccuga

SEQ ID NO: 1530731 - RNA, 13 nt, Human
gagccacugcacc

SEQ ID NO: 1530732 - RNA, 21 nt, Human
gagcagccacauuccugaugc

SEQ ID NO: 1530733 - RNA, 21 nt, Human
gagcaggcuacugucagcucc

SEQ ID NO: 1530734 - RNA, 22 nt, Human
gagccacugcaccgggccacag

SEQ ID NO: 1530735 - RNA, 13 nt, Human
gagccagauuuca

SEQ ID NO: 1530736 - RNA, 18 nt, Human
gagcccacgcccccacug

SEQ ID NO: 1530737 - RNA, 13 nt, Human
gagcccaggccuc

SEQ ID NO: 1530738 - RNA, 14 nt, Human
gagcccaggccucc

SEQ ID NO: 1530739 - RNA, 12 nt, Human
gagcccacgccc

SEQ ID NO: 1530740 - RNA, 15 nt, Human
gagcccacgccccca

SEQ ID NO: 1530741 - RNA, 16 nt, Human
gagcccacgcccccac

SEQ ID NO: 1530742 - RNA, 12 nt, Human
gagcccaggccu

SEQ ID NO: 1530743 - RNA, 22 nt, Human
gaacuagaguuuagcuggaaaa

SEQ ID NO: 1530744 - RNA, 19 nt, Human
gaacggggcucuucucauu

SEQ ID NO: 1530745 - RNA, 22 nt, Human
gaacggggcucuucucauuuca

SEQ ID NO: 1530746 - RNA, 15 nt, Human
gaacagacuggaagc

SEQ ID NO: 1530747 - RNA, 16 nt, Human
gaacagacuggaagca

SEQ ID NO: 1530748 - RNA, 19 nt, Human
gaacagacuggaagcacag

SEQ ID NO: 1530749 - RNA, 21 nt, Human
gaaccacaucuugcucugcug

SEQ ID NO: 1530750 - RNA, 18 nt, Human
gaaccugaagaacuauuu

SEQ ID NO: 1530751 - RNA, 16 nt, Human
gaaccaccacacccag

SEQ ID NO: 1530752 - RNA, 17 nt, Human
gaaccaccacacccagc

SEQ ID NO: 1530753 - RNA, 22 nt, Human
gaacuuccagauccuggaaauc

SEQ ID NO: 1530754 - RNA, 18 nt, Human
gaacuuacuugcauacca

SEQ ID NO: 1530755 - RNA, 15 nt, Human
gaacucccuuucaac

SEQ ID NO: 1530756 - RNA, 22 nt, Human
gaacuggguacuuguggacaca

SEQ ID NO: 1530757 - RNA, 14 nt, Human
gaacucccuuucaa

SEQ ID NO: 1530758 - RNA, 22 nt, Human
gaacuuguaaaggaauuuaaaa

SEQ ID NO: 1530759 - RNA, 21 nt, Human
gaagaagcaccaaucaugaau

SEQ ID NO: 1530760 - RNA, 21 nt, Human
gaacuuguaaaggaauuuaaa

SEQ ID NO: 1530761 - RNA, 17 nt, Human
gaacuuggcgcugcccc

SEQ ID NO: 1530762 - RNA, 23 nt, Human
gaacuugguucccauuugcuccu

SEQ ID NO: 1530763 - RNA, 13 nt, Human
gaacuuggcgcug

SEQ ID NO: 1530764 - RNA, 15 nt, Human
gaacuuggcgcugcc

SEQ ID NO: 1530765 - RNA, 16 nt, Human
gaacuuggcgcugccc

SEQ ID NO: 1530766 - RNA, 13 nt, Human
gaaauauuauguu

SEQ ID NO: 1530767 - RNA, 16 nt, Human
gaaauauuauguuaaa

SEQ ID NO: 1530768 - RNA, 14 nt, Human
gaaaugggcagagc

SEQ ID NO: 1530769 - RNA, 20 nt, Human
gaaaugggcagagcagagac

SEQ ID NO: 1530770 - RNA, 22 nt, Human
gaaauguaagggaaacugccag

SEQ ID NO: 1530771 - RNA, 17 nt, Human
gaaauuuguuauaauga

SEQ ID NO: 1530772 - RNA, 11 nt, Human
gaaacauuugg

SEQ ID NO: 1530773 - RNA, 21 nt, Human
gaaauaucugaaaauguaugu

SEQ ID NO: 1530774 - RNA, 17 nt, Human
gaaauauaggaacuuaa

SEQ ID NO: 1530775 - RNA, 13 nt, Human
gaaauauaauuga

SEQ ID NO: 1530776 - RNA, 14 nt, Human
gaauacuuuauaaa

SEQ ID NO: 1530777 - RNA, 14 nt, Human
gaauaacauguaau

SEQ ID NO: 1530778 - RNA, 20 nt, Human
gaaguuucugccgcagcccu

SEQ ID NO: 1530779 - RNA, 12 nt, Human
gaaguuucugcc

SEQ ID NO: 1530780 - RNA, 16 nt, Human
gaaguuuacauuguaa

SEQ ID NO: 1530781 - RNA, 17 nt, Human
gaaguuuacauuguaaa

SEQ ID NO: 1530782 - RNA, 14 nt, Human
gaaugaaagggccc

SEQ ID NO: 1530783 - RNA, 19 nt, Human
gaaugaaagggcccagaga

SEQ ID NO: 1530784 - RNA, 21 nt, Human
gaaugaaagggcccagagagg

SEQ ID NO: 1530785 - RNA, 16 nt, Human
gaaucuguauauauuu

SEQ ID NO: 1530786 - RNA, 18 nt, Human
gaaucucauaauuuauac

SEQ ID NO: 1530787 - RNA, 16 nt, Human
gaaucucaaauaacua

SEQ ID NO: 1530788 - RNA, 18 nt, Human
gaauccagacccggcugc

SEQ ID NO: 1530789 - RNA, 15 nt, Human
gaauagcugggacua

SEQ ID NO: 1530790 - RNA, 14 nt, Human
gaauagcugggacu

SEQ ID NO: 1530791 - RNA, 17 nt, Human
gaaggcagcagguggca

SEQ ID NO: 1530792 - RNA, 17 nt, Human
gaaggccccgcccaggc

SEQ ID NO: 1530793 - RNA, 16 nt, Human
gaaggccccgcccagg

SEQ ID NO: 1530794 - RNA, 14 nt, Human
gaaggccccgccca

SEQ ID NO: 1530795 - RNA, 15 nt, Human
gaaggccccgcccag

SEQ ID NO: 1530796 - RNA, 21 nt, Human
gaaggauacaaaagcauguga

SEQ ID NO: 1530797 - RNA, 19 nt, Human
gaaggauacaaaagcaugu

SEQ ID NO: 1530798 - RNA, 12 nt, Human
gaaggauacaaa

SEQ ID NO: 1530799 - RNA, 20 nt, Human
gaaggaaaaggcagggagcg

SEQ ID NO: 1530800 - RNA, 14 nt, Human
gaaggaaacccagc

SEQ ID NO: 1530801 - RNA, 17 nt, Human
gaaggaaacccagcucu

SEQ ID NO: 1530802 - RNA, 18 nt, Human
gaaggaaacccagcucug

SEQ ID NO: 1530803 - RNA, 19 nt, Human
gaaggaaacccagcucugg

SEQ ID NO: 1530804 - RNA, 14 nt, Human
gaaggaaaaugaua

SEQ ID NO: 1530805 - RNA, 15 nt, Human
gaagccagcaggcuc

SEQ ID NO: 1530806 - RNA, 16 nt, Human
gaagccagcaggcucu

SEQ ID NO: 1530807 - RNA, 17 nt, Human
gaagacugcauuauauu

SEQ ID NO: 1530808 - RNA, 14 nt, Human
gaagaagcucucuc

SEQ ID NO: 1530809 - RNA, 19 nt, Human
gaagacucauucuucugua

SEQ ID NO: 1530810 - RNA, 21 nt, Human
gaagacucauucuucuguacg

SEQ ID NO: 1530811 - RNA, 19 nt, Human
gaagccagcaggcucucag

SEQ ID NO: 1530812 - RNA, 23 nt, Human
gaagccagcaggcucucaggcca

SEQ ID NO: 1530813 - RNA, 23 nt, Human
gaagcccaggaaaggcuccagga

SEQ ID NO: 1530814 - RNA, 20 nt, Human
gaagcccaggaaaggcucca

SEQ ID NO: 1530815 - RNA, 21 nt, Human
gaagcccaggaaaggcuccag

SEQ ID NO: 1530816 - RNA, 22 nt, Human
gaagcccaggaaaggcuccagg

SEQ ID NO: 1530817 - RNA, 18 nt, Human
gaaggaaaaggcagggag

SEQ ID NO: 1530818 - RNA, 21 nt, Human
gaagccuuggggcugaugcag

SEQ ID NO: 1530819 - RNA, 14 nt, Human
gaagcggcuggcag

SEQ ID NO: 1530820 - RNA, 13 nt, Human
cuuuccacagaag

SEQ ID NO: 1530821 - RNA, 22 nt, Human
cuuuccaaaugcccagcuuaaa

SEQ ID NO: 1530822 - RNA, 18 nt, Human
cuuuccaaaugcccagcu

SEQ ID NO: 1530823 - RNA, 19 nt, Human
cuuuccaaaugcccagcuu

SEQ ID NO: 1530824 - RNA, 20 nt, Human
cuuucauuuuuuuccaggcu

SEQ ID NO: 1530825 - RNA, 22 nt, Human
cuuucauuuuuuuccaggcugg

SEQ ID NO: 1530826 - RNA, 15 nt, Human
cuuucauuuuuuucc

SEQ ID NO: 1530827 - RNA, 16 nt, Human
cuuucauuuuuuucca

SEQ ID NO: 1530828 - RNA, 19 nt, Human
cuuucauuuuuuuccaggc

SEQ ID NO: 1530829 - RNA, 15 nt, Human
cuuucagugaaagca

SEQ ID NO: 1530830 - RNA, 17 nt, Human
cuuucagugaaagcauc

SEQ ID NO: 1530831 - RNA, 21 nt, Human
cuuuauuuucuauaauuuaaa

SEQ ID NO: 1530832 - RNA, 13 nt, Human
cuuuauaauucua

SEQ ID NO: 1530833 - RNA, 20 nt, Human
cuuuaaagggauggcaagau

SEQ ID NO: 1530834 - RNA, 18 nt, Human
cuuuaaagggauggcaag

SEQ ID NO: 1530835 - RNA, 19 nt, Human
cuuguguuaaguaugugua

SEQ ID NO: 1530836 - RNA, 21 nt, Human
cuuguguguuuauugucaaag

SEQ ID NO: 1530837 - RNA, 16 nt, Human
cuuguaaauagcucag

SEQ ID NO: 1530838 - RNA, 19 nt, Human
cuuguaaaggaauuuaaaa

SEQ ID NO: 1530839 - RNA, 16 nt, Human
cuuggggggcugaggu

SEQ ID NO: 1530840 - RNA, 22 nt, Human
cuuggggggcugaggugggagg

SEQ ID NO: 1530841 - RNA, 16 nt, Human
cuuggggaccagagcu

SEQ ID NO: 1530842 - RNA, 22 nt, Human
cuuggggaccagagcugccacc

SEQ ID NO: 1530843 - RNA, 15 nt, Human
cuuggggggcugagg

SEQ ID NO: 1530844 - RNA, 18 nt, Human
cuugggccacugugaaga

SEQ ID NO: 1530845 - RNA, 13 nt, Human
cuugggcuucauc

SEQ ID NO: 1530846 - RNA, 14 nt, Human
cuugggccacugug

SEQ ID NO: 1530847 - RNA, 21 nt, Human
cuuggggaccagagcugccac

SEQ ID NO: 1530848 - RNA, 22 nt, Human
cuugggcuucauccuccucaga

SEQ ID NO: 1530849 - RNA, 22 nt, Human
cuuggaggaaggaaacccagcu

SEQ ID NO: 1530850 - RNA, 23 nt, Human
cuuggagggcaugaagacagaua

SEQ ID NO: 1530851 - RNA, 12 nt, Human
cuuggagggcau

SEQ ID NO: 1530852 - RNA, 16 nt, Human
cuuggcugcagggagu

SEQ ID NO: 1530853 - RNA, 17 nt, Human
cuuggcugcagggaguc

SEQ ID NO: 1530854 - RNA, 18 nt, Human
cuugcccuggugccucac

SEQ ID NO: 1530855 - RNA, 14 nt, Human
cuugcucugcugac

SEQ ID NO: 1530856 - RNA, 17 nt, Human
cuucuccacccugcucu

SEQ ID NO: 1530857 - RNA, 18 nt, Human
cuucuccacccugcucuc

SEQ ID NO: 1530858 - RNA, 21 nt, Human
cuucuccacccugcucuccga

SEQ ID NO: 1530859 - RNA, 21 nt, Human
cuucucauuucaccccucccu

SEQ ID NO: 1530860 - RNA, 18 nt, Human
cuucucauuucaccccuc

SEQ ID NO: 1530861 - RNA, 16 nt, Human
cuugcucugcugacag

SEQ ID NO: 1530862 - RNA, 17 nt, Human
cuugcucugcugacaga

SEQ ID NO: 1530863 - RNA, 20 nt, Human
cuugcuucaaccccaugaga

SEQ ID NO: 1530864 - RNA, 16 nt, Human
cuuggaaaugggagac

SEQ ID NO: 1530865 - RNA, 21 nt, Human
cuuggaaacuggaugagguca

SEQ ID NO: 1530866 - RNA, 13 nt, Human
cuuggaagcuccg

SEQ ID NO: 1530867 - RNA, 14 nt, Human
cuuggaagcuccgc

SEQ ID NO: 1530868 - RNA, 13 nt, Human
cuuggaggaagga

SEQ ID NO: 1530869 - RNA, 20 nt, Human
cuuuuuucucugauacagaa

SEQ ID NO: 1530870 - RNA, 16 nt, Human
cuuuugagcauuuaga

SEQ ID NO: 1530871 - RNA, 21 nt, Human
cuuuugagugccuuacacaau

SEQ ID NO: 1530872 - RNA, 22 nt, Human
cuuuuuucucugauacagaaaa

SEQ ID NO: 1530873 - RNA, 14 nt, Human
cuuuuuuggcugcu

SEQ ID NO: 1530874 - RNA, 15 nt, Human
cuuuuuuggcugcug

SEQ ID NO: 1530875 - RNA, 23 nt, Human
gaaaaaggaugcacagaguuguu

SEQ ID NO: 1530876 - RNA, 16 nt, Human
cuuuuuuggcugcuga

SEQ ID NO: 1530877 - RNA, 22 nt, Human
gaaaacaauaacgauaaaagac

SEQ ID NO: 1530878 - RNA, 13 nt, Human
gaaaacacauuuu

SEQ ID NO: 1530879 - RNA, 15 nt, Human
gaaaacaugcuacac

SEQ ID NO: 1530880 - RNA, 14 nt, Human
gaaaacaugcuaca

SEQ ID NO: 1530881 - RNA, 12 nt, Human
gaaaacaugcua

SEQ ID NO: 1530882 - RNA, 14 nt, Human
gaaaacacauuuuu

SEQ ID NO: 1530883 - RNA, 19 nt, Human
gaaaacguggcugcuucaa

SEQ ID NO: 1530884 - RNA, 18 nt, Human
gaaaacguggcugcuuca

SEQ ID NO: 1530885 - RNA, 15 nt, Human
gaaaacguggcugcu

SEQ ID NO: 1530886 - RNA, 16 nt, Human
gaaaacguggcugcuu

SEQ ID NO: 1530887 - RNA, 16 nt, Human
gaaaacaugcuacaca

SEQ ID NO: 1530888 - RNA, 19 nt, Human
gaaaauaacgauaaaagac

SEQ ID NO: 1530889 - RNA, 13 nt, Human
gaaaagcugcuga

SEQ ID NO: 1530890 - RNA, 17 nt, Human
gaaaagcugcugacagu

SEQ ID NO: 1530891 - RNA, 19 nt, Human
gaaaagcugcugacagugu

SEQ ID NO: 1530892 - RNA, 12 nt, Human
gaaaauaucacu

SEQ ID NO: 1530893 - RNA, 14 nt, Human
gaaaaucagccugc

SEQ ID NO: 1530894 - RNA, 17 nt, Human
gaaaauauuauguguuu

SEQ ID NO: 1530895 - RNA, 19 nt, Human
gaaaaucuuauaauuuaaa

SEQ ID NO: 1530896 - RNA, 16 nt, Human
gaaaaucagccugcuc

SEQ ID NO: 1530897 - RNA, 18 nt, Human
gaaaaucagccugcucca

SEQ ID NO: 1530898 - RNA, 20 nt, Human
gaaaaucuuauaauuuaaaa

SEQ ID NO: 1530899 - RNA, 18 nt, Human
gaaacagcuaaugggaca

SEQ ID NO: 1530900 - RNA, 18 nt, Human
cuuuguuuguugucagcu

SEQ ID NO: 1530901 - RNA, 20 nt, Human
cuuuguuuguugucagcuga

SEQ ID NO: 1530902 - RNA, 22 nt, Human
cuuuucauaaccuagccuuaga

SEQ ID NO: 1530903 - RNA, 20 nt, Human
cuuuucauaaccuagccuua

SEQ ID NO: 1530904 - RNA, 18 nt, Human
cuuuucuguccgagcuuu

SEQ ID NO: 1530905 - RNA, 23 nt, Human
cuuuucuguccgagcuuugaaaa

SEQ ID NO: 1530906 - RNA, 16 nt, Human
cuuuucuuucagccaa

SEQ ID NO: 1530907 - RNA, 23 nt, Human
cuuuucuugcaugaggcuagugu

SEQ ID NO: 1530908 - RNA, 19 nt, Human
cuuuggacccugaggccca

SEQ ID NO: 1530909 - RNA, 17 nt, Human
cuuuggacccugaggcc

SEQ ID NO: 1530910 - RNA, 18 nt, Human
cuuuggacccugaggccc

SEQ ID NO: 1530911 - RNA, 15 nt, Human
cuuuggacccugagg

SEQ ID NO: 1530912 - RNA, 16 nt, Human
cuuuggacccugaggc

SEQ ID NO: 1530913 - RNA, 16 nt, Human
cuuucccaucuuccaa

SEQ ID NO: 1530914 - RNA, 14 nt, Human
cuuugugauuuuug

SEQ ID NO: 1530915 - RNA, 23 nt, Human
cuuugggaggccaaggugggagg

SEQ ID NO: 1530916 - RNA, 22 nt, Human
cuuuguccccaccgcagacagg

SEQ ID NO: 1530917 - RNA, 13 nt, Human
cuuugggaggcca

SEQ ID NO: 1530918 - RNA, 18 nt, Human
cuuuguccccaccgcaga

SEQ ID NO: 1530919 - RNA, 19 nt, Human
cuuugugauuuuuguaauu

SEQ ID NO: 1530920 - RNA, 18 nt, Human
cuuugugauuuuuguaau

SEQ ID NO: 1530921 - RNA, 17 nt, Human
cuuugugauuuuuguaa

SEQ ID NO: 1530922 - RNA, 14 nt, Human
cuuuguucuggcuc

SEQ ID NO: 1530923 - RNA, 15 nt, Human
cuuuguucuggcucu

SEQ ID NO: 1530924 - RNA, 14 nt, Human
cuucagugccaaaa

SEQ ID NO: 1530925 - RNA, 15 nt, Human
cuucaguaagccgug

SEQ ID NO: 1530926 - RNA, 20 nt, Human
cuucauucaacccaccugcg

SEQ ID NO: 1530927 - RNA, 13 nt, Human
cuuccacaagagc

SEQ ID NO: 1530928 - RNA, 14 nt, Human
cuuccacaagagcc

SEQ ID NO: 1530929 - RNA, 15 nt, Human
cuuccacaagagccc

SEQ ID NO: 1530930 - RNA, 16 nt, Human
cuucagcgguuuauau

SEQ ID NO: 1530931 - RNA, 15 nt, Human
cuucagcugacuuuu

SEQ ID NO: 1530932 - RNA, 19 nt, Human
cuucagcugacuuuucugu

SEQ ID NO: 1530933 - RNA, 14 nt, Human
cuucaguaagccgu

SEQ ID NO: 1530934 - RNA, 14 nt, Human
cuucagccucccga

SEQ ID NO: 1530935 - RNA, 15 nt, Human
cuucagccugaaaga

SEQ ID NO: 1530936 - RNA, 16 nt, Human
cuucagccucccgagu

SEQ ID NO: 1530937 - RNA, 20 nt, Human
cuucagccucccgaguagcu

SEQ ID NO: 1530938 - RNA, 17 nt, Human
cuucaaauccuugaaga

SEQ ID NO: 1530939 - RNA, 22 nt, Human
cuuagucacugagacagcccgg

SEQ ID NO: 1530940 - RNA, 21 nt, Human
cuuagucacugagacagcccg

SEQ ID NO: 1530941 - RNA, 17 nt, Human
cuucaaggauccugagc

SEQ ID NO: 1530942 - RNA, 18 nt, Human
cuucaaggauccugagcc

SEQ ID NO: 1530943 - RNA, 19 nt, Human
cuucaaggauccugagcca

SEQ ID NO: 1530944 - RNA, 20 nt, Human
cuucaaggauccugagccag

SEQ ID NO: 1530945 - RNA, 12 nt, Human
cuucacaacaga

SEQ ID NO: 1530946 - RNA, 14 nt, Human
cuucacaacagauu

SEQ ID NO: 1530947 - RNA, 23 nt, Human
cuucaaggauccugagccagauu

SEQ ID NO: 1530948 - RNA, 21 nt, Human
cuucaaggauccugagccaga

SEQ ID NO: 1530949 - RNA, 22 nt, Human
cuucaaggauccugagccagau

SEQ ID NO: 1530950 - RNA, 23 nt, Human
cuucacauauugauuuccguuaa

SEQ ID NO: 1530951 - RNA, 14 nt, Human
cuucacauauugau

SEQ ID NO: 1530952 - RNA, 19 nt, Human
cuuccagauccuggaaauc

SEQ ID NO: 1530953 - RNA, 16 nt, Human
cuuccacaagagccca

SEQ ID NO: 1530954 - RNA, 14 nt, Human
cuucucauuucacc

SEQ ID NO: 1530955 - RNA, 15 nt, Human
cuucucauuucaccc

SEQ ID NO: 1530956 - RNA, 17 nt, Human
cuucucauuucaccccu

SEQ ID NO: 1530957 - RNA, 16 nt, Human
cuucucacugccaugc

SEQ ID NO: 1530958 - RNA, 21 nt, Human
cuucucacugccaugccagcu

SEQ ID NO: 1530959 - RNA, 20 nt, Human
cuucggccuccauccugagg

SEQ ID NO: 1530960 - RNA, 19 nt, Human
cuucgggaggucgaggcag

SEQ ID NO: 1530961 - RNA, 17 nt, Human
cuucgcuccugugucuu

SEQ ID NO: 1530962 - RNA, 23 nt, Human
cuuaagaagacugcauuauauuu

SEQ ID NO: 1530963 - RNA, 12 nt, Human
cuuaaaaauggu

SEQ ID NO: 1530964 - RNA, 20 nt, Human
cuuaauucuuagcucauucu

SEQ ID NO: 1530965 - RNA, 19 nt, Human
cuuaauuaaaagaauauuu

SEQ ID NO: 1530966 - RNA, 20 nt, Human
cuuaauuaaaagaauauuuu

SEQ ID NO: 1530967 - RNA, 16 nt, Human
cuuaauuaaaagaaua

SEQ ID NO: 1530968 - RNA, 17 nt, Human
cuuaauuaaaagaauau

SEQ ID NO: 1530969 - RNA, 19 nt, Human
cuuagaauuaguggcacuu

SEQ ID NO: 1530970 - RNA, 11 nt, Human
cuuagacaguc

SEQ ID NO: 1530971 - RNA, 14 nt, Human
cuuagucacugaga

SEQ ID NO: 1530972 - RNA, 23 nt, Human
cuuagguuggcaaaaaggcagga

SEQ ID NO: 1530973 - RNA, 20 nt, Human
cuuaccugccaggaagccag

SEQ ID NO: 1530974 - RNA, 13 nt, Human
cuuacuguacaug

SEQ ID NO: 1530975 - RNA, 20 nt, Human
cuuagaaaaaccaccaccau

SEQ ID NO: 1530976 - RNA, 17 nt, Human
cuuagaagucacacagu

SEQ ID NO: 1530977 - RNA, 20 nt, Human
cuuagaagucacacaguauu

SEQ ID NO: 1530978 - RNA, 18 nt, Human
cuguugcccaggcuggcg

SEQ ID NO: 1530979 - RNA, 17 nt, Human
cuguugcccaggcuggc

SEQ ID NO: 1530980 - RNA, 17 nt, Human
cuguuuagauaauacac

SEQ ID NO: 1530981 - RNA, 17 nt, Human
cuguuucaaacuuuacu

SEQ ID NO: 1530982 - RNA, 15 nt, Human
cuguuucaaacuuua

SEQ ID NO: 1530983 - RNA, 18 nt, Human
cuguuuagauaauacacc

SEQ ID NO: 1530984 - RNA, 17 nt, Human
cuguuugcuaagugagg

SEQ ID NO: 1530985 - RNA, 19 nt, Human
cuguuugcuaagugaggau

SEQ ID NO: 1530986 - RNA, 14 nt, Human
cuguuuuauaauuu

SEQ ID NO: 1530987 - RNA, 15 nt, Human
cuguuuuauaauuuu

SEQ ID NO: 1530988 - RNA, 16 nt, Human
cuuaaaaaguggaaaa

SEQ ID NO: 1530989 - RNA, 17 nt, Human
cuuaaaaaguggaaaaa

SEQ ID NO: 1530990 - RNA, 13 nt, Human
cuguuuucucuug

SEQ ID NO: 1530991 - RNA, 23 nt, Human
cuguucuuucuggcuaugcauuu

SEQ ID NO: 1530992 - RNA, 12 nt, Human
cuguugcccagg

SEQ ID NO: 1530993 - RNA, 13 nt, Human
cuguugcccaggc

SEQ ID NO: 1530994 - RNA, 14 nt, Human
cuguugcccaggcu

SEQ ID NO: 1530995 - RNA, 15 nt, Human
cuguugcccaggcug

SEQ ID NO: 1530996 - RNA, 16 nt, Human
cuguugcccaggcugg

SEQ ID NO: 1530997 - RNA, 16 nt, Human
cuguuaauaguucagg

SEQ ID NO: 1530998 - RNA, 21 nt, Human
cuguucuuucuggcuaugcau

SEQ ID NO: 1530999 - RNA, 14 nt, Human
cuguucuuucuggc

SEQ ID NO: 1531000 - RNA, 13 nt, Human
cuguucuuucugg

SEQ ID NO: 1531001 - RNA, 21 nt, Human
cuguucuuuccaaaguacacu

SEQ ID NO: 1531002 - RNA, 19 nt, Human
cuguucuuuccaaaguaca

SEQ ID NO: 1531003 - RNA, 16 nt, Human
cuguucuuuccaaagu

SEQ ID NO: 1531004 - RNA, 15 nt, Human
cuguucuuuccaaag

SEQ ID NO: 1531005 - RNA, 20 nt, Human
cugugucuuuuuucacuaca

SEQ ID NO: 1531006 - RNA, 18 nt, Human
cugugugugcgccuacag

SEQ ID NO: 1531007 - RNA, 20 nt, Human
cuguuaaaagaugaaaauau

SEQ ID NO: 1531008 - RNA, 19 nt, Human
cuguuaaaagaugaaaaua

SEQ ID NO: 1531009 - RNA, 15 nt, Human
cuguuaaaagaugaa

SEQ ID NO: 1531010 - RNA, 16 nt, Human
cuguuaaaagaugaaa

SEQ ID NO: 1531011 - RNA, 21 nt, Human
cuguggguuucuaaagcugcc

SEQ ID NO: 1531012 - RNA, 22 nt, Human
cuguggguuucuaaagcugcca

SEQ ID NO: 1531013 - RNA, 15 nt, Human
cugugaaaggaaaga

SEQ ID NO: 1531014 - RNA, 18 nt, Human
cugucuucaguaagccgu

SEQ ID NO: 1531015 - RNA, 18 nt, Human
cugucuucacaacagauu

SEQ ID NO: 1531016 - RNA, 23 nt, Human
cugucauuugagcagggcucagc

SEQ ID NO: 1531017 - RNA, 18 nt, Human
cugucaauuacaggaagu

SEQ ID NO: 1531018 - RNA, 19 nt, Human
cugucaauuacaggaagua

SEQ ID NO: 1531019 - RNA, 21 nt, Human
cugucauuugagcagggcuca

SEQ ID NO: 1531020 - RNA, 22 nt, Human
cugucauuugagcagggcucag

SEQ ID NO: 1531021 - RNA, 16 nt, Human
cugugaaaggaaagag

SEQ ID NO: 1531022 - RNA, 22 nt, Human
cugugaaaggaaagagggaggu

SEQ ID NO: 1531023 - RNA, 18 nt, Human
cugugaaaguacauuugg

SEQ ID NO: 1531024 - RNA, 15 nt, Human
cugugauggggcccu

SEQ ID NO: 1531025 - RNA, 23 nt, Human
cugugauggggcccugccuccuu

SEQ ID NO: 1531026 - RNA, 16 nt, Human
cugugauggggcccug

SEQ ID NO: 1531027 - RNA, 21 nt, Human
cugugauggggcccugccucc

SEQ ID NO: 1531028 - RNA, 14 nt, Human
cugugccaugugcc

SEQ ID NO: 1531029 - RNA, 19 nt, Human
cugugcccuaaaguguauu

SEQ ID NO: 1531030 - RNA, 15 nt, Human
cugugccaugugcca

SEQ ID NO: 1531031 - RNA, 17 nt, Human
cugguggcagcucaccu

SEQ ID NO: 1531032 - RNA, 18 nt, Human
cugguggcagcucaccuc

SEQ ID NO: 1531033 - RNA, 20 nt, Human
cugguggcagcucaccucuc

SEQ ID NO: 1531034 - RNA, 15 nt, Human
cugguggcagcugcg

SEQ ID NO: 1531035 - RNA, 14 nt, Human
cugguggcaguggg

SEQ ID NO: 1531036 - RNA, 18 nt, Human
cugguggcagugggagcu

SEQ ID NO: 1531037 - RNA, 21 nt, Human
cugguggcagcucaccucucc

SEQ ID NO: 1531038 - RNA, 19 nt, Human
cugguggcagugggagcug

SEQ ID NO: 1531039 - RNA, 15 nt, Human
cuguaauuugugaua

SEQ ID NO: 1531040 - RNA, 14 nt, Human
cuguaauuugugau

SEQ ID NO: 1531041 - RNA, 14 nt, Human
cuguacagagccca

SEQ ID NO: 1531042 - RNA, 15 nt, Human
cuguacagagcccac

SEQ ID NO: 1531043 - RNA, 18 nt, Human
cuguacagagcccacgcc

SEQ ID NO: 1531044 - RNA, 22 nt, Human
cuguacagagcccacgccccca

SEQ ID NO: 1531045 - RNA, 19 nt, Human
cuguaauccuagcacuuug

SEQ ID NO: 1531046 - RNA, 22 nt, Human
cugguuagagguucccuuugac

SEQ ID NO: 1531047 - RNA, 21 nt, Human
cugguuagagguucccuuuga

SEQ ID NO: 1531048 - RNA, 21 nt, Human
cuguaucccaugagccucagc

SEQ ID NO: 1531049 - RNA, 22 nt, Human
cuguaucccaugagccucagca

SEQ ID NO: 1531050 - RNA, 20 nt, Human
cuguaucccaugagccucag

SEQ ID NO: 1531051 - RNA, 20 nt, Human
cuguauuuuguuuuugucuu

SEQ ID NO: 1531052 - RNA, 15 nt, Human
cugucaauuacagga

SEQ ID NO: 1531053 - RNA, 16 nt, Human
cugucaauuacaggaa

SEQ ID NO: 1531054 - RNA, 19 nt, Human
cuguacgucugacaggcaa

SEQ ID NO: 1531055 - RNA, 20 nt, Human
cuguacgucugacaggcaau

SEQ ID NO: 1531056 - RNA, 21 nt, Human
cuguacaugaaaacacauuuu

SEQ ID NO: 1531057 - RNA, 20 nt, Human
cuguacaugaaaacacauuu

SEQ ID NO: 1531058 - RNA, 17 nt, Human
cuguacaugaaaacaca

SEQ ID NO: 1531059 - RNA, 14 nt, Human
cuguacgucugaca

SEQ ID NO: 1531060 - RNA, 15 nt, Human
cuguacgucugacag

SEQ ID NO: 1531061 - RNA, 16 nt, Human
cuguacgucugacagg

SEQ ID NO: 1531062 - RNA, 18 nt, Human
cuguacgucugacaggca

SEQ ID NO: 1531063 - RNA, 18 nt, Human
cugggggcugggcagagg

SEQ ID NO: 1531064 - RNA, 14 nt, Human
cugggggcugggca

SEQ ID NO: 1531065 - RNA, 17 nt, Human
cugggcuucaguggcag

SEQ ID NO: 1531066 - RNA, 15 nt, Human
cugggcuucaguggc

SEQ ID NO: 1531067 - RNA, 22 nt, Human
cugggcuuggggaccagagcug

SEQ ID NO: 1531068 - RNA, 18 nt, Human
cugggcuugucuguagau

SEQ ID NO: 1531069 - RNA, 20 nt, Human
cuggguaacuagggaagaua

SEQ ID NO: 1531070 - RNA, 19 nt, Human
cugggauguuucugucaca

SEQ ID NO: 1531071 - RNA, 21 nt, Human
cugggauuacaagcgugagcc

SEQ ID NO: 1531072 - RNA, 14 nt, Human
cugggauguuucug

SEQ ID NO: 1531073 - RNA, 22 nt, Human
cugauacagaaaaguugaauuu

SEQ ID NO: 1531074 - RNA, 20 nt, Human
cugauccuaguuccaccauc

SEQ ID NO: 1531075 - RNA, 21 nt, Human
cugauccuaguuccaccauca

SEQ ID NO: 1531076 - RNA, 14 nt, Human
cugauggugcaaug

SEQ ID NO: 1531077 - RNA, 15 nt, Human
cugauggugcaauga

SEQ ID NO: 1531078 - RNA, 16 nt, Human
cugauggugcaaugac

SEQ ID NO: 1531079 - RNA, 18 nt, Human
cugagucugaaggcuggg

SEQ ID NO: 1531080 - RNA, 19 nt, Human
cugagucugaaggcugggu

SEQ ID NO: 1531081 - RNA, 20 nt, Human
cugaguugacuugacagaac

SEQ ID NO: 1531082 - RNA, 21 nt, Human
cugaguugguguugacaugug

SEQ ID NO: 1531083 - RNA, 13 nt, Human
cugaggcugggcu

SEQ ID NO: 1531084 - RNA, 15 nt, Human
cugaggcugggcucc

SEQ ID NO: 1531085 - RNA, 16 nt, Human
cugaggcugggcuccc

SEQ ID NO: 1531086 - RNA, 17 nt, Human
cugaggcugggcucccu

SEQ ID NO: 1531087 - RNA, 22 nt, Human
cugaggcugggcucccuuccca

SEQ ID NO: 1531088 - RNA, 17 nt, Human
cugaggccugagcgcuc

SEQ ID NO: 1531089 - RNA, 18 nt, Human
cugaggccugagcgcucc

SEQ ID NO: 1531090 - RNA, 22 nt, Human
cugaggccugagcgcuccugcc

SEQ ID NO: 1531091 - RNA, 15 nt, Human
cugaggcuccacuug

SEQ ID NO: 1531092 - RNA, 21 nt, Human
cugaggcuccacuuggucugu

SEQ ID NO: 1531093 - RNA, 22 nt, Human
cugcacaagcugcacccucagg

SEQ ID NO: 1531094 - RNA, 18 nt, Human
cugcaauaaggggagagu

SEQ ID NO: 1531095 - RNA, 18 nt, Human
cugcacuugcagacucua

SEQ ID NO: 1531096 - RNA, 16 nt, Human
cugcacuccccugcug

SEQ ID NO: 1531097 - RNA, 17 nt, Human
cugcacuccccugcugg

SEQ ID NO: 1531098 - RNA, 18 nt, Human
cugcacuccccugcuggg

SEQ ID NO: 1531099 - RNA, 13 nt, Human
cugcacccucagg

SEQ ID NO: 1531100 - RNA, 14 nt, Human
cugcacccucaggc

SEQ ID NO: 1531101 - RNA, 16 nt, Human
cugcacccucaggcag

SEQ ID NO: 1531102 - RNA, 22 nt, Human
cugcaccggcuggccuggcccc

SEQ ID NO: 1531103 - RNA, 23 nt, Human
cugcaccggcuggccuggccccu

SEQ ID NO: 1531104 - RNA, 12 nt, Human
cugcaccgggcc

SEQ ID NO: 1531105 - RNA, 14 nt, Human
cugcaccgggccac

SEQ ID NO: 1531106 - RNA, 15 nt, Human
cugcacuccccugcu

SEQ ID NO: 1531107 - RNA, 16 nt, Human
cugauuuuuuuuuccu

SEQ ID NO: 1531108 - RNA, 18 nt, Human
cugauuuuuuuuuccuuc

SEQ ID NO: 1531109 - RNA, 19 nt, Human
cugauuuuuuuuuccuuca

SEQ ID NO: 1531110 - RNA, 20 nt, Human
cugauuuuuuuuuccuucag

SEQ ID NO: 1531111 - RNA, 23 nt, Human
cugauuuuuuuuuccuucagugc

SEQ ID NO: 1531112 - RNA, 21 nt, Human
cugauuuuuuuuuccuucagu

SEQ ID NO: 1531113 - RNA, 22 nt, Human
cugauuuuuuuuuccuucagug

SEQ ID NO: 1531114 - RNA, 21 nt, Human
cugauugugucucuugguccu

SEQ ID NO: 1531115 - RNA, 17 nt, Human
cugauugugucucuugg

SEQ ID NO: 1531116 - RNA, 17 nt, Human
cugauggugcaaugacc

SEQ ID NO: 1531117 - RNA, 19 nt, Human
cugauggugcaaugaccuu

SEQ ID NO: 1531118 - RNA, 20 nt, Human
cugauggugcaaugaccuuu

SEQ ID NO: 1531119 - RNA, 21 nt, Human
cugauggugcaaugaccuuuc

SEQ ID NO: 1531120 - RNA, 17 nt, Human
cugccucugacacacag

SEQ ID NO: 1531121 - RNA, 18 nt, Human
cugccucugacacacagc

SEQ ID NO: 1531122 - RNA, 21 nt, Human
cugccucugacacacagcucu

SEQ ID NO: 1531123 - RNA, 21 nt, Human
cugccugcccaggccccugcc

SEQ ID NO: 1531124 - RNA, 22 nt, Human
cugccugcccaggccccugcca

SEQ ID NO: 1531125 - RNA, 18 nt, Human
cugccuuuggcagaguuc

SEQ ID NO: 1531126 - RNA, 18 nt, Human
cugcgucgguccuggugc

SEQ ID NO: 1531127 - RNA, 17 nt, Human
cugcgucgguccuggug

SEQ ID NO: 1531128 - RNA, 19 nt, Human
cugcgguccacccaggagc

SEQ ID NO: 1531129 - RNA, 20 nt, Human
cugcgguccacccaggagcc

SEQ ID NO: 1531130 - RNA, 18 nt, Human
cugcgguccacccaggag

SEQ ID NO: 1531131 - RNA, 14 nt, Human
cugccuccagggcu

SEQ ID NO: 1531132 - RNA, 15 nt, Human
cugccuccagggcug

SEQ ID NO: 1531133 - RNA, 16 nt, Human
cugccuccagggcugg

SEQ ID NO: 1531134 - RNA, 17 nt, Human
cugccuccagggcugga

SEQ ID NO: 1531135 - RNA, 18 nt, Human
cugccuccagggcuggac

SEQ ID NO: 1531136 - RNA, 19 nt, Human
cugccuccagggcuggacu

SEQ ID NO: 1531137 - RNA, 20 nt, Human
cugccuccagggcuggacug

SEQ ID NO: 1531138 - RNA, 22 nt, Human
cugccuccagggcuggacugag

SEQ ID NO: 1531139 - RNA, 23 nt, Human
cugccuccagggcuggacugagg

SEQ ID NO: 1531140 - RNA, 15 nt, Human
cugccucagccuccc

SEQ ID NO: 1531141 - RNA, 19 nt, Human
cugccucagccucccaaag

SEQ ID NO: 1531142 - RNA, 12 nt, Human
cugccgcagccc

SEQ ID NO: 1531143 - RNA, 13 nt, Human
cugccgcagcccu

SEQ ID NO: 1531144 - RNA, 13 nt, Human
cugccgcagagcu

SEQ ID NO: 1531145 - RNA, 14 nt, Human
cugccgcagagcug

SEQ ID NO: 1531146 - RNA, 15 nt, Human
cugccgcagagcugg

SEQ ID NO: 1531147 - RNA, 23 nt, Human
cugccgcagcccugcagagggca

SEQ ID NO: 1531148 - RNA, 14 nt, Human
cugccgcagcccug

SEQ ID NO: 1531149 - RNA, 16 nt, Human
cugccgcagagcuggc

SEQ ID NO: 1531150 - RNA, 18 nt, Human
cugccgcagagcuggccg

SEQ ID NO: 1531151 - RNA, 20 nt, Human
cugccgcagcccugcagagg

SEQ ID NO: 1531152 - RNA, 21 nt, Human
cugccgcagcccugcagaggg

SEQ ID NO: 1531153 - RNA, 22 nt, Human
cugccgcagcccugcagagggc

SEQ ID NO: 1531154 - RNA, 11 nt, Human
cugccaggcau

SEQ ID NO: 1531155 - RNA, 13 nt, Human
cugccaggcaugg

SEQ ID NO: 1531156 - RNA, 14 nt, Human
cugccaugccagcu

SEQ ID NO: 1531157 - RNA, 15 nt, Human
cugccaugccagcuu

SEQ ID NO: 1531158 - RNA, 14 nt, Human
cugcccaccuggcc

SEQ ID NO: 1531159 - RNA, 15 nt, Human
cugcccaccuggccu

SEQ ID NO: 1531160 - RNA, 18 nt, Human
cugcccacucccugcaac

SEQ ID NO: 1531161 - RNA, 17 nt, Human
cugcccaccuggccucu

SEQ ID NO: 1531162 - RNA, 18 nt, Human
cugcccaccuggccucug

SEQ ID NO: 1531163 - RNA, 19 nt, Human
cugcccaccuggccucugc

SEQ ID NO: 1531164 - RNA, 20 nt, Human
cugcccaccuggccucugca

SEQ ID NO: 1531165 - RNA, 22 nt, Human
cugcccaccuggccucugcacu

SEQ ID NO: 1531166 - RNA, 14 nt, Human
cugcccacucccug

SEQ ID NO: 1531167 - RNA, 15 nt, Human
cugcccacucccugc

SEQ ID NO: 1531168 - RNA, 16 nt, Human
cugcccacucccugca

SEQ ID NO: 1531169 - RNA, 18 nt, Human
cugccaaugggagcucau

SEQ ID NO: 1531170 - RNA, 19 nt, Human
cugccaaugggagcucaug

SEQ ID NO: 1531171 - RNA, 18 nt, Human
cugcaugcgggcuuccuc

SEQ ID NO: 1531172 - RNA, 22 nt, Human
cugcaugcgggcuuccuccugg

SEQ ID NO: 1531173 - RNA, 16 nt, Human
cugcaucguuucaucu

SEQ ID NO: 1531174 - RNA, 22 nt, Human
cugcaucguuucaucuuccaac

SEQ ID NO: 1531175 - RNA, 21 nt, Human
cugcaguugccagucaccccg

SEQ ID NO: 1531176 - RNA, 22 nt, Human
cugcaguugccagucaccccgg

SEQ ID NO: 1531177 - RNA, 23 nt, Human
cugcacuugcagacucuacagag

SEQ ID NO: 1531178 - RNA, 19 nt, Human
cugcaguugccagucaccc

SEQ ID NO: 1531179 - RNA, 16 nt, Human
cugaauuaugaaacuu

SEQ ID NO: 1531180 - RNA, 14 nt, Human
cugaauuucuuuug

SEQ ID NO: 1531181 - RNA, 16 nt, Human
cugacagacacaggcc

SEQ ID NO: 1531182 - RNA, 17 nt, Human
cugacagacacaggccc

SEQ ID NO: 1531183 - RNA, 18 nt, Human
cugacagacacaggcccg

SEQ ID NO: 1531184 - RNA, 12 nt, Human
cugagaaagacu

SEQ ID NO: 1531185 - RNA, 13 nt, Human
cugagaaagacua

SEQ ID NO: 1531186 - RNA, 15 nt, Human
cugagaaagacuauu

SEQ ID NO: 1531187 - RNA, 18 nt, Human
cugagaaagacuauucaa

SEQ ID NO: 1531188 - RNA, 16 nt, Human
cugagcaggauuuuaa

SEQ ID NO: 1531189 - RNA, 15 nt, Human
cugagccagauuuca

SEQ ID NO: 1531190 - RNA, 13 nt, Human
cugagccagauuu

SEQ ID NO: 1531191 - RNA, 14 nt, Human
cugagccagauuuc

SEQ ID NO: 1531192 - RNA, 21 nt, Human
cugagaugugaacacaucagc

SEQ ID NO: 1531193 - RNA, 14 nt, Human
cugagauuucaucu

SEQ ID NO: 1531194 - RNA, 15 nt, Human
cugagauuucaucug

SEQ ID NO: 1531195 - RNA, 16 nt, Human
cugagauuucaucugc

SEQ ID NO: 1531196 - RNA, 18 nt, Human
cugagauuucaucugcuc

SEQ ID NO: 1531197 - RNA, 19 nt, Human
cugagauuucaucugcucu

SEQ ID NO: 1531198 - RNA, 20 nt, Human
cugagauuucaucugcucuc

SEQ ID NO: 1531199 - RNA, 21 nt, Human
cugagauuucaucugcucucc

SEQ ID NO: 1531200 - RNA, 22 nt, Human
cugagauuucaucugcucuccu

SEQ ID NO: 1531201 - RNA, 20 nt, Human
cugagacagcccgggcucug

SEQ ID NO: 1531202 - RNA, 22 nt, Human
cugagaaagacuauucaaacag

SEQ ID NO: 1531203 - RNA, 19 nt, Human
cugagaaagacuauucaaa

SEQ ID NO: 1531204 - RNA, 20 nt, Human
cugagaaagacuauucaaac

SEQ ID NO: 1531205 - RNA, 21 nt, Human
cugagacagcccgggcucugc

SEQ ID NO: 1531206 - RNA, 22 nt, Human
cugagacagcccgggcucugcc

SEQ ID NO: 1531207 - RNA, 20 nt, Human
cugagaugugaacacaucag

SEQ ID NO: 1531208 - RNA, 13 nt, Human
cugaauuaugaaa

SEQ ID NO: 1531209 - RNA, 14 nt, Human
cugaauuaugaaac

SEQ ID NO: 1531210 - RNA, 15 nt, Human
cugaauuaugaaacu

SEQ ID NO: 1531211 - RNA, 12 nt, Human
cugaauuucuuu

SEQ ID NO: 1531212 - RNA, 19 nt, Human
cugaaugguuuucaaaaua

SEQ ID NO: 1531213 - RNA, 20 nt, Human
cugaaugguuuucaaaauaa

SEQ ID NO: 1531214 - RNA, 17 nt, Human
cugaaguucagcugcau

SEQ ID NO: 1531215 - RNA, 22 nt, Human
cugaagucccagauacuugggg

SEQ ID NO: 1531216 - RNA, 17 nt, Human
cugaagucuuuguacag

SEQ ID NO: 1531217 - RNA, 20 nt, Human
cugaagucuuuguacagaca

SEQ ID NO: 1531218 - RNA, 14 nt, Human
cugaagaagauggu

SEQ ID NO: 1531219 - RNA, 17 nt, Human
cugaagucacacaguga

SEQ ID NO: 1531220 - RNA, 18 nt, Human
cugaagucacacagugag

SEQ ID NO: 1531221 - RNA, 19 nt, Human
cugaagucacacagugagu

SEQ ID NO: 1531222 - RNA, 21 nt, Human
cugaagucacacagugagucg

SEQ ID NO: 1531223 - RNA, 14 nt, Human
cugaagaacuauuu

SEQ ID NO: 1531224 - RNA, 20 nt, Human
cugaaauaaacgucuuaaau

SEQ ID NO: 1531225 - RNA, 16 nt, Human
cucuucuccaggcugu

SEQ ID NO: 1531226 - RNA, 22 nt, Human
cucuuuggucuacacugugcug

SEQ ID NO: 1531227 - RNA, 23 nt, Human
cucuuuggucuacacugugcuga

SEQ ID NO: 1531228 - RNA, 14 nt, Human
cucuuuucaaaaca

SEQ ID NO: 1531229 - RNA, 23 nt, Human
cugaaagggacgcuacccgggaa

SEQ ID NO: 1531230 - RNA, 15 nt, Human
cucugauacagaaaa

SEQ ID NO: 1531231 - RNA, 13 nt, Human
cucugcacaagcu

SEQ ID NO: 1531232 - RNA, 14 nt, Human
cucugcacaagcug

SEQ ID NO: 1531233 - RNA, 15 nt, Human
cucugcacaagcugc

SEQ ID NO: 1531234 - RNA, 16 nt, Human
cucugcacaagcugca

SEQ ID NO: 1531235 - RNA, 18 nt, Human
cucugcccacucccugca

SEQ ID NO: 1531236 - RNA, 20 nt, Human
cucugcccacucccugcaac

SEQ ID NO: 1531237 - RNA, 13 nt, Human
cucugcccacucc

SEQ ID NO: 1531238 - RNA, 15 nt, Human
cucugcccacucccu

SEQ ID NO: 1531239 - RNA, 16 nt, Human
cucugcccacucccug

SEQ ID NO: 1531240 - RNA, 17 nt, Human
cucugcccacucccugc

SEQ ID NO: 1531241 - RNA, 13 nt, Human
cucugccucccau

SEQ ID NO: 1531242 - RNA, 14 nt, Human
cucugccucccauc

SEQ ID NO: 1531243 - RNA, 16 nt, Human
cucugccucccaucac

SEQ ID NO: 1531244 - RNA, 17 nt, Human
cucugccucccaucacc

SEQ ID NO: 1531245 - RNA, 19 nt, Human
cucugaaggguaauuauau

SEQ ID NO: 1531246 - RNA, 19 nt, Human
cucugaauuugagauacaa

SEQ ID NO: 1531247 - RNA, 22 nt, Human
cucugaaggacauugcggacag

SEQ ID NO: 1531248 - RNA, 14 nt, Human
cucugacacacagc

SEQ ID NO: 1531249 - RNA, 15 nt, Human
cucugacacacagcu

SEQ ID NO: 1531250 - RNA, 16 nt, Human
cucugacacacagcuc

SEQ ID NO: 1531251 - RNA, 17 nt, Human
cucugacacacagcucu

SEQ ID NO: 1531252 - RNA, 18 nt, Human
cucugacacacagcucug

SEQ ID NO: 1531253 - RNA, 19 nt, Human
cucugacacacagcucugu

SEQ ID NO: 1531254 - RNA, 23 nt, Human
cucugacagaagaaccccagggu

SEQ ID NO: 1531255 - RNA, 23 nt, Human
cucugagacucgcgacaaugcaa

SEQ ID NO: 1531256 - RNA, 16 nt, Human
cucugaggacacuaac

SEQ ID NO: 1531257 - RNA, 12 nt, Human
cucugaggacac

SEQ ID NO: 1531258 - RNA, 14 nt, Human
cucugaggacacua

SEQ ID NO: 1531259 - RNA, 21 nt, Human
cucugagacucgcgacaaugc

SEQ ID NO: 1531260 - RNA, 19 nt, Human
cucuuaagaagacugcauu

SEQ ID NO: 1531261 - RNA, 20 nt, Human
cucugugucagguggggcag

SEQ ID NO: 1531262 - RNA, 21 nt, Human
cucugugucagguggggcagc

SEQ ID NO: 1531263 - RNA, 22 nt, Human
cucugugucagguggggcagcu

SEQ ID NO: 1531264 - RNA, 23 nt, Human
cucugugucagguggggcagcuu

SEQ ID NO: 1531265 - RNA, 11 nt, Human
cucuucucauu

SEQ ID NO: 1531266 - RNA, 12 nt, Human
cucuucucauuu

SEQ ID NO: 1531267 - RNA, 15 nt, Human
cucuucucauuucac

SEQ ID NO: 1531268 - RNA, 19 nt, Human
cucuucucauuucaccccu

SEQ ID NO: 1531269 - RNA, 15 nt, Human
cucuucuccaggcug

SEQ ID NO: 1531270 - RNA, 10 nt, Human
cucugccuga

SEQ ID NO: 1531271 - RNA, 21 nt, Human
cucugccucccaucacccgcu

SEQ ID NO: 1531272 - RNA, 19 nt, Human
cucugccucugacacacag

SEQ ID NO: 1531273 - RNA, 20 nt, Human
cucugccucugacacacagc

SEQ ID NO: 1531274 - RNA, 23 nt, Human
cucuggcagcucagagagggugg

SEQ ID NO: 1531275 - RNA, 21 nt, Human
cucuggccuucggccuccauc

SEQ ID NO: 1531276 - RNA, 22 nt, Human
cucuggccuucggccuccaucc

SEQ ID NO: 1531277 - RNA, 18 nt, Human
cucugucgcccagucugg

SEQ ID NO: 1531278 - RNA, 19 nt, Human
cucugucgcccagucugga

SEQ ID NO: 1531279 - RNA, 17 nt, Human
cucugucgcccagucug

SEQ ID NO: 1531280 - RNA, 13 nt, Human
cucugucgcccag

SEQ ID NO: 1531281 - RNA, 14 nt, Human
cucuguccugggag

SEQ ID NO: 1531282 - RNA, 15 nt, Human
cucuguccugggagu

SEQ ID NO: 1531283 - RNA, 22 nt, Human
cucuguccugggagugagcugg

SEQ ID NO: 1531284 - RNA, 23 nt, Human
cucaaauacgugggcauucaaau

SEQ ID NO: 1531285 - RNA, 21 nt, Human
cucaacaccucugcacaagcu

SEQ ID NO: 1531286 - RNA, 13 nt, Human
cucaaccuccugg

SEQ ID NO: 1531287 - RNA, 15 nt, Human
cucaaccuccugggc

SEQ ID NO: 1531288 - RNA, 17 nt, Human
cucaaccuccugggcua

SEQ ID NO: 1531289 - RNA, 18 nt, Human
cuauuguuagucucuuga

SEQ ID NO: 1531290 - RNA, 17 nt, Human
cucaagugauucuccug

SEQ ID NO: 1531291 - RNA, 21 nt, Human
cucaaguccucuuuucugaga

SEQ ID NO: 1531292 - RNA, 22 nt, Human
cucacacaugagcaucaggcca

SEQ ID NO: 1531293 - RNA, 24 nt, Human
cucacacaugagcaucaggccagg

SEQ ID NO: 1531294 - RNA, 15 nt, Human
cucacaguccuuacc

SEQ ID NO: 1531295 - RNA, 17 nt, Human
cucaccagccccagugc

SEQ ID NO: 1531296 - RNA, 18 nt, Human
cucaccagccccagugcc

SEQ ID NO: 1531297 - RNA, 13 nt, Human
cucaccagcccca

SEQ ID NO: 1531298 - RNA, 14 nt, Human
cucaccagccccag

SEQ ID NO: 1531299 - RNA, 15 nt, Human
cucaccagccccagu

SEQ ID NO: 1531300 - RNA, 22 nt, Human
cucacauuuauucugcucacau

SEQ ID NO: 1531301 - RNA, 15 nt, Human
cucacauuuauucug

SEQ ID NO: 1531302 - RNA, 19 nt, Human
cucacauuuauucugcuca

SEQ ID NO: 1531303 - RNA, 17 nt, Human
cucacaguccuuaccag

SEQ ID NO: 1531304 - RNA, 19 nt, Human
cucacaguccuuaccagca

SEQ ID NO: 1531305 - RNA, 22 nt, Human
cucacaguccuuaccagcagag

SEQ ID NO: 1531306 - RNA, 23 nt, Human
cucacaguccuuaccagcagagc

SEQ ID NO: 1531307 - RNA, 15 nt, Human
cucagaucuucugug

SEQ ID NO: 1531308 - RNA, 16 nt, Human
cucagcauccuggcac

SEQ ID NO: 1531309 - RNA, 17 nt, Human
cucagcauccuggcacc

SEQ ID NO: 1531310 - RNA, 18 nt, Human
cucagagagggugggagu

SEQ ID NO: 1531311 - RNA, 14 nt, Human
cucagagagggugg

SEQ ID NO: 1531312 - RNA, 21 nt, Human
cucacuguugcccaggcuggc

SEQ ID NO: 1531313 - RNA, 22 nt, Human
cucacuguugcccaggcuggcg

SEQ ID NO: 1531314 - RNA, 19 nt, Human
cucacugccaugccagcuu

SEQ ID NO: 1531315 - RNA, 22 nt, Human
cucacugccaugccagcuuauc

SEQ ID NO: 1531316 - RNA, 20 nt, Human
cucacuguugcccaggcugg

SEQ ID NO: 1531317 - RNA, 19 nt, Human
cucacuauguugcccaggc

SEQ ID NO: 1531318 - RNA, 20 nt, Human
cucacuauguugcccaggca

SEQ ID NO: 1531319 - RNA, 15 nt, Human
cucaccccagcccca

SEQ ID NO: 1531320 - RNA, 23 nt, Human
cucacuauguugcccaggcaggu

SEQ ID NO: 1531321 - RNA, 21 nt, Human
cucacuauguugcccaggcag

SEQ ID NO: 1531322 - RNA, 22 nt, Human
cucacuauguugcccaggcagg

SEQ ID NO: 1531323 - RNA, 13 nt, Human
cucacuccuugaa

SEQ ID NO: 1531324 - RNA, 11 nt, Human
cucacucuguc

SEQ ID NO: 1531325 - RNA, 12 nt, Human
cucacucugucg

SEQ ID NO: 1531326 - RNA, 14 nt, Human
cucacugcagccuc

SEQ ID NO: 1531327 - RNA, 13 nt, Human
cucacugcagccu

SEQ ID NO: 1531328 - RNA, 12 nt, Human
cucacugcagcc

SEQ ID NO: 1531329 - RNA, 22 nt, Human
cucacucugucgcccagucugg

SEQ ID NO: 1531330 - RNA, 13 nt, Human
cucacucugucgc

SEQ ID NO: 1531331 - RNA, 21 nt, Human
cucacucugucgcccagucug

SEQ ID NO: 1531332 - RNA, 18 nt, Human
cuaugggacucaaugcac

SEQ ID NO: 1531333 - RNA, 22 nt, Human
cuaugggacucaaugcacugac

SEQ ID NO: 1531334 - RNA, 23 nt, Human
cuaugggacucaaugcacugaca

SEQ ID NO: 1531335 - RNA, 15 nt, Human
cuauuagagaagaga

SEQ ID NO: 1531336 - RNA, 23 nt, Human
cuauucaaacagucucaggaaau

SEQ ID NO: 1531337 - RNA, 18 nt, Human
cuauucaaacagucucag

SEQ ID NO: 1531338 - RNA, 17 nt, Human
cuauauuuuacauaaau

SEQ ID NO: 1531339 - RNA, 14 nt, Human
cuauauuguacaca

SEQ ID NO: 1531340 - RNA, 15 nt, Human
cuauauuguacacac

SEQ ID NO: 1531341 - RNA, 18 nt, Human
cuauauuguuugcuaagc

SEQ ID NO: 1531342 - RNA, 13 nt, Human
cuauauuguacac

SEQ ID NO: 1531343 - RNA, 17 nt, Human
cuauagccuaggugaca

SEQ ID NO: 1531344 - RNA, 20 nt, Human
cuauaggugcuacaaaaaca

SEQ ID NO: 1531345 - RNA, 21 nt, Human
cuauaggugcuacaaaaacac

SEQ ID NO: 1531346 - RNA, 22 nt, Human
cuauaggugcuacaaaaacaca

SEQ ID NO: 1531347 - RNA, 21 nt, Human
cuauaauguaagcucuacuga

SEQ ID NO: 1531348 - RNA, 22 nt, Human
cuauaauuuaccugaagucuuu

SEQ ID NO: 1531349 - RNA, 16 nt, Human
cuauaauguaagcucu

SEQ ID NO: 1531350 - RNA, 16 nt, Human
cuaguaauuggaaagg

SEQ ID NO: 1531351 - RNA, 20 nt, Human
cuagugaaacucguuaauuu

SEQ ID NO: 1531352 - RNA, 18 nt, Human
cuagugaaagaggcagcu

SEQ ID NO: 1531353 - RNA, 19 nt, Human
cuagugaaagaggcagcuu

SEQ ID NO: 1531354 - RNA, 21 nt, Human
cuagugagcagucaggaaaga

SEQ ID NO: 1531355 - RNA, 23 nt, Human
cgcccaguuggguggaugccugg

SEQ ID NO: 1531356 - RNA, 20 nt, Human
cgccaucccagccccaauga

SEQ ID NO: 1531357 - RNA, 15 nt, Human
cgccaugcuccuggc

SEQ ID NO: 1531358 - RNA, 22 nt, Human
cgcccaguuggguggaugccug

SEQ ID NO: 1531359 - RNA, 14 nt, Human
cuaggugacagagu

SEQ ID NO: 1531360 - RNA, 18 nt, Human
cuaggugacagagugaga

SEQ ID NO: 1531361 - RNA, 24 nt, Human
cuaggugacagagugagacucugu

SEQ ID NO: 1531362 - RNA, 13 nt, Human
cucgcgacaaugc

SEQ ID NO: 1531363 - RNA, 22 nt, Human
cucgagcaugccuggauggggc

SEQ ID NO: 1531364 - RNA, 19 nt, Human
cucgagaacuuucauuuuu

SEQ ID NO: 1531365 - RNA, 13 nt, Human
cucgagcaugccu

SEQ ID NO: 1531366 - RNA, 15 nt, Human
cucgagcaugccugg

SEQ ID NO: 1531367 - RNA, 16 nt, Human
cucgagcaugccugga

SEQ ID NO: 1531368 - RNA, 19 nt, Human
cucgagcaugccuggaugg

SEQ ID NO: 1531369 - RNA, 20 nt, Human
cuccuuccuggagcccagag

SEQ ID NO: 1531370 - RNA, 23 nt, Human
cuccuuccuggagcccagaggag

SEQ ID NO: 1531371 - RNA, 23 nt, Human
cuccuuggugucgggcaugacac

SEQ ID NO: 1531372 - RNA, 21 nt, Human
cuccugugugugcgccuacag

SEQ ID NO: 1531373 - RNA, 23 nt, Human
cuccugugugugcgccuacagga

SEQ ID NO: 1531374 - RNA, 24 nt, Human
cuccugugugugcgccuacaggag

SEQ ID NO: 1531375 - RNA, 14 nt, Human
cuccuggaaauauu

SEQ ID NO: 1531376 - RNA, 17 nt, Human
cuccugccucagccucc

SEQ ID NO: 1531377 - RNA, 12 nt, Human
cuccugccucag

SEQ ID NO: 1531378 - RNA, 11 nt, Human
cuccugccuca

SEQ ID NO: 1531379 - RNA, 18 nt, Human
cuccugccgcagagcugg

SEQ ID NO: 1531380 - RNA, 22 nt, Human
cuccucuccccagcaagugaga

SEQ ID NO: 1531381 - RNA, 16 nt, Human
cuccugccgcagagcu

SEQ ID NO: 1531382 - RNA, 17 nt, Human
cuccugccgcagagcug

SEQ ID NO: 1531383 - RNA, 13 nt, Human
cuccucuccccag

SEQ ID NO: 1531384 - RNA, 15 nt, Human
cuccucuccccagca

SEQ ID NO: 1531385 - RNA, 22 nt, Human
cuccugccucgaacuggcugca

SEQ ID NO: 1531386 - RNA, 18 nt, Human
cuccugccucgaacuggc

SEQ ID NO: 1531387 - RNA, 20 nt, Human
cuccugccucgaacuggcug

SEQ ID NO: 1531388 - RNA, 21 nt, Human
cuccugccucgaacuggcugc

SEQ ID NO: 1531389 - RNA, 16 nt, Human
cucccgaauagcuggg

SEQ ID NO: 1531390 - RNA, 19 nt, Human
cucccgaguagcugggacu

SEQ ID NO: 1531391 - RNA, 20 nt, Human
cucccgaguagcugggacua

SEQ ID NO: 1531392 - RNA, 14 nt, Human
cuccauccugaggc

SEQ ID NO: 1531393 - RNA, 13 nt, Human
cuccauccugagg

SEQ ID NO: 1531394 - RNA, 22 nt, Human
cuccccagcaagugagagcugg

SEQ ID NO: 1531395 - RNA, 23 nt, Human
cuccccagcaagugagagcuggg

SEQ ID NO: 1531396 - RNA, 13 nt, Human
cuccccugccccc

SEQ ID NO: 1531397 - RNA, 14 nt, Human
cuccccugccccca

SEQ ID NO: 1531398 - RNA, 15 nt, Human
cuccccugcccccag

SEQ ID NO: 1531399 - RNA, 16 nt, Human
cuccccugcccccagg

SEQ ID NO: 1531400 - RNA, 17 nt, Human
cuccccugcccccagga

SEQ ID NO: 1531401 - RNA, 18 nt, Human
cuccccugcccccaggac

SEQ ID NO: 1531402 - RNA, 19 nt, Human
cuccccugcccccaggacu

SEQ ID NO: 1531403 - RNA, 20 nt, Human
cuccccugcccccaggacug

SEQ ID NO: 1531404 - RNA, 21 nt, Human
cuccccugcccccaggacugg

SEQ ID NO: 1531405 - RNA, 22 nt, Human
cuccccugcccccaggacuggg

SEQ ID NO: 1531406 - RNA, 23 nt, Human
cuccccugcccccaggacugggc

SEQ ID NO: 1531407 - RNA, 12 nt, Human
cuccucaggagc

SEQ ID NO: 1531408 - RNA, 13 nt, Human
cuccucaggagcc

SEQ ID NO: 1531409 - RNA, 22 nt, Human
cuccuccagccgccaugcuccu

SEQ ID NO: 1531410 - RNA, 17 nt, Human
cuccuccacucuccccc

SEQ ID NO: 1531411 - RNA, 15 nt, Human
cuccuccagccgcca

SEQ ID NO: 1531412 - RNA, 13 nt, Human
cuccuccagaguc

SEQ ID NO: 1531413 - RNA, 15 nt, Human
cuccuccagagucag

SEQ ID NO: 1531414 - RNA, 18 nt, Human
cuccucagaucuucugug

SEQ ID NO: 1531415 - RNA, 12 nt, Human
cucccuuucaac

SEQ ID NO: 1531416 - RNA, 21 nt, Human
cuccaaacugacucuuaagaa

SEQ ID NO: 1531417 - RNA, 12 nt, Human
cuccaaagaaau

SEQ ID NO: 1531418 - RNA, 18 nt, Human
cuccaaaauaaaacuuuu

SEQ ID NO: 1531419 - RNA, 13 nt, Human
cuccaaagaaaug

SEQ ID NO: 1531420 - RNA, 16 nt, Human
cuccaaaauaaaacuu

SEQ ID NO: 1531421 - RNA, 15 nt, Human
cuccaaaauaaaacu

SEQ ID NO: 1531422 - RNA, 18 nt, Human
cucauuugucacacacuu

SEQ ID NO: 1531423 - RNA, 20 nt, Human
cucaucucuuagcuccccuc

SEQ ID NO: 1531424 - RNA, 22 nt, Human
cucaucucuuagcuccccucca

SEQ ID NO: 1531425 - RNA, 17 nt, Human
cucauuugucacacacu

SEQ ID NO: 1531426 - RNA, 15 nt, Human
cuccacccugcucuc

SEQ ID NO: 1531427 - RNA, 13 nt, Human
cuccacccugcuc

SEQ ID NO: 1531428 - RNA, 18 nt, Human
cuccacaccauucagguc

SEQ ID NO: 1531429 - RNA, 20 nt, Human
cuccacaccauucaggucuu

SEQ ID NO: 1531430 - RNA, 15 nt, Human
cuccaccugccaggg

SEQ ID NO: 1531431 - RNA, 14 nt, Human
cuccaccugccagg

SEQ ID NO: 1531432 - RNA, 12 nt, Human
cuccaccugcca

SEQ ID NO: 1531433 - RNA, 13 nt, Human
cuccaccugccag

SEQ ID NO: 1531434 - RNA, 20 nt, Human
cuccagccccuggaugcagc

SEQ ID NO: 1531435 - RNA, 16 nt, Human
cuccagccccuggaug

SEQ ID NO: 1531436 - RNA, 17 nt, Human
cuccagccccuggaugc

SEQ ID NO: 1531437 - RNA, 14 nt, Human
cuccagcucaccag

SEQ ID NO: 1531438 - RNA, 12 nt, Human
cuccagccuggg

SEQ ID NO: 1531439 - RNA, 12 nt, Human
cuccauccugag

SEQ ID NO: 1531440 - RNA, 18 nt, Human
cuccaggagcagccacau

SEQ ID NO: 1531441 - RNA, 23 nt, Human
cuccaggagcagccacauuccug

SEQ ID NO: 1531442 - RNA, 11 nt, Human
cuccaggagca

SEQ ID NO: 1531443 - RNA, 13 nt, Human
cuccaggagcagc

SEQ ID NO: 1531444 - RNA, 14 nt, Human
cuccaggagcagcc

SEQ ID NO: 1531445 - RNA, 15 nt, Human
cuccaggagcagcca

SEQ ID NO: 1531446 - RNA, 16 nt, Human
cuccaggagcagccac

SEQ ID NO: 1531447 - RNA, 17 nt, Human
cuccaggagcagccaca

SEQ ID NO: 1531448 - RNA, 22 nt, Human
cucauacucaccucaccccacu

SEQ ID NO: 1531449 - RNA, 14 nt, Human
cucauacucaccuc

SEQ ID NO: 1531450 - RNA, 21 nt, Human
cucauaguaugguggcugggu

SEQ ID NO: 1531451 - RNA, 22 nt, Human
cucaggugauccacccaccuca

SEQ ID NO: 1531452 - RNA, 20 nt, Human
cucaggugauccacccaccu

SEQ ID NO: 1531453 - RNA, 18 nt, Human
cucaggugauccacccac

SEQ ID NO: 1531454 - RNA, 19 nt, Human
cucaggugauccacccacc

SEQ ID NO: 1531455 - RNA, 16 nt, Human
cucauacccaccccca

SEQ ID NO: 1531456 - RNA, 18 nt, Human
cucauacccacccccacc

SEQ ID NO: 1531457 - RNA, 19 nt, Human
cucauacccacccccaccc

SEQ ID NO: 1531458 - RNA, 21 nt, Human
cucauacccacccccacccaa

SEQ ID NO: 1531459 - RNA, 22 nt, Human
cucaucaccaacgucugugcca

SEQ ID NO: 1531460 - RNA, 21 nt, Human
cucaucaccaacgucugugcc

SEQ ID NO: 1531461 - RNA, 23 nt, Human
cucauaguaugguggcuggguug

SEQ ID NO: 1531462 - RNA, 15 nt, Human
cucauccucauaccc

SEQ ID NO: 1531463 - RNA, 17 nt, Human
cucaucucuuagcuccc

SEQ ID NO: 1531464 - RNA, 19 nt, Human
cucaucucuuagcuccccu

SEQ ID NO: 1531465 - RNA, 18 nt, Human
cucaggaguuugagacca

SEQ ID NO: 1531466 - RNA, 23 nt, Human
cucaggaguuugagaccaaccug

SEQ ID NO: 1531467 - RNA, 18 nt, Human
cucagcauccuggcaccc

SEQ ID NO: 1531468 - RNA, 14 nt, Human
cucagggccuggcu

SEQ ID NO: 1531469 - RNA, 15 nt, Human
cucagggccuggcuc

SEQ ID NO: 1531470 - RNA, 16 nt, Human
cucagggccuggcuca

SEQ ID NO: 1531471 - RNA, 15 nt, Human
cucagggccuggucg

SEQ ID NO: 1531472 - RNA, 15 nt, Human
cucagggucccuggu

SEQ ID NO: 1531473 - RNA, 16 nt, Human
cucagggucccuggug

SEQ ID NO: 1531474 - RNA, 17 nt, Human
cucagggucccuggugg

SEQ ID NO: 1531475 - RNA, 18 nt, Human
cucagggucccugguggc

SEQ ID NO: 1531476 - RNA, 16 nt, Human
cucaggugagaagcag

SEQ ID NO: 1531477 - RNA, 19 nt, Human
cucaggugagaagcagagg

SEQ ID NO: 1531478 - RNA, 20 nt, Human
cucaggugagaagcagagga

SEQ ID NO: 1531479 - RNA, 18 nt, Human
cgagaucacgccacugca

SEQ ID NO: 1531480 - RNA, 20 nt, Human
cgagaucacgccacugcacu

SEQ ID NO: 1531481 - RNA, 20 nt, Human
cgagauugcaccacugcacu

SEQ ID NO: 1531482 - RNA, 18 nt, Human
cgagcaggcuacugucag

SEQ ID NO: 1531483 - RNA, 20 nt, Human
cgagcaggcuucuucccccc

SEQ ID NO: 1531484 - RNA, 13 nt, Human
cgagcaugccugg

SEQ ID NO: 1531485 - RNA, 16 nt, Human
cgagcaugccuggaug

SEQ ID NO: 1531486 - RNA, 17 nt, Human
cgagcaugccuggaugg

SEQ ID NO: 1531487 - RNA, 18 nt, Human
cgagauagccaaggccaa

SEQ ID NO: 1531488 - RNA, 17 nt, Human
cgagaucacgccacugc

SEQ ID NO: 1531489 - RNA, 16 nt, Human
cgagaacuuucauuuu

SEQ ID NO: 1531490 - RNA, 17 nt, Human
cgagaacuuucauuuuu

SEQ ID NO: 1531491 - RNA, 15 nt, Human
cgaauagcugggacu

SEQ ID NO: 1531492 - RNA, 13 nt, Human
cgaauagcuggga

SEQ ID NO: 1531493 - RNA, 14 nt, Human
cgaauagcugggac

SEQ ID NO: 1531494 - RNA, 23 nt, Human
ccuuugacgccaucccagcccca

SEQ ID NO: 1531495 - RNA, 22 nt, Human
ccuuugacgccaucccagcccc

SEQ ID NO: 1531496 - RNA, 20 nt, Human
ccuuugacgccaucccagcc

SEQ ID NO: 1531497 - RNA, 21 nt, Human
ccuuugacgccaucccagccc

SEQ ID NO: 1531498 - RNA, 20 nt, Human
cgaaaacguggcugcuucaa

SEQ ID NO: 1531499 - RNA, 15 nt, Human
cgaaaacguggcugc

SEQ ID NO: 1531500 - RNA, 18 nt, Human
cgaaaacguggcugcuuc

SEQ ID NO: 1531501 - RNA, 19 nt, Human
cgaaaacguggcugcuuca

SEQ ID NO: 1531502 - RNA, 23 nt, Human
cgaagaguauuuuugacagaaua

SEQ ID NO: 1531503 - RNA, 21 nt, Human
cgaagaguauuuuugacagaa

SEQ ID NO: 1531504 - RNA, 12 nt, Human
cgaacuggcugc

SEQ ID NO: 1531505 - RNA, 14 nt, Human
cgaacuggcugcaa

SEQ ID NO: 1531506 - RNA, 21 nt, Human
cgaaagaacaguccauugaaa

SEQ ID NO: 1531507 - RNA, 12 nt, Human
cgaaagaacagu

SEQ ID NO: 1531508 - RNA, 22 nt, Human
cgaaagggacuuggaagcuccg

SEQ ID NO: 1531509 - RNA, 20 nt, Human
cgaaaggaugaaagugacca

SEQ ID NO: 1531510 - RNA, 19 nt, Human
cgaaagggacuuggaagcu

SEQ ID NO: 1531511 - RNA, 20 nt, Human
cgauuucuguuuagauaaua

SEQ ID NO: 1531512 - RNA, 18 nt, Human
cgagcccugguggcagug

SEQ ID NO: 1531513 - RNA, 18 nt, Human
cgagcaugccuggauggg

SEQ ID NO: 1531514 - RNA, 15 nt, Human
cgagcccugguggca

SEQ ID NO: 1531515 - RNA, 16 nt, Human
cgagcccugguggcag

SEQ ID NO: 1531516 - RNA, 22 nt, Human
cgccagauucuuuccugaggcu

SEQ ID NO: 1531517 - RNA, 22 nt, Human
cgccaggggaaaaucagccugc

SEQ ID NO: 1531518 - RNA, 15 nt, Human
cgcagcccugcagag

SEQ ID NO: 1531519 - RNA, 19 nt, Human
cgccagauucuuuccugag

SEQ ID NO: 1531520 - RNA, 20 nt, Human
cgccagauucuuuccugagg

SEQ ID NO: 1531521 - RNA, 21 nt, Human
cgccagauucuuuccugaggc

SEQ ID NO: 1531522 - RNA, 15 nt, Human
cgcagacaggaccag

SEQ ID NO: 1531523 - RNA, 16 nt, Human
cgcagacaggaccagg

SEQ ID NO: 1531524 - RNA, 14 nt, Human
cgcagcccugcaga

SEQ ID NO: 1531525 - RNA, 17 nt, Human
cgccaugcuccuggccc

SEQ ID NO: 1531526 - RNA, 14 nt, Human
cgagcaugccugga

SEQ ID NO: 1531527 - RNA, 19 nt, Human
ccuuucuccccugccccca

SEQ ID NO: 1531528 - RNA, 20 nt, Human
ccuuucuccccugcccccag

SEQ ID NO: 1531529 - RNA, 16 nt, Human
ccuuugacgccauccc

SEQ ID NO: 1531530 - RNA, 17 nt, Human
ccuuugacgccauccca

SEQ ID NO: 1531531 - RNA, 18 nt, Human
ccuuugacgccaucccag

SEQ ID NO: 1531532 - RNA, 15 nt, Human
ccuuucuccccugcc

SEQ ID NO: 1531533 - RNA, 18 nt, Human
ccuuucuccccugccccc

SEQ ID NO: 1531534 - RNA, 19 nt, Human
ccuuggggcugaugcaguu

SEQ ID NO: 1531535 - RNA, 22 nt, Human
ccuuggugucgggcaugacacg

SEQ ID NO: 1531536 - RNA, 21 nt, Human
ccuugguuaggcauuguggga

SEQ ID NO: 1531537 - RNA, 22 nt, Human
ccuugguuaggcauugugggaa

SEQ ID NO: 1531538 - RNA, 20 nt, Human
ccuugaguugauucagcucu

SEQ ID NO: 1531539 - RNA, 23 nt, Human
ccuugaccauucuccaccugcca

SEQ ID NO: 1531540 - RNA, 13 nt, Human
ccuugacucuuuc

SEQ ID NO: 1531541 - RNA, 15 nt, Human
ccuucuccuucaccu

SEQ ID NO: 1531542 - RNA, 19 nt, Human
ccuucuccuucaccuuugu

SEQ ID NO: 1531543 - RNA, 16 nt, Human
ccuucggccuccaucc

SEQ ID NO: 1531544 - RNA, 15 nt, Human
ccuucggcgccuuaa

SEQ ID NO: 1531545 - RNA, 14 nt, Human
ccuucuaggaagcu

SEQ ID NO: 1531546 - RNA, 14 nt, Human
ccuucucucaucuc

SEQ ID NO: 1531547 - RNA, 15 nt, Human
ccuucucucaucucu

SEQ ID NO: 1531548 - RNA, 15 nt, Human
ccuucugugaaagua

SEQ ID NO: 1531549 - RNA, 13 nt, Human
ccuucagcccuca

SEQ ID NO: 1531550 - RNA, 12 nt, Human
ccuucagccuga

SEQ ID NO: 1531551 - RNA, 11 nt, Human
ccuucagugcc

SEQ ID NO: 1531552 - RNA, 14 nt, Human
ccuucagcccucac

SEQ ID NO: 1531553 - RNA, 15 nt, Human
ccuucagcccucacc

SEQ ID NO: 1531554 - RNA, 14 nt, Human
ccuucagugccaaa

SEQ ID NO: 1531555 - RNA, 21 nt, Human
ccuucaccuuuguccccaccg

SEQ ID NO: 1531556 - RNA, 14 nt, Human
ccuuagacaguccc

SEQ ID NO: 1531557 - RNA, 17 nt, Human
ccuucacagaugggugc

SEQ ID NO: 1531558 - RNA, 19 nt, Human
ccuucaccuuuguccccac

SEQ ID NO: 1531559 - RNA, 20 nt, Human
ccuucaccuuuguccccacc

SEQ ID NO: 1531560 - RNA, 14 nt, Human
ccuucggccuccau

SEQ ID NO: 1531561 - RNA, 20 nt, Human
ccuucggccuccauccugag

SEQ ID NO: 1531562 - RNA, 22 nt, Human
ccuucauuuggcauuccccacu

SEQ ID NO: 1531563 - RNA, 18 nt, Human
ccuucagcccucaccccu

SEQ ID NO: 1531564 - RNA, 14 nt, Human
ccuuacacaauggu

SEQ ID NO: 1531565 - RNA, 20 nt, Human
ccuuacacaaugguuuucuu

SEQ ID NO: 1531566 - RNA, 17 nt, Human
ccuuagaagucacacag

SEQ ID NO: 1531567 - RNA, 18 nt, Human
ccuuagaagucacacagu

SEQ ID NO: 1531568 - RNA, 19 nt, Human
ccuuacccucauguucuua

SEQ ID NO: 1531569 - RNA, 19 nt, Human
ccuuaccugccaggaagcc

SEQ ID NO: 1531570 - RNA, 13 nt, Human
ccuuaccagcaga

SEQ ID NO: 1531571 - RNA, 15 nt, Human
ccuuacccucauguu

SEQ ID NO: 1531572 - RNA, 20 nt, Human
ccuuaccagcagagcaccuu

SEQ ID NO: 1531573 - RNA, 20 nt, Human
ccuguuaaaagaugaaaaua

SEQ ID NO: 1531574 - RNA, 21 nt, Human
ccuguuaaaagaugaaaauau

SEQ ID NO: 1531575 - RNA, 16 nt, Human
ccuguuucugcagcca

SEQ ID NO: 1531576 - RNA, 14 nt, Human
ccuguuuguuucug

SEQ ID NO: 1531577 - RNA, 18 nt, Human
ccuguuuguuucugaaag

SEQ ID NO: 1531578 - RNA, 20 nt, Human
ccugugugugcgccuacagg

SEQ ID NO: 1531579 - RNA, 21 nt, Human
ccugugugugcgccuacagga

SEQ ID NO: 1531580 - RNA, 22 nt, Human
ccugugucuugcaauggcagcc

SEQ ID NO: 1531581 - RNA, 17 nt, Human
ccugugucuugcaaugg

SEQ ID NO: 1531582 - RNA, 19 nt, Human
ccugugucuugcaauggca

SEQ ID NO: 1531583 - RNA, 21 nt, Human
ccugugucuugcaauggcagc

SEQ ID NO: 1531584 - RNA, 22 nt, Human
ccuggugcccuggaugcccagg

SEQ ID NO: 1531585 - RNA, 21 nt, Human
ccuggugcccuggaugcccag

SEQ ID NO: 1531586 - RNA, 12 nt, Human
ccuucagugccu

SEQ ID NO: 1531587 - RNA, 12 nt, Human
ccuggugcccug

SEQ ID NO: 1531588 - RNA, 18 nt, Human
ccuggugcccuggaugcc

SEQ ID NO: 1531589 - RNA, 20 nt, Human
ccuggugcccuggaugccca

SEQ ID NO: 1531590 - RNA, 20 nt, Human
ccuggucccacgagggugcc

SEQ ID NO: 1531591 - RNA, 18 nt, Human
ccuggaauauauaaccag

SEQ ID NO: 1531592 - RNA, 22 nt, Human
ccuggcacccggccccugcugg

SEQ ID NO: 1531593 - RNA, 23 nt, Human
ccuggcacccggccccugcuggu

SEQ ID NO: 1531594 - RNA, 22 nt, Human
ccuggcacuauaauguaagcuc

SEQ ID NO: 1531595 - RNA, 12 nt, Human
ccuggcagcccc

SEQ ID NO: 1531596 - RNA, 14 nt, Human
ccuggcagccccug

SEQ ID NO: 1531597 - RNA, 13 nt, Human
ccuggcagccccu

SEQ ID NO: 1531598 - RNA, 15 nt, Human
ccuggccagaugcac

SEQ ID NO: 1531599 - RNA, 20 nt, Human
ccuggccagaugcaccagcc

SEQ ID NO: 1531600 - RNA, 11 nt, Human
ccugccucagc

SEQ ID NO: 1531601 - RNA, 23 nt, Human
ccugccuguugggccaggagccu

SEQ ID NO: 1531602 - RNA, 22 nt, Human
ccugccccucaacucuccucca

SEQ ID NO: 1531603 - RNA, 20 nt, Human
ccugcccccaggacugggcc

SEQ ID NO: 1531604 - RNA, 22 nt, Human
ccugcccccaggacugggccac

SEQ ID NO: 1531605 - RNA, 16 nt, Human
ccugcccccaggacug

SEQ ID NO: 1531606 - RNA, 17 nt, Human
ccugcccccaggacugg

SEQ ID NO: 1531607 - RNA, 18 nt, Human
ccugcccccaggacuggg

SEQ ID NO: 1531608 - RNA, 19 nt, Human
ccugcccccaggacugggc

SEQ ID NO: 1531609 - RNA, 16 nt, Human
ccugcggugcuaucuc

SEQ ID NO: 1531610 - RNA, 17 nt, Human
ccugcggugcuaucucc

SEQ ID NO: 1531611 - RNA, 23 nt, Human
ccuggaaaucaggguuaguauug

SEQ ID NO: 1531612 - RNA, 14 nt, Human
ccugcuucaaauau

SEQ ID NO: 1531613 - RNA, 22 nt, Human
ccugcggugcuaucucccccag

SEQ ID NO: 1531614 - RNA, 21 nt, Human
ccugcucuccgaccagacacc

SEQ ID NO: 1531615 - RNA, 22 nt, Human
ccugcucuccgaccagacaccu

SEQ ID NO: 1531616 - RNA, 12 nt, Human
ccugagccagau

SEQ ID NO: 1531617 - RNA, 14 nt, Human
ccugagcuuucugc

SEQ ID NO: 1531618 - RNA, 11 nt, Human
ccugagcccca

SEQ ID NO: 1531619 - RNA, 21 nt, Human
ccugaggcccagagggccugc

SEQ ID NO: 1531620 - RNA, 16 nt, Human
ccugagcuuucugcua

SEQ ID NO: 1531621 - RNA, 13 nt, Human
ccugccaggaagc

SEQ ID NO: 1531622 - RNA, 14 nt, Human
ccugccaggaagcc

SEQ ID NO: 1531623 - RNA, 15 nt, Human
ccugccaggaagcca

SEQ ID NO: 1531624 - RNA, 17 nt, Human
ccugccaggaagccagc

SEQ ID NO: 1531625 - RNA, 22 nt, Human
ccugccagggacagagggggug

SEQ ID NO: 1531626 - RNA, 16 nt, Human
ccugccagggacagag

SEQ ID NO: 1531627 - RNA, 12 nt, Human
ccugcccccagg

SEQ ID NO: 1531628 - RNA, 14 nt, Human
ccugcccccaggac

SEQ ID NO: 1531629 - RNA, 15 nt, Human
ccugcccccaggacu

SEQ ID NO: 1531630 - RNA, 12 nt, Human
ccugccagggac

SEQ ID NO: 1531631 - RNA, 13 nt, Human
ccugccagggaca

SEQ ID NO: 1531632 - RNA, 14 nt, Human
ccugccagggacag

SEQ ID NO: 1531633 - RNA, 15 nt, Human
ccugccagggacaga

SEQ ID NO: 1531634 - RNA, 23 nt, Human
ccugccaggaagccagcaggcuc

SEQ ID NO: 1531635 - RNA, 16 nt, Human
ccugccaggcauggug

SEQ ID NO: 1531636 - RNA, 11 nt, Human
ccugccaggga

SEQ ID NO: 1531637 - RNA, 18 nt, Human
ccugccaggaagccagca

SEQ ID NO: 1531638 - RNA, 19 nt, Human
ccugccaggaagccagcag

SEQ ID NO: 1531639 - RNA, 21 nt, Human
ccugccaggaagccagcaggc

SEQ ID NO: 1531640 - RNA, 22 nt, Human
ccugccaggaagccagcaggcu

SEQ ID NO: 1531641 - RNA, 17 nt, Human
ccugauugugucucuug

SEQ ID NO: 1531642 - RNA, 19 nt, Human
ccugauugugucucuuggu

SEQ ID NO: 1531643 - RNA, 22 nt, Human
ccugcaaccugauugugucucu

SEQ ID NO: 1531644 - RNA, 21 nt, Human
ccugcaaccugauugugucuc

SEQ ID NO: 1531645 - RNA, 11 nt, Human
ccugaggcccu

SEQ ID NO: 1531646 - RNA, 12 nt, Human
ccugaggcccuu

SEQ ID NO: 1531647 - RNA, 20 nt, Human
ccugaugcuucuucagagac

SEQ ID NO: 1531648 - RNA, 21 nt, Human
ccugaugcuucuucagagacu

SEQ ID NO: 1531649 - RNA, 22 nt, Human
ccugaugcuucuucagagacuc

SEQ ID NO: 1531650 - RNA, 14 nt, Human
ccugaggcccuucu

SEQ ID NO: 1531651 - RNA, 15 nt, Human
ccugauugugucucu

SEQ ID NO: 1531652 - RNA, 19 nt, Human
ccugcaauuucauaugcug

SEQ ID NO: 1531653 - RNA, 14 nt, Human
ccugcaagaacaag

SEQ ID NO: 1531654 - RNA, 16 nt, Human
ccucuaggaggucucu

SEQ ID NO: 1531655 - RNA, 16 nt, Human
ccucggugccuuccuc

SEQ ID NO: 1531656 - RNA, 14 nt, Human
ccucgguguggaga

SEQ ID NO: 1531657 - RNA, 18 nt, Human
ccucgguguggagaagcg

SEQ ID NO: 1531658 - RNA, 23 nt, Human
ccuccugccucgaacuggcugca

SEQ ID NO: 1531659 - RNA, 14 nt, Human
ccuccugggcuaag

SEQ ID NO: 1531660 - RNA, 16 nt, Human
ccuccuccacucuccc

SEQ ID NO: 1531661 - RNA, 10 nt, Human
ccucccuccc

SEQ ID NO: 1531662 - RNA, 20 nt, Human
ccucccgaguagcugggacu

SEQ ID NO: 1531663 - RNA, 21 nt, Human
ccucccgaguagcugggacua

SEQ ID NO: 1531664 - RNA, 17 nt, Human
ccucccgaauagcuggg

SEQ ID NO: 1531665 - RNA, 23 nt, Human
ccuccaugugggcuaguugggcu

SEQ ID NO: 1531666 - RNA, 15 nt, Human
ccucccaaagugcug

SEQ ID NO: 1531667 - RNA, 16 nt, Human
ccucccaaagugcugg

SEQ ID NO: 1531668 - RNA, 22 nt, Human
ccuccaggugcacaagcuccaa

SEQ ID NO: 1531669 - RNA, 22 nt, Human
ccuccagggcuggacugaggcc

SEQ ID NO: 1531670 - RNA, 19 nt, Human
ccuccaggugcacaagcuc

SEQ ID NO: 1531671 - RNA, 21 nt, Human
ccuccaggugcacaagcucca

SEQ ID NO: 1531672 - RNA, 12 nt, Human
ccuccagggcug

SEQ ID NO: 1531673 - RNA, 13 nt, Human
ccuccagggcugg

SEQ ID NO: 1531674 - RNA, 16 nt, Human
ccuccagggcuggacu

SEQ ID NO: 1531675 - RNA, 17 nt, Human
ccuccagggcuggacug

SEQ ID NO: 1531676 - RNA, 18 nt, Human
ccuccagggcuggacuga

SEQ ID NO: 1531677 - RNA, 20 nt, Human
ccuccagggcuggacugagg

SEQ ID NO: 1531678 - RNA, 21 nt, Human
ccuccagggcuggacugaggc

SEQ ID NO: 1531679 - RNA, 13 nt, Human
ccucauccucaua

SEQ ID NO: 1531680 - RNA, 20 nt, Human
ccucauccucauacccaccc

SEQ ID NO: 1531681 - RNA, 20 nt, Human
ccucagucuggcccuuccuu

SEQ ID NO: 1531682 - RNA, 11 nt, Human
ccucagugcca

SEQ ID NO: 1531683 - RNA, 20 nt, Human
ccucauaguaugguggcugg

SEQ ID NO: 1531684 - RNA, 13 nt, Human
ccucauacccacc

SEQ ID NO: 1531685 - RNA, 21 nt, Human
ccucauaguaugguggcuggg

SEQ ID NO: 1531686 - RNA, 22 nt, Human
ccucauaguaugguggcugggu

SEQ ID NO: 1531687 - RNA, 13 nt, Human
ccucaucaccaac

SEQ ID NO: 1531688 - RNA, 14 nt, Human
ccucaucaccaacg

SEQ ID NO: 1531689 - RNA, 19 nt, Human
ccgcuuucuacccagcgag

SEQ ID NO: 1531690 - RNA, 23 nt, Human
ccgcuuucuacccagcgagcccu

SEQ ID NO: 1531691 - RNA, 17 nt, Human
ccggcuggccuggcccc

SEQ ID NO: 1531692 - RNA, 18 nt, Human
ccggcuggccuggccccu

SEQ ID NO: 1531693 - RNA, 12 nt, Human
ccgcuuucuacc

SEQ ID NO: 1531694 - RNA, 20 nt, Human
ccgggcgcgguggcucacgc

SEQ ID NO: 1531695 - RNA, 16 nt, Human
ccgggcguggugguga

SEQ ID NO: 1531696 - RNA, 13 nt, Human
ccgggcucugccu

SEQ ID NO: 1531697 - RNA, 14 nt, Human
ccgaggccuucucu

SEQ ID NO: 1531698 - RNA, 15 nt, Human
cccugguucucaucu

SEQ ID NO: 1531699 - RNA, 16 nt, Human
cccugguucucaucuu

SEQ ID NO: 1531700 - RNA, 20 nt, Human
cccugguggcagcucaccuc

SEQ ID NO: 1531701 - RNA, 17 nt, Human
cccugguucucaucuuu

SEQ ID NO: 1531702 - RNA, 20 nt, Human
ccgaguagcugggacuacag

SEQ ID NO: 1531703 - RNA, 17 nt, Human
ccgaggccuucucugaa

SEQ ID NO: 1531704 - RNA, 17 nt, Human
ccgaguagcugggacua

SEQ ID NO: 1531705 - RNA, 14 nt, Human
ccgcacugggcuug

SEQ ID NO: 1531706 - RNA, 19 nt, Human
ccgcacugggcuuggggac

SEQ ID NO: 1531707 - RNA, 22 nt, Human
ccgcgccaaauaaugucucugu

SEQ ID NO: 1531708 - RNA, 13 nt, Human
ccgccuuaccagg

SEQ ID NO: 1531709 - RNA, 21 nt, Human
ccgcuaagagggagggagggc

SEQ ID NO: 1531710 - RNA, 23 nt, Human
ccgcuaagagggagggagggcuc

SEQ ID NO: 1531711 - RNA, 17 nt, Human
ccguguccccugacagg

SEQ ID NO: 1531712 - RNA, 19 nt, Human
ccguguccccugacagggc

SEQ ID NO: 1531713 - RNA, 15 nt, Human
ccuaaaauucagugg

SEQ ID NO: 1531714 - RNA, 13 nt, Human
ccuaguuccacca

SEQ ID NO: 1531715 - RNA, 21 nt, Human
ccuaguuccaccaucaagcca

SEQ ID NO: 1531716 - RNA, 23 nt, Human
ccuaguuccaccaucaagccacc

SEQ ID NO: 1531717 - RNA, 22 nt, Human
ccuauauuguuuucaguguaca

SEQ ID NO: 1531718 - RNA, 18 nt, Human
ccuauauuguuuucagug

SEQ ID NO: 1531719 - RNA, 22 nt, Human
cccaccucucucacuccuugaa

SEQ ID NO: 1531720 - RNA, 18 nt, Human
cccaccaucaugucuggc

SEQ ID NO: 1531721 - RNA, 19 nt, Human
cccaccgcagacaggacca

SEQ ID NO: 1531722 - RNA, 20 nt, Human
cccaccgcagacaggaccag

SEQ ID NO: 1531723 - RNA, 19 nt, Human
cccacgcuggagugcagug

SEQ ID NO: 1531724 - RNA, 20 nt, Human
cccacgcuggagugcaguga

SEQ ID NO: 1531725 - RNA, 21 nt, Human
cccacgcuggagugcagugag

SEQ ID NO: 1531726 - RNA, 23 nt, Human
cccacuugagaauuacccuuuug

SEQ ID NO: 1531727 - RNA, 12 nt, Human
cccacuucugcc

SEQ ID NO: 1531728 - RNA, 17 nt, Human
cccaccuggccucugca

SEQ ID NO: 1531729 - RNA, 19 nt, Human
cccaccuggccucugcacu

SEQ ID NO: 1531730 - RNA, 21 nt, Human
cccaccuggccucugcacucc

SEQ ID NO: 1531731 - RNA, 20 nt, Human
cccacgacugcccggcaggg

SEQ ID NO: 1531732 - RNA, 21 nt, Human
cccacgacugcccggcagggu

SEQ ID NO: 1531733 - RNA, 20 nt, Human
cccacaagaaaugaaagcag

SEQ ID NO: 1531734 - RNA, 13 nt, Human
cccacaagaaaug

SEQ ID NO: 1531735 - RNA, 23 nt, Human
cccaaugcacuuuguucuggcuc

SEQ ID NO: 1531736 - RNA, 16 nt, Human
cccaaugcacuuuguu

SEQ ID NO: 1531737 - RNA, 20 nt, Human
cccaaugcacuuuguucugg

SEQ ID NO: 1531738 - RNA, 22 nt, Human
cccugcacuugcagacucuaca

SEQ ID NO: 1531739 - RNA, 19 nt, Human
cccugcacuugcagacucu

SEQ ID NO: 1531740 - RNA, 12 nt, Human
cccugcacuugc

SEQ ID NO: 1531741 - RNA, 16 nt, Human
cccucuggggcuguuc

SEQ ID NO: 1531742 - RNA, 15 nt, Human
cccugaaagcccuga

SEQ ID NO: 1531743 - RNA, 16 nt, Human
cccugaaagcccugag

SEQ ID NO: 1531744 - RNA, 14 nt, Human
cccugaggcccaga

SEQ ID NO: 1531745 - RNA, 15 nt, Human
cccugaggcccagag

SEQ ID NO: 1531746 - RNA, 16 nt, Human
cccugaggcccagagg

SEQ ID NO: 1531747 - RNA, 17 nt, Human
cccugaggcccagaggg

SEQ ID NO: 1531748 - RNA, 18 nt, Human
cccugaggcccagagggc

SEQ ID NO: 1531749 - RNA, 19 nt, Human
cccugaggcccagagggcc

SEQ ID NO: 1531750 - RNA, 20 nt, Human
cccugaggcccagagggccu

SEQ ID NO: 1531751 - RNA, 23 nt, Human
cccugaggcccagagggccugca

SEQ ID NO: 1531752 - RNA, 20 nt, Human
cccugcccaccuggccucug

SEQ ID NO: 1531753 - RNA, 18 nt, Human
cccugcccaccuggccuc

SEQ ID NO: 1531754 - RNA, 16 nt, Human
cccugcuggguguggc

SEQ ID NO: 1531755 - RNA, 21 nt, Human
cccugcuggguguggcgcagc

SEQ ID NO: 1531756 - RNA, 14 nt, Human
cccugcccaccugg

SEQ ID NO: 1531757 - RNA, 17 nt, Human
cccugcccaccuggccu

SEQ ID NO: 1531758 - RNA, 22 nt, Human
cccugcuggguguggcgcagca

SEQ ID NO: 1531759 - RNA, 15 nt, Human
cccugguggcagcuc

SEQ ID NO: 1531760 - RNA, 16 nt, Human
cccugguggcagcuca

SEQ ID NO: 1531761 - RNA, 17 nt, Human
cccugguggcagcucac

SEQ ID NO: 1531762 - RNA, 21 nt, Human
cccuggugaccagcaccaucu

SEQ ID NO: 1531763 - RNA, 19 nt, Human
cccgcugucagccauuccu

SEQ ID NO: 1531764 - RNA, 20 nt, Human
cccgcugucagccauuccug

SEQ ID NO: 1531765 - RNA, 23 nt, Human
cccgagggcugagccugguccca

SEQ ID NO: 1531766 - RNA, 22 nt, Human
cccgaguagcugggacuacagg

SEQ ID NO: 1531767 - RNA, 12 nt, Human
cccgggcucugc

SEQ ID NO: 1531768 - RNA, 14 nt, Human
cccgggcucugccu

SEQ ID NO: 1531769 - RNA, 15 nt, Human
cccgggcucugccuc

SEQ ID NO: 1531770 - RNA, 14 nt, Human
cccagagggccugc

SEQ ID NO: 1531771 - RNA, 15 nt, Human
cccagagggccugca

SEQ ID NO: 1531772 - RNA, 18 nt, Human
cccagagggccugcaagg

SEQ ID NO: 1531773 - RNA, 13 nt, Human
cccgaguagcugg

SEQ ID NO: 1531774 - RNA, 14 nt, Human
cccgaguagcuggg

SEQ ID NO: 1531775 - RNA, 15 nt, Human
cccgaguagcuggga

SEQ ID NO: 1531776 - RNA, 16 nt, Human
cccgaguagcugggac

SEQ ID NO: 1531777 - RNA, 17 nt, Human
cccgaguagcugggacu

SEQ ID NO: 1531778 - RNA, 18 nt, Human
cccgaguagcugggacua

SEQ ID NO: 1531779 - RNA, 21 nt, Human
cccgaguagcugggacuacag

SEQ ID NO: 1531780 - RNA, 20 nt, Human
cccuacaguugaaaaacagc

SEQ ID NO: 1531781 - RNA, 16 nt, Human
cccgggcucugccucc

SEQ ID NO: 1531782 - RNA, 18 nt, Human
cccggguugggucaccag

SEQ ID NO: 1531783 - RNA, 15 nt, Human
cccgugggguuccuc

SEQ ID NO: 1531784 - RNA, 18 nt, Human
ccauguuggccaggcugg

SEQ ID NO: 1531785 - RNA, 17 nt, Human
ccauguuggccaggcug

SEQ ID NO: 1531786 - RNA, 16 nt, Human
ccaugggacagggagg

SEQ ID NO: 1531787 - RNA, 19 nt, Human
ccaugggacagggaggacg

SEQ ID NO: 1531788 - RNA, 18 nt, Human
ccauuauuuuuaggaugu

SEQ ID NO: 1531789 - RNA, 19 nt, Human
ccauucuccaccugccagg

SEQ ID NO: 1531790 - RNA, 20 nt, Human
ccauucuccaccugccaggg

SEQ ID NO: 1531791 - RNA, 14 nt, Human
ccauuuguguuuau

SEQ ID NO: 1531792 - RNA, 13 nt, Human
cccaaagugcugg

SEQ ID NO: 1531793 - RNA, 15 nt, Human
cccaaagugcuggga

SEQ ID NO: 1531794 - RNA, 20 nt, Human
cccaaaacucuccucugcug

SEQ ID NO: 1531795 - RNA, 16 nt, Human
cccaaaacucuccucu

SEQ ID NO: 1531796 - RNA, 18 nt, Human
cccaaaacucuccucugc

SEQ ID NO: 1531797 - RNA, 16 nt, Human
cccaaagugcugggau

SEQ ID NO: 1531798 - RNA, 23 nt, Human
cccaaauggaaaugggcagagca

SEQ ID NO: 1531799 - RNA, 18 nt, Human
cccaaauggaaaugggca

SEQ ID NO: 1531800 - RNA, 22 nt, Human
cccaaauggaaaugggcagagc

SEQ ID NO: 1531801 - RNA, 18 nt, Human
ccauguuuuguuuacggu

SEQ ID NO: 1531802 - RNA, 17 nt, Human
ccagguuuuuggucuga

SEQ ID NO: 1531803 - RNA, 24 nt, Human
ccaggugcacaagcuccaagcucc

SEQ ID NO: 1531804 - RNA, 18 nt, Human
ccagucuggaaugcagug

SEQ ID NO: 1531805 - RNA, 19 nt, Human
ccagucuggaaugcagugg

SEQ ID NO: 1531806 - RNA, 20 nt, Human
ccagucuggaaugcaguggu

SEQ ID NO: 1531807 - RNA, 13 nt, Human
ccagggcuggacu

SEQ ID NO: 1531808 - RNA, 16 nt, Human
ccagggcuggacugag

SEQ ID NO: 1531809 - RNA, 17 nt, Human
ccagggcuggacugagg

SEQ ID NO: 1531810 - RNA, 18 nt, Human
ccagggcuggacugaggc

SEQ ID NO: 1531811 - RNA, 19 nt, Human
ccagggcuggacugaggcc

SEQ ID NO: 1531812 - RNA, 22 nt, Human
ccagggcuggacugaggccuga

SEQ ID NO: 1531813 - RNA, 19 nt, Human
ccaggugcacaagcuccaa

SEQ ID NO: 1531814 - RNA, 20 nt, Human
ccaggugcacaagcuccaag

SEQ ID NO: 1531815 - RNA, 20 nt, Human
ccaggcuuagucacugagac

SEQ ID NO: 1531816 - RNA, 14 nt, Human
ccagggacagaggg

SEQ ID NO: 1531817 - RNA, 15 nt, Human
ccagggacagagggg

SEQ ID NO: 1531818 - RNA, 21 nt, Human
ccagggacagaggggguggcc

SEQ ID NO: 1531819 - RNA, 22 nt, Human
ccagggacagaggggguggccu

SEQ ID NO: 1531820 - RNA, 19 nt, Human
ccaggagccccgaggccuu

SEQ ID NO: 1531821 - RNA, 20 nt, Human
ccaggagccccgaggccuuc

SEQ ID NO: 1531822 - RNA, 12 nt, Human
ccaggagccucc

SEQ ID NO: 1531823 - RNA, 18 nt, Human
ccaggcauuccccaggag

SEQ ID NO: 1531824 - RNA, 22 nt, Human
ccaggcauuccccaggaggcca

SEQ ID NO: 1531825 - RNA, 19 nt, Human
ccaggcauuccccaggagg

SEQ ID NO: 1531826 - RNA, 21 nt, Human
ccaggcauuccccaggaggcc

SEQ ID NO: 1531827 - RNA, 17 nt, Human
ccaggcuuagucacuga

SEQ ID NO: 1531828 - RNA, 24 nt, Human
ccaggcuguaucccaugagccuca

SEQ ID NO: 1531829 - RNA, 22 nt, Human
ccaggcccucugcccacucccu

SEQ ID NO: 1531830 - RNA, 23 nt, Human
ccaggcccucugcccacucccug

SEQ ID NO: 1531831 - RNA, 21 nt, Human
ccaggcccucugcccacuccc

SEQ ID NO: 1531832 - RNA, 22 nt, Human
ccaguguuguggauuuaacaga

SEQ ID NO: 1531833 - RNA, 21 nt, Human
ccaguuauggcuauaggugcu

SEQ ID NO: 1531834 - RNA, 14 nt, Human
ccaguuauggcuau

SEQ ID NO: 1531835 - RNA, 23 nt, Human
ccauauucuguuggccaguguga

SEQ ID NO: 1531836 - RNA, 16 nt, Human
ccagugaggcucugcc

SEQ ID NO: 1531837 - RNA, 14 nt, Human
ccagugaggcucug

SEQ ID NO: 1531838 - RNA, 15 nt, Human
ccagugaggcucugc

SEQ ID NO: 1531839 - RNA, 20 nt, Human
ccagugccgagaaggaagcc

SEQ ID NO: 1531840 - RNA, 17 nt, Human
ccagugaggcucugccc

SEQ ID NO: 1531841 - RNA, 13 nt, Human
ccaucuacccucc

SEQ ID NO: 1531842 - RNA, 18 nt, Human
ccagcaugcaccacgggc

SEQ ID NO: 1531843 - RNA, 20 nt, Human
ccagcaugcaccacgggccc

SEQ ID NO: 1531844 - RNA, 12 nt, Human
ccagcacugagg

SEQ ID NO: 1531845 - RNA, 13 nt, Human
ccagcacugagga

SEQ ID NO: 1531846 - RNA, 14 nt, Human
ccagcacugaggaa

SEQ ID NO: 1531847 - RNA, 15 nt, Human
ccagcacugaggaag

SEQ ID NO: 1531848 - RNA, 17 nt, Human
ccagcacugaggaagaa

SEQ ID NO: 1531849 - RNA, 22 nt, Human
ccagcacugaggaagaacgggg

SEQ ID NO: 1531850 - RNA, 15 nt, Human
ccagccaaagccucc

SEQ ID NO: 1531851 - RNA, 18 nt, Human
ccagccaaagccuccucc

SEQ ID NO: 1531852 - RNA, 19 nt, Human
ccagccaaagccuccucca

SEQ ID NO: 1531853 - RNA, 14 nt, Human
ccagccgccaugcu

SEQ ID NO: 1531854 - RNA, 18 nt, Human
ccagccgccaugcuccug

SEQ ID NO: 1531855 - RNA, 19 nt, Human
ccagccgccaugcuccugg

SEQ ID NO: 1531856 - RNA, 16 nt, Human
ccagccccagugccca

SEQ ID NO: 1531857 - RNA, 16 nt, Human
ccagcccuuagcaggg

SEQ ID NO: 1531858 - RNA, 17 nt, Human
ccagcccuuagcaggga

SEQ ID NO: 1531859 - RNA, 23 nt, Human
ccagccccaaaacucuccucugc

SEQ ID NO: 1531860 - RNA, 13 nt, Human
ccagccccagugc

SEQ ID NO: 1531861 - RNA, 15 nt, Human
ccagccccagugccc

SEQ ID NO: 1531862 - RNA, 16 nt, Human
ccagcaagugagagcu

SEQ ID NO: 1531863 - RNA, 21 nt, Human
ccagcaagugagagcugggug

SEQ ID NO: 1531864 - RNA, 22 nt, Human
ccagcaagugagagcugggugu

SEQ ID NO: 1531865 - RNA, 14 nt, Human
ccagauuucacucu

SEQ ID NO: 1531866 - RNA, 15 nt, Human
ccagcaagugagagc

SEQ ID NO: 1531867 - RNA, 15 nt, Human
ccagauuucacucuc

SEQ ID NO: 1531868 - RNA, 20 nt, Human
ccagacaccuugacagggca

SEQ ID NO: 1531869 - RNA, 21 nt, Human
ccagagaggguggugaccucu

SEQ ID NO: 1531870 - RNA, 23 nt, Human
ccagagaggguggugaccucugc

SEQ ID NO: 1531871 - RNA, 14 nt, Human
ccagagaggguggu

SEQ ID NO: 1531872 - RNA, 17 nt, Human
ccagacaccuugacagg

SEQ ID NO: 1531873 - RNA, 19 nt, Human
ccagacaccuugacagggc

SEQ ID NO: 1531874 - RNA, 21 nt, Human
ccagagcuacccgcagaguuc

SEQ ID NO: 1531875 - RNA, 20 nt, Human
ccagagcuacccgcagaguu

SEQ ID NO: 1531876 - RNA, 11 nt, Human
ccagagcugcc

SEQ ID NO: 1531877 - RNA, 12 nt, Human
ccagagcugcca

SEQ ID NO: 1531878 - RNA, 13 nt, Human
ccagagcugccac

SEQ ID NO: 1531879 - RNA, 14 nt, Human
ccagagcugccacc

SEQ ID NO: 1531880 - RNA, 15 nt, Human
ccagagcugccaccu

SEQ ID NO: 1531881 - RNA, 16 nt, Human
ccagagcugccaccug

SEQ ID NO: 1531882 - RNA, 19 nt, Human
ccagagcugccaccugccu

SEQ ID NO: 1531883 - RNA, 16 nt, Human
ccagagggagugacag

SEQ ID NO: 1531884 - RNA, 17 nt, Human
ccagagggagugacaga

SEQ ID NO: 1531885 - RNA, 18 nt, Human
ccagagggagugacagag

SEQ ID NO: 1531886 - RNA, 19 nt, Human
ccagagggagugacagagg

SEQ ID NO: 1531887 - RNA, 20 nt, Human
ccagagggagugacagaggc

SEQ ID NO: 1531888 - RNA, 21 nt, Human
ccagagggagugacagaggca

SEQ ID NO: 1531889 - RNA, 21 nt, Human
ccagaggagagaggacccccu

SEQ ID NO: 1531890 - RNA, 22 nt, Human
ccagaggagagaggacccccug

SEQ ID NO: 1531891 - RNA, 12 nt, Human
ccagaggagggc

SEQ ID NO: 1531892 - RNA, 22 nt, Human
ccagaggagggcagcagaaggg

SEQ ID NO: 1531893 - RNA, 12 nt, Human
ccagauuucacu

SEQ ID NO: 1531894 - RNA, 21 nt, Human
ccagauugcaacaggcugggc

SEQ ID NO: 1531895 - RNA, 23 nt, Human
ccagauucuuuccugaggcuggg

SEQ ID NO: 1531896 - RNA, 19 nt, Human
ccagauugcaacaggcugg

SEQ ID NO: 1531897 - RNA, 20 nt, Human
ccagauugcaacaggcuggg

SEQ ID NO: 1531898 - RNA, 15 nt, Human
ccagagggccugcaa

SEQ ID NO: 1531899 - RNA, 16 nt, Human
ccagagggccugcaag

SEQ ID NO: 1531900 - RNA, 13 nt, Human
ccagagggccugc

SEQ ID NO: 1531901 - RNA, 22 nt, Human
ccagagggagugacagaggcag

SEQ ID NO: 1531902 - RNA, 23 nt, Human
ccagagggagugacagaggcagc

SEQ ID NO: 1531903 - RNA, 18 nt, Human
ccagauucuuuccugagg

SEQ ID NO: 1531904 - RNA, 19 nt, Human
ccagauucuuuccugaggc

SEQ ID NO: 1531905 - RNA, 20 nt, Human
ccagauucuuuccugaggcu

SEQ ID NO: 1531906 - RNA, 21 nt, Human
ccagauucuuuccugaggcug

SEQ ID NO: 1531907 - RNA, 22 nt, Human
ccagauucuuuccugaggcugg

SEQ ID NO: 1531908 - RNA, 16 nt, Human
ccacugcgaccacaag

SEQ ID NO: 1531909 - RNA, 11 nt, Human
ccacugcucug

SEQ ID NO: 1531910 - RNA, 23 nt, Human
ccacugcacuccagccuggguga

SEQ ID NO: 1531911 - RNA, 15 nt, Human
ccacucccugcaacc

SEQ ID NO: 1531912 - RNA, 17 nt, Human
ccacucccugcaaccug

SEQ ID NO: 1531913 - RNA, 19 nt, Human
ccacugcacuccagccugg

SEQ ID NO: 1531914 - RNA, 20 nt, Human
ccacugcacuccagccuggg

SEQ ID NO: 1531915 - RNA, 12 nt, Human
ccacucccugca

SEQ ID NO: 1531916 - RNA, 13 nt, Human
ccacucccugcaa

SEQ ID NO: 1531917 - RNA, 23 nt, Human
ccacuacggaauaguuggcuagg

SEQ ID NO: 1531918 - RNA, 18 nt, Human
ccacuacauucuguuaau

SEQ ID NO: 1531919 - RNA, 22 nt, Human
ccacuacggaauaguuggcuag

SEQ ID NO: 1531920 - RNA, 13 nt, Human
ccacguuucuaaa

SEQ ID NO: 1531921 - RNA, 17 nt, Human
ccaccucccacaaagga

SEQ ID NO: 1531922 - RNA, 12 nt, Human
ccaccugccagg

SEQ ID NO: 1531923 - RNA, 17 nt, Human
ccaccugccuguugggc

SEQ ID NO: 1531924 - RNA, 20 nt, Human
ccaccugccuguugggccag

SEQ ID NO: 1531925 - RNA, 22 nt, Human
ccaccugcggugcuaucucccc

SEQ ID NO: 1531926 - RNA, 15 nt, Human
ccaccuggccucugc

SEQ ID NO: 1531927 - RNA, 16 nt, Human
ccaccuggccucugca

SEQ ID NO: 1531928 - RNA, 17 nt, Human
ccaccuggccucugcac

SEQ ID NO: 1531929 - RNA, 18 nt, Human
ccaccuggccucugcacu

SEQ ID NO: 1531930 - RNA, 12 nt, Human
ccacggccaggc

SEQ ID NO: 1531931 - RNA, 13 nt, Human
ccacggccaggcc

SEQ ID NO: 1531932 - RNA, 14 nt, Human
ccacggccaggcca

SEQ ID NO: 1531933 - RNA, 15 nt, Human
ccacggccaggccag

SEQ ID NO: 1531934 - RNA, 19 nt, Human
ccaccccucaacaccucug

SEQ ID NO: 1531935 - RNA, 16 nt, Human
ccacccugaaagcccu

SEQ ID NO: 1531936 - RNA, 17 nt, Human
ccacccugaaagcccug

SEQ ID NO: 1531937 - RNA, 18 nt, Human
ccacccugaaagcccuga

SEQ ID NO: 1531938 - RNA, 12 nt, Human
ccaccucagccu

SEQ ID NO: 1531939 - RNA, 13 nt, Human
ccaccucagccuc

SEQ ID NO: 1531940 - RNA, 14 nt, Human
ccaccucagccucc

SEQ ID NO: 1531941 - RNA, 15 nt, Human
ccaccucagccuccc

SEQ ID NO: 1531942 - RNA, 12 nt, Human
ccacccaggagc

SEQ ID NO: 1531943 - RNA, 23 nt, Human
ccaccccgagggcugagccuggu

SEQ ID NO: 1531944 - RNA, 14 nt, Human
ccacccaggagccc

SEQ ID NO: 1531945 - RNA, 12 nt, Human
ccacacccagcc

SEQ ID NO: 1531946 - RNA, 15 nt, Human
ccacacccagcccac

SEQ ID NO: 1531947 - RNA, 13 nt, Human
ccacacccagccc

SEQ ID NO: 1531948 - RNA, 14 nt, Human
ccacacccagccca

SEQ ID NO: 1531949 - RNA, 17 nt, Human
ccaccacacccagccca

SEQ ID NO: 1531950 - RNA, 16 nt, Human
ccacccaagggccugg

SEQ ID NO: 1531951 - RNA, 17 nt, Human
ccacccaagggccuggc

SEQ ID NO: 1531952 - RNA, 19 nt, Human
ccacccaagggccuggccu

SEQ ID NO: 1531953 - RNA, 20 nt, Human
ccaccaacauacucccaucu

SEQ ID NO: 1531954 - RNA, 14 nt, Human
ccaccacacccagc

SEQ ID NO: 1531955 - RNA, 16 nt, Human
ccaccacacccagccc

SEQ ID NO: 1531956 - RNA, 16 nt, Human
ccacccaccucagccu

SEQ ID NO: 1531957 - RNA, 14 nt, Human
ccacccaccucagc

SEQ ID NO: 1531958 - RNA, 15 nt, Human
ccacccaccucagcc

SEQ ID NO: 1531959 - RNA, 20 nt, Human
ccacccaagggccuggccug

SEQ ID NO: 1531960 - RNA, 21 nt, Human
ccacccaagggccuggccuga

SEQ ID NO: 1531961 - RNA, 22 nt, Human
ccacccaagggccuggccugag

SEQ ID NO: 1531962 - RNA, 13 nt, Human
ccacccaccucag

SEQ ID NO: 1531963 - RNA, 14 nt, Human
ccacaucuugcucu

SEQ ID NO: 1531964 - RNA, 14 nt, Human
ccaccaacauacuc

SEQ ID NO: 1531965 - RNA, 18 nt, Human
ccaccaacauacucccau

SEQ ID NO: 1531966 - RNA, 16 nt, Human
ccacaucuugcucugc

SEQ ID NO: 1531967 - RNA, 17 nt, Human
ccacaucuugcucugcu

SEQ ID NO: 1531968 - RNA, 22 nt, Human
ccacaucuugcucugcugacag

SEQ ID NO: 1531969 - RNA, 23 nt, Human
ccacaucuugcucugcugacaga

SEQ ID NO: 1531970 - RNA, 21 nt, Human
ccacccaggagccccgaggcc

SEQ ID NO: 1531971 - RNA, 20 nt, Human
cauucaaauguauuacagug

SEQ ID NO: 1531972 - RNA, 21 nt, Human
cauucagauaugauucaaaug

SEQ ID NO: 1531973 - RNA, 19 nt, Human
cauucauaaaccuugucua

SEQ ID NO: 1531974 - RNA, 22 nt, Human
cauuccaacuaucucauuucca

SEQ ID NO: 1531975 - RNA, 13 nt, Human
cauuccccaggag

SEQ ID NO: 1531976 - RNA, 15 nt, Human
cauuccccaggaggc

SEQ ID NO: 1531977 - RNA, 17 nt, Human
cauuccccaggaggcca

SEQ ID NO: 1531978 - RNA, 20 nt, Human
cauuccccaggaggccagcc

SEQ ID NO: 1531979 - RNA, 18 nt, Human
cauuccccaggaggccag

SEQ ID NO: 1531980 - RNA, 19 nt, Human
cauuccccaggaggccagc

SEQ ID NO: 1531981 - RNA, 14 nt, Human
cauuccugaacagg

SEQ ID NO: 1531982 - RNA, 14 nt, Human
cauuccugaugcuu

SEQ ID NO: 1531983 - RNA, 16 nt, Human
cauuccugaugcuucu

SEQ ID NO: 1531984 - RNA, 19 nt, Human
cauuccugaugcuucuuca

SEQ ID NO: 1531985 - RNA, 22 nt, Human
cauuccugaugcuucuucagag

SEQ ID NO: 1531986 - RNA, 23 nt, Human
cauuccugaugcuucuucagaga

SEQ ID NO: 1531987 - RNA, 13 nt, Human
cauucuggaauaa

SEQ ID NO: 1531988 - RNA, 17 nt, Human
cauucuguuaaucauua

SEQ ID NO: 1531989 - RNA, 12 nt, Human
cauucugccugc

SEQ ID NO: 1531990 - RNA, 13 nt, Human
cauucugccugcc

SEQ ID NO: 1531991 - RNA, 15 nt, Human
cauucugccugccca

SEQ ID NO: 1531992 - RNA, 16 nt, Human
cauucugccugcccag

SEQ ID NO: 1531993 - RNA, 17 nt, Human
cauucugccugcccagg

SEQ ID NO: 1531994 - RNA, 18 nt, Human
cauucugccugcccaggc

SEQ ID NO: 1531995 - RNA, 19 nt, Human
cauucugccugcccaggcc

SEQ ID NO: 1531996 - RNA, 20 nt, Human
cauucugccugcccaggccc

SEQ ID NO: 1531997 - RNA, 23 nt, Human
cauucuucuguacgucugacagg

SEQ ID NO: 1531998 - RNA, 23 nt, Human
cauuuuauuuuauuaugcaugaa

SEQ ID NO: 1531999 - RNA, 21 nt, Human
cauuuuuaagugcugcauuua

SEQ ID NO: 1532000 - RNA, 18 nt, Human
cauuuuuaguagagacag

SEQ ID NO: 1532001 - RNA, 14 nt, Human
cauuuuuaccauua

SEQ ID NO: 1532002 - RNA, 17 nt, Human
cauuuuuaguagagaca

SEQ ID NO: 1532003 - RNA, 16 nt, Human
ccaaacccuucagugc

SEQ ID NO: 1532004 - RNA, 15 nt, Human
cauuuaaaaaaaauc

SEQ ID NO: 1532005 - RNA, 20 nt, Human
cauuguacgaagaguauuuu

SEQ ID NO: 1532006 - RNA, 15 nt, Human
cauugugggaagggg

SEQ ID NO: 1532007 - RNA, 19 nt, Human
cauuguacgaagaguauuu

SEQ ID NO: 1532008 - RNA, 18 nt, Human
cauugaccugaggcccuu

SEQ ID NO: 1532009 - RNA, 15 nt, Human
cauugaccugaggcc

SEQ ID NO: 1532010 - RNA, 17 nt, Human
cauugaccugaggcccu

SEQ ID NO: 1532011 - RNA, 19 nt, Human
cauuugaaaauuuugaugu

SEQ ID NO: 1532012 - RNA, 17 nt, Human
cauuugaaaauuuugau

SEQ ID NO: 1532013 - RNA, 20 nt, Human
caugugcuaguaauuggaaa

SEQ ID NO: 1532014 - RNA, 14 nt, Human
caugugcacaugca

SEQ ID NO: 1532015 - RNA, 12 nt, Human
caugucuggcua

SEQ ID NO: 1532016 - RNA, 15 nt, Human
caugugaugagagga

SEQ ID NO: 1532017 - RNA, 16 nt, Human
caugugaugagaggaa

SEQ ID NO: 1532018 - RNA, 17 nt, Human
caugugaugagaggaaa

SEQ ID NO: 1532019 - RNA, 18 nt, Human
caugugaugagaggaaau

SEQ ID NO: 1532020 - RNA, 20 nt, Human
caugugaugagaggaaauca

SEQ ID NO: 1532021 - RNA, 21 nt, Human
caugugaugagaggaaaucac

SEQ ID NO: 1532022 - RNA, 23 nt, Human
cauggucggaaaacaugcuacac

SEQ ID NO: 1532023 - RNA, 19 nt, Human
cauggucggaaaacaugcu

SEQ ID NO: 1532024 - RNA, 17 nt, Human
cauggucggaaaacaug

SEQ ID NO: 1532025 - RNA, 14 nt, Human
cauguuugugauug

SEQ ID NO: 1532026 - RNA, 12 nt, Human
cauguuugugau

SEQ ID NO: 1532027 - RNA, 15 nt, Human
cauguuugugauuga

SEQ ID NO: 1532028 - RNA, 21 nt, Human
cauuaaaaaaucaguuguaca

SEQ ID NO: 1532029 - RNA, 19 nt, Human
cauguuuuucuucucccuc

SEQ ID NO: 1532030 - RNA, 20 nt, Human
cauguuuuucuucucccuca

SEQ ID NO: 1532031 - RNA, 15 nt, Human
caugcuguucaugaa

SEQ ID NO: 1532032 - RNA, 17 nt, Human
caugcugucccuuacgu

SEQ ID NO: 1532033 - RNA, 13 nt, Human
caugcugucccuu

SEQ ID NO: 1532034 - RNA, 15 nt, Human
caugcugucccuuac

SEQ ID NO: 1532035 - RNA, 17 nt, Human
caugcgggcuuccuccu

SEQ ID NO: 1532036 - RNA, 20 nt, Human
cauggaauuggagcucgugg

SEQ ID NO: 1532037 - RNA, 16 nt, Human
caugcuguucaugaaa

SEQ ID NO: 1532038 - RNA, 18 nt, Human
caugcuguucaugaaaga

SEQ ID NO: 1532039 - RNA, 15 nt, Human
cauggacuuccacug

SEQ ID NO: 1532040 - RNA, 23 nt, Human
cauggcauauuuuucacauaucu

SEQ ID NO: 1532041 - RNA, 15 nt, Human
cauggcauauuuuuc

SEQ ID NO: 1532042 - RNA, 19 nt, Human
cauggcauauuuuucacau

SEQ ID NO: 1532043 - RNA, 13 nt, Human
cauggcauauuuu

SEQ ID NO: 1532044 - RNA, 18 nt, Human
caugggccuccugugugu

SEQ ID NO: 1532045 - RNA, 13 nt, Human
caugaguccccug

SEQ ID NO: 1532046 - RNA, 19 nt, Human
caugagguacugagaguga

SEQ ID NO: 1532047 - RNA, 23 nt, Human
caugaguccccuguuuguuucug

SEQ ID NO: 1532048 - RNA, 14 nt, Human
caugaguccccugu

SEQ ID NO: 1532049 - RNA, 15 nt, Human
caugaguccccuguu

SEQ ID NO: 1532050 - RNA, 23 nt, Human
caugaggaacaaggcaaggcugu

SEQ ID NO: 1532051 - RNA, 16 nt, Human
caugagguacugagag

SEQ ID NO: 1532052 - RNA, 22 nt, Human
caugagccucagcauccuggca

SEQ ID NO: 1532053 - RNA, 23 nt, Human
caugagccucagcauccuggcac

SEQ ID NO: 1532054 - RNA, 16 nt, Human
caugaggaacaaggca

SEQ ID NO: 1532055 - RNA, 17 nt, Human
caugaggaacaaggcaa

SEQ ID NO: 1532056 - RNA, 20 nt, Human
caugaggaacaaggcaaggc

SEQ ID NO: 1532057 - RNA, 21 nt, Human
caugaggaacaaggcaaggcu

SEQ ID NO: 1532058 - RNA, 18 nt, Human
caugaagauguagaggag

SEQ ID NO: 1532059 - RNA, 19 nt, Human
caugaagauguagaggaga

SEQ ID NO: 1532060 - RNA, 13 nt, Human
caugagcaucagg

SEQ ID NO: 1532061 - RNA, 15 nt, Human
caugagcaucaggcc

SEQ ID NO: 1532062 - RNA, 16 nt, Human
caugagcaucaggcca

SEQ ID NO: 1532063 - RNA, 17 nt, Human
caugagcaucaggccag

SEQ ID NO: 1532064 - RNA, 18 nt, Human
caugagcaucaggccagg

SEQ ID NO: 1532065 - RNA, 20 nt, Human
caugagcaucaggccaggcc

SEQ ID NO: 1532066 - RNA, 21 nt, Human
caugagcaucaggccaggccc

SEQ ID NO: 1532067 - RNA, 22 nt, Human
caugagcaucaggccaggcccu

SEQ ID NO: 1532068 - RNA, 23 nt, Human
caugagcaucaggccaggcccuc

SEQ ID NO: 1532069 - RNA, 12 nt, Human
caugagccucag

SEQ ID NO: 1532070 - RNA, 15 nt, Human
caugagccucagcau

SEQ ID NO: 1532071 - RNA, 17 nt, Human
caugagccucagcaucc

SEQ ID NO: 1532072 - RNA, 18 nt, Human
caugagccucagcauccu

SEQ ID NO: 1532073 - RNA, 19 nt, Human
caugagccucagcauccug

SEQ ID NO: 1532074 - RNA, 20 nt, Human
caugagccucagcauccugg

SEQ ID NO: 1532075 - RNA, 21 nt, Human
caugagccucagcauccuggc

SEQ ID NO: 1532076 - RNA, 14 nt, Human
caugaaagauucaa

SEQ ID NO: 1532077 - RNA, 13 nt, Human
caugaaaaugcaa

SEQ ID NO: 1532078 - RNA, 15 nt, Human
caugaaaaugcaaca

SEQ ID NO: 1532079 - RNA, 22 nt, Human
caugaaaaugcaacaacaugua

SEQ ID NO: 1532080 - RNA, 21 nt, Human
caugaaaacacauuuuucuua

SEQ ID NO: 1532081 - RNA, 19 nt, Human
caugaaaacacauuuuucu

SEQ ID NO: 1532082 - RNA, 12 nt, Human
caugaagacaga

SEQ ID NO: 1532083 - RNA, 17 nt, Human
caugaaaacacauuuuu

SEQ ID NO: 1532084 - RNA, 16 nt, Human
caugaaaacacauuuu

SEQ ID NO: 1532085 - RNA, 15 nt, Human
caugaaaacacauuu

SEQ ID NO: 1532086 - RNA, 14 nt, Human
caugaaaacacauu

SEQ ID NO: 1532087 - RNA, 13 nt, Human
caugaaaacacau

SEQ ID NO: 1532088 - RNA, 21 nt, Human
caucuuuucuugccucugucc

SEQ ID NO: 1532089 - RNA, 14 nt, Human
caucuuuucuugcc

SEQ ID NO: 1532090 - RNA, 16 nt, Human
caucuuuucuugccuc

SEQ ID NO: 1532091 - RNA, 19 nt, Human
caucuugcucugcugacag

SEQ ID NO: 1532092 - RNA, 16 nt, Human
caucuugcucugcuga

SEQ ID NO: 1532093 - RNA, 17 nt, Human
caucuugcucugcugac

SEQ ID NO: 1532094 - RNA, 16 nt, Human
caucuugaauuguaag

SEQ ID NO: 1532095 - RNA, 21 nt, Human
caucuugaauuguaaggaaug

SEQ ID NO: 1532096 - RNA, 16 nt, Human
caucucuacaaaaagc

SEQ ID NO: 1532097 - RNA, 15 nt, Human
caucucuccuccuuu

SEQ ID NO: 1532098 - RNA, 14 nt, Human
caucucucuuuaau

SEQ ID NO: 1532099 - RNA, 17 nt, Human
caucugacuaugacaua

SEQ ID NO: 1532100 - RNA, 16 nt, Human
caucauccuaagcuau

SEQ ID NO: 1532101 - RNA, 13 nt, Human
caucaugucuggc

SEQ ID NO: 1532102 - RNA, 14 nt, Human
caucaugucuggcu

SEQ ID NO: 1532103 - RNA, 15 nt, Human
caucaugucuggcua

SEQ ID NO: 1532104 - RNA, 12 nt, Human
caucacccgcua

SEQ ID NO: 1532105 - RNA, 18 nt, Human
caucccuuaccugggaaa

SEQ ID NO: 1532106 - RNA, 15 nt, Human
caucccucuggggcu

SEQ ID NO: 1532107 - RNA, 14 nt, Human
cauccacugugcca

SEQ ID NO: 1532108 - RNA, 17 nt, Human
cauccacugugccaugu

SEQ ID NO: 1532109 - RNA, 23 nt, Human
cauccacugugccaugugccagg

SEQ ID NO: 1532110 - RNA, 21 nt, Human
cauauugauuuccguuaaaau

SEQ ID NO: 1532111 - RNA, 21 nt, Human
cauaucuaguaugaaauuaua

SEQ ID NO: 1532112 - RNA, 17 nt, Human
cauauugauuuccguua

SEQ ID NO: 1532113 - RNA, 22 nt, Human
cauauucuguuggccaguguga

SEQ ID NO: 1532114 - RNA, 15 nt, Human
cauauauaacaaugc

SEQ ID NO: 1532115 - RNA, 20 nt, Human
cauauauaacaaugcuguau

SEQ ID NO: 1532116 - RNA, 15 nt, Human
cauaucuaguaugaa

SEQ ID NO: 1532117 - RNA, 17 nt, Human
cauaucuaguaugaaau

SEQ ID NO: 1532118 - RNA, 18 nt, Human
cauaucuaguaugaaauu

SEQ ID NO: 1532119 - RNA, 13 nt, Human
cauauauaacaau

SEQ ID NO: 1532120 - RNA, 23 nt, Human
cauauaagauucauauuuacuuc

SEQ ID NO: 1532121 - RNA, 19 nt, Human
cagugcuugauugcgugga

SEQ ID NO: 1532122 - RNA, 16 nt, Human
cauaguaugguggcug

SEQ ID NO: 1532123 - RNA, 17 nt, Human
cauaguaugguggcugg

SEQ ID NO: 1532124 - RNA, 15 nt, Human
cauaguaugguggcu

SEQ ID NO: 1532125 - RNA, 14 nt, Human
caucaacaucuugg

SEQ ID NO: 1532126 - RNA, 20 nt, Human
caggucauauuaauauauuu

SEQ ID NO: 1532127 - RNA, 21 nt, Human
caggucauauuaauauauuuc

SEQ ID NO: 1532128 - RNA, 20 nt, Human
cagguaugaccuucuaggaa

SEQ ID NO: 1532129 - RNA, 19 nt, Human
cagguagaacacaagguca

SEQ ID NO: 1532130 - RNA, 20 nt, Human
cagguaacaggcagauacag

SEQ ID NO: 1532131 - RNA, 21 nt, Human
cagguaacaggcagauacagg

SEQ ID NO: 1532132 - RNA, 18 nt, Human
caggucuugaacuccugg

SEQ ID NO: 1532133 - RNA, 19 nt, Human
caggucuugaacuccuggc

SEQ ID NO: 1532134 - RNA, 20 nt, Human
caggucuugaacuccuggcc

SEQ ID NO: 1532135 - RNA, 21 nt, Human
caggucuugaacuccuggccu

SEQ ID NO: 1532136 - RNA, 22 nt, Human
caggucuugaacuccuggccuc

SEQ ID NO: 1532137 - RNA, 23 nt, Human
caggucuugaacuccuggccuca

SEQ ID NO: 1532138 - RNA, 21 nt, Human
caggugagaagcagaggaagg

SEQ ID NO: 1532139 - RNA, 13 nt, Human
caggugagaagca

SEQ ID NO: 1532140 - RNA, 20 nt, Human
caggugagaagcagaggaag

SEQ ID NO: 1532141 - RNA, 14 nt, Human
caggggugggacac

SEQ ID NO: 1532142 - RNA, 15 nt, Human
caggggugggacacc

SEQ ID NO: 1532143 - RNA, 20 nt, Human
caggggugggacacccugug

SEQ ID NO: 1532144 - RNA, 21 nt, Human
caggggugggacacccuguga

SEQ ID NO: 1532145 - RNA, 16 nt, Human
caggguuuugccaugu

SEQ ID NO: 1532146 - RNA, 17 nt, Human
cagggucucacucuguc

SEQ ID NO: 1532147 - RNA, 16 nt, Human
cagggucucacucugu

SEQ ID NO: 1532148 - RNA, 14 nt, Human
cagguaacaggcag

SEQ ID NO: 1532149 - RNA, 15 nt, Human
cagguaacaggcaga

SEQ ID NO: 1532150 - RNA, 16 nt, Human
cagguaacaggcagau

SEQ ID NO: 1532151 - RNA, 17 nt, Human
cagguaacaggcagaua

SEQ ID NO: 1532152 - RNA, 23 nt, Human
cagggucccugguggcagcucac

SEQ ID NO: 1532153 - RNA, 18 nt, Human
caggguccuguagcccua

SEQ ID NO: 1532154 - RNA, 21 nt, Human
cagggucucacuauguugccc

SEQ ID NO: 1532155 - RNA, 22 nt, Human
cagggucucacuauguugccca

SEQ ID NO: 1532156 - RNA, 23 nt, Human
cagggucucacuauguugcccag

SEQ ID NO: 1532157 - RNA, 15 nt, Human
cagggucucacucug

SEQ ID NO: 1532158 - RNA, 21 nt, Human
caggguauuccagagugggga

SEQ ID NO: 1532159 - RNA, 20 nt, Human
caggguauuccagagugggg

SEQ ID NO: 1532160 - RNA, 12 nt, Human
cagggucccugg

SEQ ID NO: 1532161 - RNA, 14 nt, Human
cagggucccuggug

SEQ ID NO: 1532162 - RNA, 15 nt, Human
cagggucccuggugg

SEQ ID NO: 1532163 - RNA, 18 nt, Human
cagggucccugguggcag

SEQ ID NO: 1532164 - RNA, 19 nt, Human
cagggucccugguggcagc

SEQ ID NO: 1532165 - RNA, 22 nt, Human
cagggucccugguggcagcuca

SEQ ID NO: 1532166 - RNA, 21 nt, Human
caguaaaugggggugcauuug

SEQ ID NO: 1532167 - RNA, 22 nt, Human
caguaaaugggggugcauuuga

SEQ ID NO: 1532168 - RNA, 12 nt, Human
cagguucagcuu

SEQ ID NO: 1532169 - RNA, 13 nt, Human
cagguucagcuug

SEQ ID NO: 1532170 - RNA, 12 nt, Human
caguaauaacuc

SEQ ID NO: 1532171 - RNA, 13 nt, Human
caguaauaacucu

SEQ ID NO: 1532172 - RNA, 22 nt, Human
caggugugagucaccaagccca

SEQ ID NO: 1532173 - RNA, 23 nt, Human
caggugugagucaccaagcccag

SEQ ID NO: 1532174 - RNA, 16 nt, Human
caggugugagucacca

SEQ ID NO: 1532175 - RNA, 20 nt, Human
caggugugagucaccaagcc

SEQ ID NO: 1532176 - RNA, 21 nt, Human
caggugugagucaccaagccc

SEQ ID NO: 1532177 - RNA, 16 nt, Human
caggugugaaccacca

SEQ ID NO: 1532178 - RNA, 19 nt, Human
caggugugaaccaccacac

SEQ ID NO: 1532179 - RNA, 22 nt, Human
caggugugaaccaccacaccca

SEQ ID NO: 1532180 - RNA, 23 nt, Human
caggugugaaccaccacacccag

SEQ ID NO: 1532181 - RNA, 16 nt, Human
caggugucccugcacu

SEQ ID NO: 1532182 - RNA, 15 nt, Human
caggugucccugcac

SEQ ID NO: 1532183 - RNA, 18 nt, Human
caggugucccugcacuug

SEQ ID NO: 1532184 - RNA, 19 nt, Human
caggugucccugcacuugc

SEQ ID NO: 1532185 - RNA, 12 nt, Human
caggugugaacc

SEQ ID NO: 1532186 - RNA, 13 nt, Human
cagguggggcagc

SEQ ID NO: 1532187 - RNA, 14 nt, Human
cagguggggcagcu

SEQ ID NO: 1532188 - RNA, 15 nt, Human
cagguggggcagcuu

SEQ ID NO: 1532189 - RNA, 16 nt, Human
cagguggggcagcuug

SEQ ID NO: 1532190 - RNA, 17 nt, Human
cagguggggcagcuuga

SEQ ID NO: 1532191 - RNA, 18 nt, Human
cagguggggucacucugg

SEQ ID NO: 1532192 - RNA, 23 nt, Human
cagguggggucacucuggcagcu

SEQ ID NO: 1532193 - RNA, 18 nt, Human
caggugguuauggagagg

SEQ ID NO: 1532194 - RNA, 19 nt, Human
cagguggggucacucuggc

SEQ ID NO: 1532195 - RNA, 20 nt, Human
cagguggggucacucuggca

SEQ ID NO: 1532196 - RNA, 21 nt, Human
cagguggggucacucuggcag

SEQ ID NO: 1532197 - RNA, 22 nt, Human
cagguggggucacucuggcagc

SEQ ID NO: 1532198 - RNA, 20 nt, Human
caggugguuauggagagggu

SEQ ID NO: 1532199 - RNA, 11 nt, Human
caggugucccu

SEQ ID NO: 1532200 - RNA, 14 nt, Human
caggugucccugca

SEQ ID NO: 1532201 - RNA, 15 nt, Human
cagucaggaaagaga

SEQ ID NO: 1532202 - RNA, 18 nt, Human
cagucaggaaagagaacu

SEQ ID NO: 1532203 - RNA, 22 nt, Human
cagucaggaaagagaacuucca

SEQ ID NO: 1532204 - RNA, 16 nt, Human
caguauuacuucugcu

SEQ ID NO: 1532205 - RNA, 18 nt, Human
caguauuacuucugcuac

SEQ ID NO: 1532206 - RNA, 19 nt, Human
caguauuacuucugcuaca

SEQ ID NO: 1532207 - RNA, 17 nt, Human
cagucauucagauauga

SEQ ID NO: 1532208 - RNA, 20 nt, Human
cagucauucagauaugauuc

SEQ ID NO: 1532209 - RNA, 16 nt, Human
caguccauagcagaga

SEQ ID NO: 1532210 - RNA, 13 nt, Human
caguccaugaaga

SEQ ID NO: 1532211 - RNA, 14 nt, Human
caguccauugaaag

SEQ ID NO: 1532212 - RNA, 12 nt, Human
caguagugauag

SEQ ID NO: 1532213 - RNA, 21 nt, Human
caguaucuugaagacuuuucu

SEQ ID NO: 1532214 - RNA, 12 nt, Human
caguauggcagc

SEQ ID NO: 1532215 - RNA, 15 nt, Human
caguaucucagggcc

SEQ ID NO: 1532216 - RNA, 12 nt, Human
caguaucuugaa

SEQ ID NO: 1532217 - RNA, 18 nt, Human
caguaucuugaagacuuu

SEQ ID NO: 1532218 - RNA, 13 nt, Human
caguaucucaggg

SEQ ID NO: 1532219 - RNA, 17 nt, Human
cagucccugccaaugga

SEQ ID NO: 1532220 - RNA, 12 nt, Human
caguccucccau

SEQ ID NO: 1532221 - RNA, 13 nt, Human
caguccucccauc

SEQ ID NO: 1532222 - RNA, 14 nt, Human
caguccucccaucu

SEQ ID NO: 1532223 - RNA, 15 nt, Human
caguccucccaucuc

SEQ ID NO: 1532224 - RNA, 12 nt, Human
cagucccugcca

SEQ ID NO: 1532225 - RNA, 13 nt, Human
cagucccugccaa

SEQ ID NO: 1532226 - RNA, 14 nt, Human
cagucccugccaau

SEQ ID NO: 1532227 - RNA, 15 nt, Human
cagucccugccaaug

SEQ ID NO: 1532228 - RNA, 16 nt, Human
cagucccugccaaugg

SEQ ID NO: 1532229 - RNA, 20 nt, Human
cagugaaagaaaauaacaau

SEQ ID NO: 1532230 - RNA, 16 nt, Human
cagugaaagaaaauaa

SEQ ID NO: 1532231 - RNA, 19 nt, Human
cagucuggaaugcaguggu

SEQ ID NO: 1532232 - RNA, 16 nt, Human
caguccucccaucuca

SEQ ID NO: 1532233 - RNA, 17 nt, Human
caguccucccaucucac

SEQ ID NO: 1532234 - RNA, 15 nt, Human
caguccuuaccagca

SEQ ID NO: 1532235 - RNA, 18 nt, Human
caguccuuaccagcagag

SEQ ID NO: 1532236 - RNA, 19 nt, Human
caguccuuaccagcagagc

SEQ ID NO: 1532237 - RNA, 20 nt, Human
caguccuuaccagcagagca

SEQ ID NO: 1532238 - RNA, 21 nt, Human
caguccuuaccagcagagcac

SEQ ID NO: 1532239 - RNA, 12 nt, Human
cagugaauucuu

SEQ ID NO: 1532240 - RNA, 13 nt, Human
cagugaaagcauc

SEQ ID NO: 1532241 - RNA, 14 nt, Human
cagugaaagcauca

SEQ ID NO: 1532242 - RNA, 15 nt, Human
cagugagacagcucu

SEQ ID NO: 1532243 - RNA, 24 nt, Human
cagugagccgagauugcaccacug

SEQ ID NO: 1532244 - RNA, 12 nt, Human
cagugaggcucu

SEQ ID NO: 1532245 - RNA, 13 nt, Human
cagugaggcucug

SEQ ID NO: 1532246 - RNA, 14 nt, Human
cagugaggcucugc

SEQ ID NO: 1532247 - RNA, 15 nt, Human
cagugaggcucugcc

SEQ ID NO: 1532248 - RNA, 16 nt, Human
cagugaggcucugccc

SEQ ID NO: 1532249 - RNA, 21 nt, Human
cagugaggcucugcccuuggu

SEQ ID NO: 1532250 - RNA, 17 nt, Human
cagugagucgaggacag

SEQ ID NO: 1532251 - RNA, 18 nt, Human
cagugagucgaggacagg

SEQ ID NO: 1532252 - RNA, 17 nt, Human
cagugaggcucugcccu

SEQ ID NO: 1532253 - RNA, 18 nt, Human
cagugaggcucugcccuu

SEQ ID NO: 1532254 - RNA, 19 nt, Human
cagugaggcucugcccuug

SEQ ID NO: 1532255 - RNA, 20 nt, Human
cagugaggcucugcccuugg

SEQ ID NO: 1532256 - RNA, 17 nt, Human
cagugauuaccagggac

SEQ ID NO: 1532257 - RNA, 18 nt, Human
cagugauuaccagggacu

SEQ ID NO: 1532258 - RNA, 22 nt, Human
cagugauuaccagggacugagg

SEQ ID NO: 1532259 - RNA, 19 nt, Human
cagugagucgaggacaggg

SEQ ID NO: 1532260 - RNA, 20 nt, Human
cagugagucgaggacaggga

SEQ ID NO: 1532261 - RNA, 22 nt, Human
cagugagucgaggacagggagg

SEQ ID NO: 1532262 - RNA, 23 nt, Human
cagugagucgaggacagggaggu

SEQ ID NO: 1532263 - RNA, 15 nt, Human
cagugccgagaagga

SEQ ID NO: 1532264 - RNA, 18 nt, Human
cagugccgagaaggaagc

SEQ ID NO: 1532265 - RNA, 11 nt, Human
cagugccuuau

SEQ ID NO: 1532266 - RNA, 13 nt, Human
cagugccuuaugg

SEQ ID NO: 1532267 - RNA, 15 nt, Human
cagugccuuauggaa

SEQ ID NO: 1532268 - RNA, 16 nt, Human
cagugccuuauggaac

SEQ ID NO: 1532269 - RNA, 17 nt, Human
cagugccuuauggaaca

SEQ ID NO: 1532270 - RNA, 18 nt, Human
cagugccuuauggaacac

SEQ ID NO: 1532271 - RNA, 19 nt, Human
cagugccuuauggaacacu

SEQ ID NO: 1532272 - RNA, 20 nt, Human
cagugccuuauggaacacuc

SEQ ID NO: 1532273 - RNA, 21 nt, Human
cagugccuuauggaacacucu

SEQ ID NO: 1532274 - RNA, 22 nt, Human
cagugccuuauggaacacucug

SEQ ID NO: 1532275 - RNA, 23 nt, Human
cagugccuuauggaacacucuga

SEQ ID NO: 1532276 - RNA, 11 nt, Human
caggggacagg

SEQ ID NO: 1532277 - RNA, 16 nt, Human
caggggacaggauggu

SEQ ID NO: 1532278 - RNA, 16 nt, Human
cagggccuggcucagg

SEQ ID NO: 1532279 - RNA, 19 nt, Human
cagggccuggcucaggugg

SEQ ID NO: 1532280 - RNA, 13 nt, Human
cagggccuggcuc

SEQ ID NO: 1532281 - RNA, 14 nt, Human
cagggccuggcuca

SEQ ID NO: 1532282 - RNA, 15 nt, Human
cagggccuggcucag

SEQ ID NO: 1532283 - RNA, 17 nt, Human
caggggccggccagugg

SEQ ID NO: 1532284 - RNA, 22 nt, Human
caggggccggccaguggccuuc

SEQ ID NO: 1532285 - RNA, 19 nt, Human
caggggaggguagagcgga

SEQ ID NO: 1532286 - RNA, 13 nt, Human
caggggaggggug

SEQ ID NO: 1532287 - RNA, 23 nt, Human
cagggacagaggggguggccucc

SEQ ID NO: 1532288 - RNA, 18 nt, Human
cagggacaggauaagagg

SEQ ID NO: 1532289 - RNA, 14 nt, Human
cagggcacaccggg

SEQ ID NO: 1532290 - RNA, 22 nt, Human
cagggcacaccgggcacucaga

SEQ ID NO: 1532291 - RNA, 23 nt, Human
cagggcacaccgggcacucagaa

SEQ ID NO: 1532292 - RNA, 15 nt, Human
cagggcacaccgggc

SEQ ID NO: 1532293 - RNA, 17 nt, Human
cagggcacaccgggcac

SEQ ID NO: 1532294 - RNA, 19 nt, Human
cagggcacaccgggcacuc

SEQ ID NO: 1532295 - RNA, 21 nt, Human
cagggcacaccgggcacucag

SEQ ID NO: 1532296 - RNA, 17 nt, Human
cagggcauggcugggaa

SEQ ID NO: 1532297 - RNA, 16 nt, Human
cagggccagugcaguu

SEQ ID NO: 1532298 - RNA, 13 nt, Human
cagggacagaggg

SEQ ID NO: 1532299 - RNA, 14 nt, Human
cagggacagagggg

SEQ ID NO: 1532300 - RNA, 20 nt, Human
cagggacagaggggguggcc

SEQ ID NO: 1532301 - RNA, 22 nt, Human
cagggaaacagcuaaugggaca

SEQ ID NO: 1532302 - RNA, 13 nt, Human
caggcuagaugua

SEQ ID NO: 1532303 - RNA, 19 nt, Human
caggcuagauguauguacu

SEQ ID NO: 1532304 - RNA, 14 nt, Human
caggcuacugucag

SEQ ID NO: 1532305 - RNA, 14 nt, Human
caggcuccuuuagc

SEQ ID NO: 1532306 - RNA, 19 nt, Human
caggcuccuuuagcgccca

SEQ ID NO: 1532307 - RNA, 20 nt, Human
caggcuccuuuagcgcccag

SEQ ID NO: 1532308 - RNA, 21 nt, Human
caggcuccuuuagcgcccagu

SEQ ID NO: 1532309 - RNA, 20 nt, Human
caggcucgggcuccccagcc

SEQ ID NO: 1532310 - RNA, 12 nt, Human
caggcucucagg

SEQ ID NO: 1532311 - RNA, 13 nt, Human
caggcucucaggc

SEQ ID NO: 1532312 - RNA, 14 nt, Human
caggcucucaggcc

SEQ ID NO: 1532313 - RNA, 15 nt, Human
caggcucucaggcca

SEQ ID NO: 1532314 - RNA, 16 nt, Human
caggcucucaggccag

SEQ ID NO: 1532315 - RNA, 21 nt, Human
caggcucucaggccagcugcu

SEQ ID NO: 1532316 - RNA, 23 nt, Human
caggcucucaggccagcugcuug

SEQ ID NO: 1532317 - RNA, 17 nt, Human
caggcucucaggccagc

SEQ ID NO: 1532318 - RNA, 18 nt, Human
caggcucucaggccagcu

SEQ ID NO: 1532319 - RNA, 19 nt, Human
caggcucucaggccagcug

SEQ ID NO: 1532320 - RNA, 20 nt, Human
caggcucucaggccagcugc

SEQ ID NO: 1532321 - RNA, 16 nt, Human
caggcccucugcccac

SEQ ID NO: 1532322 - RNA, 17 nt, Human
caggcccucugcccacu

SEQ ID NO: 1532323 - RNA, 19 nt, Human
caggcccucugcccacucc

SEQ ID NO: 1532324 - RNA, 20 nt, Human
caggcccucugcccacuccc

SEQ ID NO: 1532325 - RNA, 21 nt, Human
caggcccucugcccacucccu

SEQ ID NO: 1532326 - RNA, 22 nt, Human
caggcccucugcccacucccug

SEQ ID NO: 1532327 - RNA, 22 nt, Human
caggcccggcuccaggcuccuu

SEQ ID NO: 1532328 - RNA, 20 nt, Human
caggcccggcuccaggcucc

SEQ ID NO: 1532329 - RNA, 21 nt, Human
caggcccggcuccaggcuccu

SEQ ID NO: 1532330 - RNA, 13 nt, Human
caggcccucugcc

SEQ ID NO: 1532331 - RNA, 14 nt, Human
caggcccucugccc

SEQ ID NO: 1532332 - RNA, 15 nt, Human
caggcccucugccca

SEQ ID NO: 1532333 - RNA, 17 nt, Human
caggcccggcuccaggc

SEQ ID NO: 1532334 - RNA, 18 nt, Human
caggcccggcuccaggcu

SEQ ID NO: 1532335 - RNA, 19 nt, Human
caggcccggcuccaggcuc

SEQ ID NO: 1532336 - RNA, 16 nt, Human
caggcuuagggacagg

SEQ ID NO: 1532337 - RNA, 17 nt, Human
caggcuuagggacagga

SEQ ID NO: 1532338 - RNA, 22 nt, Human
caggcuuagucacugagacagc

SEQ ID NO: 1532339 - RNA, 23 nt, Human
caggcuuagucacugagacagcc

SEQ ID NO: 1532340 - RNA, 16 nt, Human
cagggaaacagcuaau

SEQ ID NO: 1532341 - RNA, 22 nt, Human
caggcuguaucccaugagccuc

SEQ ID NO: 1532342 - RNA, 23 nt, Human
caggcuguaucccaugagccuca

SEQ ID NO: 1532343 - RNA, 16 nt, Human
caggcuuagucacuga

SEQ ID NO: 1532344 - RNA, 17 nt, Human
caggcuuagucacugag

SEQ ID NO: 1532345 - RNA, 20 nt, Human
caggcuuagucacugagaca

SEQ ID NO: 1532346 - RNA, 21 nt, Human
caggcuuagucacugagacag

SEQ ID NO: 1532347 - RNA, 12 nt, Human
caggcuggucuc

SEQ ID NO: 1532348 - RNA, 19 nt, Human
caggcuggucucaaacucu

SEQ ID NO: 1532349 - RNA, 14 nt, Human
caggcuguauccca

SEQ ID NO: 1532350 - RNA, 20 nt, Human
caggcuguaucccaugagcc

SEQ ID NO: 1532351 - RNA, 21 nt, Human
caggcuguaucccaugagccu

SEQ ID NO: 1532352 - RNA, 13 nt, Human
caggcagguccag

SEQ ID NO: 1532353 - RNA, 16 nt, Human
caggcagccaggccac

SEQ ID NO: 1532354 - RNA, 17 nt, Human
caggcagccaggccaca

SEQ ID NO: 1532355 - RNA, 16 nt, Human
caggauuuuaaucuuu

SEQ ID NO: 1532356 - RNA, 20 nt, Human
caggauucuuccucccuccc

SEQ ID NO: 1532357 - RNA, 14 nt, Human
caggcaaugcuggc

SEQ ID NO: 1532358 - RNA, 14 nt, Human
caggcagccaggcc

SEQ ID NO: 1532359 - RNA, 15 nt, Human
caggcagccaggcca

SEQ ID NO: 1532360 - RNA, 14 nt, Human
caggcaagcaccuc

SEQ ID NO: 1532361 - RNA, 15 nt, Human
caggcaagcaccucc

SEQ ID NO: 1532362 - RNA, 16 nt, Human
caggcaagcaccuccu

SEQ ID NO: 1532363 - RNA, 21 nt, Human
caggcaagcaccuccugccuc

SEQ ID NO: 1532364 - RNA, 17 nt, Human
caggcaugguggcccac

SEQ ID NO: 1532365 - RNA, 14 nt, Human
caggcagguccagg

SEQ ID NO: 1532366 - RNA, 15 nt, Human
caggcagguccaggg

SEQ ID NO: 1532367 - RNA, 19 nt, Human
caggcagguccaggguuug

SEQ ID NO: 1532368 - RNA, 12 nt, Human
caggcaggucuu

SEQ ID NO: 1532369 - RNA, 13 nt, Human
caggcaggucuug

SEQ ID NO: 1532370 - RNA, 22 nt, Human
caggcaggucuugaacuccugg

SEQ ID NO: 1532371 - RNA, 23 nt, Human
caggcaggucuugaacuccuggc

SEQ ID NO: 1532372 - RNA, 15 nt, Human
caggcaggugggaug

SEQ ID NO: 1532373 - RNA, 24 nt, Human
caggcauuccccaggaggccagcc

SEQ ID NO: 1532374 - RNA, 22 nt, Human
caggcauuccccaggaggccag

SEQ ID NO: 1532375 - RNA, 23 nt, Human
caggcauuccccaggaggccagc

SEQ ID NO: 1532376 - RNA, 18 nt, Human
caggcauuccccaggagg

SEQ ID NO: 1532377 - RNA, 19 nt, Human
caggcauuccccaggaggc

SEQ ID NO: 1532378 - RNA, 20 nt, Human
caggcauuccccaggaggcc

SEQ ID NO: 1532379 - RNA, 21 nt, Human
caggcauuccccaggaggcca

SEQ ID NO: 1532380 - RNA, 15 nt, Human
caggcauguucucug

SEQ ID NO: 1532381 - RNA, 18 nt, Human
caggcauguucucugagg

SEQ ID NO: 1532382 - RNA, 19 nt, Human
caggcauguucucugagga

SEQ ID NO: 1532383 - RNA, 20 nt, Human
caggcauguucucugaggac

SEQ ID NO: 1532384 - RNA, 13 nt, Human
caggcauucccca

SEQ ID NO: 1532385 - RNA, 15 nt, Human
caggcauuccccagg

SEQ ID NO: 1532386 - RNA, 16 nt, Human
caggcauuccccagga

SEQ ID NO: 1532387 - RNA, 17 nt, Human
caggcauuccccaggag

SEQ ID NO: 1532388 - RNA, 21 nt, Human
caggauauucucacagcucca

SEQ ID NO: 1532389 - RNA, 13 nt, Human
caggaucagucug

SEQ ID NO: 1532390 - RNA, 14 nt, Human
caggaucagucuga

SEQ ID NO: 1532391 - RNA, 23 nt, Human
caggauggccgggcgcgguggcu

SEQ ID NO: 1532392 - RNA, 21 nt, Human
caggaugguucccuugaugaa

SEQ ID NO: 1532393 - RNA, 23 nt, Human
caggaugguucccuugaugaaga

SEQ ID NO: 1532394 - RNA, 17 nt, Human
caggauucuuccucccu

SEQ ID NO: 1532395 - RNA, 18 nt, Human
caggauucuuccucccuc

SEQ ID NO: 1532396 - RNA, 14 nt, Human
caggcccccaggug

SEQ ID NO: 1532397 - RNA, 19 nt, Human
caggcccccaggugccagu

SEQ ID NO: 1532398 - RNA, 20 nt, Human
caggcccccaggugccaguu

SEQ ID NO: 1532399 - RNA, 13 nt, Human
caggccccugcca

SEQ ID NO: 1532400 - RNA, 18 nt, Human
caggccaaacucaccugc

SEQ ID NO: 1532401 - RNA, 23 nt, Human
caggccaaacucaccugccccuc

SEQ ID NO: 1532402 - RNA, 13 nt, Human
caggccacaagac

SEQ ID NO: 1532403 - RNA, 17 nt, Human
caggccacaagacccuu

SEQ ID NO: 1532404 - RNA, 18 nt, Human
caggccacaagacccuug

SEQ ID NO: 1532405 - RNA, 20 nt, Human
caggccacaagacccuugug

SEQ ID NO: 1532406 - RNA, 21 nt, Human
caggccaggcccucugcccac

SEQ ID NO: 1532407 - RNA, 22 nt, Human
caggccaggcccucugcccacu

SEQ ID NO: 1532408 - RNA, 13 nt, Human
caggcccggcucc

SEQ ID NO: 1532409 - RNA, 14 nt, Human
caggcccggcucca

SEQ ID NO: 1532410 - RNA, 15 nt, Human
caggcccggcuccag

SEQ ID NO: 1532411 - RNA, 15 nt, Human
caggccccugccacc

SEQ ID NO: 1532412 - RNA, 17 nt, Human
caggccccugccacccu

SEQ ID NO: 1532413 - RNA, 19 nt, Human
caggccccugccacccugg

SEQ ID NO: 1532414 - RNA, 20 nt, Human
caggccccugccacccuggg

SEQ ID NO: 1532415 - RNA, 16 nt, Human
caggcccggcuccagg

SEQ ID NO: 1532416 - RNA, 17 nt, Human
caggagccgaagcccag

SEQ ID NO: 1532417 - RNA, 14 nt, Human
caggagccuccugc

SEQ ID NO: 1532418 - RNA, 17 nt, Human
caggagccuccugcccu

SEQ ID NO: 1532419 - RNA, 18 nt, Human
caggagccgaagcccagg

SEQ ID NO: 1532420 - RNA, 21 nt, Human
caggagccgaagcccaggggc

SEQ ID NO: 1532421 - RNA, 20 nt, Human
caggagccuccugcccuuac

SEQ ID NO: 1532422 - RNA, 12 nt, Human
caggagugagca

SEQ ID NO: 1532423 - RNA, 23 nt, Human
caggagccccgaggccuucucug

SEQ ID NO: 1532424 - RNA, 20 nt, Human
caggagccccgaggccuucu

SEQ ID NO: 1532425 - RNA, 22 nt, Human
caggagccccgaggccuucucu

SEQ ID NO: 1532426 - RNA, 15 nt, Human
caggagccccgaggc

SEQ ID NO: 1532427 - RNA, 16 nt, Human
caggagccccgaggcc

SEQ ID NO: 1532428 - RNA, 18 nt, Human
caggagccccgaggccuu

SEQ ID NO: 1532429 - RNA, 12 nt, Human
caggagcagcca

SEQ ID NO: 1532430 - RNA, 13 nt, Human
caggagcagccac

SEQ ID NO: 1532431 - RNA, 14 nt, Human
caggagcagccaca

SEQ ID NO: 1532432 - RNA, 19 nt, Human
caggagcagccacauuccu

SEQ ID NO: 1532433 - RNA, 16 nt, Human
caggagacccacaggu

SEQ ID NO: 1532434 - RNA, 19 nt, Human
caggagaagaaccugaaga

SEQ ID NO: 1532435 - RNA, 12 nt, Human
caggagaguaga

SEQ ID NO: 1532436 - RNA, 20 nt, Human
caggacugggccacuucugg

SEQ ID NO: 1532437 - RNA, 15 nt, Human
caggacugggccacu

SEQ ID NO: 1532438 - RNA, 16 nt, Human
caggacugggccacuu

SEQ ID NO: 1532439 - RNA, 12 nt, Human
caggacugggcc

SEQ ID NO: 1532440 - RNA, 13 nt, Human
caggacugggcca

SEQ ID NO: 1532441 - RNA, 21 nt, Human
caggaguuugagaccaaccug

SEQ ID NO: 1532442 - RNA, 22 nt, Human
caggaguuugagaccaaccugg

SEQ ID NO: 1532443 - RNA, 23 nt, Human
caggaguuugagaccaaccuggg

SEQ ID NO: 1532444 - RNA, 22 nt, Human
caggaagccagcaggcucucag

SEQ ID NO: 1532445 - RNA, 19 nt, Human
caggaagccagcaggcucu

SEQ ID NO: 1532446 - RNA, 21 nt, Human
caggaagccagcaggcucuca

SEQ ID NO: 1532447 - RNA, 14 nt, Human
caggaagccagcag

SEQ ID NO: 1532448 - RNA, 16 nt, Human
caggaagccagcaggc

SEQ ID NO: 1532449 - RNA, 17 nt, Human
caggaagccagcaggcu

SEQ ID NO: 1532450 - RNA, 18 nt, Human
caggaagccagcaggcuc

SEQ ID NO: 1532451 - RNA, 23 nt, Human
caggaagcucagggccuggcuca

SEQ ID NO: 1532452 - RNA, 20 nt, Human
caggaagcucagggccuggc

SEQ ID NO: 1532453 - RNA, 21 nt, Human
caggaagcucagggccuggcu

SEQ ID NO: 1532454 - RNA, 13 nt, Human
caggaagcucagg

SEQ ID NO: 1532455 - RNA, 14 nt, Human
caggaagcucaggg

SEQ ID NO: 1532456 - RNA, 15 nt, Human
caggaagcucagggc

SEQ ID NO: 1532457 - RNA, 16 nt, Human
caggaagcucagggcc

SEQ ID NO: 1532458 - RNA, 17 nt, Human
caggaagcucagggccu

SEQ ID NO: 1532459 - RNA, 18 nt, Human
caggaagcucagggccug

SEQ ID NO: 1532460 - RNA, 19 nt, Human
caggaagcucagggccugg

SEQ ID NO: 1532461 - RNA, 12 nt, Human
caggaaguacug

SEQ ID NO: 1532462 - RNA, 14 nt, Human
caggaaguacugga

SEQ ID NO: 1532463 - RNA, 16 nt, Human
caggaaguacuggaga

SEQ ID NO: 1532464 - RNA, 15 nt, Human
caggaaggcuaaagg

SEQ ID NO: 1532465 - RNA, 16 nt, Human
caggaaguagaggagg

SEQ ID NO: 1532466 - RNA, 15 nt, Human
caggaaguagaggag

SEQ ID NO: 1532467 - RNA, 20 nt, Human
caggaaguacuggagaaaau

SEQ ID NO: 1532468 - RNA, 17 nt, Human
caggaaguacuggagaa

SEQ ID NO: 1532469 - RNA, 18 nt, Human
caggaaguacuggagaaa

SEQ ID NO: 1532470 - RNA, 19 nt, Human
caggaaucuguauauauuu

SEQ ID NO: 1532471 - RNA, 19 nt, Human
cagcuguaugauucccagc

SEQ ID NO: 1532472 - RNA, 20 nt, Human
cagcuucauuuccugugucu

SEQ ID NO: 1532473 - RNA, 21 nt, Human
cagcuucauuuccugugucuu

SEQ ID NO: 1532474 - RNA, 18 nt, Human
cagcuugaaacugagaug

SEQ ID NO: 1532475 - RNA, 23 nt, Human
cagcuugaucaaaggcacacagc

SEQ ID NO: 1532476 - RNA, 19 nt, Human
cagcuugaucaaaggcaca

SEQ ID NO: 1532477 - RNA, 18 nt, Human
cagcuugaggguugggcu

SEQ ID NO: 1532478 - RNA, 19 nt, Human
cagcuugaggguugggcug

SEQ ID NO: 1532479 - RNA, 20 nt, Human
cagcuugaggguugggcugg

SEQ ID NO: 1532480 - RNA, 21 nt, Human
cagcuugaggguugggcuggu

SEQ ID NO: 1532481 - RNA, 14 nt, Human
cagcuugaggguug

SEQ ID NO: 1532482 - RNA, 15 nt, Human
cagcuugaggguugg

SEQ ID NO: 1532483 - RNA, 18 nt, Human
cagcuugaccgugaggcc

SEQ ID NO: 1532484 - RNA, 19 nt, Human
cagcuugaccgugaggcca

SEQ ID NO: 1532485 - RNA, 20 nt, Human
cagcuugaccgugaggccag

SEQ ID NO: 1532486 - RNA, 21 nt, Human
cagcuugaccgugaggccaga

SEQ ID NO: 1532487 - RNA, 18 nt, Human
caggaaccacaagacugc

SEQ ID NO: 1532488 - RNA, 12 nt, Human
cagcuuuguuug

SEQ ID NO: 1532489 - RNA, 21 nt, Human
cagcuuuguuuguugucagcu

SEQ ID NO: 1532490 - RNA, 22 nt, Human
cagcuuuguuuguugucagcug

SEQ ID NO: 1532491 - RNA, 23 nt, Human
cagcuuuguuuguugucagcuga

SEQ ID NO: 1532492 - RNA, 23 nt, Human
cagcuuuccucaaaacuucagac

SEQ ID NO: 1532493 - RNA, 21 nt, Human
cagcuuguaaauagcucaggu

SEQ ID NO: 1532494 - RNA, 22 nt, Human
cagcuuguaaauagcucaggug

SEQ ID NO: 1532495 - RNA, 18 nt, Human
cagcuuguaaauagcuca

SEQ ID NO: 1532496 - RNA, 19 nt, Human
cagcuuguaaauagcucag

SEQ ID NO: 1532497 - RNA, 20 nt, Human
cagcuuguaaauagcucagg

SEQ ID NO: 1532498 - RNA, 20 nt, Human
cagcucugcauacucauuag

SEQ ID NO: 1532499 - RNA, 21 nt, Human
cagcucugcaagaauugaagc

SEQ ID NO: 1532500 - RNA, 15 nt, Human
cagcucugcaagaau

SEQ ID NO: 1532501 - RNA, 16 nt, Human
cagcucugcaagaauu

SEQ ID NO: 1532502 - RNA, 13 nt, Human
cagcucagagagg

SEQ ID NO: 1532503 - RNA, 17 nt, Human
cagcucagagagggugg

SEQ ID NO: 1532504 - RNA, 19 nt, Human
cagcucagagaggguggga

SEQ ID NO: 1532505 - RNA, 20 nt, Human
cagcucagagagggugggag

SEQ ID NO: 1532506 - RNA, 16 nt, Human
cagcuccuucuguccu

SEQ ID NO: 1532507 - RNA, 17 nt, Human
cagcuccuucuguccua

SEQ ID NO: 1532508 - RNA, 21 nt, Human
cagcuccuucuguccuacucu

SEQ ID NO: 1532509 - RNA, 23 nt, Human
cagcuccuucuguccuacucugu

SEQ ID NO: 1532510 - RNA, 10 nt, Human
cagcucuggu

SEQ ID NO: 1532511 - RNA, 13 nt, Human
cagcucuggucca

SEQ ID NO: 1532512 - RNA, 16 nt, Human
cagcucugguccauag

SEQ ID NO: 1532513 - RNA, 17 nt, Human
cagcucugguccauaga

SEQ ID NO: 1532514 - RNA, 18 nt, Human
cagcucugguccauagag

SEQ ID NO: 1532515 - RNA, 21 nt, Human
cagcucugguccauagagagc

SEQ ID NO: 1532516 - RNA, 22 nt, Human
cagcucugguccauagagagca

SEQ ID NO: 1532517 - RNA, 23 nt, Human
cagcucugguccauagagagcaa

SEQ ID NO: 1532518 - RNA, 12 nt, Human
cagcucuguccu

SEQ ID NO: 1532519 - RNA, 13 nt, Human
cagcucuguccug

SEQ ID NO: 1532520 - RNA, 14 nt, Human
cagcucuguccugg

SEQ ID NO: 1532521 - RNA, 16 nt, Human
cagcucuguccuggga

SEQ ID NO: 1532522 - RNA, 17 nt, Human
cagcucuguccugggag

SEQ ID NO: 1532523 - RNA, 18 nt, Human
cagcucuguccugggagu

SEQ ID NO: 1532524 - RNA, 23 nt, Human
cagcucuguccugggagugagcu

SEQ ID NO: 1532525 - RNA, 10 nt, Human
cagcucuuau

SEQ ID NO: 1532526 - RNA, 21 nt, Human
cagcucuuauauugccauuuc

SEQ ID NO: 1532527 - RNA, 13 nt, Human
cagcucuucucca

SEQ ID NO: 1532528 - RNA, 14 nt, Human
cagcucuucuccag

SEQ ID NO: 1532529 - RNA, 15 nt, Human
cagcucuucuccagg

SEQ ID NO: 1532530 - RNA, 16 nt, Human
cagcucuucuccaggc

SEQ ID NO: 1532531 - RNA, 17 nt, Human
cagcucuucuccaggcu

SEQ ID NO: 1532532 - RNA, 18 nt, Human
cagcucuucuccaggcug

SEQ ID NO: 1532533 - RNA, 19 nt, Human
cagcucuucuccaggcugu

SEQ ID NO: 1532534 - RNA, 23 nt, Human
cagcucuucuccaggcuguaucc

SEQ ID NO: 1532535 - RNA, 21 nt, Human
cagcugggguggggaccucag

SEQ ID NO: 1532536 - RNA, 22 nt, Human
cagcugggguggggaccucagg

SEQ ID NO: 1532537 - RNA, 23 nt, Human
cagcugggguggggaccucaggc

SEQ ID NO: 1532538 - RNA, 18 nt, Human
cagcuguaugauucccag

SEQ ID NO: 1532539 - RNA, 19 nt, Human
cagcuggugguaucugagu

SEQ ID NO: 1532540 - RNA, 18 nt, Human
cagcugguugagguuuca

SEQ ID NO: 1532541 - RNA, 22 nt, Human
cagcugcuuuugucuaugggac

SEQ ID NO: 1532542 - RNA, 17 nt, Human
cagcugcuacuacuccu

SEQ ID NO: 1532543 - RNA, 20 nt, Human
cagcugcugaaacaacaaau

SEQ ID NO: 1532544 - RNA, 21 nt, Human
cagcugcugaaacaacaaaua

SEQ ID NO: 1532545 - RNA, 13 nt, Human
cagcugcuugggc

SEQ ID NO: 1532546 - RNA, 14 nt, Human
cagcugcuugggcu

SEQ ID NO: 1532547 - RNA, 15 nt, Human
cagcugcuugggcuu

SEQ ID NO: 1532548 - RNA, 16 nt, Human
cagcugcuugggcuuc

SEQ ID NO: 1532549 - RNA, 18 nt, Human
cagcugcuugggcuucau

SEQ ID NO: 1532550 - RNA, 19 nt, Human
cagcugcuugggcuucauc

SEQ ID NO: 1532551 - RNA, 21 nt, Human
cagcugcuugggcuucauccu

SEQ ID NO: 1532552 - RNA, 22 nt, Human
cagcugcuugggcuucauccuc

SEQ ID NO: 1532553 - RNA, 18 nt, Human
cagcugccugggaucccu

SEQ ID NO: 1532554 - RNA, 23 nt, Human
cagcugccugggaucccucaucc

SEQ ID NO: 1532555 - RNA, 18 nt, Human
cagcugcgguccacccag

SEQ ID NO: 1532556 - RNA, 19 nt, Human
cagcugcgguccacccagg

SEQ ID NO: 1532557 - RNA, 20 nt, Human
cagcugcgguccacccagga

SEQ ID NO: 1532558 - RNA, 21 nt, Human
cagcugcgguccacccaggag

SEQ ID NO: 1532559 - RNA, 22 nt, Human
cagcugcgguccacccaggagc

SEQ ID NO: 1532560 - RNA, 23 nt, Human
cagcugcgguccacccaggagcc

SEQ ID NO: 1532561 - RNA, 24 nt, Human
cagcugcgguccacccaggagccc

SEQ ID NO: 1532562 - RNA, 22 nt, Human
caggaagcucagggccuggcuc

SEQ ID NO: 1532563 - RNA, 17 nt, Human
cagccuugaccauucuc

SEQ ID NO: 1532564 - RNA, 20 nt, Human
cagccuugaccauucuccac

SEQ ID NO: 1532565 - RNA, 21 nt, Human
cagccuugaccauucuccacc

SEQ ID NO: 1532566 - RNA, 22 nt, Human
cagccuugaccauucuccaccu

SEQ ID NO: 1532567 - RNA, 23 nt, Human
cagccuugaccauucuccaccug

SEQ ID NO: 1532568 - RNA, 24 nt, Human
cagccuugaccauucuccaccugc

SEQ ID NO: 1532569 - RNA, 16 nt, Human
cagccugggcaaugug

SEQ ID NO: 1532570 - RNA, 19 nt, Human
cagccugggcaaugugaua

SEQ ID NO: 1532571 - RNA, 15 nt, Human
cagccuggacccugu

SEQ ID NO: 1532572 - RNA, 19 nt, Human
cagccuggacccuguggau

SEQ ID NO: 1532573 - RNA, 20 nt, Human
cagccugcuccagcuguuca

SEQ ID NO: 1532574 - RNA, 23 nt, Human
cagccucccgaauagcugggacu

SEQ ID NO: 1532575 - RNA, 19 nt, Human
cagccucccgaguagcugg

SEQ ID NO: 1532576 - RNA, 20 nt, Human
cagccucccgaguagcuggg

SEQ ID NO: 1532577 - RNA, 21 nt, Human
cagccucccgaguagcuggga

SEQ ID NO: 1532578 - RNA, 22 nt, Human
cagccucccgaguagcugggac

SEQ ID NO: 1532579 - RNA, 23 nt, Human
cagccucccgaguagcugggacu

SEQ ID NO: 1532580 - RNA, 12 nt, Human
cagcucagagag

SEQ ID NO: 1532581 - RNA, 19 nt, Human
cagcucaccucucccuugg

SEQ ID NO: 1532582 - RNA, 20 nt, Human
cagcucaccucucccuugga

SEQ ID NO: 1532583 - RNA, 22 nt, Human
cagcucaccagccccagugccc

SEQ ID NO: 1532584 - RNA, 20 nt, Human
cagcucaccagccccagugc

SEQ ID NO: 1532585 - RNA, 21 nt, Human
cagcucaccagccccagugcc

SEQ ID NO: 1532586 - RNA, 13 nt, Human
cagcucaccucuc

SEQ ID NO: 1532587 - RNA, 15 nt, Human
cagcucaccucuccc

SEQ ID NO: 1532588 - RNA, 16 nt, Human
cagcucaccucucccu

SEQ ID NO: 1532589 - RNA, 17 nt, Human
cagcucaccucucccuu

SEQ ID NO: 1532590 - RNA, 13 nt, Human
cagcuauuuuuau

SEQ ID NO: 1532591 - RNA, 13 nt, Human
cagcucaccagcc

SEQ ID NO: 1532592 - RNA, 15 nt, Human
cagcucaccagcccc

SEQ ID NO: 1532593 - RNA, 16 nt, Human
cagcucaccagcccca

SEQ ID NO: 1532594 - RNA, 17 nt, Human
cagcucaccagccccag

SEQ ID NO: 1532595 - RNA, 19 nt, Human
cagcucaccagccccagug

SEQ ID NO: 1532596 - RNA, 21 nt, Human
cagcgagcccugguggcagug

SEQ ID NO: 1532597 - RNA, 19 nt, Human
cagcuaacauggaaguacu

SEQ ID NO: 1532598 - RNA, 18 nt, Human
cagcuaacauggaaguac

SEQ ID NO: 1532599 - RNA, 13 nt, Human
cagcgagcccugg

SEQ ID NO: 1532600 - RNA, 16 nt, Human
cagcgagcccuggugg

SEQ ID NO: 1532601 - RNA, 17 nt, Human
cagcgagcccugguggc

SEQ ID NO: 1532602 - RNA, 19 nt, Human
cagcgagcccugguggcag

SEQ ID NO: 1532603 - RNA, 20 nt, Human
cagcgagcccugguggcagu

SEQ ID NO: 1532604 - RNA, 20 nt, Human
cagcuaacauggaaguacua

SEQ ID NO: 1532605 - RNA, 15 nt, Human
cagcuaaugggacac

SEQ ID NO: 1532606 - RNA, 16 nt, Human
cagcuaaugggacacu

SEQ ID NO: 1532607 - RNA, 19 nt, Human
cagcuacuugggaggcuga

SEQ ID NO: 1532608 - RNA, 16 nt, Human
cagccuaguugaucag

SEQ ID NO: 1532609 - RNA, 17 nt, Human
cagccucaaccuccugg

SEQ ID NO: 1532610 - RNA, 18 nt, Human
cagccucaaccuccuggg

SEQ ID NO: 1532611 - RNA, 19 nt, Human
cagccucaaccuccugggc

SEQ ID NO: 1532612 - RNA, 20 nt, Human
cagccucaaccuccugggcu

SEQ ID NO: 1532613 - RNA, 21 nt, Human
cagccucaaccuccugggcua

SEQ ID NO: 1532614 - RNA, 14 nt, Human
cagccucacagucc

SEQ ID NO: 1532615 - RNA, 15 nt, Human
cagccucacaguccu

SEQ ID NO: 1532616 - RNA, 20 nt, Human
cagccucacaguccuuacca

SEQ ID NO: 1532617 - RNA, 19 nt, Human
cagccucccaaagugcugg

SEQ ID NO: 1532618 - RNA, 20 nt, Human
cagccucccaaagugcuggg

SEQ ID NO: 1532619 - RNA, 21 nt, Human
cagccucccaaagugcuggga

SEQ ID NO: 1532620 - RNA, 23 nt, Human
cagccucccaaagugcugggauu

SEQ ID NO: 1532621 - RNA, 20 nt, Human
cagccucccgaauagcuggg

SEQ ID NO: 1532622 - RNA, 21 nt, Human
cagccucccgaauagcuggga

SEQ ID NO: 1532623 - RNA, 22 nt, Human
cagccucccgaauagcugggac

SEQ ID NO: 1532624 - RNA, 18 nt, Human
cagcccugcagagggcac

SEQ ID NO: 1532625 - RNA, 20 nt, Human
cagcccugcagagggcacag

SEQ ID NO: 1532626 - RNA, 13 nt, Human
cagcccugcagag

SEQ ID NO: 1532627 - RNA, 14 nt, Human
cagcccugcagagg

SEQ ID NO: 1532628 - RNA, 15 nt, Human
cagcccugcagaggg

SEQ ID NO: 1532629 - RNA, 16 nt, Human
cagcccugcagagggc

SEQ ID NO: 1532630 - RNA, 21 nt, Human
cagccguguaaccauggaccc

SEQ ID NO: 1532631 - RNA, 21 nt, Human
cagcccgggcucugccuccca

SEQ ID NO: 1532632 - RNA, 22 nt, Human
cagcccgggcucugccucccau

SEQ ID NO: 1532633 - RNA, 17 nt, Human
cagcccgggcucugccu

SEQ ID NO: 1532634 - RNA, 18 nt, Human
cagcccgggcucugccuc

SEQ ID NO: 1532635 - RNA, 19 nt, Human
cagcccgggcucugccucc

SEQ ID NO: 1532636 - RNA, 20 nt, Human
cagcccgggcucugccuccc

SEQ ID NO: 1532637 - RNA, 13 nt, Human
cagcccucacccc

SEQ ID NO: 1532638 - RNA, 14 nt, Human
cagcccucaccccu

SEQ ID NO: 1532639 - RNA, 15 nt, Human
cagcccucaccccug

SEQ ID NO: 1532640 - RNA, 18 nt, Human
cagcccucaccccugguu

SEQ ID NO: 1532641 - RNA, 24 nt, Human
cagccccuucugacccaugcugcc

SEQ ID NO: 1532642 - RNA, 22 nt, Human
cagccccuucugacccaugcug

SEQ ID NO: 1532643 - RNA, 23 nt, Human
cagccccuucugacccaugcugc

SEQ ID NO: 1532644 - RNA, 16 nt, Human
cagccccuucugaccc

SEQ ID NO: 1532645 - RNA, 17 nt, Human
cagccccuucugaccca

SEQ ID NO: 1532646 - RNA, 19 nt, Human
cagccccuucugacccaug

SEQ ID NO: 1532647 - RNA, 21 nt, Human
cagccccuucugacccaugcu

SEQ ID NO: 1532648 - RNA, 13 nt, Human
cagcccgggcucu

SEQ ID NO: 1532649 - RNA, 14 nt, Human
cagcccgggcucug

SEQ ID NO: 1532650 - RNA, 15 nt, Human
cagcccgggcucugc

SEQ ID NO: 1532651 - RNA, 16 nt, Human
cagcccgggcucugcc

SEQ ID NO: 1532652 - RNA, 13 nt, Human
cagccccagugcc

SEQ ID NO: 1532653 - RNA, 14 nt, Human
cagccccagugccc

SEQ ID NO: 1532654 - RNA, 15 nt, Human
cagccccagugccca

SEQ ID NO: 1532655 - RNA, 16 nt, Human
cagccccagugcccac

SEQ ID NO: 1532656 - RNA, 17 nt, Human
cagccccagugcccaca

SEQ ID NO: 1532657 - RNA, 18 nt, Human
cagccccagugcccacag

SEQ ID NO: 1532658 - RNA, 11 nt, Human
cagccccaucc

SEQ ID NO: 1532659 - RNA, 21 nt, Human
cagccccaucccaaacccuuc

SEQ ID NO: 1532660 - RNA, 20 nt, Human
cagccccuguucuggcagag

SEQ ID NO: 1532661 - RNA, 21 nt, Human
cagccccuguucuggcagagu

SEQ ID NO: 1532662 - RNA, 16 nt, Human
cagccccauucugccu

SEQ ID NO: 1532663 - RNA, 17 nt, Human
cagccccauucugccug

SEQ ID NO: 1532664 - RNA, 18 nt, Human
cagccccauucugccugc

SEQ ID NO: 1532665 - RNA, 23 nt, Human
cagccccuggaugcagccucaca

SEQ ID NO: 1532666 - RNA, 22 nt, Human
cagccccaucccaaacccuuca

SEQ ID NO: 1532667 - RNA, 12 nt, Human
cagccccauccu

SEQ ID NO: 1532668 - RNA, 13 nt, Human
cagccccauccuc

SEQ ID NO: 1532669 - RNA, 14 nt, Human
cagccccauccucu

SEQ ID NO: 1532670 - RNA, 16 nt, Human
cagccccauccucugu

SEQ ID NO: 1532671 - RNA, 22 nt, Human
cagccccauccucuguacagag

SEQ ID NO: 1532672 - RNA, 13 nt, Human
cagccccauucug

SEQ ID NO: 1532673 - RNA, 14 nt, Human
cagccccauucugc

SEQ ID NO: 1532674 - RNA, 23 nt, Human
cagcugcuuuugucuaugggacu

SEQ ID NO: 1532675 - RNA, 18 nt, Human
cagccaaagccuccucca

SEQ ID NO: 1532676 - RNA, 21 nt, Human
cagccaaagccuccuccagcc

SEQ ID NO: 1532677 - RNA, 15 nt, Human
cagccaaagccuccu

SEQ ID NO: 1532678 - RNA, 16 nt, Human
cagccaaagccuccuc

SEQ ID NO: 1532679 - RNA, 17 nt, Human
cagcaugcaccacgggc

SEQ ID NO: 1532680 - RNA, 21 nt, Human
cagcauccuggcacccggccc

SEQ ID NO: 1532681 - RNA, 19 nt, Human
cagcauccuggcacccggc

SEQ ID NO: 1532682 - RNA, 20 nt, Human
cagcauccuggcacccggcc

SEQ ID NO: 1532683 - RNA, 20 nt, Human
cagcagggagggcuucugcc

SEQ ID NO: 1532684 - RNA, 14 nt, Human
cagcauccuggcac

SEQ ID NO: 1532685 - RNA, 15 nt, Human
cagcauccuggcacc

SEQ ID NO: 1532686 - RNA, 16 nt, Human
cagcauccuggcaccc

SEQ ID NO: 1532687 - RNA, 17 nt, Human
cagcauccuggcacccg

SEQ ID NO: 1532688 - RNA, 16 nt, Human
cagcaggcucucaggc

SEQ ID NO: 1532689 - RNA, 17 nt, Human
cagcaggcucucaggcc

SEQ ID NO: 1532690 - RNA, 18 nt, Human
cagcaggcucucaggcca

SEQ ID NO: 1532691 - RNA, 19 nt, Human
cagcaggcucucaggccag

SEQ ID NO: 1532692 - RNA, 20 nt, Human
cagcaggcucucaggccagc

SEQ ID NO: 1532693 - RNA, 22 nt, Human
cagcaggcucucaggccagcug

SEQ ID NO: 1532694 - RNA, 18 nt, Human
cagcagggagggcuucug

SEQ ID NO: 1532695 - RNA, 19 nt, Human
cagcagccuggacccugug

SEQ ID NO: 1532696 - RNA, 22 nt, Human
cagcagccuggacccuguggau

SEQ ID NO: 1532697 - RNA, 12 nt, Human
cagcagccugga

SEQ ID NO: 1532698 - RNA, 14 nt, Human
cagcagccuggacc

SEQ ID NO: 1532699 - RNA, 15 nt, Human
cagcagccuggaccc

SEQ ID NO: 1532700 - RNA, 18 nt, Human
cagcagccuggacccugu

SEQ ID NO: 1532701 - RNA, 12 nt, Human
cagcaggcucuc

SEQ ID NO: 1532702 - RNA, 14 nt, Human
cagcaggcucucag

SEQ ID NO: 1532703 - RNA, 15 nt, Human
cagcaggcucucagg

SEQ ID NO: 1532704 - RNA, 17 nt, Human
cagcccaaagaaggaaa

SEQ ID NO: 1532705 - RNA, 15 nt, Human
cagcccaccccucaa

SEQ ID NO: 1532706 - RNA, 15 nt, Human
cagcccacuucugcc

SEQ ID NO: 1532707 - RNA, 22 nt, Human
cagccccaaaacucuccucugc

SEQ ID NO: 1532708 - RNA, 20 nt, Human
cagccccaaaacucuccucu

SEQ ID NO: 1532709 - RNA, 21 nt, Human
cagccccaaaacucuccucug

SEQ ID NO: 1532710 - RNA, 18 nt, Human
cagcccacuucugccaua

SEQ ID NO: 1532711 - RNA, 23 nt, Human
cagccacggccaggccagaggga

SEQ ID NO: 1532712 - RNA, 22 nt, Human
cagccaguaaaugggggugcau

SEQ ID NO: 1532713 - RNA, 14 nt, Human
cagccacggccagg

SEQ ID NO: 1532714 - RNA, 15 nt, Human
cagccacggccaggc

SEQ ID NO: 1532715 - RNA, 16 nt, Human
cagccacggccaggcc

SEQ ID NO: 1532716 - RNA, 17 nt, Human
cagccacggccaggcca

SEQ ID NO: 1532717 - RNA, 18 nt, Human
cagccacggccaggccag

SEQ ID NO: 1532718 - RNA, 19 nt, Human
cagccacggccaggccaga

SEQ ID NO: 1532719 - RNA, 21 nt, Human
cagccacggccaggccagagg

SEQ ID NO: 1532720 - RNA, 22 nt, Human
cagccacggccaggccagaggg

SEQ ID NO: 1532721 - RNA, 14 nt, Human
cagccacauuccug

SEQ ID NO: 1532722 - RNA, 19 nt, Human
cagccacauuccugaugcu

SEQ ID NO: 1532723 - RNA, 15 nt, Human
cagccacauuccuga

SEQ ID NO: 1532724 - RNA, 17 nt, Human
cagccacauuccugaug

SEQ ID NO: 1532725 - RNA, 17 nt, Human
cagcagaaaugccuuac

SEQ ID NO: 1532726 - RNA, 15 nt, Human
cagcagaaaugccuu

SEQ ID NO: 1532727 - RNA, 11 nt, Human
cagcagagcac

SEQ ID NO: 1532728 - RNA, 13 nt, Human
cagcagagcaccu

SEQ ID NO: 1532729 - RNA, 22 nt, Human
cagcagaaaugccuuacccuca

SEQ ID NO: 1532730 - RNA, 19 nt, Human
cagcagaaaugccuuaccc

SEQ ID NO: 1532731 - RNA, 13 nt, Human
cagcagaaggggg

SEQ ID NO: 1532732 - RNA, 17 nt, Human
cagcagaaggggguggu

SEQ ID NO: 1532733 - RNA, 22 nt, Human
cagcaauaaagcagcguuucua

SEQ ID NO: 1532734 - RNA, 21 nt, Human
cagcaauaaagcagcguuucu

SEQ ID NO: 1532735 - RNA, 13 nt, Human
cagcaauaaagca

SEQ ID NO: 1532736 - RNA, 19 nt, Human
cagcaagugagagcugggu

SEQ ID NO: 1532737 - RNA, 21 nt, Human
cagcaagugagagcugggugu

SEQ ID NO: 1532738 - RNA, 15 nt, Human
cagcaagucaggguu

SEQ ID NO: 1532739 - RNA, 12 nt, Human
cagcaagugaga

SEQ ID NO: 1532740 - RNA, 22 nt, Human
cagcaagggugaugggaaagca

SEQ ID NO: 1532741 - RNA, 23 nt, Human
cagcaagggugaugggaaagcau

SEQ ID NO: 1532742 - RNA, 14 nt, Human
cagcaagugagagc

SEQ ID NO: 1532743 - RNA, 15 nt, Human
cagcaagugagagcu

SEQ ID NO: 1532744 - RNA, 16 nt, Human
cagcaagugagagcug

SEQ ID NO: 1532745 - RNA, 17 nt, Human
cagcaagugagagcugg

SEQ ID NO: 1532746 - RNA, 18 nt, Human
cagcaaggagauuuacaa

SEQ ID NO: 1532747 - RNA, 17 nt, Human
cagcaaggagauuuaca

SEQ ID NO: 1532748 - RNA, 19 nt, Human
cagcaagggugaugggaaa

SEQ ID NO: 1532749 - RNA, 18 nt, Human
cagcaaaagaugcuucuc

SEQ ID NO: 1532750 - RNA, 23 nt, Human
cagcaacgcaggcccccaggugc

SEQ ID NO: 1532751 - RNA, 14 nt, Human
cagauuuuccugaa

SEQ ID NO: 1532752 - RNA, 15 nt, Human
cagauuuuccugaaa

SEQ ID NO: 1532753 - RNA, 14 nt, Human
cagauucuuuccug

SEQ ID NO: 1532754 - RNA, 15 nt, Human
cagauucuuuccuga

SEQ ID NO: 1532755 - RNA, 18 nt, Human
cagaugggugcuuggagg

SEQ ID NO: 1532756 - RNA, 16 nt, Human
cagauggaaugcugug

SEQ ID NO: 1532757 - RNA, 17 nt, Human
cagauggaaugcugugu

SEQ ID NO: 1532758 - RNA, 19 nt, Human
cagauggaaugcuguguua

SEQ ID NO: 1532759 - RNA, 21 nt, Human
cagauggaaugcuguguuaaa

SEQ ID NO: 1532760 - RNA, 23 nt, Human
cagaugggugcuuggaggaagga

SEQ ID NO: 1532761 - RNA, 14 nt, Human
cagcucaccagccc

SEQ ID NO: 1532762 - RNA, 15 nt, Human
cagagcccaccuugg

SEQ ID NO: 1532763 - RNA, 17 nt, Human
cagagcccaccuuggcu

SEQ ID NO: 1532764 - RNA, 19 nt, Human
cagagcccaccuuggcuca

SEQ ID NO: 1532765 - RNA, 20 nt, Human
cagagcccaccuuggcucaa

SEQ ID NO: 1532766 - RNA, 16 nt, Human
cagagcccacgccccc

SEQ ID NO: 1532767 - RNA, 23 nt, Human
cagagcaccuuagacagucccug

SEQ ID NO: 1532768 - RNA, 11 nt, Human
cagagcagaga

SEQ ID NO: 1532769 - RNA, 12 nt, Human
cagagcagagac

SEQ ID NO: 1532770 - RNA, 18 nt, Human
cagagcaccuuagacagu

SEQ ID NO: 1532771 - RNA, 19 nt, Human
cagagcaccuuagacaguc

SEQ ID NO: 1532772 - RNA, 21 nt, Human
cagagcaccuuagacaguccc

SEQ ID NO: 1532773 - RNA, 22 nt, Human
cagagcaccuuagacagucccu

SEQ ID NO: 1532774 - RNA, 13 nt, Human
cagagcagagacc

SEQ ID NO: 1532775 - RNA, 14 nt, Human
cagagcagagacca

SEQ ID NO: 1532776 - RNA, 15 nt, Human
cagagcagagaccau

SEQ ID NO: 1532777 - RNA, 17 nt, Human
cagagcagagaccaucc

SEQ ID NO: 1532778 - RNA, 18 nt, Human
cagagcagagaccauccc

SEQ ID NO: 1532779 - RNA, 19 nt, Human
cagagcagagaccaucccu

SEQ ID NO: 1532780 - RNA, 21 nt, Human
cagagcagagaccaucccuga

SEQ ID NO: 1532781 - RNA, 12 nt, Human
cagagccugcag

SEQ ID NO: 1532782 - RNA, 13 nt, Human
cagaggaaggaga

SEQ ID NO: 1532783 - RNA, 13 nt, Human
cagagccugcagu

SEQ ID NO: 1532784 - RNA, 23 nt, Human
cagagcccacgcccccacuggug

SEQ ID NO: 1532785 - RNA, 17 nt, Human
cagagcccacgccccca

SEQ ID NO: 1532786 - RNA, 19 nt, Human
cagagcccacgcccccacu

SEQ ID NO: 1532787 - RNA, 20 nt, Human
cagagcccacgcccccacug

SEQ ID NO: 1532788 - RNA, 21 nt, Human
cagagcccacgcccccacugg

SEQ ID NO: 1532789 - RNA, 14 nt, Human
cagaggagggcagc

SEQ ID NO: 1532790 - RNA, 18 nt, Human
cagaggagggcagcagaa

SEQ ID NO: 1532791 - RNA, 20 nt, Human
cagaggagagaggacccccu

SEQ ID NO: 1532792 - RNA, 11 nt, Human
cagaggcagcc

SEQ ID NO: 1532793 - RNA, 22 nt, Human
cagaggagggcagcagaagggg

SEQ ID NO: 1532794 - RNA, 13 nt, Human
cagaggagagagg

SEQ ID NO: 1532795 - RNA, 15 nt, Human
cagaggagagaggac

SEQ ID NO: 1532796 - RNA, 19 nt, Human
cagaggagagaggaccccc

SEQ ID NO: 1532797 - RNA, 19 nt, Human
cagagaaugaaagggccca

SEQ ID NO: 1532798 - RNA, 20 nt, Human
cagagaaugaaagggcccag

SEQ ID NO: 1532799 - RNA, 21 nt, Human
cagagaaugaaagggcccaga

SEQ ID NO: 1532800 - RNA, 15 nt, Human
cagagaauucucuua

SEQ ID NO: 1532801 - RNA, 16 nt, Human
cagagacacaagccuu

SEQ ID NO: 1532802 - RNA, 17 nt, Human
cagagacacaagccuuc

SEQ ID NO: 1532803 - RNA, 14 nt, Human
cagagacacaagcc

SEQ ID NO: 1532804 - RNA, 15 nt, Human
cagagacacaagccu

SEQ ID NO: 1532805 - RNA, 13 nt, Human
cagagaccauccc

SEQ ID NO: 1532806 - RNA, 14 nt, Human
cagagaccaucccu

SEQ ID NO: 1532807 - RNA, 16 nt, Human
cagagaccaucccuga

SEQ ID NO: 1532808 - RNA, 16 nt, Human
cagagcaccuuagaca

SEQ ID NO: 1532809 - RNA, 14 nt, Human
cagagcaagugaga

SEQ ID NO: 1532810 - RNA, 20 nt, Human
cagagcaagugagacccugu

SEQ ID NO: 1532811 - RNA, 21 nt, Human
cagagaccaucccugaaggcc

SEQ ID NO: 1532812 - RNA, 17 nt, Human
cagagaccaucccugaa

SEQ ID NO: 1532813 - RNA, 18 nt, Human
cagagaccaucccugaag

SEQ ID NO: 1532814 - RNA, 19 nt, Human
cagagaccaucccugaagg

SEQ ID NO: 1532815 - RNA, 20 nt, Human
cagagaccaucccugaaggc

SEQ ID NO: 1532816 - RNA, 13 nt, Human
cagagacuccugc

SEQ ID NO: 1532817 - RNA, 14 nt, Human
cagagacuccugca

SEQ ID NO: 1532818 - RNA, 15 nt, Human
cagagacuccugcag

SEQ ID NO: 1532819 - RNA, 16 nt, Human
cagagacuccugcagg

SEQ ID NO: 1532820 - RNA, 17 nt, Human
cagagacuccugcaggc

SEQ ID NO: 1532821 - RNA, 18 nt, Human
cagagacuccugcaggca

SEQ ID NO: 1532822 - RNA, 19 nt, Human
cagagacuccugcaggcag

SEQ ID NO: 1532823 - RNA, 13 nt, Human
cagaggcugccuc

SEQ ID NO: 1532824 - RNA, 23 nt, Human
cagaggcugccucucccaucacu

SEQ ID NO: 1532825 - RNA, 14 nt, Human
cagagggagugaca

SEQ ID NO: 1532826 - RNA, 16 nt, Human
cagagggagugacaga

SEQ ID NO: 1532827 - RNA, 18 nt, Human
cagagggagugacagagg

SEQ ID NO: 1532828 - RNA, 19 nt, Human
cagagggagugacagaggc

SEQ ID NO: 1532829 - RNA, 23 nt, Human
cagaggcagccccauucugccug

SEQ ID NO: 1532830 - RNA, 19 nt, Human
cagaggccaugggccuccu

SEQ ID NO: 1532831 - RNA, 20 nt, Human
cagaggccaugggccuccug

SEQ ID NO: 1532832 - RNA, 21 nt, Human
cagaggccaugggccuccugu

SEQ ID NO: 1532833 - RNA, 12 nt, Human
cagaggcagccc

SEQ ID NO: 1532834 - RNA, 13 nt, Human
cagaggcagcccc

SEQ ID NO: 1532835 - RNA, 14 nt, Human
cagaggcagcccca

SEQ ID NO: 1532836 - RNA, 15 nt, Human
cagaggcagccccau

SEQ ID NO: 1532837 - RNA, 18 nt, Human
cagaggcagccccauucu

SEQ ID NO: 1532838 - RNA, 19 nt, Human
cagaggcagccccauucug

SEQ ID NO: 1532839 - RNA, 20 nt, Human
cagaggcagccccauucugc

SEQ ID NO: 1532840 - RNA, 22 nt, Human
cagaggcagccccauucugccu

SEQ ID NO: 1532841 - RNA, 13 nt, Human
cagagucucacug

SEQ ID NO: 1532842 - RNA, 17 nt, Human
cagagucucacuguugc

SEQ ID NO: 1532843 - RNA, 19 nt, Human
cagagucucacuguugccc

SEQ ID NO: 1532844 - RNA, 20 nt, Human
cagagucucacuguugccca

SEQ ID NO: 1532845 - RNA, 21 nt, Human
cagagucucacuguugcccag

SEQ ID NO: 1532846 - RNA, 15 nt, Human
cagagggccugcaag

SEQ ID NO: 1532847 - RNA, 19 nt, Human
cagagggccugcaagggag

SEQ ID NO: 1532848 - RNA, 20 nt, Human
cagagggagugacagaggca

SEQ ID NO: 1532849 - RNA, 21 nt, Human
cagagggagugacagaggcag

SEQ ID NO: 1532850 - RNA, 22 nt, Human
cagagggagugacagaggcagc

SEQ ID NO: 1532851 - RNA, 23 nt, Human
cagagggagugacagaggcagcc

SEQ ID NO: 1532852 - RNA, 22 nt, Human
cagagucucacuguugcccagg

SEQ ID NO: 1532853 - RNA, 23 nt, Human
cagagucucacuguugcccaggc

SEQ ID NO: 1532854 - RNA, 16 nt, Human
cagagugagacucugu

SEQ ID NO: 1532855 - RNA, 17 nt, Human
cagagugagacucuguc

SEQ ID NO: 1532856 - RNA, 18 nt, Human
cagagugagacucugucu

SEQ ID NO: 1532857 - RNA, 19 nt, Human
cagagugagacucugucuc

SEQ ID NO: 1532858 - RNA, 20 nt, Human
cagagugagacucugucuca

SEQ ID NO: 1532859 - RNA, 14 nt, Human
cagauaaucacaau

SEQ ID NO: 1532860 - RNA, 14 nt, Human
cagauaaucagugu

SEQ ID NO: 1532861 - RNA, 23 nt, Human
cagauaaauaguuuaugauucca

SEQ ID NO: 1532862 - RNA, 14 nt, Human
cagauaaacaguag

SEQ ID NO: 1532863 - RNA, 19 nt, Human
cagaguuguuacauuuuua

SEQ ID NO: 1532864 - RNA, 18 nt, Human
cagaguuguuacauuuuu

SEQ ID NO: 1532865 - RNA, 15 nt, Human
cagaguuguuacauu

SEQ ID NO: 1532866 - RNA, 22 nt, Human
cagaguugaagacagagcuaca

SEQ ID NO: 1532867 - RNA, 14 nt, Human
cagaguuguuacau

SEQ ID NO: 1532868 - RNA, 17 nt, Human
cagaguugaagacagag

SEQ ID NO: 1532869 - RNA, 18 nt, Human
cagaguugaagacagagc

SEQ ID NO: 1532870 - RNA, 19 nt, Human
cagaguugaagacagagcu

SEQ ID NO: 1532871 - RNA, 20 nt, Human
cagaguugaagacagagcua

SEQ ID NO: 1532872 - RNA, 14 nt, Human
cagaguugaagaca

SEQ ID NO: 1532873 - RNA, 15 nt, Human
cagaguugaagacag

SEQ ID NO: 1532874 - RNA, 16 nt, Human
cagaguugaagacaga

SEQ ID NO: 1532875 - RNA, 14 nt, Human
cagauccuggaaau

SEQ ID NO: 1532876 - RNA, 20 nt, Human
cagaucucuaacuucaccau

SEQ ID NO: 1532877 - RNA, 20 nt, Human
cagauacaggaaaagcugcu

SEQ ID NO: 1532878 - RNA, 21 nt, Human
cagauacaggaaaagcugcug

SEQ ID NO: 1532879 - RNA, 22 nt, Human
cagauacaggaaaagcugcuga

SEQ ID NO: 1532880 - RNA, 23 nt, Human
cagauacaggaaaagcugcugac

SEQ ID NO: 1532881 - RNA, 17 nt, Human
cagaugcaccagcccuu

SEQ ID NO: 1532882 - RNA, 22 nt, Human
cagaugcaccagcccuuagcag

SEQ ID NO: 1532883 - RNA, 13 nt, Human
cagaugcaccagc

SEQ ID NO: 1532884 - RNA, 14 nt, Human
cagaugcaccagcc

SEQ ID NO: 1532885 - RNA, 16 nt, Human
cagaugcaccagcccu

SEQ ID NO: 1532886 - RNA, 16 nt, Human
cagaggccaugggccu

SEQ ID NO: 1532887 - RNA, 14 nt, Human
cagaccacaaaacu

SEQ ID NO: 1532888 - RNA, 20 nt, Human
cagaccacaaaacuuuucua

SEQ ID NO: 1532889 - RNA, 13 nt, Human
cagacccugcccu

SEQ ID NO: 1532890 - RNA, 14 nt, Human
cagacccugcccug

SEQ ID NO: 1532891 - RNA, 16 nt, Human
cagacccggcugcgug

SEQ ID NO: 1532892 - RNA, 12 nt, Human
cagacccugccc

SEQ ID NO: 1532893 - RNA, 12 nt, Human
cagacccggcug

SEQ ID NO: 1532894 - RNA, 14 nt, Human
cagacccggcugcg

SEQ ID NO: 1532895 - RNA, 22 nt, Human
cagacccugcccugugggcccc

SEQ ID NO: 1532896 - RNA, 15 nt, Human
cagacccugcccugu

SEQ ID NO: 1532897 - RNA, 16 nt, Human
cagacccugcccugug

SEQ ID NO: 1532898 - RNA, 17 nt, Human
cagacccugcccugugg

SEQ ID NO: 1532899 - RNA, 21 nt, Human
cagacccugcccugugggccc

SEQ ID NO: 1532900 - RNA, 19 nt, Human
cagacggggcuggagugug

SEQ ID NO: 1532901 - RNA, 13 nt, Human
cagacggggcugg

SEQ ID NO: 1532902 - RNA, 19 nt, Human
cagagaaaguacuucucca

SEQ ID NO: 1532903 - RNA, 23 nt, Human
cagagaaaguacuucuccacccu

SEQ ID NO: 1532904 - RNA, 18 nt, Human
cagaauggggugcaugaa

SEQ ID NO: 1532905 - RNA, 14 nt, Human
cagaauuucccaaa

SEQ ID NO: 1532906 - RNA, 11 nt, Human
cagaauucuca

SEQ ID NO: 1532907 - RNA, 18 nt, Human
cagaauucucuaguuuga

SEQ ID NO: 1532908 - RNA, 15 nt, Human
cagaauucucuaguu

SEQ ID NO: 1532909 - RNA, 24 nt, Human
cagaauuucccaaagcagugcaug

SEQ ID NO: 1532910 - RNA, 12 nt, Human
cagacaaagcgu

SEQ ID NO: 1532911 - RNA, 17 nt, Human
cagaauuucccaaagca

SEQ ID NO: 1532912 - RNA, 18 nt, Human
cagaauuucccaaagcag

SEQ ID NO: 1532913 - RNA, 19 nt, Human
cagaauuucccaaagcagu

SEQ ID NO: 1532914 - RNA, 20 nt, Human
cagaauuucccaaagcagug

SEQ ID NO: 1532915 - RNA, 20 nt, Human
cagacaacaaaccuguuucu

SEQ ID NO: 1532916 - RNA, 22 nt, Human
cagacaaagcgugguggacaug

SEQ ID NO: 1532917 - RNA, 20 nt, Human
cagacaguuaagagaaauga

SEQ ID NO: 1532918 - RNA, 19 nt, Human
cagacaccuugacagggca

SEQ ID NO: 1532919 - RNA, 20 nt, Human
cagacaccuugacagggcac

SEQ ID NO: 1532920 - RNA, 22 nt, Human
cagacaccuugacagggcacac

SEQ ID NO: 1532921 - RNA, 19 nt, Human
cagacauacuaaccagcag

SEQ ID NO: 1532922 - RNA, 17 nt, Human
cagacauagaauuaaca

SEQ ID NO: 1532923 - RNA, 19 nt, Human
cagacauagaauuaacaca

SEQ ID NO: 1532924 - RNA, 14 nt, Human
cagacacaugucca

SEQ ID NO: 1532925 - RNA, 17 nt, Human
cagacacauguccaaga

SEQ ID NO: 1532926 - RNA, 21 nt, Human
cagacacauguccaagaagcc

SEQ ID NO: 1532927 - RNA, 22 nt, Human
cagacacauguccaagaagccc

SEQ ID NO: 1532928 - RNA, 23 nt, Human
cagacacauguccaagaagccca

SEQ ID NO: 1532929 - RNA, 13 nt, Human
cagacacaggccc

SEQ ID NO: 1532930 - RNA, 14 nt, Human
cagacacaggcccg

SEQ ID NO: 1532931 - RNA, 15 nt, Human
cagacacaggcccgg

SEQ ID NO: 1532932 - RNA, 17 nt, Human
cagacacaggcccggcu

SEQ ID NO: 1532933 - RNA, 18 nt, Human
cagacacaggcccggcuc

SEQ ID NO: 1532934 - RNA, 21 nt, Human
cagacacaggcccggcuccag

SEQ ID NO: 1532935 - RNA, 22 nt, Human
cagacacaggcccggcuccagg

SEQ ID NO: 1532936 - RNA, 23 nt, Human
cagacacaggcccggcuccaggc

SEQ ID NO: 1532937 - RNA, 18 nt, Human
cagaaagcagaacaguga

SEQ ID NO: 1532938 - RNA, 19 nt, Human
cagaaagcagaacagugau

SEQ ID NO: 1532939 - RNA, 23 nt, Human
cagaacagugauuaccagggacu

SEQ ID NO: 1532940 - RNA, 17 nt, Human
cagaaaaguugaauuuu

SEQ ID NO: 1532941 - RNA, 20 nt, Human
cagaaaaguugaauuuuaca

SEQ ID NO: 1532942 - RNA, 22 nt, Human
cagaaaaguugaauuuuacaug

SEQ ID NO: 1532943 - RNA, 19 nt, Human
cagaaaauauuauguguuu

SEQ ID NO: 1532944 - RNA, 23 nt, Human
cagaaaauggaagacagcucuua

SEQ ID NO: 1532945 - RNA, 16 nt, Human
cagaaaauggaagaca

SEQ ID NO: 1532946 - RNA, 20 nt, Human
cagaaaauggaagacagcuc

SEQ ID NO: 1532947 - RNA, 21 nt, Human
cagaaaauggaagacagcucu

SEQ ID NO: 1532948 - RNA, 22 nt, Human
cagaaaauggaagacagcucuu

SEQ ID NO: 1532949 - RNA, 22 nt, Human
cacuuucuagccagaggagaga

SEQ ID NO: 1532950 - RNA, 16 nt, Human
cacuuugggaggccaa

SEQ ID NO: 1532951 - RNA, 12 nt, Human
cacuuugggagg

SEQ ID NO: 1532952 - RNA, 13 nt, Human
cacuuugggaggc

SEQ ID NO: 1532953 - RNA, 13 nt, Human
cacuuuguucugg

SEQ ID NO: 1532954 - RNA, 14 nt, Human
cacuuuguucuggc

SEQ ID NO: 1532955 - RNA, 16 nt, Human
cacuuuguucuggcuc

SEQ ID NO: 1532956 - RNA, 23 nt, Human
cacuuuguucuggcucuuccagg

SEQ ID NO: 1532957 - RNA, 14 nt, Human
cacuuuuguucuug

SEQ ID NO: 1532958 - RNA, 22 nt, Human
cacuuuuguucuugguuuguaa

SEQ ID NO: 1532959 - RNA, 14 nt, Human
cagaagaaggcagc

SEQ ID NO: 1532960 - RNA, 15 nt, Human
cagaagaaggcagca

SEQ ID NO: 1532961 - RNA, 21 nt, Human
cagaagacacugaugggcaac

SEQ ID NO: 1532962 - RNA, 19 nt, Human
cagaagcaacccaaauguu

SEQ ID NO: 1532963 - RNA, 20 nt, Human
cagaagcaacccaaauguuc

SEQ ID NO: 1532964 - RNA, 19 nt, Human
cagaaggaagacuucaucc

SEQ ID NO: 1532965 - RNA, 17 nt, Human
cagaaggaucuucaucu

SEQ ID NO: 1532966 - RNA, 16 nt, Human
cagaaggaagacuuca

SEQ ID NO: 1532967 - RNA, 17 nt, Human
cagaaggaagacuucau

SEQ ID NO: 1532968 - RNA, 18 nt, Human
cagaaggaagacuucauc

SEQ ID NO: 1532969 - RNA, 19 nt, Human
cagaaggggguggugucuc

SEQ ID NO: 1532970 - RNA, 20 nt, Human
cagaaggggguggugucucc

SEQ ID NO: 1532971 - RNA, 21 nt, Human
cagaaggggguggugucucca

SEQ ID NO: 1532972 - RNA, 14 nt, Human
cagaaggggguggu

SEQ ID NO: 1532973 - RNA, 17 nt, Human
cagaaucucaaauaacu

SEQ ID NO: 1532974 - RNA, 18 nt, Human
cagaaucucaaauaacua

SEQ ID NO: 1532975 - RNA, 16 nt, Human
cagacaacaaaccugu

SEQ ID NO: 1532976 - RNA, 16 nt, Human
cacucucccccacccc

SEQ ID NO: 1532977 - RNA, 18 nt, Human
cacucucccccacccccu

SEQ ID NO: 1532978 - RNA, 20 nt, Human
cacucucccccacccccucc

SEQ ID NO: 1532979 - RNA, 12 nt, Human
cacucuccuugg

SEQ ID NO: 1532980 - RNA, 12 nt, Human
cacucugagacu

SEQ ID NO: 1532981 - RNA, 23 nt, Human
cacucugagacucgcgacaaugc

SEQ ID NO: 1532982 - RNA, 12 nt, Human
cacucuggcagc

SEQ ID NO: 1532983 - RNA, 13 nt, Human
cacucuggcagcu

SEQ ID NO: 1532984 - RNA, 14 nt, Human
cacucuggcagcuc

SEQ ID NO: 1532985 - RNA, 15 nt, Human
cacucauugaccuga

SEQ ID NO: 1532986 - RNA, 16 nt, Human
cacucaguccauagca

SEQ ID NO: 1532987 - RNA, 18 nt, Human
cacucauugaccugaggc

SEQ ID NO: 1532988 - RNA, 19 nt, Human
cacucauugaccugaggcc

SEQ ID NO: 1532989 - RNA, 20 nt, Human
cacucauugaccugaggccc

SEQ ID NO: 1532990 - RNA, 22 nt, Human
cacucauugaccugaggcccuu

SEQ ID NO: 1532991 - RNA, 12 nt, Human
cacucccugcaa

SEQ ID NO: 1532992 - RNA, 13 nt, Human
cacucccugcaac

SEQ ID NO: 1532993 - RNA, 16 nt, Human
cacucccugcaaccug

SEQ ID NO: 1532994 - RNA, 17 nt, Human
cacucccugcaaccuga

SEQ ID NO: 1532995 - RNA, 14 nt, Human
cacuccuucacaga

SEQ ID NO: 1532996 - RNA, 21 nt, Human
cacuccuucacagaugggugc

SEQ ID NO: 1532997 - RNA, 17 nt, Human
cacuaagagagaaugag

SEQ ID NO: 1532998 - RNA, 18 nt, Human
cacuaaccacgcuggacc

SEQ ID NO: 1532999 - RNA, 17 nt, Human
cacuaaggugugcucug

SEQ ID NO: 1533000 - RNA, 18 nt, Human
cacuaaggugugcucuga

SEQ ID NO: 1533001 - RNA, 21 nt, Human
cacuaaauugacacuuaaaaa

SEQ ID NO: 1533002 - RNA, 14 nt, Human
cacuaaccacgcug

SEQ ID NO: 1533003 - RNA, 15 nt, Human
cacuaaccacgcugg

SEQ ID NO: 1533004 - RNA, 16 nt, Human
cacuaaccacgcugga

SEQ ID NO: 1533005 - RNA, 19 nt, Human
cacuaguauuucuaugaaa

SEQ ID NO: 1533006 - RNA, 14 nt, Human
cacuauaauguaag

SEQ ID NO: 1533007 - RNA, 18 nt, Human
cacuauaauguaagcucu

SEQ ID NO: 1533008 - RNA, 14 nt, Human
cacuauagccuagg

SEQ ID NO: 1533009 - RNA, 21 nt, Human
cacuauagccuaggugacaga

SEQ ID NO: 1533010 - RNA, 15 nt, Human
cacuauguugcccag

SEQ ID NO: 1533011 - RNA, 16 nt, Human
cacuauguugcccagg

SEQ ID NO: 1533012 - RNA, 17 nt, Human
cacuauguugcccaggc

SEQ ID NO: 1533013 - RNA, 18 nt, Human
cacuauguugcccaggca

SEQ ID NO: 1533014 - RNA, 19 nt, Human
cacuauguugcccaggcag

SEQ ID NO: 1533015 - RNA, 22 nt, Human
cacucagaagacacugaugggc

SEQ ID NO: 1533016 - RNA, 18 nt, Human
cacucagaagacacugau

SEQ ID NO: 1533017 - RNA, 19 nt, Human
cacucagaagacacugaug

SEQ ID NO: 1533018 - RNA, 19 nt, Human
cacucacauuuauucugcu

SEQ ID NO: 1533019 - RNA, 20 nt, Human
cacucacauuuauucugcuc

SEQ ID NO: 1533020 - RNA, 12 nt, Human
cacucagaagac

SEQ ID NO: 1533021 - RNA, 16 nt, Human
cacucagaagacacug

SEQ ID NO: 1533022 - RNA, 17 nt, Human
cacucagaagacacuga

SEQ ID NO: 1533023 - RNA, 20 nt, Human
cacucaaaagcugggcaggu

SEQ ID NO: 1533024 - RNA, 16 nt, Human
cacucaaaucaagaaa

SEQ ID NO: 1533025 - RNA, 20 nt, Human
cacuauguugcccaggcagg

SEQ ID NO: 1533026 - RNA, 21 nt, Human
cacuauguugcccaggcaggu

SEQ ID NO: 1533027 - RNA, 15 nt, Human
cacucaaaagcuggg

SEQ ID NO: 1533028 - RNA, 17 nt, Human
cacucaaaagcugggca

SEQ ID NO: 1533029 - RNA, 18 nt, Human
cacucaaaagcugggcag

SEQ ID NO: 1533030 - RNA, 19 nt, Human
cacucaaaagcugggcagg

SEQ ID NO: 1533031 - RNA, 13 nt, Human
cacuaaacaaaga

SEQ ID NO: 1533032 - RNA, 23 nt, Human
cacguuucuaaaggcuaccuuug

SEQ ID NO: 1533033 - RNA, 14 nt, Human
cacguuucuaaagg

SEQ ID NO: 1533034 - RNA, 12 nt, Human
cacguuucuaaa

SEQ ID NO: 1533035 - RNA, 16 nt, Human
cacgugguccuaaucu

SEQ ID NO: 1533036 - RNA, 19 nt, Human
cacgugguccuaaucuucu

SEQ ID NO: 1533037 - RNA, 22 nt, Human
cacguucuuacuaguuucccuu

SEQ ID NO: 1533038 - RNA, 18 nt, Human
cacguacacacacauaca

SEQ ID NO: 1533039 - RNA, 19 nt, Human
cacguacacacacauacac

SEQ ID NO: 1533040 - RNA, 14 nt, Human
cacguacacacaca

SEQ ID NO: 1533041 - RNA, 19 nt, Human
cacgccuguaauccuagca

SEQ ID NO: 1533042 - RNA, 20 nt, Human
cacgccuguaauccuagcac

SEQ ID NO: 1533043 - RNA, 23 nt, Human
cacgcgugcacacaccagagccc

SEQ ID NO: 1533044 - RNA, 15 nt, Human
cacgcgugcacacac

SEQ ID NO: 1533045 - RNA, 16 nt, Human
cacgcgugcacacacc

SEQ ID NO: 1533046 - RNA, 21 nt, Human
cacgcgugcacacaccagagc

SEQ ID NO: 1533047 - RNA, 20 nt, Human
cacgcuggaccuugaacugg

SEQ ID NO: 1533048 - RNA, 17 nt, Human
cacgcuggaccuugaac

SEQ ID NO: 1533049 - RNA, 16 nt, Human
cacggcucacugcagc

SEQ ID NO: 1533050 - RNA, 17 nt, Human
cacggcucacugcagcc

SEQ ID NO: 1533051 - RNA, 19 nt, Human
cacggcucacugcagccuc

SEQ ID NO: 1533052 - RNA, 20 nt, Human
cacggcucacugcagccuca

SEQ ID NO: 1533053 - RNA, 13 nt, Human
cacgccacugcac

SEQ ID NO: 1533054 - RNA, 15 nt, Human
cacgccacugcacua

SEQ ID NO: 1533055 - RNA, 19 nt, Human
cacgccagauucuuuccug

SEQ ID NO: 1533056 - RNA, 20 nt, Human
cacgccagauucuuuccuga

SEQ ID NO: 1533057 - RNA, 22 nt, Human
cacgccagauucuuuccugagg

SEQ ID NO: 1533058 - RNA, 23 nt, Human
cacgccagauucuuuccugaggc

SEQ ID NO: 1533059 - RNA, 13 nt, Human
cacgcccccacug

SEQ ID NO: 1533060 - RNA, 15 nt, Human
cacgcccccacuggu

SEQ ID NO: 1533061 - RNA, 17 nt, Human
cacgcccccacugguga

SEQ ID NO: 1533062 - RNA, 18 nt, Human
cacgcccccacuggugac

SEQ ID NO: 1533063 - RNA, 16 nt, Human
cacgauuucuguuuag

SEQ ID NO: 1533064 - RNA, 14 nt, Human
cacgauuucuguuu

SEQ ID NO: 1533065 - RNA, 12 nt, Human
cacgauuucugu

SEQ ID NO: 1533066 - RNA, 17 nt, Human
cacgcacuucgggaggu

SEQ ID NO: 1533067 - RNA, 17 nt, Human
cacgagcaggcuacugu

SEQ ID NO: 1533068 - RNA, 19 nt, Human
cacgagcaggcuacuguca

SEQ ID NO: 1533069 - RNA, 20 nt, Human
cacgagcaggcuacugucag

SEQ ID NO: 1533070 - RNA, 22 nt, Human
cacgagcaggcuacugucagcu

SEQ ID NO: 1533071 - RNA, 14 nt, Human
caccuuagacaguc

SEQ ID NO: 1533072 - RNA, 16 nt, Human
caccuuagacaguccc

SEQ ID NO: 1533073 - RNA, 18 nt, Human
caccuuagacagucccug

SEQ ID NO: 1533074 - RNA, 19 nt, Human
caccuuagacagucccugc

SEQ ID NO: 1533075 - RNA, 15 nt, Human
caccuuauauuuacg

SEQ ID NO: 1533076 - RNA, 21 nt, Human
caccuuagacagucccugcca

SEQ ID NO: 1533077 - RNA, 23 nt, Human
caccuuagacagucccugccaau

SEQ ID NO: 1533078 - RNA, 18 nt, Human
caccuugacagggcacac

SEQ ID NO: 1533079 - RNA, 15 nt, Human
caccuugacagggca

SEQ ID NO: 1533080 - RNA, 16 nt, Human
caccuugacagggcac

SEQ ID NO: 1533081 - RNA, 13 nt, Human
caccuugacaggg

SEQ ID NO: 1533082 - RNA, 16 nt, Human
cacgacugcccggcag

SEQ ID NO: 1533083 - RNA, 17 nt, Human
cacgacugcccggcagg

SEQ ID NO: 1533084 - RNA, 16 nt, Human
cacgaauauugcugau

SEQ ID NO: 1533085 - RNA, 19 nt, Human
cacgaauauugcugauggu

SEQ ID NO: 1533086 - RNA, 22 nt, Human
cacgaauauugcugauggugca

SEQ ID NO: 1533087 - RNA, 23 nt, Human
cacugcaaccuccgccucuuggg

SEQ ID NO: 1533088 - RNA, 14 nt, Human
cacugcaaccuccg

SEQ ID NO: 1533089 - RNA, 16 nt, Human
cacugcaaccuccgcc

SEQ ID NO: 1533090 - RNA, 13 nt, Human
cacugcaaccucc

SEQ ID NO: 1533091 - RNA, 14 nt, Human
cacugaugggcaac

SEQ ID NO: 1533092 - RNA, 18 nt, Human
cacugaugggcaaccccc

SEQ ID NO: 1533093 - RNA, 24 nt, Human
cacugaugggcaacccccagccug

SEQ ID NO: 1533094 - RNA, 21 nt, Human
cacugagaauguaagaacuac

SEQ ID NO: 1533095 - RNA, 19 nt, Human
cacugagaauguaagaacu

SEQ ID NO: 1533096 - RNA, 20 nt, Human
cacugagaauguaagaacua

SEQ ID NO: 1533097 - RNA, 23 nt, Human
cacugagacagcccgggcucugc

SEQ ID NO: 1533098 - RNA, 13 nt, Human
cacugaggaagaa

SEQ ID NO: 1533099 - RNA, 14 nt, Human
cacugaggaagaac

SEQ ID NO: 1533100 - RNA, 15 nt, Human
cacugaggaagaacg

SEQ ID NO: 1533101 - RNA, 17 nt, Human
cacugaggaagaacggg

SEQ ID NO: 1533102 - RNA, 15 nt, Human
cacucugucgcccag

SEQ ID NO: 1533103 - RNA, 16 nt, Human
cacucugucgcccagu

SEQ ID NO: 1533104 - RNA, 19 nt, Human
cacucugucgcccagucug

SEQ ID NO: 1533105 - RNA, 23 nt, Human
cacugacauuguuggccaaagcc

SEQ ID NO: 1533106 - RNA, 20 nt, Human
cacucugucgcccagucugg

SEQ ID NO: 1533107 - RNA, 13 nt, Human
cacugacagauuu

SEQ ID NO: 1533108 - RNA, 17 nt, Human
cacugacagauuuccau

SEQ ID NO: 1533109 - RNA, 22 nt, Human
cacugacagauuuccauccuag

SEQ ID NO: 1533110 - RNA, 23 nt, Human
cacucuggcagcucagagagggu

SEQ ID NO: 1533111 - RNA, 20 nt, Human
cacucuggcagcucagagag

SEQ ID NO: 1533112 - RNA, 21 nt, Human
cacucuggcagcucagagagg

SEQ ID NO: 1533113 - RNA, 15 nt, Human
cacucuggcagcuca

SEQ ID NO: 1533114 - RNA, 16 nt, Human
cacucuggcagcucag

SEQ ID NO: 1533115 - RNA, 17 nt, Human
cacucuggcagcucaga

SEQ ID NO: 1533116 - RNA, 19 nt, Human
cacucuggcagcucagaga

SEQ ID NO: 1533117 - RNA, 16 nt, Human
cacugagaauguaaga

SEQ ID NO: 1533118 - RNA, 18 nt, Human
cacugagaauguaagaac

SEQ ID NO: 1533119 - RNA, 21 nt, Human
cacugacuucuaaguaaaacc

SEQ ID NO: 1533120 - RNA, 12 nt, Human
cacugagacagc

SEQ ID NO: 1533121 - RNA, 13 nt, Human
cacugagacagcc

SEQ ID NO: 1533122 - RNA, 14 nt, Human
cacugagacagccc

SEQ ID NO: 1533123 - RNA, 17 nt, Human
cacugagacagcccggg

SEQ ID NO: 1533124 - RNA, 19 nt, Human
cacugagacagcccgggcu

SEQ ID NO: 1533125 - RNA, 22 nt, Human
cacugagacagcccgggcucug

SEQ ID NO: 1533126 - RNA, 14 nt, Human
cacugacuucuaag

SEQ ID NO: 1533127 - RNA, 15 nt, Human
cacugacuucuaagu

SEQ ID NO: 1533128 - RNA, 16 nt, Human
cacugacuucuaagua

SEQ ID NO: 1533129 - RNA, 20 nt, Human
cacugacuucuaaguaaaac

SEQ ID NO: 1533130 - RNA, 20 nt, Human
cacugccuucucaacuccaa

SEQ ID NO: 1533131 - RNA, 12 nt, Human
cacugcucuggu

SEQ ID NO: 1533132 - RNA, 19 nt, Human
cacugcacuauagccuagg

SEQ ID NO: 1533133 - RNA, 14 nt, Human
cacugcaccgggcc

SEQ ID NO: 1533134 - RNA, 15 nt, Human
cacugcaccgggcca

SEQ ID NO: 1533135 - RNA, 16 nt, Human
cacugcaccgggccac

SEQ ID NO: 1533136 - RNA, 18 nt, Human
cacugcaccgggccacag

SEQ ID NO: 1533137 - RNA, 19 nt, Human
cacugcaccgggccacaga

SEQ ID NO: 1533138 - RNA, 18 nt, Human
cacugcacuauagccuag

SEQ ID NO: 1533139 - RNA, 21 nt, Human
cacugcuuuuggucuguguga

SEQ ID NO: 1533140 - RNA, 17 nt, Human
cacuggaacacuaauga

SEQ ID NO: 1533141 - RNA, 22 nt, Human
cacugcuuccagugaggcucug

SEQ ID NO: 1533142 - RNA, 20 nt, Human
cacugcuuuuggucugugug

SEQ ID NO: 1533143 - RNA, 18 nt, Human
cacugcuuccagugaggc

SEQ ID NO: 1533144 - RNA, 19 nt, Human
cacugcuuccagugaggcu

SEQ ID NO: 1533145 - RNA, 20 nt, Human
cacugcuuccagugaggcuc

SEQ ID NO: 1533146 - RNA, 21 nt, Human
cacugcuuccagugaggcucu

SEQ ID NO: 1533147 - RNA, 13 nt, Human
cacugcuuaacuu

SEQ ID NO: 1533148 - RNA, 14 nt, Human
cacugcuuccagug

SEQ ID NO: 1533149 - RNA, 15 nt, Human
cacugcuuccaguga

SEQ ID NO: 1533150 - RNA, 16 nt, Human
cacugcuuccagugag

SEQ ID NO: 1533151 - RNA, 14 nt, Human
cacugucaagauga

SEQ ID NO: 1533152 - RNA, 13 nt, Human
cacugugaagaga

SEQ ID NO: 1533153 - RNA, 14 nt, Human
cacugucuugaaga

SEQ ID NO: 1533154 - RNA, 14 nt, Human
cacugugccaugug

SEQ ID NO: 1533155 - RNA, 22 nt, Human
cacuguggguagacacacauga

SEQ ID NO: 1533156 - RNA, 24 nt, Human
cacuguggguagacacacaugaag

SEQ ID NO: 1533157 - RNA, 13 nt, Human
cacuguucucugc

SEQ ID NO: 1533158 - RNA, 14 nt, Human
cacuguucucugcc

SEQ ID NO: 1533159 - RNA, 15 nt, Human
cacuguucucugccc

SEQ ID NO: 1533160 - RNA, 16 nt, Human
cacuguucucugcccu

SEQ ID NO: 1533161 - RNA, 17 nt, Human
cacuguucucugcccuc

SEQ ID NO: 1533162 - RNA, 19 nt, Human
cacuguucucugcccucca

SEQ ID NO: 1533163 - RNA, 21 nt, Human
cacuguucucugcccuccaag

SEQ ID NO: 1533164 - RNA, 22 nt, Human
cacuguucucugcccuccaaga

SEQ ID NO: 1533165 - RNA, 19 nt, Human
cacuguggguagacacaca

SEQ ID NO: 1533166 - RNA, 17 nt, Human
cacugugcugagucuga

SEQ ID NO: 1533167 - RNA, 20 nt, Human
cacugugcugagucugaagg

SEQ ID NO: 1533168 - RNA, 21 nt, Human
cacugugcugagucugaaggc

SEQ ID NO: 1533169 - RNA, 22 nt, Human
cacugugcugagucugaaggcu

SEQ ID NO: 1533170 - RNA, 18 nt, Human
cacugugccaugugccag

SEQ ID NO: 1533171 - RNA, 15 nt, Human
cacugugccaugugc

SEQ ID NO: 1533172 - RNA, 16 nt, Human
cacugugccaugugcc

SEQ ID NO: 1533173 - RNA, 13 nt, Human
cacugugcugagu

SEQ ID NO: 1533174 - RNA, 15 nt, Human
cacugugcugagucu

SEQ ID NO: 1533175 - RNA, 15 nt, Human
cacuuggucugugag

SEQ ID NO: 1533176 - RNA, 17 nt, Human
cacuuggucugugagau

SEQ ID NO: 1533177 - RNA, 19 nt, Human
cacuuucuagccagaggag

SEQ ID NO: 1533178 - RNA, 20 nt, Human
cacuuucuagccagaggaga

SEQ ID NO: 1533179 - RNA, 24 nt, Human
cacuugcagacucuacagaggcca

SEQ ID NO: 1533180 - RNA, 14 nt, Human
cacuugcagacucu

SEQ ID NO: 1533181 - RNA, 18 nt, Human
cacuugcagacucuacag

SEQ ID NO: 1533182 - RNA, 19 nt, Human
cacuugcagacucuacaga

SEQ ID NO: 1533183 - RNA, 22 nt, Human
cacuugcagacucuacagaggc

SEQ ID NO: 1533184 - RNA, 18 nt, Human
cacuucuggguggggcag

SEQ ID NO: 1533185 - RNA, 19 nt, Human
cacuucuggguggggcagu

SEQ ID NO: 1533186 - RNA, 20 nt, Human
cacuugaacccgggaggcag

SEQ ID NO: 1533187 - RNA, 21 nt, Human
cacuugaacccgggaggcaga

SEQ ID NO: 1533188 - RNA, 23 nt, Human
cacuugaacccgggaggcagagg

SEQ ID NO: 1533189 - RNA, 16 nt, Human
cacuugacaucaacug

SEQ ID NO: 1533190 - RNA, 13 nt, Human
cacuugcagacuc

SEQ ID NO: 1533191 - RNA, 13 nt, Human
cacuugaguccag

SEQ ID NO: 1533192 - RNA, 19 nt, Human
cacuugacaucaacugcau

SEQ ID NO: 1533193 - RNA, 17 nt, Human
cacuugagaauuacccu

SEQ ID NO: 1533194 - RNA, 20 nt, Human
cacuugagaauuacccuuuu

SEQ ID NO: 1533195 - RNA, 22 nt, Human
cacuucugccauauucuguugg

SEQ ID NO: 1533196 - RNA, 21 nt, Human
cacuucgggaggucgaggcag

SEQ ID NO: 1533197 - RNA, 23 nt, Human
cacuucgggaggucgaggcagga

SEQ ID NO: 1533198 - RNA, 16 nt, Human
cacuucccuacaugga

SEQ ID NO: 1533199 - RNA, 14 nt, Human
cacuguugcccagg

SEQ ID NO: 1533200 - RNA, 12 nt, Human
cacuucagcuga

SEQ ID NO: 1533201 - RNA, 21 nt, Human
cacuucagcugacuuuucugu

SEQ ID NO: 1533202 - RNA, 21 nt, Human
caccgcagacaggaccaggga

SEQ ID NO: 1533203 - RNA, 14 nt, Human
caccggcuggccug

SEQ ID NO: 1533204 - RNA, 15 nt, Human
caccggcuggccugg

SEQ ID NO: 1533205 - RNA, 16 nt, Human
caccggcuggccuggc

SEQ ID NO: 1533206 - RNA, 17 nt, Human
caccggcuggccuggcc

SEQ ID NO: 1533207 - RNA, 18 nt, Human
caccggcuggccuggccc

SEQ ID NO: 1533208 - RNA, 20 nt, Human
caccggcuggccuggccccu

SEQ ID NO: 1533209 - RNA, 14 nt, Human
caccgggcacucag

SEQ ID NO: 1533210 - RNA, 15 nt, Human
caccgggcacucaga

SEQ ID NO: 1533211 - RNA, 22 nt, Human
caccgggcacucagaagacacu

SEQ ID NO: 1533212 - RNA, 15 nt, Human
caccgggccacagag

SEQ ID NO: 1533213 - RNA, 18 nt, Human
caccgggccacagagaaa

SEQ ID NO: 1533214 - RNA, 11 nt, Human
caccucaugga

SEQ ID NO: 1533215 - RNA, 12 nt, Human
caccucauggaa

SEQ ID NO: 1533216 - RNA, 14 nt, Human
caccucauggaauu

SEQ ID NO: 1533217 - RNA, 13 nt, Human
caccucucccuug

SEQ ID NO: 1533218 - RNA, 14 nt, Human
caccucucccuugg

SEQ ID NO: 1533219 - RNA, 17 nt, Human
caccucucccuuggauu

SEQ ID NO: 1533220 - RNA, 14 nt, Human
caccuccugccucg

SEQ ID NO: 1533221 - RNA, 13 nt, Human
caccuccugccuc

SEQ ID NO: 1533222 - RNA, 11 nt, Human
caccuccugcc

SEQ ID NO: 1533223 - RNA, 23 nt, Human
caccuggccucugcacuccccug

SEQ ID NO: 1533224 - RNA, 17 nt, Human
caccuggccucugcacu

SEQ ID NO: 1533225 - RNA, 18 nt, Human
caccuggccucugcacuc

SEQ ID NO: 1533226 - RNA, 19 nt, Human
caccuggccucugcacucc

SEQ ID NO: 1533227 - RNA, 20 nt, Human
caccuggccucugcacuccc

SEQ ID NO: 1533228 - RNA, 12 nt, Human
caccuggccucu

SEQ ID NO: 1533229 - RNA, 13 nt, Human
caccuggccucug

SEQ ID NO: 1533230 - RNA, 14 nt, Human
caccuggccucugc

SEQ ID NO: 1533231 - RNA, 15 nt, Human
caccuggccucugca

SEQ ID NO: 1533232 - RNA, 20 nt, Human
caccuggaauauauaaccag

SEQ ID NO: 1533233 - RNA, 23 nt, Human
caccugcggugcuaucuccccca

SEQ ID NO: 1533234 - RNA, 23 nt, Human
caccugaagacucauucuucugu

SEQ ID NO: 1533235 - RNA, 14 nt, Human
caccugaagacuca

SEQ ID NO: 1533236 - RNA, 15 nt, Human
caccugaagacucau

SEQ ID NO: 1533237 - RNA, 15 nt, Human
caccucucucacucc

SEQ ID NO: 1533238 - RNA, 17 nt, Human
caccucucucacuccuu

SEQ ID NO: 1533239 - RNA, 18 nt, Human
caccucucucacuccuug

SEQ ID NO: 1533240 - RNA, 19 nt, Human
caccucucucacuccuuga

SEQ ID NO: 1533241 - RNA, 18 nt, Human
caccucugcacaagcugc

SEQ ID NO: 1533242 - RNA, 19 nt, Human
caccucugcacaagcugca

SEQ ID NO: 1533243 - RNA, 12 nt, Human
caccgcagacag

SEQ ID NO: 1533244 - RNA, 13 nt, Human
caccgcagacagg

SEQ ID NO: 1533245 - RNA, 14 nt, Human
caccgcagacagga

SEQ ID NO: 1533246 - RNA, 15 nt, Human
caccgcagacaggac

SEQ ID NO: 1533247 - RNA, 17 nt, Human
caccgcagacaggacca

SEQ ID NO: 1533248 - RNA, 18 nt, Human
caccgcagacaggaccag

SEQ ID NO: 1533249 - RNA, 15 nt, Human
caccgaaaacguggc

SEQ ID NO: 1533250 - RNA, 18 nt, Human
caccgaaaacguggcugc

SEQ ID NO: 1533251 - RNA, 22 nt, Human
caccgaaaacguggcugcuuca

SEQ ID NO: 1533252 - RNA, 19 nt, Human
caccgaaaacguggcugcu

SEQ ID NO: 1533253 - RNA, 21 nt, Human
caccgaaaacguggcugcuuc

SEQ ID NO: 1533254 - RNA, 11 nt, Human
cacccugugau

SEQ ID NO: 1533255 - RNA, 12 nt, Human
cacccugugaug

SEQ ID NO: 1533256 - RNA, 15 nt, Human
cacccugugaugggg

SEQ ID NO: 1533257 - RNA, 18 nt, Human
cacccugugauggggccc

SEQ ID NO: 1533258 - RNA, 20 nt, Human
cacccugugauggggcccug

SEQ ID NO: 1533259 - RNA, 21 nt, Human
cacccugugauggggcccugc

SEQ ID NO: 1533260 - RNA, 22 nt, Human
cacccugugauggggcccugcc

SEQ ID NO: 1533261 - RNA, 23 nt, Human
cacccugugauggggcccugccu

SEQ ID NO: 1533262 - RNA, 19 nt, Human
cacccgcuaagagggaggg

SEQ ID NO: 1533263 - RNA, 12 nt, Human
cacccggccccu

SEQ ID NO: 1533264 - RNA, 13 nt, Human
cacccggccccug

SEQ ID NO: 1533265 - RNA, 14 nt, Human
cacccggccccugc

SEQ ID NO: 1533266 - RNA, 16 nt, Human
cacccggccccugcug

SEQ ID NO: 1533267 - RNA, 17 nt, Human
cacccggccccugcugg

SEQ ID NO: 1533268 - RNA, 18 nt, Human
cacccggccccugcuggu

SEQ ID NO: 1533269 - RNA, 21 nt, Human
cacccggccccugcugguuca

SEQ ID NO: 1533270 - RNA, 13 nt, Human
cacauauugauuu

SEQ ID NO: 1533271 - RNA, 20 nt, Human
caccccucaacaccucugca

SEQ ID NO: 1533272 - RNA, 15 nt, Human
caccccucccuuucu

SEQ ID NO: 1533273 - RNA, 18 nt, Human
caccccucccuuucuccc

SEQ ID NO: 1533274 - RNA, 17 nt, Human
caccccugguucucauc

SEQ ID NO: 1533275 - RNA, 18 nt, Human
caccccugguucucaucu

SEQ ID NO: 1533276 - RNA, 20 nt, Human
cacauauugauuuccguuaa

SEQ ID NO: 1533277 - RNA, 16 nt, Human
cacgccagauucuuuc

SEQ ID NO: 1533278 - RNA, 19 nt, Human adenovirus A
gaagcgguaugucggccug

SEQ ID NO: 1533279 - RNA, 21 nt, Human adenovirus A
ccaggcacagcagacacaauc

SEQ ID NO: 1533280 - RNA, 15 nt, Human adenovirus A
aacccugaauguuug

SEQ ID NO: 1533281 - RNA, 15 nt, Human adenovirus A
acuauucuagcaaaa

SEQ ID NO: 1533282 - RNA, 21 nt, Human adenovirus A
cucugauuucgauaaacaaaa

SEQ ID NO: 1533283 - RNA, 21 nt, Human adenovirus A
cacagcuuauucgccagucaa

SEQ ID NO: 1533284 - RNA, 16 nt, Human adenovirus A
uuaaccauuguaaaug

SEQ ID NO: 1533285 - RNA, 18 nt, Human adenovirus A
ccaagcguagccgcagca

SEQ ID NO: 1533286 - RNA, 22 nt, Human adenovirus A
cuacuuuauaacuaacuuuaau

SEQ ID NO: 1533287 - RNA, 16 nt, Human adenovirus A
gcggccacuaaagacc

SEQ ID NO: 1533288 - RNA, 13 nt, Human adenovirus A
ucuuuagaaacuu

SEQ ID NO: 1533289 - RNA, 15 nt, Human adenovirus A
aacuccgcgcaagga

SEQ ID NO: 1533290 - RNA, 16 nt, Human adenovirus A
gcauuaguucuuuucu

SEQ ID NO: 1533291 - RNA, 20 nt, Human adenovirus A
uuucccucacaaauuugcau

SEQ ID NO: 1533292 - RNA, 16 nt, Human adenovirus A
uaaccagcugggcaga

SEQ ID NO: 1533293 - RNA, 15 nt, Human adenovirus A
agagcaaagguaucu

SEQ ID NO: 1533294 - RNA, 21 nt, Human adenovirus A
uuaccagaaugaucacagcaa

SEQ ID NO: 1533295 - RNA, 22 nt, Human adenovirus A
acuguuguauuauuugaacaca

SEQ ID NO: 1533296 - RNA, 14 nt, Human adenovirus A
auucuguuggacac

SEQ ID NO: 1533297 - RNA, 14 nt, Human adenovirus A
gaucuauuguuaau

SEQ ID NO: 1533298 - RNA, 22 nt, Human adenovirus A
cgcucuggcaggggaagguguu

SEQ ID NO: 1533299 - RNA, 14 nt, Human adenovirus A
uacggacagucugu

SEQ ID NO: 1533300 - RNA, 21 nt, Human adenovirus A
gauggguguuuggcagcaaug

SEQ ID NO: 1533301 - RNA, 19 nt, Human adenovirus A
agccauugguuuaaugcau

SEQ ID NO: 1533302 - RNA, 15 nt, Human adenovirus A
gccguaccuuuuguu

SEQ ID NO: 1533303 - RNA, 19 nt, Human adenovirus A
cccaagcuaaccgcuuuuc

SEQ ID NO: 1533304 - RNA, 12 nt, Human adenovirus A
uacuaacaacuc

SEQ ID NO: 1533305 - RNA, 22 nt, Human adenovirus A
uccccuguggagccacugcuac

SEQ ID NO: 1533306 - RNA, 15 nt, Human adenovirus A
caugguaagcucuug

SEQ ID NO: 1533307 - RNA, 13 nt, Human adenovirus A
aggguacagugga

SEQ ID NO: 1533308 - RNA, 17 nt, Human adenovirus A
cauguggagcuuucaac

SEQ ID NO: 1533309 - RNA, 16 nt, Human adenovirus A
gcucgcccgggacagu

SEQ ID NO: 1533310 - RNA, 17 nt, Human adenovirus A
ucccauuggucccaucc

SEQ ID NO: 1533311 - RNA, 22 nt, Human adenovirus A
uuauuaaaaaucaaauggcucu

SEQ ID NO: 1533312 - RNA, 17 nt, Human adenovirus A
gacaccauugaaaccag

SEQ ID NO: 1533313 - RNA, 16 nt, Human adenovirus A
caaauugcggcucuuu

SEQ ID NO: 1533314 - RNA, 18 nt, Human adenovirus A
gccagcucacggugucag

SEQ ID NO: 1533315 - RNA, 15 nt, Human adenovirus A
acgcacacaacagaa

SEQ ID NO: 1533316 - RNA, 19 nt, Human adenovirus A
gcaacauagccccaggucc

SEQ ID NO: 1533317 - RNA, 21 nt, Human adenovirus A
gaaaccagcgccgcaaacuug

SEQ ID NO: 1533318 - RNA, 16 nt, Human adenovirus A
gccggucgcgagcugc

SEQ ID NO: 1533319 - RNA, 12 nt, Human adenovirus A
aaucuuaaaugg

SEQ ID NO: 1533320 - RNA, 22 nt, Human adenovirus A
gcacaauaguuuaauguuuccc

SEQ ID NO: 1533321 - RNA, 20 nt, Human adenovirus A
cucuucuaucaucaaacugc

SEQ ID NO: 1533322 - RNA, 15 nt, Human adenovirus A
ugauaaccuugcaaa

SEQ ID NO: 1533323 - RNA, 17 nt, Human adenovirus A
ccugccggucgagcgcg

SEQ ID NO: 1533324 - RNA, 16 nt, Human adenovirus A
ucguccaagaucuuug

SEQ ID NO: 1533325 - RNA, 18 nt, Human adenovirus A
cacuuaagucuuuacaau

SEQ ID NO: 1533326 - RNA, 22 nt, Human adenovirus A
uguggacccuauuuuuugggaa

SEQ ID NO: 1533327 - RNA, 22 nt, Human adenovirus A
gucaccaucacugacgcccgcc

SEQ ID NO: 1533328 - RNA, 14 nt, Human adenovirus A
gaggucuccauguc

SEQ ID NO: 1533329 - RNA, 19 nt, Human adenovirus A
accugggauacuaccgcug

SEQ ID NO: 1533330 - RNA, 13 nt, Human adenovirus A
gaaguaagcuguu

SEQ ID NO: 1533331 - RNA, 15 nt, Human adenovirus A
accauugaaaccagc

SEQ ID NO: 1533332 - RNA, 21 nt, Human adenovirus A
cauuuacaguacaaauacagu

SEQ ID NO: 1533333 - RNA, 16 nt, Human adenovirus A
augcuuuucgccagca

SEQ ID NO: 1533334 - RNA, 14 nt, Human adenovirus A
cauuacgcagggaa

SEQ ID NO: 1533335 - RNA, 22 nt, Human adenovirus A
cuuaauuucaugguuugcuaac

SEQ ID NO: 1533336 - RNA, 16 nt, Human adenovirus A
uacugcagccugucuu

SEQ ID NO: 1533337 - RNA, 21 nt, Human adenovirus A
gacaccaugguaaaaaggaag

SEQ ID NO: 1533338 - RNA, 23 nt, Human adenovirus A
cgcugccgacguugcaagaggag

SEQ ID NO: 1533339 - RNA, 20 nt, Human adenovirus A
gacuugcuaacuaccuagcu

SEQ ID NO: 1533340 - RNA, 22 nt, Human adenovirus A
gccccacuaugcgggagggaca

SEQ ID NO: 1533341 - RNA, 18 nt, Human adenovirus A
acgaccgccuuuucuaga

SEQ ID NO: 1533342 - RNA, 15 nt, Human adenovirus A
cuuccgcggccgcuu

SEQ ID NO: 1533343 - RNA, 17 nt, Human adenovirus A
caggaaaaucccccucc

SEQ ID NO: 1533344 - RNA, 18 nt, Human adenovirus A
aacuaacuuuaauguuuc

SEQ ID NO: 1533345 - RNA, 15 nt, Human adenovirus A
uagagcguucuggga

SEQ ID NO: 1533346 - RNA, 15 nt, Human adenovirus A
acugugcgguuuaag

SEQ ID NO: 1533347 - RNA, 17 nt, Human adenovirus A
cagaugauggaaagccg

SEQ ID NO: 1533348 - RNA, 14 nt, Human adenovirus A
acaacauugaacuu

SEQ ID NO: 1533349 - RNA, 23 nt, Human adenovirus A
cagagggaaagguauucagcuga

SEQ ID NO: 1533350 - RNA, 19 nt, Human adenovirus A
aucccagcugacauacacu

SEQ ID NO: 1533351 - RNA, 18 nt, Human adenovirus A
ucuuuaaaaaucacaaaa

SEQ ID NO: 1533352 - RNA, 18 nt, Human adenovirus A
gacgagcaauuaacuaag

SEQ ID NO: 1533353 - RNA, 18 nt, Human adenovirus A
aaaugcauuaucaugaaa

SEQ ID NO: 1533354 - RNA, 18 nt, Human adenovirus A
gagguguaccuggcggcc

SEQ ID NO: 1533355 - RNA, 14 nt, Human adenovirus A
uucuuuagaaacuu

SEQ ID NO: 1533356 - RNA, 21 nt, Human adenovirus A
cccuccuggauuuuacacugg

SEQ ID NO: 1533357 - RNA, 20 nt, Human adenovirus A
agguagugggcacauugcaa

SEQ ID NO: 1533358 - RNA, 22 nt, Human adenovirus A
cgcguuguacaaagggggcgca

SEQ ID NO: 1533359 - RNA, 14 nt, Human adenovirus A
acuaaagaaacaaa

SEQ ID NO: 1533360 - RNA, 12 nt, Human adenovirus A
acauaccuggca

SEQ ID NO: 1533361 - RNA, 13 nt, Human adenovirus A
ccagcucuuggaa

SEQ ID NO: 1533362 - RNA, 12 nt, Human adenovirus A
uauacugggugc

SEQ ID NO: 1533363 - RNA, 21 nt, Human adenovirus A
ccuaauggagugucacugccg

SEQ ID NO: 1533364 - RNA, 15 nt, Human adenovirus A
cucuaacaagcugcg

SEQ ID NO: 1533365 - RNA, 13 nt, Human adenovirus A
gcagacaguggcu

SEQ ID NO: 1533366 - RNA, 18 nt, Human adenovirus A
cgaaaaaaaucacuuccg

SEQ ID NO: 1533367 - RNA, 13 nt, Human adenovirus A
ggaccauugaagg

SEQ ID NO: 1533368 - RNA, 13 nt, Human adenovirus A
gggcagccaggcg

SEQ ID NO: 1533369 - RNA, 16 nt, Human adenovirus A
agugccucaaagugaa

SEQ ID NO: 1533370 - RNA, 23 nt, Human adenovirus A
ugcuucggcaagguagcauuuua

SEQ ID NO: 1533371 - RNA, 18 nt, Human adenovirus A
gauaacccugaauguuug

SEQ ID NO: 1533372 - RNA, 18 nt, Human adenovirus A
ggcgcggacgagcucccg

SEQ ID NO: 1533373 - RNA, 20 nt, Human adenovirus A
cacgccaaagccacaccucc

SEQ ID NO: 1533374 - RNA, 17 nt, Human adenovirus A
ccuucuggcuuguaugc

SEQ ID NO: 1533375 - RNA, 23 nt, Human adenovirus A
gcccucuccaaugaaacccgcug

SEQ ID NO: 1533376 - RNA, 20 nt, Human adenovirus A
gcgcagaccuacgguggcag

SEQ ID NO: 1533377 - RNA, 16 nt, Human adenovirus A
ucuacuguugaugcag

SEQ ID NO: 1533378 - RNA, 15 nt, Human adenovirus A
cugaccauuacuuuu

SEQ ID NO: 1533379 - RNA, 15 nt, Human adenovirus A
agccacaugggaagg

SEQ ID NO: 1533380 - RNA, 20 nt, Human adenovirus A
uugauacuuguuuuuucuga

SEQ ID NO: 1533381 - RNA, 19 nt, Human adenovirus A
agugcuggaaagugacauu

SEQ ID NO: 1533382 - RNA, 12 nt, Human adenovirus A
agcaaacacugc

SEQ ID NO: 1533383 - RNA, 16 nt, Human adenovirus A
cagugucauuuacugc

SEQ ID NO: 1533384 - RNA, 18 nt, Human adenovirus A
caguucaugcuaaaagcu

SEQ ID NO: 1533385 - RNA, 16 nt, Human adenovirus A
cuaggaaaacaaacaa

SEQ ID NO: 1533386 - RNA, 21 nt, Human adenovirus A
auuaacuaagugguugggaac

SEQ ID NO: 1533387 - RNA, 20 nt, Human adenovirus A
agcccgcgaaaaaaaucacu

SEQ ID NO: 1533388 - RNA, 20 nt, Human adenovirus A
caggucccguaaaauacaca

SEQ ID NO: 1533389 - RNA, 12 nt, Human adenovirus A
caacacaaaaaa

SEQ ID NO: 1533390 - RNA, 20 nt, Human adenovirus A
augcaguguaaccagaucua

SEQ ID NO: 1533391 - RNA, 23 nt, Human adenovirus A
cccggaggaagcggcgguucggg

SEQ ID NO: 1533392 - RNA, 20 nt, Human adenovirus A
cuaacgcuggggcacagcuu

SEQ ID NO: 1533393 - RNA, 18 nt, Human adenovirus A
ugcuuugcucgagacauc

SEQ ID NO: 1533394 - RNA, 13 nt, Human adenovirus A
cacggccucagca

SEQ ID NO: 1533395 - RNA, 13 nt, Human adenovirus A
aaaguaugcugca

SEQ ID NO: 1533396 - RNA, 12 nt, Human adenovirus A
uggcacaacaca

SEQ ID NO: 1533397 - RNA, 19 nt, Human adenovirus A
uggaugcuuugggagacag

SEQ ID NO: 1533398 - RNA, 22 nt, Human adenovirus A
gccacgcuuugaccggucaggc

SEQ ID NO: 1533399 - RNA, 15 nt, Human adenovirus A
cagcgccaacaaaaa

SEQ ID NO: 1533400 - RNA, 17 nt, Human adenovirus A
caacaccaacaguuuaa

SEQ ID NO: 1533401 - RNA, 17 nt, Human adenovirus A
agaguguguuuaaaugg

SEQ ID NO: 1533402 - RNA, 17 nt, Human adenovirus A
auauaguacugcuucca

SEQ ID NO: 1533403 - RNA, 20 nt, Human adenovirus A
agcccuauccgucuccagcu

SEQ ID NO: 1533404 - RNA, 15 nt, Human adenovirus A
acgccccauccgugg

SEQ ID NO: 1533405 - RNA, 13 nt, Human adenovirus A
uaagacuuacccc

SEQ ID NO: 1533406 - RNA, 19 nt, Human adenovirus A
agcagguguaaccagcugg

SEQ ID NO: 1533407 - RNA, 22 nt, Human adenovirus A
uacaacugcuccccucaacagc

SEQ ID NO: 1533408 - RNA, 21 nt, Human adenovirus A
augacaaugaauaagccaccg

SEQ ID NO: 1533409 - RNA, 16 nt, Human adenovirus A
gauagcccacaaggaa

SEQ ID NO: 1533410 - RNA, 19 nt, Human adenovirus A
gcgguggaacugcagacag

SEQ ID NO: 1533411 - RNA, 14 nt, Human adenovirus A
ucucagugucauuu

SEQ ID NO: 1533412 - RNA, 19 nt, Human adenovirus A
uccugauuguagcuacaga

SEQ ID NO: 1533413 - RNA, 17 nt, Human adenovirus A
accgaccugcaacagcc

SEQ ID NO: 1533414 - RNA, 14 nt, Human adenovirus A
ccggcuuguugaau

SEQ ID NO: 1533415 - RNA, 20 nt, Human adenovirus A
gugcuguggaaagcauuuug

SEQ ID NO: 1533416 - RNA, 23 nt, Human adenovirus A
uaguagagacaaugaaacuuuua

SEQ ID NO: 1533417 - RNA, 18 nt, Human adenovirus A
caacacggaguaaugaac

SEQ ID NO: 1533418 - RNA, 17 nt, Human adenovirus A
auugacucgguaguggc

SEQ ID NO: 1533419 - RNA, 18 nt, Human adenovirus A
ucuucagagcacacuggg

SEQ ID NO: 1533420 - RNA, 20 nt, Human adenovirus A
auuaugcuggaaccugaagu

SEQ ID NO: 1533421 - RNA, 16 nt, Human adenovirus A
acacaaaacacaaauu

SEQ ID NO: 1533422 - RNA, 18 nt, Human adenovirus A
gccccccuccccugugga

SEQ ID NO: 1533423 - RNA, 16 nt, Human adenovirus A
caugaccauguaauaa

SEQ ID NO: 1533424 - RNA, 23 nt, Human adenovirus A
uacuucaccgcgcaagcuuucau

SEQ ID NO: 1533425 - RNA, 15 nt, Human adenovirus A
cauacaguaagcaca

SEQ ID NO: 1533426 - RNA, 20 nt, Human adenovirus A
ugcaaaauggacucaaauaa

SEQ ID NO: 1533427 - RNA, 19 nt, Human adenovirus A
auacaacucuacaaaucuu

SEQ ID NO: 1533428 - RNA, 20 nt, Human adenovirus A
gcggcucuuuugcagcucca

SEQ ID NO: 1533429 - RNA, 14 nt, Human adenovirus A
augcaaagccagcc

SEQ ID NO: 1533430 - RNA, 14 nt, Human adenovirus A
aaguucuguuucau

SEQ ID NO: 1533431 - RNA, 18 nt, Human adenovirus A
gcaaacaugcuguauccc

SEQ ID NO: 1533432 - RNA, 16 nt, Human adenovirus A
ucauaagacaaagccu

SEQ ID NO: 1533433 - RNA, 22 nt, Human adenovirus A
aaauaaugcauuaccagcagcc

SEQ ID NO: 1533434 - RNA, 23 nt, Human adenovirus A
aggaauaucaacugcuaugugca

SEQ ID NO: 1533435 - RNA, 16 nt, Human adenovirus A
uccacggugcacuuuu

SEQ ID NO: 1533436 - RNA, 15 nt, Human adenovirus A
cgcugcucagcucca

SEQ ID NO: 1533437 - RNA, 15 nt, Human adenovirus A
gcggugguggagaag

SEQ ID NO: 1533438 - RNA, 16 nt, Human adenovirus A
uugaaccgguugaaac

SEQ ID NO: 1533439 - RNA, 14 nt, Human adenovirus A
aucaucaaacugcc

SEQ ID NO: 1533440 - RNA, 17 nt, Human adenovirus A
caaaguaugcugcacaa

SEQ ID NO: 1533441 - RNA, 17 nt, Human adenovirus A
cgccggcgaacgggcag

SEQ ID NO: 1533442 - RNA, 17 nt, Human adenovirus A
acuucccaaauuuucca

SEQ ID NO: 1533443 - RNA, 23 nt, Human adenovirus A
ugcuucauugaauuaccagaaug

SEQ ID NO: 1533444 - RNA, 14 nt, Human adenovirus A
acuuaauuucuaga

SEQ ID NO: 1533445 - RNA, 20 nt, Human adenovirus A
guuagccugaaaaauaaaaa

SEQ ID NO: 1533446 - RNA, 21 nt, Human adenovirus A
aacuucgccaauaaaaacaac

SEQ ID NO: 1533447 - RNA, 16 nt, Human adenovirus A
auucgcgugccaggca

SEQ ID NO: 1533448 - RNA, 11 nt, Human adenovirus A
uucuccaaauc

SEQ ID NO: 1533449 - RNA, 15 nt, Human adenovirus A
cacauacaucaccuc

SEQ ID NO: 1533450 - RNA, 17 nt, Human adenovirus A
ugcucuaauagaacugg

SEQ ID NO: 1533451 - RNA, 14 nt, Human adenovirus A
caacaacagcuucu

SEQ ID NO: 1533452 - RNA, 14 nt, Human adenovirus A
cagcacgagagggg

SEQ ID NO: 1533453 - RNA, 15 nt, Human adenovirus A
gccugacgcucuggc

SEQ ID NO: 1533454 - RNA, 14 nt, Human adenovirus A
aucagaagccagca

SEQ ID NO: 1533455 - RNA, 13 nt, Human adenovirus A
uagagaggaauuu

SEQ ID NO: 1533456 - RNA, 18 nt, Human adenovirus A
ugcacguacuagccccug

SEQ ID NO: 1533457 - RNA, 23 nt, Human adenovirus A
gccgccguacuuguaacugugga

SEQ ID NO: 1533458 - RNA, 13 nt, Human adenovirus A
aauaucaacugcu

SEQ ID NO: 1533459 - RNA, 23 nt, Human adenovirus A
uauauuaagguacauuggcauua

SEQ ID NO: 1533460 - RNA, 16 nt, Human adenovirus A
uguggcccaaugcaau

SEQ ID NO: 1533461 - RNA, 13 nt, Human adenovirus A
uuaagaaaucuuu

SEQ ID NO: 1533462 - RNA, 21 nt, Human adenovirus A
aacaaacuguuagacagagca

SEQ ID NO: 1533463 - RNA, 11 nt, Human adenovirus A
auacucuggaa

SEQ ID NO: 1533464 - RNA, 15 nt, Human adenovirus A
accgucgcuuucaac

SEQ ID NO: 1533465 - RNA, 16 nt, Human adenovirus A
gacacggcacgcggcc

SEQ ID NO: 1533466 - RNA, 21 nt, Human adenovirus A
ucguacaggaauucugaccac

SEQ ID NO: 1533467 - RNA, 21 nt, Human adenovirus A
gcagaugagcuucuugcuuua

SEQ ID NO: 1533468 - RNA, 20 nt, Human adenovirus A
ugacuuuucgcuccucgcgu

SEQ ID NO: 1533469 - RNA, 17 nt, Human adenovirus A
cagcaacggcaggaaau

SEQ ID NO: 1533470 - RNA, 21 nt, Human adenovirus A
uacaugaagauuucugcuguc

SEQ ID NO: 1533471 - RNA, 23 nt, Human adenovirus A
aagucuggaucuucaaacaccug

SEQ ID NO: 1533472 - RNA, 15 nt, Human adenovirus A
uaugagucaaaguau

SEQ ID NO: 1533473 - RNA, 22 nt, Human adenovirus A
augauuuaagaguaguacaaau

SEQ ID NO: 1533474 - RNA, 20 nt, Human adenovirus A
aaaagagccacagcucugau

SEQ ID NO: 1533475 - RNA, 17 nt, Human adenovirus A
acuguaaaaccuacaca

SEQ ID NO: 1533476 - RNA, 21 nt, Human adenovirus A
cauuaaaaucaaccuuucgau

SEQ ID NO: 1533477 - RNA, 21 nt, Human adenovirus A
caacagcggggaggaagcuga

SEQ ID NO: 1533478 - RNA, 16 nt, Human adenovirus A
gcgaucagccaugugc

SEQ ID NO: 1533479 - RNA, 11 nt, Human adenovirus A
ucagcacugcg

SEQ ID NO: 1533480 - RNA, 16 nt, Human adenovirus A
caaugacaaugaauaa

SEQ ID NO: 1533481 - RNA, 14 nt, Human adenovirus A
cagucaaccgcgcu

SEQ ID NO: 1533482 - RNA, 16 nt, Human adenovirus A
acauguggagcuuuca

SEQ ID NO: 1533483 - RNA, 16 nt, Human adenovirus A
acaaacgcccugcucc

SEQ ID NO: 1533484 - RNA, 16 nt, Human adenovirus A
aggaaaugauggcuuu

SEQ ID NO: 1533485 - RNA, 19 nt, Human adenovirus A
gccagauguaaaaguacgu

SEQ ID NO: 1533486 - RNA, 19 nt, Human adenovirus A
agugcaaaauaaugacuau

SEQ ID NO: 1533487 - RNA, 20 nt, Human adenovirus A
cucucaaacgccgacgcugc

SEQ ID NO: 1533488 - RNA, 22 nt, Human adenovirus A
uugaaaagacugagaaccgucu

SEQ ID NO: 1533489 - RNA, 22 nt, Human adenovirus A
aagucgcaauuagggccagcau

SEQ ID NO: 1533490 - RNA, 23 nt, Human adenovirus A
caucuacagcgacaaagcacuau

SEQ ID NO: 1533491 - RNA, 21 nt, Human adenovirus A
aaaacuuaaugcccaagguca

SEQ ID NO: 1533492 - RNA, 22 nt, Human adenovirus A
aguuuaacgaggugcagcugcc

SEQ ID NO: 1533493 - RNA, 13 nt, Human adenovirus A
auguuaaguuugg

SEQ ID NO: 1533494 - RNA, 19 nt, Human adenovirus A
cugcaaaccgcgcuuuucu

SEQ ID NO: 1533495 - RNA, 23 nt, Human adenovirus A
uauuuuagagagugccccccucc

SEQ ID NO: 1533496 - RNA, 20 nt, Human adenovirus A
gugccaggcauuuccaggug

SEQ ID NO: 1533497 - RNA, 16 nt, Human adenovirus A
aaagcgcagaguaucc

SEQ ID NO: 1533498 - RNA, 14 nt, Human adenovirus A
gauaugaugcaaga

SEQ ID NO: 1533499 - RNA, 12 nt, Human adenovirus A
cuccugccacca

SEQ ID NO: 1533500 - RNA, 17 nt, Human adenovirus A
gccacaccuccacccaa

SEQ ID NO: 1533501 - RNA, 15 nt, Human adenovirus A
cuggcgaacaggaag

SEQ ID NO: 1533502 - RNA, 14 nt, Human adenovirus A
aguaauggaguugg

SEQ ID NO: 1533503 - RNA, 16 nt, Human adenovirus A
cauucaugcugauguu

SEQ ID NO: 1533504 - RNA, 13 nt, Human adenovirus A
acacgcugcccug

SEQ ID NO: 1533505 - RNA, 15 nt, Human adenovirus A
aacuuuuuacuaacu

SEQ ID NO: 1533506 - RNA, 14 nt, Human adenovirus A
gccucuucuucuuc

SEQ ID NO: 1533507 - RNA, 18 nt, Human adenovirus A
ggaacugcagacaguggc

SEQ ID NO: 1533508 - RNA, 17 nt, Human adenovirus A
aggguggggugcugccc

SEQ ID NO: 1533509 - RNA, 13 nt, Human adenovirus A
caaagugaagugu

SEQ ID NO: 1533510 - RNA, 14 nt, Human adenovirus A
cuguuagacagagc

SEQ ID NO: 1533511 - RNA, 11 nt, Human adenovirus A
aacccuucccc

SEQ ID NO: 1533512 - RNA, 22 nt, Human adenovirus A
gaaauaaaaaauuacaaaggca

SEQ ID NO: 1533513 - RNA, 14 nt, Human adenovirus A
auggcgaccagugu

SEQ ID NO: 1533514 - RNA, 18 nt, Human adenovirus A
auucuuccacuguuguau

SEQ ID NO: 1533515 - RNA, 20 nt, Human adenovirus A
ugugagggccgaugcauaca

SEQ ID NO: 1533516 - RNA, 23 nt, Human adenovirus A
acugcgucuccccauucgcagca

SEQ ID NO: 1533517 - RNA, 19 nt, Human adenovirus A
uccgacaacagcugcuguc

SEQ ID NO: 1533518 - RNA, 19 nt, Human adenovirus A
acgggccgcagcugcggcc

SEQ ID NO: 1533519 - RNA, 14 nt, Human adenovirus A
augucgaaugcagg

SEQ ID NO: 1533520 - RNA, 19 nt, Human adenovirus A
gcuuccgcggccgcuucua

SEQ ID NO: 1533521 - RNA, 13 nt, Human adenovirus A
uaaccaaauacug

SEQ ID NO: 1533522 - RNA, 15 nt, Human adenovirus A
accaccucaaaaucu

SEQ ID NO: 1533523 - RNA, 16 nt, Human adenovirus A
gcuaacuuuuuuccca

SEQ ID NO: 1533524 - RNA, 23 nt, Human adenovirus A
aggagaaaauaacacauaagcau

SEQ ID NO: 1533525 - RNA, 22 nt, Human adenovirus A
cagcucuuuuggauguaaaaaa

SEQ ID NO: 1533526 - RNA, 23 nt, Human adenovirus A
uggaaauuaauuugcaggcuaau

SEQ ID NO: 1533527 - RNA, 17 nt, Human adenovirus A
uaauuaagcgagcccaa

SEQ ID NO: 1533528 - RNA, 21 nt, Human adenovirus A
gaugauagagauaagcaggaa

SEQ ID NO: 1533529 - RNA, 15 nt, Human adenovirus A
aagacuauagagagg

SEQ ID NO: 1533530 - RNA, 15 nt, Human adenovirus A
agcuuaccacucaga

SEQ ID NO: 1533531 - RNA, 14 nt, Human adenovirus A
aauaucaauguuuu

SEQ ID NO: 1533532 - RNA, 23 nt, Human adenovirus A
uaaggauugguuccuaauacaaa

SEQ ID NO: 1533533 - RNA, 23 nt, Human adenovirus A
ucuguucaauaaauacugcuccc

SEQ ID NO: 1533534 - RNA, 20 nt, Human adenovirus A
acauggaaaaaaugaaaguu

SEQ ID NO: 1533535 - RNA, 16 nt, Human adenovirus A
aaaauauguuaaauua

SEQ ID NO: 1533536 - RNA, 16 nt, Human adenovirus A
augaauuugaaauaaa

SEQ ID NO: 1533537 - RNA, 20 nt, Human adenovirus A
gaugaaggucccuugcuuga

SEQ ID NO: 1533538 - RNA, 21 nt, Human adenovirus A
auacgcgugguuaaacugccu

SEQ ID NO: 1533539 - RNA, 18 nt, Human adenovirus A
cuacuucacccugggaaa

SEQ ID NO: 1533540 - RNA, 13 nt, Human adenovirus A
uuggcggccaugc

SEQ ID NO: 1533541 - RNA, 15 nt, Human adenovirus A
auccccagacaguuu

SEQ ID NO: 1533542 - RNA, 12 nt, Human adenovirus A
gaaaaaugugua

SEQ ID NO: 1533543 - RNA, 13 nt, Human adenovirus A
agcgcgagaagaa

SEQ ID NO: 1533544 - RNA, 18 nt, Human adenovirus A
cuaucaucaaacugccug

SEQ ID NO: 1533545 - RNA, 16 nt, Human adenovirus A
cugccaccgucaauuc

SEQ ID NO: 1533546 - RNA, 15 nt, Human adenovirus A
cagguguacuggucc

SEQ ID NO: 1533547 - RNA, 18 nt, Human adenovirus A
cgacgcaaaaaaggggca

SEQ ID NO: 1533548 - RNA, 19 nt, Human adenovirus A
auggggucaugaaaguaaa

SEQ ID NO: 1533549 - RNA, 18 nt, Human adenovirus A
uugagcccgaaguugacu

SEQ ID NO: 1533550 - RNA, 17 nt, Human adenovirus A
cagcgccaccugccauu

SEQ ID NO: 1533551 - RNA, 17 nt, Human adenovirus A
gaugcgggcagccaggc

SEQ ID NO: 1533552 - RNA, 17 nt, Human adenovirus A
aaggguggggugcugcc

SEQ ID NO: 1533553 - RNA, 14 nt, Human adenovirus A
cgccuuaacuucua

SEQ ID NO: 1533554 - RNA, 13 nt, Human adenovirus A
agcaucccagcug

SEQ ID NO: 1533555 - RNA, 20 nt, Human adenovirus A
uguucaauaaauacugcucc

SEQ ID NO: 1533556 - RNA, 16 nt, Human adenovirus A
aaaauaaaacuuccaa

SEQ ID NO: 1533557 - RNA, 20 nt, Human adenovirus A
cauuugaucagaaaaaacua

SEQ ID NO: 1533558 - RNA, 14 nt, Human adenovirus A
acuaugagucaagu

SEQ ID NO: 1533559 - RNA, 16 nt, Human adenovirus A
cuuuuguuagaugcag

SEQ ID NO: 1533560 - RNA, 14 nt, Human adenovirus A
augcccgccuggca

SEQ ID NO: 1533561 - RNA, 18 nt, Human adenovirus A
caacugucaaaccugaca

SEQ ID NO: 1533562 - RNA, 20 nt, Human adenovirus A
cuagcggugcccuaucuguu

SEQ ID NO: 1533563 - RNA, 15 nt, Human adenovirus A
gcucauggcgggcuc

SEQ ID NO: 1533564 - RNA, 16 nt, Human adenovirus A
aaacaguacaaagcca

SEQ ID NO: 1533565 - RNA, 16 nt, Human adenovirus A
accauugaaaccagcg

SEQ ID NO: 1533566 - RNA, 17 nt, Human adenovirus A
cagcgccaacaaaaacc

SEQ ID NO: 1533567 - RNA, 12 nt, Human adenovirus A
agcuaugaugcg

SEQ ID NO: 1533568 - RNA, 15 nt, Human adenovirus A
caccgcccaggcagg

SEQ ID NO: 1533569 - RNA, 16 nt, Human adenovirus A
gcuucuaaaagagcca

SEQ ID NO: 1533570 - RNA, 15 nt, Human adenovirus A
gugacacgcaccgca

SEQ ID NO: 1533571 - RNA, 13 nt, Human adenovirus A
uaguccguuuucu

SEQ ID NO: 1533572 - RNA, 17 nt, Human adenovirus A
gucucaaaagcagccau

SEQ ID NO: 1533573 - RNA, 13 nt, Human adenovirus A
acugggugccgcc

SEQ ID NO: 1533574 - RNA, 20 nt, Human adenovirus A
agaaaaaaaccuucgagaac

SEQ ID NO: 1533575 - RNA, 19 nt, Human adenovirus A
cuccaauuuguggaggaau

SEQ ID NO: 1533576 - RNA, 16 nt, Human adenovirus A
aauuugucugaaaauu

SEQ ID NO: 1533577 - RNA, 15 nt, Human adenovirus A
gguguuuggcagcaa

SEQ ID NO: 1533578 - RNA, 14 nt, Human adenovirus A
uguaucuguugaau

SEQ ID NO: 1533579 - RNA, 17 nt, Human adenovirus A
uuccaauggucuucaag

SEQ ID NO: 1533580 - RNA, 15 nt, Human adenovirus A
uucuuugguuugcaa

SEQ ID NO: 1533581 - RNA, 16 nt, Human adenovirus A
caucuuuuacuaaaau

SEQ ID NO: 1533582 - RNA, 18 nt, Human adenovirus A
uuacaggaggaggaggaa

SEQ ID NO: 1533583 - RNA, 20 nt, Human adenovirus A
caucuggggggucggcaucu

SEQ ID NO: 1533584 - RNA, 17 nt, Human adenovirus A
aaaauucggcuauuuac

SEQ ID NO: 1533585 - RNA, 21 nt, Human adenovirus A
acccuuccccaccuuucuggu

SEQ ID NO: 1533586 - RNA, 14 nt, Human adenovirus A
ugcugucacugagc

SEQ ID NO: 1533587 - RNA, 12 nt, Human adenovirus A
agugucccaaca

SEQ ID NO: 1533588 - RNA, 13 nt, Human adenovirus A
uguuuuauuaaaa

SEQ ID NO: 1533589 - RNA, 21 nt, Human adenovirus A
cagccagauguaaaaguacgu

SEQ ID NO: 1533590 - RNA, 12 nt, Human adenovirus A
gacaaaaagacu

SEQ ID NO: 1533591 - RNA, 23 nt, Human adenovirus A
cugaagcgcgugucuucucccug

SEQ ID NO: 1533592 - RNA, 20 nt, Human adenovirus A
uaccugagcggcaagaacaa

SEQ ID NO: 1533593 - RNA, 16 nt, Human adenovirus A
gucgcgagcugcgccg

SEQ ID NO: 1533594 - RNA, 13 nt, Human adenovirus A
uaaccuugcaaaa

SEQ ID NO: 1533595 - RNA, 13 nt, Human adenovirus A
ucuuuacaacugu

SEQ ID NO: 1533596 - RNA, 17 nt, Human adenovirus A
acgaugacgaagaccag

SEQ ID NO: 1533597 - RNA, 21 nt, Human adenovirus A
acaacucuacuuaaaagcaag

SEQ ID NO: 1533598 - RNA, 20 nt, Human adenovirus A
gccauccgcaggcaguacuu

SEQ ID NO: 1533599 - RNA, 22 nt, Human adenovirus A
agaggaagaagucgccgcggcg

SEQ ID NO: 1533600 - RNA, 19 nt, Human adenovirus A
agcugagcaaugcuacuaa

SEQ ID NO: 1533601 - RNA, 11 nt, Human adenovirus A
ucagcugcaaa

SEQ ID NO: 1533602 - RNA, 20 nt, Human adenovirus A
gucgaccuguggcaccugca

SEQ ID NO: 1533603 - RNA, 14 nt, Human adenovirus A
cgcgcggccagagc

SEQ ID NO: 1533604 - RNA, 12 nt, Human adenovirus A
cguacacuggcu

SEQ ID NO: 1533605 - RNA, 21 nt, Human adenovirus A
aaaguggucagauccuuagau

SEQ ID NO: 1533606 - RNA, 15 nt, Human adenovirus A
augccaguuuacuga

SEQ ID NO: 1533607 - RNA, 23 nt, Human adenovirus A
cgcaaguucaaagaagagcugcu

SEQ ID NO: 1533608 - RNA, 16 nt, Human adenovirus A
aggaggguuugcauuu

SEQ ID NO: 1533609 - RNA, 22 nt, Human adenovirus A
cuccuaccacuguacuuuugcc

SEQ ID NO: 1533610 - RNA, 16 nt, Human adenovirus A
uacgguggcagccaag

SEQ ID NO: 1533611 - RNA, 17 nt, Human adenovirus A
cuccauccaaaacuaac

SEQ ID NO: 1533612 - RNA, 20 nt, Human adenovirus A
ccuuggaagaggugccuaaa

SEQ ID NO: 1533613 - RNA, 19 nt, Human adenovirus A
uaggcagcagcagcaacac

SEQ ID NO: 1533614 - RNA, 16 nt, Human adenovirus A
agguuagccugaaaaa

SEQ ID NO: 1533615 - RNA, 17 nt, Human adenovirus A
accuaucccaugaccaa

SEQ ID NO: 1533616 - RNA, 22 nt, Human adenovirus A
agggcacaauaguuuaauguuu

SEQ ID NO: 1533617 - RNA, 20 nt, Human adenovirus A
acucuccugagcgucaccca

SEQ ID NO: 1533618 - RNA, 18 nt, Human adenovirus A
acaacaaaacacugagcu

SEQ ID NO: 1533619 - RNA, 22 nt, Human adenovirus A
uucgcgacaacagcggggagga

SEQ ID NO: 1533620 - RNA, 18 nt, Human adenovirus A
cuucaucgcuuucuucug

SEQ ID NO: 1533621 - RNA, 23 nt, Human adenovirus A
gucuggaucuucaaacaccugca

SEQ ID NO: 1533622 - RNA, 12 nt, Human adenovirus A
gggccaggagga

SEQ ID NO: 1533623 - RNA, 16 nt, Human adenovirus A
uaauccuaggcaaaga

SEQ ID NO: 1533624 - RNA, 22 nt, Human adenovirus A
gacuuuuuugccugguaaaaca

SEQ ID NO: 1533625 - RNA, 13 nt, Human adenovirus A
acagucugcagga

SEQ ID NO: 1533626 - RNA, 18 nt, Human adenovirus A
gagaaccgucugcaugau

SEQ ID NO: 1533627 - RNA, 21 nt, Human adenovirus A
aacugggggcguacacuggcu

SEQ ID NO: 1533628 - RNA, 20 nt, Human adenovirus A
ucccauuacaguagagucuu

SEQ ID NO: 1533629 - RNA, 19 nt, Human adenovirus A
ucagucagagagaaaagca

SEQ ID NO: 1533630 - RNA, 13 nt, Human adenovirus A
augccgcaguggu

SEQ ID NO: 1533631 - RNA, 21 nt, Human adenovirus A
uccugcgacaaaugcgaccuc

SEQ ID NO: 1533632 - RNA, 12 nt, Human adenovirus A
ccugacgcucug

SEQ ID NO: 1533633 - RNA, 16 nt, Human adenovirus A
uagucgcgcacugggc

SEQ ID NO: 1533634 - RNA, 13 nt, Human adenovirus A
aguacugcuucca

SEQ ID NO: 1533635 - RNA, 19 nt, Human adenovirus A
cuuguacggacaacauccu

SEQ ID NO: 1533636 - RNA, 21 nt, Human adenovirus A
uaaagacuccggaaacaacac

SEQ ID NO: 1533637 - RNA, 17 nt, Human adenovirus A
ugccagaagcacuggca

SEQ ID NO: 1533638 - RNA, 12 nt, Human adenovirus A
cuucaucuuuuc

SEQ ID NO: 1533639 - RNA, 24 nt, Human adenovirus A
agacauauggcaccaaggcgugga

SEQ ID NO: 1533640 - RNA, 14 nt, Human adenovirus A
gaacgguugcuucu

SEQ ID NO: 1533641 - RNA, 16 nt, Human adenovirus A
gaccucagcccagggc

SEQ ID NO: 1533642 - RNA, 13 nt, Human adenovirus A
agagcuuaugcau

SEQ ID NO: 1533643 - RNA, 18 nt, Human adenovirus A
guuagucgcgcacugggc

SEQ ID NO: 1533644 - RNA, 15 nt, Human adenovirus A
aauacuggcuaacgc

SEQ ID NO: 1533645 - RNA, 18 nt, Human adenovirus A
ugccaggacaaagauuuu

SEQ ID NO: 1533646 - RNA, 21 nt, Human adenovirus A
ucaccaugggaauagugcucu

SEQ ID NO: 1533647 - RNA, 15 nt, Human adenovirus A
agaggcauaaaaacu

SEQ ID NO: 1533648 - RNA, 20 nt, Human adenovirus A
ucaaaguaccuuacaaacga

SEQ ID NO: 1533649 - RNA, 18 nt, Human adenovirus A
cauaauguaacccuuccc

SEQ ID NO: 1533650 - RNA, 18 nt, Human adenovirus A
uggcgcuacggcugucau

SEQ ID NO: 1533651 - RNA, 23 nt, Human adenovirus A
uggaguggcgauuccaaggaaug

SEQ ID NO: 1533652 - RNA, 16 nt, Human adenovirus A
cagcggcgccacccua

SEQ ID NO: 1533653 - RNA, 16 nt, Human adenovirus A
agcgguaugucggccu

SEQ ID NO: 1533654 - RNA, 13 nt, Human adenovirus A
gcgcgcggccaga

SEQ ID NO: 1533655 - RNA, 22 nt, Human adenovirus A
gccagccaagcguagccgcagc

SEQ ID NO: 1533656 - RNA, 20 nt, Human adenovirus A
ucuaaaguaccaggaagcug

SEQ ID NO: 1533657 - RNA, 22 nt, Human adenovirus A
uggagauaaguuuaaaggcauu

SEQ ID NO: 1533658 - RNA, 14 nt, Human adenovirus A
uuuggaaacuguau

SEQ ID NO: 1533659 - RNA, 15 nt, Human adenovirus A
aacaucgcaaaacac

SEQ ID NO: 1533660 - RNA, 16 nt, Human adenovirus A
gaggacgaccccgccg

SEQ ID NO: 1533661 - RNA, 14 nt, Human adenovirus A
uacucuuauaaaau

SEQ ID NO: 1533662 - RNA, 13 nt, Human adenovirus A
acaacaguacagg

SEQ ID NO: 1533663 - RNA, 19 nt, Human adenovirus A
ccacugcgucaguaacaaa

SEQ ID NO: 1533664 - RNA, 18 nt, Human adenovirus A
ucacagcuuauucgccag

SEQ ID NO: 1533665 - RNA, 17 nt, Human adenovirus A
cuagugcaacauuugua

SEQ ID NO: 1533666 - RNA, 13 nt, Human adenovirus A
cgacgggccaggc

SEQ ID NO: 1533667 - RNA, 17 nt, Human adenovirus A
aaacgaccgccuuuucu

SEQ ID NO: 1533668 - RNA, 18 nt, Human adenovirus A
accucuuuaggcauuaaa

SEQ ID NO: 1533669 - RNA, 14 nt, Human adenovirus A
cagcaaacacugcu

SEQ ID NO: 1533670 - RNA, 12 nt, Human adenovirus A
gggucggagaac

SEQ ID NO: 1533671 - RNA, 17 nt, Human adenovirus A
gagccacagccccuagc

SEQ ID NO: 1533672 - RNA, 16 nt, Human adenovirus A
ccaacaugccaaacgu

SEQ ID NO: 1533673 - RNA, 22 nt, Human adenovirus A
agaaaucuuuuaccaaugaauu

SEQ ID NO: 1533674 - RNA, 16 nt, Human adenovirus A
gcaccccuucccaccu

SEQ ID NO: 1533675 - RNA, 15 nt, Human adenovirus A
gcugugaaaugaggc

SEQ ID NO: 1533676 - RNA, 17 nt, Human adenovirus A
cuucauacccaacuuug

SEQ ID NO: 1533677 - RNA, 15 nt, Human adenovirus A
acaacuuuuaacauu

SEQ ID NO: 1533678 - RNA, 16 nt, Human adenovirus A
aaaaaguaaacugucu

SEQ ID NO: 1533679 - RNA, 16 nt, Human adenovirus A
ugcaaugcuuaacaua

SEQ ID NO: 1533680 - RNA, 15 nt, Human adenovirus A
acauaauccagcaag

SEQ ID NO: 1533681 - RNA, 20 nt, Human adenovirus A
ucuagccaacauccagugcg

SEQ ID NO: 1533682 - RNA, 18 nt, Human adenovirus A
accagcgucccaaaagca

SEQ ID NO: 1533683 - RNA, 17 nt, Human adenovirus A
ucuggcgaacaggaaga

SEQ ID NO: 1533684 - RNA, 18 nt, Human adenovirus A
uuaaugcuggaugcuuug

SEQ ID NO: 1533685 - RNA, 16 nt, Human adenovirus A
gaguaggaagacagca

SEQ ID NO: 1533686 - RNA, 15 nt, Human adenovirus A
cauuuauaaauguua

SEQ ID NO: 1533687 - RNA, 14 nt, Human adenovirus A
ccgcguggucagga

SEQ ID NO: 1533688 - RNA, 19 nt, Human adenovirus A
cuggaccuuuaacggaaaa

SEQ ID NO: 1533689 - RNA, 16 nt, Human adenovirus A
ugcuaugugcaaauau

SEQ ID NO: 1533690 - RNA, 23 nt, Human adenovirus A
gggauggguguuuggcagcaaug

SEQ ID NO: 1533691 - RNA, 15 nt, Human adenovirus A
caucaggagcagaaa

SEQ ID NO: 1533692 - RNA, 15 nt, Human adenovirus A
uggccagugugcgcu

SEQ ID NO: 1533693 - RNA, 14 nt, Human adenovirus A
ugauuucagcuucu

SEQ ID NO: 1533694 - RNA, 14 nt, Human adenovirus A
guuucuguacugca

SEQ ID NO: 1533695 - RNA, 17 nt, Human adenovirus A
gcgacagaguugcuuuu

SEQ ID NO: 1533696 - RNA, 23 nt, Human adenovirus A
uuguguguuucuaaaacagaacc

SEQ ID NO: 1533697 - RNA, 16 nt, Human adenovirus A
cauuacaauuaacugc

SEQ ID NO: 1533698 - RNA, 18 nt, Human adenovirus A
gagcggcugacagagcgc

SEQ ID NO: 1533699 - RNA, 20 nt, Human adenovirus A
gucgccagcaagugccuccu

SEQ ID NO: 1533700 - RNA, 15 nt, Human adenovirus A
caaucuacaaacugg

SEQ ID NO: 1533701 - RNA, 17 nt, Human adenovirus A
aucaacuuaacccuccc

SEQ ID NO: 1533702 - RNA, 17 nt, Human adenovirus A
cagcauaaaagcuucaa

SEQ ID NO: 1533703 - RNA, 16 nt, Human adenovirus A
ccaugcaaagccagcc

SEQ ID NO: 1533704 - RNA, 15 nt, Human adenovirus A
gcguggaacagccaa

SEQ ID NO: 1533705 - RNA, 20 nt, Human adenovirus A
aggucaucguaggacaacuu

SEQ ID NO: 1533706 - RNA, 18 nt, Human adenovirus A
auucuggagaauaagcau

SEQ ID NO: 1533707 - RNA, 16 nt, Human adenovirus A
aaaccggccagaugcu

SEQ ID NO: 1533708 - RNA, 13 nt, Human adenovirus A
augugguccaggg

SEQ ID NO: 1533709 - RNA, 17 nt, Human adenovirus A
aaccgauugggaaaaag

SEQ ID NO: 1533710 - RNA, 18 nt, Human adenovirus A
uuaaacaacaaaacacug

SEQ ID NO: 1533711 - RNA, 20 nt, Human adenovirus A
uggagcgagaucuuccaaca

SEQ ID NO: 1533712 - RNA, 18 nt, Human adenovirus A
uaauugauuuacaaaccg

SEQ ID NO: 1533713 - RNA, 13 nt, Human adenovirus A
guuugacaccaga

SEQ ID NO: 1533714 - RNA, 17 nt, Human adenovirus A
gaacuaaaccuuccauc

SEQ ID NO: 1533715 - RNA, 13 nt, Human adenovirus A
uguacaguuucug

SEQ ID NO: 1533716 - RNA, 18 nt, Human adenovirus A
aaagucauccaaagauca

SEQ ID NO: 1533717 - RNA, 23 nt, Human adenovirus A
ucuguuauguaugcccagcauga

SEQ ID NO: 1533718 - RNA, 12 nt, Human adenovirus A
uaauauuuugcc

SEQ ID NO: 1533719 - RNA, 17 nt, Human adenovirus A
gucggagaaccuuucaa

SEQ ID NO: 1533720 - RNA, 22 nt, Human adenovirus A
uacuuaccggaaaucugaaaau

SEQ ID NO: 1533721 - RNA, 23 nt, Human adenovirus A
aucuugggcaaaauaugcuguac

SEQ ID NO: 1533722 - RNA, 15 nt, Human adenovirus A
cccuccccuguggag

SEQ ID NO: 1533723 - RNA, 21 nt, Human adenovirus A
uuacaacuugcuuccagacaa

SEQ ID NO: 1533724 - RNA, 20 nt, Human adenovirus A
acagcauggagugcuggaaa

SEQ ID NO: 1533725 - RNA, 18 nt, Human adenovirus A
ccgcaaagaugaggcugg

SEQ ID NO: 1533726 - RNA, 12 nt, Human adenovirus A
cuaugaaucuuu

SEQ ID NO: 1533727 - RNA, 21 nt, Human adenovirus A
ccgugguuggugggcagggau

SEQ ID NO: 1533728 - RNA, 16 nt, Human adenovirus A
aggcuuucuucaaauc

SEQ ID NO: 1533729 - RNA, 20 nt, Human adenovirus A
ucaaauuccugugcaaacug

SEQ ID NO: 1533730 - RNA, 16 nt, Human adenovirus A
cagcgccgagccacag

SEQ ID NO: 1533731 - RNA, 15 nt, Human adenovirus A
caaauuugcauuucc

SEQ ID NO: 1533732 - RNA, 13 nt, Human adenovirus A
cucacugcuuugc

SEQ ID NO: 1533733 - RNA, 15 nt, Human adenovirus A
aguaucugcccauuu

SEQ ID NO: 1533734 - RNA, 22 nt, Human adenovirus A
aacaaccucccgauaccaaaaa

SEQ ID NO: 1533735 - RNA, 19 nt, Human adenovirus A
gacgcagaagcucuguuca

SEQ ID NO: 1533736 - RNA, 18 nt, Human adenovirus A
acguccaagcgguuauug

SEQ ID NO: 1533737 - RNA, 17 nt, Human adenovirus A
gugagcauccaaaugga

SEQ ID NO: 1533738 - RNA, 21 nt, Human adenovirus A
guucccaaauauccaggagga

SEQ ID NO: 1533739 - RNA, 15 nt, Human adenovirus A
cuuucuaccaaggaa

SEQ ID NO: 1533740 - RNA, 21 nt, Human adenovirus A
cagaacccaguaugcugaaga

SEQ ID NO: 1533741 - RNA, 14 nt, Human adenovirus A
gcaccagaaagcag

SEQ ID NO: 1533742 - RNA, 22 nt, Human adenovirus A
ccuuccgugguuugguggaaaa

SEQ ID NO: 1533743 - RNA, 19 nt, Human adenovirus A
agcuacgcaguuuuucuac

SEQ ID NO: 1533744 - RNA, 14 nt, Human adenovirus A
gaucuagaaauuga

SEQ ID NO: 1533745 - RNA, 20 nt, Human adenovirus A
caauaacuacaaacaguuuc

SEQ ID NO: 1533746 - RNA, 14 nt, Human adenovirus A
aagcgaugacucag

SEQ ID NO: 1533747 - RNA, 14 nt, Human adenovirus A
acuaggggcuggcu

SEQ ID NO: 1533748 - RNA, 13 nt, Human adenovirus A
gaagcuggccaua

SEQ ID NO: 1533749 - RNA, 14 nt, Human adenovirus A
cagcucuugcagua

SEQ ID NO: 1533750 - RNA, 13 nt, Human adenovirus A
uuaguuuggcaga

SEQ ID NO: 1533751 - RNA, 19 nt, Human adenovirus A
cccaguuuuugcagugcca

SEQ ID NO: 1533752 - RNA, 12 nt, Human adenovirus A
auggaaccccaa

SEQ ID NO: 1533753 - RNA, 16 nt, Human adenovirus A
cgcagucaccaccagc

SEQ ID NO: 1533754 - RNA, 14 nt, Human adenovirus A
agucacaaguacau

SEQ ID NO: 1533755 - RNA, 16 nt, Human adenovirus A
caacaccucacaaggu

SEQ ID NO: 1533756 - RNA, 16 nt, Human adenovirus A
uccacacaucucaccu

SEQ ID NO: 1533757 - RNA, 13 nt, Human adenovirus A
gcgaccucagccc

SEQ ID NO: 1533758 - RNA, 21 nt, Human adenovirus A
uguaucuggacauccauguga

SEQ ID NO: 1533759 - RNA, 22 nt, Human adenovirus A
uucauguggucaggucuaucaa

SEQ ID NO: 1533760 - RNA, 21 nt, Human adenovirus A
auuacacucaggccauaaaga

SEQ ID NO: 1533761 - RNA, 22 nt, Human adenovirus A
cuuuauauugcauuuguccugu

SEQ ID NO: 1533762 - RNA, 19 nt, Human adenovirus A
acgagcucccggaggaagc

SEQ ID NO: 1533763 - RNA, 13 nt, Human adenovirus A
aaauuacacacua

SEQ ID NO: 1533764 - RNA, 19 nt, Human adenovirus A
uuuauaaccaaucuacaaa

SEQ ID NO: 1533765 - RNA, 18 nt, Human adenovirus A
aauuauugcuuuccucuu

SEQ ID NO: 1533766 - RNA, 23 nt, Human adenovirus A
agucucacguacuuacagggaga

SEQ ID NO: 1533767 - RNA, 22 nt, Human adenovirus A
ugagcgcugcggucuggggugc

SEQ ID NO: 1533768 - RNA, 15 nt, Human adenovirus A
cuuacucuauugcca

SEQ ID NO: 1533769 - RNA, 16 nt, Human adenovirus A
agguauuccuccuuau

SEQ ID NO: 1533770 - RNA, 17 nt, Human adenovirus A
caccaguuggaagaaug

SEQ ID NO: 1533771 - RNA, 18 nt, Human adenovirus A
guuuaacgaggugcagcu

SEQ ID NO: 1533772 - RNA, 18 nt, Human adenovirus A
ucuuacaugggcaucuug

SEQ ID NO: 1533773 - RNA, 22 nt, Human adenovirus A
uuuaagucgagauucauaccug

SEQ ID NO: 1533774 - RNA, 15 nt, Human adenovirus A
acccuccguguuccc

SEQ ID NO: 1533775 - RNA, 19 nt, Human adenovirus A
accuuuaguauagguauug

SEQ ID NO: 1533776 - RNA, 17 nt, Human adenovirus A
ccaugaaaacagcauua

SEQ ID NO: 1533777 - RNA, 19 nt, Human adenovirus A
uuuguccaguuuacuaaca

SEQ ID NO: 1533778 - RNA, 22 nt, Human adenovirus A
ucaaagaagagcugcugcaggc

SEQ ID NO: 1533779 - RNA, 18 nt, Human adenovirus A
aaaggaagcugcuguucu

SEQ ID NO: 1533780 - RNA, 20 nt, Human adenovirus A
uaacauguuuaugcgcugua

SEQ ID NO: 1533781 - RNA, 14 nt, Human adenovirus A
aacagacgcucucc

SEQ ID NO: 1533782 - RNA, 13 nt, Human adenovirus A
aguucaaacagug

SEQ ID NO: 1533783 - RNA, 21 nt, Human adenovirus A
uuuggcggccaugcaaagcca

SEQ ID NO: 1533784 - RNA, 21 nt, Human adenovirus A
caaugcuuggaagaaaaaaac

SEQ ID NO: 1533785 - RNA, 20 nt, Human adenovirus A
gccaacaucaugaaaacagc

SEQ ID NO: 1533786 - RNA, 15 nt, Human adenovirus A
acgauaccacucgag

SEQ ID NO: 1533787 - RNA, 20 nt, Human adenovirus A
gacccgauuacuuuuuucaa

SEQ ID NO: 1533788 - RNA, 22 nt, Human adenovirus A
acaucuacagcgacaaagcacu

SEQ ID NO: 1533789 - RNA, 23 nt, Human adenovirus A
uguccuacauuggaguuggaaga

SEQ ID NO: 1533790 - RNA, 19 nt, Human adenovirus A
augcuuuucgccagcagcc

SEQ ID NO: 1533791 - RNA, 19 nt, Human adenovirus A
gcugcaguuugucauuacu

SEQ ID NO: 1533792 - RNA, 15 nt, Human adenovirus A
cucagaaagccaacc

SEQ ID NO: 1533793 - RNA, 22 nt, Human adenovirus A
ucccauagcucaguuauauuuu

SEQ ID NO: 1533794 - RNA, 17 nt, Human adenovirus A
guagugggcacauugca

SEQ ID NO: 1533795 - RNA, 15 nt, Human adenovirus A
ucagauagcaagcgu

SEQ ID NO: 1533796 - RNA, 20 nt, Human adenovirus A
ggaguuggaagaaggagaag

SEQ ID NO: 1533797 - RNA, 21 nt, Human adenovirus A
agcugccgucuucguggagaa

SEQ ID NO: 1533798 - RNA, 20 nt, Human adenovirus A
gggcagcccaacccuuccca

SEQ ID NO: 1533799 - RNA, 23 nt, Human adenovirus A
uacugaaaaauagugacguaaau

SEQ ID NO: 1533800 - RNA, 17 nt, Human adenovirus A
aaagcauaauaugguuu

SEQ ID NO: 1533801 - RNA, 19 nt, Human adenovirus A
agugccagaagcacuggca

SEQ ID NO: 1533802 - RNA, 15 nt, Human adenovirus A
caaacuuucuccaaa

SEQ ID NO: 1533803 - RNA, 12 nt, Human adenovirus A
agaugccuggca

SEQ ID NO: 1533804 - RNA, 21 nt, Human adenovirus A
gaacggaacuacucagaacaa

SEQ ID NO: 1533805 - RNA, 19 nt, Human adenovirus A
aauaguggcugcaagguca

SEQ ID NO: 1533806 - RNA, 21 nt, Human adenovirus A
cagccgaaagaccacuaaaag

SEQ ID NO: 1533807 - RNA, 14 nt, Human adenovirus A
aacacaugucuccu

SEQ ID NO: 1533808 - RNA, 20 nt, Human adenovirus A
ccuugcagcgguuguaauaa

SEQ ID NO: 1533809 - RNA, 23 nt, Human adenovirus A
cuccguguucccacaguaggaag

SEQ ID NO: 1533810 - RNA, 22 nt, Human adenovirus A
uaccgcucgucaagccuaccug

SEQ ID NO: 1533811 - RNA, 22 nt, Human adenovirus A
cuuguucuuccucuucuaccuc

SEQ ID NO: 1533812 - RNA, 18 nt, Human adenovirus A
guggaucuccugccacca

SEQ ID NO: 1533813 - RNA, 23 nt, Human adenovirus A
uacgcagggaaaaauucuagccc

SEQ ID NO: 1533814 - RNA, 13 nt, Human adenovirus A
guggagccacugc

SEQ ID NO: 1533815 - RNA, 20 nt, Human adenovirus A
caaugaauaagccaccgcuc

SEQ ID NO: 1533816 - RNA, 15 nt, Human adenovirus A
aucaguguaaaaaag

SEQ ID NO: 1533817 - RNA, 17 nt, Human adenovirus A
ucugugagugcugauug

SEQ ID NO: 1533818 - RNA, 20 nt, Human adenovirus A
cucauuugcgcccagacgua

SEQ ID NO: 1533819 - RNA, 20 nt, Human adenovirus A
cagacuacguuuuacauccu

SEQ ID NO: 1533820 - RNA, 17 nt, Human adenovirus A
ugaaagaucacagccag

SEQ ID NO: 1533821 - RNA, 19 nt, Human adenovirus A
aagcuauuugagccuucau

SEQ ID NO: 1533822 - RNA, 20 nt, Human adenovirus A
aagaaagagaacaaacagug

SEQ ID NO: 1533823 - RNA, 23 nt, Human adenovirus A
guuacuucguugauaucaauguu

SEQ ID NO: 1533824 - RNA, 20 nt, Human adenovirus A
uggaacucgagugcaugcau

SEQ ID NO: 1533825 - RNA, 21 nt, Human adenovirus A
ugcuggugaaagaucacagcc

SEQ ID NO: 1533826 - RNA, 14 nt, Human adenovirus A
cuauugcgcagcaa

SEQ ID NO: 1533827 - RNA, 21 nt, Human adenovirus A
agucacucaagcggcauuccc

SEQ ID NO: 1533828 - RNA, 13 nt, Human adenovirus A
cucuuuaacauuc

SEQ ID NO: 1533829 - RNA, 23 nt, Human adenovirus A
aacuaguuuacccgccaguguua

SEQ ID NO: 1533830 - RNA, 20 nt, Human adenovirus A
aaugccuguuuuguauuauu

SEQ ID NO: 1533831 - RNA, 18 nt, Human adenovirus A
cauuacuuuuaaauacug

SEQ ID NO: 1533832 - RNA, 13 nt, Human adenovirus A
gaguuagaggaaa

SEQ ID NO: 1533833 - RNA, 17 nt, Human adenovirus A
gcagucugacagcaauu

SEQ ID NO: 1533834 - RNA, 21 nt, Human adenovirus A
ucggcuguauacuaccccucc

SEQ ID NO: 1533835 - RNA, 14 nt, Human adenovirus A
agcuccauggggcg

SEQ ID NO: 1533836 - RNA, 11 nt, Human adenovirus A
ccaugcaaagc

SEQ ID NO: 1533837 - RNA, 16 nt, Human adenovirus A
uugcuaaauuggccuu

SEQ ID NO: 1533838 - RNA, 22 nt, Human adenovirus A
gaacaguaucuggagcggucuu

SEQ ID NO: 1533839 - RNA, 14 nt, Human adenovirus A
cuccgacaacagcu

SEQ ID NO: 1533840 - RNA, 17 nt, Human adenovirus A
uggcagcggcgccaccc

SEQ ID NO: 1533841 - RNA, 13 nt, Human adenovirus A
cggaggaaagggc

SEQ ID NO: 1533842 - RNA, 20 nt, Human adenovirus A
agcaaaaauguuuucuggau

SEQ ID NO: 1533843 - RNA, 21 nt, Human adenovirus A
caccgccaugcgcgcggccag

SEQ ID NO: 1533844 - RNA, 19 nt, Human adenovirus A
ggucagauucuucuuccca

SEQ ID NO: 1533845 - RNA, 16 nt, Human adenovirus A
cuaccgucaucucuac

SEQ ID NO: 1533846 - RNA, 21 nt, Human adenovirus A
cauguaucagcagccaacuua

SEQ ID NO: 1533847 - RNA, 12 nt, Human adenovirus A
ccuaccacugua

SEQ ID NO: 1533848 - RNA, 14 nt, Human adenovirus A
uuuuguuagaugca

SEQ ID NO: 1533849 - RNA, 13 nt, Human adenovirus A
caacgaaggccaa

SEQ ID NO: 1533850 - RNA, 18 nt, Human adenovirus A
ccaacuuaacgcaguagu

SEQ ID NO: 1533851 - RNA, 22 nt, Human adenovirus A
guucaacaacagcuucuaaaag

SEQ ID NO: 1533852 - RNA, 21 nt, Human adenovirus A
gcagcuccaaccaugaaaaca

SEQ ID NO: 1533853 - RNA, 19 nt, Human adenovirus A
uggagccacaggaaagcuu

SEQ ID NO: 1533854 - RNA, 21 nt, Human adenovirus A
cccucgaugaugccgcagugg

SEQ ID NO: 1533855 - RNA, 14 nt, Human adenovirus A
guuccauggcuucg

SEQ ID NO: 1533856 - RNA, 20 nt, Human adenovirus A
cuaccugacacuacagagcu

SEQ ID NO: 1533857 - RNA, 18 nt, Human adenovirus A
caaacgauuauugucaca

SEQ ID NO: 1533858 - RNA, 20 nt, Human adenovirus A
uggccauaauguaacccuuc

SEQ ID NO: 1533859 - RNA, 16 nt, Human adenovirus A
agguguuaucuucaaa

SEQ ID NO: 1533860 - RNA, 16 nt, Human adenovirus A
aaacaacaaaacacug

SEQ ID NO: 1533861 - RNA, 22 nt, Human adenovirus A
augccagacacgcaucuugugu

SEQ ID NO: 1533862 - RNA, 16 nt, Human adenovirus A
ggaacagacaccgccc

SEQ ID NO: 1533863 - RNA, 12 nt, Human adenovirus A
uugggacagaac

SEQ ID NO: 1533864 - RNA, 19 nt, Human adenovirus A
accccaagauuaccacgcc

SEQ ID NO: 1533865 - RNA, 18 nt, Human adenovirus A
caagcacgccaaagccac

SEQ ID NO: 1533866 - RNA, 16 nt, Human adenovirus A
agcgaugacucagcug

SEQ ID NO: 1533867 - RNA, 13 nt, Human adenovirus A
accaaagccaugg

SEQ ID NO: 1533868 - RNA, 15 nt, Human adenovirus A
ugaaggcauuuaagg

SEQ ID NO: 1533869 - RNA, 23 nt, Human adenovirus A
ucacuuacauuauguaaagucag

SEQ ID NO: 1533870 - RNA, 18 nt, Human adenovirus A
aagaucuucguaggaaag

SEQ ID NO: 1533871 - RNA, 20 nt, Human adenovirus A
aaauacacauaaagagucuc

SEQ ID NO: 1533872 - RNA, 21 nt, Human adenovirus A
cuaagaaggcacccucccaga

SEQ ID NO: 1533873 - RNA, 17 nt, Human adenovirus A
uaaacaaaagcaaagca

SEQ ID NO: 1533874 - RNA, 15 nt, Human adenovirus A
uucuucgacuuuugc

SEQ ID NO: 1533875 - RNA, 13 nt, Human adenovirus A
aaggagaaaagcg

SEQ ID NO: 1533876 - RNA, 12 nt, Human adenovirus A
uaauugauuuac

SEQ ID NO: 1533877 - RNA, 18 nt, Human adenovirus A
agccgucuacucacagcu

SEQ ID NO: 1533878 - RNA, 16 nt, Human adenovirus A
agaucuucguaggaaa

SEQ ID NO: 1533879 - RNA, 16 nt, Human adenovirus A
cuucuuguacucaaau

SEQ ID NO: 1533880 - RNA, 18 nt, Human adenovirus A
ggcguuagcguccacaca

SEQ ID NO: 1533881 - RNA, 12 nt, Human adenovirus A
uuacucugcuaa

SEQ ID NO: 1533882 - RNA, 16 nt, Human adenovirus A
cugucaacagcauugg

SEQ ID NO: 1533883 - RNA, 13 nt, Human adenovirus A
cagcuaacgccac

SEQ ID NO: 1533884 - RNA, 22 nt, Human adenovirus A
uggguccuacggagggaagaaa

SEQ ID NO: 1533885 - RNA, 17 nt, Human adenovirus A
aaaaaucaaauggcucu

SEQ ID NO: 1533886 - RNA, 16 nt, Human adenovirus A
auucagcuaacaaugc

SEQ ID NO: 1533887 - RNA, 20 nt, Human adenovirus A
acuccauaaggcggcguccu

SEQ ID NO: 1533888 - RNA, 11 nt, Human adenovirus A
uacaaggcauu

SEQ ID NO: 1533889 - RNA, 24 nt, Human adenovirus A
gacagcuuuuauaugcgcauggcu

SEQ ID NO: 1533890 - RNA, 20 nt, Human adenovirus A
uuauucgauccauuuggauu

SEQ ID NO: 1533891 - RNA, 23 nt, Human adenovirus A
aagacgcaccgguugagcagaac

SEQ ID NO: 1533892 - RNA, 13 nt, Human adenovirus A
cauugcaacgcaa

SEQ ID NO: 1533893 - RNA, 11 nt, Human adenovirus A
ggaaaacuuuu

SEQ ID NO: 1533894 - RNA, 17 nt, Human adenovirus A
acuacagacaaacaagu

SEQ ID NO: 1533895 - RNA, 14 nt, Human adenovirus A
ccacacaucucacc

SEQ ID NO: 1533896 - RNA, 19 nt, Human adenovirus A
caacaauggcauagaaagu

SEQ ID NO: 1533897 - RNA, 20 nt, Human adenovirus A
uuuaaaggcauuauguucga

SEQ ID NO: 1533898 - RNA, 23 nt, Human adenovirus A
gucccgcccgcguuuggaaacug

SEQ ID NO: 1533899 - RNA, 16 nt, Human adenovirus A
cgucgccagcaagugc

SEQ ID NO: 1533900 - RNA, 20 nt, Human adenovirus A
acaacacggaguaaugaaca

SEQ ID NO: 1533901 - RNA, 14 nt, Human adenovirus A
augauggaaagccg

SEQ ID NO: 1533902 - RNA, 13 nt, Human adenovirus A
caguuucuggagc

SEQ ID NO: 1533903 - RNA, 21 nt, Human adenovirus A
gaucaauuucuuccuccugga

SEQ ID NO: 1533904 - RNA, 15 nt, Human adenovirus A
ugcucagcuggaaga

SEQ ID NO: 1533905 - RNA, 13 nt, Human adenovirus A
aauccacaaagca

SEQ ID NO: 1533906 - RNA, 15 nt, Human adenovirus A
gcggccacggccgga

SEQ ID NO: 1533907 - RNA, 12 nt, Human adenovirus A
aggcaacagaug

SEQ ID NO: 1533908 - RNA, 20 nt, Human adenovirus A
ccaaugaaacccgcugugag

SEQ ID NO: 1533909 - RNA, 16 nt, Human adenovirus A
ggcgaggaacuaaacc

SEQ ID NO: 1533910 - RNA, 22 nt, Human adenovirus A
acaaugaaaguugcauuuaaug

SEQ ID NO: 1533911 - RNA, 20 nt, Human adenovirus A
cagcagugcggccuguugcc

SEQ ID NO: 1533912 - RNA, 22 nt, Human adenovirus A
augugcaaauauaaaagcacaa

SEQ ID NO: 1533913 - RNA, 20 nt, Human adenovirus A
cuuaauaguucaacauagua

SEQ ID NO: 1533914 - RNA, 15 nt, Human adenovirus A
uacauaauccagcaa

SEQ ID NO: 1533915 - RNA, 23 nt, Human adenovirus A
gcuacaucuuuuacuaaaaugca

SEQ ID NO: 1533916 - RNA, 16 nt, Human adenovirus A
gaaacuuucagcccau

SEQ ID NO: 1533917 - RNA, 14 nt, Human adenovirus A
aauugcagaacuau

SEQ ID NO: 1533918 - RNA, 16 nt, Human adenovirus A
agagucaggcagagga

SEQ ID NO: 1533919 - RNA, 20 nt, Human adenovirus A
caaguugacuucgcacaggc

SEQ ID NO: 1533920 - RNA, 23 nt, Human adenovirus A
cuaguucuugucaacuacauaaa

SEQ ID NO: 1533921 - RNA, 22 nt, Human adenovirus A
cuaaaagagccacagcucugau

SEQ ID NO: 1533922 - RNA, 14 nt, Human adenovirus A
ccugcgguggugga

SEQ ID NO: 1533923 - RNA, 12 nt, Human adenovirus A
ccgcaaaacagg

SEQ ID NO: 1533924 - RNA, 12 nt, Human adenovirus A
augcaaagccag

SEQ ID NO: 1533925 - RNA, 16 nt, Human adenovirus A
aacaucgcaaaacacg

SEQ ID NO: 1533926 - RNA, 14 nt, Human adenovirus A
ugcuguucuuagua

SEQ ID NO: 1533927 - RNA, 12 nt, Human adenovirus A
agccuggauaaa

SEQ ID NO: 1533928 - RNA, 22 nt, Human adenovirus A
ugcgacaaaugcgaccucagcc

SEQ ID NO: 1533929 - RNA, 17 nt, Human adenovirus A
aacaauugcuucugagu

SEQ ID NO: 1533930 - RNA, 14 nt, Human adenovirus A
aaugcaaaauggac

SEQ ID NO: 1533931 - RNA, 18 nt, Human adenovirus A
gucuacaacugcuccccu

SEQ ID NO: 1533932 - RNA, 23 nt, Human adenovirus A
aacugcuccccucaacagcacag

SEQ ID NO: 1533933 - RNA, 17 nt, Human adenovirus A
guaugcugaagaaacag

SEQ ID NO: 1533934 - RNA, 19 nt, Human adenovirus A
cgggcuguaucuguugaau

SEQ ID NO: 1533935 - RNA, 21 nt, Human adenovirus A
aaauggauacucuuuaacauu

SEQ ID NO: 1533936 - RNA, 22 nt, Human adenovirus A
cuucucccugugcuucggcaag

SEQ ID NO: 1533937 - RNA, 15 nt, Human adenovirus A
auagguauugauaaa

SEQ ID NO: 1533938 - RNA, 22 nt, Human adenovirus A
gccaacaaaacuuaucagccag

SEQ ID NO: 1533939 - RNA, 19 nt, Human adenovirus A
acuguaugcgcgccuuaau

SEQ ID NO: 1533940 - RNA, 20 nt, Human adenovirus A
aucucacuuaagucuuuaca

SEQ ID NO: 1533941 - RNA, 17 nt, Human adenovirus A
uaacacaagagcgcccu

SEQ ID NO: 1533942 - RNA, 15 nt, Human adenovirus A
cagcaauuacuugaa

SEQ ID NO: 1533943 - RNA, 22 nt, Human adenovirus A
auauuguagccugcuuucagca

SEQ ID NO: 1533944 - RNA, 13 nt, Human adenovirus A
gcaaggcgccgca

SEQ ID NO: 1533945 - RNA, 15 nt, Human adenovirus A
ccuguggcaccugca

SEQ ID NO: 1533946 - RNA, 20 nt, Human adenovirus A
aaacaguauugugggacugg

SEQ ID NO: 1533947 - RNA, 15 nt, Human adenovirus A
uaggcaauuucugcc

SEQ ID NO: 1533948 - RNA, 15 nt, Human adenovirus A
accgcucgucaagcc

SEQ ID NO: 1533949 - RNA, 12 nt, Human adenovirus A
ggcuccacaccu

SEQ ID NO: 1533950 - RNA, 17 nt, Human adenovirus A
gccauuuugaaccagcg

SEQ ID NO: 1533951 - RNA, 17 nt, Human adenovirus A
caucagccgcccaagga

SEQ ID NO: 1533952 - RNA, 20 nt, Human adenovirus A
aggcguagaugugcugugga

SEQ ID NO: 1533953 - RNA, 13 nt, Human adenovirus A
gauugggaguuca

SEQ ID NO: 1533954 - RNA, 20 nt, Human adenovirus A
accaccgaucgcucgcagcg

SEQ ID NO: 1533955 - RNA, 20 nt, Human adenovirus A
acucuccaauuuguggagga

SEQ ID NO: 1533956 - RNA, 20 nt, Human adenovirus A
cuguuacauaccuggcaaac

SEQ ID NO: 1533957 - RNA, 16 nt, Human adenovirus A
gaaaugguaggacgcu

SEQ ID NO: 1533958 - RNA, 17 nt, Human adenovirus A
uaaaguaaauuaaaugg

SEQ ID NO: 1533959 - RNA, 16 nt, Human adenovirus A
auuguuaacacugccg

SEQ ID NO: 1533960 - RNA, 21 nt, Human adenovirus A
caccaugguaaaaaggaagca

SEQ ID NO: 1533961 - RNA, 21 nt, Human adenovirus A
caaugcagcuguggagggcau

SEQ ID NO: 1533962 - RNA, 19 nt, Human adenovirus A
aacagcaaacuuucuccaa

SEQ ID NO: 1533963 - RNA, 20 nt, Human adenovirus A
ucaccgcgcugcggccauga

SEQ ID NO: 1533964 - RNA, 14 nt, Human adenovirus A
uccaauuuguggag

SEQ ID NO: 1533965 - RNA, 18 nt, Human adenovirus A
cauguuaagaaaugacac

SEQ ID NO: 1533966 - RNA, 20 nt, Human adenovirus A
gagcuacgcaguuuuucuac

SEQ ID NO: 1533967 - RNA, 18 nt, Human adenovirus A
ucaaacauuaugcuggaa

SEQ ID NO: 1533968 - RNA, 17 nt, Human adenovirus A
accuuugcucaggcgcc

SEQ ID NO: 1533969 - RNA, 12 nt, Human adenovirus A
cccccuccugga

SEQ ID NO: 1533970 - RNA, 22 nt, Human adenovirus A
cuaugacccuugagcugccucc

SEQ ID NO: 1533971 - RNA, 18 nt, Human adenovirus A
ugaguugggauuacaugc

SEQ ID NO: 1533972 - RNA, 17 nt, Human adenovirus A
cccaacuuaacgcagua

SEQ ID NO: 1533973 - RNA, 23 nt, Human adenovirus A
ucucaaaagcagccauaaugccu

SEQ ID NO: 1533974 - RNA, 13 nt, Human adenovirus A
cugaaagaaaguu

SEQ ID NO: 1533975 - RNA, 21 nt, Human adenovirus A
cugacagagcgcggcugcgac

SEQ ID NO: 1533976 - RNA, 14 nt, Human adenovirus A
cauuuguauucaua

SEQ ID NO: 1533977 - RNA, 22 nt, Human adenovirus A
cacuucauuuuaauauuggcac

SEQ ID NO: 1533978 - RNA, 15 nt, Human adenovirus A
agagaacaaacagug

SEQ ID NO: 1533979 - RNA, 13 nt, Human adenovirus A
ugggcacauugca

SEQ ID NO: 1533980 - RNA, 14 nt, Human adenovirus A
cuuaagcagugaaa

SEQ ID NO: 1533981 - RNA, 19 nt, Human adenovirus A
cucaaaagcgaagaucagu

SEQ ID NO: 1533982 - RNA, 19 nt, Human adenovirus A
acgaggauccagaggagga

SEQ ID NO: 1533983 - RNA, 14 nt, Human adenovirus A
gucagauucuucuu

SEQ ID NO: 1533984 - RNA, 18 nt, Human adenovirus A
gaucggcacgagccagcu

SEQ ID NO: 1533985 - RNA, 24 nt, Human adenovirus A
aggugcaagaaggccauguacuug

SEQ ID NO: 1533986 - RNA, 11 nt, Human adenovirus A
guuaaauuaaa

SEQ ID NO: 1533987 - RNA, 21 nt, Human adenovirus A
uucuuaguaggcuaacuguua

SEQ ID NO: 1533988 - RNA, 18 nt, Human adenovirus A
aagucaacccaaacugua

SEQ ID NO: 1533989 - RNA, 14 nt, Human adenovirus A
ccuccuuauccuuc

SEQ ID NO: 1533990 - RNA, 16 nt, Human adenovirus A
gaacgacgaagucaca

SEQ ID NO: 1533991 - RNA, 17 nt, Human adenovirus A
acagacuugcaaacagc

SEQ ID NO: 1533992 - RNA, 16 nt, Human adenovirus A
cacgcgcucaaaggca

SEQ ID NO: 1533993 - RNA, 13 nt, Human adenovirus A
uuauguaugaaca

SEQ ID NO: 1533994 - RNA, 14 nt, Human adenovirus A
gcggcguccuuucu

SEQ ID NO: 1533995 - RNA, 21 nt, Human adenovirus A
cagagcacacugggaaaugau

SEQ ID NO: 1533996 - RNA, 17 nt, Human adenovirus A
ugggccuucggaagaaa

SEQ ID NO: 1533997 - RNA, 15 nt, Human adenovirus A
acuccaucuguuuac

SEQ ID NO: 1533998 - RNA, 14 nt, Human adenovirus A
augaauuaaauaaa

SEQ ID NO: 1533999 - RNA, 16 nt, Human adenovirus A
aguucuguuucaugua

SEQ ID NO: 1534000 - RNA, 11 nt, Human adenovirus A
auuuaggacac

SEQ ID NO: 1534001 - RNA, 17 nt, Human adenovirus A
agagucaggcagaggac

SEQ ID NO: 1534002 - RNA, 13 nt, Human adenovirus A
ucagccagagccg

SEQ ID NO: 1534003 - RNA, 13 nt, Human adenovirus A
gcucagcuggaag

SEQ ID NO: 1534004 - RNA, 14 nt, Human adenovirus A
cuccuuauccuucc

SEQ ID NO: 1534005 - RNA, 20 nt, Human adenovirus A
ucgagaucuaggcuguggac

SEQ ID NO: 1534006 - RNA, 11 nt, Human adenovirus A
aaaaauguuuu

SEQ ID NO: 1534007 - RNA, 20 nt, Human adenovirus A
accaaaaacaccuuuuguua

SEQ ID NO: 1534008 - RNA, 16 nt, Human adenovirus A
aggguggggugcugcc

SEQ ID NO: 1534009 - RNA, 18 nt, Human adenovirus A
gccuuaaauaaggcugcu

SEQ ID NO: 1534010 - RNA, 23 nt, Human adenovirus A
cgaaaaaaaucacuuccgcauau

SEQ ID NO: 1534011 - RNA, 18 nt, Human adenovirus A
uuaagaaaacgcauuuuu

SEQ ID NO: 1534012 - RNA, 20 nt, Human adenovirus A
acgcagaagcucuguucaau

SEQ ID NO: 1534013 - RNA, 17 nt, Human adenovirus A
aguggcacaacacauac

SEQ ID NO: 1534014 - RNA, 16 nt, Human adenovirus A
aaccaaucuacaaacu

SEQ ID NO: 1534015 - RNA, 14 nt, Human adenovirus A
acuuuaauguuuca

SEQ ID NO: 1534016 - RNA, 13 nt, Human adenovirus A
ugaaaguagaaau

SEQ ID NO: 1534017 - RNA, 15 nt, Human adenovirus A
caaacuuacaagcac

SEQ ID NO: 1534018 - RNA, 18 nt, Human adenovirus A
cugaucuagaaauugaug

SEQ ID NO: 1534019 - RNA, 21 nt, Human adenovirus A
augaccguuugcuaaccccaa

SEQ ID NO: 1534020 - RNA, 20 nt, Human adenovirus A
cagcauguccccgaaagccg

SEQ ID NO: 1534021 - RNA, 19 nt, Human adenovirus A
accacggccucagcagcgg

SEQ ID NO: 1534022 - RNA, 13 nt, Human adenovirus A
ccuggauaaagcg

SEQ ID NO: 1534023 - RNA, 15 nt, Human adenovirus A
uccaacugauuuuca

SEQ ID NO: 1534024 - RNA, 18 nt, Human adenovirus A
ccgucuucguggagaagc

SEQ ID NO: 1534025 - RNA, 11 nt, Human adenovirus A
augaauuaaau

SEQ ID NO: 1534026 - RNA, 16 nt, Human adenovirus A
uacuaaaagcuuuaau

SEQ ID NO: 1534027 - RNA, 19 nt, Human adenovirus A
gacaacauccuuuuucuac

SEQ ID NO: 1534028 - RNA, 18 nt, Human adenovirus A
agcagguguaaccagcug

SEQ ID NO: 1534029 - RNA, 14 nt, Human adenovirus A
gaucagaaaaaacu

SEQ ID NO: 1534030 - RNA, 22 nt, Human adenovirus A
uucuagaacaaaaaggaggaag

SEQ ID NO: 1534031 - RNA, 17 nt, Human adenovirus A
cacaucgccggucagga

SEQ ID NO: 1534032 - RNA, 16 nt, Human adenovirus A
ucaggcagaggacgag

SEQ ID NO: 1534033 - RNA, 17 nt, Human adenovirus A
guacgcagacgaugaca

SEQ ID NO: 1534034 - RNA, 15 nt, Human adenovirus A
acacagcguuccaga

SEQ ID NO: 1534035 - RNA, 15 nt, Human adenovirus A
aaugcagcaaacacu

SEQ ID NO: 1534036 - RNA, 22 nt, Human adenovirus A
cuuggaagaaugggaggaggag

SEQ ID NO: 1534037 - RNA, 19 nt, Human adenovirus A
guccucagguagugggcac

SEQ ID NO: 1534038 - RNA, 14 nt, Human adenovirus A
caaaugagcaaaac

SEQ ID NO: 1534039 - RNA, 22 nt, Human adenovirus A
acaucagacguacccuuuguua

SEQ ID NO: 1534040 - RNA, 14 nt, Human adenovirus A
ccuuagaagacaaa

SEQ ID NO: 1534041 - RNA, 16 nt, Human adenovirus A
gcagcaacaaggaaag

SEQ ID NO: 1534042 - RNA, 23 nt, Human adenovirus A
gaugcauaauuaaacccuuuagc

SEQ ID NO: 1534043 - RNA, 14 nt, Human adenovirus A
acugcagccugucu

SEQ ID NO: 1534044 - RNA, 19 nt, Human adenovirus A
cugauauuaguaccgaaaa

SEQ ID NO: 1534045 - RNA, 20 nt, Human adenovirus A
caaaagauccguacaaggca

SEQ ID NO: 1534046 - RNA, 23 nt, Human adenovirus A
gucauagcaacaacgcugggcau

SEQ ID NO: 1534047 - RNA, 20 nt, Human adenovirus A
uaauugaguaacuucaacau

SEQ ID NO: 1534048 - RNA, 21 nt, Human adenovirus A
caacaaaacuuaucagccaga

SEQ ID NO: 1534049 - RNA, 23 nt, Human adenovirus A
agcauuaguucuuuucuuuaugu

SEQ ID NO: 1534050 - RNA, 17 nt, Human adenovirus A
gaccggauggguacaga

SEQ ID NO: 1534051 - RNA, 17 nt, Human adenovirus A
gcuuucaagauggccac

SEQ ID NO: 1534052 - RNA, 13 nt, Human adenovirus A
gccgcagagagcu

SEQ ID NO: 1534053 - RNA, 19 nt, Human adenovirus A
acucuccaauuuguggagg

SEQ ID NO: 1534054 - RNA, 16 nt, Human adenovirus A
uaaaaaaacaaaacca

SEQ ID NO: 1534055 - RNA, 20 nt, Human adenovirus A
gucaucguaggacaacuuaa

SEQ ID NO: 1534056 - RNA, 16 nt, Human adenovirus A
caaagccacaccucca

SEQ ID NO: 1534057 - RNA, 14 nt, Human adenovirus A
cccggcguaaccaa

SEQ ID NO: 1534058 - RNA, 12 nt, Human adenovirus A
gacucagugacc

SEQ ID NO: 1534059 - RNA, 20 nt, Human adenovirus A
aauaaucaauuuugcaagug

SEQ ID NO: 1534060 - RNA, 23 nt, Human adenovirus A
gcccccuaaacggcaagccaacg

SEQ ID NO: 1534061 - RNA, 18 nt, Human adenovirus A
cauaccugggucacuuag

SEQ ID NO: 1534062 - RNA, 17 nt, Human adenovirus A
aaagcuaaaucugccac

SEQ ID NO: 1534063 - RNA, 22 nt, Human adenovirus A
ccagcguucgcuuugacaacau

SEQ ID NO: 1534064 - RNA, 16 nt, Human adenovirus A
cuuacauaccaacaug

SEQ ID NO: 1534065 - RNA, 16 nt, Human adenovirus A
gauuaugguucagcuu

SEQ ID NO: 1534066 - RNA, 20 nt, Human adenovirus A
uaaucgccccgcugcaauuu

SEQ ID NO: 1534067 - RNA, 12 nt, Human adenovirus A
acauaggcauug

SEQ ID NO: 1534068 - RNA, 14 nt, Human adenovirus A
gagcugcugcaggc

SEQ ID NO: 1534069 - RNA, 12 nt, Human adenovirus A
aaguuuaaaggc

SEQ ID NO: 1534070 - RNA, 20 nt, Human adenovirus A
cgcagacgaugacauuuugg

SEQ ID NO: 1534071 - RNA, 15 nt, Human adenovirus A
aaauacacauaaaga

SEQ ID NO: 1534072 - RNA, 11 nt, Human adenovirus A
gugacuuccca

SEQ ID NO: 1534073 - RNA, 15 nt, Human adenovirus A
gcccuauccgucucc

SEQ ID NO: 1534074 - RNA, 24 nt, Human adenovirus A
gcugacauaauuuucccagaaagg

SEQ ID NO: 1534075 - RNA, 14 nt, Human adenovirus A
agguggcuggacug

SEQ ID NO: 1534076 - RNA, 21 nt, Human adenovirus A
uaccaagguuuuuacauucca

SEQ ID NO: 1534077 - RNA, 20 nt, Human adenovirus A
ucaugguuugcuaacagcuc

SEQ ID NO: 1534078 - RNA, 18 nt, Human adenovirus A
ugcccugcaaaaagaaaa

SEQ ID NO: 1534079 - RNA, 21 nt, Human adenovirus A
augccuaaugugagugcuuac

SEQ ID NO: 1534080 - RNA, 16 nt, Human adenovirus A
uuuaauuaacauucug

SEQ ID NO: 1534081 - RNA, 17 nt, Human adenovirus A
cagccgcuaccaucacu

SEQ ID NO: 1534082 - RNA, 23 nt, Human adenovirus A
ugcagggaccgcagucugacagc

SEQ ID NO: 1534083 - RNA, 22 nt, Human adenovirus A
aaugcaucuuugggacuuugua

SEQ ID NO: 1534084 - RNA, 20 nt, Human adenovirus A
aggggucuauccuucagugg

SEQ ID NO: 1534085 - RNA, 14 nt, Human adenovirus A
gaaguaagcuguuu

SEQ ID NO: 1534086 - RNA, 18 nt, Human adenovirus A
aaacucagcccaugcucu

SEQ ID NO: 1534087 - RNA, 17 nt, Human adenovirus A
auaccuuaaaaacuguu

SEQ ID NO: 1534088 - RNA, 19 nt, Human adenovirus A
cauaaggagacguuuuugc

SEQ ID NO: 1534089 - RNA, 15 nt, Human adenovirus A
cgugauggcagcggc

SEQ ID NO: 1534090 - RNA, 22 nt, Human adenovirus A
caugcgggggaugaaggaagcg

SEQ ID NO: 1534091 - RNA, 14 nt, Human adenovirus A
ccauuugacacauc

SEQ ID NO: 1534092 - RNA, 22 nt, Human adenovirus A
uucuccaaaucuuaaauggaag

SEQ ID NO: 1534093 - RNA, 13 nt, Human adenovirus A
acugaagugccuc

SEQ ID NO: 1534094 - RNA, 19 nt, Human adenovirus A
uggaucguauuauggcuuu

SEQ ID NO: 1534095 - RNA, 17 nt, Human adenovirus A
auaccuggcaaacuggg

SEQ ID NO: 1534096 - RNA, 23 nt, Human adenovirus A
uggaacucuccaauuuguggagg

SEQ ID NO: 1534097 - RNA, 16 nt, Human adenovirus A
aaaacgagcagcaaau

SEQ ID NO: 1534098 - RNA, 17 nt, Human adenovirus A
aggcuagugcccucaca

SEQ ID NO: 1534099 - RNA, 14 nt, Human adenovirus A
ggcuccgaacaggu

SEQ ID NO: 1534100 - RNA, 21 nt, Human adenovirus A
caucuauaguaaaaaugccag

SEQ ID NO: 1534101 - RNA, 20 nt, Human adenovirus A
uucgcaggcggucugccauu

SEQ ID NO: 1534102 - RNA, 16 nt, Human adenovirus A
cggucgaccuguggca

SEQ ID NO: 1534103 - RNA, 12 nt, Human adenovirus A
gcaucuguucca

SEQ ID NO: 1534104 - RNA, 12 nt, Human adenovirus A
auaauuucccuc

SEQ ID NO: 1534105 - RNA, 15 nt, Human adenovirus A
gaaccugaaagaaag

SEQ ID NO: 1534106 - RNA, 20 nt, Human adenovirus A
aaagcgcagaguauccacac

SEQ ID NO: 1534107 - RNA, 16 nt, Human adenovirus A
aaugaaaguugcauuu

SEQ ID NO: 1534108 - RNA, 22 nt, Human adenovirus A
agugcuuucaacaaaaaaaaag

SEQ ID NO: 1534109 - RNA, 12 nt, Human adenovirus A
gcaaucagaaug

SEQ ID NO: 1534110 - RNA, 14 nt, Human adenovirus A
uacuuuacaaaugc

SEQ ID NO: 1534111 - RNA, 20 nt, Human adenovirus A
augcgugagggugccacccc

SEQ ID NO: 1534112 - RNA, 15 nt, Human adenovirus A
auaggcauugggaau

SEQ ID NO: 1534113 - RNA, 12 nt, Human adenovirus A
aauuacauuuau

SEQ ID NO: 1534114 - RNA, 21 nt, Human adenovirus A
aguucgccuacacaacacaaa

SEQ ID NO: 1534115 - RNA, 19 nt, Human adenovirus A
ccacgccuggguaccgugg

SEQ ID NO: 1534116 - RNA, 20 nt, Human adenovirus A
cuguugaugugaugaaagua

SEQ ID NO: 1534117 - RNA, 20 nt, Human adenovirus A
aguguuuguuugaaaaaugu

SEQ ID NO: 1534118 - RNA, 16 nt, Human adenovirus A
acuuaccaaagccaug

SEQ ID NO: 1534119 - RNA, 17 nt, Human adenovirus A
aggauugggaguucaaa

SEQ ID NO: 1534120 - RNA, 20 nt, Human adenovirus A
aauugggcggcauuuagagg

SEQ ID NO: 1534121 - RNA, 18 nt, Human adenovirus A
ugccucaaagugaagugu

SEQ ID NO: 1534122 - RNA, 21 nt, Human adenovirus A
cuacaucuuuuacuaaaaugc

SEQ ID NO: 1534123 - RNA, 19 nt, Human adenovirus A
ugcuuagucauuacaacau

SEQ ID NO: 1534124 - RNA, 14 nt, Human adenovirus A
auuauuugaacaca

SEQ ID NO: 1534125 - RNA, 23 nt, Human adenovirus A
ucccgcgguuuuggcggccaugc

SEQ ID NO: 1534126 - RNA, 14 nt, Human adenovirus A
uccguggcaggcca

SEQ ID NO: 1534127 - RNA, 21 nt, Human adenovirus A
uguuuggcagcaaugcuugga

SEQ ID NO: 1534128 - RNA, 16 nt, Human adenovirus A
cucauccucagcuccg

SEQ ID NO: 1534129 - RNA, 17 nt, Human adenovirus A
acuucacccugggaaac

SEQ ID NO: 1534130 - RNA, 11 nt, Human adenovirus A
ugccagcucuu

SEQ ID NO: 1534131 - RNA, 13 nt, Human adenovirus A
cucgcagcucuua

SEQ ID NO: 1534132 - RNA, 15 nt, Human adenovirus A
caaaccuagcugcuc

SEQ ID NO: 1534133 - RNA, 22 nt, Human adenovirus A
cugcccugauauaucaggaaaa

SEQ ID NO: 1534134 - RNA, 17 nt, Human adenovirus A
aggcaacagaugaugga

SEQ ID NO: 1534135 - RNA, 15 nt, Human adenovirus A
cugacgauaacguuc

SEQ ID NO: 1534136 - RNA, 18 nt, Human adenovirus A
aggggcacaugcggggga

SEQ ID NO: 1534137 - RNA, 16 nt, Human adenovirus A
caaaucagaagccagc

SEQ ID NO: 1534138 - RNA, 15 nt, Human adenovirus A
uggguuuggauggaa

SEQ ID NO: 1534139 - RNA, 22 nt, Human adenovirus A
ggaguaauaaaaccugugccuc

SEQ ID NO: 1534140 - RNA, 16 nt, Human adenovirus A
ccucacugcuuugcuc

SEQ ID NO: 1534141 - RNA, 14 nt, Human adenovirus A
uggaauaagguuuc

SEQ ID NO: 1534142 - RNA, 15 nt, Human adenovirus A
cauagccccaggucc

SEQ ID NO: 1534143 - RNA, 18 nt, Human adenovirus A
cuaccaccuaucccauga

SEQ ID NO: 1534144 - RNA, 18 nt, Human adenovirus A
gcaaucuaguuucuuaca

SEQ ID NO: 1534145 - RNA, 20 nt, Human adenovirus A
agcucaguuauauuuucuau

SEQ ID NO: 1534146 - RNA, 20 nt, Human adenovirus A
ugcaaguguaauuuuccagc

SEQ ID NO: 1534147 - RNA, 16 nt, Human adenovirus A
caaguguaauuuucca

SEQ ID NO: 1534148 - RNA, 21 nt, Human adenovirus A
aacacguuaccaauacagaua

SEQ ID NO: 1534149 - RNA, 14 nt, Human adenovirus A
cucuucccaacugu

SEQ ID NO: 1534150 - RNA, 12 nt, Human adenovirus A
agagcggcgaga

SEQ ID NO: 1534151 - RNA, 22 nt, Human adenovirus A
cucuaacaaaggugcuucccac

SEQ ID NO: 1534152 - RNA, 16 nt, Human adenovirus A
ucagauuuugugccua

SEQ ID NO: 1534153 - RNA, 13 nt, Human adenovirus A
gucaacuacauaa

SEQ ID NO: 1534154 - RNA, 14 nt, Human adenovirus A
uaggcauuaaaugg

SEQ ID NO: 1534155 - RNA, 12 nt, Human adenovirus A
uuuagguccugu

SEQ ID NO: 1534156 - RNA, 14 nt, Human adenovirus A
caacugauuuucau

SEQ ID NO: 1534157 - RNA, 18 nt, Human adenovirus A
aguaccgcgcgcccgcug

SEQ ID NO: 1534158 - RNA, 23 nt, Human adenovirus A
aaugccuuaccagaaaaacagua

SEQ ID NO: 1534159 - RNA, 14 nt, Human adenovirus A
auaaaauuucuaga

SEQ ID NO: 1534160 - RNA, 22 nt, Human adenovirus A
aauggaacuuuagaaaggaugu

SEQ ID NO: 1534161 - RNA, 20 nt, Human adenovirus A
uaaaagcgugcgcaguguuc

SEQ ID NO: 1534162 - RNA, 14 nt, Human adenovirus A
cuaccugcgcaaau

SEQ ID NO: 1534163 - RNA, 18 nt, Human adenovirus A
gugauaagcuccugcauu

SEQ ID NO: 1534164 - RNA, 22 nt, Human adenovirus A
cacaugcgggggaugaaggaag

SEQ ID NO: 1534165 - RNA, 19 nt, Human adenovirus A
uaacugcucagcuggaaga

SEQ ID NO: 1534166 - RNA, 13 nt, Human adenovirus A
acauuugugacug

SEQ ID NO: 1534167 - RNA, 14 nt, Human adenovirus A
ucaaacaauaacau

SEQ ID NO: 1534168 - RNA, 14 nt, Human adenovirus A
augaaggaaugccu

SEQ ID NO: 1534169 - RNA, 14 nt, Human adenovirus A
agaacauacaacuu

SEQ ID NO: 1534170 - RNA, 19 nt, Human adenovirus A
uuacauguggagcuuucaa

SEQ ID NO: 1534171 - RNA, 15 nt, Human adenovirus A
uacacaacacaaaaa

SEQ ID NO: 1534172 - RNA, 17 nt, Human adenovirus A
ugaugcaguaauugaug

SEQ ID NO: 1534173 - RNA, 20 nt, Human adenovirus A
ccguuuucuucuugagccca

SEQ ID NO: 1534174 - RNA, 13 nt, Human adenovirus A
cagaaaaaguuuc

SEQ ID NO: 1534175 - RNA, 14 nt, Human adenovirus A
uguaucagcagcca

SEQ ID NO: 1534176 - RNA, 16 nt, Human adenovirus A
cuucucgaaaaaauua

SEQ ID NO: 1534177 - RNA, 14 nt, Human adenovirus A
accaaacgcaaguu

SEQ ID NO: 1534178 - RNA, 15 nt, Human adenovirus A
uucagaauaaaacaa

SEQ ID NO: 1534179 - RNA, 20 nt, Human adenovirus A
aauaaugcauuaccagcagc

SEQ ID NO: 1534180 - RNA, 14 nt, Human adenovirus A
auuaugguucagcu

SEQ ID NO: 1534181 - RNA, 20 nt, Human adenovirus A
ggcagccguuucaggaagga

SEQ ID NO: 1534182 - RNA, 12 nt, Human adenovirus A
uuauggcuuuaa

SEQ ID NO: 1534183 - RNA, 19 nt, Human adenovirus A
ugaaccgguugaaacagac

SEQ ID NO: 1534184 - RNA, 22 nt, Human adenovirus A
aaugcuuuccauuuuucuuuua

SEQ ID NO: 1534185 - RNA, 14 nt, Human adenovirus A
aaggaggaagaaca

SEQ ID NO: 1534186 - RNA, 16 nt, Human adenovirus A
aaauaguuccguaaag

SEQ ID NO: 1534187 - RNA, 21 nt, Human adenovirus A
auaaggagacguuuuugccca

SEQ ID NO: 1534188 - RNA, 17 nt, Human adenovirus A
uacgguggcagccaagc

SEQ ID NO: 1534189 - RNA, 22 nt, Human adenovirus A
gcaacauaccauauuuucuuua

SEQ ID NO: 1534190 - RNA, 21 nt, Human adenovirus A
uucccaaauauccaggaggaa

SEQ ID NO: 1534191 - RNA, 14 nt, Human adenovirus A
aagcacugccuguu

SEQ ID NO: 1534192 - RNA, 14 nt, Human adenovirus A
aaaaauuacaaagg

SEQ ID NO: 1534193 - RNA, 14 nt, Human adenovirus A
aauuuucuccccac

SEQ ID NO: 1534194 - RNA, 20 nt, Human adenovirus A
acauccuuccauugugccca

SEQ ID NO: 1534195 - RNA, 16 nt, Human adenovirus A
aaauacgaaaacaguc

SEQ ID NO: 1534196 - RNA, 23 nt, Human adenovirus A
acugggauggguguuuggcagca

SEQ ID NO: 1534197 - RNA, 21 nt, Human adenovirus A
cagcuaacaaugcagcaaaca

SEQ ID NO: 1534198 - RNA, 13 nt, Human adenovirus A
gcacuuccuucag

SEQ ID NO: 1534199 - RNA, 19 nt, Human adenovirus A
acaagaugaguaaagauau

SEQ ID NO: 1534200 - RNA, 21 nt, Human adenovirus A
acaaguuaaaagaccaaaauu

SEQ ID NO: 1534201 - RNA, 23 nt, Human adenovirus A
gaagauagacagcuuuuauaugc

SEQ ID NO: 1534202 - RNA, 23 nt, Human adenovirus A
agucuugaaugcucuggacaugg

SEQ ID NO: 1534203 - RNA, 15 nt, Human adenovirus A
gcacgccaaagccac

SEQ ID NO: 1534204 - RNA, 17 nt, Human adenovirus A
aaaugugccuaugaccc

SEQ ID NO: 1534205 - RNA, 23 nt, Human adenovirus A
accugagucccggucuggugcaa

SEQ ID NO: 1534206 - RNA, 19 nt, Human adenovirus A
cuaccgcugcucagcucca

SEQ ID NO: 1534207 - RNA, 15 nt, Human adenovirus A
gggggaugaaggaag

SEQ ID NO: 1534208 - RNA, 22 nt, Human adenovirus A
uacuucaccgcgcaagcuuuca

SEQ ID NO: 1534209 - RNA, 14 nt, Human adenovirus A
caaaguaccuuaca

SEQ ID NO: 1534210 - RNA, 22 nt, Human adenovirus A
uacuaccgucaucucuacagcc

SEQ ID NO: 1534211 - RNA, 18 nt, Human adenovirus A
auaggaggaguuaaauaa

SEQ ID NO: 1534212 - RNA, 20 nt, Human adenovirus A
cacuagucccauuacaguaa

SEQ ID NO: 1534213 - RNA, 22 nt, Human adenovirus A
ccuucuggcguuacagcuucag

SEQ ID NO: 1534214 - RNA, 17 nt, Human adenovirus A
gccggaccccacaugau

SEQ ID NO: 1534215 - RNA, 19 nt, Human adenovirus A
cgggcuggggacugggugc

SEQ ID NO: 1534216 - RNA, 12 nt, Human adenovirus A
aggcuggagcuu

SEQ ID NO: 1534217 - RNA, 21 nt, Human adenovirus A
gugccccccuccccuguggag

SEQ ID NO: 1534218 - RNA, 14 nt, Human adenovirus A
cggccauaggcaug

SEQ ID NO: 1534219 - RNA, 14 nt, Human adenovirus A
ccugguaaaacaag

SEQ ID NO: 1534220 - RNA, 16 nt, Human adenovirus A
gugcugauugcuggcc

SEQ ID NO: 1534221 - RNA, 21 nt, Human adenovirus A
aagccauggcgaccaguguuc

SEQ ID NO: 1534222 - RNA, 21 nt, Human adenovirus A
ucaacgacuaaaacaaaucua

SEQ ID NO: 1534223 - RNA, 23 nt, Human adenovirus A
gcaccuugcaggacgcagaagcu

SEQ ID NO: 1534224 - RNA, 20 nt, Human adenovirus A
acgcaagcgugcaaacagac

SEQ ID NO: 1534225 - RNA, 18 nt, Human adenovirus A
ccugcuccuuuucuuaca

SEQ ID NO: 1534226 - RNA, 15 nt, Human adenovirus A
ggaccccgaaaccca

SEQ ID NO: 1534227 - RNA, 15 nt, Human adenovirus A
ugaaugcguaaaucu

SEQ ID NO: 1534228 - RNA, 17 nt, Human adenovirus A
cuacccaccaucuucau

SEQ ID NO: 1534229 - RNA, 18 nt, Human adenovirus A
acguagucauauagcuca

SEQ ID NO: 1534230 - RNA, 17 nt, Human adenovirus A
gucuuuaccuacuuuga

SEQ ID NO: 1534231 - RNA, 18 nt, Human adenovirus A
agccacaguagacauugu

SEQ ID NO: 1534232 - RNA, 12 nt, Human adenovirus A
acugggccagga

SEQ ID NO: 1534233 - RNA, 15 nt, Human adenovirus A
cacacugauuuugca

SEQ ID NO: 1534234 - RNA, 17 nt, Human adenovirus A
cggguccugcgggaagc

SEQ ID NO: 1534235 - RNA, 12 nt, Human adenovirus A
cguacagccaga

SEQ ID NO: 1534236 - RNA, 22 nt, Human adenovirus A
cagcugccgucuucguggagaa

SEQ ID NO: 1534237 - RNA, 16 nt, Human adenovirus A
ccaugacuauugacuu

SEQ ID NO: 1534238 - RNA, 19 nt, Human adenovirus A
aaugauuaaacaacaaaac

SEQ ID NO: 1534239 - RNA, 20 nt, Human adenovirus A
ccaguuucaauugcagaacu

SEQ ID NO: 1534240 - RNA, 12 nt, Human adenovirus A
acaaaacacaaa

SEQ ID NO: 1534241 - RNA, 19 nt, Human adenovirus A
cugcaaaauugaaaaacug

SEQ ID NO: 1534242 - RNA, 19 nt, Human adenovirus A
agcauuaguucuuuucuuu

SEQ ID NO: 1534243 - RNA, 18 nt, Human adenovirus A
ucuauaguaaaaaugcca

SEQ ID NO: 1534244 - RNA, 15 nt, Human adenovirus A
gcuacacgcugccca

SEQ ID NO: 1534245 - RNA, 17 nt, Human adenovirus A
ccugcuccgacaacagc

SEQ ID NO: 1534246 - RNA, 13 nt, Human adenovirus A
agcugcaguuugu

SEQ ID NO: 1534247 - RNA, 15 nt, Human adenovirus A
guuuggaaacuguau

SEQ ID NO: 1534248 - RNA, 23 nt, Human adenovirus A
uucuaaaagagccacagcucuga

SEQ ID NO: 1534249 - RNA, 15 nt, Human adenovirus A
gugcaaaacuuucua

SEQ ID NO: 1534250 - RNA, 15 nt, Human adenovirus A
gacagaguugcuuuu

SEQ ID NO: 1534251 - RNA, 14 nt, Human adenovirus A
aaucuuaaauggaa

SEQ ID NO: 1534252 - RNA, 16 nt, Human adenovirus A
uauacgccuccuaugu

SEQ ID NO: 1534253 - RNA, 17 nt, Human adenovirus A
uaguaacauuuguguag

SEQ ID NO: 1534254 - RNA, 12 nt, Human adenovirus A
uucuugcuuuaa

SEQ ID NO: 1534255 - RNA, 16 nt, Human adenovirus A
ugucuccucuguaguu

SEQ ID NO: 1534256 - RNA, 11 nt, Human adenovirus A
gcccaagguca

SEQ ID NO: 1534257 - RNA, 16 nt, Human adenovirus A
agguauaacaaaauuc

SEQ ID NO: 1534258 - RNA, 15 nt, Human adenovirus A
caaaaaaacagauuc

SEQ ID NO: 1534259 - RNA, 19 nt, Human adenovirus A
gagccacuucauucaucau

SEQ ID NO: 1534260 - RNA, 20 nt, Human adenovirus A
aaugaaacccgcugugagca

SEQ ID NO: 1534261 - RNA, 16 nt, Human adenovirus A
acugcccagcuguucu

SEQ ID NO: 1534262 - RNA, 13 nt, Human adenovirus A
gaaacagcagcaa

SEQ ID NO: 1534263 - RNA, 17 nt, Human adenovirus A
cagcagcaacacuccau

SEQ ID NO: 1534264 - RNA, 23 nt, Human adenovirus A
aguucuucuucgcuuucggaauc

SEQ ID NO: 1534265 - RNA, 22 nt, Human adenovirus A
uuuaugccuaaugugagugcuu

SEQ ID NO: 1534266 - RNA, 14 nt, Human adenovirus A
cacaaggaaaugag

SEQ ID NO: 1534267 - RNA, 13 nt, Human adenovirus A
gaggcuggcacgc

SEQ ID NO: 1534268 - RNA, 12 nt, Human adenovirus A
cucauuugcaag

SEQ ID NO: 1534269 - RNA, 18 nt, Human adenovirus A
ugugcaaauauaaaagca

SEQ ID NO: 1534270 - RNA, 17 nt, Human adenovirus A
acacuuuaauaaaaaca

SEQ ID NO: 1534271 - RNA, 13 nt, Human adenovirus A
cuaggcuguggac

SEQ ID NO: 1534272 - RNA, 12 nt, Human adenovirus A
ugugcugcaaac

SEQ ID NO: 1534273 - RNA, 21 nt, Human adenovirus A
ugcugcacaauuaucgcucuu

SEQ ID NO: 1534274 - RNA, 18 nt, Human adenovirus A
cuccguguucccacagua

SEQ ID NO: 1534275 - RNA, 11 nt, Human adenovirus A
acgugugcccc

SEQ ID NO: 1534276 - RNA, 23 nt, Human adenovirus A
ggucggugguuacucgauuuaau

SEQ ID NO: 1534277 - RNA, 23 nt, Human adenovirus A
acccaguuuuugcagugccagaa

SEQ ID NO: 1534278 - RNA, 16 nt, Human adenovirus A
ccuaaauauuguauuu

SEQ ID NO: 1534279 - RNA, 18 nt, Human adenovirus A
ucuuccaauggucuucaa

SEQ ID NO: 1534280 - RNA, 20 nt, Human adenovirus A
accacccuagcauucucuaa

SEQ ID NO: 1534281 - RNA, 16 nt, Human adenovirus A
caucacucuauuucaa

SEQ ID NO: 1534282 - RNA, 20 nt, Human adenovirus A
aagaucuucguaggaaagau

SEQ ID NO: 1534283 - RNA, 21 nt, Human adenovirus A
acuuuguaccgcgaagccauu

SEQ ID NO: 1534284 - RNA, 19 nt, Human adenovirus A
agggucggugauggaaacg

SEQ ID NO: 1534285 - RNA, 16 nt, Human adenovirus A
aacccacgauccagua

SEQ ID NO: 1534286 - RNA, 14 nt, Human adenovirus A
aaaguaucugccca

SEQ ID NO: 1534287 - RNA, 19 nt, Human adenovirus A
agugucuuguuaauguuug

SEQ ID NO: 1534288 - RNA, 20 nt, Human adenovirus A
uuuccagcgccaccugccau

SEQ ID NO: 1534289 - RNA, 20 nt, Human adenovirus A
gcaucuagccagucacaguc

SEQ ID NO: 1534290 - RNA, 16 nt, Human adenovirus A
aaccuacacaugaagg

SEQ ID NO: 1534291 - RNA, 14 nt, Human adenovirus A
guuacgacccugac

SEQ ID NO: 1534292 - RNA, 13 nt, Human adenovirus A
aagguagcuccag

SEQ ID NO: 1534293 - RNA, 16 nt, Human adenovirus A
cugacgggagcaggaa

SEQ ID NO: 1534294 - RNA, 21 nt, Human adenovirus A
cucugguccugggacauaauu

SEQ ID NO: 1534295 - RNA, 20 nt, Human adenovirus A
ccgcaguggucuuacaugca

SEQ ID NO: 1534296 - RNA, 23 nt, Human adenovirus A
cuuagaagacaaagagugacuca

SEQ ID NO: 1534297 - RNA, 17 nt, Human adenovirus A
gagcugcugcaggccuu

SEQ ID NO: 1534298 - RNA, 19 nt, Human adenovirus A
ggcgcugacgggagcagga

SEQ ID NO: 1534299 - RNA, 15 nt, Human adenovirus A
aauaaaauaaaacuu

SEQ ID NO: 1534300 - RNA, 19 nt, Human adenovirus A
cuggaauaacaagccuagg

SEQ ID NO: 1534301 - RNA, 18 nt, Human adenovirus A
cguacuuaaaaaaacaaa

SEQ ID NO: 1534302 - RNA, 15 nt, Human adenovirus A
guuaagcaguagaaa

SEQ ID NO: 1534303 - RNA, 23 nt, Human adenovirus A
cgagcgcauagaaaaagcuacau

SEQ ID NO: 1534304 - RNA, 12 nt, Human adenovirus A
gagcaccugggc

SEQ ID NO: 1534305 - RNA, 23 nt, Human adenovirus A
cagcuccaaccaugaaaacagca

SEQ ID NO: 1534306 - RNA, 21 nt, Human adenovirus A
ccggcuaauguuccgcguggu

SEQ ID NO: 1534307 - RNA, 15 nt, Human adenovirus A
gcaacggcaggaaau

SEQ ID NO: 1534308 - RNA, 19 nt, Human adenovirus A
uugcgccaccuuggcuuuc

SEQ ID NO: 1534309 - RNA, 13 nt, Human adenovirus A
acuuacuacgacu

SEQ ID NO: 1534310 - RNA, 19 nt, Human adenovirus A
auccuuuuucuacaggcag

SEQ ID NO: 1534311 - RNA, 23 nt, Human adenovirus A
uaaggggaggaccccaaggcaug

SEQ ID NO: 1534312 - RNA, 16 nt, Human adenovirus A
gcgccgcggauuuaau

SEQ ID NO: 1534313 - RNA, 23 nt, Human adenovirus A
ucauguaaaaugggaaaugaggc

SEQ ID NO: 1534314 - RNA, 22 nt, Human adenovirus A
cuuuuagaugucgaaugcaggg

SEQ ID NO: 1534315 - RNA, 23 nt, Human adenovirus A
cccacgccgcgccccacuuccuc

SEQ ID NO: 1534316 - RNA, 20 nt, Human adenovirus A
guggaaaagucacaagggua

SEQ ID NO: 1534317 - RNA, 20 nt, Human adenovirus A
caagacuauucuagcaaaau

SEQ ID NO: 1534318 - RNA, 13 nt, Human adenovirus A
ccgucgccagcaa

SEQ ID NO: 1534319 - RNA, 21 nt, Human adenovirus A
ggcuggggacugggugccgcc

SEQ ID NO: 1534320 - RNA, 15 nt, Human adenovirus A
ugugauuauguauga

SEQ ID NO: 1534321 - RNA, 15 nt, Human adenovirus A
gcauagaaaaagcua

SEQ ID NO: 1534322 - RNA, 22 nt, Human adenovirus A
acuguagugcaaaauaaugacu

SEQ ID NO: 1534323 - RNA, 13 nt, Human adenovirus A
uggcauuugugcc

SEQ ID NO: 1534324 - RNA, 21 nt, Human adenovirus A
gaaagaagacuauagagagga

SEQ ID NO: 1534325 - RNA, 20 nt, Human adenovirus A
gaacguaacuuucaaaaaag

SEQ ID NO: 1534326 - RNA, 14 nt, Human adenovirus A
auuguuaacacugc

SEQ ID NO: 1534327 - RNA, 18 nt, Human adenovirus A
ugcucguaaaaucuacaa

SEQ ID NO: 1534328 - RNA, 14 nt, Human adenovirus A
aggcaaugggagau

SEQ ID NO: 1534329 - RNA, 19 nt, Human adenovirus A
cagcagcaacacuccauac

SEQ ID NO: 1534330 - RNA, 21 nt, Human adenovirus A
agggcguacaguuuuggagcc

SEQ ID NO: 1534331 - RNA, 21 nt, Human adenovirus A
gcccauaacaucaggagcaga

SEQ ID NO: 1534332 - RNA, 14 nt, Human adenovirus A
gaacgggcagccug

SEQ ID NO: 1534333 - RNA, 18 nt, Human adenovirus A
gaccgggcaccacagugg

SEQ ID NO: 1534334 - RNA, 15 nt, Human adenovirus A
cuguugggacagcaa

SEQ ID NO: 1534335 - RNA, 20 nt, Human adenovirus A
agaaauacagagcugucaua

SEQ ID NO: 1534336 - RNA, 14 nt, Human adenovirus A
uguaugaacacuua

SEQ ID NO: 1534337 - RNA, 15 nt, Human adenovirus A
ccgucaucucuacag

SEQ ID NO: 1534338 - RNA, 16 nt, Human adenovirus A
caaacggguggaaaaa

SEQ ID NO: 1534339 - RNA, 16 nt, Human adenovirus A
caccaaacgcccgcua

SEQ ID NO: 1534340 - RNA, 18 nt, Human adenovirus A
guaguaugcgcagacgca

SEQ ID NO: 1534341 - RNA, 15 nt, Human adenovirus A
cuuccaucaccuuug

SEQ ID NO: 1534342 - RNA, 15 nt, Human adenovirus A
cugcgugaggaggac

SEQ ID NO: 1534343 - RNA, 16 nt, Human adenovirus A
gacaaguugcuuucca

SEQ ID NO: 1534344 - RNA, 19 nt, Human adenovirus A
uuggccaccauagccccuc

SEQ ID NO: 1534345 - RNA, 17 nt, Human adenovirus A
ugcacguacuagccccu

SEQ ID NO: 1534346 - RNA, 14 nt, Human adenovirus A
aaucagaagccagc

SEQ ID NO: 1534347 - RNA, 15 nt, Human adenovirus A
cacccaagggugcag

SEQ ID NO: 1534348 - RNA, 15 nt, Human adenovirus A
cuguuuaaacaucua

SEQ ID NO: 1534349 - RNA, 19 nt, Human adenovirus A
aacacggaggacaauccaa

SEQ ID NO: 1534350 - RNA, 19 nt, Human adenovirus A
cugcggugguggagaagua

SEQ ID NO: 1534351 - RNA, 19 nt, Human adenovirus A
gcgcucaaaggcaggcauu

SEQ ID NO: 1534352 - RNA, 21 nt, Human adenovirus A
agcauucaugcugauguuugu

SEQ ID NO: 1534353 - RNA, 22 nt, Human adenovirus A
ccugcuuaaaaucggcggcgcg

SEQ ID NO: 1534354 - RNA, 19 nt, Human adenovirus A
uuuaauacugaaaaauagu

SEQ ID NO: 1534355 - RNA, 16 nt, Human adenovirus A
cagcagcgguggcgcu

SEQ ID NO: 1534356 - RNA, 19 nt, Human adenovirus A
agaaaggauguaaacauga

SEQ ID NO: 1534357 - RNA, 12 nt, Human adenovirus A
cuacacaacaca

SEQ ID NO: 1534358 - RNA, 13 nt, Human adenovirus A
uaagaaagaggca

SEQ ID NO: 1534359 - RNA, 22 nt, Human adenovirus A
uaaaaacuguucauauugugag

SEQ ID NO: 1534360 - RNA, 13 nt, Human adenovirus A
gucgcuguuuuga

SEQ ID NO: 1534361 - RNA, 19 nt, Human adenovirus A
uugguucgacgggccaggc

SEQ ID NO: 1534362 - RNA, 20 nt, Human adenovirus A
aaugaaaguugguaagcgac

SEQ ID NO: 1534363 - RNA, 11 nt, Human adenovirus A
gcuggaaccug

SEQ ID NO: 1534364 - RNA, 13 nt, Human adenovirus A
ugcuaacagcucu

SEQ ID NO: 1534365 - RNA, 16 nt, Human adenovirus A
accguagaugggacac

SEQ ID NO: 1534366 - RNA, 19 nt, Human adenovirus A
cggucaggaugccucggag

SEQ ID NO: 1534367 - RNA, 22 nt, Human adenovirus A
aguaauggaguuggaaacugug

SEQ ID NO: 1534368 - RNA, 21 nt, Human adenovirus A
gcccaucggauaaccuuacca

SEQ ID NO: 1534369 - RNA, 17 nt, Human adenovirus A
uaacauuuguguagagu

SEQ ID NO: 1534370 - RNA, 16 nt, Human adenovirus A
cgugcaucaguguaaa

SEQ ID NO: 1534371 - RNA, 16 nt, Human adenovirus A
acuugggaaauuuguc

SEQ ID NO: 1534372 - RNA, 18 nt, Human adenovirus A
gacucauaagcugugaaa

SEQ ID NO: 1534373 - RNA, 16 nt, Human adenovirus A
agcuuagccuuaauaa

SEQ ID NO: 1534374 - RNA, 17 nt, Human adenovirus A
cuacgguggcagccaag

SEQ ID NO: 1534375 - RNA, 23 nt, Human adenovirus A
cagcaaagaaaguucaccuccag

SEQ ID NO: 1534376 - RNA, 22 nt, Human adenovirus A
auugcaggggcucuuuuaagau

SEQ ID NO: 1534377 - RNA, 16 nt, Human adenovirus A
acgaaggccaaaccau

SEQ ID NO: 1534378 - RNA, 17 nt, Human adenovirus A
aucuuguuuccagugcg

SEQ ID NO: 1534379 - RNA, 22 nt, Human adenovirus A
gaggcagccguuucaggaagga

SEQ ID NO: 1534380 - RNA, 14 nt, Human adenovirus A
gaagcuucuuguac

SEQ ID NO: 1534381 - RNA, 23 nt, Human adenovirus A
auguaacugaggagcugagaagu

SEQ ID NO: 1534382 - RNA, 17 nt, Human adenovirus A
acaaguuccggaguucc

SEQ ID NO: 1534383 - RNA, 15 nt, Human adenovirus A
accucacugcuuugc

SEQ ID NO: 1534384 - RNA, 10 nt, Human adenovirus A
aucacuuccg

SEQ ID NO: 1534385 - RNA, 20 nt, Human adenovirus A
ggcaagaacaauuucaucaa

SEQ ID NO: 1534386 - RNA, 12 nt, Human adenovirus A
aggaaaagcugc

SEQ ID NO: 1534387 - RNA, 15 nt, Human adenovirus A
cugacacaaaagcuc

SEQ ID NO: 1534388 - RNA, 23 nt, Human adenovirus A
auuucgauaaacaaaagcaaagc

SEQ ID NO: 1534389 - RNA, 13 nt, Human adenovirus A
acgcuuugcuuga

SEQ ID NO: 1534390 - RNA, 15 nt, Human adenovirus A
cugcugucauuugug

SEQ ID NO: 1534391 - RNA, 19 nt, Human adenovirus A
aaagaucaguagcuaagga

SEQ ID NO: 1534392 - RNA, 22 nt, Human adenovirus A
gaacuauuaagugaaagucaag

SEQ ID NO: 1534393 - RNA, 16 nt, Human adenovirus A
caugcucuagacauga

SEQ ID NO: 1534394 - RNA, 13 nt, Human adenovirus A
agcaacuuuuuaa

SEQ ID NO: 1534395 - RNA, 22 nt, Human adenovirus A
ccgcacguucaauaguggcugc

SEQ ID NO: 1534396 - RNA, 15 nt, Human adenovirus A
aaauaaccaguguua

SEQ ID NO: 1534397 - RNA, 19 nt, Human adenovirus A
caaugugcaggcuaacuua

SEQ ID NO: 1534398 - RNA, 12 nt, Human adenovirus A
cuuuuuaaccac

SEQ ID NO: 1534399 - RNA, 14 nt, Human adenovirus A
gcucggccaccguc

SEQ ID NO: 1534400 - RNA, 23 nt, Human adenovirus A
acaacugcacuugaauauuucga

SEQ ID NO: 1534401 - RNA, 14 nt, Human adenovirus A
ggagcuaaaacaag

SEQ ID NO: 1534402 - RNA, 17 nt, Human adenovirus A
acaagguaggcuaaguu

SEQ ID NO: 1534403 - RNA, 15 nt, Human adenovirus A
aagcaauaaaacaag

SEQ ID NO: 1534404 - RNA, 23 nt, Human adenovirus A
gcuggcgcuuccauaccugggau

SEQ ID NO: 1534405 - RNA, 17 nt, Human adenovirus A
gcuuccaguucuucuuc

SEQ ID NO: 1534406 - RNA, 14 nt, Human adenovirus A
gcggccuguuuugu

SEQ ID NO: 1534407 - RNA, 23 nt, Human adenovirus A
ggaaacaaguuuagaaaccccac

SEQ ID NO: 1534408 - RNA, 14 nt, Human adenovirus A
uggaagcuggccau

SEQ ID NO: 1534409 - RNA, 17 nt, Human adenovirus A
agguagcauuuuaacau

SEQ ID NO: 1534410 - RNA, 22 nt, Human adenovirus A
uuuucuuuaaaaaucacaaaau

SEQ ID NO: 1534411 - RNA, 20 nt, Human adenovirus A
gcugacgggagcaggaacag

SEQ ID NO: 1534412 - RNA, 23 nt, Human adenovirus A
acaacagucaguguccaucagcc

SEQ ID NO: 1534413 - RNA, 23 nt, Human adenovirus A
cgcacguucaauaguggcugcaa

SEQ ID NO: 1534414 - RNA, 14 nt, Human adenovirus A
guacagccagaugu

SEQ ID NO: 1534415 - RNA, 17 nt, Human adenovirus A
cugucaaaccugacaga

SEQ ID NO: 1534416 - RNA, 20 nt, Human adenovirus A
cucauccauuauuauggcaa

SEQ ID NO: 1534417 - RNA, 14 nt, Human adenovirus A
aucaugaaaacagc

SEQ ID NO: 1534418 - RNA, 17 nt, Human adenovirus A
aaccaugaaaacagcau

SEQ ID NO: 1534419 - RNA, 17 nt, Human adenovirus A
aggaauuagcugaugcu

SEQ ID NO: 1534420 - RNA, 20 nt, Human adenovirus A
auacauaauuuuaaaguaaa

SEQ ID NO: 1534421 - RNA, 14 nt, Human adenovirus A
gcgagcugccaccg

SEQ ID NO: 1534422 - RNA, 13 nt, Human adenovirus A
cugaaaacaacug

SEQ ID NO: 1534423 - RNA, 12 nt, Human adenovirus A
caggcuggaggu

SEQ ID NO: 1534424 - RNA, 13 nt, Human adenovirus A
gugguucaggaac

SEQ ID NO: 1534425 - RNA, 17 nt, Human adenovirus A
augcgggcagccaggcg

SEQ ID NO: 1534426 - RNA, 23 nt, Human adenovirus A
uuaaugcaucuuugggacuuugu

SEQ ID NO: 1534427 - RNA, 12 nt, Human adenovirus A
uuaauacuggcu

SEQ ID NO: 1534428 - RNA, 23 nt, Human adenovirus A
auguaaguaggauagcaccugcc

SEQ ID NO: 1534429 - RNA, 19 nt, Human adenovirus A
cagugagccguccagcagu

SEQ ID NO: 1534430 - RNA, 16 nt, Human adenovirus A
ggcuaggaaaacaaac

SEQ ID NO: 1534431 - RNA, 15 nt, Human adenovirus A
ccauguaucagcagc

SEQ ID NO: 1534432 - RNA, 18 nt, Human adenovirus A
gaauuccgcaguggacag

SEQ ID NO: 1534433 - RNA, 21 nt, Human adenovirus A
ugcgccuauauuauagguaac

SEQ ID NO: 1534434 - RNA, 17 nt, Human adenovirus A
gaaccacgaaaacggug

SEQ ID NO: 1534435 - RNA, 17 nt, Human adenovirus A
ugaucacagcaacuuuu

SEQ ID NO: 1534436 - RNA, 23 nt, Human adenovirus A
auuaggcuuucuuccauuugauc

SEQ ID NO: 1534437 - RNA, 16 nt, Human adenovirus A
caaauagcucuuaaug

SEQ ID NO: 1534438 - RNA, 20 nt, Human adenovirus A
uaaaugcggaagaagaacgc

SEQ ID NO: 1534439 - RNA, 20 nt, Human adenovirus A
uuguugaauucgcaggcggu

SEQ ID NO: 1534440 - RNA, 18 nt, Human adenovirus A
gccgcagcugcggccgca

SEQ ID NO: 1534441 - RNA, 14 nt, Human adenovirus A
aggccaaacagcug

SEQ ID NO: 1534442 - RNA, 23 nt, Human adenovirus A
uacaaggaccgcauguauucuuu

SEQ ID NO: 1534443 - RNA, 23 nt, Human adenovirus A
cgcaagcuuucauugguccaggc

SEQ ID NO: 1534444 - RNA, 20 nt, Human adenovirus A
cuucagagcacacugggaaa

SEQ ID NO: 1534445 - RNA, 19 nt, Human adenovirus A
auggugacgguucuucuca

SEQ ID NO: 1534446 - RNA, 16 nt, Human adenovirus A
ugcuuuccaaaugccc

SEQ ID NO: 1534447 - RNA, 17 nt, Human adenovirus A
agauccguacaaggcau

SEQ ID NO: 1534448 - RNA, 20 nt, Human adenovirus A
gacgaagcgucagcucguug

SEQ ID NO: 1534449 - RNA, 19 nt, Human adenovirus A
cugaagugccucaaaguga

SEQ ID NO: 1534450 - RNA, 20 nt, Human adenovirus A
cauaccugggauuguguccu

SEQ ID NO: 1534451 - RNA, 14 nt, Human adenovirus A
acauaauuucccuc

SEQ ID NO: 1534452 - RNA, 22 nt, Human adenovirus A
cuuaaugccaguuguauaaaau

SEQ ID NO: 1534453 - RNA, 18 nt, Human adenovirus A
uaaacaaaagcaaagcaa

SEQ ID NO: 1534454 - RNA, 21 nt, Human adenovirus A
cauccaugugaugccggcagc

SEQ ID NO: 1534455 - RNA, 22 nt, Human adenovirus A
cuuucuaagguguguaaacaca

SEQ ID NO: 1534456 - RNA, 18 nt, Human adenovirus A
uguaaccagagcaccccu

SEQ ID NO: 1534457 - RNA, 17 nt, Human adenovirus A
agaucuuccaacaugag

SEQ ID NO: 1534458 - RNA, 15 nt, Human adenovirus A
gccaugcaaagccag

SEQ ID NO: 1534459 - RNA, 12 nt, Human adenovirus A
uuuaaaaaucac

SEQ ID NO: 1534460 - RNA, 13 nt, Human adenovirus A
acaugauuuccag

SEQ ID NO: 1534461 - RNA, 15 nt, Human adenovirus A
aagucuucugacauu

SEQ ID NO: 1534462 - RNA, 18 nt, Human adenovirus A
cguggaacagccaaaccg

SEQ ID NO: 1534463 - RNA, 12 nt, Human adenovirus A
caguguccauca

SEQ ID NO: 1534464 - RNA, 21 nt, Human adenovirus A
ucauaccuuaaaaacuguuca

SEQ ID NO: 1534465 - RNA, 14 nt, Human adenovirus A
ugaacgauuuuaug

SEQ ID NO: 1534466 - RNA, 13 nt, Human adenovirus A
uagagggaggcaa

SEQ ID NO: 1534467 - RNA, 15 nt, Human adenovirus A
ccgcagucagugacc

SEQ ID NO: 1534468 - RNA, 20 nt, Human adenovirus A
augagcaaaacgcugggcuc

SEQ ID NO: 1534469 - RNA, 16 nt, Human adenovirus A
caaaagguugaggaau

SEQ ID NO: 1534470 - RNA, 19 nt, Human adenovirus A
ucauauugugagccacagu

SEQ ID NO: 1534471 - RNA, 13 nt, Human adenovirus A
auuccgcagugga

SEQ ID NO: 1534472 - RNA, 18 nt, Human adenovirus A
cacaacggaugaaagcuu

SEQ ID NO: 1534473 - RNA, 19 nt, Human adenovirus A
gcuucuacuuuagaagcca

SEQ ID NO: 1534474 - RNA, 21 nt, Human adenovirus A
acuuccucauccgcccaaacu

SEQ ID NO: 1534475 - RNA, 22 nt, Human adenovirus A
ggauggguguuuggcagcaaug

SEQ ID NO: 1534476 - RNA, 14 nt, Human adenovirus A
ucccaucccagcua

SEQ ID NO: 1534477 - RNA, 14 nt, Human adenovirus A
cacugcaaugcagc

SEQ ID NO: 1534478 - RNA, 14 nt, Human adenovirus A
gccuucauuccuuc

SEQ ID NO: 1534479 - RNA, 22 nt, Human adenovirus A
acaaggaccguuuucugcagcg

SEQ ID NO: 1534480 - RNA, 21 nt, Human adenovirus A
caacacuacgcgaugaagcac

SEQ ID NO: 1534481 - RNA, 17 nt, Human adenovirus A
auuugcgcacugaaaaa

SEQ ID NO: 1534482 - RNA, 14 nt, Human adenovirus A
caacaaaacacuga

SEQ ID NO: 1534483 - RNA, 23 nt, Human adenovirus A
uaaugaugauacucgacaucguu

SEQ ID NO: 1534484 - RNA, 21 nt, Human adenovirus A
cuugaacaacuuuuaacauua

SEQ ID NO: 1534485 - RNA, 23 nt, Human adenovirus A
cuugagcaaaaauguuuucugga

SEQ ID NO: 1534486 - RNA, 22 nt, Human adenovirus A
cguuccgucaaaaaagcaaagu

SEQ ID NO: 1534487 - RNA, 15 nt, Human adenovirus A
agauuuaauuucaga

SEQ ID NO: 1534488 - RNA, 18 nt, Human adenovirus A
gcgcccacucuccugagc

SEQ ID NO: 1534489 - RNA, 23 nt, Human adenovirus A
cauuacccaagaauaaaaacaca

SEQ ID NO: 1534490 - RNA, 23 nt, Human adenovirus A
ccaacaaaacuuaucagccagag

SEQ ID NO: 1534491 - RNA, 12 nt, Human adenovirus A
gcucuaccuuaa

SEQ ID NO: 1534492 - RNA, 18 nt, Human adenovirus A
caccaaauuuaaggccag

SEQ ID NO: 1534493 - RNA, 20 nt, Human adenovirus A
ucacaaggucuuaaacuuuc

SEQ ID NO: 1534494 - RNA, 20 nt, Human adenovirus A
augggguggagauuuaaaaa

SEQ ID NO: 1534495 - RNA, 17 nt, Human adenovirus A
cagugcggccuguugcc

SEQ ID NO: 1534496 - RNA, 13 nt, Human adenovirus A
ucagcuucuccag

SEQ ID NO: 1534497 - RNA, 23 nt, Human adenovirus A
guugguucgacgggccaggcgca

SEQ ID NO: 1534498 - RNA, 22 nt, Human adenovirus A
ugacuggacagcggccauggau

SEQ ID NO: 1534499 - RNA, 15 nt, Human adenovirus A
agcacuaaaaucccu

SEQ ID NO: 1534500 - RNA, 23 nt, Human adenovirus A
gagcucauccucagcuccgagau

SEQ ID NO: 1534501 - RNA, 18 nt, Human adenovirus A
guuaccugugcugaugga

SEQ ID NO: 1534502 - RNA, 18 nt, Human adenovirus A
aagcgacaaagagcuuau

SEQ ID NO: 1534503 - RNA, 13 nt, Human adenovirus A
uaaucacaacaca

SEQ ID NO: 1534504 - RNA, 19 nt, Human adenovirus A
augaugcgggcagccaggc

SEQ ID NO: 1534505 - RNA, 11 nt, Human adenovirus A
cacggagagga

SEQ ID NO: 1534506 - RNA, 12 nt, Human adenovirus A
aaguuuaaagga

SEQ ID NO: 1534507 - RNA, 13 nt, Human adenovirus A
aacuacaaaaaag

SEQ ID NO: 1534508 - RNA, 14 nt, Human adenovirus A
cccucuccaaugaa

SEQ ID NO: 1534509 - RNA, 17 nt, Human adenovirus A
auggaguuggaaacugu

SEQ ID NO: 1534510 - RNA, 12 nt, Human adenovirus A
gacaacauugcc

SEQ ID NO: 1534511 - RNA, 23 nt, Human adenovirus A
uagguauaagaaagaggcagccg

SEQ ID NO: 1534512 - RNA, 15 nt, Human adenovirus A
guuuaaacuacacaa

SEQ ID NO: 1534513 - RNA, 20 nt, Human adenovirus A
gccaugcgcgcggccagagc

SEQ ID NO: 1534514 - RNA, 20 nt, Human adenovirus A
aacaguuugcgugccuggcu

SEQ ID NO: 1534515 - RNA, 18 nt, Human adenovirus A
aacaugauucuucagagc

SEQ ID NO: 1534516 - RNA, 22 nt, Human adenovirus A
ucagccagagccgcaaguagga

SEQ ID NO: 1534517 - RNA, 18 nt, Human adenovirus A
cgucuucguggagaagcg

SEQ ID NO: 1534518 - RNA, 20 nt, Human adenovirus A
accuacuucacccugggaaa

SEQ ID NO: 1534519 - RNA, 11 nt, Human adenovirus A
caagcugaaac

SEQ ID NO: 1534520 - RNA, 19 nt, Human adenovirus A
accuuugugugcuacugcg

SEQ ID NO: 1534521 - RNA, 19 nt, Human adenovirus A
caaaguucgccuacacaac

SEQ ID NO: 1534522 - RNA, 17 nt, Human adenovirus A
ugcucgaccguuuucac

SEQ ID NO: 1534523 - RNA, 12 nt, Human adenovirus A
ccuccuggaggu

SEQ ID NO: 1534524 - RNA, 23 nt, Human adenovirus A
aggcgaucguucaacuuugucca

SEQ ID NO: 1534525 - RNA, 21 nt, Human adenovirus A
cagcugacgacaguaguguau

SEQ ID NO: 1534526 - RNA, 23 nt, Human adenovirus A
ugcacauauucgcgugccaggca

SEQ ID NO: 1534527 - RNA, 10 nt, Human adenovirus A
ccagcucuug

SEQ ID NO: 1534528 - RNA, 15 nt, Human adenovirus A
ccuauagaggcuggc

SEQ ID NO: 1534529 - RNA, 12 nt, Human adenovirus A
acgggccaggcg

SEQ ID NO: 1534530 - RNA, 17 nt, Human adenovirus A
cagagcacacugggaaa

SEQ ID NO: 1534531 - RNA, 18 nt, Human adenovirus A
guuuacaaagcacugggc

SEQ ID NO: 1534532 - RNA, 14 nt, Human adenovirus A
cggcaugcugaaac

SEQ ID NO: 1534533 - RNA, 18 nt, Human adenovirus A
cuauaguaaaaaugccag

SEQ ID NO: 1534534 - RNA, 13 nt, Human adenovirus A
cauggcuuccaug

SEQ ID NO: 1534535 - RNA, 14 nt, Human adenovirus A
ugugcaaaacuuuc

SEQ ID NO: 1534536 - RNA, 15 nt, Human adenovirus A
gccugguaaaacaag

SEQ ID NO: 1534537 - RNA, 22 nt, Human adenovirus A
aacucagcccaugcucuagaca

SEQ ID NO: 1534538 - RNA, 12 nt, Human adenovirus A
acacuuaacaca

SEQ ID NO: 1534539 - RNA, 16 nt, Human adenovirus A
cgcuuuugccagacua

SEQ ID NO: 1534540 - RNA, 16 nt, Human adenovirus A
auuguagccugcuuuc

SEQ ID NO: 1534541 - RNA, 20 nt, Human adenovirus A
uaaucaagacggucagcaag

SEQ ID NO: 1534542 - RNA, 22 nt, Human adenovirus A
cugggugcgcgacucagugacc

SEQ ID NO: 1534543 - RNA, 19 nt, Human adenovirus A
agcugacgacaguagugua

SEQ ID NO: 1534544 - RNA, 14 nt, Human adenovirus A
acggagacaaaauu

SEQ ID NO: 1534545 - RNA, 18 nt, Human adenovirus A
uuaaacccuuuagcaguu

SEQ ID NO: 1534546 - RNA, 16 nt, Human adenovirus A
aagagguaucgcagcc

SEQ ID NO: 1534547 - RNA, 20 nt, Human adenovirus A
cauccggcgcgcccggcucc

SEQ ID NO: 1534548 - RNA, 15 nt, Human adenovirus A
cacuggcuggcuuuu

SEQ ID NO: 1534549 - RNA, 18 nt, Human adenovirus A
aguuacaacuugcuucca

SEQ ID NO: 1534550 - RNA, 17 nt, Human adenovirus A
aggaagguuccaaggac

SEQ ID NO: 1534551 - RNA, 22 nt, Human adenovirus A
cacuagaaucggcaacagcagc

SEQ ID NO: 1534552 - RNA, 23 nt, Human adenovirus A
ugaacgucgccugaguuaucuug

SEQ ID NO: 1534553 - RNA, 19 nt, Human adenovirus A
acuuuagaaaggauguaaa

SEQ ID NO: 1534554 - RNA, 16 nt, Human adenovirus A
ucuugcugaaaugcgc

SEQ ID NO: 1534555 - RNA, 16 nt, Human adenovirus A
accacugaaacucccu

SEQ ID NO: 1534556 - RNA, 22 nt, Human adenovirus A
aaguaaaccccuaacugcccag

SEQ ID NO: 1534557 - RNA, 13 nt, Human adenovirus A
caaaccugacaga

SEQ ID NO: 1534558 - RNA, 10 nt, Human adenovirus A
uguuaaccau

SEQ ID NO: 1534559 - RNA, 18 nt, Human adenovirus A
ucagcaguugcaagcgau

SEQ ID NO: 1534560 - RNA, 21 nt, Human adenovirus A
caccgcucccgccauuggcgc

SEQ ID NO: 1534561 - RNA, 12 nt, Human adenovirus A
gcgugccuggcu

SEQ ID NO: 1534562 - RNA, 19 nt, Human adenovirus A
augacuaacgcuggggcac

SEQ ID NO: 1534563 - RNA, 23 nt, Human adenovirus A
uaauggagcggcugacagagcgc

SEQ ID NO: 1534564 - RNA, 22 nt, Human adenovirus A
auucauauauguaucuggacau

SEQ ID NO: 1534565 - RNA, 19 nt, Human adenovirus A
agccuugucuacaacugcu

SEQ ID NO: 1534566 - RNA, 18 nt, Human adenovirus A
gcaggaaaucugggagga

SEQ ID NO: 1534567 - RNA, 14 nt, Human adenovirus A
aucggcggcgcgga

SEQ ID NO: 1534568 - RNA, 20 nt, Human adenovirus A
ucuucggguggacggagcca

SEQ ID NO: 1534569 - RNA, 16 nt, Human adenovirus A
ccgaauauccaaaccc

SEQ ID NO: 1534570 - RNA, 13 nt, Human adenovirus A
guguaugccaaca

SEQ ID NO: 1534571 - RNA, 13 nt, Human adenovirus A
aacagcuucuaaa

SEQ ID NO: 1534572 - RNA, 14 nt, Human adenovirus A
uugaauucuggaau

SEQ ID NO: 1534573 - RNA, 11 nt, Human adenovirus A
cgggcucuggc

SEQ ID NO: 1534574 - RNA, 16 nt, Human adenovirus A
guggauaccacagaau

SEQ ID NO: 1534575 - RNA, 18 nt, Human adenovirus A
cacgguauuggccauucc

SEQ ID NO: 1534576 - RNA, 21 nt, Human adenovirus A
gaaauugucauaccuuaaaaa

SEQ ID NO: 1534577 - RNA, 19 nt, Human adenovirus A
uagacauuguuggccugua

SEQ ID NO: 1534578 - RNA, 12 nt, Human adenovirus A
aggggcucuuuu

SEQ ID NO: 1534579 - RNA, 22 nt, Human adenovirus A
cagggaagauuaaucacaucaa

SEQ ID NO: 1534580 - RNA, 15 nt, Human adenovirus A
ucaauuuugcaagug

SEQ ID NO: 1534581 - RNA, 18 nt, Human adenovirus A
guguacuugguggacaac

SEQ ID NO: 1534582 - RNA, 19 nt, Human adenovirus A
ccauugggagucagacccg

SEQ ID NO: 1534583 - RNA, 16 nt, Human adenovirus A
auagcaacaacgcugg

SEQ ID NO: 1534584 - RNA, 19 nt, Human adenovirus A
gccggcgaacgggcagccu

SEQ ID NO: 1534585 - RNA, 23 nt, Human adenovirus A
gacauccaugugaugccggcagc

SEQ ID NO: 1534586 - RNA, 14 nt, Human adenovirus A
gagccauguugugc

SEQ ID NO: 1534587 - RNA, 17 nt, Human adenovirus A
cacaaauggacccauau

SEQ ID NO: 1534588 - RNA, 13 nt, Human adenovirus A
acacauaaagagu

SEQ ID NO: 1534589 - RNA, 17 nt, Human adenovirus A
uaugaccuuaaucuguu

SEQ ID NO: 1534590 - RNA, 18 nt, Human adenovirus A
caagacggucagcaagga

SEQ ID NO: 1534591 - RNA, 22 nt, Human adenovirus A
gaacaguguuuucagcaauuac

SEQ ID NO: 1534592 - RNA, 20 nt, Human adenovirus A
ucuuuguguguuucuaaaac

SEQ ID NO: 1534593 - RNA, 17 nt, Human adenovirus A
ccaccgccaugcgcgcg

SEQ ID NO: 1534594 - RNA, 20 nt, Human adenovirus A
gacagagcgcggcugcgaca

SEQ ID NO: 1534595 - RNA, 12 nt, Human adenovirus A
gcuucuccagac

SEQ ID NO: 1534596 - RNA, 15 nt, Human adenovirus A
aagcaaguacaaagg

SEQ ID NO: 1534597 - RNA, 16 nt, Human adenovirus A
uagaugugcuguggaa

SEQ ID NO: 1534598 - RNA, 18 nt, Human adenovirus A
aauagcacuuuggauggc

SEQ ID NO: 1534599 - RNA, 19 nt, Human adenovirus A
ucaauuugccuaaaagcua

SEQ ID NO: 1534600 - RNA, 17 nt, Human adenovirus A
agccaacauccagugcg

SEQ ID NO: 1534601 - RNA, 23 nt, Human adenovirus A
aaaaagcuuuaauaaccaugugc

SEQ ID NO: 1534602 - RNA, 20 nt, Human adenovirus A
cacauucaacugaccagguc

SEQ ID NO: 1534603 - RNA, 13 nt, Human adenovirus A
cucuuaaugcagg

SEQ ID NO: 1534604 - RNA, 15 nt, Human adenovirus A
uuugucauggaguuu

SEQ ID NO: 1534605 - RNA, 20 nt, Human adenovirus A
cagagucgaggucaagaaca

SEQ ID NO: 1534606 - RNA, 16 nt, Human adenovirus A
uaaguguucgcaacaa

SEQ ID NO: 1534607 - RNA, 17 nt, Human adenovirus A
gucgauuucggcggcgu

SEQ ID NO: 1534608 - RNA, 15 nt, Human adenovirus A
ccagcgccaccugcc

SEQ ID NO: 1534609 - RNA, 12 nt, Human adenovirus A
gaagagcugcug

SEQ ID NO: 1534610 - RNA, 21 nt, Human adenovirus A
ggcuggcuuuuggauggaacc

SEQ ID NO: 1534611 - RNA, 15 nt, Human adenovirus A
ugauuuacaaaccgu

SEQ ID NO: 1534612 - RNA, 22 nt, Human adenovirus A
acagcucugauuucgauaaaca

SEQ ID NO: 1534613 - RNA, 14 nt, Human adenovirus A
ugcauuuaguguuu

SEQ ID NO: 1534614 - RNA, 16 nt, Human adenovirus A
ugcgcuuuaaacugag

SEQ ID NO: 1534615 - RNA, 17 nt, Human adenovirus A
uaguugccacgcuuuga

SEQ ID NO: 1534616 - RNA, 14 nt, Human adenovirus A
gcugcucagcucca

SEQ ID NO: 1534617 - RNA, 19 nt, Human adenovirus A
agguguaaccagcugggca

SEQ ID NO: 1534618 - RNA, 16 nt, Human adenovirus A
gcaggaguugcaggau

SEQ ID NO: 1534619 - RNA, 17 nt, Human adenovirus A
uccaaggaugacaacau

SEQ ID NO: 1534620 - RNA, 14 nt, Human adenovirus A
aguauuuuguaaag

SEQ ID NO: 1534621 - RNA, 16 nt, Human adenovirus A
caggaagagccucaau

SEQ ID NO: 1534622 - RNA, 14 nt, Human adenovirus A
uuuguguagagucu

SEQ ID NO: 1534623 - RNA, 20 nt, Human adenovirus A
gccagaagcacuggcaacau

SEQ ID NO: 1534624 - RNA, 16 nt, Human adenovirus A
agccguagacgagguc

SEQ ID NO: 1534625 - RNA, 22 nt, Human adenovirus A
aaggaagccacaugggaagggu

SEQ ID NO: 1534626 - RNA, 18 nt, Human adenovirus A
guacauaauccagcaagu

SEQ ID NO: 1534627 - RNA, 14 nt, Human adenovirus A
ggacauaauuuccc

SEQ ID NO: 1534628 - RNA, 13 nt, Human adenovirus A
gcacugggccagg

SEQ ID NO: 1534629 - RNA, 15 nt, Human adenovirus A
uccuacauuggaguu

SEQ ID NO: 1534630 - RNA, 15 nt, Human adenovirus A
caugcaaagccagcc

SEQ ID NO: 1534631 - RNA, 18 nt, Human adenovirus A
gaagcugaggaaaugcga

SEQ ID NO: 1534632 - RNA, 13 nt, Human adenovirus A
cauggaaaaacuu

SEQ ID NO: 1534633 - RNA, 15 nt, Human adenovirus A
ucaaauggcucuucg

SEQ ID NO: 1534634 - RNA, 19 nt, Human adenovirus A
agugguauuccgcgguccu

SEQ ID NO: 1534635 - RNA, 16 nt, Human adenovirus A
uccaacgaacuacaac

SEQ ID NO: 1534636 - RNA, 21 nt, Human adenovirus A
ugacaccaacgaccagucuuu

SEQ ID NO: 1534637 - RNA, 12 nt, Human adenovirus A
ggccagcucacg

SEQ ID NO: 1534638 - RNA, 15 nt, Human adenovirus A
acucauaccccaaga

SEQ ID NO: 1534639 - RNA, 18 nt, Human adenovirus A
cugcaaaaagaaaaugaa

SEQ ID NO: 1534640 - RNA, 18 nt, Human adenovirus A
uguggaauaauaguuccc

SEQ ID NO: 1534641 - RNA, 19 nt, Human adenovirus A
aauacugguauuuaaaauc

SEQ ID NO: 1534642 - RNA, 15 nt, Human adenovirus A
ccagauuguggaaua

SEQ ID NO: 1534643 - RNA, 16 nt, Human adenovirus A
ucuguaguuucuuuac

SEQ ID NO: 1534644 - RNA, 18 nt, Human adenovirus A
gcaaauuacgcaacaacu

SEQ ID NO: 1534645 - RNA, 16 nt, Human adenovirus A
caaaugcccugcaaaa

SEQ ID NO: 1534646 - RNA, 23 nt, Human adenovirus A
caggggugguggguuuggaugga

SEQ ID NO: 1534647 - RNA, 21 nt, Human adenovirus A
uacagaaaaaaauugccaacc

SEQ ID NO: 1534648 - RNA, 16 nt, Human adenovirus A
ccgguugagcagaacu

SEQ ID NO: 1534649 - RNA, 23 nt, Human adenovirus A
gaccccaucuuguuuccagugcg

SEQ ID NO: 1534650 - RNA, 12 nt, Human adenovirus A
acccccagugcc

SEQ ID NO: 1534651 - RNA, 17 nt, Human adenovirus A
acaacacaaaaaaaacc

SEQ ID NO: 1534652 - RNA, 21 nt, Human adenovirus A
ggaggucuccaugucccgcac

SEQ ID NO: 1534653 - RNA, 20 nt, Human adenovirus A
auugaaaacguuaaagcugg

SEQ ID NO: 1534654 - RNA, 14 nt, Human adenovirus A
acuacucagaacaa

SEQ ID NO: 1534655 - RNA, 15 nt, Human adenovirus A
auccuguaguugcag

SEQ ID NO: 1534656 - RNA, 20 nt, Human adenovirus A
uaaugaggcuuuucauccag

SEQ ID NO: 1534657 - RNA, 16 nt, Human adenovirus A
ccaagcguagccgcag

SEQ ID NO: 1534658 - RNA, 20 nt, Human adenovirus A
caugggcaucuugcaugaaa

SEQ ID NO: 1534659 - RNA, 18 nt, Human adenovirus A
aggacacuggcaguuuag

SEQ ID NO: 1534660 - RNA, 22 nt, Human adenovirus A
aaauugcucgaugaugcauaau

SEQ ID NO: 1534661 - RNA, 19 nt, Human adenovirus A
ccgcgguuuuggcggccau

SEQ ID NO: 1534662 - RNA, 14 nt, Human adenovirus A
aguuucuccuucua

SEQ ID NO: 1534663 - RNA, 23 nt, Human adenovirus A
agccaacuuaguaacagcauaug

SEQ ID NO: 1534664 - RNA, 17 nt, Human adenovirus A
cacuggcgaugacgaug

SEQ ID NO: 1534665 - RNA, 16 nt, Human adenovirus A
gcggcccgacgaggua

SEQ ID NO: 1534666 - RNA, 19 nt, Human adenovirus A
uaaaaaggaagcaggugau

SEQ ID NO: 1534667 - RNA, 23 nt, Human adenovirus A
agcagcggcuugagcaaaaaugu

SEQ ID NO: 1534668 - RNA, 20 nt, Human adenovirus A
caccagguguauuagcacuu

SEQ ID NO: 1534669 - RNA, 19 nt, Human adenovirus A
cuuggccaguuccccuaac

SEQ ID NO: 1534670 - RNA, 19 nt, Human adenovirus A
gguaccauagcgaggaacc

SEQ ID NO: 1534671 - RNA, 20 nt, Human adenovirus A
uaacaaaggugcuucccaca

SEQ ID NO: 1534672 - RNA, 14 nt, Human adenovirus A
acuucauauuugcu

SEQ ID NO: 1534673 - RNA, 15 nt, Human adenovirus A
cgcauuuuucccacu

SEQ ID NO: 1534674 - RNA, 13 nt, Human adenovirus A
gaggaaagacagc

SEQ ID NO: 1534675 - RNA, 16 nt, Human adenovirus A
ugaguaacuucaacau

SEQ ID NO: 1534676 - RNA, 14 nt, Human adenovirus A
agacgacaacugag

SEQ ID NO: 1534677 - RNA, 23 nt, Human adenovirus A
gaccaauccaaacccccaaaagc

SEQ ID NO: 1534678 - RNA, 14 nt, Human adenovirus A
guaugcgcagacgc

SEQ ID NO: 1534679 - RNA, 15 nt, Human adenovirus A
ugcagccucauacaa

SEQ ID NO: 1534680 - RNA, 21 nt, Human adenovirus A
agccuucauuccuucagaaua

SEQ ID NO: 1534681 - RNA, 22 nt, Human adenovirus A
acgcgugguuaaacugccuccu

SEQ ID NO: 1534682 - RNA, 14 nt, Human adenovirus A
ugcaagugauaguu

SEQ ID NO: 1534683 - RNA, 16 nt, Human adenovirus A
caacuuaacaaauuua

SEQ ID NO: 1534684 - RNA, 18 nt, Human adenovirus A
cuggcaguuuagaggcca

SEQ ID NO: 1534685 - RNA, 13 nt, Human adenovirus A
ucacacuuaacac

SEQ ID NO: 1534686 - RNA, 15 nt, Human adenovirus A
gcgagcgcauagaaa

SEQ ID NO: 1534687 - RNA, 13 nt, Human adenovirus A
gcuaauaccuguc

SEQ ID NO: 1534688 - RNA, 19 nt, Human adenovirus A
caugauguuuaauaaagcg

SEQ ID NO: 1534689 - RNA, 20 nt, Human adenovirus A
accgacgaagcgucagcucg

SEQ ID NO: 1534690 - RNA, 15 nt, Human adenovirus A
gcugaggaaaugcga

SEQ ID NO: 1534691 - RNA, 17 nt, Human adenovirus A
cauccccagacaguuuc

SEQ ID NO: 1534692 - RNA, 20 nt, Human adenovirus A
caugcuuuagguuagccuga

SEQ ID NO: 1534693 - RNA, 15 nt, Human adenovirus A
aguuuaaaggcauua

SEQ ID NO: 1534694 - RNA, 16 nt, Human adenovirus A
uauaguaaaaaugcca

SEQ ID NO: 1534695 - RNA, 12 nt, Human adenovirus A
agcccacaagga

SEQ ID NO: 1534696 - RNA, 20 nt, Human adenovirus A
uggaaaaagaucaaggaaau

SEQ ID NO: 1534697 - RNA, 14 nt, Human adenovirus A
uucaauaaauacug

SEQ ID NO: 1534698 - RNA, 23 nt, Human adenovirus A
caacuaaaaauuguuuuuguucu

SEQ ID NO: 1534699 - RNA, 14 nt, Human adenovirus A
ugcauuaccagcag

SEQ ID NO: 1534700 - RNA, 12 nt, Human adenovirus A
aggcaaagaaca

SEQ ID NO: 1534701 - RNA, 16 nt, Human adenovirus A
gaugcgagcaauaacc

SEQ ID NO: 1534702 - RNA, 16 nt, Human adenovirus A
ggagaaggcauagccc

SEQ ID NO: 1534703 - RNA, 13 nt, Human adenovirus A
ugaaucuguggau

SEQ ID NO: 1534704 - RNA, 17 nt, Human adenovirus A
aggcaacguuggcagcg

SEQ ID NO: 1534705 - RNA, 17 nt, Human adenovirus A
gaacaaacagugccugu

SEQ ID NO: 1534706 - RNA, 16 nt, Human adenovirus A
auauguuucuguacug

SEQ ID NO: 1534707 - RNA, 13 nt, Human adenovirus A
gcagcuggagugg

SEQ ID NO: 1534708 - RNA, 18 nt, Human adenovirus A
cuagccaacauccagugc

SEQ ID NO: 1534709 - RNA, 14 nt, Human adenovirus A
aaugcccugcaaaa

SEQ ID NO: 1534710 - RNA, 20 nt, Human adenovirus A
gcuucagguguuaucuucaa

SEQ ID NO: 1534711 - RNA, 14 nt, Human adenovirus A
gcagugaggacacu

SEQ ID NO: 1534712 - RNA, 17 nt, Human adenovirus A
cauggcugaagaggagg

SEQ ID NO: 1534713 - RNA, 19 nt, Human adenovirus A
gcauugcgauaaacuggau

SEQ ID NO: 1534714 - RNA, 17 nt, Human adenovirus A
aguguauggaaaaaacg

SEQ ID NO: 1534715 - RNA, 14 nt, Human adenovirus A
gcgacucagugacc

SEQ ID NO: 1534716 - RNA, 14 nt, Human adenovirus A
aggauguugggccc

SEQ ID NO: 1534717 - RNA, 23 nt, Human adenovirus A
cucuuacgaaaccgugauggcag

SEQ ID NO: 1534718 - RNA, 17 nt, Human adenovirus A
cuuuaauaaaaacacug

SEQ ID NO: 1534719 - RNA, 14 nt, Human adenovirus A
ccuaucuguugcua

SEQ ID NO: 1534720 - RNA, 15 nt, Human adenovirus A
aauguguuccaguau

SEQ ID NO: 1534721 - RNA, 21 nt, Human adenovirus A
auuugcugaaaaaagucugga

SEQ ID NO: 1534722 - RNA, 15 nt, Human adenovirus A
agguggcuggacugc

SEQ ID NO: 1534723 - RNA, 14 nt, Human adenovirus A
cuaauagaacugga

SEQ ID NO: 1534724 - RNA, 21 nt, Human adenovirus A
gaucuagaaauugauggaaga

SEQ ID NO: 1534725 - RNA, 17 nt, Human adenovirus A
ugcauguccagauuuca

SEQ ID NO: 1534726 - RNA, 15 nt, Human adenovirus A
gguggacaacaaguc

SEQ ID NO: 1534727 - RNA, 19 nt, Human adenovirus A
agccaaaccggccagaugc

SEQ ID NO: 1534728 - RNA, 17 nt, Human adenovirus A
cuagucccauuacagua

SEQ ID NO: 1534729 - RNA, 19 nt, Human adenovirus A
caggaagagccucaauguc

SEQ ID NO: 1534730 - RNA, 22 nt, Human adenovirus A
gauacuaccgcugcucagcucc

SEQ ID NO: 1534731 - RNA, 20 nt, Human adenovirus A
agcaauuacuugaacaacuu

SEQ ID NO: 1534732 - RNA, 12 nt, Human adenovirus A
gcguacagccag

SEQ ID NO: 1534733 - RNA, 21 nt, Human adenovirus A
caaacaacgaaggccaaacca

SEQ ID NO: 1534734 - RNA, 18 nt, Human adenovirus A
gaaagaucacagccagau

SEQ ID NO: 1534735 - RNA, 18 nt, Human adenovirus A
gucaggcgugcgcagucu

SEQ ID NO: 1534736 - RNA, 23 nt, Human adenovirus A
aagcgcgacuaguccguuuucuu

SEQ ID NO: 1534737 - RNA, 16 nt, Human adenovirus A
auggagugucacugcc

SEQ ID NO: 1534738 - RNA, 23 nt, Human adenovirus A
gccuucaaaacguguaccugccu

SEQ ID NO: 1534739 - RNA, 14 nt, Human adenovirus A
aaccacggccucag

SEQ ID NO: 1534740 - RNA, 15 nt, Human adenovirus A
aagauacuaccuacu

SEQ ID NO: 1534741 - RNA, 21 nt, Human adenovirus A
cuaaaacaaggucuagccaac

SEQ ID NO: 1534742 - RNA, 23 nt, Human adenovirus A
ggagggacaagcuuaccccgcca

SEQ ID NO: 1534743 - RNA, 12 nt, Human adenovirus A
guuuccagugcg

SEQ ID NO: 1534744 - RNA, 16 nt, Human adenovirus A
cuuuggaggcagcugg

SEQ ID NO: 1534745 - RNA, 18 nt, Human adenovirus A
guagacauuguuggccug

SEQ ID NO: 1534746 - RNA, 17 nt, Human adenovirus A
uguaaagauuugaaauu

SEQ ID NO: 1534747 - RNA, 19 nt, Human adenovirus A
acucuacuaacaacuccag

SEQ ID NO: 1534748 - RNA, 17 nt, Human adenovirus A
ugcaagaggagaaggag

SEQ ID NO: 1534749 - RNA, 14 nt, Human adenovirus A
uuugaccggucagg

SEQ ID NO: 1534750 - RNA, 14 nt, Human adenovirus A
aaaacaaguuuccc

SEQ ID NO: 1534751 - RNA, 14 nt, Human adenovirus A
caaaaaguaacaac

SEQ ID NO: 1534752 - RNA, 21 nt, Human adenovirus A
ggucuuaaaaauuuugguucc

SEQ ID NO: 1534753 - RNA, 12 nt, Human adenovirus A
cacagcuuccag

SEQ ID NO: 1534754 - RNA, 17 nt, Human adenovirus A
agccauggcgaccagug

SEQ ID NO: 1534755 - RNA, 17 nt, Human adenovirus A
caagcgugcaaacagac

SEQ ID NO: 1534756 - RNA, 18 nt, Human adenovirus A
guaccgccugaagaagaa

SEQ ID NO: 1534757 - RNA, 14 nt, Human adenovirus A
aacccggccaagga

SEQ ID NO: 1534758 - RNA, 15 nt, Human adenovirus A
gauuguguccuugga

SEQ ID NO: 1534759 - RNA, 18 nt, Human adenovirus A
cuacuacgugagaauugu

SEQ ID NO: 1534760 - RNA, 11 nt, Human adenovirus A
uagucauauag

SEQ ID NO: 1534761 - RNA, 13 nt, Human adenovirus A
acaacaauuugca

SEQ ID NO: 1534762 - RNA, 17 nt, Human adenovirus A
gcgucagcucguugaug

SEQ ID NO: 1534763 - RNA, 15 nt, Human adenovirus A
uuacaacuugcuucc

SEQ ID NO: 1534764 - RNA, 15 nt, Human adenovirus A
augcuaugcaggcag

SEQ ID NO: 1534765 - RNA, 17 nt, Human adenovirus A
uuaauaauaaaaccauu

SEQ ID NO: 1534766 - RNA, 23 nt, Human adenovirus A
uuuucuagaacaaaaaggaggaa

SEQ ID NO: 1534767 - RNA, 18 nt, Human adenovirus A
agcuggguugguguugcu

SEQ ID NO: 1534768 - RNA, 14 nt, Human adenovirus A
gauagcaagcguaa

SEQ ID NO: 1534769 - RNA, 22 nt, Human adenovirus A
acaggcggguaagagcaggcug

SEQ ID NO: 1534770 - RNA, 22 nt, Human adenovirus A
ccuaucuguugcuacugcagac

SEQ ID NO: 1534771 - RNA, 17 nt, Human adenovirus A
cuaccaccuaagaaggc

SEQ ID NO: 1534772 - RNA, 17 nt, Human adenovirus A
aauucuggaauaacaag

SEQ ID NO: 1534773 - RNA, 18 nt, Human adenovirus A
cugagacgaagaaauaca

SEQ ID NO: 1534774 - RNA, 18 nt, Human adenovirus A
caucgccggucaggaugc

SEQ ID NO: 1534775 - RNA, 13 nt, Human adenovirus A
cugccgcugcaau

SEQ ID NO: 1534776 - RNA, 14 nt, Human adenovirus A
uaagaaccaagcau

SEQ ID NO: 1534777 - RNA, 17 nt, Human adenovirus A
guaaaccuugaaaugcc

SEQ ID NO: 1534778 - RNA, 17 nt, Human adenovirus A
cccugucaacagcauug

SEQ ID NO: 1534779 - RNA, 19 nt, Human adenovirus A
gaggugcucccgcagugag

SEQ ID NO: 1534780 - RNA, 13 nt, Human adenovirus A
ucuaccaaggaaa

SEQ ID NO: 1534781 - RNA, 12 nt, Human adenovirus A
guuucuucuaaa

SEQ ID NO: 1534782 - RNA, 21 nt, Human adenovirus A
accuucuggcuuguaugcuca

SEQ ID NO: 1534783 - RNA, 19 nt, Human adenovirus A
guauuauuugaacacacug

SEQ ID NO: 1534784 - RNA, 23 nt, Human adenovirus A
uaaagcgcagaguauccacacag

SEQ ID NO: 1534785 - RNA, 12 nt, Human adenovirus A
uaccaugaugga

SEQ ID NO: 1534786 - RNA, 11 nt, Human adenovirus A
ggcugaagagg

SEQ ID NO: 1534787 - RNA, 17 nt, Human adenovirus A
cugcuagaacaagccgc

SEQ ID NO: 1534788 - RNA, 14 nt, Human adenovirus A
aaaugggaaaugag

SEQ ID NO: 1534789 - RNA, 14 nt, Human adenovirus A
gcgucccaaaagca

SEQ ID NO: 1534790 - RNA, 14 nt, Human adenovirus A
acugcauuggguga

SEQ ID NO: 1534791 - RNA, 13 nt, Human adenovirus A
gguuuaauguuua

SEQ ID NO: 1534792 - RNA, 18 nt, Human adenovirus A
cuggccagugugcgcuuu

SEQ ID NO: 1534793 - RNA, 16 nt, Human adenovirus A
cgacucauaagcugug

SEQ ID NO: 1534794 - RNA, 15 nt, Human adenovirus A
gacucggcauaauac

SEQ ID NO: 1534795 - RNA, 23 nt, Human adenovirus A
agcccaacccauugacaaagaug

SEQ ID NO: 1534796 - RNA, 20 nt, Human adenovirus A
agguuuuuugggaugaaaaa

SEQ ID NO: 1534797 - RNA, 15 nt, Human adenovirus A
acuaccuagcuuacc

SEQ ID NO: 1534798 - RNA, 19 nt, Human adenovirus A
ugcgguuccagaaggagua

SEQ ID NO: 1534799 - RNA, 12 nt, Human adenovirus A
aacauuaaaaga

SEQ ID NO: 1534800 - RNA, 15 nt, Human adenovirus A
guauucauauaugua

SEQ ID NO: 1534801 - RNA, 17 nt, Human adenovirus A
aggugcaagaaggccau

SEQ ID NO: 1534802 - RNA, 13 nt, Human adenovirus A
uccagaggaggag

SEQ ID NO: 1534803 - RNA, 23 nt, Human adenovirus A
uggccauaauguaacccuucccc

SEQ ID NO: 1534804 - RNA, 21 nt, Human adenovirus A
gcgacaaagagcuuaugcaua

SEQ ID NO: 1534805 - RNA, 14 nt, Human adenovirus A
ucaacccaaacugu

SEQ ID NO: 1534806 - RNA, 17 nt, Human adenovirus A
agagcacacugggaaau

SEQ ID NO: 1534807 - RNA, 12 nt, Human adenovirus A
aaugaacaaaau

SEQ ID NO: 1534808 - RNA, 16 nt, Human adenovirus A
uaaagauuugaaauuu

SEQ ID NO: 1534809 - RNA, 20 nt, Human adenovirus A
gcucgcugguccccagaugu

SEQ ID NO: 1534810 - RNA, 18 nt, Human adenovirus A
agcucauuggaguacaag

SEQ ID NO: 1534811 - RNA, 20 nt, Human adenovirus A
ccacugcgucaguaacaaac

SEQ ID NO: 1534812 - RNA, 19 nt, Human adenovirus A
gggccaggaggacacuggc

SEQ ID NO: 1534813 - RNA, 19 nt, Human adenovirus A
gcuuagauggagguggaaa

SEQ ID NO: 1534814 - RNA, 18 nt, Human adenovirus A
caguggacaaaaacuaug

SEQ ID NO: 1534815 - RNA, 23 nt, Human adenovirus A
ccauccgugcguuaccacccuag

SEQ ID NO: 1534816 - RNA, 14 nt, Human adenovirus A
gguucucuuucaac

SEQ ID NO: 1534817 - RNA, 19 nt, Human adenovirus A
cuagccaacauccagugcg

SEQ ID NO: 1534818 - RNA, 20 nt, Human adenovirus A
gcuaauugcccccuuuacca

SEQ ID NO: 1534819 - RNA, 16 nt, Human adenovirus A
aucaaggaaauacuau

SEQ ID NO: 1534820 - RNA, 16 nt, Human adenovirus A
gugccuccccgcuauu

SEQ ID NO: 1534821 - RNA, 21 nt, Human adenovirus A
gcucgcagcgucugacgcugc

SEQ ID NO: 1534822 - RNA, 15 nt, Human adenovirus A
gaacggacaguagcu

SEQ ID NO: 1534823 - RNA, 14 nt, Human adenovirus A
acucaucagaggga

SEQ ID NO: 1534824 - RNA, 22 nt, Human adenovirus A
ccuacuuacuggggugccuaau

SEQ ID NO: 1534825 - RNA, 17 nt, Human adenovirus A
auauuaaaaagcucugu

SEQ ID NO: 1534826 - RNA, 20 nt, Human adenovirus A
aggcuuucuucaaauccaaa

SEQ ID NO: 1534827 - RNA, 13 nt, Human adenovirus A
guacucaucagag

SEQ ID NO: 1534828 - RNA, 21 nt, Human adenovirus A
cuuaguaacagcauaugaaca

SEQ ID NO: 1534829 - RNA, 22 nt, Human adenovirus A
agugaccgggacgcgugugcca

SEQ ID NO: 1534830 - RNA, 21 nt, Human adenovirus A
ugcagguaauacuuaauuucu

SEQ ID NO: 1534831 - RNA, 19 nt, Human adenovirus A
cagcggggaggaagcugag

SEQ ID NO: 1534832 - RNA, 20 nt, Human adenovirus A
ggaucaaaaacaaguuuccc

SEQ ID NO: 1534833 - RNA, 20 nt, Human adenovirus A
cauaggcaugugguccaggg

SEQ ID NO: 1534834 - RNA, 23 nt, Human adenovirus A
gaaaguuguagauggucuggcuu

SEQ ID NO: 1534835 - RNA, 13 nt, Human adenovirus A
caaccaaaggaga

SEQ ID NO: 1534836 - RNA, 15 nt, Human adenovirus A
gacgggccaggcgca

SEQ ID NO: 1534837 - RNA, 18 nt, Human adenovirus A
uacaaaugcuuagucauu

SEQ ID NO: 1534838 - RNA, 16 nt, Human adenovirus A
gcuucacaauggucag

SEQ ID NO: 1534839 - RNA, 22 nt, Human adenovirus A
ucauugguaccuucgaaaugca

SEQ ID NO: 1534840 - RNA, 17 nt, Human adenovirus A
gcuaacgccaccagcgu

SEQ ID NO: 1534841 - RNA, 13 nt, Human adenovirus A
gucgcaccacugu

SEQ ID NO: 1534842 - RNA, 18 nt, Human adenovirus A
gauauaguacugcuucca

SEQ ID NO: 1534843 - RNA, 23 nt, Human adenovirus A
cgacaaaaauuuucccaacaaug

SEQ ID NO: 1534844 - RNA, 20 nt, Human adenovirus A
gcguacaguuuuggagccaa

SEQ ID NO: 1534845 - RNA, 14 nt, Human adenovirus A
uggauagcaaagcc

SEQ ID NO: 1534846 - RNA, 18 nt, Human adenovirus A
cuguaucccaucccagcu

SEQ ID NO: 1534847 - RNA, 16 nt, Human adenovirus A
gccaacaaaaaccccu

SEQ ID NO: 1534848 - RNA, 22 nt, Human adenovirus A
acgaggguuuuguccuuccagg

SEQ ID NO: 1534849 - RNA, 23 nt, Human adenovirus A
ccuugcuugacucucgggcgagu

SEQ ID NO: 1534850 - RNA, 13 nt, Human adenovirus A
gugaguuggccug

SEQ ID NO: 1534851 - RNA, 21 nt, Human adenovirus A
guugcaagcgaucccauagcu

SEQ ID NO: 1534852 - RNA, 13 nt, Human adenovirus A
aaagccaaauggu

SEQ ID NO: 1534853 - RNA, 15 nt, Human adenovirus A
cagacaguggcuuuu

SEQ ID NO: 1534854 - RNA, 12 nt, Human adenovirus A
agucagcugcaa

SEQ ID NO: 1534855 - RNA, 22 nt, Human adenovirus A
cagucgcguggcauuugugccu

SEQ ID NO: 1534856 - RNA, 20 nt, Human adenovirus A
uaugcgcuguaccauacauu

SEQ ID NO: 1534857 - RNA, 15 nt, Human adenovirus A
caagaggaagaaaga

SEQ ID NO: 1534858 - RNA, 13 nt, Human adenovirus A
cacauacaucacc

SEQ ID NO: 1534859 - RNA, 17 nt, Human adenovirus A
gcuuaguauuugucucc

SEQ ID NO: 1534860 - RNA, 18 nt, Human adenovirus A
caaaacucacccugugcu

SEQ ID NO: 1534861 - RNA, 21 nt, Human adenovirus A
cacaacacauacauacacuca

SEQ ID NO: 1534862 - RNA, 16 nt, Human adenovirus A
uaaaacuaccugauaa

SEQ ID NO: 1534863 - RNA, 15 nt, Human adenovirus A
cuuguuaauguuugu

SEQ ID NO: 1534864 - RNA, 14 nt, Human adenovirus A
gcacugggccagga

SEQ ID NO: 1534865 - RNA, 15 nt, Human adenovirus A
cuuuaagggcuggcg

SEQ ID NO: 1534866 - RNA, 16 nt, Human adenovirus A
aggugcuucccacaua

SEQ ID NO: 1534867 - RNA, 16 nt, Human adenovirus A
cacacuuaacacaaga

SEQ ID NO: 1534868 - RNA, 19 nt, Human adenovirus A
guucucacgacacgucaca

SEQ ID NO: 1534869 - RNA, 12 nt, Human adenovirus A
gaccccaaggca

SEQ ID NO: 1534870 - RNA, 19 nt, Human adenovirus A
cagaauauaagaacuacaa

SEQ ID NO: 1534871 - RNA, 22 nt, Human adenovirus A
auguaaaggaggcgcuggcuca

SEQ ID NO: 1534872 - RNA, 16 nt, Human adenovirus A
aacgaaaaugugccua

SEQ ID NO: 1534873 - RNA, 17 nt, Human adenovirus A
aacuaccugauaacaag

SEQ ID NO: 1534874 - RNA, 15 nt, Human adenovirus A
uugccuacccggcag

SEQ ID NO: 1534875 - RNA, 21 nt, Human adenovirus A
auaaguuuaaaggcauuaugu

SEQ ID NO: 1534876 - RNA, 13 nt, Human adenovirus A
uggaggcagcugg

SEQ ID NO: 1534877 - RNA, 20 nt, Human adenovirus A
auaacuaacuuuaauguuuc

SEQ ID NO: 1534878 - RNA, 18 nt, Human adenovirus A
gcaaccacggccucagca

SEQ ID NO: 1534879 - RNA, 16 nt, Human adenovirus A
uauaagaaagaggcag

SEQ ID NO: 1534880 - RNA, 22 nt, Human adenovirus A
guucacaauuuucugguggugg

SEQ ID NO: 1534881 - RNA, 13 nt, Human adenovirus A
gacgggccaggcg

SEQ ID NO: 1534882 - RNA, 20 nt, Human adenovirus A
aauccaaggaugacaacauu

SEQ ID NO: 1534883 - RNA, 22 nt, Human adenovirus A
cacugggccaggaggacacugg

SEQ ID NO: 1534884 - RNA, 15 nt, Human adenovirus A
ucuuuugcagcucca

SEQ ID NO: 1534885 - RNA, 20 nt, Human adenovirus A
uucgauaauggggucaugaa

SEQ ID NO: 1534886 - RNA, 18 nt, Human adenovirus A
caucucaccacugaaacu

SEQ ID NO: 1534887 - RNA, 19 nt, Human adenovirus A
ugcagccuacaaugcaacu

SEQ ID NO: 1534888 - RNA, 17 nt, Human adenovirus A
uaaaacagaaccucuua

SEQ ID NO: 1534889 - RNA, 18 nt, Human adenovirus A
aucggcaacagcagcaac

SEQ ID NO: 1534890 - RNA, 17 nt, Human adenovirus A
cauuaucaugaaacucu

SEQ ID NO: 1534891 - RNA, 22 nt, Human adenovirus A
aaguuguggauaccacagaaua

SEQ ID NO: 1534892 - RNA, 19 nt, Human adenovirus A
caaaugcuuagucauuaca

SEQ ID NO: 1534893 - RNA, 15 nt, Human adenovirus A
gcagguggcagcgau

SEQ ID NO: 1534894 - RNA, 18 nt, Human adenovirus A
uaaccauuguaaaugcuu

SEQ ID NO: 1534895 - RNA, 15 nt, Human adenovirus A
gagguauuccuccuu

SEQ ID NO: 1534896 - RNA, 23 nt, Human adenovirus A
aacaugcuuuagguuagccugaa

SEQ ID NO: 1534897 - RNA, 17 nt, Human adenovirus A
cugaaacaaauauuuac

SEQ ID NO: 1534898 - RNA, 11 nt, Human adenovirus A
ccaugagcccg

SEQ ID NO: 1534899 - RNA, 15 nt, Human adenovirus A
gcucaaagaaacagc

SEQ ID NO: 1534900 - RNA, 12 nt, Human adenovirus A
agcaagcggcac

SEQ ID NO: 1534901 - RNA, 14 nt, Human adenovirus A
uagcguccacacag

SEQ ID NO: 1534902 - RNA, 15 nt, Human adenovirus A
cuaaacaaacuguua

SEQ ID NO: 1534903 - RNA, 19 nt, Human adenovirus A
augaaguuuugauuguauu

SEQ ID NO: 1534904 - RNA, 16 nt, Human adenovirus A
gugccacccccagugc

SEQ ID NO: 1534905 - RNA, 17 nt, Human adenovirus A
acaagcacgccaaagcc

SEQ ID NO: 1534906 - RNA, 17 nt, Human adenovirus A
cucgccuggacacuauc

SEQ ID NO: 1534907 - RNA, 22 nt, Human adenovirus A
uuacaagcacgccaaagccaca

SEQ ID NO: 1534908 - RNA, 12 nt, Human adenovirus A
uacaaagccagg

SEQ ID NO: 1534909 - RNA, 15 nt, Human adenovirus A
caucucauaaucagu

SEQ ID NO: 1534910 - RNA, 17 nt, Human adenovirus A
acauuccagagagcuac

SEQ ID NO: 1534911 - RNA, 14 nt, Human adenovirus A
gcaucgacagugag

SEQ ID NO: 1534912 - RNA, 13 nt, Human adenovirus A
agaaacagcagca

SEQ ID NO: 1534913 - RNA, 12 nt, Human adenovirus A
cgcugcagcuuc

SEQ ID NO: 1534914 - RNA, 18 nt, Human adenovirus A
gcccuauccgucuccagc

SEQ ID NO: 1534915 - RNA, 15 nt, Human adenovirus A
auguccuacauugga

SEQ ID NO: 1534916 - RNA, 21 nt, Human adenovirus A
aaaaugcguuuaguccaauuu

SEQ ID NO: 1534917 - RNA, 12 nt, Human adenovirus A
gcguggucagga

SEQ ID NO: 1534918 - RNA, 19 nt, Human adenovirus A
acauucaaauuccugugca

SEQ ID NO: 1534919 - RNA, 15 nt, Human adenovirus A
agacuauagagagga

SEQ ID NO: 1534920 - RNA, 16 nt, Human adenovirus A
uuaaaauuccauaauu

SEQ ID NO: 1534921 - RNA, 16 nt, Human adenovirus A
auuaacuuugaugaaa

SEQ ID NO: 1534922 - RNA, 16 nt, Human adenovirus A
uguggcaccugcaaau

SEQ ID NO: 1534923 - RNA, 14 nt, Human adenovirus A
caugucaaugcagc

SEQ ID NO: 1534924 - RNA, 14 nt, Human adenovirus A
uuaauguuucaggu

SEQ ID NO: 1534925 - RNA, 12 nt, Human adenovirus A
auuugaaugcgu

SEQ ID NO: 1534926 - RNA, 16 nt, Human adenovirus A
ugcuuagucauuacaa

SEQ ID NO: 1534927 - RNA, 18 nt, Human adenovirus A
uaauuuuagauguuaauu

SEQ ID NO: 1534928 - RNA, 20 nt, Human adenovirus A
acuuucuccaaaucuuaaau

SEQ ID NO: 1534929 - RNA, 16 nt, Human adenovirus A
gcgcugacgggagcag

SEQ ID NO: 1534930 - RNA, 20 nt, Human adenovirus A
ccuacccuucuuuauguuuu

SEQ ID NO: 1534931 - RNA, 15 nt, Human adenovirus A
uuuaccaggcaaaga

SEQ ID NO: 1534932 - RNA, 16 nt, Human adenovirus A
acaugguaagcucuug

SEQ ID NO: 1534933 - RNA, 15 nt, Human adenovirus A
uucaaacuuuacaaa

SEQ ID NO: 1534934 - RNA, 17 nt, Human adenovirus A
cagcgacaaagcacuau

SEQ ID NO: 1534935 - RNA, 15 nt, Human adenovirus A
ccugcuuucagcacu

SEQ ID NO: 1534936 - RNA, 16 nt, Human adenovirus A
ucacaaggucuuaaac

SEQ ID NO: 1534937 - RNA, 13 nt, Human adenovirus A
uaacaacaagcua

SEQ ID NO: 1534938 - RNA, 22 nt, Human adenovirus A
ccucguacaggaauucugacca

SEQ ID NO: 1534939 - RNA, 20 nt, Human adenovirus A
cagauguaacaggcggcucc

SEQ ID NO: 1534940 - RNA, 14 nt, Human adenovirus A
acuuaaaaaaggac

SEQ ID NO: 1534941 - RNA, 17 nt, Human adenovirus A
uaaccuguccuuaagac

SEQ ID NO: 1534942 - RNA, 13 nt, Human adenovirus A
ccgcgagcagcgg

SEQ ID NO: 1534943 - RNA, 20 nt, Human adenovirus A
gcaacagcagcaacaaggaa

SEQ ID NO: 1534944 - RNA, 22 nt, Human adenovirus A
agacuucccacagccagugggu

SEQ ID NO: 1534945 - RNA, 18 nt, Human adenovirus A
aggagguuuguaagcggu

SEQ ID NO: 1534946 - RNA, 19 nt, Human adenovirus A
cgagcucccggaggaagcg

SEQ ID NO: 1534947 - RNA, 23 nt, Human adenovirus A
caaauggacgaggguuuuguccu

SEQ ID NO: 1534948 - RNA, 21 nt, Human adenovirus A
gacauccaugugaugccggca

SEQ ID NO: 1534949 - RNA, 14 nt, Human adenovirus A
aacuaacuuuaaug

SEQ ID NO: 1534950 - RNA, 14 nt, Human adenovirus A
gucuguugccaauc

SEQ ID NO: 1534951 - RNA, 21 nt, Human adenovirus A
uaaagcgcagaguauccacac

SEQ ID NO: 1534952 - RNA, 19 nt, Human adenovirus A
ccagugcuuucaacaaaaa

SEQ ID NO: 1534953 - RNA, 22 nt, Human adenovirus A
ccaaaguucgccuacacaacac

SEQ ID NO: 1534954 - RNA, 11 nt, Human adenovirus A
caaugggagau

SEQ ID NO: 1534955 - RNA, 21 nt, Human adenovirus A
uguccuuggaagaggugccua

SEQ ID NO: 1534956 - RNA, 21 nt, Human adenovirus A
ucuucccaacugucaaaccug

SEQ ID NO: 1534957 - RNA, 16 nt, Human adenovirus A
agcggccacuaaagac

SEQ ID NO: 1534958 - RNA, 17 nt, Human adenovirus A
cuugcuuccagacaaaa

SEQ ID NO: 1534959 - RNA, 15 nt, Human adenovirus A
cguaaaaucuacaaa

SEQ ID NO: 1534960 - RNA, 20 nt, Human adenovirus A
gcuggccccgcgacacggca

SEQ ID NO: 1534961 - RNA, 13 nt, Human adenovirus A
aacagcuauugca

SEQ ID NO: 1534962 - RNA, 20 nt, Human adenovirus A
gcuggcgggagggcauuaaa

SEQ ID NO: 1534963 - RNA, 23 nt, Human adenovirus A
accguucccuaucauuaagaaca

SEQ ID NO: 1534964 - RNA, 18 nt, Human adenovirus A
gcaccuuuaauacugaaa

SEQ ID NO: 1534965 - RNA, 22 nt, Human adenovirus A
guaaacaugauucuucagagca

SEQ ID NO: 1534966 - RNA, 18 nt, Human adenovirus A
cuuucucugugacaaaaa

SEQ ID NO: 1534967 - RNA, 12 nt, Human adenovirus A
cuccaucuguuu

SEQ ID NO: 1534968 - RNA, 18 nt, Human adenovirus A
cauaauacgguguucuca

SEQ ID NO: 1534969 - RNA, 19 nt, Human adenovirus A
cuccugagcgucacccaag

SEQ ID NO: 1534970 - RNA, 14 nt, Human adenovirus A
agacaaagagugac

SEQ ID NO: 1534971 - RNA, 15 nt, Human adenovirus A
uucuuuacaacugua

SEQ ID NO: 1534972 - RNA, 22 nt, Human adenovirus A
gaauucgcaggcggucugccau

SEQ ID NO: 1534973 - RNA, 21 nt, Human adenovirus A
cgccaaguaacaacacgggcu

SEQ ID NO: 1534974 - RNA, 18 nt, Human adenovirus A
ccuucaauuggaacagua

SEQ ID NO: 1534975 - RNA, 19 nt, Human adenovirus A
gcgacagaguugcuuuuag

SEQ ID NO: 1534976 - RNA, 18 nt, Human adenovirus A
ugggcuuuggacuucugc

SEQ ID NO: 1534977 - RNA, 20 nt, Human adenovirus A
cucaaagaaacagcagcaac

SEQ ID NO: 1534978 - RNA, 22 nt, Human adenovirus A
agcggcaagaacaauuucauca

SEQ ID NO: 1534979 - RNA, 14 nt, Human adenovirus A
aagaccaauccaaa

SEQ ID NO: 1534980 - RNA, 14 nt, Human adenovirus A
acaggaaagcuuaa

SEQ ID NO: 1534981 - RNA, 14 nt, Human adenovirus A
gacgagcucccgga

SEQ ID NO: 1534982 - RNA, 22 nt, Human adenovirus A
gcggcgagaaugggaggaaaga

SEQ ID NO: 1534983 - RNA, 20 nt, Human adenovirus A
auacuaaauaucgcagcugg

SEQ ID NO: 1534984 - RNA, 18 nt, Human adenovirus A
uccuccauuacuaccguc

SEQ ID NO: 1534985 - RNA, 14 nt, Human adenovirus A
aaauauccaaagua

SEQ ID NO: 1534986 - RNA, 15 nt, Human adenovirus A
cauucuuccacuguu

SEQ ID NO: 1534987 - RNA, 17 nt, Human adenovirus A
uacaugggcaccuggaa

SEQ ID NO: 1534988 - RNA, 16 nt, Human adenovirus A
aaauuucccucuuccc

SEQ ID NO: 1534989 - RNA, 13 nt, Human adenovirus A
cuguaaaauuucu

SEQ ID NO: 1534990 - RNA, 16 nt, Human adenovirus A
ucagauccuuagauuu

SEQ ID NO: 1534991 - RNA, 23 nt, Human adenovirus A
ugucaacuacauaaaccauggaa

SEQ ID NO: 1534992 - RNA, 22 nt, Human adenovirus A
uaauaaagcuaaaucugccacu

SEQ ID NO: 1534993 - RNA, 15 nt, Human adenovirus A
aacuuaucagccaga

SEQ ID NO: 1534994 - RNA, 19 nt, Human adenovirus A
ccccgaggaauuugaaggc

SEQ ID NO: 1534995 - RNA, 18 nt, Human adenovirus A
guacaaauuuuuccaccu

SEQ ID NO: 1534996 - RNA, 12 nt, Human adenovirus A
cguuuggaaacu

SEQ ID NO: 1534997 - RNA, 19 nt, Human adenovirus A
cucgcgcuuuggaggcagc

SEQ ID NO: 1534998 - RNA, 18 nt, Human adenovirus A
gcgagcgacugcugcgug

SEQ ID NO: 1534999 - RNA, 21 nt, Human adenovirus A
cuuuaacggcgcgcaguccug

SEQ ID NO: 1535000 - RNA, 14 nt, Human adenovirus A
cuccccuguggagc

SEQ ID NO: 1535001 - RNA, 12 nt, Human adenovirus A
uuuauuggccug

SEQ ID NO: 1535002 - RNA, 11 nt, Human adenovirus A
caguauuuugu

SEQ ID NO: 1535003 - RNA, 16 nt, Human adenovirus A
gcuuucgggcucuggc

SEQ ID NO: 1535004 - RNA, 15 nt, Human adenovirus A
augaugccgcagugg

SEQ ID NO: 1535005 - RNA, 21 nt, Human adenovirus A
gcuuauguacauaauccagca

SEQ ID NO: 1535006 - RNA, 13 nt, Human adenovirus A
cuguaaaaaagug

SEQ ID NO: 1535007 - RNA, 14 nt, Human adenovirus A
gcggcgucagcaga

SEQ ID NO: 1535008 - RNA, 19 nt, Human adenovirus A
aggaaaugcgagacugcag

SEQ ID NO: 1535009 - RNA, 13 nt, Human adenovirus A
gacauccauguga

SEQ ID NO: 1535010 - RNA, 17 nt, Human adenovirus A
gaacggagagggugacg

SEQ ID NO: 1535011 - RNA, 16 nt, Human adenovirus A
cgacgggccaggcgca

SEQ ID NO: 1535012 - RNA, 13 nt, Human adenovirus A
uacaaaggcauua

SEQ ID NO: 1535013 - RNA, 17 nt, Human adenovirus A
cugugacaaaaagacug

SEQ ID NO: 1535014 - RNA, 13 nt, Human adenovirus A
gagaacuaaacaa

SEQ ID NO: 1535015 - RNA, 20 nt, Human adenovirus A
cgcugacgggagcaggaaca

SEQ ID NO: 1535016 - RNA, 16 nt, Human adenovirus A
ccaauaaagaaaaaac

SEQ ID NO: 1535017 - RNA, 22 nt, Human adenovirus A
acugggauggguguuuggcagc

SEQ ID NO: 1535018 - RNA, 13 nt, Human adenovirus A
aaugcaaaaugga

SEQ ID NO: 1535019 - RNA, 18 nt, Human adenovirus A
gacgggagcaggaacaga

SEQ ID NO: 1535020 - RNA, 22 nt, Human adenovirus A
gccagcaagugccuccucagua

SEQ ID NO: 1535021 - RNA, 15 nt, Human adenovirus A
gaggcagcuggagug

SEQ ID NO: 1535022 - RNA, 15 nt, Human adenovirus A
cagucaccaccagcg

SEQ ID NO: 1535023 - RNA, 12 nt, Human adenovirus A
cuaaauauugua

SEQ ID NO: 1535024 - RNA, 17 nt, Human adenovirus A
cagacaccgcccaggca

SEQ ID NO: 1535025 - RNA, 12 nt, Human adenovirus A
uuaagaaaucuu

SEQ ID NO: 1535026 - RNA, 14 nt, Human adenovirus A
auuuaaggccaggg

SEQ ID NO: 1535027 - RNA, 19 nt, Human adenovirus A
caccaaacugcagccucau

SEQ ID NO: 1535028 - RNA, 12 nt, Human adenovirus A
gcgccaccugcc

SEQ ID NO: 1535029 - RNA, 21 nt, Human adenovirus A
guuuuggcggccaugcaaagc

SEQ ID NO: 1535030 - RNA, 21 nt, Human adenovirus A
agaaggaaaggcauggaaaaa

SEQ ID NO: 1535031 - RNA, 19 nt, Human adenovirus A
aggaggacuuugagccaga

SEQ ID NO: 1535032 - RNA, 14 nt, Human adenovirus A
gcaccccuucccac

SEQ ID NO: 1535033 - RNA, 23 nt, Human adenovirus A
uuaacuaagugguugggaacaga

SEQ ID NO: 1535034 - RNA, 17 nt, Human adenovirus A
gaacaauaaaaaaaaca

SEQ ID NO: 1535035 - RNA, 22 nt, Human adenovirus A
cagguaauacuuaauuucuaga

SEQ ID NO: 1535036 - RNA, 18 nt, Human adenovirus A
acuaacaaugcuuuccau

SEQ ID NO: 1535037 - RNA, 14 nt, Human adenovirus A
guguacacaaugca

SEQ ID NO: 1535038 - RNA, 20 nt, Human adenovirus A
uuucgguugaagugucuugu

SEQ ID NO: 1535039 - RNA, 17 nt, Human adenovirus A
gcuauuguuaacacugc

SEQ ID NO: 1535040 - RNA, 20 nt, Human adenovirus A
gcuaugagcacaagugaggc

SEQ ID NO: 1535041 - RNA, 17 nt, Human adenovirus A
gccauuuuggaagcagu

SEQ ID NO: 1535042 - RNA, 11 nt, Human adenovirus A
cgucacuuuga

SEQ ID NO: 1535043 - RNA, 14 nt, Human adenovirus A
aucgcaagcaggcg

SEQ ID NO: 1535044 - RNA, 14 nt, Human adenovirus A
agaugagccuguau

SEQ ID NO: 1535045 - RNA, 12 nt, Human adenovirus A
cuacaggcaggg

SEQ ID NO: 1535046 - RNA, 17 nt, Human adenovirus A
agaaaucccaccugagu

SEQ ID NO: 1535047 - RNA, 21 nt, Human adenovirus A
gccgucaaaauuuucucccca

SEQ ID NO: 1535048 - RNA, 17 nt, Human adenovirus A
acuuuucaaacuuuaca

SEQ ID NO: 1535049 - RNA, 21 nt, Human adenovirus A
ugucuguugccaauccucuga

SEQ ID NO: 1535050 - RNA, 23 nt, Human adenovirus A
uuuagagggcgaacaguguuuuc

SEQ ID NO: 1535051 - RNA, 13 nt, Human adenovirus A
cugauuuucacau

SEQ ID NO: 1535052 - RNA, 17 nt, Human adenovirus A
ccuuacagaucacggga

SEQ ID NO: 1535053 - RNA, 18 nt, Human adenovirus A
guaauuuuuuucuccuuu

SEQ ID NO: 1535054 - RNA, 19 nt, Human adenovirus A
cuaacgcuggggcacagcu

SEQ ID NO: 1535055 - RNA, 20 nt, Human adenovirus A
caaagguaaugagcgcagug

SEQ ID NO: 1535056 - RNA, 14 nt, Human adenovirus A
auaacacagcuucu

SEQ ID NO: 1535057 - RNA, 13 nt, Human adenovirus A
aggagcagaaauc

SEQ ID NO: 1535058 - RNA, 13 nt, Human adenovirus A
ccgaaagaccacu

SEQ ID NO: 1535059 - RNA, 16 nt, Human adenovirus A
aacacgguacuuuucc

SEQ ID NO: 1535060 - RNA, 12 nt, Human adenovirus A
cccaacccuucc

SEQ ID NO: 1535061 - RNA, 14 nt, Human adenovirus A
ccccuguggagcca

SEQ ID NO: 1535062 - RNA, 18 nt, Human adenovirus A
cauuugcgcccagacgua

SEQ ID NO: 1535063 - RNA, 18 nt, Human adenovirus A
ucuaacugcucagcugga

SEQ ID NO: 1535064 - RNA, 20 nt, Human adenovirus A
uauucgcgugccaggcauuu

SEQ ID NO: 1535065 - RNA, 16 nt, Human adenovirus A
ugcagccuuucuuaaa

SEQ ID NO: 1535066 - RNA, 13 nt, Human adenovirus A
auuugaacacacu

SEQ ID NO: 1535067 - RNA, 13 nt, Human adenovirus A
gcguacagccaga

SEQ ID NO: 1535068 - RNA, 16 nt, Human adenovirus A
aagcaguagugccguc

SEQ ID NO: 1535069 - RNA, 13 nt, Human adenovirus A
auccuagcguaca

SEQ ID NO: 1535070 - RNA, 17 nt, Human adenovirus A
agaaccgucugcaugau

SEQ ID NO: 1535071 - RNA, 19 nt, Human adenovirus A
auguuaauuaucccuuuga

SEQ ID NO: 1535072 - RNA, 14 nt, Human adenovirus A
uggauguuggaagg

SEQ ID NO: 1535073 - RNA, 18 nt, Human adenovirus A
uggaaagcauuuuggauu

SEQ ID NO: 1535074 - RNA, 17 nt, Human adenovirus A
cccgcgguuuuggcggc

SEQ ID NO: 1535075 - RNA, 17 nt, Human adenovirus A
uaguuguggucuagagu

SEQ ID NO: 1535076 - RNA, 17 nt, Human adenovirus A
uuaagggcguacaguuu

SEQ ID NO: 1535077 - RNA, 14 nt, Human adenovirus A
cauccgcaggcagu

SEQ ID NO: 1535078 - RNA, 22 nt, Human adenovirus A
cccagugccgccuuagacauga

SEQ ID NO: 1535079 - RNA, 21 nt, Human adenovirus A
cuuuacaaaccacuuaguuuu

SEQ ID NO: 1535080 - RNA, 12 nt, Human adenovirus A
ugguccaggcua

SEQ ID NO: 1535081 - RNA, 20 nt, Human adenovirus A
cgcccauaacaucaggagca

SEQ ID NO: 1535082 - RNA, 13 nt, Human adenovirus A
uuucaaucauuuc

SEQ ID NO: 1535083 - RNA, 15 nt, Human adenovirus A
agcgacgagcaauua

SEQ ID NO: 1535084 - RNA, 18 nt, Human adenovirus A
cuuugaauaguucaucuu

SEQ ID NO: 1535085 - RNA, 23 nt, Human adenovirus A
cacuggcaacauaccauauuuuc

SEQ ID NO: 1535086 - RNA, 13 nt, Human adenovirus A
auaggaggaguua

SEQ ID NO: 1535087 - RNA, 15 nt, Human adenovirus A
auaucacucuucgcu

SEQ ID NO: 1535088 - RNA, 15 nt, Human adenovirus A
aaacaacgaaggcca

SEQ ID NO: 1535089 - RNA, 13 nt, Human adenovirus A
guacgaaacuguu

SEQ ID NO: 1535090 - RNA, 19 nt, Human adenovirus A
agcacgccaaagccacacc

SEQ ID NO: 1535091 - RNA, 15 nt, Human adenovirus A
cggugcacuuuucca

SEQ ID NO: 1535092 - RNA, 18 nt, Human adenovirus A
agacguaggguacagugg

SEQ ID NO: 1535093 - RNA, 17 nt, Human adenovirus A
uaauauuuugccagcuc

SEQ ID NO: 1535094 - RNA, 14 nt, Human adenovirus A
cacaggauccacuu

SEQ ID NO: 1535095 - RNA, 14 nt, Human adenovirus A
uacaagcacgccaa

SEQ ID NO: 1535096 - RNA, 20 nt, Human adenovirus A
cacuguaaaaccuacacaug

SEQ ID NO: 1535097 - RNA, 17 nt, Human adenovirus A
cgacacuaucaccgccg

SEQ ID NO: 1535098 - RNA, 15 nt, Human adenovirus A
ugugcugcaaacaug

SEQ ID NO: 1535099 - RNA, 19 nt, Human adenovirus A
acaaaaucaccaugggaau

SEQ ID NO: 1535100 - RNA, 15 nt, Human adenovirus A
cgacaacagcugcug

SEQ ID NO: 1535101 - RNA, 15 nt, Human adenovirus A
cuacuccuacaaggc

SEQ ID NO: 1535102 - RNA, 18 nt, Human adenovirus A
cagcgagucaccaucacu

SEQ ID NO: 1535103 - RNA, 17 nt, Human adenovirus A
ucggaagaaaagcgugg

SEQ ID NO: 1535104 - RNA, 14 nt, Human adenovirus A
acgcugcccacuca

SEQ ID NO: 1535105 - RNA, 13 nt, Human adenovirus A
gcccugcuccgac

SEQ ID NO: 1535106 - RNA, 18 nt, Human adenovirus A
uuugcuggagauaaguuu

SEQ ID NO: 1535107 - RNA, 14 nt, Human adenovirus A
acaagugaggcgcu

SEQ ID NO: 1535108 - RNA, 19 nt, Human adenovirus A
acugguaacggucuucaag

SEQ ID NO: 1535109 - RNA, 16 nt, Human adenovirus A
caagcauauaaaacug

SEQ ID NO: 1535110 - RNA, 15 nt, Human adenovirus A
caguuuuugcagugc

SEQ ID NO: 1535111 - RNA, 23 nt, Human adenovirus A
gccccauccguggcaggccaucu

SEQ ID NO: 1535112 - RNA, 12 nt, Human adenovirus A
cuuucuuuagaa

SEQ ID NO: 1535113 - RNA, 21 nt, Human adenovirus A
uggagcagguguaaccagcug

SEQ ID NO: 1535114 - RNA, 15 nt, Human adenovirus A
acugcgucuccccau

SEQ ID NO: 1535115 - RNA, 21 nt, Human adenovirus A
cgcuuucccgagaaccagaua

SEQ ID NO: 1535116 - RNA, 15 nt, Human adenovirus A
cucgcagcucuuauu

SEQ ID NO: 1535117 - RNA, 20 nt, Human adenovirus A
gcuucaagacguuccauggc

SEQ ID NO: 1535118 - RNA, 22 nt, Human adenovirus A
ccauguggagguauaacaaaau

SEQ ID NO: 1535119 - RNA, 17 nt, Human adenovirus A
gcaaagaaacacaugau

SEQ ID NO: 1535120 - RNA, 14 nt, Human adenovirus A
acugucccccacca

SEQ ID NO: 1535121 - RNA, 14 nt, Human adenovirus A
aggaagaacaucca

SEQ ID NO: 1535122 - RNA, 17 nt, Human adenovirus A
ggcuccacaccuugguc

SEQ ID NO: 1535123 - RNA, 18 nt, Human adenovirus A
ccuuauuugacuuccagg

SEQ ID NO: 1535124 - RNA, 14 nt, Human adenovirus A
cuguacgcaaacuc

SEQ ID NO: 1535125 - RNA, 21 nt, Human adenovirus A
gaauuauucccgcagccaaca

SEQ ID NO: 1535126 - RNA, 20 nt, Human adenovirus A
agcuacccuucgcuaugaau

SEQ ID NO: 1535127 - RNA, 16 nt, Human adenovirus A
caguacuucauauuug

SEQ ID NO: 1535128 - RNA, 17 nt, Human adenovirus A
uagcugcaguuugucau

SEQ ID NO: 1535129 - RNA, 22 nt, Human adenovirus A
ggcaaagaaacacaugauggau

SEQ ID NO: 1535130 - RNA, 17 nt, Human adenovirus A
uacaaccacucucgcag

SEQ ID NO: 1535131 - RNA, 17 nt, Human adenovirus A
gagauuacgugcgagac

SEQ ID NO: 1535132 - RNA, 18 nt, Human adenovirus A
aacccuuuagcaguugcu

SEQ ID NO: 1535133 - RNA, 20 nt, Human adenovirus A
uuauaugcgcauggcuuuaa

SEQ ID NO: 1535134 - RNA, 18 nt, Human adenovirus A
caaccucacugcuuugcu

SEQ ID NO: 1535135 - RNA, 20 nt, Human adenovirus A
cccacgccgcgccccacuuc

SEQ ID NO: 1535136 - RNA, 22 nt, Human adenovirus A
ucaaaaaagcaaaguacaacca

SEQ ID NO: 1535137 - RNA, 15 nt, Human adenovirus A
gagcacacugggaaa

SEQ ID NO: 1535138 - RNA, 23 nt, Human adenovirus A
ccuuugaagagcucgacaaggaa

SEQ ID NO: 1535139 - RNA, 19 nt, Human adenovirus A
cccaugaguaggcaaguug

SEQ ID NO: 1535140 - RNA, 13 nt, Human adenovirus A
uaacaacagucag

SEQ ID NO: 1535141 - RNA, 23 nt, Human adenovirus A
uucagguuuuuggagguaucugu

SEQ ID NO: 1535142 - RNA, 16 nt, Human adenovirus A
agagcauugugguuca

SEQ ID NO: 1535143 - RNA, 20 nt, Human adenovirus A
cgaucguucaacuuugucca

SEQ ID NO: 1535144 - RNA, 23 nt, Human adenovirus A
aguccguuuucuucuugagccca

SEQ ID NO: 1535145 - RNA, 18 nt, Human adenovirus A
accaaaugagcaaaacgc

SEQ ID NO: 1535146 - RNA, 19 nt, Human adenovirus A
augccaguuuacugacaga

SEQ ID NO: 1535147 - RNA, 19 nt, Human adenovirus A
cuuaugcgugagggugcca

SEQ ID NO: 1535148 - RNA, 21 nt, Human adenovirus A
acaaaacuuaucagccagagc

SEQ ID NO: 1535149 - RNA, 22 nt, Human adenovirus A
cuuuaagggcuggcgcuuccau

SEQ ID NO: 1535150 - RNA, 16 nt, Human adenovirus A
acaguugaaaaaggaa

SEQ ID NO: 1535151 - RNA, 20 nt, Human adenovirus A
uuacacucaggccauaaaga

SEQ ID NO: 1535152 - RNA, 13 nt, Human adenovirus A
aaaacaaaaccac

SEQ ID NO: 1535153 - RNA, 15 nt, Human adenovirus A
auucggcuauuuaca

SEQ ID NO: 1535154 - RNA, 18 nt, Human adenovirus A
ggcagccaagcgcucgcg

SEQ ID NO: 1535155 - RNA, 18 nt, Human adenovirus A
aaagcagccauaaugccu

SEQ ID NO: 1535156 - RNA, 16 nt, Human adenovirus A
acauugacuguuucca

SEQ ID NO: 1535157 - RNA, 17 nt, Human adenovirus A
agagcguucugggaugc

SEQ ID NO: 1535158 - RNA, 17 nt, Human adenovirus A
cuacauuacgcccccag

SEQ ID NO: 1535159 - RNA, 22 nt, Human adenovirus A
ggugaaagaagacuauagagag

SEQ ID NO: 1535160 - RNA, 18 nt, Human adenovirus A
aauuugccuaaaagcuau

SEQ ID NO: 1535161 - RNA, 13 nt, Human adenovirus A
cagcaagugccuc

SEQ ID NO: 1535162 - RNA, 18 nt, Human adenovirus A
guagaccugcaagacaga

SEQ ID NO: 1535163 - RNA, 16 nt, Human adenovirus A
gugcuacugcgucucc

SEQ ID NO: 1535164 - RNA, 14 nt, Human adenovirus A
acaacgagcaagcc

SEQ ID NO: 1535165 - RNA, 23 nt, Human adenovirus A
auguguugugcacuuccuucaga

SEQ ID NO: 1535166 - RNA, 18 nt, Human adenovirus A
uguagaagcuuauguaca

SEQ ID NO: 1535167 - RNA, 21 nt, Human adenovirus A
caacuuacagcuaguaauaau

SEQ ID NO: 1535168 - RNA, 13 nt, Human adenovirus A
uaaaaucauacaa

SEQ ID NO: 1535169 - RNA, 21 nt, Human adenovirus A
ucgcaauuagggccagcauug

SEQ ID NO: 1535170 - RNA, 18 nt, Human adenovirus A
caaaacacugagcuccau

SEQ ID NO: 1535171 - RNA, 22 nt, Human adenovirus A
aacggcgcgcaguccugaugcu

SEQ ID NO: 1535172 - RNA, 20 nt, Human adenovirus A
auucgcaggcggucugccau

SEQ ID NO: 1535173 - RNA, 13 nt, Human adenovirus A
auagaaaguuugg

SEQ ID NO: 1535174 - RNA, 15 nt, Human adenovirus A
agcagaauuacugcc

SEQ ID NO: 1535175 - RNA, 12 nt, Human adenovirus A
caggugcaagaa

SEQ ID NO: 1535176 - RNA, 14 nt, Human adenovirus A
ccacauacaucacc

SEQ ID NO: 1535177 - RNA, 20 nt, Human adenovirus A
gcagcauguccccgaaagcc

SEQ ID NO: 1535178 - RNA, 21 nt, Human adenovirus A
aacagacgaauaagcucggcc

SEQ ID NO: 1535179 - RNA, 20 nt, Human adenovirus A
aggaacuccgcgcaaggagc

SEQ ID NO: 1535180 - RNA, 15 nt, Human adenovirus A
aauauuguauuucca

SEQ ID NO: 1535181 - RNA, 22 nt, Human adenovirus A
cacauugcaacgcaaucagaau

SEQ ID NO: 1535182 - RNA, 18 nt, Human adenovirus A
aaguacuacuaccacugu

SEQ ID NO: 1535183 - RNA, 19 nt, Human adenovirus A
agcggccacggccggaugc

SEQ ID NO: 1535184 - RNA, 19 nt, Human adenovirus A
cuuacuacgacuugcuaac

SEQ ID NO: 1535185 - RNA, 18 nt, Human adenovirus A
gcaagcgugcaaacagac

SEQ ID NO: 1535186 - RNA, 18 nt, Human adenovirus A
ucuugcauuaaccuuucc

SEQ ID NO: 1535187 - RNA, 19 nt, Human adenovirus A
uaacgcuaccaccuaagaa

SEQ ID NO: 1535188 - RNA, 15 nt, Human adenovirus A
acgccaaagccacac

SEQ ID NO: 1535189 - RNA, 20 nt, Human adenovirus A
aaaacacgucggaaugauua

SEQ ID NO: 1535190 - RNA, 14 nt, Human adenovirus A
aucccagcuaacgc

SEQ ID NO: 1535191 - RNA, 21 nt, Human adenovirus A
aacauccuuuuucuacaggca

SEQ ID NO: 1535192 - RNA, 14 nt, Human adenovirus A
ucucagaaagccaa

SEQ ID NO: 1535193 - RNA, 22 nt, Human adenovirus A
ugcuguacgcaaacucagccca

SEQ ID NO: 1535194 - RNA, 15 nt, Human adenovirus A
ugauuuuacagagag

SEQ ID NO: 1535195 - RNA, 16 nt, Human adenovirus A
cguaaaauacacauaa

SEQ ID NO: 1535196 - RNA, 18 nt, Human adenovirus A
gaagccauguuaagaaau

SEQ ID NO: 1535197 - RNA, 11 nt, Human adenovirus A
ucucuuucaac

SEQ ID NO: 1535198 - RNA, 14 nt, Human adenovirus A
ucucuuuucuuuac

SEQ ID NO: 1535199 - RNA, 14 nt, Human adenovirus A
ugggaggaaagaca

SEQ ID NO: 1535200 - RNA, 21 nt, Human adenovirus A
aauguuuucuggaucagaaac

SEQ ID NO: 1535201 - RNA, 19 nt, Human adenovirus A
uccuuagauuuuucaucug

SEQ ID NO: 1535202 - RNA, 14 nt, Human adenovirus A
augacuggacagcg

SEQ ID NO: 1535203 - RNA, 15 nt, Human adenovirus A
acucacgagaaagug

SEQ ID NO: 1535204 - RNA, 19 nt, Human adenovirus A
aaacucccuuaguuguaaa

SEQ ID NO: 1535205 - RNA, 21 nt, Human adenovirus A
accgucgcuuucaaccaagcc

SEQ ID NO: 1535206 - RNA, 12 nt, Human adenovirus A
ucaccuccaggu

SEQ ID NO: 1535207 - RNA, 20 nt, Human adenovirus A
ggauuauaaaaggcuggaag

SEQ ID NO: 1535208 - RNA, 16 nt, Human adenovirus A
gcauuaccagcagcca

SEQ ID NO: 1535209 - RNA, 18 nt, Human adenovirus A
aaguggaucuccugccac

SEQ ID NO: 1535210 - RNA, 17 nt, Human adenovirus A
uggcuggacugccgaca

SEQ ID NO: 1535211 - RNA, 14 nt, Human adenovirus A
uccucuucugcugc

SEQ ID NO: 1535212 - RNA, 11 nt, Human adenovirus A
uaagggcuggc

SEQ ID NO: 1535213 - RNA, 15 nt, Human adenovirus A
ucagaagccagcagc

SEQ ID NO: 1535214 - RNA, 22 nt, Human adenovirus A
gccuuaaauaaggcugcuagga

SEQ ID NO: 1535215 - RNA, 21 nt, Human adenovirus A
ucauaagcugugaaaaugcgu

SEQ ID NO: 1535216 - RNA, 20 nt, Human adenovirus A
caaacggguggaaaaacaac

SEQ ID NO: 1535217 - RNA, 22 nt, Human adenovirus A
uggugcaauucgcccgcgccac

SEQ ID NO: 1535218 - RNA, 18 nt, Human adenovirus A
agaagacaaagagugacu

SEQ ID NO: 1535219 - RNA, 22 nt, Human adenovirus A
ccacccuguacgcaagcauuuu

SEQ ID NO: 1535220 - RNA, 20 nt, Human adenovirus A
aauuacuuaccggaaaucug

SEQ ID NO: 1535221 - RNA, 16 nt, Human adenovirus A
guacgcguccaccuca

SEQ ID NO: 1535222 - RNA, 17 nt, Human adenovirus A
cuuuagguuagccugaa

SEQ ID NO: 1535223 - RNA, 11 nt, Human adenovirus A
aagugccucaa

SEQ ID NO: 1535224 - RNA, 20 nt, Human adenovirus A
auugcaacgcaaucagaaug

SEQ ID NO: 1535225 - RNA, 17 nt, Human adenovirus A
agcccaauugcaugcua

SEQ ID NO: 1535226 - RNA, 23 nt, Human adenovirus A
gggaccgcagucugacagcaauu

SEQ ID NO: 1535227 - RNA, 16 nt, Human adenovirus A
acgcaugaaggguggg

SEQ ID NO: 1535228 - RNA, 18 nt, Human adenovirus A
cagaaauacagagcuguc

SEQ ID NO: 1535229 - RNA, 20 nt, Human adenovirus A
aggcaaagaaacacaugaug

SEQ ID NO: 1535230 - RNA, 15 nt, Human adenovirus A
caaugacaaugaaua

SEQ ID NO: 1535231 - RNA, 19 nt, Human adenovirus A
cuccagcuauaaaaagagu

SEQ ID NO: 1535232 - RNA, 10 nt, Human adenovirus A
uugcauggug

SEQ ID NO: 1535233 - RNA, 22 nt, Human adenovirus A
ugcgaguaggaagacagcaugg

SEQ ID NO: 1535234 - RNA, 17 nt, Human adenovirus A
gcucaguuauauuuucu

SEQ ID NO: 1535235 - RNA, 19 nt, Human adenovirus A
caagauccggugacuuuuc

SEQ ID NO: 1535236 - RNA, 13 nt, Human adenovirus A
gucuugcauuaac

SEQ ID NO: 1535237 - RNA, 22 nt, Human adenovirus A
cauuggcgcuacggcugucaug

SEQ ID NO: 1535238 - RNA, 12 nt, Human adenovirus A
cgccaagccugu

SEQ ID NO: 1535239 - RNA, 16 nt, Human adenovirus A
acugaggagcugagaa

SEQ ID NO: 1535240 - RNA, 17 nt, Human adenovirus A
caagccuaccugacacu

SEQ ID NO: 1535241 - RNA, 23 nt, Human adenovirus A
ugccacgcuuugaccggucaggc

SEQ ID NO: 1535242 - RNA, 18 nt, Human adenovirus A
caauaacuacaaacaguu

SEQ ID NO: 1535243 - RNA, 17 nt, Human adenovirus A
aggcaacauagccccag

SEQ ID NO: 1535244 - RNA, 14 nt, Human adenovirus A
aguaggcuaacugu

SEQ ID NO: 1535245 - RNA, 14 nt, Human adenovirus A
gacacuacagagcu

SEQ ID NO: 1535246 - RNA, 17 nt, Human adenovirus A
ccucgaccugcaugucc

SEQ ID NO: 1535247 - RNA, 17 nt, Human adenovirus A
cuggacagcggccaugg

SEQ ID NO: 1535248 - RNA, 15 nt, Human adenovirus A
ucaaaauaaacaucu

SEQ ID NO: 1535249 - RNA, 21 nt, Human adenovirus A
ugccuuaggcagcagcagcaa

SEQ ID NO: 1535250 - RNA, 21 nt, Human adenovirus A
acugaaccauucccagguaau

SEQ ID NO: 1535251 - RNA, 18 nt, Human adenovirus A
agucgcaauuagggccag

SEQ ID NO: 1535252 - RNA, 19 nt, Human adenovirus A
ggauuacaugucaaugcag

SEQ ID NO: 1535253 - RNA, 21 nt, Human adenovirus A
auaaagcguucuguggauggg

SEQ ID NO: 1535254 - RNA, 14 nt, Human adenovirus A
aucaguggaguuca

SEQ ID NO: 1535255 - RNA, 15 nt, Human adenovirus A
guagagacaucagau

SEQ ID NO: 1535256 - RNA, 16 nt, Human adenovirus A
ugaaagaucacagcca

SEQ ID NO: 1535257 - RNA, 19 nt, Human adenovirus A
aggaauuuacuccaucugu

SEQ ID NO: 1535258 - RNA, 14 nt, Human adenovirus A
aaaugaccccaucu

SEQ ID NO: 1535259 - RNA, 16 nt, Human adenovirus A
gcgcauugggcggcga

SEQ ID NO: 1535260 - RNA, 13 nt, Human adenovirus A
auuaggcuuucuu

SEQ ID NO: 1535261 - RNA, 21 nt, Human adenovirus A
uacauccuuccauugugccca

SEQ ID NO: 1535262 - RNA, 21 nt, Human adenovirus A
cagccuuuauuuaucugugcu

SEQ ID NO: 1535263 - RNA, 15 nt, Human adenovirus A
acccaagggugcagc

SEQ ID NO: 1535264 - RNA, 21 nt, Human adenovirus A
uaaaggcuagugcccucacac

SEQ ID NO: 1535265 - RNA, 19 nt, Human adenovirus A
uacggagggaagaaacagu

SEQ ID NO: 1535266 - RNA, 21 nt, Human adenovirus A
aauauuuagacuauaaucccu

SEQ ID NO: 1535267 - RNA, 17 nt, Human adenovirus A
cugacagacuugcaaac

SEQ ID NO: 1535268 - RNA, 21 nt, Human adenovirus A
ugcgacguuuuguuaccugug

SEQ ID NO: 1535269 - RNA, 15 nt, Human adenovirus A
aacaaguuuagaaac

SEQ ID NO: 1535270 - RNA, 13 nt, Human adenovirus A
uuugcauuuccca

SEQ ID NO: 1535271 - RNA, 21 nt, Human adenovirus A
ucaugucgcauaaugaaaaca

SEQ ID NO: 1535272 - RNA, 22 nt, Human adenovirus A
ugaaaacaauguucccaaauau

SEQ ID NO: 1535273 - RNA, 23 nt, Human adenovirus A
cugcguucacuuacccgcagcug

SEQ ID NO: 1535274 - RNA, 18 nt, Human adenovirus A
gcgauacaacggccagcc

SEQ ID NO: 1535275 - RNA, 14 nt, Human adenovirus A
uuguauaaaaucau

SEQ ID NO: 1535276 - RNA, 13 nt, Human adenovirus A
ccuguuuaaacau

SEQ ID NO: 1535277 - RNA, 20 nt, Human adenovirus A
ggcuucgaaugcugugacac

SEQ ID NO: 1535278 - RNA, 17 nt, Human adenovirus A
caaaaucuaagccaugc

SEQ ID NO: 1535279 - RNA, 16 nt, Human adenovirus A
aagcaguagaaaguag

SEQ ID NO: 1535280 - RNA, 13 nt, Human adenovirus A
gucucaaaagcag

SEQ ID NO: 1535281 - RNA, 21 nt, Human adenovirus A
ugaugccacuugaauucugga

SEQ ID NO: 1535282 - RNA, 16 nt, Human adenovirus A
uacgcuugugcagccu

SEQ ID NO: 1535283 - RNA, 20 nt, Human adenovirus A
aacagacuggggaauuugca

SEQ ID NO: 1535284 - RNA, 15 nt, Human adenovirus A
uucuuuaccuucugg

SEQ ID NO: 1535285 - RNA, 23 nt, Human adenovirus A
ggucccauccaaguucuaaugca

SEQ ID NO: 1535286 - RNA, 23 nt, Human adenovirus A
aacuuucuccaaaucuuaaaugg

SEQ ID NO: 1535287 - RNA, 21 nt, Human adenovirus A
uugaaccagcgucccaaaagc

SEQ ID NO: 1535288 - RNA, 15 nt, Human adenovirus A
uuuaaaaucuugguc

SEQ ID NO: 1535289 - RNA, 16 nt, Human adenovirus A
gaggacuuggaagaau

SEQ ID NO: 1535290 - RNA, 16 nt, Human adenovirus A
cuuaccaaagccaugg

SEQ ID NO: 1535291 - RNA, 12 nt, Human adenovirus A
caaagaaaacau

SEQ ID NO: 1535292 - RNA, 17 nt, Human adenovirus A
cgggagggacaagcuua

SEQ ID NO: 1535293 - RNA, 16 nt, Human adenovirus A
cgccaauaaaaacaac

SEQ ID NO: 1535294 - RNA, 15 nt, Human adenovirus A
uccagucauagcaac

SEQ ID NO: 1535295 - RNA, 13 nt, Human adenovirus A
gaacuaaaccuuc

SEQ ID NO: 1535296 - RNA, 21 nt, Human adenovirus A
cauauaaaacugauuuaccgc

SEQ ID NO: 1535297 - RNA, 18 nt, Human adenovirus A
ucuaaaccuauaacaaug

SEQ ID NO: 1535298 - RNA, 20 nt, Human adenovirus A
uccucuuccucuucugcugc

SEQ ID NO: 1535299 - RNA, 22 nt, Human adenovirus A
caaaugcgaccucagcccaggg

SEQ ID NO: 1535300 - RNA, 20 nt, Human adenovirus A
cuagccccugucaacagcau

SEQ ID NO: 1535301 - RNA, 20 nt, Human adenovirus A
uuuaugcucguaaaaucuac

SEQ ID NO: 1535302 - RNA, 18 nt, Human adenovirus A
cuuaguaacagcauauga

SEQ ID NO: 1535303 - RNA, 17 nt, Human adenovirus A
uucgcagcgcacuggca

SEQ ID NO: 1535304 - RNA, 13 nt, Human adenovirus A
gagacagaacacg

SEQ ID NO: 1535305 - RNA, 22 nt, Human adenovirus A
acaugcgggggaugaaggaagc

SEQ ID NO: 1535306 - RNA, 15 nt, Human adenovirus A
uccggaaacaacacg

SEQ ID NO: 1535307 - RNA, 16 nt, Human adenovirus A
accucuaaguucuguu

SEQ ID NO: 1535308 - RNA, 17 nt, Human adenovirus A
ggcaggggaagguguug

SEQ ID NO: 1535309 - RNA, 21 nt, Human adenovirus A
gccccauccguggcaggccau

SEQ ID NO: 1535310 - RNA, 22 nt, Human adenovirus A
cagauacuggugcguccaccag

SEQ ID NO: 1535311 - RNA, 13 nt, Human adenovirus A
acaguuuaacaca

SEQ ID NO: 1535312 - RNA, 20 nt, Human adenovirus A
gguggggaaaaugguggugc

SEQ ID NO: 1535313 - RNA, 15 nt, Human adenovirus A
cgcacugggccagga

SEQ ID NO: 1535314 - RNA, 14 nt, Human adenovirus A
uacauaccuggcaa

SEQ ID NO: 1535315 - RNA, 22 nt, Human adenovirus A
gauaagauuguaauuuuuuucu

SEQ ID NO: 1535316 - RNA, 13 nt, Human adenovirus A
aucuuaaauggaa

SEQ ID NO: 1535317 - RNA, 15 nt, Human adenovirus A
cacuguagugcaaaa

SEQ ID NO: 1535318 - RNA, 17 nt, Human adenovirus A
ccuagcguacagccaga

SEQ ID NO: 1535319 - RNA, 22 nt, Human adenovirus A
uuucauuaggcuuucuuccauu

SEQ ID NO: 1535320 - RNA, 15 nt, Human adenovirus A
cucuuuuaagaucuu

SEQ ID NO: 1535321 - RNA, 18 nt, Human adenovirus A
auauuuugccagcucuug

SEQ ID NO: 1535322 - RNA, 13 nt, Human adenovirus A
auagcgaggaacc

SEQ ID NO: 1535323 - RNA, 18 nt, Human adenovirus A
uucaaacaauaacauugc

SEQ ID NO: 1535324 - RNA, 13 nt, Human adenovirus A
gaacuaucuugca

SEQ ID NO: 1535325 - RNA, 20 nt, Human adenovirus A
aacggaucuugggcaaaaua

SEQ ID NO: 1535326 - RNA, 12 nt, Human adenovirus A
augggaggagga

SEQ ID NO: 1535327 - RNA, 23 nt, Human adenovirus A
uaaccugggauacuaccgcugcu

SEQ ID NO: 1535328 - RNA, 23 nt, Human adenovirus A
uggaacaacaggugcaagaaggc

SEQ ID NO: 1535329 - RNA, 21 nt, Human adenovirus A
ccugaugcuuuucgccagcag

SEQ ID NO: 1535330 - RNA, 23 nt, Human adenovirus A
cagcauguccccgaaagccgcaa

SEQ ID NO: 1535331 - RNA, 13 nt, Human adenovirus A
gcucccgccauug

SEQ ID NO: 1535332 - RNA, 14 nt, Human adenovirus A
agacguaggguaca

SEQ ID NO: 1535333 - RNA, 18 nt, Human adenovirus A
caaaucucagaaagccaa

SEQ ID NO: 1535334 - RNA, 15 nt, Human adenovirus A
aacaguacaaagcca

SEQ ID NO: 1535335 - RNA, 17 nt, Human adenovirus A
aauuacuaaaacaguaa

SEQ ID NO: 1535336 - RNA, 14 nt, Human adenovirus A
caggacgcagaagc

SEQ ID NO: 1535337 - RNA, 17 nt, Human adenovirus A
uuaggcagcagcagcaa

SEQ ID NO: 1535338 - RNA, 21 nt, Human adenovirus A
caaaggugcuucccacauaca

SEQ ID NO: 1535339 - RNA, 20 nt, Human adenovirus A
cagucaaugcuucugaaaca

SEQ ID NO: 1535340 - RNA, 16 nt, Human adenovirus A
ucgcgcauaggaggag

SEQ ID NO: 1535341 - RNA, 20 nt, Human adenovirus A
acagcauuggaauuuaacuu

SEQ ID NO: 1535342 - RNA, 23 nt, Human adenovirus A
cagucuguuuaguccugcaguua

SEQ ID NO: 1535343 - RNA, 13 nt, Human adenovirus A
aaguguaauuuuc

SEQ ID NO: 1535344 - RNA, 19 nt, Human adenovirus A
uugccgcacggccaaugcc

SEQ ID NO: 1535345 - RNA, 16 nt, Human adenovirus A
uagcccaauugcaugc

SEQ ID NO: 1535346 - RNA, 15 nt, Human adenovirus A
cuacacaacacaaaa

SEQ ID NO: 1535347 - RNA, 14 nt, Human adenovirus A
uguaacccuucccc

SEQ ID NO: 1535348 - RNA, 22 nt, Human adenovirus A
auccuuccauugugcccacgcc

SEQ ID NO: 1535349 - RNA, 19 nt, Human adenovirus A
ugaauggaacaccagcauu

SEQ ID NO: 1535350 - RNA, 18 nt, Human adenovirus A
aggaggacuuugagccag

SEQ ID NO: 1535351 - RNA, 20 nt, Human adenovirus A
aaaagcuuuaauaaccaugu

SEQ ID NO: 1535352 - RNA, 12 nt, Human adenovirus A
aaacacacacaa

SEQ ID NO: 1535353 - RNA, 17 nt, Human adenovirus A
caucuuaguaauggagu

SEQ ID NO: 1535354 - RNA, 22 nt, Human adenovirus A
gaaguagccauugguuuaaugc

SEQ ID NO: 1535355 - RNA, 19 nt, Human adenovirus A
aaauuguguacuuuucaaa

SEQ ID NO: 1535356 - RNA, 14 nt, Human adenovirus A
aaagccgcaaaaca

SEQ ID NO: 1535357 - RNA, 12 nt, Human adenovirus A
gaugaaggaagc

SEQ ID NO: 1535358 - RNA, 21 nt, Human adenovirus A
cugccauugccgcacggccaa

SEQ ID NO: 1535359 - RNA, 11 nt, Human adenovirus A
auaugcauuua

SEQ ID NO: 1535360 - RNA, 22 nt, Human adenovirus A
gcucgcuuuacgcuggcugugg

SEQ ID NO: 1535361 - RNA, 19 nt, Human adenovirus A
caguuuuggagccaaaaaa

SEQ ID NO: 1535362 - RNA, 14 nt, Human adenovirus A
cuggacauggaaaa

SEQ ID NO: 1535363 - RNA, 17 nt, Human adenovirus A
uccgcggggacagcgcg

SEQ ID NO: 1535364 - RNA, 12 nt, Human adenovirus A
aacaaaacacug

SEQ ID NO: 1535365 - RNA, 23 nt, Human adenovirus A
aaacgaaucccucgcccgcacag

SEQ ID NO: 1535366 - RNA, 21 nt, Human adenovirus A
aacaucuacagcgacaaagca

SEQ ID NO: 1535367 - RNA, 15 nt, Human adenovirus A
aagguauucagcuga

SEQ ID NO: 1535368 - RNA, 18 nt, Human adenovirus A
cucacauuguguaaccag

SEQ ID NO: 1535369 - RNA, 22 nt, Human adenovirus A
cgguccuccucguacaggaauu

SEQ ID NO: 1535370 - RNA, 16 nt, Human adenovirus A
ggcacaacagacuggg

SEQ ID NO: 1535371 - RNA, 15 nt, Human adenovirus A
ucagaugacuggaca

SEQ ID NO: 1535372 - RNA, 19 nt, Human adenovirus A
aaaagcagccauaaugccu

SEQ ID NO: 1535373 - RNA, 17 nt, Human adenovirus A
acauauggcaccaaggc

SEQ ID NO: 1535374 - RNA, 15 nt, Human adenovirus A
gccacagccccuagc

SEQ ID NO: 1535375 - RNA, 15 nt, Human adenovirus A
ugcguuuugugcccg

SEQ ID NO: 1535376 - RNA, 14 nt, Human adenovirus A
ccuugaaaugccag

SEQ ID NO: 1535377 - RNA, 20 nt, Human adenovirus A
ugcgaaccgauugggaaaaa

SEQ ID NO: 1535378 - RNA, 20 nt, Human adenovirus A
uauggagugugcuauuaaag

SEQ ID NO: 1535379 - RNA, 21 nt, Human adenovirus A
uccaaugaaacccgcugugag

SEQ ID NO: 1535380 - RNA, 14 nt, Human adenovirus A
ccacaggugguggg

SEQ ID NO: 1535381 - RNA, 14 nt, Human adenovirus A
gauaaacaaaagca

SEQ ID NO: 1535382 - RNA, 19 nt, Human adenovirus A
gaucuuuguaguagucuug

SEQ ID NO: 1535383 - RNA, 20 nt, Human adenovirus A
uugcuucauugaauuaccag

SEQ ID NO: 1535384 - RNA, 19 nt, Human adenovirus A
cuccaaugaaacccgcugu

SEQ ID NO: 1535385 - RNA, 14 nt, Human adenovirus A
ggugcagcucgccc

SEQ ID NO: 1535386 - RNA, 18 nt, Human adenovirus A
ggccaaacagcuguggaa

SEQ ID NO: 1535387 - RNA, 22 nt, Human adenovirus A
gcaucuauaguaaaaaugccag

SEQ ID NO: 1535388 - RNA, 16 nt, Human adenovirus A
acacaguuucuuuacg

SEQ ID NO: 1535389 - RNA, 16 nt, Human adenovirus A
uuaaauaauauuuugc

SEQ ID NO: 1535390 - RNA, 12 nt, Human adenovirus A
gacaacugaggu

SEQ ID NO: 1535391 - RNA, 16 nt, Human adenovirus A
guacagauguaaagga

SEQ ID NO: 1535392 - RNA, 19 nt, Human adenovirus A
uacaagcacgccaaagcca

SEQ ID NO: 1535393 - RNA, 19 nt, Human adenovirus A
auuaaaagggaagccaugg

SEQ ID NO: 1535394 - RNA, 16 nt, Human adenovirus A
ggaguucccacagaac

SEQ ID NO: 1535395 - RNA, 19 nt, Human adenovirus A
ccccgcgacacggcacgcg

SEQ ID NO: 1535396 - RNA, 20 nt, Human adenovirus A
gcuucuacaaucacuuggcu

SEQ ID NO: 1535397 - RNA, 18 nt, Human adenovirus A
cagaaaguuguagauggu

SEQ ID NO: 1535398 - RNA, 18 nt, Human adenovirus A
cagaugacuggacagcgg

SEQ ID NO: 1535399 - RNA, 16 nt, Human adenovirus A
agccuggagcugucca

SEQ ID NO: 1535400 - RNA, 14 nt, Human adenovirus A
cagcugcugucacu

SEQ ID NO: 1535401 - RNA, 20 nt, Human adenovirus A
caccgucaauucuucuucca

SEQ ID NO: 1535402 - RNA, 15 nt, Human adenovirus A
ucuauagguacgaaa

SEQ ID NO: 1535403 - RNA, 21 nt, Human adenovirus A
gcacugaaaaaccaacaaaca

SEQ ID NO: 1535404 - RNA, 15 nt, Human adenovirus A
cgguuccagaaggag

SEQ ID NO: 1535405 - RNA, 15 nt, Human adenovirus A
gucagcugcaaaccg

SEQ ID NO: 1535406 - RNA, 21 nt, Human adenovirus A
augaccaaacgcaaguucaaa

SEQ ID NO: 1535407 - RNA, 13 nt, Human adenovirus A
gugguuuggugga

SEQ ID NO: 1535408 - RNA, 20 nt, Human adenovirus A
cuuuuuuuuuccauaguucu

SEQ ID NO: 1535409 - RNA, 15 nt, Human adenovirus A
gaucugucagugaaa

SEQ ID NO: 1535410 - RNA, 20 nt, Human adenovirus A
gcuaguucuuacuuugacau

SEQ ID NO: 1535411 - RNA, 15 nt, Human adenovirus A
accguagaugggaca

SEQ ID NO: 1535412 - RNA, 12 nt, Human adenovirus A
ggcuggcuugcc

SEQ ID NO: 1535413 - RNA, 15 nt, Human adenovirus A
cucaggccauaaaga

SEQ ID NO: 1535414 - RNA, 14 nt, Human adenovirus A
cuuuugcagcucca

SEQ ID NO: 1535415 - RNA, 15 nt, Human adenovirus A
gaggaggcggacagc

SEQ ID NO: 1535416 - RNA, 15 nt, Human adenovirus A
aacaucaacugugcu

SEQ ID NO: 1535417 - RNA, 14 nt, Human adenovirus A
uggcuucgaaugcu

SEQ ID NO: 1535418 - RNA, 14 nt, Human adenovirus A
gguaaugagcgcag

SEQ ID NO: 1535419 - RNA, 18 nt, Human adenovirus A
uuacauuauguaaaguca

SEQ ID NO: 1535420 - RNA, 13 nt, Human adenovirus A
gcuacaucuuuua

SEQ ID NO: 1535421 - RNA, 19 nt, Human adenovirus A
cccagacguaggguacagu

SEQ ID NO: 1535422 - RNA, 18 nt, Human adenovirus A
uggaguuuagaaggaaag

SEQ ID NO: 1535423 - RNA, 23 nt, Human adenovirus A
gcgccaaguugaguuccacgagc

SEQ ID NO: 1535424 - RNA, 17 nt, Human adenovirus A
cggguggacggagccag

SEQ ID NO: 1535425 - RNA, 14 nt, Human adenovirus A
agaccaaaugccag

SEQ ID NO: 1535426 - RNA, 19 nt, Human adenovirus A
accaaaugcucuuugcgca

SEQ ID NO: 1535427 - RNA, 13 nt, Human adenovirus A
auacaauguggcc

SEQ ID NO: 1535428 - RNA, 17 nt, Human adenovirus A
ggcggcaugcugaaacc

SEQ ID NO: 1535429 - RNA, 20 nt, Human adenovirus A
auauuagagcguucugggau

SEQ ID NO: 1535430 - RNA, 20 nt, Human adenovirus A
gcaaguguaauuuuccagcg

SEQ ID NO: 1535431 - RNA, 15 nt, Human adenovirus A
caaggcguggaacag

SEQ ID NO: 1535432 - RNA, 23 nt, Human adenovirus A
uuccacuuauugcugcggccauu

SEQ ID NO: 1535433 - RNA, 13 nt, Human adenovirus A
caacaagaugagu

SEQ ID NO: 1535434 - RNA, 14 nt, Human adenovirus A
uucugccuaccugc

SEQ ID NO: 1535435 - RNA, 14 nt, Human adenovirus A
ccguuccuguugca

SEQ ID NO: 1535436 - RNA, 18 nt, Human adenovirus A
ccaacaugaggcgguggu

SEQ ID NO: 1535437 - RNA, 15 nt, Human adenovirus A
auggacucaaauaaa

SEQ ID NO: 1535438 - RNA, 16 nt, Human adenovirus A
uaaaauacacauaaag

SEQ ID NO: 1535439 - RNA, 21 nt, Human adenovirus A
acagcuucuacuuuagaagcc

SEQ ID NO: 1535440 - RNA, 22 nt, Human adenovirus A
cuauaacaguaccaaugugcag

SEQ ID NO: 1535441 - RNA, 17 nt, Human adenovirus A
gaaugauuaaacaacaa

SEQ ID NO: 1535442 - RNA, 14 nt, Human adenovirus A
gcuccugcauuaau

SEQ ID NO: 1535443 - RNA, 13 nt, Human adenovirus A
ccaccaccaaacu

SEQ ID NO: 1535444 - RNA, 22 nt, Human adenovirus A
agcaacuuuuuaaccacuguag

SEQ ID NO: 1535445 - RNA, 21 nt, Human adenovirus A
cagacaguuucaucaccagca

SEQ ID NO: 1535446 - RNA, 22 nt, Human adenovirus A
ggauccuagcguacagccagau

SEQ ID NO: 1535447 - RNA, 21 nt, Human adenovirus A
acucuauugccaccuuuuguu

SEQ ID NO: 1535448 - RNA, 14 nt, Human adenovirus A
gucgcaugugaggg

SEQ ID NO: 1535449 - RNA, 15 nt, Human adenovirus A
gcagcaacaaggaaa

SEQ ID NO: 1535450 - RNA, 21 nt, Human adenovirus A
caaccguuuagagccgcggcc

SEQ ID NO: 1535451 - RNA, 15 nt, Human adenovirus A
ccauuagcauagcca

SEQ ID NO: 1535452 - RNA, 23 nt, Human adenovirus A
uuaagaacacggugaauguguuc

SEQ ID NO: 1535453 - RNA, 17 nt, Human adenovirus A
uauggaaauccaaacuu

SEQ ID NO: 1535454 - RNA, 17 nt, Human adenovirus A
ugccgacguugcaagag

SEQ ID NO: 1535455 - RNA, 15 nt, Human adenovirus A
aggaccccaaggcau

SEQ ID NO: 1535456 - RNA, 17 nt, Human adenovirus A
auucuuucuuuagaaac

SEQ ID NO: 1535457 - RNA, 15 nt, Human adenovirus A
aauaauuggcuucag

SEQ ID NO: 1535458 - RNA, 14 nt, Human adenovirus A
uaguccaagcaagu

SEQ ID NO: 1535459 - RNA, 11 nt, Human adenovirus A
ccauguugcua

SEQ ID NO: 1535460 - RNA, 21 nt, Human adenovirus A
caaguugacuucgcacaggcg

SEQ ID NO: 1535461 - RNA, 19 nt, Human adenovirus A
uacaacucuacaaaucuug

SEQ ID NO: 1535462 - RNA, 16 nt, Human adenovirus A
cuucucccugugcuuc

SEQ ID NO: 1535463 - RNA, 18 nt, Human adenovirus A
acuguugaugcaguaauu

SEQ ID NO: 1535464 - RNA, 18 nt, Human adenovirus A
caguaugcugaagaaaca

SEQ ID NO: 1535465 - RNA, 18 nt, Human adenovirus A
aacuacauuacgccccca

SEQ ID NO: 1535466 - RNA, 13 nt, Human adenovirus A
gcauuaagccaga

SEQ ID NO: 1535467 - RNA, 18 nt, Human adenovirus A
acagcagcaacaaggaaa

SEQ ID NO: 1535468 - RNA, 17 nt, Human adenovirus A
ggcggccaugcaaagcc

SEQ ID NO: 1535469 - RNA, 21 nt, Human adenovirus A
caaaguaauauuguagccugc

SEQ ID NO: 1535470 - RNA, 13 nt, Human adenovirus A
gcgaguaggaaga

SEQ ID NO: 1535471 - RNA, 19 nt, Human adenovirus A
gcugccgacguugcaagag

SEQ ID NO: 1535472 - RNA, 16 nt, Human adenovirus A
agaccaaaauuuucaa

SEQ ID NO: 1535473 - RNA, 18 nt, Human adenovirus A
gugucuucucccugugcu

SEQ ID NO: 1535474 - RNA, 11 nt, Human adenovirus A
ucuagaaacug

SEQ ID NO: 1535475 - RNA, 17 nt, Human adenovirus A
ugggaggauauggagug

SEQ ID NO: 1535476 - RNA, 22 nt, Human adenovirus A
aauuaagcgagcccaacccauu

SEQ ID NO: 1535477 - RNA, 21 nt, Human adenovirus A
auauucgcgugccaggcauuu

SEQ ID NO: 1535478 - RNA, 17 nt, Human adenovirus A
aucagccuuucucuaca

SEQ ID NO: 1535479 - RNA, 18 nt, Human adenovirus A
uguaauaaagcuaaaucu

SEQ ID NO: 1535480 - RNA, 20 nt, Human adenovirus A
ggaguguacacuaaugaggc

SEQ ID NO: 1535481 - RNA, 15 nt, Human adenovirus A
agcuguggagggcau

SEQ ID NO: 1535482 - RNA, 21 nt, Human adenovirus A
gucgugguggaagcuggccau

SEQ ID NO: 1535483 - RNA, 13 nt, Human adenovirus A
gcagcaacggcag

SEQ ID NO: 1535484 - RNA, 15 nt, Human adenovirus A
aggagcugagaagug

SEQ ID NO: 1535485 - RNA, 16 nt, Human adenovirus A
auaaaagcauacuuac

SEQ ID NO: 1535486 - RNA, 22 nt, Human adenovirus A
cauuaccagcagccaaaacuca

SEQ ID NO: 1535487 - RNA, 23 nt, Human adenovirus A
gaaguauuccaugagcccgggga

SEQ ID NO: 1535488 - RNA, 14 nt, Human adenovirus A
auucaucauuuguc

SEQ ID NO: 1535489 - RNA, 12 nt, Human adenovirus A
guccacacaguu

SEQ ID NO: 1535490 - RNA, 19 nt, Human adenovirus A
uaaggcauguuugacaaga

SEQ ID NO: 1535491 - RNA, 21 nt, Human adenovirus A
cuaugaugcgggcagccaggc

SEQ ID NO: 1535492 - RNA, 23 nt, Human adenovirus A
cugggguuaagcaguagaaagua

SEQ ID NO: 1535493 - RNA, 13 nt, Human adenovirus A
aaagcaucccagc

SEQ ID NO: 1535494 - RNA, 16 nt, Human adenovirus A
cuacauuacgccccca

SEQ ID NO: 1535495 - RNA, 15 nt, Human adenovirus A
cucauccucagcucc

SEQ ID NO: 1535496 - RNA, 22 nt, Human adenovirus A
uauuauugaagggaauggcuau

SEQ ID NO: 1535497 - RNA, 22 nt, Human adenovirus A
uaagcaggaaaaaaaagaaagu

SEQ ID NO: 1535498 - RNA, 12 nt, Human adenovirus A
ccagucacaguc

SEQ ID NO: 1535499 - RNA, 18 nt, Human adenovirus A
auuugcgaguaggaagac

SEQ ID NO: 1535500 - RNA, 23 nt, Human adenovirus A
cuguacagaaaaaaauugccaac

SEQ ID NO: 1535501 - RNA, 19 nt, Human adenovirus A
ccagagcaccccuucccac

SEQ ID NO: 1535502 - RNA, 18 nt, Human adenovirus A
agcacacugggaaaugau

SEQ ID NO: 1535503 - RNA, 23 nt, Human adenovirus A
cuuauuuuauuccugauuucuaa

SEQ ID NO: 1535504 - RNA, 21 nt, Human adenovirus A
gaguuaggucaucguaggaca

SEQ ID NO: 1535505 - RNA, 11 nt, Human adenovirus A
caacccuuccc

SEQ ID NO: 1535506 - RNA, 14 nt, Human adenovirus A
uuccaccaaaugcu

SEQ ID NO: 1535507 - RNA, 16 nt, Human adenovirus A
ucaacgacuaaaacaa

SEQ ID NO: 1535508 - RNA, 20 nt, Human adenovirus A
aaaagcguggaauuaaaagg

SEQ ID NO: 1535509 - RNA, 13 nt, Human adenovirus A
agacaugacagcg

SEQ ID NO: 1535510 - RNA, 18 nt, Human adenovirus A
auuugauucaagaggaag

SEQ ID NO: 1535511 - RNA, 19 nt, Human adenovirus A
gcauacuuaccaaagccau

SEQ ID NO: 1535512 - RNA, 19 nt, Human adenovirus A
ucgaccuguggcaccugca

SEQ ID NO: 1535513 - RNA, 18 nt, Human adenovirus A
ggcagaauuugugcuacc

SEQ ID NO: 1535514 - RNA, 22 nt, Human adenovirus A
acuaccccuccuucgcuguccc

SEQ ID NO: 1535515 - RNA, 19 nt, Human adenovirus A
gucuucaagaaaaaccacc

SEQ ID NO: 1535516 - RNA, 16 nt, Human adenovirus A
cuucguugagccaugu

SEQ ID NO: 1535517 - RNA, 18 nt, Human adenovirus A
gaaaguaacucuuguaaa

SEQ ID NO: 1535518 - RNA, 22 nt, Human adenovirus A
guauacugaugaucuucccgaa

SEQ ID NO: 1535519 - RNA, 15 nt, Human adenovirus A
ucaagaaaggcaucu

SEQ ID NO: 1535520 - RNA, 13 nt, Human adenovirus A
uagcguacagcca

SEQ ID NO: 1535521 - RNA, 17 nt, Human adenovirus A
gcauuaccagcagccaa

SEQ ID NO: 1535522 - RNA, 21 nt, Human adenovirus A
cccgcgaaaaaaaucacuucc

SEQ ID NO: 1535523 - RNA, 12 nt, Human adenovirus A
ucauuccuucag

SEQ ID NO: 1535524 - RNA, 15 nt, Human adenovirus A
uaccccuauccuguc

SEQ ID NO: 1535525 - RNA, 15 nt, Human adenovirus A
acccuuccccaccuu

SEQ ID NO: 1535526 - RNA, 15 nt, Human adenovirus A
aacgcucguugccca

SEQ ID NO: 1535527 - RNA, 17 nt, Human adenovirus A
cacugggccaggaggac

SEQ ID NO: 1535528 - RNA, 20 nt, Human adenovirus A
cuccccuguggagccacugc

SEQ ID NO: 1535529 - RNA, 15 nt, Human adenovirus A
cugcugucacugagc

SEQ ID NO: 1535530 - RNA, 16 nt, Human adenovirus A
gucacaaguacaucca

SEQ ID NO: 1535531 - RNA, 20 nt, Human adenovirus A
uccaucaccuuugugugcua

SEQ ID NO: 1535532 - RNA, 15 nt, Human adenovirus A
uaacuccgggagugu

SEQ ID NO: 1535533 - RNA, 19 nt, Human adenovirus A
gaggagcacccccaggggc

SEQ ID NO: 1535534 - RNA, 21 nt, Human adenovirus A
agcacgccaaagccacaccuc

SEQ ID NO: 1535535 - RNA, 17 nt, Human adenovirus A
gugaaggcgccaggaug

SEQ ID NO: 1535536 - RNA, 14 nt, Human adenovirus A
caguaauugaugag

SEQ ID NO: 1535537 - RNA, 23 nt, Human adenovirus A
gauauaguacugcuuccagguug

SEQ ID NO: 1535538 - RNA, 16 nt, Human adenovirus A
cacccuuaauugcagg

SEQ ID NO: 1535539 - RNA, 20 nt, Human adenovirus A
cuacauaaaccauggaauuu

SEQ ID NO: 1535540 - RNA, 17 nt, Human adenovirus A
cuucuacaaucacuugg

SEQ ID NO: 1535541 - RNA, 17 nt, Human adenovirus A
agauugucauccccaga

SEQ ID NO: 1535542 - RNA, 23 nt, Human adenovirus A
agacuuaccccugggcuuuggac

SEQ ID NO: 1535543 - RNA, 14 nt, Human adenovirus A
gucaaaauaaucaa

SEQ ID NO: 1535544 - RNA, 15 nt, Human adenovirus A
aggcuaaguuuuguu

SEQ ID NO: 1535545 - RNA, 15 nt, Human adenovirus A
uccgccuaaggaaag

SEQ ID NO: 1535546 - RNA, 17 nt, Human adenovirus A
uaguccguuuucuucuu

SEQ ID NO: 1535547 - RNA, 19 nt, Human adenovirus A
agcuaagcgucugcauauc

SEQ ID NO: 1535548 - RNA, 12 nt, Human adenovirus A
ucgcggagaggg

SEQ ID NO: 1535549 - RNA, 15 nt, Human adenovirus A
uauugaguugcacau

SEQ ID NO: 1535550 - RNA, 23 nt, Human adenovirus A
cccccuuuguagcugaaaacaac

SEQ ID NO: 1535551 - RNA, 19 nt, Human adenovirus A
agcaacuuuuuaaccacug

SEQ ID NO: 1535552 - RNA, 15 nt, Human adenovirus A
aagaaauaaccagug

SEQ ID NO: 1535553 - RNA, 19 nt, Human adenovirus A
acuuuauauugcauuuguc

SEQ ID NO: 1535554 - RNA, 21 nt, Human adenovirus A
caaucagugucuaccaauacu

SEQ ID NO: 1535555 - RNA, 16 nt, Human adenovirus A
uaauaauugaguaacu

SEQ ID NO: 1535556 - RNA, 13 nt, Human adenovirus A
acugcagccuguc

SEQ ID NO: 1535557 - RNA, 23 nt, Human adenovirus A
uuuuaagaagcaccacaucuuug

SEQ ID NO: 1535558 - RNA, 17 nt, Human adenovirus A
ccugacacuacagagcu

SEQ ID NO: 1535559 - RNA, 24 nt, Human adenovirus A
uagaagccauguuaagaaaugaca

SEQ ID NO: 1535560 - RNA, 20 nt, Human adenovirus A
uuggguccggcuuguugaau

SEQ ID NO: 1535561 - RNA, 23 nt, Human adenovirus A
cgcugacgggagcaggaacagag

SEQ ID NO: 1535562 - RNA, 15 nt, Human adenovirus A
uaaauaucgcagcug

SEQ ID NO: 1535563 - RNA, 21 nt, Human adenovirus A
gcuaugaaucuuuaccaggca

SEQ ID NO: 1535564 - RNA, 14 nt, Human adenovirus A
gaacaaacagugcc

SEQ ID NO: 1535565 - RNA, 22 nt, Human adenovirus A
aagcucuguucaauaaauacug

SEQ ID NO: 1535566 - RNA, 20 nt, Human adenovirus A
gcaaagaaacacaugaugga

SEQ ID NO: 1535567 - RNA, 21 nt, Human adenovirus A
auuggaguacaagcuugacug

SEQ ID NO: 1535568 - RNA, 13 nt, Human adenovirus A
aagaagaacgcau

SEQ ID NO: 1535569 - RNA, 15 nt, Human adenovirus A
ccagcucuuggaaua

SEQ ID NO: 1535570 - RNA, 13 nt, Human adenovirus A
cggcaacagcagc

SEQ ID NO: 1535571 - RNA, 14 nt, Human adenovirus A
gaagcuuauguaca

SEQ ID NO: 1535572 - RNA, 15 nt, Human adenovirus A
aguguuaaccauugu

SEQ ID NO: 1535573 - RNA, 18 nt, Human adenovirus A
auuggucccauccaaguu

SEQ ID NO: 1535574 - RNA, 21 nt, Human adenovirus A
ucgucuuauuuuccuucuucc

SEQ ID NO: 1535575 - RNA, 14 nt, Human adenovirus A
agauucuucuuccc

SEQ ID NO: 1535576 - RNA, 15 nt, Human adenovirus A
gcaaacuacauugca

SEQ ID NO: 1535577 - RNA, 18 nt, Human adenovirus A
gcuugagcgcguggcacg

SEQ ID NO: 1535578 - RNA, 11 nt, Human adenovirus A
uauacaaacuu

SEQ ID NO: 1535579 - RNA, 16 nt, Human adenovirus A
agcauaugaacaaacg

SEQ ID NO: 1535580 - RNA, 19 nt, Human adenovirus A
caccgcgcugcggccauga

SEQ ID NO: 1535581 - RNA, 13 nt, Human adenovirus A
cgucccaaaagca

SEQ ID NO: 1535582 - RNA, 17 nt, Human adenovirus A
gcggccguacaugggca

SEQ ID NO: 1535583 - RNA, 14 nt, Human adenovirus A
uaguuccguaaaga

SEQ ID NO: 1535584 - RNA, 17 nt, Human adenovirus A
guacagaggaaauugug

SEQ ID NO: 1535585 - RNA, 15 nt, Human adenovirus A
cgacgggccaggcgc

SEQ ID NO: 1535586 - RNA, 20 nt, Human adenovirus A
gcaguauaccucuaaaaaca

SEQ ID NO: 1535587 - RNA, 21 nt, Human adenovirus A
cagcugaacgacgaagucaca

SEQ ID NO: 1535588 - RNA, 15 nt, Human adenovirus A
uggcagccaagcgcu

SEQ ID NO: 1535589 - RNA, 14 nt, Human adenovirus A
augcgcauggcuuu

SEQ ID NO: 1535590 - RNA, 19 nt, Human adenovirus A
augcgggagggacaagcuu

SEQ ID NO: 1535591 - RNA, 17 nt, Human adenovirus A
cuaacauguuauuuaaa

SEQ ID NO: 1535592 - RNA, 18 nt, Human adenovirus A
auauaguacugcuuccag

SEQ ID NO: 1535593 - RNA, 13 nt, Human adenovirus A
auagcaaagccau

SEQ ID NO: 1535594 - RNA, 17 nt, Human adenovirus A
gaaaacagcagcgggca

SEQ ID NO: 1535595 - RNA, 15 nt, Human adenovirus A
gccuaaaagcuauuu

SEQ ID NO: 1535596 - RNA, 22 nt, Human adenovirus A
aucauacauaauuuuaaaguaa

SEQ ID NO: 1535597 - RNA, 24 nt, Human adenovirus A
aguaacaacacgggcuggggacug

SEQ ID NO: 1535598 - RNA, 22 nt, Human adenovirus A
uguauaaauucuuaaacaaucu

SEQ ID NO: 1535599 - RNA, 13 nt, Human adenovirus A
auuguaaaugcuu

SEQ ID NO: 1535600 - RNA, 17 nt, Human adenovirus A
uccagguguagguuucu

SEQ ID NO: 1535601 - RNA, 19 nt, Human adenovirus A
cuucugcugcauugccacu

SEQ ID NO: 1535602 - RNA, 21 nt, Human adenovirus A
ccaaauauccaggaggaauau

SEQ ID NO: 1535603 - RNA, 18 nt, Human adenovirus A
aacggguggaaaaacaac

SEQ ID NO: 1535604 - RNA, 23 nt, Human adenovirus A
gaacgguugcuucuauugcuuuu

SEQ ID NO: 1535605 - RNA, 18 nt, Human adenovirus A
agaacacggugaaugugu

SEQ ID NO: 1535606 - RNA, 16 nt, Human adenovirus A
gccuucauuccuucag

SEQ ID NO: 1535607 - RNA, 23 nt, Human adenovirus A
aauuucccucuucccaacuguca

SEQ ID NO: 1535608 - RNA, 19 nt, Human adenovirus A
gaacuauuucuuguucuuc

SEQ ID NO: 1535609 - RNA, 21 nt, Human adenovirus A
gccaacaaaacuuaucagcca

SEQ ID NO: 1535610 - RNA, 16 nt, Human adenovirus A
augauaaccuugcaaa

SEQ ID NO: 1535611 - RNA, 22 nt, Human adenovirus A
cgggcuggggacugggugccgc

SEQ ID NO: 1535612 - RNA, 14 nt, Human adenovirus A
cuuggccaguuccc

SEQ ID NO: 1535613 - RNA, 16 nt, Human adenovirus A
aaagucuacugcaaaa

SEQ ID NO: 1535614 - RNA, 17 nt, Human adenovirus A
ugauggaucuggagcca

SEQ ID NO: 1535615 - RNA, 17 nt, Human adenovirus A
cgccagcaagugccucc

SEQ ID NO: 1535616 - RNA, 23 nt, Human adenovirus A
gcuaaccaggcauggccaucaua

SEQ ID NO: 1535617 - RNA, 15 nt, Human adenovirus A
cugucacugagcaca

SEQ ID NO: 1535618 - RNA, 17 nt, Human adenovirus A
ggccagcauaaaagcuu

SEQ ID NO: 1535619 - RNA, 14 nt, Human adenovirus A
ucaagaaaaaccac

SEQ ID NO: 1535620 - RNA, 24 nt, Human adenovirus A
gucgccgcggcgucagcagacggc

SEQ ID NO: 1535621 - RNA, 20 nt, Human adenovirus A
uguaagcgacgagcaauuaa

SEQ ID NO: 1535622 - RNA, 15 nt, Human adenovirus A
accacucgaguguac

SEQ ID NO: 1535623 - RNA, 22 nt, Human adenovirus A
cuuaugcucccacacgcagcaa

SEQ ID NO: 1535624 - RNA, 19 nt, Human adenovirus A
acgacaacugagguaagug

SEQ ID NO: 1535625 - RNA, 16 nt, Human adenovirus A
agcugagcaaugcuac

SEQ ID NO: 1535626 - RNA, 12 nt, Human adenovirus A
acuuccuucaga

SEQ ID NO: 1535627 - RNA, 18 nt, Human adenovirus A
guuccaguauuuuguaaa

SEQ ID NO: 1535628 - RNA, 13 nt, Human adenovirus A
cuuucaacaaaaa

SEQ ID NO: 1535629 - RNA, 23 nt, Human adenovirus A
cccgcgguuuuggcggccaugca

SEQ ID NO: 1535630 - RNA, 16 nt, Human adenovirus A
aguucaccuccaggua

SEQ ID NO: 1535631 - RNA, 17 nt, Human adenovirus A
agccccuuaccaacacc

SEQ ID NO: 1535632 - RNA, 19 nt, Human adenovirus A
acagguaguuuaagguggu

SEQ ID NO: 1535633 - RNA, 23 nt, Human adenovirus A
ccuccccuguggagccacugcua

SEQ ID NO: 1535634 - RNA, 19 nt, Human adenovirus A
aagcgaccucugaaacaug

SEQ ID NO: 1535635 - RNA, 18 nt, Human adenovirus A
gcucaacgagagcgcuuu

SEQ ID NO: 1535636 - RNA, 18 nt, Human adenovirus A
gcaacgcaccuugcagga

SEQ ID NO: 1535637 - RNA, 22 nt, Human adenovirus A
gugcgcuuuaaacugaggcggc

SEQ ID NO: 1535638 - RNA, 13 nt, Human adenovirus A
ccaccgaaacgca

SEQ ID NO: 1535639 - RNA, 22 nt, Human adenovirus A
uggucccuacccgauaugaugc

SEQ ID NO: 1535640 - RNA, 16 nt, Human adenovirus A
acuuguuuuuucugac

SEQ ID NO: 1535641 - RNA, 18 nt, Human adenovirus A
ggcgaucaucgcggagag

SEQ ID NO: 1535642 - RNA, 15 nt, Human adenovirus A
guagccuugcaggcu

SEQ ID NO: 1535643 - RNA, 15 nt, Human adenovirus A
uaaacaucucauaau

SEQ ID NO: 1535644 - RNA, 20 nt, Human adenovirus A
cauggguguauuggccgggc

SEQ ID NO: 1535645 - RNA, 22 nt, Human adenovirus A
cgacuaaugguuacugaagugc

SEQ ID NO: 1535646 - RNA, 21 nt, Human adenovirus A
ugggaauauagccgccaugga

SEQ ID NO: 1535647 - RNA, 20 nt, Human adenovirus A
ucaaaauaaucaauuuugca

SEQ ID NO: 1535648 - RNA, 13 nt, Human adenovirus A
gcuuaacauagcu

SEQ ID NO: 1535649 - RNA, 15 nt, Human adenovirus A
cgcaggcuugcuaaa

SEQ ID NO: 1535650 - RNA, 19 nt, Human adenovirus A
cuucuacaacgagcaagcc

SEQ ID NO: 1535651 - RNA, 18 nt, Human adenovirus A
aauccucugacuauuuca

SEQ ID NO: 1535652 - RNA, 15 nt, Human adenovirus A
uguggucuagaguua

SEQ ID NO: 1535653 - RNA, 14 nt, Human adenovirus A
ucgcuuucuucugc

SEQ ID NO: 1535654 - RNA, 12 nt, Human adenovirus A
acacaguuuaac

SEQ ID NO: 1535655 - RNA, 15 nt, Human adenovirus A
gcugcgugaggagga

SEQ ID NO: 1535656 - RNA, 15 nt, Human adenovirus A
acauuaggcuccaca

SEQ ID NO: 1535657 - RNA, 20 nt, Human adenovirus A
aaaugguaggacgcugaaac

SEQ ID NO: 1535658 - RNA, 20 nt, Human adenovirus A
gcagucuugaaugcucugga

SEQ ID NO: 1535659 - RNA, 13 nt, Human adenovirus A
gaaaaagcuacau

SEQ ID NO: 1535660 - RNA, 20 nt, Human adenovirus A
ucaaugcuucugaaacaaau

SEQ ID NO: 1535661 - RNA, 21 nt, Human adenovirus A
ucauccacaucuacaaagcgg

SEQ ID NO: 1535662 - RNA, 22 nt, Human adenovirus A
ucgccagcaagugccuccucag

SEQ ID NO: 1535663 - RNA, 17 nt, Human adenovirus A
gcuuuuuugaguacuca

SEQ ID NO: 1535664 - RNA, 23 nt, Human adenovirus A
cugcgcugccguuuuuucagaug

SEQ ID NO: 1535665 - RNA, 16 nt, Human adenovirus A
gcauacaacuacggag

SEQ ID NO: 1535666 - RNA, 19 nt, Human adenovirus A
uucgagaucuaggcugugg

SEQ ID NO: 1535667 - RNA, 20 nt, Human adenovirus A
aagauccguacaaggcauug

SEQ ID NO: 1535668 - RNA, 18 nt, Human adenovirus A
cuucccaaucccuaccca

SEQ ID NO: 1535669 - RNA, 23 nt, Human adenovirus A
uugcaagaggagaaggaggagga

SEQ ID NO: 1535670 - RNA, 18 nt, Human adenovirus A
cuaucaaacuauauaaau

SEQ ID NO: 1535671 - RNA, 18 nt, Human adenovirus A
cacgguuccacggugcac

SEQ ID NO: 1535672 - RNA, 24 nt, Human adenovirus A
aaaaucuaagccaugcaaauaguu

SEQ ID NO: 1535673 - RNA, 23 nt, Human adenovirus A
cuuaguaauggaguuggaaacug

SEQ ID NO: 1535674 - RNA, 17 nt, Human adenovirus A
aauugaaguaagcuguu

SEQ ID NO: 1535675 - RNA, 12 nt, Human adenovirus A
uaaagaguaaaa

SEQ ID NO: 1535676 - RNA, 14 nt, Human adenovirus A
accauccaauggau

SEQ ID NO: 1535677 - RNA, 12 nt, Human adenovirus A
ccccaaaagccc

SEQ ID NO: 1535678 - RNA, 14 nt, Human adenovirus A
augccaacaaaacu

SEQ ID NO: 1535679 - RNA, 13 nt, Human adenovirus A
aagucaacccaaa

SEQ ID NO: 1535680 - RNA, 20 nt, Human adenovirus A
cuccagacaacuucauuuuc

SEQ ID NO: 1535681 - RNA, 21 nt, Human adenovirus A
cgcgcuuuggaggcagcugga

SEQ ID NO: 1535682 - RNA, 16 nt, Human adenovirus A
gccagcagcaaagaaa

SEQ ID NO: 1535683 - RNA, 14 nt, Human adenovirus A
gacaacagcgggga

SEQ ID NO: 1535684 - RNA, 13 nt, Human adenovirus A
aaugcucuggaca

SEQ ID NO: 1535685 - RNA, 17 nt, Human adenovirus A
guacacuaaugaggcuu

SEQ ID NO: 1535686 - RNA, 15 nt, Human adenovirus A
ugaaugcucuggaca

SEQ ID NO: 1535687 - RNA, 15 nt, Human adenovirus A
ccgguugaaacagac

SEQ ID NO: 1535688 - RNA, 21 nt, Human adenovirus A
cugacacuguggacaacuccu

SEQ ID NO: 1535689 - RNA, 17 nt, Human adenovirus A
uggaaaaaaugaaaguu

SEQ ID NO: 1535690 - RNA, 17 nt, Human adenovirus A
uucgagaucuaggcugu

SEQ ID NO: 1535691 - RNA, 19 nt, Human adenovirus A
cuuggaauaaaauuucuag

SEQ ID NO: 1535692 - RNA, 15 nt, Human adenovirus A
ugaugugaugaaagu

SEQ ID NO: 1535693 - RNA, 12 nt, Human adenovirus A
caaauagcucuu

SEQ ID NO: 1535694 - RNA, 18 nt, Human adenovirus A
accuuuaauacugaaaaa

SEQ ID NO: 1535695 - RNA, 21 nt, Human adenovirus A
cauaacaucaggagcagaaau

SEQ ID NO: 1535696 - RNA, 15 nt, Human adenovirus A
acugguuagagccau

SEQ ID NO: 1535697 - RNA, 15 nt, Human adenovirus A
gcuuuggaggcagcu

SEQ ID NO: 1535698 - RNA, 18 nt, Human adenovirus A
gguggagauuuaaaaacc

SEQ ID NO: 1535699 - RNA, 11 nt, Human adenovirus A
gucccauccaa

SEQ ID NO: 1535700 - RNA, 15 nt, Human adenovirus A
cacaaaacacaaauu

SEQ ID NO: 1535701 - RNA, 16 nt, Human adenovirus A
cagccacaccgcggcg

SEQ ID NO: 1535702 - RNA, 16 nt, Human adenovirus A
uaaauggauacucuuu

SEQ ID NO: 1535703 - RNA, 16 nt, Human adenovirus A
auaaucuccaaauaaa

SEQ ID NO: 1535704 - RNA, 16 nt, Human adenovirus A
caaugcagcuguggag

SEQ ID NO: 1535705 - RNA, 16 nt, Human adenovirus A
gcaacuauuggacccu

SEQ ID NO: 1535706 - RNA, 14 nt, Human adenovirus A
aaagaccccauugu

SEQ ID NO: 1535707 - RNA, 22 nt, Human adenovirus A
cuaaaugcaucauuacuucaaa

SEQ ID NO: 1535708 - RNA, 16 nt, Human adenovirus A
acgaacugaaaauaaa

SEQ ID NO: 1535709 - RNA, 20 nt, Human adenovirus A
uaggggaugguuuaacauuc

SEQ ID NO: 1535710 - RNA, 18 nt, Human adenovirus A
uugcgcuauguacagcaa

SEQ ID NO: 1535711 - RNA, 20 nt, Human adenovirus A
caaugcagcaaacacugcuc

SEQ ID NO: 1535712 - RNA, 17 nt, Human adenovirus A
ugacaaugaauaagcca

SEQ ID NO: 1535713 - RNA, 15 nt, Human adenovirus A
gaacaauuucaucaa

SEQ ID NO: 1535714 - RNA, 15 nt, Human adenovirus A
aagcuaauaccuguc

SEQ ID NO: 1535715 - RNA, 21 nt, Human adenovirus A
ugauagagauaagcaggaaaa

SEQ ID NO: 1535716 - RNA, 14 nt, Human adenovirus A
aggaggaagaacau

SEQ ID NO: 1535717 - RNA, 13 nt, Human adenovirus A
auugauacuuguu

SEQ ID NO: 1535718 - RNA, 18 nt, Human adenovirus A
cugcuaaacucacauugu

SEQ ID NO: 1535719 - RNA, 21 nt, Human adenovirus A
caggaaaaaaaagaaaguuua

SEQ ID NO: 1535720 - RNA, 15 nt, Human adenovirus A
cgagcagcaaaugcc

SEQ ID NO: 1535721 - RNA, 19 nt, Human adenovirus A
cgggcagccugucuacaaa

SEQ ID NO: 1535722 - RNA, 15 nt, Human adenovirus A
auguucgaagcuaau

SEQ ID NO: 1535723 - RNA, 18 nt, Human adenovirus A
acucuccaauuuguggag

SEQ ID NO: 1535724 - RNA, 14 nt, Human adenovirus A
gcaaagaaacacau

SEQ ID NO: 1535725 - RNA, 13 nt, Human adenovirus A
uuuccaaaugccc

SEQ ID NO: 1535726 - RNA, 20 nt, Human adenovirus A
aacagucaguguccaucagc

SEQ ID NO: 1535727 - RNA, 21 nt, Human adenovirus A
gauuucuaacuuguuucuagu

SEQ ID NO: 1535728 - RNA, 18 nt, Human adenovirus A
uggaauuauguaagguua

SEQ ID NO: 1535729 - RNA, 15 nt, Human adenovirus A
guuuccgauaaugag

SEQ ID NO: 1535730 - RNA, 14 nt, Human adenovirus A
ggacuuggaagaau

SEQ ID NO: 1535731 - RNA, 15 nt, Human adenovirus A
ucauccgcccaaacu

SEQ ID NO: 1535732 - RNA, 19 nt, Human adenovirus A
guagcugcaguuugucauu

SEQ ID NO: 1535733 - RNA, 16 nt, Human adenovirus A
gauggaucaaaaacaa

SEQ ID NO: 1535734 - RNA, 22 nt, Human adenovirus A
ugcucguaaaaucuacaaaagu

SEQ ID NO: 1535735 - RNA, 13 nt, Human adenovirus A
uggaacaccagca

SEQ ID NO: 1535736 - RNA, 20 nt, Human adenovirus A
uacaaaucagaagccagcag

SEQ ID NO: 1535737 - RNA, 21 nt, Human adenovirus A
cuuuucuucguugagccaugu

SEQ ID NO: 1535738 - RNA, 22 nt, Human adenovirus A
ugaaauaaagcguucuguggau

SEQ ID NO: 1535739 - RNA, 23 nt, Human adenovirus A
gaaggucagauucuucuucccaa

SEQ ID NO: 1535740 - RNA, 22 nt, Human adenovirus A
ccuacguuuacaaagcacuggg

SEQ ID NO: 1535741 - RNA, 14 nt, Human adenovirus A
uugaacaauuaaaa

SEQ ID NO: 1535742 - RNA, 18 nt, Human adenovirus A
cuuuaauacugaaaaaua

SEQ ID NO: 1535743 - RNA, 17 nt, Human adenovirus A
gccucauacaagagcua

SEQ ID NO: 1535744 - RNA, 22 nt, Human adenovirus A
gaggguaacuauucggaaacca

SEQ ID NO: 1535745 - RNA, 13 nt, Human adenovirus A
caaaaaaaaagcg

SEQ ID NO: 1535746 - RNA, 18 nt, Human adenovirus A
guucuccccacgugugcc

SEQ ID NO: 1535747 - RNA, 17 nt, Human adenovirus A
guugcuuuccaaaugcc

SEQ ID NO: 1535748 - RNA, 16 nt, Human adenovirus A
gcacgagccagcugaa

SEQ ID NO: 1535749 - RNA, 13 nt, Human adenovirus A
cggccagccaagc

SEQ ID NO: 1535750 - RNA, 17 nt, Human adenovirus A
auccuaggcaaagaaac

SEQ ID NO: 1535751 - RNA, 21 nt, Human adenovirus A
uaugcucccacacgcagcaac

SEQ ID NO: 1535752 - RNA, 18 nt, Human adenovirus A
ugaaaaaccaacaaacac

SEQ ID NO: 1535753 - RNA, 20 nt, Human adenovirus A
acuugggaaauuugucaugg

SEQ ID NO: 1535754 - RNA, 16 nt, Human adenovirus A
gaacacuuagagggag

SEQ ID NO: 1535755 - RNA, 17 nt, Human adenovirus A
ugcguuucuuaccuugc

SEQ ID NO: 1535756 - RNA, 15 nt, Human adenovirus A
gcaagaggagaagga

SEQ ID NO: 1535757 - RNA, 17 nt, Human adenovirus A
acagcgcgcaaguugac

SEQ ID NO: 1535758 - RNA, 13 nt, Human adenovirus A
auuuuaacuguga

SEQ ID NO: 1535759 - RNA, 14 nt, Human adenovirus A
agucauauagcuca

SEQ ID NO: 1535760 - RNA, 13 nt, Human adenovirus A
aaaagagccacag

SEQ ID NO: 1535761 - RNA, 18 nt, Human adenovirus A
cauguauaauaaaacugg

SEQ ID NO: 1535762 - RNA, 21 nt, Human adenovirus A
accucccgauaccaaaaacac

SEQ ID NO: 1535763 - RNA, 13 nt, Human adenovirus A
gagauaagcagga

SEQ ID NO: 1535764 - RNA, 19 nt, Human adenovirus A
gguaggcaauuucugccau

SEQ ID NO: 1535765 - RNA, 12 nt, Human adenovirus A
aagcaaaccacu

SEQ ID NO: 1535766 - RNA, 19 nt, Human adenovirus A
caauaaaacaaggagccgc

SEQ ID NO: 1535767 - RNA, 19 nt, Human adenovirus A
ccacgccuuacauguggag

SEQ ID NO: 1535768 - RNA, 18 nt, Human adenovirus A
uaguacuccuauguaagu

SEQ ID NO: 1535769 - RNA, 17 nt, Human adenovirus A
ugggacauaauuucccu

SEQ ID NO: 1535770 - RNA, 23 nt, Human adenovirus A
uucagaauaaaacaagccgcagg

SEQ ID NO: 1535771 - RNA, 15 nt, Human adenovirus A
uaaaguaaauuaaau

SEQ ID NO: 1535772 - RNA, 13 nt, Human adenovirus A
ucuucuucccaau

SEQ ID NO: 1535773 - RNA, 16 nt, Human adenovirus A
auuggaaagcagcuug

SEQ ID NO: 1535774 - RNA, 15 nt, Human adenovirus A
uagcagccuuuauuu

SEQ ID NO: 1535775 - RNA, 16 nt, Human adenovirus A
ccuucuuuauguuuua

SEQ ID NO: 1535776 - RNA, 23 nt, Human adenovirus A
acccuucgcuaugaaucuuuacc

SEQ ID NO: 1535777 - RNA, 16 nt, Human adenovirus A
cuuccucguugcgggg

SEQ ID NO: 1535778 - RNA, 17 nt, Human adenovirus A
agcaaaccacugcaaug

SEQ ID NO: 1535779 - RNA, 20 nt, Human adenovirus A
guacuuaaaaaaacaaaacc

SEQ ID NO: 1535780 - RNA, 23 nt, Human adenovirus A
gcaggacuuuccggagaaagaau

SEQ ID NO: 1535781 - RNA, 15 nt, Human adenovirus A
aggcggucugccauu

SEQ ID NO: 1535782 - RNA, 21 nt, Human adenovirus A
gacaccgcccaggcaggcgcg

SEQ ID NO: 1535783 - RNA, 17 nt, Human adenovirus A
uggaaaaacuuggaaac

SEQ ID NO: 1535784 - RNA, 21 nt, Human adenovirus A
aggacccccagacacggagag

SEQ ID NO: 1535785 - RNA, 22 nt, Human adenovirus A
cccgcgaaaaaaaucacuuccg

SEQ ID NO: 1535786 - RNA, 13 nt, Human adenovirus A
uucccucuuccca

SEQ ID NO: 1535787 - RNA, 19 nt, Human adenovirus A
uaaaaacacacacaaaaca

SEQ ID NO: 1535788 - RNA, 21 nt, Human adenovirus A
agacugcauuuaccuuuuccu

SEQ ID NO: 1535789 - RNA, 20 nt, Human adenovirus A
cauuaagaacacggugaaug

SEQ ID NO: 1535790 - RNA, 23 nt, Human adenovirus A
gagcuguccaugguaucagucag

SEQ ID NO: 1535791 - RNA, 13 nt, Human adenovirus A
ugcccucacacuu

SEQ ID NO: 1535792 - RNA, 17 nt, Human adenovirus A
uagccgcagcaccugga

SEQ ID NO: 1535793 - RNA, 18 nt, Human adenovirus A
cagaggaggaggaggaag

SEQ ID NO: 1535794 - RNA, 19 nt, Human adenovirus A
uuugcucgagacaucugug

SEQ ID NO: 1535795 - RNA, 14 nt, Human adenovirus A
uggacggagccagc

SEQ ID NO: 1535796 - RNA, 19 nt, Human adenovirus A
guugcaacgcaccuugcag

SEQ ID NO: 1535797 - RNA, 17 nt, Human adenovirus A
uaaguuuaaaggcauua

SEQ ID NO: 1535798 - RNA, 13 nt, Human adenovirus A
aagagccacagcu

SEQ ID NO: 1535799 - RNA, 16 nt, Human adenovirus A
guuauguaugcccagc

SEQ ID NO: 1535800 - RNA, 17 nt, Human adenovirus A
guuugcuaacagcucuc

SEQ ID NO: 1535801 - RNA, 14 nt, Human adenovirus A
augcagaggaaacc

SEQ ID NO: 1535802 - RNA, 13 nt, Human adenovirus A
ccagccuucuggc

SEQ ID NO: 1535803 - RNA, 16 nt, Human adenovirus A
gcgcacugggccagga

SEQ ID NO: 1535804 - RNA, 21 nt, Human adenovirus A
ggucgaccuguggcaccugca

SEQ ID NO: 1535805 - RNA, 14 nt, Human adenovirus A
cacaaugcauuaau

SEQ ID NO: 1535806 - RNA, 18 nt, Human adenovirus A
agcgccagucgccgcaga

SEQ ID NO: 1535807 - RNA, 16 nt, Human adenovirus A
guagccuugcaggcuu

SEQ ID NO: 1535808 - RNA, 13 nt, Human adenovirus A
acucucuggggaa

SEQ ID NO: 1535809 - RNA, 19 nt, Human adenovirus A
aguucgccuacacaacaca

SEQ ID NO: 1535810 - RNA, 17 nt, Human adenovirus A
aggcaucuagccaguca

SEQ ID NO: 1535811 - RNA, 19 nt, Human adenovirus A
cuuacccgcagcugucucu

SEQ ID NO: 1535812 - RNA, 23 nt, Human adenovirus A
aaggaagcugcuguucuuaguag

SEQ ID NO: 1535813 - RNA, 17 nt, Human adenovirus A
cgucgaguuugugcgcu

SEQ ID NO: 1535814 - RNA, 23 nt, Human adenovirus A
uuugaaccugaaagaaaguucaa

SEQ ID NO: 1535815 - RNA, 11 nt, Human adenovirus A
cuacaucuuuu

SEQ ID NO: 1535816 - RNA, 13 nt, Human adenovirus A
acuacuaccacug

SEQ ID NO: 1535817 - RNA, 18 nt, Human adenovirus A
cugaagugccucaaagug

SEQ ID NO: 1535818 - RNA, 14 nt, Human adenovirus A
uucagcaguugcaa

SEQ ID NO: 1535819 - RNA, 19 nt, Human adenovirus A
caaauauuuacuaugauuu

SEQ ID NO: 1535820 - RNA, 18 nt, Human adenovirus A
caacaucaugaaaacagc

SEQ ID NO: 1535821 - RNA, 18 nt, Human adenovirus A
aaacugaggcggcuggug

SEQ ID NO: 1535822 - RNA, 15 nt, Human adenovirus A
uccaaccaaaggaga

SEQ ID NO: 1535823 - RNA, 14 nt, Human adenovirus A
cauagaaaaucuuu

SEQ ID NO: 1535824 - RNA, 13 nt, Human adenovirus A
caaaaccaggucc

SEQ ID NO: 1535825 - RNA, 17 nt, Human adenovirus A
aacaaugaaaguugcau

SEQ ID NO: 1535826 - RNA, 13 nt, Human adenovirus A
gcaaagccagccu

SEQ ID NO: 1535827 - RNA, 13 nt, Human adenovirus A
uauaguggcacaa

SEQ ID NO: 1535828 - RNA, 13 nt, Human adenovirus A
cuaggaaaacaaa

SEQ ID NO: 1535829 - RNA, 14 nt, Human adenovirus A
auguaucuggacau

SEQ ID NO: 1535830 - RNA, 22 nt, Human adenovirus A
auaaaacuaccugauaacaaga

SEQ ID NO: 1535831 - RNA, 17 nt, Human adenovirus A
aaauauuuacuaugauu

SEQ ID NO: 1535832 - RNA, 16 nt, Human adenovirus A
gaacucgagugcaugc

SEQ ID NO: 1535833 - RNA, 14 nt, Human adenovirus A
aguauaagguauau

SEQ ID NO: 1535834 - RNA, 13 nt, Human adenovirus A
gcggcaagaacaa

SEQ ID NO: 1535835 - RNA, 17 nt, Human adenovirus A
gucacacccuccguguu

SEQ ID NO: 1535836 - RNA, 13 nt, Human adenovirus A
uuauuugaacaca

SEQ ID NO: 1535837 - RNA, 20 nt, Human adenovirus A
gggcccaagaugugugcgcu

SEQ ID NO: 1535838 - RNA, 15 nt, Human adenovirus A
gagcaccccuuccca

SEQ ID NO: 1535839 - RNA, 22 nt, Human adenovirus A
ucaaacaccugcaguaaauuca

SEQ ID NO: 1535840 - RNA, 13 nt, Human adenovirus A
agcgcacuggcau

SEQ ID NO: 1535841 - RNA, 14 nt, Human adenovirus A
cuggcuguggguga

SEQ ID NO: 1535842 - RNA, 20 nt, Human adenovirus A
uccaaauguucaacaacagc

SEQ ID NO: 1535843 - RNA, 14 nt, Human adenovirus A
gauccagaggagga

SEQ ID NO: 1535844 - RNA, 12 nt, Human adenovirus A
ccuguggagcca

SEQ ID NO: 1535845 - RNA, 16 nt, Human adenovirus A
cguauuauggcuuuaa

SEQ ID NO: 1535846 - RNA, 14 nt, Human adenovirus A
agauuaccacgccc

SEQ ID NO: 1535847 - RNA, 21 nt, Human adenovirus A
agcccgaaguugacuggcaug

SEQ ID NO: 1535848 - RNA, 12 nt, Human adenovirus A
aaauguguacuu

SEQ ID NO: 1535849 - RNA, 15 nt, Human adenovirus A
cagaauaaaacaagc

SEQ ID NO: 1535850 - RNA, 13 nt, Human adenovirus A
agcagugcggccu

SEQ ID NO: 1535851 - RNA, 21 nt, Human adenovirus A
caaaagcaaccaaaugagcaa

SEQ ID NO: 1535852 - RNA, 13 nt, Human adenovirus A
gcuaagggacaag

SEQ ID NO: 1535853 - RNA, 20 nt, Human adenovirus A
aacaacucuacuuaaaagca

SEQ ID NO: 1535854 - RNA, 13 nt, Human adenovirus A
agaagagcugcug

SEQ ID NO: 1535855 - RNA, 16 nt, Human adenovirus A
gugauggcagcggcgc

SEQ ID NO: 1535856 - RNA, 16 nt, Human adenovirus A
uaggauagcaccugcc

SEQ ID NO: 1535857 - RNA, 22 nt, Human adenovirus A
ccuccuuugccagaacccacua

SEQ ID NO: 1535858 - RNA, 15 nt, Human adenovirus A
ccaagcaaguacaaa

SEQ ID NO: 1535859 - RNA, 12 nt, Human adenovirus A
cuggagaauaag

SEQ ID NO: 1535860 - RNA, 21 nt, Human adenovirus A
aagaacacggugaauguguuc

SEQ ID NO: 1535861 - RNA, 11 nt, Human adenovirus A
cccaccguggc

SEQ ID NO: 1535862 - RNA, 20 nt, Human adenovirus A
ccaggcauuuccaggugggg

SEQ ID NO: 1535863 - RNA, 19 nt, Human adenovirus A
cuccccacagcuggcgcac

SEQ ID NO: 1535864 - RNA, 18 nt, Human adenovirus A
caaagaugcaaacuugca

SEQ ID NO: 1535865 - RNA, 13 nt, Human adenovirus A
cgaggugcagcug

SEQ ID NO: 1535866 - RNA, 18 nt, Human adenovirus A
uacauuaggcuccacacc

SEQ ID NO: 1535867 - RNA, 14 nt, Human adenovirus A
ucagauagcaagcg

SEQ ID NO: 1535868 - RNA, 17 nt, Human adenovirus A
gcagcaaugcuuggaag

SEQ ID NO: 1535869 - RNA, 14 nt, Human adenovirus A
cucgaccacaggug

SEQ ID NO: 1535870 - RNA, 20 nt, Human adenovirus A
ccuacuucacccugggaaac

SEQ ID NO: 1535871 - RNA, 15 nt, Human adenovirus A
aauaauaaaaccauu

SEQ ID NO: 1535872 - RNA, 19 nt, Human adenovirus A
ggucuacuguugaugcagu

SEQ ID NO: 1535873 - RNA, 14 nt, Human adenovirus A
acggaacuacucag

SEQ ID NO: 1535874 - RNA, 22 nt, Human adenovirus A
caugcaucguuuuuucuccgac

SEQ ID NO: 1535875 - RNA, 18 nt, Human adenovirus A
ucuaagccaugcaaauag

SEQ ID NO: 1535876 - RNA, 15 nt, Human adenovirus A
ccggcguagaccaac

SEQ ID NO: 1535877 - RNA, 16 nt, Human adenovirus A
gcccacaaggaaauga

SEQ ID NO: 1535878 - RNA, 19 nt, Human adenovirus A
cuaacugcucagcuggaag

SEQ ID NO: 1535879 - RNA, 18 nt, Human adenovirus A
augggaggaaagacagcc

SEQ ID NO: 1535880 - RNA, 15 nt, Human adenovirus A
ugaaaguagaaaucu

SEQ ID NO: 1535881 - RNA, 23 nt, Human adenovirus A
caaccguuuagagccgcggcccg

SEQ ID NO: 1535882 - RNA, 23 nt, Human adenovirus A
cuggccauaauguaacccuuccc

SEQ ID NO: 1535883 - RNA, 17 nt, Human adenovirus A
gcagccaaaacucaggu

SEQ ID NO: 1535884 - RNA, 12 nt, Human adenovirus A
aagacagaaaua

SEQ ID NO: 1535885 - RNA, 14 nt, Human adenovirus A
ugaucgcucuucaa

SEQ ID NO: 1535886 - RNA, 15 nt, Human adenovirus A
ucggcggacagagca

SEQ ID NO: 1535887 - RNA, 21 nt, Human adenovirus A
gugccuaugacccuugagcug

SEQ ID NO: 1535888 - RNA, 18 nt, Human adenovirus A
gaaacacauuaaaaugug

SEQ ID NO: 1535889 - RNA, 13 nt, Human adenovirus A
cuuucagcccaug

SEQ ID NO: 1535890 - RNA, 12 nt, Human adenovirus A
gaaaaauaauau

SEQ ID NO: 1535891 - RNA, 22 nt, Human adenovirus A
ucggggucucaauuaguaacaa

SEQ ID NO: 1535892 - RNA, 23 nt, Human adenovirus A
agaaaaacaguacaaagccaggc

SEQ ID NO: 1535893 - RNA, 18 nt, Human adenovirus A
uccccagacaguuucauc

SEQ ID NO: 1535894 - RNA, 15 nt, Human adenovirus A
gcucgcccgggacag

SEQ ID NO: 1535895 - RNA, 18 nt, Human adenovirus A
caaguucaaagaagagcu

SEQ ID NO: 1535896 - RNA, 21 nt, Human adenovirus A
guaaaugcuuuguuggauagc

SEQ ID NO: 1535897 - RNA, 19 nt, Human adenovirus A
gcccauugagacaagugug

SEQ ID NO: 1535898 - RNA, 18 nt, Human adenovirus A
uaacaaaauucgcaggag

SEQ ID NO: 1535899 - RNA, 22 nt, Human adenovirus A
caguagauuuacauuaggcucc

SEQ ID NO: 1535900 - RNA, 15 nt, Human adenovirus A
uuugugccucgucag

SEQ ID NO: 1535901 - RNA, 14 nt, Human adenovirus A
aucauuaagaacac

SEQ ID NO: 1535902 - RNA, 18 nt, Human adenovirus A
acuguaagaggagacaac

SEQ ID NO: 1535903 - RNA, 13 nt, Human adenovirus A
ccgaggugacaug

SEQ ID NO: 1535904 - RNA, 14 nt, Human adenovirus A
auaaccaaucuaca

SEQ ID NO: 1535905 - RNA, 18 nt, Human adenovirus A
cagacgcaugaagggugg

SEQ ID NO: 1535906 - RNA, 17 nt, Human adenovirus A
guacacaaugcauuaau

SEQ ID NO: 1535907 - RNA, 13 nt, Human adenovirus A
ugcgcauggcuuu

SEQ ID NO: 1535908 - RNA, 17 nt, Human adenovirus A
ugcauuaucaugaaacu

SEQ ID NO: 1535909 - RNA, 14 nt, Human adenovirus A
uguccagauuucag

SEQ ID NO: 1535910 - RNA, 18 nt, Human adenovirus A
cuucagcguccaugaaug

SEQ ID NO: 1535911 - RNA, 15 nt, Human adenovirus A
uauaaucuccaaaua

SEQ ID NO: 1535912 - RNA, 17 nt, Human adenovirus A
gauucauauuguggaga

SEQ ID NO: 1535913 - RNA, 15 nt, Human adenovirus A
cgagucaccaucacu

SEQ ID NO: 1535914 - RNA, 21 nt, Human adenovirus A
ucauguggucaggucuaucaa

SEQ ID NO: 1535915 - RNA, 18 nt, Human adenovirus A
uggaacugcagacagugg

SEQ ID NO: 1535916 - RNA, 16 nt, Human adenovirus A
ucaucucuacagcccc

SEQ ID NO: 1535917 - RNA, 15 nt, Human adenovirus A
cgcugcagcuuccgc

SEQ ID NO: 1535918 - RNA, 13 nt, Human adenovirus A
gggcauuaaagca

SEQ ID NO: 1535919 - RNA, 23 nt, Human adenovirus A
aaaaagcaaaguacaaccacucu

SEQ ID NO: 1535920 - RNA, 11 nt, Human adenovirus A
ucuuggagugu

SEQ ID NO: 1535921 - RNA, 18 nt, Human adenovirus A
gcucccacccaugauguu

SEQ ID NO: 1535922 - RNA, 14 nt, Human adenovirus A
cucaccacugaaac

SEQ ID NO: 1535923 - RNA, 23 nt, Human adenovirus A
auaucuuuuaacaacaagcuaau

SEQ ID NO: 1535924 - RNA, 20 nt, Human adenovirus A
cuacgugcgccaagccugua

SEQ ID NO: 1535925 - RNA, 18 nt, Human adenovirus A
gcugcuacuaacauuaaa

SEQ ID NO: 1535926 - RNA, 13 nt, Human adenovirus A
guccuccuucugu

SEQ ID NO: 1535927 - RNA, 13 nt, Human adenovirus A
cucuaccucgcgg

SEQ ID NO: 1535928 - RNA, 17 nt, Human adenovirus A
agccgcaaguaggacca

SEQ ID NO: 1535929 - RNA, 19 nt, Human adenovirus A
uccuguaguugcagcagaa

SEQ ID NO: 1535930 - RNA, 21 nt, Human adenovirus A
ugccccccuccccuguggagc

SEQ ID NO: 1535931 - RNA, 15 nt, Human adenovirus A
gccgcagcaccugga

SEQ ID NO: 1535932 - RNA, 19 nt, Human adenovirus A
acaguagcugcagagcuag

SEQ ID NO: 1535933 - RNA, 21 nt, Human adenovirus A
cugucgagcuaaccgcagccg

SEQ ID NO: 1535934 - RNA, 17 nt, Human adenovirus A
agcauaaaagcuucaau

SEQ ID NO: 1535935 - RNA, 19 nt, Human adenovirus A
acugggaguugcgagcugc

SEQ ID NO: 1535936 - RNA, 16 nt, Human adenovirus A
cuauauuaacuuuaua

SEQ ID NO: 1535937 - RNA, 23 nt, Human adenovirus A
accagagcaccccuucccaccuu

SEQ ID NO: 1535938 - RNA, 13 nt, Human adenovirus A
cgauuaagacaua

SEQ ID NO: 1535939 - RNA, 23 nt, Human adenovirus A
uggucuggcuucgggaauuaaug

SEQ ID NO: 1535940 - RNA, 22 nt, Human adenovirus A
gccuguugaauuuggguaaggg

SEQ ID NO: 1535941 - RNA, 24 nt, Human adenovirus A
aagacagaaauacagagcugucau

SEQ ID NO: 1535942 - RNA, 17 nt, Human adenovirus A
cuuagauuuuucaucug

SEQ ID NO: 1535943 - RNA, 16 nt, Human adenovirus A
gacagaacgugcuaca

SEQ ID NO: 1535944 - RNA, 17 nt, Human adenovirus A
gcaaaucucagaaagcc

SEQ ID NO: 1535945 - RNA, 11 nt, Human adenovirus A
aaugcucuuug

SEQ ID NO: 1535946 - RNA, 21 nt, Human adenovirus A
uuucaaacuuuacaaaccacu

SEQ ID NO: 1535947 - RNA, 12 nt, Human adenovirus A
caccaccaaacu

SEQ ID NO: 1535948 - RNA, 23 nt, Human adenovirus A
caacguagcuuuugacuguuccu

SEQ ID NO: 1535949 - RNA, 11 nt, Human adenovirus A
uggaggcagcu

SEQ ID NO: 1535950 - RNA, 16 nt, Human adenovirus A
aagcgucacuacagac

SEQ ID NO: 1535951 - RNA, 15 nt, Human adenovirus A
cagccuacaaugcaa

SEQ ID NO: 1535952 - RNA, 15 nt, Human adenovirus A
ucuucuaucaucaaa

SEQ ID NO: 1535953 - RNA, 20 nt, Human adenovirus A
aagacagaaauacagagcug

SEQ ID NO: 1535954 - RNA, 15 nt, Human adenovirus A
cgauuuuccaaaugu

SEQ ID NO: 1535955 - RNA, 23 nt, Human adenovirus A
cacguucaauaguggcugcaagg

SEQ ID NO: 1535956 - RNA, 18 nt, Human adenovirus A
aggaguuaaauaaugcau

SEQ ID NO: 1535957 - RNA, 11 nt, Human adenovirus A
ggcucuuuuaa

SEQ ID NO: 1535958 - RNA, 18 nt, Human adenovirus A
cagaacauacaacuugca

SEQ ID NO: 1535959 - RNA, 21 nt, Human adenovirus A
uacacccccuuuuacuucuuc

SEQ ID NO: 1535960 - RNA, 17 nt, Human adenovirus A
caacagcuauugcaaac

SEQ ID NO: 1535961 - RNA, 16 nt, Human adenovirus A
cgagaacggagagggu

SEQ ID NO: 1535962 - RNA, 19 nt, Human adenovirus A
cuauauacaacucuacaaa

SEQ ID NO: 1535963 - RNA, 17 nt, Human adenovirus A
gcaacguuggcagcgac

SEQ ID NO: 1535964 - RNA, 17 nt, Human adenovirus A
ucggcaacagcagcaac

SEQ ID NO: 1535965 - RNA, 19 nt, Human adenovirus A
cuggggugccuaauuguau

SEQ ID NO: 1535966 - RNA, 21 nt, Human adenovirus A
ggauaauguaaacccuuuuaa

SEQ ID NO: 1535967 - RNA, 17 nt, Human adenovirus A
uacuuguaacuguggaa

SEQ ID NO: 1535968 - RNA, 22 nt, Human adenovirus A
acuagccccugucaacagcauu

SEQ ID NO: 1535969 - RNA, 23 nt, Human adenovirus A
uaaacugaggcggcuggugcuga

SEQ ID NO: 1535970 - RNA, 23 nt, Human adenovirus A
uaaucacacuuacccuuuuaaug

SEQ ID NO: 1535971 - RNA, 12 nt, Human adenovirus A
caacaaggaaag

SEQ ID NO: 1535972 - RNA, 20 nt, Human adenovirus A
cagugccagaagcacuggca

SEQ ID NO: 1535973 - RNA, 14 nt, Human adenovirus A
accgccaugcgcgc

SEQ ID NO: 1535974 - RNA, 13 nt, Human adenovirus A
aaacaaacuacau

SEQ ID NO: 1535975 - RNA, 13 nt, Human adenovirus A
accauccaaugga

SEQ ID NO: 1535976 - RNA, 18 nt, Human adenovirus A
ccuaaaauuuuugaaggu

SEQ ID NO: 1535977 - RNA, 14 nt, Human adenovirus A
cagcaagugccucc

SEQ ID NO: 1535978 - RNA, 23 nt, Human adenovirus A
cuuuuccauuagcauagccaugg

SEQ ID NO: 1535979 - RNA, 13 nt, Human adenovirus A
caaucagugucua

SEQ ID NO: 1535980 - RNA, 20 nt, Human adenovirus A
gcucgcaaguaccgcgcgcc

SEQ ID NO: 1535981 - RNA, 19 nt, Human adenovirus A
ccaguuucaauugcagaac

SEQ ID NO: 1535982 - RNA, 12 nt, Human adenovirus A
acaccuccaccc

SEQ ID NO: 1535983 - RNA, 23 nt, Human adenovirus A
gucauaccuuaaaaacuguucau

SEQ ID NO: 1535984 - RNA, 12 nt, Human adenovirus A
ggcgccaggaug

SEQ ID NO: 1535985 - RNA, 18 nt, Human adenovirus A
ccuuuucuagaacaaaaa

SEQ ID NO: 1535986 - RNA, 21 nt, Human adenovirus A
cuacauuggaguuggaagaag

SEQ ID NO: 1535987 - RNA, 16 nt, Human adenovirus A
cguaacucaaaaacuc

SEQ ID NO: 1535988 - RNA, 22 nt, Human adenovirus A
aaacuggauuugcgcacugaaa

SEQ ID NO: 1535989 - RNA, 20 nt, Human adenovirus A
cauccagauauaguacugcu

SEQ ID NO: 1535990 - RNA, 16 nt, Human adenovirus A
uugaaugcguaaaucu

SEQ ID NO: 1535991 - RNA, 12 nt, Human adenovirus A
uaagcuugcaua

SEQ ID NO: 1535992 - RNA, 16 nt, Human adenovirus A
auauguaucuggacau

SEQ ID NO: 1535993 - RNA, 11 nt, Human adenovirus A
uucuuccaaca

SEQ ID NO: 1535994 - RNA, 23 nt, Human adenovirus A
aaggcauggaaaaacuuggaaac

SEQ ID NO: 1535995 - RNA, 17 nt, Human adenovirus A
ucgcaguauggcagcug

SEQ ID NO: 1535996 - RNA, 16 nt, Human adenovirus A
acaaaugcgaccucag

SEQ ID NO: 1535997 - RNA, 13 nt, Human adenovirus A
gugagggugccac

SEQ ID NO: 1535998 - RNA, 15 nt, Human adenovirus A
aaugcagcuguggag

SEQ ID NO: 1535999 - RNA, 19 nt, Human adenovirus A
cugguucacaccaaacugg

SEQ ID NO: 1536000 - RNA, 14 nt, Human adenovirus A
cacuguaagaggag

SEQ ID NO: 1536001 - RNA, 15 nt, Human adenovirus A
auggaugcgcuccug

SEQ ID NO: 1536002 - RNA, 21 nt, Human adenovirus A
gacugcagguuuagggccggu

SEQ ID NO: 1536003 - RNA, 18 nt, Human adenovirus A
gugccaggcauuuccagg

SEQ ID NO: 1536004 - RNA, 20 nt, Human adenovirus A
uagccugcuuucagcacugc

SEQ ID NO: 1536005 - RNA, 18 nt, Human adenovirus A
ucgcgcacugggccagga

SEQ ID NO: 1536006 - RNA, 14 nt, Human adenovirus A
gcuuaccacucaga

SEQ ID NO: 1536007 - RNA, 19 nt, Human adenovirus A
gcugaggaaaugcgagacu

SEQ ID NO: 1536008 - RNA, 16 nt, Human adenovirus A
gcuacagauccauguu

SEQ ID NO: 1536009 - RNA, 22 nt, Human adenovirus A
aaacagugccuguugaucuguc

SEQ ID NO: 1536010 - RNA, 13 nt, Human adenovirus A
ggcuuaugcaagg

SEQ ID NO: 1536011 - RNA, 20 nt, Human adenovirus A
cggcgguguaugccaacaaa

SEQ ID NO: 1536012 - RNA, 22 nt, Human adenovirus A
ucaccuaccaccuaucccauga

SEQ ID NO: 1536013 - RNA, 14 nt, Human adenovirus A
auuuuccaaauguu

SEQ ID NO: 1536014 - RNA, 12 nt, Human adenovirus A
acucacuuugcc

SEQ ID NO: 1536015 - RNA, 24 nt, Human adenovirus A
aaugcaauaugacuaaggauuggu

SEQ ID NO: 1536016 - RNA, 15 nt, Human adenovirus A
acauuuagaccacug

SEQ ID NO: 1536017 - RNA, 15 nt, Human adenovirus A
cauuuuuuguugcuc

SEQ ID NO: 1536018 - RNA, 20 nt, Human adenovirus A
uacuucaccgcgcaagcuuu

SEQ ID NO: 1536019 - RNA, 16 nt, Human adenovirus A
cggaaugauuaaacaa

SEQ ID NO: 1536020 - RNA, 20 nt, Human adenovirus A
uaccagaaugaucacagcaa

SEQ ID NO: 1536021 - RNA, 17 nt, Human adenovirus A
guuccagauuguggaau

SEQ ID NO: 1536022 - RNA, 14 nt, Human adenovirus A
aagugccuccucag

SEQ ID NO: 1536023 - RNA, 18 nt, Human adenovirus A
cgcccacucuccugagcg

SEQ ID NO: 1536024 - RNA, 22 nt, Human adenovirus A
cucacaaauuugcauuucccaa

SEQ ID NO: 1536025 - RNA, 16 nt, Human adenovirus A
caaacccccaaaagcg

SEQ ID NO: 1536026 - RNA, 17 nt, Human adenovirus A
cucuggcgaacaggaag

SEQ ID NO: 1536027 - RNA, 21 nt, Human adenovirus A
aaauaaugcauuaccagcagc

SEQ ID NO: 1536028 - RNA, 18 nt, Human adenovirus A
acccaguuuuugcagugc

SEQ ID NO: 1536029 - RNA, 17 nt, Human adenovirus A
cacgagccagcugaacg

SEQ ID NO: 1536030 - RNA, 21 nt, Human adenovirus A
acacuuuaauaaaaacacugu

SEQ ID NO: 1536031 - RNA, 14 nt, Human adenovirus A
agaacaaacagugc

SEQ ID NO: 1536032 - RNA, 13 nt, Human adenovirus A
cugcaguaaauuc

SEQ ID NO: 1536033 - RNA, 23 nt, Human adenovirus A
gccacccuacgugccuccccgcu

SEQ ID NO: 1536034 - RNA, 21 nt, Human adenovirus A
ugagacuucccacagccagug

SEQ ID NO: 1536035 - RNA, 13 nt, Human adenovirus A
ccuguucucccca

SEQ ID NO: 1536036 - RNA, 21 nt, Human adenovirus A
uaaauggcgaccucuaacaaa

SEQ ID NO: 1536037 - RNA, 23 nt, Human adenovirus A
aaaggaggaagaacauccaacug

SEQ ID NO: 1536038 - RNA, 20 nt, Human adenovirus A
cuaugaugcgggcagccagg

SEQ ID NO: 1536039 - RNA, 18 nt, Human adenovirus A
gcaaaugcccugcaaaaa

SEQ ID NO: 1536040 - RNA, 17 nt, Human adenovirus A
uagggaugcaaugcuua

SEQ ID NO: 1536041 - RNA, 15 nt, Human adenovirus A
auauccaaaguacua

SEQ ID NO: 1536042 - RNA, 23 nt, Human adenovirus A
aggguuugcaaaccguaaacuua

SEQ ID NO: 1536043 - RNA, 15 nt, Human adenovirus A
ggggcuacugcucau

SEQ ID NO: 1536044 - RNA, 16 nt, Human adenovirus A
acugaugaucuucccg

SEQ ID NO: 1536045 - RNA, 13 nt, Human adenovirus A
caaaccggccaga

SEQ ID NO: 1536046 - RNA, 18 nt, Human adenovirus A
caaccaugaaaacagcau

SEQ ID NO: 1536047 - RNA, 16 nt, Human adenovirus A
ccgaggacgcacuggu

SEQ ID NO: 1536048 - RNA, 15 nt, Human adenovirus A
accuucgagaacuaa

SEQ ID NO: 1536049 - RNA, 16 nt, Human adenovirus A
auuuuauuauuugcug

SEQ ID NO: 1536050 - RNA, 19 nt, Human adenovirus A
auugcgcaaaauugaggaa

SEQ ID NO: 1536051 - RNA, 18 nt, Human adenovirus A
ggugauaagcuccugcau

SEQ ID NO: 1536052 - RNA, 13 nt, Human adenovirus A
aucuguuuggcuc

SEQ ID NO: 1536053 - RNA, 16 nt, Human adenovirus A
cagccaacaucaugaa

SEQ ID NO: 1536054 - RNA, 22 nt, Human adenovirus A
uacuagccccugucaacagcau

SEQ ID NO: 1536055 - RNA, 16 nt, Human adenovirus A
cguagccuugcagcgg

SEQ ID NO: 1536056 - RNA, 19 nt, Human adenovirus A
uacauccuuccauugugcc

SEQ ID NO: 1536057 - RNA, 21 nt, Human adenovirus A
cacuuuaauaaaaacacugug

SEQ ID NO: 1536058 - RNA, 23 nt, Human adenovirus A
uaacaggugaaagugaauacuua

SEQ ID NO: 1536059 - RNA, 16 nt, Human adenovirus A
cucuuggccagcugcc

SEQ ID NO: 1536060 - RNA, 14 nt, Human adenovirus A
ucaucaaacugccu

SEQ ID NO: 1536061 - RNA, 19 nt, Human adenovirus A
gccccaagcuaaccgcuuu

SEQ ID NO: 1536062 - RNA, 17 nt, Human adenovirus A
acggugucagaauaaca

SEQ ID NO: 1536063 - RNA, 20 nt, Human adenovirus A
gagcccgaaguugacuggca

SEQ ID NO: 1536064 - RNA, 13 nt, Human adenovirus A
augugcuguggaa

SEQ ID NO: 1536065 - RNA, 23 nt, Human adenovirus A
uaaucaagacggucagcaaggau

SEQ ID NO: 1536066 - RNA, 23 nt, Human adenovirus A
uaacaaaggugcuucccacauac

SEQ ID NO: 1536067 - RNA, 17 nt, Human adenovirus A
ccuucgaaaugcaggga

SEQ ID NO: 1536068 - RNA, 22 nt, Human adenovirus A
acgcguccaccucacccuuaga

SEQ ID NO: 1536069 - RNA, 19 nt, Human adenovirus A
caagccgcucucaccgcua

SEQ ID NO: 1536070 - RNA, 21 nt, Human adenovirus A
cccucccucuuggccagcugc

SEQ ID NO: 1536071 - RNA, 21 nt, Human adenovirus A
aaugccuuaccagaaaaacag

SEQ ID NO: 1536072 - RNA, 22 nt, Human adenovirus A
gauuugcgcacugaaaaaccaa

SEQ ID NO: 1536073 - RNA, 22 nt, Human adenovirus A
aaugguuacugaagugccucaa

SEQ ID NO: 1536074 - RNA, 16 nt, Human adenovirus A
cuacgugagaauuguu

SEQ ID NO: 1536075 - RNA, 12 nt, Human adenovirus A
aacuuuagaaag

SEQ ID NO: 1536076 - RNA, 14 nt, Human adenovirus A
cagauccguuaaug

SEQ ID NO: 1536077 - RNA, 15 nt, Human adenovirus A
gcuucagaugacugg

SEQ ID NO: 1536078 - RNA, 15 nt, Human adenovirus A
uauggauguuggaag

SEQ ID NO: 1536079 - RNA, 13 nt, Human adenovirus A
acacuggcuggcu

SEQ ID NO: 1536080 - RNA, 23 nt, Human adenovirus A
gucacucaagcggcauuccccau

SEQ ID NO: 1536081 - RNA, 18 nt, Human adenovirus A
aguuaaguuugacaccag

SEQ ID NO: 1536082 - RNA, 18 nt, Human adenovirus A
aaaaacuuggaaacgccu

SEQ ID NO: 1536083 - RNA, 16 nt, Human adenovirus A
acuuuccgccauggcu

SEQ ID NO: 1536084 - RNA, 21 nt, Human adenovirus A
ugcccugauauaucaggaaaa

SEQ ID NO: 1536085 - RNA, 15 nt, Human adenovirus A
uggaagcuggccaua

SEQ ID NO: 1536086 - RNA, 15 nt, Human adenovirus A
gcgugccaggcauuu

SEQ ID NO: 1536087 - RNA, 15 nt, Human adenovirus A
caaacagcuguggaa

SEQ ID NO: 1536088 - RNA, 15 nt, Human adenovirus A
gcgagcccaacccau

SEQ ID NO: 1536089 - RNA, 12 nt, Human adenovirus A
cgaggugcagcu

SEQ ID NO: 1536090 - RNA, 20 nt, Human adenovirus A
ugggcaucuugcaugaaaac

SEQ ID NO: 1536091 - RNA, 23 nt, Human adenovirus A
ugccagacuacguuuuacauccu

SEQ ID NO: 1536092 - RNA, 23 nt, Human adenovirus A
gccagccaagcguagccgcagca

SEQ ID NO: 1536093 - RNA, 23 nt, Human adenovirus A
ugaccgaauccacaaagcaguaa

SEQ ID NO: 1536094 - RNA, 21 nt, Human adenovirus A
augucggccugacgcucuggc

SEQ ID NO: 1536095 - RNA, 15 nt, Human adenovirus A
uccuaaaacugcucu

SEQ ID NO: 1536096 - RNA, 12 nt, Human adenovirus A
guacaaagccag

SEQ ID NO: 1536097 - RNA, 14 nt, Human adenovirus A
uacaacaguacagg

SEQ ID NO: 1536098 - RNA, 14 nt, Human adenovirus A
ugacauugcuucau

SEQ ID NO: 1536099 - RNA, 15 nt, Human adenovirus A
caaugcagcaaacac

SEQ ID NO: 1536100 - RNA, 15 nt, Human adenovirus A
agcgcacuggcauaa

SEQ ID NO: 1536101 - RNA, 13 nt, Human adenovirus A
uggaguuggaaac

SEQ ID NO: 1536102 - RNA, 17 nt, Human adenovirus A
aguuaagaaaacgcauu

SEQ ID NO: 1536103 - RNA, 12 nt, Human adenovirus A
aaugaaaacaau

SEQ ID NO: 1536104 - RNA, 16 nt, Human adenovirus A
ccuacacaacacaaaa

SEQ ID NO: 1536105 - RNA, 18 nt, Human adenovirus A
aguacgacgaaguguacg

SEQ ID NO: 1536106 - RNA, 16 nt, Human adenovirus A
gcaagauccggugacu

SEQ ID NO: 1536107 - RNA, 16 nt, Human adenovirus A
acaacugcacuugaau

SEQ ID NO: 1536108 - RNA, 18 nt, Human adenovirus A
ccacggccucagcagcgg

SEQ ID NO: 1536109 - RNA, 15 nt, Human adenovirus A
auuaguucuuuucuu

SEQ ID NO: 1536110 - RNA, 15 nt, Human adenovirus A
uggaacuuaacaacu

SEQ ID NO: 1536111 - RNA, 18 nt, Human adenovirus A
aaauguucaacaacagcu

SEQ ID NO: 1536112 - RNA, 20 nt, Human adenovirus A
agccagauguaaaaguacgu

SEQ ID NO: 1536113 - RNA, 22 nt, Human adenovirus A
agugaauggaacaccagcauug

SEQ ID NO: 1536114 - RNA, 16 nt, Human adenovirus A
cuccggaaacaacacg

SEQ ID NO: 1536115 - RNA, 14 nt, Human adenovirus A
uugcgauaaacugg

SEQ ID NO: 1536116 - RNA, 13 nt, Human adenovirus A
cagucaccaccag

SEQ ID NO: 1536117 - RNA, 14 nt, Human adenovirus A
guucgcuuugacaa

SEQ ID NO: 1536118 - RNA, 14 nt, Human adenovirus A
uacaaaucuuucaa

SEQ ID NO: 1536119 - RNA, 22 nt, Human adenovirus A
acuuauuacugguacuaugacu

SEQ ID NO: 1536120 - RNA, 22 nt, Human adenovirus A
aagucacguguucacaauuuuc

SEQ ID NO: 1536121 - RNA, 13 nt, Human adenovirus A
uaacuucuaccca

SEQ ID NO: 1536122 - RNA, 16 nt, Human adenovirus A
cauuuuucccacuuua

SEQ ID NO: 1536123 - RNA, 17 nt, Human adenovirus A
gcaaaaauuuuuugcca

SEQ ID NO: 1536124 - RNA, 17 nt, Human adenovirus A
agcgccgagccacagcc

SEQ ID NO: 1536125 - RNA, 14 nt, Human adenovirus A
cuuucaacaaaaaa

SEQ ID NO: 1536126 - RNA, 17 nt, Human adenovirus A
caaaauugaggaauguc

SEQ ID NO: 1536127 - RNA, 16 nt, Human adenovirus A
uuugccagcucuugga

SEQ ID NO: 1536128 - RNA, 15 nt, Human adenovirus A
cgcaauuagggccag

SEQ ID NO: 1536129 - RNA, 21 nt, Human adenovirus A
cgggcccauguaucagcagcc

SEQ ID NO: 1536130 - RNA, 16 nt, Human adenovirus A
cacgccaaagccacac

SEQ ID NO: 1536131 - RNA, 23 nt, Human adenovirus A
gccccccuccccuguggagccac

SEQ ID NO: 1536132 - RNA, 14 nt, Human adenovirus A
cccugauccggcaa

SEQ ID NO: 1536133 - RNA, 11 nt, Human adenovirus A
uacagagagca

SEQ ID NO: 1536134 - RNA, 18 nt, Human adenovirus A
uggauuugauucaagagg

SEQ ID NO: 1536135 - RNA, 18 nt, Human adenovirus A
agcagugcggccuguugc

SEQ ID NO: 1536136 - RNA, 17 nt, Human adenovirus A
gcuguacaguuucugug

SEQ ID NO: 1536137 - RNA, 20 nt, Human adenovirus A
cuuaaugaacaaugcuauua

SEQ ID NO: 1536138 - RNA, 14 nt, Human adenovirus A
gccaaucaggcugu

SEQ ID NO: 1536139 - RNA, 18 nt, Human adenovirus A
gguucgacgggccaggcg

SEQ ID NO: 1536140 - RNA, 18 nt, Human adenovirus A
aacuaugccaguuuacug

SEQ ID NO: 1536141 - RNA, 18 nt, Human adenovirus A
auucccagguaauuuuca

SEQ ID NO: 1536142 - RNA, 16 nt, Human adenovirus A
gaccccuacuuuguau

SEQ ID NO: 1536143 - RNA, 23 nt, Human adenovirus A
ggaggacuuugagccagaugaac

SEQ ID NO: 1536144 - RNA, 18 nt, Human adenovirus A
cucgcgcuuuggaggcag

SEQ ID NO: 1536145 - RNA, 16 nt, Human adenovirus A
ugaaccauucccaggu

SEQ ID NO: 1536146 - RNA, 18 nt, Human adenovirus A
cugcauguccagauuuca

SEQ ID NO: 1536147 - RNA, 22 nt, Human adenovirus A
aagcugaaacuaggggcuggcu

SEQ ID NO: 1536148 - RNA, 19 nt, Human adenovirus A
cuugcuuccagacaaaaaa

SEQ ID NO: 1536149 - RNA, 20 nt, Human adenovirus A
caauuuacauuuuaacugug

SEQ ID NO: 1536150 - RNA, 17 nt, Human adenovirus A
uacaacuugcacaaaug

SEQ ID NO: 1536151 - RNA, 19 nt, Human adenovirus A
cagucuugaaugcucugga

SEQ ID NO: 1536152 - RNA, 21 nt, Human adenovirus A
cugccgccacgaaugcuggcg

SEQ ID NO: 1536153 - RNA, 22 nt, Human adenovirus A
auugauaaaacgguuaagcugg

SEQ ID NO: 1536154 - RNA, 17 nt, Human adenovirus A
gacagacuugcaaacag

SEQ ID NO: 1536155 - RNA, 22 nt, Human adenovirus A
auacauauaugggcucuuuuag

SEQ ID NO: 1536156 - RNA, 16 nt, Human adenovirus A
cuaaaaugcaaaaugg

SEQ ID NO: 1536157 - RNA, 18 nt, Human adenovirus A
ugugcuacacgcugccca

SEQ ID NO: 1536158 - RNA, 13 nt, Human adenovirus A
aaccccaaaagcc

SEQ ID NO: 1536159 - RNA, 18 nt, Human adenovirus A
uuuucuuacauuacccaa

SEQ ID NO: 1536160 - RNA, 14 nt, Human adenovirus A
cccaacuuaacgca

SEQ ID NO: 1536161 - RNA, 17 nt, Human adenovirus A
gggcaucuugcaugaaa

SEQ ID NO: 1536162 - RNA, 19 nt, Human adenovirus A
cacauauucgcgugccagg

SEQ ID NO: 1536163 - RNA, 15 nt, Human adenovirus A
aucugccacuacccg

SEQ ID NO: 1536164 - RNA, 17 nt, Human adenovirus A
cuuuaacggaaaacacg

SEQ ID NO: 1536165 - RNA, 19 nt, Human adenovirus A
uauuagcucauuggaguac

SEQ ID NO: 1536166 - RNA, 23 nt, Human adenovirus A
cuauuauugagcauuauuugcga

SEQ ID NO: 1536167 - RNA, 20 nt, Human adenovirus A
caaagggggcgcacacuaau

SEQ ID NO: 1536168 - RNA, 15 nt, Human adenovirus A
caagccgcucucacc

SEQ ID NO: 1536169 - RNA, 14 nt, Human adenovirus A
caguggacaaaaac

SEQ ID NO: 1536170 - RNA, 14 nt, Human adenovirus A
agcccaacccuucc

SEQ ID NO: 1536171 - RNA, 13 nt, Human adenovirus A
gacugacuaugag

SEQ ID NO: 1536172 - RNA, 16 nt, Human adenovirus A
aggaaaaucccccucc

SEQ ID NO: 1536173 - RNA, 16 nt, Human adenovirus A
cguguuagacauggcu

SEQ ID NO: 1536174 - RNA, 19 nt, Human adenovirus A
gaccaaaaaguaaacuguc

SEQ ID NO: 1536175 - RNA, 14 nt, Human adenovirus A
gcagcaaaugcccu

SEQ ID NO: 1536176 - RNA, 18 nt, Human adenovirus A
gcuaggcgacgccaacag

SEQ ID NO: 1536177 - RNA, 13 nt, Human adenovirus A
auuuaaaaaccau

SEQ ID NO: 1536178 - RNA, 18 nt, Human adenovirus A
cgagaagaaguagccauu

SEQ ID NO: 1536179 - RNA, 21 nt, Human adenovirus A
acugcagccugucuuaaaauc

SEQ ID NO: 1536180 - RNA, 21 nt, Human adenovirus A
acccucccucuuggccagcug

SEQ ID NO: 1536181 - RNA, 20 nt, Human adenovirus A
gaaugggaggaaagacagcc

SEQ ID NO: 1536182 - RNA, 17 nt, Human adenovirus A
caaacuggaacuuaaca

SEQ ID NO: 1536183 - RNA, 21 nt, Human adenovirus A
aaucccucgcccgcacaguca

SEQ ID NO: 1536184 - RNA, 22 nt, Human adenovirus A
ccaccgucaauucuucuuccaa

SEQ ID NO: 1536185 - RNA, 15 nt, Human adenovirus A
accagcgucccaaaa

SEQ ID NO: 1536186 - RNA, 20 nt, Human adenovirus A
acaaggucuuaaacuuucuu

SEQ ID NO: 1536187 - RNA, 17 nt, Human adenovirus A
aucccuugcuugcuuac

SEQ ID NO: 1536188 - RNA, 18 nt, Human adenovirus A
acaaggaccguuuucugc

SEQ ID NO: 1536189 - RNA, 22 nt, Human adenovirus A
uuaagcgacgaucuuggagugu

SEQ ID NO: 1536190 - RNA, 17 nt, Human adenovirus A
agauuuguuccuuuuca

SEQ ID NO: 1536191 - RNA, 21 nt, Human adenovirus A
aagcauacuuaccaaagccau

SEQ ID NO: 1536192 - RNA, 16 nt, Human adenovirus A
cagcugacgacaguag

SEQ ID NO: 1536193 - RNA, 15 nt, Human adenovirus A
acuccgggaguguac

SEQ ID NO: 1536194 - RNA, 14 nt, Human adenovirus A
gacagcauggagug

SEQ ID NO: 1536195 - RNA, 15 nt, Human adenovirus A
uugaguacucagccg

SEQ ID NO: 1536196 - RNA, 19 nt, Human adenovirus A
uccaucuguuuacuucaau

SEQ ID NO: 1536197 - RNA, 18 nt, Human adenovirus A
uuccaaccaaaggagaaa

SEQ ID NO: 1536198 - RNA, 19 nt, Human adenovirus A
agcauucucuaacaagcug

SEQ ID NO: 1536199 - RNA, 13 nt, Human adenovirus A
uacgcuggcugug

SEQ ID NO: 1536200 - RNA, 20 nt, Human adenovirus A
ugaucaauuucuuccuccug

SEQ ID NO: 1536201 - RNA, 17 nt, Human adenovirus A
acugccgacaacacugu

SEQ ID NO: 1536202 - RNA, 19 nt, Human adenovirus A
caaagguaucucugaccau

SEQ ID NO: 1536203 - RNA, 18 nt, Human adenovirus A
uaaagaaacaaacuacau

SEQ ID NO: 1536204 - RNA, 19 nt, Human adenovirus A
ccaccaaacugcagccuca

SEQ ID NO: 1536205 - RNA, 15 nt, Human adenovirus A
gucagcucaggacau

SEQ ID NO: 1536206 - RNA, 16 nt, Human adenovirus A
cuacgguggcagccaa

SEQ ID NO: 1536207 - RNA, 17 nt, Human adenovirus A
cacaccaaacuggccau

SEQ ID NO: 1536208 - RNA, 21 nt, Human adenovirus A
acgcucaaagaaacagcagca

SEQ ID NO: 1536209 - RNA, 22 nt, Human adenovirus A
cccgcgguuuuggcggccaugc

SEQ ID NO: 1536210 - RNA, 15 nt, Human adenovirus A
auaaagaauuuuccg

SEQ ID NO: 1536211 - RNA, 16 nt, Human adenovirus A
aaacacugagcuccau

SEQ ID NO: 1536212 - RNA, 17 nt, Human adenovirus A
ucuugccugcggacuga

SEQ ID NO: 1536213 - RNA, 22 nt, Human adenovirus A
cggcaccuuuuaccuaaaccac

SEQ ID NO: 1536214 - RNA, 14 nt, Human adenovirus A
uauugcgcagcaac

SEQ ID NO: 1536215 - RNA, 21 nt, Human adenovirus A
caaggauuugaaugcguaaau

SEQ ID NO: 1536216 - RNA, 15 nt, Human adenovirus A
ggaaacaacacggag

SEQ ID NO: 1536217 - RNA, 20 nt, Human adenovirus A
caaugcauuaauaauaaaac

SEQ ID NO: 1536218 - RNA, 15 nt, Human adenovirus A
cagccugucuacaaa

SEQ ID NO: 1536219 - RNA, 20 nt, Human adenovirus A
cagauuucagcacgagaggg

SEQ ID NO: 1536220 - RNA, 23 nt, Human adenovirus A
uaaacaucuacagcgacaaagca

SEQ ID NO: 1536221 - RNA, 19 nt, Human adenovirus A
ugacuggacagcggccaug

SEQ ID NO: 1536222 - RNA, 14 nt, Human adenovirus A
gaggcgcuggcuca

SEQ ID NO: 1536223 - RNA, 11 nt, Human adenovirus A
ugacaaagaug

SEQ ID NO: 1536224 - RNA, 12 nt, Human adenovirus A
cguucuguggau

SEQ ID NO: 1536225 - RNA, 21 nt, Human adenovirus A
aagcaaaccacauaggcauug

SEQ ID NO: 1536226 - RNA, 19 nt, Human adenovirus A
cugucuugucuugcauggu

SEQ ID NO: 1536227 - RNA, 15 nt, Human adenovirus A
acgaacuacaacagc

SEQ ID NO: 1536228 - RNA, 22 nt, Human adenovirus A
caagcauuuuuuguugcuccag

SEQ ID NO: 1536229 - RNA, 16 nt, Human adenovirus A
gacaucuuaaugccag

SEQ ID NO: 1536230 - RNA, 15 nt, Human adenovirus A
gcccugcuccgacaa

SEQ ID NO: 1536231 - RNA, 14 nt, Human adenovirus A
aacauuaaaagacg

SEQ ID NO: 1536232 - RNA, 15 nt, Human adenovirus A
gagcgcccuuaacca

SEQ ID NO: 1536233 - RNA, 15 nt, Human adenovirus A
ugcgagcugccaccg

SEQ ID NO: 1536234 - RNA, 19 nt, Human adenovirus A
uagagcaaacuacauugca

SEQ ID NO: 1536235 - RNA, 22 nt, Human adenovirus A
gauuuaaggggucuauccuuca

SEQ ID NO: 1536236 - RNA, 14 nt, Human adenovirus A
auggagaaggacaa

SEQ ID NO: 1536237 - RNA, 16 nt, Human adenovirus A
aaaguagaaaucucgu

SEQ ID NO: 1536238 - RNA, 17 nt, Human adenovirus A
cagcugccguucguccu

SEQ ID NO: 1536239 - RNA, 16 nt, Human adenovirus A
cugauuaugcauuuua

SEQ ID NO: 1536240 - RNA, 13 nt, Human adenovirus A
acgccaacaggau

SEQ ID NO: 1536241 - RNA, 23 nt, Human adenovirus A
augaaaguugcauuuaauggcau

SEQ ID NO: 1536242 - RNA, 13 nt, Human adenovirus A
accauggaauuuu

SEQ ID NO: 1536243 - RNA, 19 nt, Human adenovirus A
acuccauguggagguauaa

SEQ ID NO: 1536244 - RNA, 13 nt, Human adenovirus A
uggaaaaacaacu

SEQ ID NO: 1536245 - RNA, 13 nt, Human adenovirus A
auucaucaacauu

SEQ ID NO: 1536246 - RNA, 23 nt, Human adenovirus A
agaauaggggaugguuuaacauu

SEQ ID NO: 1536247 - RNA, 12 nt, Human adenovirus A
gacagcaagcag

SEQ ID NO: 1536248 - RNA, 14 nt, Human adenovirus A
gcagcaacaaggaa

SEQ ID NO: 1536249 - RNA, 14 nt, Human adenovirus A
ugaaaauacaucau

SEQ ID NO: 1536250 - RNA, 20 nt, Human adenovirus A
ugacggugccccucgaccug

SEQ ID NO: 1536251 - RNA, 18 nt, Human adenovirus A
agucaaaguaugcugcac

SEQ ID NO: 1536252 - RNA, 19 nt, Human adenovirus A
cgcaguccugaugcuuuuc

SEQ ID NO: 1536253 - RNA, 21 nt, Human adenovirus A
gcuaugaugcgggcagccagg

SEQ ID NO: 1536254 - RNA, 17 nt, Human adenovirus A
aaaagucuacucauacc

SEQ ID NO: 1536255 - RNA, 15 nt, Human adenovirus A
acaacaagcuaauug

SEQ ID NO: 1536256 - RNA, 20 nt, Human adenovirus A
ccuacacuuacgaauggaac

SEQ ID NO: 1536257 - RNA, 18 nt, Human adenovirus A
cagacaguggcuuuuccu

SEQ ID NO: 1536258 - RNA, 14 nt, Human adenovirus A
cacugaaaaaccaa

SEQ ID NO: 1536259 - RNA, 14 nt, Human adenovirus A
accccaaaagcccg

SEQ ID NO: 1536260 - RNA, 16 nt, Human adenovirus A
gacgaggucgaggacu

SEQ ID NO: 1536261 - RNA, 18 nt, Human adenovirus A
cuuuggacuucugccuac

SEQ ID NO: 1536262 - RNA, 18 nt, Human adenovirus A
ucagcgagucaccaucac

SEQ ID NO: 1536263 - RNA, 14 nt, Human adenovirus A
cuuuucaaacuuua

SEQ ID NO: 1536264 - RNA, 11 nt, Human adenovirus A
accaggaagcu

SEQ ID NO: 1536265 - RNA, 13 nt, Human adenovirus A
ugucauggagaag

SEQ ID NO: 1536266 - RNA, 20 nt, Human adenovirus A
ucuacuaacaacuccagaug

SEQ ID NO: 1536267 - RNA, 14 nt, Human adenovirus A
gccgcaaaacaggc

SEQ ID NO: 1536268 - RNA, 14 nt, Human adenovirus A
uuuucuuagaugca

SEQ ID NO: 1536269 - RNA, 14 nt, Human adenovirus A
cgcgcaaguugacu

SEQ ID NO: 1536270 - RNA, 15 nt, Human adenovirus A
cugaacgggggcgcc

SEQ ID NO: 1536271 - RNA, 22 nt, Human adenovirus A
caaacuauauaaaucagccuuu

SEQ ID NO: 1536272 - RNA, 17 nt, Human adenovirus A
gugcuuccguagccuug

SEQ ID NO: 1536273 - RNA, 13 nt, Human adenovirus A
uaaugcagcuuca

SEQ ID NO: 1536274 - RNA, 16 nt, Human adenovirus A
aaacaaaagcaaagca

SEQ ID NO: 1536275 - RNA, 15 nt, Human adenovirus A
augaacaaaaucacc

SEQ ID NO: 1536276 - RNA, 21 nt, Human adenovirus A
gcugcccugauauaucaggaa

SEQ ID NO: 1536277 - RNA, 16 nt, Human adenovirus A
cacuguaagaggagac

SEQ ID NO: 1536278 - RNA, 19 nt, Human adenovirus A
gggauuguguccuuggaag

SEQ ID NO: 1536279 - RNA, 21 nt, Human adenovirus A
acucaacguagcuuuugacug

SEQ ID NO: 1536280 - RNA, 14 nt, Human adenovirus A
caacugcacuugaa

SEQ ID NO: 1536281 - RNA, 13 nt, Human adenovirus A
ugagguguaccug

SEQ ID NO: 1536282 - RNA, 12 nt, Human adenovirus A
cacacaaaacac

SEQ ID NO: 1536283 - RNA, 23 nt, Human adenovirus A
acagcacuaacauguuauuuaaa

SEQ ID NO: 1536284 - RNA, 15 nt, Human adenovirus A
uugcgagcugccacc

SEQ ID NO: 1536285 - RNA, 10 nt, Human adenovirus A
uggacacuau

SEQ ID NO: 1536286 - RNA, 18 nt, Human adenovirus A
caaacacggauacuuaau

SEQ ID NO: 1536287 - RNA, 14 nt, Human adenovirus A
aacuuaacccuccc

SEQ ID NO: 1536288 - RNA, 19 nt, Human adenovirus A
ggauacuaccgcugcucag

SEQ ID NO: 1536289 - RNA, 11 nt, Human adenovirus A
ccagugccgcc

SEQ ID NO: 1536290 - RNA, 22 nt, Human adenovirus A
gggcgcugacgggagcaggaac

SEQ ID NO: 1536291 - RNA, 16 nt, Human adenovirus A
ugacaaacgcccugcu

SEQ ID NO: 1536292 - RNA, 15 nt, Human adenovirus A
gccacaccuccaccc

SEQ ID NO: 1536293 - RNA, 20 nt, Human adenovirus A
gagcaggcuggaggugcagg

SEQ ID NO: 1536294 - RNA, 21 nt, Human adenovirus A
caaagaccccauuguaacuga

SEQ ID NO: 1536295 - RNA, 13 nt, Human adenovirus A
gggccgcagcugc

SEQ ID NO: 1536296 - RNA, 22 nt, Human adenovirus A
ggcaggaaaucugggaggaaga

SEQ ID NO: 1536297 - RNA, 19 nt, Human adenovirus A
aacgccaccagcgugccca

SEQ ID NO: 1536298 - RNA, 15 nt, Human adenovirus A
aaguaccaggaagcu

SEQ ID NO: 1536299 - RNA, 18 nt, Human adenovirus A
auugauacacaccucauu

SEQ ID NO: 1536300 - RNA, 22 nt, Human adenovirus A
auuugaaugcguaaaucucgca

SEQ ID NO: 1536301 - RNA, 14 nt, Human adenovirus A
uuugaaccugaaag

SEQ ID NO: 1536302 - RNA, 20 nt, Human adenovirus A
cagguauaaaggucgcacug

SEQ ID NO: 1536303 - RNA, 22 nt, Human adenovirus A
aggcuaaguuuuguuucuucua

SEQ ID NO: 1536304 - RNA, 21 nt, Human adenovirus A
cuuuuaacauuagcagucugg

SEQ ID NO: 1536305 - RNA, 19 nt, Human adenovirus A
auuaguaacuccgggagug

SEQ ID NO: 1536306 - RNA, 19 nt, Human adenovirus A
caacauugcccuguaugcu

SEQ ID NO: 1536307 - RNA, 18 nt, Human adenovirus A
acgccuuacauguggagc

SEQ ID NO: 1536308 - RNA, 19 nt, Human adenovirus A
gaaaugcgagacugcaggu

SEQ ID NO: 1536309 - RNA, 22 nt, Human adenovirus A
cuucaccgcgcugcggccauga

SEQ ID NO: 1536310 - RNA, 21 nt, Human adenovirus A
acaaccacucucgcaggcuug

SEQ ID NO: 1536311 - RNA, 14 nt, Human adenovirus A
agcgccaccugcca

SEQ ID NO: 1536312 - RNA, 16 nt, Human adenovirus A
ccaggcaggcgcggcg

SEQ ID NO: 1536313 - RNA, 15 nt, Human adenovirus A
aaaggcauggaaaaa

SEQ ID NO: 1536314 - RNA, 13 nt, Human adenovirus A
cuaacuguuaauc

SEQ ID NO: 1536315 - RNA, 12 nt, Human adenovirus A
gccgcagcugcg

SEQ ID NO: 1536316 - RNA, 17 nt, Human adenovirus A
acagcuucuaaaagagc

SEQ ID NO: 1536317 - RNA, 20 nt, Human adenovirus A
auguaaaggaggcgcuggcu

SEQ ID NO: 1536318 - RNA, 15 nt, Human adenovirus A
uggucccauccaagu

SEQ ID NO: 1536319 - RNA, 14 nt, Human adenovirus A
ucauccucagcucc

SEQ ID NO: 1536320 - RNA, 16 nt, Human adenovirus A
gagaagcggagccacu

SEQ ID NO: 1536321 - RNA, 16 nt, Human adenovirus A
uacugccaguucaugc

SEQ ID NO: 1536322 - RNA, 20 nt, Human adenovirus A
acaaacacggauacuuaaua

SEQ ID NO: 1536323 - RNA, 18 nt, Human adenovirus A
gcugggcucgaggaccau

SEQ ID NO: 1536324 - RNA, 21 nt, Human adenovirus A
uggacuuugagcaccugggca

SEQ ID NO: 1536325 - RNA, 17 nt, Human adenovirus A
ugggaccccgaaaccca

SEQ ID NO: 1536326 - RNA, 17 nt, Human adenovirus A
cugaggcggcuggugcu

SEQ ID NO: 1536327 - RNA, 21 nt, Human adenovirus A
acguaaugugcgcgucagggu

SEQ ID NO: 1536328 - RNA, 20 nt, Human adenovirus A
ucaaacugccugacugaacc

SEQ ID NO: 1536329 - RNA, 15 nt, Human adenovirus A
guuauccacauugcu

SEQ ID NO: 1536330 - RNA, 14 nt, Human adenovirus A
ucaccaccagcgcu

SEQ ID NO: 1536331 - RNA, 13 nt, Human adenovirus A
ucaccgcuacacc

SEQ ID NO: 1536332 - RNA, 18 nt, Human adenovirus A
agccuucauuccuucaga

SEQ ID NO: 1536333 - RNA, 14 nt, Human adenovirus A
gacgcagugaguga

SEQ ID NO: 1536334 - RNA, 13 nt, Human adenovirus A
uuuuugaguacuc

SEQ ID NO: 1536335 - RNA, 15 nt, Human adenovirus A
uucgucgcuguuuug

SEQ ID NO: 1536336 - RNA, 15 nt, Human adenovirus A
gcaauauuccagcuc

SEQ ID NO: 1536337 - RNA, 13 nt, Human adenovirus A
acuuauugcugcg

SEQ ID NO: 1536338 - RNA, 14 nt, Human adenovirus A
ggccagcauugccg

SEQ ID NO: 1536339 - RNA, 17 nt, Human adenovirus A
uguagagucuuggaaua

SEQ ID NO: 1536340 - RNA, 23 nt, Human adenovirus A
ucgccuaaaaacuaaagaaacuc

SEQ ID NO: 1536341 - RNA, 23 nt, Human adenovirus A
aagcgcucgcgcuuuggaggcag

SEQ ID NO: 1536342 - RNA, 16 nt, Human adenovirus A
caggaggacacuggca

SEQ ID NO: 1536343 - RNA, 18 nt, Human adenovirus A
guacuuguaacuguggaa

SEQ ID NO: 1536344 - RNA, 19 nt, Human adenovirus A
agagcuaagcgacaaagag

SEQ ID NO: 1536345 - RNA, 12 nt, Human adenovirus A
cuuuucaaacuu

SEQ ID NO: 1536346 - RNA, 18 nt, Human adenovirus A
cucuggcgaacaggaaga

SEQ ID NO: 1536347 - RNA, 17 nt, Human adenovirus A
caccgcgcugcggccau

SEQ ID NO: 1536348 - RNA, 23 nt, Human adenovirus A
gcaggguaugggcccaggggugg

SEQ ID NO: 1536349 - RNA, 16 nt, Human adenovirus A
uuggauagcaaagcca

SEQ ID NO: 1536350 - RNA, 22 nt, Human adenovirus A
guauguucccauugacaaggaa

SEQ ID NO: 1536351 - RNA, 17 nt, Human adenovirus A
cuuuauaacuaacuuua

SEQ ID NO: 1536352 - RNA, 12 nt, Human adenovirus A
ugcaaugcuuaa

SEQ ID NO: 1536353 - RNA, 22 nt, Human adenovirus A
uaauaauugaguaacuucaaca

SEQ ID NO: 1536354 - RNA, 15 nt, Human adenovirus A
aaguaaauuaaaugg

SEQ ID NO: 1536355 - RNA, 16 nt, Human adenovirus A
ccugcgggaagcgggg

SEQ ID NO: 1536356 - RNA, 18 nt, Human adenovirus A
aauuucuaauguggagcu

SEQ ID NO: 1536357 - RNA, 21 nt, Human adenovirus A
agagaacaaacagugccuguu

SEQ ID NO: 1536358 - RNA, 14 nt, Human adenovirus A
ggcgcucagugcga

SEQ ID NO: 1536359 - RNA, 20 nt, Human adenovirus A
caaaaucuaagccaugcaaa

SEQ ID NO: 1536360 - RNA, 16 nt, Human adenovirus A
aaggagguuuguaagc

SEQ ID NO: 1536361 - RNA, 16 nt, Human adenovirus A
aucuucaucuuuucua

SEQ ID NO: 1536362 - RNA, 21 nt, Human adenovirus A
ccagcccaaccuguaacccaa

SEQ ID NO: 1536363 - RNA, 19 nt, Human adenovirus A
agcauaaaugggacaaguu

SEQ ID NO: 1536364 - RNA, 16 nt, Human adenovirus A
cuauuguuaacacugc

SEQ ID NO: 1536365 - RNA, 12 nt, Human adenovirus A
ucaacugaccag

SEQ ID NO: 1536366 - RNA, 13 nt, Human adenovirus A
uggcgcuuccaua

SEQ ID NO: 1536367 - RNA, 23 nt, Human adenovirus A
ucucguugauuauaaucuccaaa

SEQ ID NO: 1536368 - RNA, 18 nt, Human adenovirus A
ggucgcaccacuguagac

SEQ ID NO: 1536369 - RNA, 21 nt, Human adenovirus A
acagacgaauaagcucggcca

SEQ ID NO: 1536370 - RNA, 20 nt, Human adenovirus A
ugguucugccucuucuucuu

SEQ ID NO: 1536371 - RNA, 21 nt, Human adenovirus A
aacacugucagugaagcaaac

SEQ ID NO: 1536372 - RNA, 18 nt, Human adenovirus A
ggcagccguuucaggaag

SEQ ID NO: 1536373 - RNA, 22 nt, Human adenovirus A
aguagccauugguuuaaugcau

SEQ ID NO: 1536374 - RNA, 14 nt, Human adenovirus A
acuuucaaaaaagc

SEQ ID NO: 1536375 - RNA, 18 nt, Human adenovirus A
ucaacgacuaaaacaaau

SEQ ID NO: 1536376 - RNA, 15 nt, Human adenovirus A
ucgagaacuaaacaa

SEQ ID NO: 1536377 - RNA, 14 nt, Human adenovirus A
auuaucgcucuuuu

SEQ ID NO: 1536378 - RNA, 20 nt, Human adenovirus A
guacugcaaacgcugaugcc

SEQ ID NO: 1536379 - RNA, 20 nt, Human adenovirus A
caccaucuucaucuuuucua

SEQ ID NO: 1536380 - RNA, 16 nt, Human adenovirus A
cucaaagugaagugua

SEQ ID NO: 1536381 - RNA, 15 nt, Human adenovirus A
aagucauccaaagau

SEQ ID NO: 1536382 - RNA, 14 nt, Human adenovirus A
caucuguuuacuuc

SEQ ID NO: 1536383 - RNA, 16 nt, Human adenovirus A
cauagcuuacaaaggg

SEQ ID NO: 1536384 - RNA, 19 nt, Human adenovirus A
agggcuuuuggcuucacua

SEQ ID NO: 1536385 - RNA, 17 nt, Human adenovirus A
gucacagucacaaggua

SEQ ID NO: 1536386 - RNA, 18 nt, Human adenovirus A
uacaauaaucacaacaca

SEQ ID NO: 1536387 - RNA, 17 nt, Human adenovirus A
uaaaaucauacaaauca

SEQ ID NO: 1536388 - RNA, 15 nt, Human adenovirus A
uauugauaaaacggu

SEQ ID NO: 1536389 - RNA, 17 nt, Human adenovirus A
cgauuauugucacauua

SEQ ID NO: 1536390 - RNA, 21 nt, Human adenovirus A
gagggugccacccccagugcc

SEQ ID NO: 1536391 - RNA, 23 nt, Human adenovirus A
acugaaacucccuuaguuguaaa

SEQ ID NO: 1536392 - RNA, 22 nt, Human adenovirus A
uaacauguuauuuaaaauucca

SEQ ID NO: 1536393 - RNA, 17 nt, Human adenovirus A
cgucaaaaaagcaaagu

SEQ ID NO: 1536394 - RNA, 13 nt, Human adenovirus A
aguugacuggcau

SEQ ID NO: 1536395 - RNA, 19 nt, Human adenovirus A
ggauuguguccuuggaaga

SEQ ID NO: 1536396 - RNA, 12 nt, Human adenovirus A
cgagccagcuga

SEQ ID NO: 1536397 - RNA, 17 nt, Human adenovirus A
aacacacugauuuugca

SEQ ID NO: 1536398 - RNA, 15 nt, Human adenovirus A
guaggcuaacuguua

SEQ ID NO: 1536399 - RNA, 20 nt, Human adenovirus A
aaaaaaccuucgagaacuaa

SEQ ID NO: 1536400 - RNA, 18 nt, Human adenovirus A
cauacaaaucagaagcca

SEQ ID NO: 1536401 - RNA, 15 nt, Human adenovirus A
gcaucugcacgguaa

SEQ ID NO: 1536402 - RNA, 22 nt, Human adenovirus A
cacgggcccauguaucagcagc

SEQ ID NO: 1536403 - RNA, 17 nt, Human adenovirus A
auggagcggcugacaga

SEQ ID NO: 1536404 - RNA, 20 nt, Human adenovirus A
uuucacauucaacugaccag

SEQ ID NO: 1536405 - RNA, 21 nt, Human adenovirus A
agugaauggaacaccagcauu

SEQ ID NO: 1536406 - RNA, 15 nt, Human adenovirus A
uaggcauaaugcagc

SEQ ID NO: 1536407 - RNA, 11 nt, Human adenovirus A
uaguugccacg

SEQ ID NO: 1536408 - RNA, 23 nt, Human adenovirus A
ucaucaacauuaaccuaugcaac

SEQ ID NO: 1536409 - RNA, 13 nt, Human adenovirus A
gaagcgggggaag

SEQ ID NO: 1536410 - RNA, 16 nt, Human adenovirus A
cuacacucaacacuac

SEQ ID NO: 1536411 - RNA, 15 nt, Human adenovirus A
uuuguauucugcuaa

SEQ ID NO: 1536412 - RNA, 15 nt, Human adenovirus A
gcucccgcagugagg

SEQ ID NO: 1536413 - RNA, 19 nt, Human adenovirus A
acagacuugcaaacagcaa

SEQ ID NO: 1536414 - RNA, 21 nt, Human adenovirus A
uggaaaccuagguuuaaaucu

SEQ ID NO: 1536415 - RNA, 17 nt, Human adenovirus A
auaguucaucuuaguaa

SEQ ID NO: 1536416 - RNA, 16 nt, Human adenovirus A
gagccguccagcagug

SEQ ID NO: 1536417 - RNA, 15 nt, Human adenovirus A
gagucucaaaagcag

SEQ ID NO: 1536418 - RNA, 11 nt, Human adenovirus A
accaaagccau

SEQ ID NO: 1536419 - RNA, 14 nt, Human adenovirus A
ccugacgcucuggc

SEQ ID NO: 1536420 - RNA, 14 nt, Human adenovirus A
augugaugccggca

SEQ ID NO: 1536421 - RNA, 14 nt, Human adenovirus A
cucuaagcuuagau

SEQ ID NO: 1536422 - RNA, 23 nt, Human adenovirus A
cgcuuuggaggcagcuggagugg

SEQ ID NO: 1536423 - RNA, 13 nt, Human adenovirus A
gccaaacagcugu

SEQ ID NO: 1536424 - RNA, 22 nt, Human adenovirus A
uggaucuggagccacaggaaag

SEQ ID NO: 1536425 - RNA, 16 nt, Human adenovirus A
auaucucauuugcaag

SEQ ID NO: 1536426 - RNA, 14 nt, Human adenovirus A
uggacauccaugug

SEQ ID NO: 1536427 - RNA, 17 nt, Human adenovirus A
agucucaaaagcagcca

SEQ ID NO: 1536428 - RNA, 15 nt, Human adenovirus A
cuccccauucgcagc

SEQ ID NO: 1536429 - RNA, 23 nt, Human adenovirus A
gucuguuuaguccugcaguuauu

SEQ ID NO: 1536430 - RNA, 18 nt, Human adenovirus A
ccgcgguuuuggcggcca

SEQ ID NO: 1536431 - RNA, 18 nt, Human adenovirus A
aaugcccccauccaggug

SEQ ID NO: 1536432 - RNA, 13 nt, Human adenovirus A
cuuaaaaacuguu

SEQ ID NO: 1536433 - RNA, 23 nt, Human adenovirus A
gacccgacggaguguuucagcuc

SEQ ID NO: 1536434 - RNA, 17 nt, Human adenovirus A
gauauaguacugcuucc

SEQ ID NO: 1536435 - RNA, 15 nt, Human adenovirus A
cauacaucaccucuu

SEQ ID NO: 1536436 - RNA, 20 nt, Human adenovirus A
caauaaaaaaaacaguuucu

SEQ ID NO: 1536437 - RNA, 18 nt, Human adenovirus A
gguuacugaagugccuca

SEQ ID NO: 1536438 - RNA, 22 nt, Human adenovirus A
cugagcccuauccgucuccagc

SEQ ID NO: 1536439 - RNA, 17 nt, Human adenovirus A
gcucaacgagagcgcuu

SEQ ID NO: 1536440 - RNA, 20 nt, Human adenovirus A
cuuuacucgccuaaaaacua

SEQ ID NO: 1536441 - RNA, 14 nt, Human adenovirus A
ugacaacauugccc

SEQ ID NO: 1536442 - RNA, 15 nt, Human adenovirus A
aucuuggaguguacc

SEQ ID NO: 1536443 - RNA, 21 nt, Human adenovirus A
gacgccaacaggaucaaaaaa

SEQ ID NO: 1536444 - RNA, 23 nt, Human adenovirus A
gcuuuccaaaugcccccauccag

SEQ ID NO: 1536445 - RNA, 23 nt, Human adenovirus A
cacacuaauagcgcgagaagaag

SEQ ID NO: 1536446 - RNA, 16 nt, Human adenovirus A
ggaguuguagacauag

SEQ ID NO: 1536447 - RNA, 22 nt, Human adenovirus A
cauacgcuugugcagccuuucu

SEQ ID NO: 1536448 - RNA, 14 nt, Human adenovirus A
cagauuuugugccu

SEQ ID NO: 1536449 - RNA, 15 nt, Human adenovirus A
uuccgcgaucagcca

SEQ ID NO: 1536450 - RNA, 13 nt, Human adenovirus A
caguuuuaagccc

SEQ ID NO: 1536451 - RNA, 18 nt, Human adenovirus A
ggauacuuaauacuggcu

SEQ ID NO: 1536452 - RNA, 17 nt, Human adenovirus A
agcuuuaauaaccaugu

SEQ ID NO: 1536453 - RNA, 16 nt, Human adenovirus A
caagcacgccaaagcc

SEQ ID NO: 1536454 - RNA, 19 nt, Human adenovirus A
ccugccggucgagcgcgga

SEQ ID NO: 1536455 - RNA, 15 nt, Human adenovirus A
cauaaugaaaacaau

SEQ ID NO: 1536456 - RNA, 13 nt, Human adenovirus A
agcggccacggcc

SEQ ID NO: 1536457 - RNA, 17 nt, Human adenovirus A
ccgcacggccaaugccc

SEQ ID NO: 1536458 - RNA, 13 nt, Human adenovirus A
agcugacggccau

SEQ ID NO: 1536459 - RNA, 20 nt, Human adenovirus A
aaugguaggacgcugaaaca

SEQ ID NO: 1536460 - RNA, 16 nt, Human adenovirus A
gggcauggcugaagag

SEQ ID NO: 1536461 - RNA, 16 nt, Human adenovirus A
auacaaaucagaagcc

SEQ ID NO: 1536462 - RNA, 14 nt, Human adenovirus A
auauucccacgccu

SEQ ID NO: 1536463 - RNA, 23 nt, Human adenovirus A
uauuuaaaauuccauaauuaaag

SEQ ID NO: 1536464 - RNA, 13 nt, Human adenovirus A
gcgccccacuucc

SEQ ID NO: 1536465 - RNA, 15 nt, Human adenovirus A
auugugggacuggga

SEQ ID NO: 1536466 - RNA, 23 nt, Human adenovirus A
cucuacagccccuuugaagagcu

SEQ ID NO: 1536467 - RNA, 20 nt, Human adenovirus A
cgcccuuacagaucacggga

SEQ ID NO: 1536468 - RNA, 19 nt, Human adenovirus A
aggaacuccgcgcaaggag

SEQ ID NO: 1536469 - RNA, 18 nt, Human adenovirus A
ugucauuuacugcagccu

SEQ ID NO: 1536470 - RNA, 15 nt, Human adenovirus A
uuucugacaugguaa

SEQ ID NO: 1536471 - RNA, 18 nt, Human adenovirus A
cgagcuaaccgcagccgc

SEQ ID NO: 1536472 - RNA, 16 nt, Human adenovirus A
auccaacugauuuuca

SEQ ID NO: 1536473 - RNA, 21 nt, Human adenovirus A
gcgcaaauuugaaccccaaga

SEQ ID NO: 1536474 - RNA, 11 nt, Human adenovirus A
gacuuccaggu

SEQ ID NO: 1536475 - RNA, 18 nt, Human adenovirus A
auaguaaaaaugccagga

SEQ ID NO: 1536476 - RNA, 14 nt, Human adenovirus A
ucuaaugcaaguug

SEQ ID NO: 1536477 - RNA, 15 nt, Human adenovirus A
ucaucucuacagccc

SEQ ID NO: 1536478 - RNA, 20 nt, Human adenovirus A
uugacaaacgcccugcuccg

SEQ ID NO: 1536479 - RNA, 22 nt, Human adenovirus A
uuggagccccuuaccaacaccu

SEQ ID NO: 1536480 - RNA, 12 nt, Human adenovirus A
cuccuuaauuuc

SEQ ID NO: 1536481 - RNA, 18 nt, Human adenovirus A
augcugauguuuguaaaa

SEQ ID NO: 1536482 - RNA, 17 nt, Human adenovirus A
ccaaaugaauuugaaau

SEQ ID NO: 1536483 - RNA, 18 nt, Human adenovirus A
aggagaaaauaacacaua

SEQ ID NO: 1536484 - RNA, 14 nt, Human adenovirus A
aacaacaagcuaau

SEQ ID NO: 1536485 - RNA, 20 nt, Human adenovirus A
ucuuggucgucacacccucc

SEQ ID NO: 1536486 - RNA, 16 nt, Human adenovirus A
aggaagguuccaagga

SEQ ID NO: 1536487 - RNA, 20 nt, Human adenovirus A
augaugcgggcagccaggcg

SEQ ID NO: 1536488 - RNA, 14 nt, Human adenovirus A
agcauuggaauuua

SEQ ID NO: 1536489 - RNA, 18 nt, Human adenovirus A
caaauagagcaaacuaca

SEQ ID NO: 1536490 - RNA, 21 nt, Human adenovirus A
aucaugauguuuaauaaagcg

SEQ ID NO: 1536491 - RNA, 16 nt, Human adenovirus A
acuaacaaugcuuucc

SEQ ID NO: 1536492 - RNA, 23 nt, Human adenovirus A
gcccaaacuuacaagcacgccaa

SEQ ID NO: 1536493 - RNA, 19 nt, Human adenovirus A
aacuuucuaccaaggaaaa

SEQ ID NO: 1536494 - RNA, 20 nt, Human adenovirus A
auggcagcggcgccacccua

SEQ ID NO: 1536495 - RNA, 15 nt, Human adenovirus A
uuacauccuuccauu

SEQ ID NO: 1536496 - RNA, 19 nt, Human adenovirus A
cccagcgguuuugcgccac

SEQ ID NO: 1536497 - RNA, 14 nt, Human adenovirus A
ccacacgcagcaac

SEQ ID NO: 1536498 - RNA, 13 nt, Human adenovirus A
gcguacagccugg

SEQ ID NO: 1536499 - RNA, 14 nt, Human adenovirus A
ucuacucauacccc

SEQ ID NO: 1536500 - RNA, 23 nt, Human adenovirus A
agaugcauccuguccugcgacaa

SEQ ID NO: 1536501 - RNA, 12 nt, Human adenovirus A
caggggccagcu

SEQ ID NO: 1536502 - RNA, 14 nt, Human adenovirus A
acacaaaagcucua

SEQ ID NO: 1536503 - RNA, 17 nt, Human adenovirus A
agcuuggcuauagaucu

SEQ ID NO: 1536504 - RNA, 23 nt, Human adenovirus A
uccgccauggcuacgugcgccaa

SEQ ID NO: 1536505 - RNA, 19 nt, Human adenovirus A
acaaugcagcaaacacugc

SEQ ID NO: 1536506 - RNA, 21 nt, Human adenovirus A
ccaggguuugcuucagcaguu

SEQ ID NO: 1536507 - RNA, 12 nt, Human adenovirus A
acaaaacacuga

SEQ ID NO: 1536508 - RNA, 13 nt, Human adenovirus A
acugaaaauggaa

SEQ ID NO: 1536509 - RNA, 12 nt, Human adenovirus A
uacacauaaaga

SEQ ID NO: 1536510 - RNA, 18 nt, Human adenovirus A
cgcaccgguugagcagaa

SEQ ID NO: 1536511 - RNA, 22 nt, Human adenovirus A
cgcaauuagggccagcauugcc

SEQ ID NO: 1536512 - RNA, 19 nt, Human adenovirus A
uuauaugcgcauggcuuua

SEQ ID NO: 1536513 - RNA, 15 nt, Human adenovirus A
caaaccacauaggca

SEQ ID NO: 1536514 - RNA, 15 nt, Human adenovirus A
gccacaugggaaggg

SEQ ID NO: 1536515 - RNA, 13 nt, Human adenovirus A
uccccauccaaaa

SEQ ID NO: 1536516 - RNA, 14 nt, Human adenovirus A
cuucugccuaccug

SEQ ID NO: 1536517 - RNA, 13 nt, Human adenovirus A
auccauuauuaug

SEQ ID NO: 1536518 - RNA, 19 nt, Human adenovirus A
aucucuacagccccuuuga

SEQ ID NO: 1536519 - RNA, 14 nt, Human adenovirus A
gaaacucccuuagu

SEQ ID NO: 1536520 - RNA, 21 nt, Human adenovirus A
agcuucuccagacaacuucau

SEQ ID NO: 1536521 - RNA, 21 nt, Human adenovirus A
ggcggccaugcaaagccagcc

SEQ ID NO: 1536522 - RNA, 22 nt, Human adenovirus A
uuagucgcgcacugggccagga

SEQ ID NO: 1536523 - RNA, 15 nt, Human adenovirus A
aguugcgagcugcca

SEQ ID NO: 1536524 - RNA, 13 nt, Human adenovirus A
uggagcuuucaac

SEQ ID NO: 1536525 - RNA, 20 nt, Human adenovirus A
ccugucuuaaaaucuccuga

SEQ ID NO: 1536526 - RNA, 14 nt, Human adenovirus A
accaaacuggccau

SEQ ID NO: 1536527 - RNA, 16 nt, Human adenovirus A
gaaagcagaugggaaa

SEQ ID NO: 1536528 - RNA, 15 nt, Human adenovirus A
ccacagguggugggg

SEQ ID NO: 1536529 - RNA, 18 nt, Human adenovirus A
ugaauguuuguacacuuu

SEQ ID NO: 1536530 - RNA, 16 nt, Human adenovirus A
ccccuccuucgcuguc

SEQ ID NO: 1536531 - RNA, 19 nt, Human adenovirus A
gagcguucgccagcucuug

SEQ ID NO: 1536532 - RNA, 14 nt, Human adenovirus A
uaaugcaucuuugg

SEQ ID NO: 1536533 - RNA, 23 nt, Human adenovirus A
gacgcagugagugaaucugugga

SEQ ID NO: 1536534 - RNA, 21 nt, Human adenovirus A
accgccguccuaugaggaagc

SEQ ID NO: 1536535 - RNA, 19 nt, Human adenovirus A
gcagcccaacccuucccaa

SEQ ID NO: 1536536 - RNA, 13 nt, Human adenovirus A
caagcgcugaaac

SEQ ID NO: 1536537 - RNA, 11 nt, Human adenovirus A
cuaaaacagaa

SEQ ID NO: 1536538 - RNA, 18 nt, Human adenovirus A
acucacccugugcuuaac

SEQ ID NO: 1536539 - RNA, 17 nt, Human adenovirus A
cauuacuccuaaaacug

SEQ ID NO: 1536540 - RNA, 15 nt, Human adenovirus A
ccuuugcucaggcgc

SEQ ID NO: 1536541 - RNA, 22 nt, Human adenovirus A
uaacugaaaauggaacccuuac

SEQ ID NO: 1536542 - RNA, 19 nt, Human adenovirus A
aguuuucuuuuuucuuaca

SEQ ID NO: 1536543 - RNA, 16 nt, Human adenovirus A
gcaauauuccagcucu

SEQ ID NO: 1536544 - RNA, 22 nt, Human adenovirus A
cugaggaaaugcgagacugcag

SEQ ID NO: 1536545 - RNA, 13 nt, Human adenovirus A
ugacacaucagac

SEQ ID NO: 1536546 - RNA, 20 nt, Human adenovirus A
accugauuuucacauuugug

SEQ ID NO: 1536547 - RNA, 15 nt, Human adenovirus A
gcagacaagguggcc

SEQ ID NO: 1536548 - RNA, 22 nt, Human adenovirus A
ggacagagcauucaugcugaug

SEQ ID NO: 1536549 - RNA, 23 nt, Human adenovirus A
cuagaugaagcgcagcagaaccc

SEQ ID NO: 1536550 - RNA, 14 nt, Human adenovirus A
cgcggggacagcgc

SEQ ID NO: 1536551 - RNA, 14 nt, Human adenovirus A
cggcauuccccauc

SEQ ID NO: 1536552 - RNA, 16 nt, Human adenovirus A
aacccaaacuguacaa

SEQ ID NO: 1536553 - RNA, 16 nt, Human adenovirus A
ucaaacaauaacauug

SEQ ID NO: 1536554 - RNA, 15 nt, Human adenovirus A
aaucucagaaagcca

SEQ ID NO: 1536555 - RNA, 21 nt, Human adenovirus A
cacuuugccuacccggcagua

SEQ ID NO: 1536556 - RNA, 13 nt, Human adenovirus A
aaagucuguugcg

SEQ ID NO: 1536557 - RNA, 20 nt, Human adenovirus A
caccucuagaaacugugccc

SEQ ID NO: 1536558 - RNA, 19 nt, Human adenovirus A
ugcacaucgccggucagga

SEQ ID NO: 1536559 - RNA, 16 nt, Human adenovirus A
aucguauuauggcuuu

SEQ ID NO: 1536560 - RNA, 20 nt, Human adenovirus A
ccuaauggagugucacugcc

SEQ ID NO: 1536561 - RNA, 18 nt, Human adenovirus A
ugcgaguaggaagacagc

SEQ ID NO: 1536562 - RNA, 16 nt, Human adenovirus A
ugcagccugucuuaaa

SEQ ID NO: 1536563 - RNA, 22 nt, Human adenovirus A
cgguggaacugcagacaguggc

SEQ ID NO: 1536564 - RNA, 17 nt, Human adenovirus A
caagacguuccauggcu

SEQ ID NO: 1536565 - RNA, 14 nt, Human adenovirus A
uuugagauuggcaa

SEQ ID NO: 1536566 - RNA, 14 nt, Human adenovirus A
cacacgcagcaacc

SEQ ID NO: 1536567 - RNA, 16 nt, Human adenovirus A
guuacauaccuggcaa

SEQ ID NO: 1536568 - RNA, 16 nt, Human adenovirus A
aagaaggagaaggcau

SEQ ID NO: 1536569 - RNA, 19 nt, Human adenovirus A
gcgcagaugagcuucuugc

SEQ ID NO: 1536570 - RNA, 14 nt, Human adenovirus A
aagaaaagcgugga

SEQ ID NO: 1536571 - RNA, 17 nt, Human adenovirus A
agguuuuuacauuccag

SEQ ID NO: 1536572 - RNA, 18 nt, Human adenovirus A
auggaaaaacuuggaaac

SEQ ID NO: 1536573 - RNA, 13 nt, Human adenovirus A
gggaggaggagga

SEQ ID NO: 1536574 - RNA, 20 nt, Human adenovirus A
uuaguaacagcauaugaaca

SEQ ID NO: 1536575 - RNA, 13 nt, Human adenovirus A
ugguuuaacauuc

SEQ ID NO: 1536576 - RNA, 22 nt, Human adenovirus A
gcuucuacaacgagcaagccgu

SEQ ID NO: 1536577 - RNA, 22 nt, Human adenovirus A
cccagggcaaccacggccucag

SEQ ID NO: 1536578 - RNA, 23 nt, Human adenovirus A
cauuuauaguggcacaacacaua

SEQ ID NO: 1536579 - RNA, 16 nt, Human adenovirus A
acaguugacgccccau

SEQ ID NO: 1536580 - RNA, 20 nt, Human adenovirus A
aaaacaucacucuauuucaa

SEQ ID NO: 1536581 - RNA, 21 nt, Human adenovirus A
cuccuauguuagcgccagagg

SEQ ID NO: 1536582 - RNA, 13 nt, Human adenovirus A
gauagcaccugcc

SEQ ID NO: 1536583 - RNA, 15 nt, Human adenovirus A
aguggcugcaagguc

SEQ ID NO: 1536584 - RNA, 14 nt, Human adenovirus A
gcuuugcucgagac

SEQ ID NO: 1536585 - RNA, 22 nt, Human adenovirus A
cuaccugacacuacagagcuca

SEQ ID NO: 1536586 - RNA, 15 nt, Human adenovirus A
cauaacauguuuaug

SEQ ID NO: 1536587 - RNA, 22 nt, Human adenovirus A
cggcaaguaaaacgcauuuugc

SEQ ID NO: 1536588 - RNA, 16 nt, Human adenovirus A
aguaauaaaaccugug

SEQ ID NO: 1536589 - RNA, 19 nt, Human adenovirus A
uaccugacacuacagagcu

SEQ ID NO: 1536590 - RNA, 17 nt, Human adenovirus A
acuaaauggaagacauc

SEQ ID NO: 1536591 - RNA, 16 nt, Human adenovirus A
caaagaaacagcagca

SEQ ID NO: 1536592 - RNA, 12 nt, Human adenovirus A
ccauugacaaag

SEQ ID NO: 1536593 - RNA, 21 nt, Human adenovirus A
aaaugaucuucggguggacgg

SEQ ID NO: 1536594 - RNA, 13 nt, Human adenovirus A
guacaaagccagg

SEQ ID NO: 1536595 - RNA, 21 nt, Human adenovirus A
cggggaauacuuuacaaaugc

SEQ ID NO: 1536596 - RNA, 15 nt, Human adenovirus A
aggaauacaagguag

SEQ ID NO: 1536597 - RNA, 20 nt, Human adenovirus A
cagaagccagcagcaaagaa

SEQ ID NO: 1536598 - RNA, 20 nt, Human adenovirus A
auaccuggcaaacugggaug

SEQ ID NO: 1536599 - RNA, 12 nt, Human adenovirus A
cuaacuuuaaug

SEQ ID NO: 1536600 - RNA, 18 nt, Human adenovirus A
gccaaggacccccagaca

SEQ ID NO: 1536601 - RNA, 13 nt, Human adenovirus A
cugagacuuccca

SEQ ID NO: 1536602 - RNA, 18 nt, Human adenovirus A
auauagccgccauggaaa

SEQ ID NO: 1536603 - RNA, 24 nt, Human adenovirus A
aggugguaaauagggugaaagaag

SEQ ID NO: 1536604 - RNA, 20 nt, Human adenovirus A
ugaugcuuuucgccagcagc

SEQ ID NO: 1536605 - RNA, 17 nt, Human adenovirus A
agcaaaacgcugggcuc

SEQ ID NO: 1536606 - RNA, 17 nt, Human adenovirus A
aucugaucgcucuucaa

SEQ ID NO: 1536607 - RNA, 16 nt, Human adenovirus A
gauccucgaaagcgag

SEQ ID NO: 1536608 - RNA, 21 nt, Human adenovirus A
agcugccuccuuugccagaac

SEQ ID NO: 1536609 - RNA, 20 nt, Human adenovirus A
aaggcaucuagccagucaca

SEQ ID NO: 1536610 - RNA, 14 nt, Human adenovirus A
aacacauacaguaa

SEQ ID NO: 1536611 - RNA, 16 nt, Human adenovirus A
auccguggcaggccau

SEQ ID NO: 1536612 - RNA, 13 nt, Human adenovirus A
ccgacaacacugu

SEQ ID NO: 1536613 - RNA, 12 nt, Human adenovirus A
acgccaccagcg

SEQ ID NO: 1536614 - RNA, 13 nt, Human adenovirus A
agaucaaggaaau

SEQ ID NO: 1536615 - RNA, 19 nt, Human adenovirus A
cugccaccucuagaaacug

SEQ ID NO: 1536616 - RNA, 21 nt, Human adenovirus A
gaucuccugccaccaguugga

SEQ ID NO: 1536617 - RNA, 15 nt, Human adenovirus A
gggcaucuugcauga

SEQ ID NO: 1536618 - RNA, 18 nt, Human adenovirus A
aauugaugagguaguggc

SEQ ID NO: 1536619 - RNA, 13 nt, Human adenovirus A
caaauuacacacu

SEQ ID NO: 1536620 - RNA, 16 nt, Human adenovirus A
guauaagaaagaggca

SEQ ID NO: 1536621 - RNA, 21 nt, Human adenovirus A
agugucauuuacugcagccug

SEQ ID NO: 1536622 - RNA, 16 nt, Human adenovirus A
cagacgaugacauuuu

SEQ ID NO: 1536623 - RNA, 14 nt, Human adenovirus A
gcaguauggcagcu

SEQ ID NO: 1536624 - RNA, 16 nt, Human adenovirus A
auuucccucuucccaa

SEQ ID NO: 1536625 - RNA, 13 nt, Human adenovirus A
guacucaaaugug

SEQ ID NO: 1536626 - RNA, 12 nt, Human adenovirus A
gcucuggcaggg

SEQ ID NO: 1536627 - RNA, 23 nt, Human adenovirus A
guaguagaccugcaagacagaaa

SEQ ID NO: 1536628 - RNA, 13 nt, Human adenovirus A
uugcgcaagcgcu

SEQ ID NO: 1536629 - RNA, 20 nt, Human adenovirus A
ugcaucucaccacugaaacu

SEQ ID NO: 1536630 - RNA, 23 nt, Human adenovirus A
cuucguaaaagucuacugcaaaa

SEQ ID NO: 1536631 - RNA, 21 nt, Human adenovirus A
caauuucuuccuccuggaggu

SEQ ID NO: 1536632 - RNA, 16 nt, Human adenovirus A
ggccggaugcagagga

SEQ ID NO: 1536633 - RNA, 18 nt, Human adenovirus A
auuggcuucagcauuuug

SEQ ID NO: 1536634 - RNA, 19 nt, Human adenovirus A
ugccagcucuuggaauaaa

SEQ ID NO: 1536635 - RNA, 16 nt, Human adenovirus A
cuuacuggggugccua

SEQ ID NO: 1536636 - RNA, 17 nt, Human adenovirus A
cucauccgcccaaacuu

SEQ ID NO: 1536637 - RNA, 19 nt, Human adenovirus A
cgggaugaaaaacgagcag

SEQ ID NO: 1536638 - RNA, 24 nt, Human adenovirus A
agugccucaaagugaaguguauca

SEQ ID NO: 1536639 - RNA, 13 nt, Human adenovirus A
acaaguuucccuc

SEQ ID NO: 1536640 - RNA, 21 nt, Human adenovirus A
gucccguaaaauacacauaaa

SEQ ID NO: 1536641 - RNA, 23 nt, Human adenovirus A
accgccaugcgcgcggccagagc

SEQ ID NO: 1536642 - RNA, 19 nt, Human adenovirus A
cgcagccgcgcagaugagc

SEQ ID NO: 1536643 - RNA, 23 nt, Human adenovirus A
ccacggacaccuacuucacccug

SEQ ID NO: 1536644 - RNA, 13 nt, Human adenovirus A
caacguuggcagc

SEQ ID NO: 1536645 - RNA, 19 nt, Human adenovirus A
gucgcaauuagggccagca

SEQ ID NO: 1536646 - RNA, 17 nt, Human adenovirus A
cggacagagcauucaug

SEQ ID NO: 1536647 - RNA, 18 nt, Human adenovirus A
caagaaggccauguacuu

SEQ ID NO: 1536648 - RNA, 16 nt, Human adenovirus A
cgaaagaccacuaaaa

SEQ ID NO: 1536649 - RNA, 21 nt, Human adenovirus A
uucaagaaaggcaucuagcca

SEQ ID NO: 1536650 - RNA, 16 nt, Human adenovirus A
aggggugguggguuug

SEQ ID NO: 1536651 - RNA, 24 nt, Human adenovirus A
aggacaaaagucuacucauacccc

SEQ ID NO: 1536652 - RNA, 16 nt, Human adenovirus A
aggauccagaggagga

SEQ ID NO: 1536653 - RNA, 15 nt, Human adenovirus A
accacuguagugcaa

SEQ ID NO: 1536654 - RNA, 21 nt, Human adenovirus A
agacugagaaccgucugcaug

SEQ ID NO: 1536655 - RNA, 22 nt, Human adenovirus A
cugcaaucuuugcaccccccac

SEQ ID NO: 1536656 - RNA, 20 nt, Human adenovirus A
agccuucuggcguuacagcu

SEQ ID NO: 1536657 - RNA, 19 nt, Human adenovirus A
uaaaggguuagaacuuucu

SEQ ID NO: 1536658 - RNA, 17 nt, Human adenovirus A
ggaauaauuggcuucag

SEQ ID NO: 1536659 - RNA, 16 nt, Human adenovirus A
aucagaagccagcagc

SEQ ID NO: 1536660 - RNA, 23 nt, Human adenovirus A
uaaacaaaagcaaagcaaaugca

SEQ ID NO: 1536661 - RNA, 19 nt, Human adenovirus A
gcgcuggcucaacgagagc

SEQ ID NO: 1536662 - RNA, 18 nt, Human adenovirus A
aacugccuccuucccauu

SEQ ID NO: 1536663 - RNA, 14 nt, Human adenovirus A
auuccaugagcccg

SEQ ID NO: 1536664 - RNA, 18 nt, Human adenovirus A
acagccuagacgaggauc

SEQ ID NO: 1536665 - RNA, 13 nt, Human adenovirus A
ugacaaggaagug

SEQ ID NO: 1536666 - RNA, 20 nt, Human adenovirus A
caaaggugcuucccacauac

SEQ ID NO: 1536667 - RNA, 14 nt, Human adenovirus A
aacaguaccaaugu

SEQ ID NO: 1536668 - RNA, 16 nt, Human adenovirus A
gaagggacggcaagua

SEQ ID NO: 1536669 - RNA, 22 nt, Human adenovirus A
uaaucaagacggucagcaagga

SEQ ID NO: 1536670 - RNA, 20 nt, Human adenovirus A
ggacgagcucccggaggaag

SEQ ID NO: 1536671 - RNA, 21 nt, Human adenovirus A
acacuguaagaggagacaacu

SEQ ID NO: 1536672 - RNA, 18 nt, Human adenovirus A
auagcugaaccccagggu

SEQ ID NO: 1536673 - RNA, 21 nt, Human adenovirus A
auaaagcgcagaguauccaca

SEQ ID NO: 1536674 - RNA, 20 nt, Human adenovirus A
gauggguguuuggcagcaau

SEQ ID NO: 1536675 - RNA, 19 nt, Human adenovirus A
gacgcaccgguugagcaga

SEQ ID NO: 1536676 - RNA, 13 nt, Human adenovirus A
ucauuccuucaga

SEQ ID NO: 1536677 - RNA, 18 nt, Human adenovirus A
ccgguugaaacagacccc

SEQ ID NO: 1536678 - RNA, 18 nt, Human adenovirus A
cuuuucuuuauguuaauc

SEQ ID NO: 1536679 - RNA, 15 nt, Human adenovirus A
uguauguucuuacac

SEQ ID NO: 1536680 - RNA, 20 nt, Human adenovirus A
cggguggacggagccagcgu

SEQ ID NO: 1536681 - RNA, 22 nt, Human adenovirus A
ccaucuugcuuguuuaaacauu

SEQ ID NO: 1536682 - RNA, 20 nt, Human adenovirus A
gcccgcguuuggaaacugua

SEQ ID NO: 1536683 - RNA, 19 nt, Human adenovirus A
acgcugcguuuugugcccg

SEQ ID NO: 1536684 - RNA, 21 nt, Human adenovirus A
augauuaaacaacaaaacacu

SEQ ID NO: 1536685 - RNA, 20 nt, Human adenovirus A
ggcgugccguuggcagaguc

SEQ ID NO: 1536686 - RNA, 18 nt, Human adenovirus A
auuucuuguucuuccucu

SEQ ID NO: 1536687 - RNA, 12 nt, Human adenovirus A
ugagaacuucug

SEQ ID NO: 1536688 - RNA, 17 nt, Human adenovirus A
aaaucccuauggaccgg

SEQ ID NO: 1536689 - RNA, 17 nt, Human adenovirus A
aacgaggugcagcugcc

SEQ ID NO: 1536690 - RNA, 15 nt, Human adenovirus A
ggguggagauuuaaa

SEQ ID NO: 1536691 - RNA, 12 nt, Human adenovirus A
ggcggugagcau

SEQ ID NO: 1536692 - RNA, 19 nt, Human adenovirus A
uggacguuaguaacaacaa

SEQ ID NO: 1536693 - RNA, 21 nt, Human adenovirus A
aauuuuuugccaucagaaauu

SEQ ID NO: 1536694 - RNA, 20 nt, Human adenovirus A
aucagaagccagcagcaaag

SEQ ID NO: 1536695 - RNA, 17 nt, Human adenovirus A
ccuccccgcuauuuggg

SEQ ID NO: 1536696 - RNA, 14 nt, Human adenovirus A
gcauuucccaagau

SEQ ID NO: 1536697 - RNA, 15 nt, Human adenovirus A
uagaaacugugcccg

SEQ ID NO: 1536698 - RNA, 20 nt, Human adenovirus A
ccugauuucuaacuuguuuc

SEQ ID NO: 1536699 - RNA, 18 nt, Human adenovirus A
aguacgucagaauguggu

SEQ ID NO: 1536700 - RNA, 12 nt, Human adenovirus A
ccgcagccaaca

SEQ ID NO: 1536701 - RNA, 17 nt, Human adenovirus A
uuugcaaggcgguauuu

SEQ ID NO: 1536702 - RNA, 14 nt, Human adenovirus A
caugaaaacagcau

SEQ ID NO: 1536703 - RNA, 21 nt, Human adenovirus A
cauuuauaguggcacaacaca

SEQ ID NO: 1536704 - RNA, 15 nt, Human adenovirus A
acuauagagaggaau

SEQ ID NO: 1536705 - RNA, 15 nt, Human adenovirus A
ugugugcugcaaaca

SEQ ID NO: 1536706 - RNA, 17 nt, Human adenovirus A
agcuucuacuuuagaag

SEQ ID NO: 1536707 - RNA, 14 nt, Human adenovirus A
uaugcccagcauga

SEQ ID NO: 1536708 - RNA, 19 nt, Human adenovirus A
ccugccauugccgcacggc

SEQ ID NO: 1536709 - RNA, 15 nt, Human adenovirus A
ccuuauccuuccagu

SEQ ID NO: 1536710 - RNA, 12 nt, Human adenovirus A
aacgcugggcuc

SEQ ID NO: 1536711 - RNA, 16 nt, Human adenovirus A
aaugcccccauccagg

SEQ ID NO: 1536712 - RNA, 23 nt, Human adenovirus A
gcugcacaauuaucgcucuuuua

SEQ ID NO: 1536713 - RNA, 22 nt, Human adenovirus A
aacagcuucuaaaagagccaca

SEQ ID NO: 1536714 - RNA, 22 nt, Human adenovirus A
uacccggcgauugauaucuuga

SEQ ID NO: 1536715 - RNA, 17 nt, Human adenovirus A
cagaugacuggacagcg

SEQ ID NO: 1536716 - RNA, 17 nt, Human adenovirus A
uguaaccagcugggcag

SEQ ID NO: 1536717 - RNA, 16 nt, Human adenovirus A
cuugucaacuacauaa

SEQ ID NO: 1536718 - RNA, 16 nt, Human adenovirus A
aacugcagacaguggc

SEQ ID NO: 1536719 - RNA, 15 nt, Human adenovirus A
ucuacucauacccca

SEQ ID NO: 1536720 - RNA, 21 nt, Human adenovirus A
uuacucgauuuaauuaacauu

SEQ ID NO: 1536721 - RNA, 21 nt, Human adenovirus A
auucauauauguaucuggaca

SEQ ID NO: 1536722 - RNA, 13 nt, Human adenovirus A
gaacuugggcuac

SEQ ID NO: 1536723 - RNA, 21 nt, Human adenovirus A
acauaauuucccucacaaauu

SEQ ID NO: 1536724 - RNA, 19 nt, Human adenovirus A
cucccucuuggccagcugc

SEQ ID NO: 1536725 - RNA, 16 nt, Human adenovirus A
aaacauaugcacaaga

SEQ ID NO: 1536726 - RNA, 12 nt, Human adenovirus A
aacauaagauca

SEQ ID NO: 1536727 - RNA, 20 nt, Human adenovirus A
ugaggacacugaaggcauuu

SEQ ID NO: 1536728 - RNA, 14 nt, Human adenovirus A
gauccagcaaacuu

SEQ ID NO: 1536729 - RNA, 18 nt, Human adenovirus A
cgcggagacgggccgcag

SEQ ID NO: 1536730 - RNA, 18 nt, Human adenovirus A
guacgcauucaccagcca

SEQ ID NO: 1536731 - RNA, 13 nt, Human adenovirus A
agugucuccguau

SEQ ID NO: 1536732 - RNA, 15 nt, Human adenovirus A
auucuugagccugga

SEQ ID NO: 1536733 - RNA, 18 nt, Human adenovirus A
cuaaccuggaucccgcgg

SEQ ID NO: 1536734 - RNA, 15 nt, Human adenovirus A
cugucccccaccagu

SEQ ID NO: 1536735 - RNA, 13 nt, Human adenovirus A
aaagcaaaugcau

SEQ ID NO: 1536736 - RNA, 13 nt, Human adenovirus A
acagaaccauggu

SEQ ID NO: 1536737 - RNA, 19 nt, Human adenovirus A
ccaaauauugcgcaggggu

SEQ ID NO: 1536738 - RNA, 18 nt, Human adenovirus A
aaccccaaaugggacugg

SEQ ID NO: 1536739 - RNA, 13 nt, Human adenovirus A
cacaguaaucuuu

SEQ ID NO: 1536740 - RNA, 18 nt, Human adenovirus A
cauuaccagcagccaaaa

SEQ ID NO: 1536741 - RNA, 14 nt, Human adenovirus A
gggaguugcgagcu

SEQ ID NO: 1536742 - RNA, 14 nt, Human adenovirus A
cuaccugacacuac

SEQ ID NO: 1536743 - RNA, 15 nt, Human adenovirus A
uuuuguauucugcua

SEQ ID NO: 1536744 - RNA, 22 nt, Human adenovirus A
acaacagcggcguaaacucaug

SEQ ID NO: 1536745 - RNA, 14 nt, Human adenovirus A
auagaacuggaagg

SEQ ID NO: 1536746 - RNA, 17 nt, Human adenovirus A
cguacuuguaacugugg

SEQ ID NO: 1536747 - RNA, 15 nt, Human adenovirus A
cacagcacuaacaug

SEQ ID NO: 1536748 - RNA, 20 nt, Human adenovirus A
acuuguuuuuucugacaugg

SEQ ID NO: 1536749 - RNA, 20 nt, Human adenovirus A
gggcucuggcgaacaggaag

SEQ ID NO: 1536750 - RNA, 13 nt, Human adenovirus A
caucuuuuuaugc

SEQ ID NO: 1536751 - RNA, 17 nt, Human adenovirus A
ucacauuugugacugcu

SEQ ID NO: 1536752 - RNA, 14 nt, Human adenovirus A
acauaaagagucuc

SEQ ID NO: 1536753 - RNA, 22 nt, Human adenovirus A
auaccaguuucaauugcagaac

SEQ ID NO: 1536754 - RNA, 22 nt, Human adenovirus A
cgggguugauuuuacagagagc

SEQ ID NO: 1536755 - RNA, 22 nt, Human adenovirus A
auccauguugcuaggcaauggg

SEQ ID NO: 1536756 - RNA, 21 nt, Human adenovirus A
agucaggcagaggacgagguc

SEQ ID NO: 1536757 - RNA, 19 nt, Human adenovirus A
aaacaaaagcaaagcaaau

SEQ ID NO: 1536758 - RNA, 19 nt, Human adenovirus A
auccuagcguacagccaga

SEQ ID NO: 1536759 - RNA, 13 nt, Human adenovirus A
ucguacuuaaaaa

SEQ ID NO: 1536760 - RNA, 17 nt, Human adenovirus A
ggagcugcacguacuag

SEQ ID NO: 1536761 - RNA, 21 nt, Human adenovirus A
cuuacccuagaccaaaugcca

SEQ ID NO: 1536762 - RNA, 13 nt, Human adenovirus A
cguccaggcaggg

SEQ ID NO: 1536763 - RNA, 21 nt, Human adenovirus A
aaaggcaggcauuaccucugu

SEQ ID NO: 1536764 - RNA, 15 nt, Human adenovirus A
uguguccuuggaaga

SEQ ID NO: 1536765 - RNA, 15 nt, Human adenovirus A
cguuuggaaacugua

SEQ ID NO: 1536766 - RNA, 13 nt, Human adenovirus A
agcagccaaaacu

SEQ ID NO: 1536767 - RNA, 19 nt, Human adenovirus A
gccaggcauuuccaggugg

SEQ ID NO: 1536768 - RNA, 19 nt, Human adenovirus A
acaccauugaaaccagcgc

SEQ ID NO: 1536769 - RNA, 17 nt, Human adenovirus A
guugacuucgcacaggc

SEQ ID NO: 1536770 - RNA, 19 nt, Human adenovirus A
agugcgguuccagaaggag

SEQ ID NO: 1536771 - RNA, 22 nt, Human adenovirus A
ggagcggcugacagagcgcggc

SEQ ID NO: 1536772 - RNA, 18 nt, Human adenovirus A
caugauguuaccaccgau

SEQ ID NO: 1536773 - RNA, 12 nt, Human adenovirus A
aaugaacaaugc

SEQ ID NO: 1536774 - RNA, 16 nt, Human adenovirus A
cucuucgcugcaguuu

SEQ ID NO: 1536775 - RNA, 19 nt, Human adenovirus A
cuuggaagaaugggaggag

SEQ ID NO: 1536776 - RNA, 12 nt, Human adenovirus A
aucauuaaauaa

SEQ ID NO: 1536777 - RNA, 19 nt, Human adenovirus A
ucuuaaaaucuccugaacg

SEQ ID NO: 1536778 - RNA, 22 nt, Human adenovirus A
auguuaauuaucccuuugaugc

SEQ ID NO: 1536779 - RNA, 16 nt, Human adenovirus A
uuuaguggcaaucaaa

SEQ ID NO: 1536780 - RNA, 14 nt, Human adenovirus A
uccaagaucuuugu

SEQ ID NO: 1536781 - RNA, 15 nt, Human adenovirus A
gccgccgcugcagcu

SEQ ID NO: 1536782 - RNA, 13 nt, Human adenovirus A
cgaaaaaaaucac

SEQ ID NO: 1536783 - RNA, 15 nt, Human adenovirus A
ggcaggaguugcagg

SEQ ID NO: 1536784 - RNA, 14 nt, Human adenovirus A
ugcgaccgggcacc

SEQ ID NO: 1536785 - RNA, 19 nt, Human adenovirus A
uucagguguuaucuucaaa

SEQ ID NO: 1536786 - RNA, 22 nt, Human adenovirus A
gugagcaaaucucagaaagcca

SEQ ID NO: 1536787 - RNA, 14 nt, Human adenovirus A
uugauuuaggaggu

SEQ ID NO: 1536788 - RNA, 21 nt, Human adenovirus A
gaggcgcgcgaguuaagaaaa

SEQ ID NO: 1536789 - RNA, 20 nt, Human adenovirus A
cugauuucgauaaacaaaag

SEQ ID NO: 1536790 - RNA, 20 nt, Human adenovirus A
ggagacgggccgcagcugcg

SEQ ID NO: 1536791 - RNA, 18 nt, Human adenovirus A
cgacguugcaagaggaga

SEQ ID NO: 1536792 - RNA, 15 nt, Human adenovirus A
gcauuaagccagaua

SEQ ID NO: 1536793 - RNA, 12 nt, Human adenovirus A
gcaacagcuauu

SEQ ID NO: 1536794 - RNA, 18 nt, Human adenovirus A
gcgcgucggggcuacugc

SEQ ID NO: 1536795 - RNA, 17 nt, Human adenovirus A
caaggucaacuuacagc

SEQ ID NO: 1536796 - RNA, 17 nt, Human adenovirus A
aggagguggcuggacug

SEQ ID NO: 1536797 - RNA, 14 nt, Human adenovirus A
uucccaaauaucca

SEQ ID NO: 1536798 - RNA, 18 nt, Human adenovirus A
auaauuaaacccuuuagc

SEQ ID NO: 1536799 - RNA, 20 nt, Human adenovirus A
cuuuuaguacuccuauguaa

SEQ ID NO: 1536800 - RNA, 16 nt, Human adenovirus A
gcaguauaccucuaaa

SEQ ID NO: 1536801 - RNA, 14 nt, Human adenovirus A
augaaaacagcauu

SEQ ID NO: 1536802 - RNA, 20 nt, Human adenovirus A
cagaguugcuuuuagauguc

SEQ ID NO: 1536803 - RNA, 16 nt, Human adenovirus A
auauugcauuuguccu

SEQ ID NO: 1536804 - RNA, 23 nt, Human adenovirus A
ucaaaaaagcaaaguacaaccac

SEQ ID NO: 1536805 - RNA, 19 nt, Human adenovirus A
agucgccgugguugguggg

SEQ ID NO: 1536806 - RNA, 17 nt, Human adenovirus A
uuccacggugcacuuuu

SEQ ID NO: 1536807 - RNA, 15 nt, Human adenovirus A
gacauggaaaaaaug

SEQ ID NO: 1536808 - RNA, 15 nt, Human adenovirus A
auuuugauuauuaua

SEQ ID NO: 1536809 - RNA, 23 nt, Human adenovirus A
caagcauguuaaaaaacgggaaa

SEQ ID NO: 1536810 - RNA, 14 nt, Human adenovirus A
ggauagcaccugcc

SEQ ID NO: 1536811 - RNA, 18 nt, Human adenovirus A
accgucaucucuacagcc

SEQ ID NO: 1536812 - RNA, 19 nt, Human adenovirus A
acugaacuauuaagugaaa

SEQ ID NO: 1536813 - RNA, 12 nt, Human adenovirus A
uguaucuggaca

SEQ ID NO: 1536814 - RNA, 22 nt, Human adenovirus A
cgaccgccuuuucuagaacaaa

SEQ ID NO: 1536815 - RNA, 21 nt, Human adenovirus A
aggcauggaaaaacuuggaaa

SEQ ID NO: 1536816 - RNA, 22 nt, Human adenovirus A
gccacucaaacauuaugcugga

SEQ ID NO: 1536817 - RNA, 21 nt, Human adenovirus A
ccaccaaauuuaaggccaggg

SEQ ID NO: 1536818 - RNA, 11 nt, Human adenovirus A
ggacuuucaac

SEQ ID NO: 1536819 - RNA, 20 nt, Human adenovirus A
aagcaauaaaacaaggagcc

SEQ ID NO: 1536820 - RNA, 18 nt, Human adenovirus A
agguuccguuccuguugc

SEQ ID NO: 1536821 - RNA, 15 nt, Human adenovirus A
cguugagccauguug

SEQ ID NO: 1536822 - RNA, 17 nt, Human adenovirus A
ccagcgccaccugccau

SEQ ID NO: 1536823 - RNA, 13 nt, Human adenovirus A
uguuaccaaugga

SEQ ID NO: 1536824 - RNA, 16 nt, Human adenovirus A
aauauuguauuuccag

SEQ ID NO: 1536825 - RNA, 20 nt, Human adenovirus A
gaacauacaacuugcacaaa

SEQ ID NO: 1536826 - RNA, 22 nt, Human adenovirus A
aguguacgcagacgaugacauu

SEQ ID NO: 1536827 - RNA, 17 nt, Human adenovirus A
agaaaauaacacauaag

SEQ ID NO: 1536828 - RNA, 22 nt, Human adenovirus A
guugcuuugaauaguucaucuu

SEQ ID NO: 1536829 - RNA, 14 nt, Human adenovirus A
cugagcaaugcuac

SEQ ID NO: 1536830 - RNA, 21 nt, Human adenovirus A
ccaucuugcuuguuuaaacau

SEQ ID NO: 1536831 - RNA, 18 nt, Human adenovirus A
acuauggaccuacuuacu

SEQ ID NO: 1536832 - RNA, 14 nt, Human adenovirus A
agaagccagcagca

SEQ ID NO: 1536833 - RNA, 14 nt, Human adenovirus A
agcccgaaguugac

SEQ ID NO: 1536834 - RNA, 22 nt, Human adenovirus A
uacuuacagggagauacaucua

SEQ ID NO: 1536835 - RNA, 19 nt, Human adenovirus A
gaagugaagauagacagcu

SEQ ID NO: 1536836 - RNA, 21 nt, Human adenovirus A
cgcagaccuacgguggcagcc

SEQ ID NO: 1536837 - RNA, 15 nt, Human adenovirus A
cuuguuuccagugcg

SEQ ID NO: 1536838 - RNA, 15 nt, Human adenovirus A
gccaaucaggcugua

SEQ ID NO: 1536839 - RNA, 12 nt, Human adenovirus A
aaauaugcugua

SEQ ID NO: 1536840 - RNA, 19 nt, Human adenovirus A
guauucugcuaaacucaca

SEQ ID NO: 1536841 - RNA, 16 nt, Human adenovirus A
aggcugucacuuugca

SEQ ID NO: 1536842 - RNA, 23 nt, Human adenovirus A
cgcaguggucuuacaugcacauc

SEQ ID NO: 1536843 - RNA, 16 nt, Human adenovirus A
ugcuuuucgccagcag

SEQ ID NO: 1536844 - RNA, 17 nt, Human adenovirus A
cuuuucuagaacaaaaa

SEQ ID NO: 1536845 - RNA, 15 nt, Human adenovirus A
cagagcacacuggga

SEQ ID NO: 1536846 - RNA, 19 nt, Human adenovirus A
auuuggauuuucugaucaa

SEQ ID NO: 1536847 - RNA, 20 nt, Human adenovirus A
agcuucagaaaaugccuguu

SEQ ID NO: 1536848 - RNA, 20 nt, Human adenovirus A
auggucuucaagaaaaacca

SEQ ID NO: 1536849 - RNA, 23 nt, Human adenovirus A
agugguauuccgcgguccuccuc

SEQ ID NO: 1536850 - RNA, 12 nt, Human adenovirus A
gccccacuuccu

SEQ ID NO: 1536851 - RNA, 14 nt, Human adenovirus A
cucauccucagcuc

SEQ ID NO: 1536852 - RNA, 17 nt, Human adenovirus A
uauuucucuuuucuuua

SEQ ID NO: 1536853 - RNA, 13 nt, Human adenovirus A
gaucacagccaga

SEQ ID NO: 1536854 - RNA, 21 nt, Human adenovirus A
ugaugcuuuucgccagcagcc

SEQ ID NO: 1536855 - RNA, 22 nt, Human adenovirus A
aguaugcugaagaaacagaaga

SEQ ID NO: 1536856 - RNA, 17 nt, Human adenovirus A
ucucgcagcucuuauuu

SEQ ID NO: 1536857 - RNA, 23 nt, Human adenovirus A
agauaacggaggaggagguggcu

SEQ ID NO: 1536858 - RNA, 16 nt, Human adenovirus A
gggacgcgugugccag

SEQ ID NO: 1536859 - RNA, 19 nt, Human adenovirus A
cugucuuaaaaucuccuga

SEQ ID NO: 1536860 - RNA, 14 nt, Human adenovirus A
uuucacauucaacu

SEQ ID NO: 1536861 - RNA, 23 nt, Human adenovirus A
ucuuggucgucacacccuccgug

SEQ ID NO: 1536862 - RNA, 14 nt, Human adenovirus A
cuuaacaaaaaacg

SEQ ID NO: 1536863 - RNA, 18 nt, Human adenovirus A
acauguggagcuuucaac

SEQ ID NO: 1536864 - RNA, 18 nt, Human adenovirus A
ugaagugccucaaaguga

SEQ ID NO: 1536865 - RNA, 21 nt, Human adenovirus A
acauaccuggcaaacugggau

SEQ ID NO: 1536866 - RNA, 19 nt, Human adenovirus A
guacucaacgugucaguuu

SEQ ID NO: 1536867 - RNA, 16 nt, Human adenovirus A
ucaauucuucuuccaa

SEQ ID NO: 1536868 - RNA, 15 nt, Human adenovirus A
cuuuagaagccaugu

SEQ ID NO: 1536869 - RNA, 14 nt, Human adenovirus A
ggcgacuacccggc

SEQ ID NO: 1536870 - RNA, 13 nt, Human adenovirus A
acacuuaacacaa

SEQ ID NO: 1536871 - RNA, 13 nt, Human adenovirus A
aaccguuuagagc

SEQ ID NO: 1536872 - RNA, 13 nt, Human adenovirus A
ggcaggggaaggu

SEQ ID NO: 1536873 - RNA, 17 nt, Human adenovirus A
ugcuggaaccugaagug

SEQ ID NO: 1536874 - RNA, 21 nt, Human adenovirus A
uggauuacaugucaaugcagc

SEQ ID NO: 1536875 - RNA, 16 nt, Human adenovirus A
agaugcauccuguccu

SEQ ID NO: 1536876 - RNA, 17 nt, Human adenovirus A
aagaugcaaacuugcaa

SEQ ID NO: 1536877 - RNA, 16 nt, Human adenovirus A
gaacuaaacaaacugu

SEQ ID NO: 1536878 - RNA, 14 nt, Human adenovirus A
ugggaaacaaguuu

SEQ ID NO: 1536879 - RNA, 21 nt, Human adenovirus A
auaaaagcuucaauuugccua

SEQ ID NO: 1536880 - RNA, 15 nt, Human adenovirus A
ccaggcgggcugcaa

SEQ ID NO: 1536881 - RNA, 11 nt, Human adenovirus A
cccccagugcc

SEQ ID NO: 1536882 - RNA, 14 nt, Human adenovirus A
gcuccaaccaugaa

SEQ ID NO: 1536883 - RNA, 14 nt, Human adenovirus A
agcaccugccgcca

SEQ ID NO: 1536884 - RNA, 22 nt, Human adenovirus A
agcaaaugcccugcaaaaagaa

SEQ ID NO: 1536885 - RNA, 17 nt, Human adenovirus A
cuuggccaccauagccc

SEQ ID NO: 1536886 - RNA, 18 nt, Human adenovirus A
cccaaucaaauuacacac

SEQ ID NO: 1536887 - RNA, 14 nt, Human adenovirus A
cauagccccucuaa

SEQ ID NO: 1536888 - RNA, 22 nt, Human adenovirus A
acaaaaaacggaucuauuguua

SEQ ID NO: 1536889 - RNA, 20 nt, Human adenovirus A
gaucaacgacuaaaacaaau

SEQ ID NO: 1536890 - RNA, 21 nt, Human adenovirus A
gggaaaaaaaagaggaagaag

SEQ ID NO: 1536891 - RNA, 18 nt, Human adenovirus A
ggaaagccgguuguaagc

SEQ ID NO: 1536892 - RNA, 13 nt, Human adenovirus A
guucagcuucucc

SEQ ID NO: 1536893 - RNA, 18 nt, Human adenovirus A
uaacaguugaaaaaggaa

SEQ ID NO: 1536894 - RNA, 15 nt, Human adenovirus A
caaccaaaggagaaa

SEQ ID NO: 1536895 - RNA, 13 nt, Human adenovirus A
aguuguaaggcau

SEQ ID NO: 1536896 - RNA, 12 nt, Human adenovirus A
ucgccagcagcc

SEQ ID NO: 1536897 - RNA, 15 nt, Human adenovirus A
cugcaacagccaagc

SEQ ID NO: 1536898 - RNA, 20 nt, Human adenovirus A
aauucgcaggcggucugcca

SEQ ID NO: 1536899 - RNA, 19 nt, Human adenovirus A
aucucacuuaagucuuuac

SEQ ID NO: 1536900 - RNA, 15 nt, Human adenovirus A
agccauccgcaaaga

SEQ ID NO: 1536901 - RNA, 21 nt, Human adenovirus A
aacucuaacugcucagcugga

SEQ ID NO: 1536902 - RNA, 14 nt, Human adenovirus A
cgcagacggcugcg

SEQ ID NO: 1536903 - RNA, 23 nt, Human adenovirus A
aagccacuuuagccccagcggca

SEQ ID NO: 1536904 - RNA, 21 nt, Human adenovirus A
acguucccgcccuuacagauc

SEQ ID NO: 1536905 - RNA, 16 nt, Human adenovirus A
agcauguuaaaaaacg

SEQ ID NO: 1536906 - RNA, 13 nt, Human adenovirus A
aaccuuugacaaa

SEQ ID NO: 1536907 - RNA, 19 nt, Human adenovirus A
aaugcgccugcuuaaaauc

SEQ ID NO: 1536908 - RNA, 21 nt, Human adenovirus A
auuuagaggcuggagcuuuac

SEQ ID NO: 1536909 - RNA, 18 nt, Human adenovirus A
acugcaaaauugaaaaac

SEQ ID NO: 1536910 - RNA, 16 nt, Human adenovirus A
aauaguuuaauguuuc

SEQ ID NO: 1536911 - RNA, 12 nt, Human adenovirus A
agucacaaggua

SEQ ID NO: 1536912 - RNA, 19 nt, Human adenovirus A
cacuuuaauaaaaacacug

SEQ ID NO: 1536913 - RNA, 18 nt, Human adenovirus A
auaugcuauuuuucagca

SEQ ID NO: 1536914 - RNA, 19 nt, Human adenovirus A
ggaucuggagccacaggaa

SEQ ID NO: 1536915 - RNA, 23 nt, Human adenovirus A
uccgauaaaaaagguagcuccag

SEQ ID NO: 1536916 - RNA, 20 nt, Human adenovirus A
cuagcuuaccacucagaccu

SEQ ID NO: 1536917 - RNA, 13 nt, Human adenovirus A
uauugguggaaaa

SEQ ID NO: 1536918 - RNA, 17 nt, Human adenovirus A
cgcccgcgccacggaca

SEQ ID NO: 1536919 - RNA, 15 nt, Human adenovirus A
ccugugcaaacugca

SEQ ID NO: 1536920 - RNA, 23 nt, Human adenovirus A
uuaauuacuccauguuaaguuug

SEQ ID NO: 1536921 - RNA, 20 nt, Human adenovirus A
agcuucagaugacuggacag

SEQ ID NO: 1536922 - RNA, 15 nt, Human adenovirus A
cucaaaagcagccau

SEQ ID NO: 1536923 - RNA, 20 nt, Human adenovirus A
ugagcccgaaguugacuggc

SEQ ID NO: 1536924 - RNA, 18 nt, Human adenovirus A
ccauguaucagcagccaa

SEQ ID NO: 1536925 - RNA, 19 nt, Human adenovirus A
aggggaagguguugagccc

SEQ ID NO: 1536926 - RNA, 17 nt, Human adenovirus A
gucgaggacuuggaaga

SEQ ID NO: 1536927 - RNA, 22 nt, Human adenovirus A
cggcaggauccgcuaugagcac

SEQ ID NO: 1536928 - RNA, 16 nt, Human adenovirus A
caguccugaugcuuuu

SEQ ID NO: 1536929 - RNA, 16 nt, Human adenovirus A
auugcgauaaacugga

SEQ ID NO: 1536930 - RNA, 23 nt, Human adenovirus A
gcuccugguugagcgcuggccag

SEQ ID NO: 1536931 - RNA, 16 nt, Human adenovirus A
auguauucagcuucag

SEQ ID NO: 1536932 - RNA, 11 nt, Human adenovirus A
augaacaaugc

SEQ ID NO: 1536933 - RNA, 18 nt, Human adenovirus A
gcggucuuaaaaauuuug

SEQ ID NO: 1536934 - RNA, 12 nt, Human adenovirus A
aucugucggcgu

SEQ ID NO: 1536935 - RNA, 18 nt, Human adenovirus A
accuauaacaaugaaagu

SEQ ID NO: 1536936 - RNA, 17 nt, Human adenovirus A
cauuugaucagaaaaaa

SEQ ID NO: 1536937 - RNA, 21 nt, Human adenovirus A
agaugcauccuguccugcgac

SEQ ID NO: 1536938 - RNA, 23 nt, Human adenovirus A
gcuuuuccugagacaccaccucc

SEQ ID NO: 1536939 - RNA, 18 nt, Human adenovirus A
ggauggguguuuggcagc

SEQ ID NO: 1536940 - RNA, 10 nt, Human adenovirus A
cugcagagca

SEQ ID NO: 1536941 - RNA, 22 nt, Human adenovirus A
ucuugaccaccguucccuauca

SEQ ID NO: 1536942 - RNA, 14 nt, Human adenovirus A
cccuguggagccac

SEQ ID NO: 1536943 - RNA, 20 nt, Human adenovirus A
gcuggugaaagaucacagcc

SEQ ID NO: 1536944 - RNA, 19 nt, Human adenovirus A
aaagaauuauucccgcagc

SEQ ID NO: 1536945 - RNA, 17 nt, Human adenovirus A
cugcacuaacucugauu

SEQ ID NO: 1536946 - RNA, 18 nt, Human adenovirus A
gaaagagaacaaacagug

SEQ ID NO: 1536947 - RNA, 12 nt, Human adenovirus A
cugcggccauga

SEQ ID NO: 1536948 - RNA, 12 nt, Human adenovirus A
acaacagcugcu

SEQ ID NO: 1536949 - RNA, 13 nt, Human adenovirus A
cauuuacugcagc

SEQ ID NO: 1536950 - RNA, 12 nt, Human adenovirus A
ccacucuccuga

SEQ ID NO: 1536951 - RNA, 15 nt, Human adenovirus A
auuugacuuccaggu

SEQ ID NO: 1536952 - RNA, 12 nt, Human adenovirus A
agauuggcaaug

SEQ ID NO: 1536953 - RNA, 19 nt, Human adenovirus A
ggcggguaagagcaggcug

SEQ ID NO: 1536954 - RNA, 22 nt, Human adenovirus A
uuccacugguaacggucuucaa

SEQ ID NO: 1536955 - RNA, 14 nt, Human adenovirus A
auagggguuaaggg

SEQ ID NO: 1536956 - RNA, 16 nt, Human adenovirus A
cgagaucggcacgagc

SEQ ID NO: 1536957 - RNA, 14 nt, Human adenovirus A
uuucguuccagacu

SEQ ID NO: 1536958 - RNA, 16 nt, Human adenovirus A
auaagaaagaggcagc

SEQ ID NO: 1536959 - RNA, 23 nt, Human adenovirus A
ggaaaucagggcguacagccugg

SEQ ID NO: 1536960 - RNA, 15 nt, Human adenovirus A
ugcuaaauuggccuu

SEQ ID NO: 1536961 - RNA, 15 nt, Human adenovirus A
auugaauaaaagcau

SEQ ID NO: 1536962 - RNA, 21 nt, Human adenovirus A
acguuuacaaagcacugggca

SEQ ID NO: 1536963 - RNA, 20 nt, Human adenovirus A
gcauacccgaggacgcacug

SEQ ID NO: 1536964 - RNA, 13 nt, Human adenovirus A
cgauaugaugcaa

SEQ ID NO: 1536965 - RNA, 22 nt, Human adenovirus A
aaauuugcauuucccaagauuu

SEQ ID NO: 1536966 - RNA, 22 nt, Human adenovirus A
gcacaaguugcagggcgcccau

SEQ ID NO: 1536967 - RNA, 21 nt, Human adenovirus A
uauuacacucaggccauaaag

SEQ ID NO: 1536968 - RNA, 11 nt, Human adenovirus A
agccacaggaa

SEQ ID NO: 1536969 - RNA, 14 nt, Human adenovirus A
cgaggcggugagca

SEQ ID NO: 1536970 - RNA, 19 nt, Human adenovirus A
aaauaguuccguaaagacu

SEQ ID NO: 1536971 - RNA, 17 nt, Human adenovirus A
gcgcugcggucuggggu

SEQ ID NO: 1536972 - RNA, 21 nt, Human adenovirus A
caggggaagguguugagcccg

SEQ ID NO: 1536973 - RNA, 15 nt, Human adenovirus A
acucaaaugugggcu

SEQ ID NO: 1536974 - RNA, 11 nt, Human adenovirus A
aguugacuggc

SEQ ID NO: 1536975 - RNA, 11 nt, Human adenovirus A
ccauaguucuu

SEQ ID NO: 1536976 - RNA, 14 nt, Human adenovirus A
aagagccacagcuc

SEQ ID NO: 1536977 - RNA, 24 nt, Human adenovirus A
auuuuauccuacaaaaaguaacaa

SEQ ID NO: 1536978 - RNA, 21 nt, Human adenovirus A
gcuucuauugcuuuuuuggca

SEQ ID NO: 1536979 - RNA, 13 nt, Human adenovirus A
aagcgcugaaaca

SEQ ID NO: 1536980 - RNA, 14 nt, Human adenovirus A
cuuuaauguuucag

SEQ ID NO: 1536981 - RNA, 17 nt, Human adenovirus A
cuggaggucuccauguc

SEQ ID NO: 1536982 - RNA, 17 nt, Human adenovirus A
guuccauggcuucguaa

SEQ ID NO: 1536983 - RNA, 15 nt, Human adenovirus A
agaaauaaccagugu

SEQ ID NO: 1536984 - RNA, 23 nt, Human adenovirus A
auaaagaguuaauugauuuacaa

SEQ ID NO: 1536985 - RNA, 18 nt, Human adenovirus A
caaagaaaguucaccucc

SEQ ID NO: 1536986 - RNA, 19 nt, Human adenovirus A
auggcagcggcgccacccu

SEQ ID NO: 1536987 - RNA, 17 nt, Human adenovirus A
cacggccucagcagcgg

SEQ ID NO: 1536988 - RNA, 15 nt, Human adenovirus A
agaaaguuuaaagga

SEQ ID NO: 1536989 - RNA, 16 nt, Human adenovirus A
cagcauaaaagcuuca

SEQ ID NO: 1536990 - RNA, 15 nt, Human adenovirus A
caagacagaaauaca

SEQ ID NO: 1536991 - RNA, 15 nt, Human adenovirus A
uggcagcggcgccac

SEQ ID NO: 1536992 - RNA, 19 nt, Human adenovirus A
agagggcgaacaguguuuu

SEQ ID NO: 1536993 - RNA, 13 nt, Human adenovirus A
cuccccuguggag

SEQ ID NO: 1536994 - RNA, 12 nt, Human adenovirus A
agaaacaaacua

SEQ ID NO: 1536995 - RNA, 15 nt, Human adenovirus A
ggcuauugcgcagca

SEQ ID NO: 1536996 - RNA, 18 nt, Human adenovirus A
gcuaaauguaacugagga

SEQ ID NO: 1536997 - RNA, 16 nt, Human adenovirus A
cugcuuucagcacugc

SEQ ID NO: 1536998 - RNA, 16 nt, Human adenovirus A
cuuuaauaaaaacacu

SEQ ID NO: 1536999 - RNA, 23 nt, Human adenovirus A
uccauguuaaguuugggaaaguu

SEQ ID NO: 1537000 - RNA, 22 nt, Human adenovirus A
augucggccugacgcucuggca

SEQ ID NO: 1537001 - RNA, 16 nt, Human adenovirus A
cacggccucagcagcg

SEQ ID NO: 1537002 - RNA, 12 nt, Human adenovirus A
ugcccugcaaaa

SEQ ID NO: 1537003 - RNA, 18 nt, Human adenovirus A
gaguacucaucagaggga

SEQ ID NO: 1537004 - RNA, 18 nt, Human adenovirus A
agaaucaaucucaguguc

SEQ ID NO: 1537005 - RNA, 14 nt, Human adenovirus A
agaucacagccaga

SEQ ID NO: 1537006 - RNA, 22 nt, Human adenovirus A
auacaacggccagccaagcgua

SEQ ID NO: 1537007 - RNA, 16 nt, Human adenovirus A
ugaugcauaaugcgga

SEQ ID NO: 1537008 - RNA, 15 nt, Human adenovirus A
uaaaccaagccaugc

SEQ ID NO: 1537009 - RNA, 21 nt, Human adenovirus A
uuccccuauagaggcuggcac

SEQ ID NO: 1537010 - RNA, 23 nt, Human adenovirus A
gcugccuccuuugccagaaccca

SEQ ID NO: 1537011 - RNA, 16 nt, Human adenovirus A
augguaaaaaggaagc

SEQ ID NO: 1537012 - RNA, 21 nt, Human adenovirus A
ugaugccgcaguggucuuaca

SEQ ID NO: 1537013 - RNA, 22 nt, Human adenovirus A
cagcgacgcaaaaaaggggcac

SEQ ID NO: 1537014 - RNA, 19 nt, Human adenovirus A
uccaaauguucaacaacag

SEQ ID NO: 1537015 - RNA, 14 nt, Human adenovirus A
cauuaccagcagcc

SEQ ID NO: 1537016 - RNA, 23 nt, Human adenovirus A
ugcuuuuagaugucgaaugcagg

SEQ ID NO: 1537017 - RNA, 22 nt, Human adenovirus A
uuaccaccaaauuuaaggccag

SEQ ID NO: 1537018 - RNA, 21 nt, Human adenovirus A
ccaaggcguggaacagccaaa

SEQ ID NO: 1537019 - RNA, 21 nt, Human adenovirus A
guuaucuaguuugguagcaaa

SEQ ID NO: 1537020 - RNA, 23 nt, Human adenovirus A
aggacacggaguguaccuugauc

SEQ ID NO: 1537021 - RNA, 22 nt, Human adenovirus A
aaacccaauuaguaacuccggg

SEQ ID NO: 1537022 - RNA, 17 nt, Human adenovirus A
ugagccauguugugcau

SEQ ID NO: 1537023 - RNA, 13 nt, Human adenovirus A
ccacaaagcagua

SEQ ID NO: 1537024 - RNA, 16 nt, Human adenovirus A
uaaccaaauacugcua

SEQ ID NO: 1537025 - RNA, 22 nt, Human adenovirus A
gacuuggaagaaugggaggagg

SEQ ID NO: 1537026 - RNA, 13 nt, Human adenovirus A
ucuaguccaagca

SEQ ID NO: 1537027 - RNA, 13 nt, Human adenovirus A
acuuuagccccag

SEQ ID NO: 1537028 - RNA, 13 nt, Human adenovirus A
caucauacauaau

SEQ ID NO: 1537029 - RNA, 15 nt, Human adenovirus A
gcagcaccuggagcg

SEQ ID NO: 1537030 - RNA, 17 nt, Human adenovirus A
cucgcagcucuuauuuu

SEQ ID NO: 1537031 - RNA, 15 nt, Human adenovirus A
gcaaugcuuggaaga

SEQ ID NO: 1537032 - RNA, 23 nt, Human adenovirus A
cacugucagugaagcaaaccaca

SEQ ID NO: 1537033 - RNA, 18 nt, Human adenovirus A
cgugaauauuaaaaagcu

SEQ ID NO: 1537034 - RNA, 20 nt, Human adenovirus A
cgugguacgcauucaccagc

SEQ ID NO: 1537035 - RNA, 16 nt, Human adenovirus A
auggaaccccaaaucg

SEQ ID NO: 1537036 - RNA, 19 nt, Human adenovirus A
acuggcuaacgcuccaggg

SEQ ID NO: 1537037 - RNA, 16 nt, Human adenovirus A
ucauccacaucuacaa

SEQ ID NO: 1537038 - RNA, 16 nt, Human adenovirus A
gccuacacaacacaaa

SEQ ID NO: 1537039 - RNA, 18 nt, Human adenovirus A
caagcauuuuuuguugcu

SEQ ID NO: 1537040 - RNA, 13 nt, Human adenovirus A
auaugcauuuaca

SEQ ID NO: 1537041 - RNA, 19 nt, Human adenovirus A
ggauggguguuuggcagca

SEQ ID NO: 1537042 - RNA, 20 nt, Human adenovirus A
uauguacauaauccagcaag

SEQ ID NO: 1537043 - RNA, 14 nt, Human adenovirus A
auuaccagcagcca

SEQ ID NO: 1537044 - RNA, 19 nt, Human adenovirus A
ugaaucgcagucaccacca

SEQ ID NO: 1537045 - RNA, 14 nt, Human adenovirus A
uggccagcugcccu

SEQ ID NO: 1537046 - RNA, 22 nt, Human adenovirus A
uuaacuaguuuacccgccagug

SEQ ID NO: 1537047 - RNA, 21 nt, Human adenovirus A
aacuaaccgucgccagcaagu

SEQ ID NO: 1537048 - RNA, 22 nt, Human adenovirus A
caaugacaaugaauaagccacc

SEQ ID NO: 1537049 - RNA, 22 nt, Human adenovirus A
cuaaccccaaaugaauuugaaa

SEQ ID NO: 1537050 - RNA, 17 nt, Human adenovirus A
cuaacaacuccagaugu

SEQ ID NO: 1537051 - RNA, 17 nt, Human adenovirus A
ccguaaaauacacauaa

SEQ ID NO: 1537052 - RNA, 15 nt, Human adenovirus A
acaacuuaacaaauu

SEQ ID NO: 1537053 - RNA, 16 nt, Human adenovirus A
cauuguaaaugcuuug

SEQ ID NO: 1537054 - RNA, 23 nt, Human adenovirus A
aucuggagcggucuuaaaaauuu

SEQ ID NO: 1537055 - RNA, 14 nt, Human adenovirus A
auuacaugcuggau

SEQ ID NO: 1537056 - RNA, 16 nt, Human adenovirus A
uucauugguccaggcu

SEQ ID NO: 1537057 - RNA, 23 nt, Human adenovirus A
cagacuaaauggaagacaucaau

SEQ ID NO: 1537058 - RNA, 13 nt, Human adenovirus A
aagacagcaugga

SEQ ID NO: 1537059 - RNA, 13 nt, Human adenovirus A
uaugcccagcaug

SEQ ID NO: 1537060 - RNA, 13 nt, Human adenovirus A
ccaccaguuggaa

SEQ ID NO: 1537061 - RNA, 12 nt, Human adenovirus A
uacuugaacaac

SEQ ID NO: 1537062 - RNA, 15 nt, Human adenovirus A
acaagcugcgcugcc

SEQ ID NO: 1537063 - RNA, 22 nt, Human adenovirus A
uuacaugaagauuucugcuguc

SEQ ID NO: 1537064 - RNA, 20 nt, Human adenovirus A
cgcuacagauccauguugcu

SEQ ID NO: 1537065 - RNA, 14 nt, Human adenovirus A
ggcgaacaggaaga

SEQ ID NO: 1537066 - RNA, 15 nt, Human adenovirus A
gguagucggccagca

SEQ ID NO: 1537067 - RNA, 14 nt, Human adenovirus A
augaggcagucaca

SEQ ID NO: 1537068 - RNA, 22 nt, Human adenovirus A
gcgcacuucuugcugaaaugcg

SEQ ID NO: 1537069 - RNA, 12 nt, Human adenovirus A
cagauuuugugc

SEQ ID NO: 1537070 - RNA, 21 nt, Human adenovirus A
gcacauauucgcgugccaggc

SEQ ID NO: 1537071 - RNA, 19 nt, Human adenovirus A
aguucaugcuaaaagcuuc

SEQ ID NO: 1537072 - RNA, 17 nt, Human adenovirus A
aauacugaaaaauagug

SEQ ID NO: 1537073 - RNA, 21 nt, Human adenovirus A
caacagcuucuaaaagagcca

SEQ ID NO: 1537074 - RNA, 20 nt, Human adenovirus A
auuacaugaagauuucugcu

SEQ ID NO: 1537075 - RNA, 20 nt, Human adenovirus A
gggauacuaccgcugcucag

SEQ ID NO: 1537076 - RNA, 14 nt, Human adenovirus A
ucaaaggcaggcau

SEQ ID NO: 1537077 - RNA, 17 nt, Human adenovirus A
aagaccaaaauuuucaa

SEQ ID NO: 1537078 - RNA, 18 nt, Human adenovirus A
caaacagccgaaagacca

SEQ ID NO: 1537079 - RNA, 17 nt, Human adenovirus A
gccggcgaacgggcagc

SEQ ID NO: 1537080 - RNA, 22 nt, Human adenovirus A
agccaaaaaaacagauucugga

SEQ ID NO: 1537081 - RNA, 17 nt, Human adenovirus A
ccagaaaaaggaguucg

SEQ ID NO: 1537082 - RNA, 17 nt, Human adenovirus A
augugaugaaaguagaa

SEQ ID NO: 1537083 - RNA, 13 nt, Human adenovirus A
cgccuuuucuaga

SEQ ID NO: 1537084 - RNA, 21 nt, Human adenovirus A
aguacaggcaacaugggugua

SEQ ID NO: 1537085 - RNA, 23 nt, Human adenovirus A
uccaccgccauccgcaggcagua

SEQ ID NO: 1537086 - RNA, 16 nt, Human adenovirus A
agguauucagcugaac

SEQ ID NO: 1537087 - RNA, 22 nt, Human adenovirus A
guuuaaaucuuucugcuccccu

SEQ ID NO: 1537088 - RNA, 20 nt, Human adenovirus A
gaagucaacuaaaaauuguu

SEQ ID NO: 1537089 - RNA, 15 nt, Human adenovirus A
augaugcgggcagcc

SEQ ID NO: 1537090 - RNA, 20 nt, Human adenovirus A
ugcauuuuauuauuugcugc

SEQ ID NO: 1537091 - RNA, 17 nt, Human adenovirus A
cugcuccgacaacagcu

SEQ ID NO: 1537092 - RNA, 15 nt, Human adenovirus A
aacugcagacagugg

SEQ ID NO: 1537093 - RNA, 19 nt, Human adenovirus A
agcugccguucguccucuu

SEQ ID NO: 1537094 - RNA, 16 nt, Human adenovirus A
ucauggagaaggacaa

SEQ ID NO: 1537095 - RNA, 11 nt, Human adenovirus A
ugcaaugcagc

SEQ ID NO: 1537096 - RNA, 13 nt, Human adenovirus A
ugucgaaugcagg

SEQ ID NO: 1537097 - RNA, 12 nt, Human adenovirus A
cuauuguuaaug

SEQ ID NO: 1537098 - RNA, 18 nt, Human adenovirus A
aacaauuugcaucucacc

SEQ ID NO: 1537099 - RNA, 21 nt, Human adenovirus A
cauuccugcagcacuguaaaa

SEQ ID NO: 1537100 - RNA, 18 nt, Human adenovirus A
guaggcaaguuguggaua

SEQ ID NO: 1537101 - RNA, 23 nt, Human adenovirus A
cguuguacaaagggggcgcacac

SEQ ID NO: 1537102 - RNA, 18 nt, Human adenovirus A
cuguacgcaagcauuuuu

SEQ ID NO: 1537103 - RNA, 18 nt, Human adenovirus A
agauguaacaggcggcuc

SEQ ID NO: 1537104 - RNA, 20 nt, Human adenovirus A
aaguguuuguuugaaaaaug

SEQ ID NO: 1537105 - RNA, 17 nt, Human adenovirus A
aggagguauuccuccuu

SEQ ID NO: 1537106 - RNA, 14 nt, Human adenovirus A
uccucgaaagcgag

SEQ ID NO: 1537107 - RNA, 11 nt, Human adenovirus A
uggcuuccaug

SEQ ID NO: 1537108 - RNA, 19 nt, Human adenovirus A
ggaugaaaaacgagcagca

SEQ ID NO: 1537109 - RNA, 20 nt, Human adenovirus A
caagucuucugacauugcuu

SEQ ID NO: 1537110 - RNA, 15 nt, Human adenovirus A
auuaggcuccacacc

SEQ ID NO: 1537111 - RNA, 13 nt, Human adenovirus A
ucucgauccagca

SEQ ID NO: 1537112 - RNA, 18 nt, Human adenovirus A
ggguguauuggccgggca

SEQ ID NO: 1537113 - RNA, 14 nt, Human adenovirus A
cuuaccaacaccuc

SEQ ID NO: 1537114 - RNA, 12 nt, Human adenovirus A
guagacgagguc

SEQ ID NO: 1537115 - RNA, 23 nt, Human adenovirus A
augcguuacccuagaaaagucaa

SEQ ID NO: 1537116 - RNA, 16 nt, Human adenovirus A
uaaucacaacacagca

SEQ ID NO: 1537117 - RNA, 15 nt, Human adenovirus A
gacauaauuuuccca

SEQ ID NO: 1537118 - RNA, 15 nt, Human adenovirus A
gagaagcggagccac

SEQ ID NO: 1537119 - RNA, 17 nt, Human adenovirus A
gccaggguaaugguggc

SEQ ID NO: 1537120 - RNA, 13 nt, Human adenovirus A
ucucuacagcccc

SEQ ID NO: 1537121 - RNA, 16 nt, Human adenovirus A
caagcuacccuucgcu

SEQ ID NO: 1537122 - RNA, 18 nt, Human adenovirus A
cacuuacccgcagcuguc

SEQ ID NO: 1537123 - RNA, 12 nt, Human adenovirus A
agcagcgguggc

SEQ ID NO: 1537124 - RNA, 22 nt, Human adenovirus A
accaaagccauggcgaccagug

SEQ ID NO: 1537125 - RNA, 21 nt, Human adenovirus A
cggcauuuagaggcuggagcu

SEQ ID NO: 1537126 - RNA, 16 nt, Human adenovirus A
cugaucgcucuucaau

SEQ ID NO: 1537127 - RNA, 15 nt, Human adenovirus A
acugcuuugcucgag

SEQ ID NO: 1537128 - RNA, 19 nt, Human adenovirus A
gcauguuugacaagauugu

SEQ ID NO: 1537129 - RNA, 22 nt, Human adenovirus A
cauggcuaguucuuacuuugac

SEQ ID NO: 1537130 - RNA, 22 nt, Human adenovirus A
acuacuuuauaacuaacuuuaa

SEQ ID NO: 1537131 - RNA, 20 nt, Human adenovirus A
acuaccgcugcucagcucca

SEQ ID NO: 1537132 - RNA, 15 nt, Human adenovirus A
accuacacaugaagg

SEQ ID NO: 1537133 - RNA, 19 nt, Human adenovirus A
gcgacauuuagaccacugu

SEQ ID NO: 1537134 - RNA, 18 nt, Human adenovirus A
cccgacggaguguuucag

SEQ ID NO: 1537135 - RNA, 21 nt, Human adenovirus A
aagcggcacaacagacugggg

SEQ ID NO: 1537136 - RNA, 21 nt, Human adenovirus A
gugaagcaaaccacauaggca

SEQ ID NO: 1537137 - RNA, 20 nt, Human adenovirus A
gaccaagccuauuuuaccca

SEQ ID NO: 1537138 - RNA, 14 nt, Human adenovirus A
aggcauuuccaggu

SEQ ID NO: 1537139 - RNA, 13 nt, Human adenovirus A
aaagacagccaag

SEQ ID NO: 1537140 - RNA, 22 nt, Human adenovirus A
aggcagccguuucaggaaggau

SEQ ID NO: 1537141 - RNA, 12 nt, Human adenovirus A
aguuaaguuuga

SEQ ID NO: 1537142 - RNA, 16 nt, Human adenovirus A
caguuuaacacauaca

SEQ ID NO: 1537143 - RNA, 13 nt, Human adenovirus A
aguagccuugcag

SEQ ID NO: 1537144 - RNA, 15 nt, Human adenovirus A
accuguucuccccac

SEQ ID NO: 1537145 - RNA, 16 nt, Human adenovirus A
cacuuaugcucccaca

SEQ ID NO: 1537146 - RNA, 22 nt, Human adenovirus A
aggccaucuugcuuguuuaaac

SEQ ID NO: 1537147 - RNA, 20 nt, Human adenovirus A
ucgcgcuuuggaggcagcug

SEQ ID NO: 1537148 - RNA, 17 nt, Human adenovirus A
caggaaaucugggagga

SEQ ID NO: 1537149 - RNA, 17 nt, Human adenovirus A
aguccaagcaaguacaa

SEQ ID NO: 1537150 - RNA, 23 nt, Human adenovirus A
agcuucuugcuuuaagggcuggc

SEQ ID NO: 1537151 - RNA, 17 nt, Human adenovirus A
gacugucagugucuccg

SEQ ID NO: 1537152 - RNA, 17 nt, Human adenovirus A
caguacacuugggaaau

SEQ ID NO: 1537153 - RNA, 20 nt, Human adenovirus A
acgcaacaacugagacuucc

SEQ ID NO: 1537154 - RNA, 22 nt, Human adenovirus A
uaaagucagacuauuacacuca

SEQ ID NO: 1537155 - RNA, 22 nt, Human adenovirus A
gaacaacuuuuaacauuagcag

SEQ ID NO: 1537156 - RNA, 13 nt, Human adenovirus A
cgugccaggcauu

SEQ ID NO: 1537157 - RNA, 16 nt, Human adenovirus A
uuuuaccuaaaccaca

SEQ ID NO: 1537158 - RNA, 16 nt, Human adenovirus A
cugcacucucugggga

SEQ ID NO: 1537159 - RNA, 22 nt, Human adenovirus A
ugauuucgauaaacaaaagcaa

SEQ ID NO: 1537160 - RNA, 13 nt, Human adenovirus A
agcugaaaacaac

SEQ ID NO: 1537161 - RNA, 14 nt, Human adenovirus A
uuucccucuuccca

SEQ ID NO: 1537162 - RNA, 16 nt, Human adenovirus A
auaaaaggcuggaagu

SEQ ID NO: 1537163 - RNA, 16 nt, Human adenovirus A
gggccggucgcgagcu

SEQ ID NO: 1537164 - RNA, 17 nt, Human adenovirus A
uuacaugucaaugcagc

SEQ ID NO: 1537165 - RNA, 14 nt, Human adenovirus A
ugagacuucccaca

SEQ ID NO: 1537166 - RNA, 19 nt, Human adenovirus A
acuuuccggagaaagaauu

SEQ ID NO: 1537167 - RNA, 15 nt, Human adenovirus A
guuauguaugcccag

SEQ ID NO: 1537168 - RNA, 13 nt, Human adenovirus A
caaccucacugcu

SEQ ID NO: 1537169 - RNA, 18 nt, Human adenovirus A
aggagcuaaaacaagguc

SEQ ID NO: 1537170 - RNA, 17 nt, Human adenovirus A
gcuacugcgucucccca

SEQ ID NO: 1537171 - RNA, 15 nt, Human adenovirus A
aaagaucaaggaaau

SEQ ID NO: 1537172 - RNA, 13 nt, Human adenovirus A
acaaguuaaaaga

SEQ ID NO: 1537173 - RNA, 19 nt, Human adenovirus A
cuacuaacaacuccagaug

SEQ ID NO: 1537174 - RNA, 20 nt, Human adenovirus A
uuacauaccuggcaaacugg

SEQ ID NO: 1537175 - RNA, 22 nt, Human adenovirus A
auguucccauugacaaggaagu

SEQ ID NO: 1537176 - RNA, 13 nt, Human adenovirus A
augaaaacaaugu

SEQ ID NO: 1537177 - RNA, 14 nt, Human adenovirus A
cuuacauuuaauaa

SEQ ID NO: 1537178 - RNA, 17 nt, Human adenovirus A
caauaaagaaaaaacuu

SEQ ID NO: 1537179 - RNA, 15 nt, Human adenovirus A
auuugccggaaggaa

SEQ ID NO: 1537180 - RNA, 12 nt, Human adenovirus A
aaucggcggcgc

SEQ ID NO: 1537181 - RNA, 19 nt, Human adenovirus A
accaaaauuuucaacagaa

SEQ ID NO: 1537182 - RNA, 22 nt, Human adenovirus A
cugauaacaagaacaccuacga

SEQ ID NO: 1537183 - RNA, 15 nt, Human adenovirus A
aggagcuaaaacaag

SEQ ID NO: 1537184 - RNA, 12 nt, Human adenovirus A
cgacaacacugu

SEQ ID NO: 1537185 - RNA, 17 nt, Human adenovirus A
cccgcauguauggagga

SEQ ID NO: 1537186 - RNA, 16 nt, Human adenovirus A
aacgcaaguucaaaga

SEQ ID NO: 1537187 - RNA, 21 nt, Human adenovirus A
aaguucaccggugaagaugau

SEQ ID NO: 1537188 - RNA, 18 nt, Human adenovirus A
cgagggaaauccaacacc

SEQ ID NO: 1537189 - RNA, 18 nt, Human adenovirus A
cauucucuaacaagcugc

SEQ ID NO: 1537190 - RNA, 16 nt, Human adenovirus A
uuacuugaacaacuuu

SEQ ID NO: 1537191 - RNA, 15 nt, Human adenovirus A
cacggccucagcagc

SEQ ID NO: 1537192 - RNA, 22 nt, Human adenovirus A
auacgcuugugcagccuuucuu

SEQ ID NO: 1537193 - RNA, 22 nt, Human adenovirus A
uccugaugcuuuucgccagcag

SEQ ID NO: 1537194 - RNA, 20 nt, Human adenovirus A
auaaauucuuaaacaaucug

SEQ ID NO: 1537195 - RNA, 20 nt, Human adenovirus A
cauguggucaggucuaucaa

SEQ ID NO: 1537196 - RNA, 22 nt, Human adenovirus A
acaacaaaacacugagcuccau

SEQ ID NO: 1537197 - RNA, 13 nt, Human adenovirus A
caaguuaaaagac

SEQ ID NO: 1537198 - RNA, 17 nt, Human adenovirus A
uucaaacaccugcagua

SEQ ID NO: 1537199 - RNA, 13 nt, Human adenovirus A
cguuaccacccua

SEQ ID NO: 1537200 - RNA, 14 nt, Human adenovirus A
cacaugucuccuuc

SEQ ID NO: 1537201 - RNA, 19 nt, Human adenovirus A
aauauugagguuacucacu

SEQ ID NO: 1537202 - RNA, 21 nt, Human adenovirus A
cgaguguuaauucccaucugu

SEQ ID NO: 1537203 - RNA, 19 nt, Human adenovirus A
ucauuugcgcccacagggu

SEQ ID NO: 1537204 - RNA, 17 nt, Human adenovirus A
cgcaggagaaaauaaca

SEQ ID NO: 1537205 - RNA, 21 nt, Human adenovirus A
auucaggugccgcaaaaauuu

SEQ ID NO: 1537206 - RNA, 16 nt, Human adenovirus A
caugcuaaaagcuucu

SEQ ID NO: 1537207 - RNA, 18 nt, Human adenovirus A
gcgcagcagaacccagua

SEQ ID NO: 1537208 - RNA, 16 nt, Human adenovirus A
cauaauuuuaaaguaa

SEQ ID NO: 1537209 - RNA, 11 nt, Human adenovirus A
uuguuaucuag

SEQ ID NO: 1537210 - RNA, 16 nt, Human adenovirus A
ucaaaggcaggcauua

SEQ ID NO: 1537211 - RNA, 16 nt, Human adenovirus A
cauucaacugaccagg

SEQ ID NO: 1537212 - RNA, 19 nt, Human adenovirus A
uggagugugcuauuaaagc

SEQ ID NO: 1537213 - RNA, 15 nt, Human adenovirus A
aggacaauccaagga

SEQ ID NO: 1537214 - RNA, 21 nt, Human adenovirus A
acuuaucaagaaauaaccagu

SEQ ID NO: 1537215 - RNA, 16 nt, Human adenovirus A
aagaucaguagcuaag

SEQ ID NO: 1537216 - RNA, 18 nt, Human adenovirus A
uggaagaaugggaggagg

SEQ ID NO: 1537217 - RNA, 19 nt, Human adenovirus A
uacagccccuuugaagagc

SEQ ID NO: 1537218 - RNA, 23 nt, Human adenovirus A
auggcuucguaaaagucuacugc

SEQ ID NO: 1537219 - RNA, 19 nt, Human adenovirus A
cuaaaagagccacagcucu

SEQ ID NO: 1537220 - RNA, 22 nt, Human adenovirus A
uagagucuuuuucccauugguc

SEQ ID NO: 1537221 - RNA, 14 nt, Human adenovirus A
gcugaggaaaugcg

SEQ ID NO: 1537222 - RNA, 14 nt, Human adenovirus A
cuucuugcugaaau

SEQ ID NO: 1537223 - RNA, 13 nt, Human adenovirus A
guuucuacaucau

SEQ ID NO: 1537224 - RNA, 23 nt, Human adenovirus A
uagacauagccaaucaggcugua

SEQ ID NO: 1537225 - RNA, 17 nt, Human adenovirus A
ccauugugcuaaaugua

SEQ ID NO: 1537226 - RNA, 19 nt, Human adenovirus A
caggaaaaaaaagaaaguu

SEQ ID NO: 1537227 - RNA, 12 nt, Human adenovirus A
acggaugaaagc

SEQ ID NO: 1537228 - RNA, 18 nt, Human adenovirus A
ugccgcccgcauguaugg

SEQ ID NO: 1537229 - RNA, 14 nt, Human adenovirus A
ugccguuggcagag

SEQ ID NO: 1537230 - RNA, 16 nt, Human adenovirus A
uccguacaaggcauug

SEQ ID NO: 1537231 - RNA, 14 nt, Human adenovirus A
uuuccggagaaaga

SEQ ID NO: 1537232 - RNA, 21 nt, Human adenovirus A
ggaaauuguguacuuuucaaa

SEQ ID NO: 1537233 - RNA, 16 nt, Human adenovirus A
agaugagccuguauau

SEQ ID NO: 1537234 - RNA, 17 nt, Human adenovirus A
aagaugauugaaccuga

SEQ ID NO: 1537235 - RNA, 22 nt, Human adenovirus A
gagcuccauucuugagccugga

SEQ ID NO: 1537236 - RNA, 19 nt, Human adenovirus A
cagcauuaguucuuuucuu

SEQ ID NO: 1537237 - RNA, 15 nt, Human adenovirus A
ugccuuaggcagcag

SEQ ID NO: 1537238 - RNA, 17 nt, Human adenovirus A
caaaaggcgcuccuaau

SEQ ID NO: 1537239 - RNA, 18 nt, Human adenovirus A
ccccucgaccugcauguc

SEQ ID NO: 1537240 - RNA, 21 nt, Human adenovirus A
ccaaggaaaacuuuuguauuc

SEQ ID NO: 1537241 - RNA, 15 nt, Human adenovirus A
guuagaacuuucuaa

SEQ ID NO: 1537242 - RNA, 16 nt, Human adenovirus A
auuucuaauguggagc

SEQ ID NO: 1537243 - RNA, 16 nt, Human adenovirus A
caaauccaaaagcaac

SEQ ID NO: 1537244 - RNA, 16 nt, Human adenovirus A
ucacagccagaucaaa

SEQ ID NO: 1537245 - RNA, 23 nt, Human adenovirus A
cuaccaaggaaaacuuuuguauu

SEQ ID NO: 1537246 - RNA, 15 nt, Human adenovirus A
agccauggcgaccag

SEQ ID NO: 1537247 - RNA, 12 nt, Human adenovirus A
augauggcuuuu

SEQ ID NO: 1537248 - RNA, 19 nt, Human adenovirus A
agcuauuugagccuucauu

SEQ ID NO: 1537249 - RNA, 20 nt, Human adenovirus A
uccuacaaggcucgcuuuac

SEQ ID NO: 1537250 - RNA, 15 nt, Human adenovirus A
ccacucucgcaggcu

SEQ ID NO: 1537251 - RNA, 23 nt, Human adenovirus A
aguuaauugauuuacaaaccgug

SEQ ID NO: 1537252 - RNA, 21 nt, Human adenovirus A
acagacaccgcccaggcaggc

SEQ ID NO: 1537253 - RNA, 14 nt, Human adenovirus A
gccuaauggagugu

SEQ ID NO: 1537254 - RNA, 16 nt, Human adenovirus A
cucuuuugcagcucca

SEQ ID NO: 1537255 - RNA, 15 nt, Human adenovirus A
ggcagcggcgccacc

SEQ ID NO: 1537256 - RNA, 19 nt, Human adenovirus A
cuggcaguuuagaggccac

SEQ ID NO: 1537257 - RNA, 16 nt, Human adenovirus A
cggcgcggcucaagac

SEQ ID NO: 1537258 - RNA, 17 nt, Human adenovirus A
cuuuaaagguacuaaca

SEQ ID NO: 1537259 - RNA, 12 nt, Human adenovirus A
gucaaucauguu

SEQ ID NO: 1537260 - RNA, 23 nt, Human adenovirus A
ucagcagagucgaggucaagaac

SEQ ID NO: 1537261 - RNA, 15 nt, Human adenovirus A
gacuuuguagaagcu

SEQ ID NO: 1537262 - RNA, 13 nt, Human adenovirus A
cguuuggaaacug

SEQ ID NO: 1537263 - RNA, 13 nt, Human adenovirus A
aaggcaggcauua

SEQ ID NO: 1537264 - RNA, 15 nt, Human adenovirus A
ugguuuaauauacaa

SEQ ID NO: 1537265 - RNA, 16 nt, Human adenovirus A
acaaaauuugucugaa

SEQ ID NO: 1537266 - RNA, 14 nt, Human adenovirus A
acuccaucuguuua

SEQ ID NO: 1537267 - RNA, 23 nt, Human adenovirus A
ggaggugcucccgcagugaggac

SEQ ID NO: 1537268 - RNA, 21 nt, Human adenovirus A
cagccgcgcagaugagcuucu

SEQ ID NO: 1537269 - RNA, 22 nt, Human adenovirus A
ggauacaauguggcccaaugca

SEQ ID NO: 1537270 - RNA, 19 nt, Human adenovirus A
aacuguuagacagagcacu

SEQ ID NO: 1537271 - RNA, 16 nt, Human adenovirus A
aaaaauguuuucugga

SEQ ID NO: 1537272 - RNA, 23 nt, Human adenovirus A
aaacuucgccaauaaaaacaacg

SEQ ID NO: 1537273 - RNA, 14 nt, Human adenovirus A
uuaaaagaccaaaa

SEQ ID NO: 1537274 - RNA, 14 nt, Human adenovirus A
cggcaaaaaacgaa

SEQ ID NO: 1537275 - RNA, 18 nt, Human adenovirus A
cuuaagucuuuacaauaa

SEQ ID NO: 1537276 - RNA, 20 nt, Human adenovirus A
gcagagcauugugguucagg

SEQ ID NO: 1537277 - RNA, 15 nt, Human adenovirus A
gcacgagccagcuga

SEQ ID NO: 1537278 - RNA, 17 nt, Human adenovirus A
ugcaaguuguaaggcau

SEQ ID NO: 1537279 - RNA, 19 nt, Human adenovirus A
gcagcuccaaccaugaaaa

SEQ ID NO: 1537280 - RNA, 18 nt, Human adenovirus A
gaagacuauagagaggaa

SEQ ID NO: 1537281 - RNA, 13 nt, Human adenovirus A
augguagaggaaa

SEQ ID NO: 1537282 - RNA, 19 nt, Human adenovirus A
agauccguacaaggcauug

SEQ ID NO: 1537283 - RNA, 20 nt, Human adenovirus A
uaacaguuugcgugccuggc

SEQ ID NO: 1537284 - RNA, 21 nt, Human adenovirus A
caauaaaacaaggagccgcuc

SEQ ID NO: 1537285 - RNA, 18 nt, Human adenovirus A
augccuuuuucccaagcu

SEQ ID NO: 1537286 - RNA, 19 nt, Human adenovirus A
uugcaaacagcaaacuuuc

SEQ ID NO: 1537287 - RNA, 11 nt, Human adenovirus A
gacugagaacc

SEQ ID NO: 1537288 - RNA, 17 nt, Human adenovirus A
cagguguauuagcacuu

SEQ ID NO: 1537289 - RNA, 12 nt, Human adenovirus A
aggcauuggaaa

SEQ ID NO: 1537290 - RNA, 17 nt, Human adenovirus A
cuguggacccuauuuuu

SEQ ID NO: 1537291 - RNA, 19 nt, Human adenovirus A
auaccuuugcucaggcgcc

SEQ ID NO: 1537292 - RNA, 20 nt, Human adenovirus A
ggagcagguguaaccagcug

SEQ ID NO: 1537293 - RNA, 23 nt, Human adenovirus A
gagauuggcaauguuaccugcca

SEQ ID NO: 1537294 - RNA, 15 nt, Human adenovirus A
uaguccaguauaagg

SEQ ID NO: 1537295 - RNA, 14 nt, Human adenovirus A
uguuaacacugccg

SEQ ID NO: 1537296 - RNA, 22 nt, Human adenovirus A
acagcuucagaugacuggacag

SEQ ID NO: 1537297 - RNA, 21 nt, Human adenovirus A
ugaccccaucuuguuuccagu

SEQ ID NO: 1537298 - RNA, 18 nt, Human adenovirus A
gcugacauaauuuuccca

SEQ ID NO: 1537299 - RNA, 22 nt, Human adenovirus A
gccaucuugcuuguuuaaacau

SEQ ID NO: 1537300 - RNA, 10 nt, Human adenovirus A
ucaaggaaau

SEQ ID NO: 1537301 - RNA, 23 nt, Human adenovirus A
acgcuuuuuugaguacucagccg

SEQ ID NO: 1537302 - RNA, 19 nt, Human adenovirus A
cacgccgcgccccacuucc

SEQ ID NO: 1537303 - RNA, 21 nt, Human adenovirus A
aaaccggcgaggaacuaaacc

SEQ ID NO: 1537304 - RNA, 18 nt, Human adenovirus A
acaucaauuuuucgucgc

SEQ ID NO: 1537305 - RNA, 16 nt, Human adenovirus A
cggccauuggagccgu

SEQ ID NO: 1537306 - RNA, 13 nt, Human adenovirus A
uguccuuccaggg

SEQ ID NO: 1537307 - RNA, 20 nt, Human adenovirus A
gguacuuuuccuuguggaau

SEQ ID NO: 1537308 - RNA, 15 nt, Human adenovirus A
agcgccagaggacca

SEQ ID NO: 1537309 - RNA, 13 nt, Human adenovirus A
cacuuagagggag

SEQ ID NO: 1537310 - RNA, 15 nt, Human adenovirus A
uguccccgaaagccg

SEQ ID NO: 1537311 - RNA, 12 nt, Human adenovirus A
gaaucuguggau

SEQ ID NO: 1537312 - RNA, 22 nt, Human adenovirus A
acauugcccuguaugcuaacuu

SEQ ID NO: 1537313 - RNA, 23 nt, Human adenovirus A
acccucccucuuggccagcugcc

SEQ ID NO: 1537314 - RNA, 15 nt, Human adenovirus A
auagcaacaacgcug

SEQ ID NO: 1537315 - RNA, 22 nt, Human adenovirus A
ccuacuuuguauacucuggaac

SEQ ID NO: 1537316 - RNA, 20 nt, Human adenovirus A
ccaaggcguggaacagccaa

SEQ ID NO: 1537317 - RNA, 15 nt, Human adenovirus A
cuaguucuugucaac

SEQ ID NO: 1537318 - RNA, 16 nt, Human adenovirus A
acgucgcuaaauggau

SEQ ID NO: 1537319 - RNA, 23 nt, Human adenovirus A
aaccaaaggagaaaagcggccac

SEQ ID NO: 1537320 - RNA, 13 nt, Human adenovirus A
auaucaauguuuu

SEQ ID NO: 1537321 - RNA, 22 nt, Human adenovirus A
aaaaucuaagccaugcaaauag

SEQ ID NO: 1537322 - RNA, 10 nt, Human adenovirus A
uuaauguuuc

SEQ ID NO: 1537323 - RNA, 10 nt, Human adenovirus A
ucaauguuuu

SEQ ID NO: 1537324 - RNA, 16 nt, Human adenovirus A
ugaucugucagugaaa

SEQ ID NO: 1537325 - RNA, 17 nt, Human adenovirus A
cgcucuggcaggggaag

SEQ ID NO: 1537326 - RNA, 19 nt, Human adenovirus A
ccuccuauguuagcgccag

SEQ ID NO: 1537327 - RNA, 16 nt, Human adenovirus A
ccagcucuuggaauaa

SEQ ID NO: 1537328 - RNA, 17 nt, Human adenovirus A
ccgcagcugucucuacc

SEQ ID NO: 1537329 - RNA, 12 nt, Human adenovirus A
ugcaaacagcaa

SEQ ID NO: 1537330 - RNA, 15 nt, Human adenovirus A
caucuuaaugccagu

SEQ ID NO: 1537331 - RNA, 12 nt, Human adenovirus A
agaccaaaaagu

SEQ ID NO: 1537332 - RNA, 12 nt, Human adenovirus A
acacaaagaaaa

SEQ ID NO: 1537333 - RNA, 16 nt, Human adenovirus A
acaacagcugcuguca

SEQ ID NO: 1537334 - RNA, 17 nt, Human adenovirus A
uauaguggcacaacaca

SEQ ID NO: 1537335 - RNA, 15 nt, Human adenovirus A
gacagcauggagugc

SEQ ID NO: 1537336 - RNA, 20 nt, Human adenovirus A
cacagaacauacaacuugca

SEQ ID NO: 1537337 - RNA, 17 nt, Human adenovirus A
cguauuuuuccuuugga

SEQ ID NO: 1537338 - RNA, 20 nt, Human adenovirus A
ucuaagguguguaaacacau

SEQ ID NO: 1537339 - RNA, 16 nt, Human adenovirus A
cucucgcuuaaagagu

SEQ ID NO: 1537340 - RNA, 19 nt, Human adenovirus A
uuuggauguaaaaaaauac

SEQ ID NO: 1537341 - RNA, 15 nt, Human adenovirus A
uggcuuuaggccauc

SEQ ID NO: 1537342 - RNA, 23 nt, Human adenovirus A
uaaagcaaaccacugcaaugcag

SEQ ID NO: 1537343 - RNA, 17 nt, Human adenovirus A
guucaauaguggcugca

SEQ ID NO: 1537344 - RNA, 22 nt, Human adenovirus A
uacaaacuggaacuuaacaacu

SEQ ID NO: 1537345 - RNA, 23 nt, Human adenovirus A
acgcaguuacaacuugcuuccag

SEQ ID NO: 1537346 - RNA, 14 nt, Human adenovirus A
ccgucgcuuucaac

SEQ ID NO: 1537347 - RNA, 21 nt, Human adenovirus A
acuuggcuucgaaugcuguga

SEQ ID NO: 1537348 - RNA, 19 nt, Human adenovirus A
gcaucuauaguaaaaaugc

SEQ ID NO: 1537349 - RNA, 21 nt, Human adenovirus A
cgcccagacguaggguacagu

SEQ ID NO: 1537350 - RNA, 18 nt, Human adenovirus A
cuggacugccgacaacac

SEQ ID NO: 1537351 - RNA, 21 nt, Human adenovirus A
aggguccggacguuccuccuu

SEQ ID NO: 1537352 - RNA, 18 nt, Human adenovirus A
uaaccagagcaccccuuc

SEQ ID NO: 1537353 - RNA, 16 nt, Human adenovirus A
aacagcaaacuuucuc

SEQ ID NO: 1537354 - RNA, 23 nt, Human adenovirus A
caacauuuguauucauacuaaca

SEQ ID NO: 1537355 - RNA, 21 nt, Human adenovirus A
ucuacccaguuuuugcagugc

SEQ ID NO: 1537356 - RNA, 18 nt, Human adenovirus A
ugcuccccucaacagcac

SEQ ID NO: 1537357 - RNA, 15 nt, Human adenovirus A
gcgcccuccaccgcc

SEQ ID NO: 1537358 - RNA, 16 nt, Human adenovirus A
cauacauaauuuuaaa

SEQ ID NO: 1537359 - RNA, 11 nt, Human adenovirus A
uaaacugccuc

SEQ ID NO: 1537360 - RNA, 12 nt, Human adenovirus A
cagcgcacuggc

SEQ ID NO: 1537361 - RNA, 19 nt, Human adenovirus A
cauuccccauccaaaacca

SEQ ID NO: 1537362 - RNA, 21 nt, Human adenovirus A
uaaccagagcaccccuuccca

SEQ ID NO: 1537363 - RNA, 14 nt, Human adenovirus A
gucguuacuuuugc

SEQ ID NO: 1537364 - RNA, 18 nt, Human adenovirus A
gccaucggccauaggcau

SEQ ID NO: 1537365 - RNA, 15 nt, Human adenovirus A
caacggccagccaag

SEQ ID NO: 1537366 - RNA, 13 nt, Human adenovirus A
aauuaaacccuuu

SEQ ID NO: 1537367 - RNA, 18 nt, Human adenovirus A
gcgcgcaauauggagccg

SEQ ID NO: 1537368 - RNA, 12 nt, Human adenovirus A
aaggguccaggg

SEQ ID NO: 1537369 - RNA, 18 nt, Human adenovirus A
ucuacaacgagcaagccg

SEQ ID NO: 1537370 - RNA, 17 nt, Human adenovirus A
uugcaagcgaucccaua

SEQ ID NO: 1537371 - RNA, 21 nt, Human adenovirus A
cauuaauaauaaaaccauuuu

SEQ ID NO: 1537372 - RNA, 21 nt, Human adenovirus A
gcguugguucgacgggccagg

SEQ ID NO: 1537373 - RNA, 18 nt, Human adenovirus A
ugaucacagcaacuuuuu

SEQ ID NO: 1537374 - RNA, 15 nt, Human adenovirus A
agaagcuuauguaca

SEQ ID NO: 1537375 - RNA, 13 nt, Human adenovirus A
agaggaagaaaga

SEQ ID NO: 1537376 - RNA, 23 nt, Human adenovirus A
uuguacggacaacauccuuuuuc

SEQ ID NO: 1537377 - RNA, 20 nt, Human adenovirus A
ugacccaccaccaaacugca

SEQ ID NO: 1537378 - RNA, 22 nt, Human adenovirus A
cgucuccccauucgcagcaugu

SEQ ID NO: 1537379 - RNA, 23 nt, Human adenovirus A
auugcccccuuuaccaacaccaa

SEQ ID NO: 1537380 - RNA, 21 nt, Human adenovirus A
cucaaacgccgacgcugcuac

SEQ ID NO: 1537381 - RNA, 13 nt, Human adenovirus A
aaaaaauugccaa

SEQ ID NO: 1537382 - RNA, 19 nt, Human adenovirus A
caggcgcggcgguguaugc

SEQ ID NO: 1537383 - RNA, 14 nt, Human adenovirus A
gacaaagagugacu

SEQ ID NO: 1537384 - RNA, 13 nt, Human adenovirus A
caaagaagagcug

SEQ ID NO: 1537385 - RNA, 21 nt, Human adenovirus A
uagaacaaaaaggaggaagaa

SEQ ID NO: 1537386 - RNA, 20 nt, Human adenovirus A
aaacuguauauuggcaggag

SEQ ID NO: 1537387 - RNA, 20 nt, Human adenovirus A
accuucgagaacuaaacaaa

SEQ ID NO: 1537388 - RNA, 16 nt, Human adenovirus A
gcaagaggagaaggag

SEQ ID NO: 1537389 - RNA, 16 nt, Human adenovirus A
cagucuguuuaguccu

SEQ ID NO: 1537390 - RNA, 19 nt, Human adenovirus A
cauuaccgagcuccauggg

SEQ ID NO: 1537391 - RNA, 16 nt, Human adenovirus A
gauuucgauaaacaaa

SEQ ID NO: 1537392 - RNA, 19 nt, Human adenovirus A
cccggauccguuccaacca

SEQ ID NO: 1537393 - RNA, 15 nt, Human adenovirus A
auauguaucuggaca

SEQ ID NO: 1537394 - RNA, 22 nt, Human adenovirus A
aggaaaaaaaagaaaguuuaaa

SEQ ID NO: 1537395 - RNA, 13 nt, Human adenovirus A
gagccccuuacca

SEQ ID NO: 1537396 - RNA, 14 nt, Human adenovirus A
aucguucaacuuug

SEQ ID NO: 1537397 - RNA, 22 nt, Human adenovirus A
caucuauaguaaaaaugccagg

SEQ ID NO: 1537398 - RNA, 16 nt, Human adenovirus A
uggaacugcagacagu

SEQ ID NO: 1537399 - RNA, 20 nt, Human adenovirus A
aagccuagggggggagccgu

SEQ ID NO: 1537400 - RNA, 13 nt, Human adenovirus A
cugaagaaacaga

SEQ ID NO: 1537401 - RNA, 18 nt, Human adenovirus A
cuccaauuuuuugauuac

SEQ ID NO: 1537402 - RNA, 20 nt, Human adenovirus A
cgugaaguauuccaugagcc

SEQ ID NO: 1537403 - RNA, 15 nt, Human adenovirus A
aaaauggaacccuua

SEQ ID NO: 1537404 - RNA, 23 nt, Human adenovirus A
gugcaaaacuuucuaccaaggaa

SEQ ID NO: 1537405 - RNA, 21 nt, Human adenovirus A
acacauugacuguuuccacug

SEQ ID NO: 1537406 - RNA, 21 nt, Human adenovirus A
cacauugcgcaaaauugagga

SEQ ID NO: 1537407 - RNA, 21 nt, Human adenovirus A
acaauuugcaucucaccacug

SEQ ID NO: 1537408 - RNA, 22 nt, Human adenovirus A
gccuguuuuguauuauugaagg

SEQ ID NO: 1537409 - RNA, 15 nt, Human adenovirus A
aauacuguuaccaau

SEQ ID NO: 1537410 - RNA, 20 nt, Human adenovirus A
cuacacaugaaggaaugccu

SEQ ID NO: 1537411 - RNA, 20 nt, Human adenovirus A
gcgcgcccggcucccacgcc

SEQ ID NO: 1537412 - RNA, 20 nt, Human adenovirus A
gcagacgcaugaaggguggg

SEQ ID NO: 1537413 - RNA, 19 nt, Human adenovirus A
cggguaagagcaggcugga

SEQ ID NO: 1537414 - RNA, 17 nt, Human adenovirus A
gaccuacuuacuggggu

SEQ ID NO: 1537415 - RNA, 16 nt, Human adenovirus A
gaccuuaaucuguuuu

SEQ ID NO: 1537416 - RNA, 15 nt, Human adenovirus A
gucgccgcagagagc

SEQ ID NO: 1537417 - RNA, 17 nt, Human adenovirus A
gccguggcuagcuugcg

SEQ ID NO: 1537418 - RNA, 22 nt, Human adenovirus A
cuucuccagacaacuucauuuu

SEQ ID NO: 1537419 - RNA, 14 nt, Human adenovirus A
cauaggagcugcac

SEQ ID NO: 1537420 - RNA, 20 nt, Human adenovirus A
uggcuucacuagaccuuugu

SEQ ID NO: 1537421 - RNA, 17 nt, Human adenovirus A
aguuuacccgccagugu

SEQ ID NO: 1537422 - RNA, 15 nt, Human adenovirus A
cucaugaccauguaa

SEQ ID NO: 1537423 - RNA, 23 nt, Human adenovirus A
cucagcuggaagagcuaucgcaa

SEQ ID NO: 1537424 - RNA, 18 nt, Human adenovirus A
cacggaguaaugaacaag

SEQ ID NO: 1537425 - RNA, 21 nt, Human adenovirus A
augggcaccuggaacgagauc

SEQ ID NO: 1537426 - RNA, 15 nt, Human adenovirus A
ccgcgcugcggccau

SEQ ID NO: 1537427 - RNA, 17 nt, Human adenovirus A
ucaugguuugcuaacag

SEQ ID NO: 1537428 - RNA, 15 nt, Human adenovirus A
ucaucguaggacaac

SEQ ID NO: 1537429 - RNA, 14 nt, Human adenovirus A
accgauugggacag

SEQ ID NO: 1537430 - RNA, 15 nt, Human adenovirus A
cgagcuaaccgcagc

SEQ ID NO: 1537431 - RNA, 14 nt, Human adenovirus A
aggagcuaaaacaa

SEQ ID NO: 1537432 - RNA, 15 nt, Human adenovirus A
gaccgccuuuucuag

SEQ ID NO: 1537433 - RNA, 14 nt, Human adenovirus A
cauguuaaaaaacg

SEQ ID NO: 1537434 - RNA, 21 nt, Human adenovirus A
caaggcauuggaaagcagcuu

SEQ ID NO: 1537435 - RNA, 15 nt, Human adenovirus A
aguucaaacagugga

SEQ ID NO: 1537436 - RNA, 20 nt, Human adenovirus A
aaagaauuauucccgcagcc

SEQ ID NO: 1537437 - RNA, 22 nt, Human adenovirus A
aagccgucuacucacagcuuau

SEQ ID NO: 1537438 - RNA, 13 nt, Human adenovirus A
gcccgccuggcag

SEQ ID NO: 1537439 - RNA, 16 nt, Human adenovirus A
caaacguccaggcagg

SEQ ID NO: 1537440 - RNA, 16 nt, Human adenovirus A
gcgagucaccaucacu

SEQ ID NO: 1537441 - RNA, 15 nt, Human adenovirus A
cagccauaaugccuu

SEQ ID NO: 1537442 - RNA, 20 nt, Human adenovirus A
gcacauugcaacgcaaucag

SEQ ID NO: 1537443 - RNA, 15 nt, Human adenovirus A
cagcguccaugaaug

SEQ ID NO: 1537444 - RNA, 14 nt, Human adenovirus A
uaauugaaguaagc

SEQ ID NO: 1537445 - RNA, 20 nt, Human adenovirus A
gcugagguuaaaaggaguga

SEQ ID NO: 1537446 - RNA, 13 nt, Human adenovirus A
gcacaauaguuua

SEQ ID NO: 1537447 - RNA, 20 nt, Human adenovirus A
gcgcgagaagaaguagccau

SEQ ID NO: 1537448 - RNA, 14 nt, Human adenovirus A
aucuguaaguuugu

SEQ ID NO: 1537449 - RNA, 15 nt, Human adenovirus A
guaacccuuccccac

SEQ ID NO: 1537450 - RNA, 22 nt, Human adenovirus A
ggguacuggaucguggucccag

SEQ ID NO: 1537451 - RNA, 22 nt, Human adenovirus A
cuaaacgagggagauguccugu

SEQ ID NO: 1537452 - RNA, 13 nt, Human adenovirus A
cucaaaaacucca

SEQ ID NO: 1537453 - RNA, 18 nt, Human adenovirus A
aagcgacagaguugcuuu

SEQ ID NO: 1537454 - RNA, 18 nt, Human adenovirus A
gcuccgacaacagcugcu

SEQ ID NO: 1537455 - RNA, 19 nt, Human adenovirus A
uguuaaauuaaagaugccu

SEQ ID NO: 1537456 - RNA, 20 nt, Human adenovirus A
gaugcgaaccgauugggaaa

SEQ ID NO: 1537457 - RNA, 13 nt, Human adenovirus A
ccauggcuuccau

SEQ ID NO: 1537458 - RNA, 21 nt, Human adenovirus A
gcgagucaccaucacugacgc

SEQ ID NO: 1537459 - RNA, 15 nt, Human adenovirus A
cacucugacacaaaa

SEQ ID NO: 1537460 - RNA, 20 nt, Human adenovirus A
agcugaaacuaggggcuggc

SEQ ID NO: 1537461 - RNA, 11 nt, Human adenovirus A
cagcuguggaa

SEQ ID NO: 1537462 - RNA, 17 nt, Human adenovirus A
ggcuauugcgcagcaac

SEQ ID NO: 1537463 - RNA, 17 nt, Human adenovirus A
gaacucgagugcaugca

SEQ ID NO: 1537464 - RNA, 15 nt, Human adenovirus A
gagcgccccccuagc

SEQ ID NO: 1537465 - RNA, 21 nt, Human adenovirus A
ccaacgcgugaaucgcaguca

SEQ ID NO: 1537466 - RNA, 13 nt, Human adenovirus A
gccacaccuccac

SEQ ID NO: 1537467 - RNA, 13 nt, Human adenovirus A
aagcaguagaaag

SEQ ID NO: 1537468 - RNA, 17 nt, Human adenovirus A
ggaagaacauccaacug

SEQ ID NO: 1537469 - RNA, 22 nt, Human adenovirus A
uuccacggugcacuuuuccaau

SEQ ID NO: 1537470 - RNA, 18 nt, Human adenovirus A
ucuagugcaacauuugua

SEQ ID NO: 1537471 - RNA, 17 nt, Human adenovirus A
aguaacuucaugucuau

SEQ ID NO: 1537472 - RNA, 16 nt, Human adenovirus A
aaaucagaagccagca

SEQ ID NO: 1537473 - RNA, 14 nt, Human adenovirus A
uacaggcagggcau

SEQ ID NO: 1537474 - RNA, 23 nt, Human adenovirus A
gguaguuuaaggugguggcaacg

SEQ ID NO: 1537475 - RNA, 22 nt, Human adenovirus A
cgucugcaguauuauuacucug

SEQ ID NO: 1537476 - RNA, 16 nt, Human adenovirus A
gaaagguauucagcug

SEQ ID NO: 1537477 - RNA, 17 nt, Human adenovirus A
uucagaugacuggacag

SEQ ID NO: 1537478 - RNA, 15 nt, Human adenovirus A
cacaaaauaccccua

SEQ ID NO: 1537479 - RNA, 23 nt, Human adenovirus A
cagaacauguuucgcgacaacag

SEQ ID NO: 1537480 - RNA, 18 nt, Human adenovirus A
uaaaaccuacacaugaag

SEQ ID NO: 1537481 - RNA, 12 nt, Human adenovirus A
acauuagcaguc

SEQ ID NO: 1537482 - RNA, 16 nt, Human adenovirus A
uugugguucaggaacg

SEQ ID NO: 1537483 - RNA, 23 nt, Human adenovirus A
cuugguaggcaauuucugccauu

SEQ ID NO: 1537484 - RNA, 19 nt, Human adenovirus A
ggaggugcucccgcaguga

SEQ ID NO: 1537485 - RNA, 15 nt, Human adenovirus A
gacucauaagcugug

SEQ ID NO: 1537486 - RNA, 19 nt, Human adenovirus A
gcaauuagggccagcauug

SEQ ID NO: 1537487 - RNA, 20 nt, Human adenovirus A
caauaaauacugcucccucu

SEQ ID NO: 1537488 - RNA, 17 nt, Human adenovirus A
gggcccagggguggugg

SEQ ID NO: 1537489 - RNA, 15 nt, Human adenovirus A
ggacaaguuaaaaga

SEQ ID NO: 1537490 - RNA, 22 nt, Human adenovirus A
ugguguuaugaaucuuuauuga

SEQ ID NO: 1537491 - RNA, 14 nt, Human adenovirus A
ucucuaacaagcug

SEQ ID NO: 1537492 - RNA, 22 nt, Human adenovirus A
cacagcuggcgcacaaguugca

SEQ ID NO: 1537493 - RNA, 23 nt, Human adenovirus A
ucaccuggaccuuuaacggaaaa

SEQ ID NO: 1537494 - RNA, 22 nt, Human adenovirus A
cauguuauuuaaaauuccauaa

SEQ ID NO: 1537495 - RNA, 15 nt, Human adenovirus A
caugaagauuucugc

SEQ ID NO: 1537496 - RNA, 14 nt, Human adenovirus A
gccagaacccacua

SEQ ID NO: 1537497 - RNA, 18 nt, Human adenovirus A
auguuagguuugcuggag

SEQ ID NO: 1537498 - RNA, 13 nt, Human adenovirus A
auagggugaaaga

SEQ ID NO: 1537499 - RNA, 23 nt, Human adenovirus A
aaccagcugggcagaaagcaaau

SEQ ID NO: 1537500 - RNA, 23 nt, Human adenovirus A
cagcccaacccuucccaacuacu

SEQ ID NO: 1537501 - RNA, 20 nt, Human adenovirus A
auccuuagauuuuucaucug

SEQ ID NO: 1537502 - RNA, 17 nt, Human adenovirus A
guuaaaaauacagucaa

SEQ ID NO: 1537503 - RNA, 14 nt, Human adenovirus A
uggacauggaaaaa

SEQ ID NO: 1537504 - RNA, 18 nt, Human adenovirus A
auaccacucgaguguacu

SEQ ID NO: 1537505 - RNA, 19 nt, Human adenovirus A
gcaauaaaacaaggagccg

SEQ ID NO: 1537506 - RNA, 18 nt, Human adenovirus A
cgucggggcuacugcuca

SEQ ID NO: 1537507 - RNA, 21 nt, Human adenovirus A
ccguacaaggcauuggaaagc

SEQ ID NO: 1537508 - RNA, 20 nt, Human adenovirus A
ccuuaacuucuacccaguuu

SEQ ID NO: 1537509 - RNA, 22 nt, Human adenovirus A
uuagccuuaauaaccgccccuc

SEQ ID NO: 1537510 - RNA, 18 nt, Human adenovirus A
auaauuggcuucagcauu

SEQ ID NO: 1537511 - RNA, 19 nt, Human adenovirus A
aacaacgcugggcauggug

SEQ ID NO: 1537512 - RNA, 13 nt, Human adenovirus A
aagaaaaugaaca

SEQ ID NO: 1537513 - RNA, 22 nt, Human adenovirus A
caugauguuuaauaaagcgcag

SEQ ID NO: 1537514 - RNA, 14 nt, Human adenovirus A
ggcgcccuccaccg

SEQ ID NO: 1537515 - RNA, 16 nt, Human adenovirus A
agguaggcuaaguuuu

SEQ ID NO: 1537516 - RNA, 20 nt, Human adenovirus A
gccauccgcaaagaugaggc

SEQ ID NO: 1537517 - RNA, 14 nt, Human adenovirus A
cugcucaaguugug

SEQ ID NO: 1537518 - RNA, 16 nt, Human adenovirus A
ccggucuggugcaauu

SEQ ID NO: 1537519 - RNA, 19 nt, Human adenovirus A
caucagaaauuuguugcug

SEQ ID NO: 1537520 - RNA, 18 nt, Human adenovirus A
gguaguuuaagguggugg

SEQ ID NO: 1537521 - RNA, 13 nt, Human adenovirus A
accugacagacuu

SEQ ID NO: 1537522 - RNA, 15 nt, Human adenovirus A
caaacagacccuugg

SEQ ID NO: 1537523 - RNA, 14 nt, Human adenovirus A
aaagcuucaauuug

SEQ ID NO: 1537524 - RNA, 16 nt, Human adenovirus A
aauuuuauuggccuga

SEQ ID NO: 1537525 - RNA, 22 nt, Human adenovirus A
agccauggcuuccaugccuuuu

SEQ ID NO: 1537526 - RNA, 22 nt, Human adenovirus A
cagcgaccggcgaucaucgcgg

SEQ ID NO: 1537527 - RNA, 14 nt, Human adenovirus A
ucagcgccaacaaa

SEQ ID NO: 1537528 - RNA, 15 nt, Human adenovirus A
caaauagagcaaacu

SEQ ID NO: 1537529 - RNA, 18 nt, Human adenovirus A
gcacuggucgcaccacug

SEQ ID NO: 1537530 - RNA, 18 nt, Human adenovirus A
acuaaaacaaaucuauca

SEQ ID NO: 1537531 - RNA, 17 nt, Human adenovirus A
agcagcaacaaggaaag

SEQ ID NO: 1537532 - RNA, 14 nt, Human adenovirus A
uuuaacggaaaaca

SEQ ID NO: 1537533 - RNA, 18 nt, Human adenovirus A
aacacaguuuaacacaua

SEQ ID NO: 1537534 - RNA, 13 nt, Human adenovirus A
aauaccugucuug

SEQ ID NO: 1537535 - RNA, 13 nt, Human adenovirus A
aaaaaucaaaugg

SEQ ID NO: 1537536 - RNA, 16 nt, Human adenovirus A
gcacacugggaaauga

SEQ ID NO: 1537537 - RNA, 19 nt, Human adenovirus A
acagcggcguaaacucaug

SEQ ID NO: 1537538 - RNA, 20 nt, Human adenovirus A
aacaucaugaaaacagcagc

SEQ ID NO: 1537539 - RNA, 14 nt, Human adenovirus A
agaagacaaagagu

SEQ ID NO: 1537540 - RNA, 21 nt, Human adenovirus A
aggaggagguggcuggacugc

SEQ ID NO: 1537541 - RNA, 13 nt, Human adenovirus A
uuggccagcugcc

SEQ ID NO: 1537542 - RNA, 18 nt, Human adenovirus A
accuucuggcuuguaugc

SEQ ID NO: 1537543 - RNA, 15 nt, Human adenovirus A
gaaugagaacuucug

SEQ ID NO: 1537544 - RNA, 22 nt, Human adenovirus A
cugugagugcugauugcuggcc

SEQ ID NO: 1537545 - RNA, 23 nt, Human adenovirus A
ucuaaaagagccacagcucugau

SEQ ID NO: 1537546 - RNA, 13 nt, Human adenovirus A
cguuaguaacaac

SEQ ID NO: 1537547 - RNA, 16 nt, Human adenovirus A
uucuagcaaaaugaau

SEQ ID NO: 1537548 - RNA, 16 nt, Human adenovirus A
caggcggucugccauu

SEQ ID NO: 1537549 - RNA, 13 nt, Human adenovirus A
uuuggagccccuu

SEQ ID NO: 1537550 - RNA, 16 nt, Human adenovirus A
gcugauggaaauuguc

SEQ ID NO: 1537551 - RNA, 16 nt, Human adenovirus A
gacguaaauggccaaa

SEQ ID NO: 1537552 - RNA, 23 nt, Human adenovirus A
auagcaacaacgcugggcauggu

SEQ ID NO: 1537553 - RNA, 19 nt, Human adenovirus A
caagcacgccaaagccaca

SEQ ID NO: 1537554 - RNA, 17 nt, Human adenovirus A
gcacgccaaagccacac

SEQ ID NO: 1537555 - RNA, 20 nt, Human adenovirus A
gcuagcugacauaauuuucc

SEQ ID NO: 1537556 - RNA, 13 nt, Human adenovirus A
uguauuagcacuu

SEQ ID NO: 1537557 - RNA, 17 nt, Human adenovirus A
aaggaaaugauggcuuu

SEQ ID NO: 1537558 - RNA, 21 nt, Human adenovirus A
uuagaagacaaagagugacuc

SEQ ID NO: 1537559 - RNA, 17 nt, Human adenovirus A
cucgucaagccuaccug

SEQ ID NO: 1537560 - RNA, 15 nt, Human adenovirus A
acuugggaaauuugu

SEQ ID NO: 1537561 - RNA, 13 nt, Human adenovirus A
ugcaaucuuugca

SEQ ID NO: 1537562 - RNA, 22 nt, Human adenovirus A
uaauuuuccagcgccaccugcc

SEQ ID NO: 1537563 - RNA, 22 nt, Human adenovirus A
auucgcgugccaggcauuucca

SEQ ID NO: 1537564 - RNA, 13 nt, Human adenovirus A
ccgggcaagcuuc

SEQ ID NO: 1537565 - RNA, 16 nt, Human adenovirus A
cgcacggccaaugccc

SEQ ID NO: 1537566 - RNA, 16 nt, Human adenovirus A
cuuuugcagcuccaac

SEQ ID NO: 1537567 - RNA, 22 nt, Human adenovirus A
uuggagcgccccccuagcagua

SEQ ID NO: 1537568 - RNA, 22 nt, Human adenovirus A
aguuuugauuguauuuugagau

SEQ ID NO: 1537569 - RNA, 16 nt, Human adenovirus A
augucgcauaaugaaa

SEQ ID NO: 1537570 - RNA, 19 nt, Human adenovirus A
uuagaccuucccaauguaa

SEQ ID NO: 1537571 - RNA, 13 nt, Human adenovirus A
gaaacuguugacc

SEQ ID NO: 1537572 - RNA, 13 nt, Human adenovirus A
cugcaaaaagaaa

SEQ ID NO: 1537573 - RNA, 20 nt, Human adenovirus A
aaaaagcuuuaauaaccaug

SEQ ID NO: 1537574 - RNA, 12 nt, Human adenovirus A
ccaccgccaugc

SEQ ID NO: 1537575 - RNA, 22 nt, Human adenovirus A
uaacuucuacccaguuuuugca

SEQ ID NO: 1537576 - RNA, 20 nt, Human adenovirus A
cuagagcacaugaaggugga

SEQ ID NO: 1537577 - RNA, 20 nt, Human adenovirus A
gcaaggcgguauuugcuaua

SEQ ID NO: 1537578 - RNA, 17 nt, Human adenovirus A
acacagcacuaacaugu

SEQ ID NO: 1537579 - RNA, 15 nt, Human adenovirus A
gucuuaaacuuucuu

SEQ ID NO: 1537580 - RNA, 20 nt, Human adenovirus A
cugucagugaagcaaaccac

SEQ ID NO: 1537581 - RNA, 14 nt, Human adenovirus A
cauugacaaggaag

SEQ ID NO: 1537582 - RNA, 18 nt, Human adenovirus A
uaaccaaucuacaaacug

SEQ ID NO: 1537583 - RNA, 19 nt, Human adenovirus A
gccgccuuagacaugacag

SEQ ID NO: 1537584 - RNA, 21 nt, Human adenovirus A
auaccacuuggcagcugccgu

SEQ ID NO: 1537585 - RNA, 23 nt, Human adenovirus A
cuaaggagguuuguaagcgguuu

SEQ ID NO: 1537586 - RNA, 17 nt, Human adenovirus A
aaaccgucgcuuucaac

SEQ ID NO: 1537587 - RNA, 21 nt, Human adenovirus A
aagguacuaacauuaagcgac

SEQ ID NO: 1537588 - RNA, 19 nt, Human adenovirus A
caucguaaacaacagacuu

SEQ ID NO: 1537589 - RNA, 18 nt, Human adenovirus A
aaugagcgcagugaugaa

SEQ ID NO: 1537590 - RNA, 17 nt, Human adenovirus A
cuagcuuaccacucaga

SEQ ID NO: 1537591 - RNA, 16 nt, Human adenovirus A
cacuagucccauuaca

SEQ ID NO: 1537592 - RNA, 14 nt, Human adenovirus A
cuccccacagcugg

SEQ ID NO: 1537593 - RNA, 17 nt, Human adenovirus A
ugcuggugaaagaucac

SEQ ID NO: 1537594 - RNA, 17 nt, Human adenovirus A
augugugcgcugugguu

SEQ ID NO: 1537595 - RNA, 18 nt, Human adenovirus A
uuacuuaccggaaaucug

SEQ ID NO: 1537596 - RNA, 12 nt, Human adenovirus A
uugacuguuuua

SEQ ID NO: 1537597 - RNA, 24 nt, Human adenovirus A
aaaagcugccaccucuagaaacug

SEQ ID NO: 1537598 - RNA, 20 nt, Human adenovirus A
acuuagagggaggcaauauu

SEQ ID NO: 1537599 - RNA, 18 nt, Human adenovirus A
cgccggcgaacgggcagc

SEQ ID NO: 1537600 - RNA, 22 nt, Human adenovirus A
aaugcuggaugcuuugggagac

SEQ ID NO: 1537601 - RNA, 19 nt, Human adenovirus A
caauguaacuucagccacu

SEQ ID NO: 1537602 - RNA, 18 nt, Human adenovirus A
ggcaagccaacggcacau

SEQ ID NO: 1537603 - RNA, 17 nt, Human adenovirus A
aauacagucaaugcuuc

SEQ ID NO: 1537604 - RNA, 20 nt, Human adenovirus A
ccuucgcugucccgagcgcg

SEQ ID NO: 1537605 - RNA, 15 nt, Human adenovirus A
uaauuacuccauguu

SEQ ID NO: 1537606 - RNA, 18 nt, Human adenovirus A
auuuaaaauuccauaauu

SEQ ID NO: 1537607 - RNA, 14 nt, Human adenovirus A
uggcccaaugcaau

SEQ ID NO: 1537608 - RNA, 20 nt, Human adenovirus A
caaaauaccccuauccuguc

SEQ ID NO: 1537609 - RNA, 19 nt, Human adenovirus A
guucgcuaguagcauuaaa

SEQ ID NO: 1537610 - RNA, 17 nt, Human adenovirus A
cuugcauuaaccuuucc

SEQ ID NO: 1537611 - RNA, 21 nt, Human adenovirus A
acuaaugaggcuuuucaucca

SEQ ID NO: 1537612 - RNA, 18 nt, Human adenovirus A
acugugcugcaaaguuuu

SEQ ID NO: 1537613 - RNA, 21 nt, Human adenovirus A
caaaggagaaaagcggccacg

SEQ ID NO: 1537614 - RNA, 14 nt, Human adenovirus A
accaugaaaacagc

SEQ ID NO: 1537615 - RNA, 15 nt, Human adenovirus A
cuugccaagcuugaa

SEQ ID NO: 1537616 - RNA, 16 nt, Human adenovirus A
gcuuuucgccagcagc

SEQ ID NO: 1537617 - RNA, 15 nt, Human adenovirus A
aguuugguagcaaaa

SEQ ID NO: 1537618 - RNA, 16 nt, Human adenovirus A
auacugcuagaacaag

SEQ ID NO: 1537619 - RNA, 14 nt, Human adenovirus A
ucugcccauuuuug

SEQ ID NO: 1537620 - RNA, 21 nt, Human adenovirus A
uggaauaaaauuucuagaaau

SEQ ID NO: 1537621 - RNA, 14 nt, Human adenovirus A
accggcccuguugu

SEQ ID NO: 1537622 - RNA, 16 nt, Human adenovirus A
cucguugaugucaccu

SEQ ID NO: 1537623 - RNA, 22 nt, Human adenovirus A
agcggcuugagcaaaaauguuu

SEQ ID NO: 1537624 - RNA, 22 nt, Human adenovirus A
cagagagcuaagcgacaaagag

SEQ ID NO: 1537625 - RNA, 23 nt, Human adenovirus A
acacaugauggaucuggagccac

SEQ ID NO: 1537626 - RNA, 21 nt, Human adenovirus A
guucaauaguugccacgcuuu

SEQ ID NO: 1537627 - RNA, 14 nt, Human adenovirus A
acuuaauacuggcu

SEQ ID NO: 1537628 - RNA, 21 nt, Human adenovirus A
aaauuguuuuuguucuuuuaa

SEQ ID NO: 1537629 - RNA, 16 nt, Human adenovirus A
aacaguacaaagccag

SEQ ID NO: 1537630 - RNA, 14 nt, Human adenovirus A
cuacaacugcuccc

SEQ ID NO: 1537631 - RNA, 11 nt, Human adenovirus A
acaggcagggc

SEQ ID NO: 1537632 - RNA, 15 nt, Human adenovirus A
gaccggucaggcgug

SEQ ID NO: 1537633 - RNA, 18 nt, Human adenovirus A
uuggauagcaaagccauc

SEQ ID NO: 1537634 - RNA, 16 nt, Human adenovirus A
ucaagacggucagcaa

SEQ ID NO: 1537635 - RNA, 17 nt, Human adenovirus A
acgccuuacauguggag

SEQ ID NO: 1537636 - RNA, 24 nt, Human adenovirus A
acaacuuuuaacauuagcagucug

SEQ ID NO: 1537637 - RNA, 15 nt, Human adenovirus A
guuggaaacugugcu

SEQ ID NO: 1537638 - RNA, 17 nt, Human adenovirus A
ccacugucgccaaccuc

SEQ ID NO: 1537639 - RNA, 21 nt, Human adenovirus A
uucuggcguuacagcuucaga

SEQ ID NO: 1537640 - RNA, 15 nt, Human adenovirus A
gaccacagguggugg

SEQ ID NO: 1537641 - RNA, 23 nt, Human adenovirus A
gacgccccauccguggcaggcca

SEQ ID NO: 1537642 - RNA, 15 nt, Human adenovirus A
uaacaggugaaagug

SEQ ID NO: 1537643 - RNA, 13 nt, Human adenovirus A
acauuuaggcuua

SEQ ID NO: 1537644 - RNA, 17 nt, Human adenovirus A
uccagaggaggaggagg

SEQ ID NO: 1537645 - RNA, 23 nt, Human adenovirus A
aggauccagaggaggaggaggaa

SEQ ID NO: 1537646 - RNA, 14 nt, Human adenovirus A
ggaaagacagccaa

SEQ ID NO: 1537647 - RNA, 22 nt, Human adenovirus A
cauaguagagacaaugaaacuu

SEQ ID NO: 1537648 - RNA, 16 nt, Human adenovirus A
gauucaaacaauaaca

SEQ ID NO: 1537649 - RNA, 14 nt, Human adenovirus A
gaagaaugggagga

SEQ ID NO: 1537650 - RNA, 17 nt, Human adenovirus A
cuuggugguucugccuc

SEQ ID NO: 1537651 - RNA, 22 nt, Human adenovirus A
cucuuggaauaaaauuucuaga

SEQ ID NO: 1537652 - RNA, 22 nt, Human adenovirus A
acggagacccagaaaaaggagu

SEQ ID NO: 1537653 - RNA, 13 nt, Human adenovirus A
gaguguauggaaa

SEQ ID NO: 1537654 - RNA, 19 nt, Human adenovirus A
uuugaaaacauauuggccg

SEQ ID NO: 1537655 - RNA, 15 nt, Human adenovirus A
ggcgccgcagacggc

SEQ ID NO: 1537656 - RNA, 20 nt, Human adenovirus A
aacaaugaaaguugcauuua

SEQ ID NO: 1537657 - RNA, 16 nt, Human adenovirus A
aaucuacaaacuggaa

SEQ ID NO: 1537658 - RNA, 17 nt, Human adenovirus A
uggcacauaacacagcu

SEQ ID NO: 1537659 - RNA, 21 nt, Human adenovirus A
gaugcauaaugcggacgggcg

SEQ ID NO: 1537660 - RNA, 15 nt, Human adenovirus A
acccgauaugaugca

SEQ ID NO: 1537661 - RNA, 14 nt, Human adenovirus A
gcaucuugcaugaa

SEQ ID NO: 1537662 - RNA, 21 nt, Human adenovirus A
agucuugaaugcucuggacau

SEQ ID NO: 1537663 - RNA, 14 nt, Human adenovirus A
auaaacaucucaua

SEQ ID NO: 1537664 - RNA, 17 nt, Human adenovirus A
cguuccagauuguggaa

SEQ ID NO: 1537665 - RNA, 17 nt, Human adenovirus A
agcuucaauuugccuaa

SEQ ID NO: 1537666 - RNA, 15 nt, Human adenovirus A
ggucuagccaacauc

SEQ ID NO: 1537667 - RNA, 23 nt, Human adenovirus A
ucacugccgcugcaaucuuugca

SEQ ID NO: 1537668 - RNA, 23 nt, Human adenovirus A
cguguucacaauuuucugguggu

SEQ ID NO: 1537669 - RNA, 16 nt, Human adenovirus A
gauaaacaaaagcaaa

SEQ ID NO: 1537670 - RNA, 23 nt, Human adenovirus A
ccacuguuguauuauuugaacac

SEQ ID NO: 1537671 - RNA, 17 nt, Human adenovirus A
aaaaucccccuccuacc

SEQ ID NO: 1537672 - RNA, 13 nt, Human adenovirus A
uuguauaaauucu

SEQ ID NO: 1537673 - RNA, 13 nt, Human adenovirus A
aagcucuguucaa

SEQ ID NO: 1537674 - RNA, 20 nt, Human adenovirus A
cagcugcggccgcaacagcu

SEQ ID NO: 1537675 - RNA, 19 nt, Human adenovirus A
aaaucugaaaauacaucau

SEQ ID NO: 1537676 - RNA, 14 nt, Human adenovirus A
aaauuacaaaggca

SEQ ID NO: 1537677 - RNA, 12 nt, Human adenovirus A
aacagaccccaa

SEQ ID NO: 1537678 - RNA, 17 nt, Human adenovirus A
gaguaccugagucccgg

SEQ ID NO: 1537679 - RNA, 20 nt, Human adenovirus A
gugauaacccugaauguuug

SEQ ID NO: 1537680 - RNA, 15 nt, Human adenovirus A
ggaucuccugccacc

SEQ ID NO: 1537681 - RNA, 22 nt, Human adenovirus A
uucuuccucgaccacagguggu

SEQ ID NO: 1537682 - RNA, 12 nt, Human adenovirus A
cacaucuacaaa

SEQ ID NO: 1537683 - RNA, 19 nt, Human adenovirus A
gauuaaauauaucuuuuaa

SEQ ID NO: 1537684 - RNA, 20 nt, Human adenovirus A
aacacggaggacaauccaag

SEQ ID NO: 1537685 - RNA, 16 nt, Human adenovirus A
cugcuaugugcaaaua

SEQ ID NO: 1537686 - RNA, 17 nt, Human adenovirus A
gcaacauagccccaggu

SEQ ID NO: 1537687 - RNA, 14 nt, Human adenovirus A
gcaagguagcauuu

SEQ ID NO: 1537688 - RNA, 14 nt, Human adenovirus A
cauccucagcuccg

SEQ ID NO: 1537689 - RNA, 12 nt, Human adenovirus A
uaguuucuccac

SEQ ID NO: 1537690 - RNA, 20 nt, Human adenovirus A
agauaacgcuaagcuuaaua

SEQ ID NO: 1537691 - RNA, 23 nt, Human adenovirus A
aagauguaugaguaagagcaaag

SEQ ID NO: 1537692 - RNA, 20 nt, Human adenovirus A
uguacagcaaucuguaaguu

SEQ ID NO: 1537693 - RNA, 18 nt, Human adenovirus A
guauaaauucuuaaacaa

SEQ ID NO: 1537694 - RNA, 13 nt, Human adenovirus A
uguugaaugaggu

SEQ ID NO: 1537695 - RNA, 12 nt, Human adenovirus A
ccaguuaaugcu

SEQ ID NO: 1537696 - RNA, 17 nt, Human adenovirus A
auccuacaaaaaguaac

SEQ ID NO: 1537697 - RNA, 18 nt, Human adenovirus A
gugaaagugaauacuuaa

SEQ ID NO: 1537698 - RNA, 21 nt, Human adenovirus A
acuaacgcuggggcacagcuu

SEQ ID NO: 1537699 - RNA, 14 nt, Human adenovirus A
cccaggcaggcgcg

SEQ ID NO: 1537700 - RNA, 23 nt, Human adenovirus A
auuaguaccgaaaaagguuuaau

SEQ ID NO: 1537701 - RNA, 13 nt, Human adenovirus A
aucagccaugugc

SEQ ID NO: 1537702 - RNA, 18 nt, Human adenovirus A
agaauuuuccgaaguacu

SEQ ID NO: 1537703 - RNA, 17 nt, Human adenovirus A
accuuggucucgcagcu

SEQ ID NO: 1537704 - RNA, 15 nt, Human adenovirus A
ucccugugcuucggc

SEQ ID NO: 1537705 - RNA, 17 nt, Human adenovirus A
agcaaaugcccugcaaa

SEQ ID NO: 1537706 - RNA, 20 nt, Human adenovirus A
acucaggauucgugggauac

SEQ ID NO: 1537707 - RNA, 21 nt, Human adenovirus A
cuauguaaguaggauagcacc

SEQ ID NO: 1537708 - RNA, 20 nt, Human adenovirus A
gagauguccuguuuaaacau

SEQ ID NO: 1537709 - RNA, 19 nt, Human adenovirus A
cacgggacccugccgcugc

SEQ ID NO: 1537710 - RNA, 17 nt, Human adenovirus A
cgcagcugcggccgcaa

SEQ ID NO: 1537711 - RNA, 17 nt, Human adenovirus A
acgcucaaagaaacagc

SEQ ID NO: 1537712 - RNA, 22 nt, Human adenovirus A
acaauccaaggaugacaacauu

SEQ ID NO: 1537713 - RNA, 16 nt, Human adenovirus A
acgggccgcagcugcg

SEQ ID NO: 1537714 - RNA, 19 nt, Human adenovirus A
cuuaguaacgcacacaaca

SEQ ID NO: 1537715 - RNA, 16 nt, Human adenovirus A
auugaaguaagcuguu

SEQ ID NO: 1537716 - RNA, 22 nt, Human adenovirus A
caaaguaauauuguagccugcu

SEQ ID NO: 1537717 - RNA, 22 nt, Human adenovirus A
ucguguuauguggcgcauccca

SEQ ID NO: 1537718 - RNA, 22 nt, Human adenovirus A
auuguaagcgauuuuccaaaug

SEQ ID NO: 1537719 - RNA, 22 nt, Human adenovirus A
guagcugaaaacaacugcacuu

SEQ ID NO: 1537720 - RNA, 22 nt, Human adenovirus A
uccugggacauaauuucccuca

SEQ ID NO: 1537721 - RNA, 21 nt, Human adenovirus A
ccugauaacaagaacaccuac

SEQ ID NO: 1537722 - RNA, 20 nt, Human adenovirus A
uaccaauacuguuaccaaug

SEQ ID NO: 1537723 - RNA, 15 nt, Human adenovirus A
gcagaugauagagau

SEQ ID NO: 1537724 - RNA, 13 nt, Human adenovirus A
accaacaaacacg

SEQ ID NO: 1537725 - RNA, 22 nt, Human adenovirus A
cuaguccguuuucuucuugagc

SEQ ID NO: 1537726 - RNA, 16 nt, Human adenovirus A
caagcggcgaaggccu

SEQ ID NO: 1537727 - RNA, 12 nt, Human adenovirus A
uagcgccagagg

SEQ ID NO: 1537728 - RNA, 15 nt, Human adenovirus A
cuacgcugguaacua

SEQ ID NO: 1537729 - RNA, 18 nt, Human adenovirus A
gaaggguggggugcugcc

SEQ ID NO: 1537730 - RNA, 20 nt, Human adenovirus A
uaaagcuuuugcuaaauugg

SEQ ID NO: 1537731 - RNA, 21 nt, Human adenovirus A
gccaguucguacgcguccacc

SEQ ID NO: 1537732 - RNA, 21 nt, Human adenovirus A
auacacauaaagagucucaaa

SEQ ID NO: 1537733 - RNA, 19 nt, Human adenovirus A
guucaauaaauacugcucc

SEQ ID NO: 1537734 - RNA, 22 nt, Human adenovirus A
augcgacguuuuguuaccugug

SEQ ID NO: 1537735 - RNA, 17 nt, Human adenovirus A
auaccaugauggagugg

SEQ ID NO: 1537736 - RNA, 18 nt, Human adenovirus A
auggagugcuggaaagug

SEQ ID NO: 1537737 - RNA, 16 nt, Human adenovirus A
acuauucggaaaccau

SEQ ID NO: 1537738 - RNA, 18 nt, Human adenovirus A
caggucccguaaaauaca

SEQ ID NO: 1537739 - RNA, 17 nt, Human adenovirus A
gaagcugagcaaugcua

SEQ ID NO: 1537740 - RNA, 17 nt, Human adenovirus A
ucuuuacaacuguaugc

SEQ ID NO: 1537741 - RNA, 16 nt, Human adenovirus A
cugaaggcauuuaagg

SEQ ID NO: 1537742 - RNA, 16 nt, Human adenovirus A
cuaaaccaagccaugc

SEQ ID NO: 1537743 - RNA, 14 nt, Human adenovirus A
cuuacauuauguaa

SEQ ID NO: 1537744 - RNA, 19 nt, Human adenovirus A
gcgcugcaucguaaacaac

SEQ ID NO: 1537745 - RNA, 18 nt, Human adenovirus A
uuucaaaauaaacaucuc

SEQ ID NO: 1537746 - RNA, 22 nt, Human adenovirus A
aacaguacaaagccaggcacag

SEQ ID NO: 1537747 - RNA, 16 nt, Human adenovirus A
cauuauguaaagucag

SEQ ID NO: 1537748 - RNA, 13 nt, Human adenovirus A
ggagguggcugga

SEQ ID NO: 1537749 - RNA, 14 nt, Human adenovirus A
auaccaaaaacacc

SEQ ID NO: 1537750 - RNA, 14 nt, Human adenovirus A
cuacacaacacaaa

SEQ ID NO: 1537751 - RNA, 23 nt, Human adenovirus A
ugcuaagggacaaguuaaaagac

SEQ ID NO: 1537752 - RNA, 13 nt, Human adenovirus A
guagagucuuuuu

SEQ ID NO: 1537753 - RNA, 12 nt, Human adenovirus A
uagauuucuuga

SEQ ID NO: 1537754 - RNA, 15 nt, Human adenovirus A
auacagauuuaaggg

SEQ ID NO: 1537755 - RNA, 16 nt, Human adenovirus A
cggaggaaagggcuga

SEQ ID NO: 1537756 - RNA, 18 nt, Human adenovirus A
aaaagcuuuaauaaccau

SEQ ID NO: 1537757 - RNA, 23 nt, Human adenovirus A
accgugaauauuaaaaagcucug

SEQ ID NO: 1537758 - RNA, 23 nt, Human adenovirus A
uuaguccugcaguuauuggacac

SEQ ID NO: 1537759 - RNA, 22 nt, Human adenovirus A
uacaaguuccggaguucccaca

SEQ ID NO: 1537760 - RNA, 17 nt, Human adenovirus A
uaaaaaggaagcaggug

SEQ ID NO: 1537761 - RNA, 14 nt, Human adenovirus A
uacgguggcagcca

SEQ ID NO: 1537762 - RNA, 13 nt, Human adenovirus A
ccacccccagugc

SEQ ID NO: 1537763 - RNA, 15 nt, Human adenovirus A
auacucuuuaacauu

SEQ ID NO: 1537764 - RNA, 14 nt, Human adenovirus A
cgaaaacagucugc

SEQ ID NO: 1537765 - RNA, 13 nt, Human adenovirus A
auauaguacugcu

SEQ ID NO: 1537766 - RNA, 15 nt, Human adenovirus A
caacacaaaaaaaac

SEQ ID NO: 1537767 - RNA, 15 nt, Human adenovirus A
cugugcuucggcaag

SEQ ID NO: 1537768 - RNA, 23 nt, Human adenovirus A
agcaaagccauccgcaaagauga

SEQ ID NO: 1537769 - RNA, 15 nt, Human adenovirus A
guacacuaaugaggc

SEQ ID NO: 1537770 - RNA, 19 nt, Human adenovirus A
gcuuaauaccuuugcucag

SEQ ID NO: 1537771 - RNA, 14 nt, Human adenovirus A
auaaagaaaaaacu

SEQ ID NO: 1537772 - RNA, 14 nt, Human adenovirus A
gagucucaaaagca

SEQ ID NO: 1537773 - RNA, 22 nt, Human adenovirus A
cuggaaaacauaugcacaagag

SEQ ID NO: 1537774 - RNA, 19 nt, Human adenovirus A
cauccguggcaggccaucu

SEQ ID NO: 1537775 - RNA, 18 nt, Human adenovirus A
aauuacuugaacaacuuu

SEQ ID NO: 1537776 - RNA, 24 nt, Human adenovirus A
gaaucccucgcccgcacagucacu

SEQ ID NO: 1537777 - RNA, 23 nt, Human adenovirus A
acuacccggcgauugauaucuug

SEQ ID NO: 1537778 - RNA, 20 nt, Human adenovirus A
gaugaaaaacgagcagcaaa

SEQ ID NO: 1537779 - RNA, 17 nt, Human adenovirus A
gugcgcguacgcggaca

SEQ ID NO: 1537780 - RNA, 20 nt, Human adenovirus A
cggcuugagcaaaaauguuu

SEQ ID NO: 1537781 - RNA, 21 nt, Human adenovirus A
gcagcaaugcuuggaagaaaa

SEQ ID NO: 1537782 - RNA, 21 nt, Human adenovirus A
aggaaagacagccaagaccag

SEQ ID NO: 1537783 - RNA, 21 nt, Human adenovirus A
cagcaaagaaaguucaccucc

SEQ ID NO: 1537784 - RNA, 22 nt, Human adenovirus A
uaacaaccucccgauaccaaaa

SEQ ID NO: 1537785 - RNA, 21 nt, Human adenovirus A
gcugucucuaccucaaaagcg

SEQ ID NO: 1537786 - RNA, 15 nt, Human adenovirus A
cuguucauauuguga

SEQ ID NO: 1537787 - RNA, 18 nt, Human adenovirus A
accacggccucagcagcg

SEQ ID NO: 1537788 - RNA, 13 nt, Human adenovirus A
agagcaggcugga

SEQ ID NO: 1537789 - RNA, 16 nt, Human adenovirus A
agcgcaacagcgcaug

SEQ ID NO: 1537790 - RNA, 18 nt, Human adenovirus A
aaucaggcuguacagaaa

SEQ ID NO: 1537791 - RNA, 14 nt, Human adenovirus A
ccagcucuuuugga

SEQ ID NO: 1537792 - RNA, 20 nt, Human adenovirus A
ucguacuuaaaaaaacaaaa

SEQ ID NO: 1537793 - RNA, 20 nt, Human adenovirus A
ccaauuuguggaggaauuua

SEQ ID NO: 1537794 - RNA, 19 nt, Human adenovirus A
ucuggaucuucaaacaccu

SEQ ID NO: 1537795 - RNA, 11 nt, Human adenovirus A
acaggaagagc

SEQ ID NO: 1537796 - RNA, 18 nt, Human adenovirus A
gcuaaucaccucgcucca

SEQ ID NO: 1537797 - RNA, 22 nt, Human adenovirus A
gaccaaacgcaaguucaaagaa

SEQ ID NO: 1537798 - RNA, 20 nt, Human adenovirus A
gucccgcccgcguuuggaaa

SEQ ID NO: 1537799 - RNA, 14 nt, Human adenovirus A
augggcaccuggaa

SEQ ID NO: 1537800 - RNA, 23 nt, Human adenovirus A
cguagcaguaucaguggaguuca

SEQ ID NO: 1537801 - RNA, 18 nt, Human adenovirus A
cagacgacuuaaaauaca

SEQ ID NO: 1537802 - RNA, 23 nt, Human adenovirus A
agaggagaaggaggaggagcgga

SEQ ID NO: 1537803 - RNA, 14 nt, Human adenovirus A
aaauuccugugcaa

SEQ ID NO: 1537804 - RNA, 17 nt, Human adenovirus A
uaacgaggugcagcugc

SEQ ID NO: 1537805 - RNA, 22 nt, Human adenovirus A
ccaguguuagucgcgcacuggg

SEQ ID NO: 1537806 - RNA, 18 nt, Human adenovirus A
caggcggucugccauucc

SEQ ID NO: 1537807 - RNA, 20 nt, Human adenovirus A
agacuccccccgaggaauuu

SEQ ID NO: 1537808 - RNA, 22 nt, Human adenovirus A
gauuacaugucaaugcagcugu

SEQ ID NO: 1537809 - RNA, 14 nt, Human adenovirus A
ccagguaauuuuca

SEQ ID NO: 1537810 - RNA, 16 nt, Human adenovirus A
caaucaaauagcucuu

SEQ ID NO: 1537811 - RNA, 18 nt, Human adenovirus A
gguacuuuuccuugugga

SEQ ID NO: 1537812 - RNA, 14 nt, Human adenovirus A
gagcggcugacaga

SEQ ID NO: 1537813 - RNA, 14 nt, Human adenovirus A
auugucacauuaca

SEQ ID NO: 1537814 - RNA, 14 nt, Human adenovirus A
ccaggggugguggg

SEQ ID NO: 1537815 - RNA, 13 nt, Human adenovirus A
ggcacaacagacu

SEQ ID NO: 1537816 - RNA, 18 nt, Human adenovirus A
gacacggcacgcggccgu

SEQ ID NO: 1537817 - RNA, 21 nt, Human adenovirus A
aauauuguagccugcuuucag

SEQ ID NO: 1537818 - RNA, 14 nt, Human adenovirus A
gucuugccugcgga

SEQ ID NO: 1537819 - RNA, 13 nt, Human adenovirus A
acagaaauacaga

SEQ ID NO: 1537820 - RNA, 19 nt, Human adenovirus A
uucaacaggcgggaaaagu

SEQ ID NO: 1537821 - RNA, 14 nt, Human adenovirus A
caacuuaacaaauu

SEQ ID NO: 1537822 - RNA, 19 nt, Human adenovirus A
agaagcuuauguacauaau

SEQ ID NO: 1537823 - RNA, 20 nt, Human adenovirus A
cgcagcaacgcucaaagaaa

SEQ ID NO: 1537824 - RNA, 23 nt, Human adenovirus A
caagucuucugacauugcuucau

SEQ ID NO: 1537825 - RNA, 18 nt, Human adenovirus A
aaauacugcucccucucg

SEQ ID NO: 1537826 - RNA, 16 nt, Human adenovirus A
cuucaauuugccuaaa

SEQ ID NO: 1537827 - RNA, 14 nt, Human adenovirus A
uacaugccgcaaau

SEQ ID NO: 1537828 - RNA, 14 nt, Human adenovirus A
auuucccucuuccc

SEQ ID NO: 1537829 - RNA, 17 nt, Human adenovirus A
ggcguacacuggcuggc

SEQ ID NO: 1537830 - RNA, 21 nt, Human adenovirus A
caaagguaaugagcgcaguga

SEQ ID NO: 1537831 - RNA, 20 nt, Human adenovirus A
accucccgauaccaaaaaca

SEQ ID NO: 1537832 - RNA, 17 nt, Human adenovirus A
augacaaugaauaagcc

SEQ ID NO: 1537833 - RNA, 16 nt, Human adenovirus A
cuugauccccaaaccg

SEQ ID NO: 1537834 - RNA, 16 nt, Human adenovirus A
uugucauuacugacca

SEQ ID NO: 1537835 - RNA, 17 nt, Human adenovirus A
ggaggaagcugaggaaa

SEQ ID NO: 1537836 - RNA, 16 nt, Human adenovirus A
gcgcucaaaggcaggc

SEQ ID NO: 1537837 - RNA, 23 nt, Human adenovirus A
cuugguacccgccagugcuuuca

SEQ ID NO: 1537838 - RNA, 15 nt, Human adenovirus A
gcaaacucagcccau

SEQ ID NO: 1537839 - RNA, 17 nt, Human adenovirus A
ugguugggaacagacaa

SEQ ID NO: 1537840 - RNA, 22 nt, Human adenovirus A
cuuuagguuagccugaaaaaua

SEQ ID NO: 1537841 - RNA, 13 nt, Human adenovirus A
cguuuucugcagc

SEQ ID NO: 1537842 - RNA, 17 nt, Human adenovirus A
gccauuccugcagcacu

SEQ ID NO: 1537843 - RNA, 21 nt, Human adenovirus A
ccugucuacaaaucuuucaau

SEQ ID NO: 1537844 - RNA, 22 nt, Human adenovirus A
uaaauacugguauuuaaaaucu

SEQ ID NO: 1537845 - RNA, 13 nt, Human adenovirus A
uguaaguaggaua

SEQ ID NO: 1537846 - RNA, 13 nt, Human adenovirus A
cuuuauugccuua

SEQ ID NO: 1537847 - RNA, 20 nt, Human adenovirus A
ucaacagaaucaaucucagu

SEQ ID NO: 1537848 - RNA, 22 nt, Human adenovirus A
aggcgcuugcgcguugaacccg

SEQ ID NO: 1537849 - RNA, 22 nt, Human adenovirus A
gagcccuauccgucuccagcua

SEQ ID NO: 1537850 - RNA, 17 nt, Human adenovirus A
aagcagccauaaugccu

SEQ ID NO: 1537851 - RNA, 20 nt, Human adenovirus A
ccagagcaccccuucccacc

SEQ ID NO: 1537852 - RNA, 10 nt, Human adenovirus A
cacaaggucu

SEQ ID NO: 1537853 - RNA, 16 nt, Human adenovirus A
ggaaccccaaaucgca

SEQ ID NO: 1537854 - RNA, 13 nt, Human adenovirus A
gucagacuauuac

SEQ ID NO: 1537855 - RNA, 15 nt, Human adenovirus A
caauaaaaaaaacag

SEQ ID NO: 1537856 - RNA, 11 nt, Human adenovirus A
ggaaaugaggc

SEQ ID NO: 1537857 - RNA, 18 nt, Human adenovirus A
ucaguacacuuuaaaugc

SEQ ID NO: 1537858 - RNA, 13 nt, Human adenovirus A
uuacgcuggcugu

SEQ ID NO: 1537859 - RNA, 20 nt, Human adenovirus A
auauuaaaaagcucuguaag

SEQ ID NO: 1537860 - RNA, 22 nt, Human adenovirus A
caucagacguacccuuuguuac

SEQ ID NO: 1537861 - RNA, 13 nt, Human adenovirus A
uaucagccagagc

SEQ ID NO: 1537862 - RNA, 15 nt, Human adenovirus A
cacuacgcccacuuc

SEQ ID NO: 1537863 - RNA, 19 nt, Human adenovirus A
gaagcgcgugucuucuccc

SEQ ID NO: 1537864 - RNA, 22 nt, Human adenovirus A
cacaugauggaucuggagccac

SEQ ID NO: 1537865 - RNA, 13 nt, Human adenovirus A
gcgcggccagagc

SEQ ID NO: 1537866 - RNA, 23 nt, Human adenovirus A
aagcgguaugucggccugacgcu

SEQ ID NO: 1537867 - RNA, 14 nt, Human adenovirus A
cagcggggaggaag

SEQ ID NO: 1537868 - RNA, 21 nt, Human adenovirus A
ccaugguaaaaaggaagcagg

SEQ ID NO: 1537869 - RNA, 16 nt, Human adenovirus A
agcugcugcaggccuu

SEQ ID NO: 1537870 - RNA, 23 nt, Human adenovirus A
acauacaacuugcacaaauggac

SEQ ID NO: 1537871 - RNA, 17 nt, Human adenovirus A
agauguaaaggaggcgc

SEQ ID NO: 1537872 - RNA, 22 nt, Human adenovirus A
agcaucccagcugacauacacu

SEQ ID NO: 1537873 - RNA, 22 nt, Human adenovirus A
ccugaugcuuuucgccagcagc

SEQ ID NO: 1537874 - RNA, 22 nt, Human adenovirus A
caacggaugaaagcuuagccuu

SEQ ID NO: 1537875 - RNA, 19 nt, Human adenovirus A
gaagugccucaaagugaag

SEQ ID NO: 1537876 - RNA, 17 nt, Human adenovirus A
cuuuuuucuuacaguau

SEQ ID NO: 1537877 - RNA, 16 nt, Human adenovirus A
augcgggcagccaggc

SEQ ID NO: 1537878 - RNA, 15 nt, Human adenovirus A
ggacaguagcugcag

SEQ ID NO: 1537879 - RNA, 15 nt, Human adenovirus A
caaaguaauauugua

SEQ ID NO: 1537880 - RNA, 20 nt, Human adenovirus A
aacgaccgccuuuucuagaa

SEQ ID NO: 1537881 - RNA, 22 nt, Human adenovirus A
agggcaaccacggccucagcag

SEQ ID NO: 1537882 - RNA, 15 nt, Human adenovirus A
caggaggacacuggc

SEQ ID NO: 1537883 - RNA, 22 nt, Human adenovirus A
caacauccuuuuucuacaggca

SEQ ID NO: 1537884 - RNA, 15 nt, Human adenovirus A
acuuaccccugggcu

SEQ ID NO: 1537885 - RNA, 14 nt, Human adenovirus A
cauggcugaagagg

SEQ ID NO: 1537886 - RNA, 17 nt, Human adenovirus A
cagugagugaaucugug

SEQ ID NO: 1537887 - RNA, 15 nt, Human adenovirus A
uuggccagcugcccu

SEQ ID NO: 1537888 - RNA, 14 nt, Human adenovirus A
ugcucuggacaugg

SEQ ID NO: 1537889 - RNA, 16 nt, Human adenovirus A
ucaccguuguacgaua

SEQ ID NO: 1537890 - RNA, 23 nt, Human adenovirus A
cuuguuuccagugcgcgacaaaa

SEQ ID NO: 1537891 - RNA, 13 nt, Human adenovirus A
acaguagcugcag

SEQ ID NO: 1537892 - RNA, 16 nt, Human adenovirus A
uggacguuaguaacaa

SEQ ID NO: 1537893 - RNA, 15 nt, Human adenovirus A
acucuaacugcucag

SEQ ID NO: 1537894 - RNA, 18 nt, Human adenovirus A
cgcagcugcggccgcaac

SEQ ID NO: 1537895 - RNA, 17 nt, Human adenovirus A
ugggaagggcaaaagua

SEQ ID NO: 1537896 - RNA, 22 nt, Human adenovirus A
gcgaagaguuuuuacuuaaaaa

SEQ ID NO: 1537897 - RNA, 14 nt, Human adenovirus A
caacuuacagcuag

SEQ ID NO: 1537898 - RNA, 13 nt, Human adenovirus A
accacaucuuugg

SEQ ID NO: 1537899 - RNA, 15 nt, Human adenovirus A
cugcugcauugccac

SEQ ID NO: 1537900 - RNA, 21 nt, Human adenovirus A
ccuccuggaggucuccauguc

SEQ ID NO: 1537901 - RNA, 17 nt, Human adenovirus A
ggaagcaauaaaacaag

SEQ ID NO: 1537902 - RNA, 13 nt, Human adenovirus A
uguauaaaaucau

SEQ ID NO: 1537903 - RNA, 19 nt, Human adenovirus A
ugguacgcauucaccagcc

SEQ ID NO: 1537904 - RNA, 21 nt, Human adenovirus A
cacaguuuaacacauacagua

SEQ ID NO: 1537905 - RNA, 12 nt, Human adenovirus A
uuucaagaaagg

SEQ ID NO: 1537906 - RNA, 14 nt, Human adenovirus A
uguaaccagcuggg

SEQ ID NO: 1537907 - RNA, 13 nt, Human adenovirus A
accuagguuuaaa

SEQ ID NO: 1537908 - RNA, 17 nt, Human adenovirus A
gaaggguggggugcugc

SEQ ID NO: 1537909 - RNA, 17 nt, Human adenovirus A
cuggaacuuaacaacug

SEQ ID NO: 1537910 - RNA, 18 nt, Human adenovirus A
cagugccagaagcacugg

SEQ ID NO: 1537911 - RNA, 20 nt, Human adenovirus A
cgggagcaggaacagaggac

SEQ ID NO: 1537912 - RNA, 19 nt, Human adenovirus A
cuucagcguccaugaaugu

SEQ ID NO: 1537913 - RNA, 13 nt, Human adenovirus A
agaggaggguuug

SEQ ID NO: 1537914 - RNA, 21 nt, Human adenovirus A
uaaaaaccaucuuacauacca

SEQ ID NO: 1537915 - RNA, 19 nt, Human adenovirus A
agcuucagaugacuggaca

SEQ ID NO: 1537916 - RNA, 11 nt, Human adenovirus A
guuccaaggac

SEQ ID NO: 1537917 - RNA, 22 nt, Human adenovirus A
uggcagcaaugcuuggaagaaa

SEQ ID NO: 1537918 - RNA, 12 nt, Human adenovirus A
gguauucagcug

SEQ ID NO: 1537919 - RNA, 19 nt, Human adenovirus A
cugcuagaacaagccgcuc

SEQ ID NO: 1537920 - RNA, 16 nt, Human adenovirus A
aggcaauuucugccau

SEQ ID NO: 1537921 - RNA, 12 nt, Human adenovirus A
cauugaaaccag

SEQ ID NO: 1537922 - RNA, 15 nt, Human adenovirus A
acacuuuccgccaug

SEQ ID NO: 1537923 - RNA, 16 nt, Human adenovirus A
gaaccuuucaagaaag

SEQ ID NO: 1537924 - RNA, 13 nt, Human adenovirus A
aacaacaaaacac

SEQ ID NO: 1537925 - RNA, 13 nt, Human adenovirus A
accuuuaacggaa

SEQ ID NO: 1537926 - RNA, 12 nt, Human adenovirus A
accaaacugcag

SEQ ID NO: 1537927 - RNA, 22 nt, Human adenovirus A
uacacuuuaaaugcggaagaag

SEQ ID NO: 1537928 - RNA, 14 nt, Human adenovirus A
gcuacaucuuuuac

SEQ ID NO: 1537929 - RNA, 14 nt, Human adenovirus A
aguccaauuucguu

SEQ ID NO: 1537930 - RNA, 14 nt, Human adenovirus A
aguacaaauuuuuc

SEQ ID NO: 1537931 - RNA, 16 nt, Human adenovirus A
gccguccagcagugcg

SEQ ID NO: 1537932 - RNA, 18 nt, Human adenovirus A
gaccaauuaacaguuugc

SEQ ID NO: 1537933 - RNA, 22 nt, Human adenovirus A
cugcuaaucaccucgcuccaau

SEQ ID NO: 1537934 - RNA, 19 nt, Human adenovirus A
ucccaugagcuccugaaag

SEQ ID NO: 1537935 - RNA, 15 nt, Human adenovirus A
aggaaugucuucacu

SEQ ID NO: 1537936 - RNA, 12 nt, Human adenovirus A
uuagacagagca

SEQ ID NO: 1537937 - RNA, 19 nt, Human adenovirus A
gguugauuuuacagagagc

SEQ ID NO: 1537938 - RNA, 23 nt, Human adenovirus A
gcugaagaggaggguuugcauuu

SEQ ID NO: 1537939 - RNA, 11 nt, Human adenovirus A
aaggaaaguaa

SEQ ID NO: 1537940 - RNA, 16 nt, Human adenovirus A
uguccccgaaagccgc

SEQ ID NO: 1537941 - RNA, 20 nt, Human adenovirus A
gcagcaacggcaggaaaucu

SEQ ID NO: 1537942 - RNA, 16 nt, Human adenovirus A
cagagcaccccuuccc

SEQ ID NO: 1537943 - RNA, 21 nt, Human adenovirus A
uuacagaggaacguaacuuuc

SEQ ID NO: 1537944 - RNA, 22 nt, Human adenovirus A
uggaacaacaggugcaagaagg

SEQ ID NO: 1537945 - RNA, 19 nt, Human adenovirus A
ucgagaucuaggcugugga

SEQ ID NO: 1537946 - RNA, 20 nt, Human adenovirus A
ugcauauauccuugcaaaaa

SEQ ID NO: 1537947 - RNA, 12 nt, Human adenovirus A
auacugggugcg

SEQ ID NO: 1537948 - RNA, 15 nt, Human adenovirus A
auuauuugugugcug

SEQ ID NO: 1537949 - RNA, 20 nt, Human adenovirus A
acaaagcacugggcauaguu

SEQ ID NO: 1537950 - RNA, 20 nt, Human adenovirus A
cauaacaucaggagcagaaa

SEQ ID NO: 1537951 - RNA, 20 nt, Human adenovirus A
aaccagagcaccccuuccca

SEQ ID NO: 1537952 - RNA, 15 nt, Human adenovirus A
ucauccucagcuccg

SEQ ID NO: 1537953 - RNA, 13 nt, Human adenovirus A
uggauccaaugga

SEQ ID NO: 1537954 - RNA, 20 nt, Human adenovirus A
gcuguugggacagcaagcag

SEQ ID NO: 1537955 - RNA, 23 nt, Human adenovirus A
ggagugucacugccgcugcaauc

SEQ ID NO: 1537956 - RNA, 19 nt, Human adenovirus A
gucagugaagcaaaccaca

SEQ ID NO: 1537957 - RNA, 22 nt, Human adenovirus A
aaugucuguuauguaugcccag

SEQ ID NO: 1537958 - RNA, 20 nt, Human adenovirus A
acaauaguuuaauguuuccc

SEQ ID NO: 1537959 - RNA, 14 nt, Human adenovirus A
auuucuagaaauuu

SEQ ID NO: 1537960 - RNA, 15 nt, Human adenovirus A
ggggauugggaaggg

SEQ ID NO: 1537961 - RNA, 21 nt, Human adenovirus A
ccuuguggaauuccgcagugg

SEQ ID NO: 1537962 - RNA, 17 nt, Human adenovirus A
guaagaaccaagcauau

SEQ ID NO: 1537963 - RNA, 19 nt, Human adenovirus A
cugcagacaguggcuuuuc

SEQ ID NO: 1537964 - RNA, 21 nt, Human adenovirus A
uguuuacuucaauccuuuuuc

SEQ ID NO: 1537965 - RNA, 17 nt, Human adenovirus A
caaggcauuggaaagca

SEQ ID NO: 1537966 - RNA, 16 nt, Human adenovirus A
ucagcuaacaaugcag

SEQ ID NO: 1537967 - RNA, 18 nt, Human adenovirus A
gaauggaugcgcuccugg

SEQ ID NO: 1537968 - RNA, 19 nt, Human adenovirus A
uacuguugcuaauugcccc

SEQ ID NO: 1537969 - RNA, 14 nt, Human adenovirus A
uguauacugggugc

SEQ ID NO: 1537970 - RNA, 16 nt, Human adenovirus A
ccuggagcuguccaug

SEQ ID NO: 1537971 - RNA, 22 nt, Human adenovirus A
gguuagaacuuucuaaggugug

SEQ ID NO: 1537972 - RNA, 16 nt, Human adenovirus A
ugugcugcaaaguuuu

SEQ ID NO: 1537973 - RNA, 21 nt, Human adenovirus A
uggaccuacuuacuggggugc

SEQ ID NO: 1537974 - RNA, 20 nt, Human adenovirus A
ccuacuguuaccaauggaac

SEQ ID NO: 1537975 - RNA, 20 nt, Human adenovirus A
uguacagaaaaaaauugcca

SEQ ID NO: 1537976 - RNA, 19 nt, Human adenovirus A
aaaugcccugcaaaaagaa

SEQ ID NO: 1537977 - RNA, 19 nt, Human adenovirus A
uccagaaaguaucugccca

SEQ ID NO: 1537978 - RNA, 22 nt, Human adenovirus A
cuuaaagaguaaaaaaagcccg

SEQ ID NO: 1537979 - RNA, 22 nt, Human adenovirus A
gugaaucgcagucaccaccagc

SEQ ID NO: 1537980 - RNA, 17 nt, Human adenovirus A
accaguacgaggacuga

SEQ ID NO: 1537981 - RNA, 22 nt, Human adenovirus A
gguuuguggggugucugaucaa

SEQ ID NO: 1537982 - RNA, 13 nt, Human adenovirus A
agcauuauuugcg

SEQ ID NO: 1537983 - RNA, 18 nt, Human adenovirus A
auugaagggaauggcuau

SEQ ID NO: 1537984 - RNA, 15 nt, Human adenovirus A
aagguguugagcccg

SEQ ID NO: 1537985 - RNA, 12 nt, Human adenovirus A
uucaacuuuguc

SEQ ID NO: 1537986 - RNA, 16 nt, Human adenovirus A
ccuacuucacccuggg

SEQ ID NO: 1537987 - RNA, 14 nt, Human adenovirus A
aucauauacauaua

SEQ ID NO: 1537988 - RNA, 13 nt, Human adenovirus A
agauaaguuuaaa

SEQ ID NO: 1537989 - RNA, 20 nt, Human adenovirus A
uucaccgcgcugcggccaug

SEQ ID NO: 1537990 - RNA, 14 nt, Human adenovirus A
guaugcucaaacag

SEQ ID NO: 1537991 - RNA, 22 nt, Human adenovirus A
cagcaaagaaaguucaccucca

SEQ ID NO: 1537992 - RNA, 14 nt, Human adenovirus A
cucuuuucuuuacc

SEQ ID NO: 1537993 - RNA, 17 nt, Human adenovirus A
cgcgcaagcuuucauug

SEQ ID NO: 1537994 - RNA, 23 nt, Human adenovirus A
cuaagacuuaccccugggcuuug

SEQ ID NO: 1537995 - RNA, 18 nt, Human adenovirus A
aaaguacccuaaacagua

SEQ ID NO: 1537996 - RNA, 20 nt, Human adenovirus A
ccaaucaggcuguacagaaa

SEQ ID NO: 1537997 - RNA, 13 nt, Human adenovirus A
gagccacagcucu

SEQ ID NO: 1537998 - RNA, 14 nt, Human adenovirus A
uauuaacuuuauau

SEQ ID NO: 1537999 - RNA, 16 nt, Human adenovirus A
caaaggugcuucccac

SEQ ID NO: 1538000 - RNA, 17 nt, Human adenovirus A
acuggauuugcgcacug

SEQ ID NO: 1538001 - RNA, 16 nt, Human adenovirus A
cauccguggcaggcca

SEQ ID NO: 1538002 - RNA, 13 nt, Human adenovirus A
aagcgcaauauug

SEQ ID NO: 1538003 - RNA, 15 nt, Human adenovirus A
guuaucuucaaauca

SEQ ID NO: 1538004 - RNA, 15 nt, Human adenovirus A
caauaaauacugcuc

SEQ ID NO: 1538005 - RNA, 17 nt, Human adenovirus A
cauaguucuugauuuag

SEQ ID NO: 1538006 - RNA, 21 nt, Human adenovirus A
cauuaagaacacggugaaugu

SEQ ID NO: 1538007 - RNA, 16 nt, Human adenovirus A
uuuuucccacuuuaua

SEQ ID NO: 1538008 - RNA, 12 nt, Human adenovirus A
aagaggaggguu

SEQ ID NO: 1538009 - RNA, 14 nt, Human adenovirus A
uggcuucagcauuu

SEQ ID NO: 1538010 - RNA, 14 nt, Human adenovirus A
cguugcaagaggag

SEQ ID NO: 1538011 - RNA, 21 nt, Human adenovirus A
cagauuaugguucagcuucuc

SEQ ID NO: 1538012 - RNA, 14 nt, Human adenovirus A
guccccgaaagccg

SEQ ID NO: 1538013 - RNA, 13 nt, Human adenovirus A
gcgcuccauccaa

SEQ ID NO: 1538014 - RNA, 22 nt, Human adenovirus A
gaacaaacgguuacagaggaac

SEQ ID NO: 1538015 - RNA, 14 nt, Human adenovirus A
cuccauggggcgcg

SEQ ID NO: 1538016 - RNA, 19 nt, Human adenovirus A
guguacuuuucaaacuuua

SEQ ID NO: 1538017 - RNA, 17 nt, Human adenovirus A
gucaucucuacagcccc

SEQ ID NO: 1538018 - RNA, 10 nt, Human adenovirus A
cuucugccua

SEQ ID NO: 1538019 - RNA, 22 nt, Human adenovirus A
augugcuauuguuaacacugcc

SEQ ID NO: 1538020 - RNA, 23 nt, Human adenovirus A
ugaagaagaaccuaacugucauc

SEQ ID NO: 1538021 - RNA, 21 nt, Human adenovirus A
auggaguuggaaacugugcug

SEQ ID NO: 1538022 - RNA, 20 nt, Human adenovirus A
aacagaaaguuguagauggu

SEQ ID NO: 1538023 - RNA, 21 nt, Human adenovirus A
agcugccaccucuagaaacug

SEQ ID NO: 1538024 - RNA, 17 nt, Human adenovirus A
gugccacccccagugcc

SEQ ID NO: 1538025 - RNA, 23 nt, Human adenovirus A
accuagguuuaaaucuuucugcu

SEQ ID NO: 1538026 - RNA, 17 nt, Human adenovirus A
ugggcuuauaccuacca

SEQ ID NO: 1538027 - RNA, 12 nt, Human adenovirus A
aagcaaaugcau

SEQ ID NO: 1538028 - RNA, 21 nt, Human adenovirus A
cccgacggaguguuucagcuc

SEQ ID NO: 1538029 - RNA, 15 nt, Human adenovirus A
agccaugcaaauagu

SEQ ID NO: 1538030 - RNA, 20 nt, Human adenovirus A
gaaucggcaacagcagcaac

SEQ ID NO: 1538031 - RNA, 21 nt, Human adenovirus A
ccccuaaacggcaagccaacg

SEQ ID NO: 1538032 - RNA, 16 nt, Human adenovirus A
aucggcggcgcggacg

SEQ ID NO: 1538033 - RNA, 15 nt, Human adenovirus A
auuacuugaacaacu

SEQ ID NO: 1538034 - RNA, 23 nt, Human adenovirus A
aucaaauuguaagcgauuuucca

SEQ ID NO: 1538035 - RNA, 15 nt, Human adenovirus A
uagacgaacaaacuu

SEQ ID NO: 1538036 - RNA, 14 nt, Human adenovirus A
aauacugaacuauu

SEQ ID NO: 1538037 - RNA, 11 nt, Human adenovirus A
ccucuucccaa

SEQ ID NO: 1538038 - RNA, 11 nt, Human adenovirus A
guucccacagu

SEQ ID NO: 1538039 - RNA, 16 nt, Human adenovirus A
uagcaaagccauccgc

SEQ ID NO: 1538040 - RNA, 22 nt, Human adenovirus A
cgcuguugggacagcaagcagc

SEQ ID NO: 1538041 - RNA, 22 nt, Human adenovirus A
cauuccuucagaauaaaacaag

SEQ ID NO: 1538042 - RNA, 14 nt, Human adenovirus A
ccaccucuagaaac

SEQ ID NO: 1538043 - RNA, 18 nt, Human adenovirus A
agacaaaaaaaauacuaa

SEQ ID NO: 1538044 - RNA, 14 nt, Human adenovirus A
ucuguuauguaugc

SEQ ID NO: 1538045 - RNA, 14 nt, Human adenovirus A
agucaccaccagcg

SEQ ID NO: 1538046 - RNA, 17 nt, Human adenovirus A
acaaaauaccccuaucc

SEQ ID NO: 1538047 - RNA, 15 nt, Human adenovirus A
cguaggguacagugg

SEQ ID NO: 1538048 - RNA, 13 nt, Human adenovirus A
ggaacuauuucuu

SEQ ID NO: 1538049 - RNA, 15 nt, Human adenovirus A
cuuaacccucccucu

SEQ ID NO: 1538050 - RNA, 23 nt, Human adenovirus A
uguaaccagagcaccccuuccca

SEQ ID NO: 1538051 - RNA, 16 nt, Human adenovirus A
auccuaggcaaagaaa

SEQ ID NO: 1538052 - RNA, 12 nt, Human adenovirus A
ggcaggaguugc

SEQ ID NO: 1538053 - RNA, 18 nt, Human adenovirus A
gucuacucacagcuuauu

SEQ ID NO: 1538054 - RNA, 10 nt, Human adenovirus A
cucuuuucuu

SEQ ID NO: 1538055 - RNA, 18 nt, Human adenovirus A
ccauugugcccacgccug

SEQ ID NO: 1538056 - RNA, 16 nt, Human adenovirus A
aaagcuucaauuugcc

SEQ ID NO: 1538057 - RNA, 22 nt, Human adenovirus A
aacugggggcguacacuggcug

SEQ ID NO: 1538058 - RNA, 18 nt, Human adenovirus A
aagaucaaggaaauacua

SEQ ID NO: 1538059 - RNA, 18 nt, Human adenovirus A
aguuuggcagacaaggug

SEQ ID NO: 1538060 - RNA, 19 nt, Human adenovirus A
aagguaaugagcgcaguga

SEQ ID NO: 1538061 - RNA, 19 nt, Human adenovirus A
aaacacuguaagaggagac

SEQ ID NO: 1538062 - RNA, 16 nt, Human adenovirus A
uaaaacuuccaacuua

SEQ ID NO: 1538063 - RNA, 17 nt, Human adenovirus A
gauguugggcccaagau

SEQ ID NO: 1538064 - RNA, 22 nt, Human adenovirus A
aacguagcuuuugacuguuccu

SEQ ID NO: 1538065 - RNA, 19 nt, Human adenovirus A
gcauauugcgcuauguaca

SEQ ID NO: 1538066 - RNA, 15 nt, Human adenovirus A
ugaagcaaaccacau

SEQ ID NO: 1538067 - RNA, 17 nt, Human adenovirus A
auggcugaagaggaggg

SEQ ID NO: 1538068 - RNA, 16 nt, Human adenovirus A
cgccaaagccacaccu

SEQ ID NO: 1538069 - RNA, 14 nt, Human adenovirus A
cugacuauuucaca

SEQ ID NO: 1538070 - RNA, 18 nt, Human adenovirus A
aucuucaucuuuucuaga

SEQ ID NO: 1538071 - RNA, 18 nt, Human adenovirus A
auucgcagcgcacuggca

SEQ ID NO: 1538072 - RNA, 20 nt, Human adenovirus A
gcuaaacgaccgccuuuucu

SEQ ID NO: 1538073 - RNA, 16 nt, Human adenovirus A
ccaaggaugacaacau

SEQ ID NO: 1538074 - RNA, 18 nt, Human adenovirus A
cuuuuauuucucuuuucu

SEQ ID NO: 1538075 - RNA, 20 nt, Human adenovirus A
cgagcucccggaggaagcgg

SEQ ID NO: 1538076 - RNA, 22 nt, Human adenovirus A
cuccgugaguuggccuggaaau

SEQ ID NO: 1538077 - RNA, 22 nt, Human adenovirus A
ugaagugccucaaagugaagug

SEQ ID NO: 1538078 - RNA, 15 nt, Human adenovirus A
cauuccccaguuuaa

SEQ ID NO: 1538079 - RNA, 11 nt, Human adenovirus A
caauguaacuu

SEQ ID NO: 1538080 - RNA, 21 nt, Human adenovirus A
ucauccgcauuuaagcaacau

SEQ ID NO: 1538081 - RNA, 13 nt, Human adenovirus A
gacagugugagug

SEQ ID NO: 1538082 - RNA, 12 nt, Human adenovirus A
ugcgggcagcca

SEQ ID NO: 1538083 - RNA, 22 nt, Human adenovirus A
aggaacuaaaccuuccaucacc

SEQ ID NO: 1538084 - RNA, 13 nt, Human adenovirus A
caacgacuaaaac

SEQ ID NO: 1538085 - RNA, 19 nt, Human adenovirus A
accacucugacacaaaagc

SEQ ID NO: 1538086 - RNA, 18 nt, Human adenovirus A
uuccggaguucccacaga

SEQ ID NO: 1538087 - RNA, 21 nt, Human adenovirus A
augcgcccggaacuauuucuu

SEQ ID NO: 1538088 - RNA, 15 nt, Human adenovirus A
ugagugggcagaauu

SEQ ID NO: 1538089 - RNA, 15 nt, Human adenovirus A
accccaaaagcccgc

SEQ ID NO: 1538090 - RNA, 14 nt, Human adenovirus A
ucuuuugcagcucc

SEQ ID NO: 1538091 - RNA, 17 nt, Human adenovirus A
cagccguuucaggaagg

SEQ ID NO: 1538092 - RNA, 22 nt, Human adenovirus A
acagcuucuaaaagagccacag

SEQ ID NO: 1538093 - RNA, 11 nt, Human adenovirus A
cuaacaccaaa

SEQ ID NO: 1538094 - RNA, 22 nt, Human adenovirus A
cugaagaagaaccuaacuguca

SEQ ID NO: 1538095 - RNA, 11 nt, Human adenovirus A
guccuacggag

SEQ ID NO: 1538096 - RNA, 14 nt, Human adenovirus A
augcauaauuaaac

SEQ ID NO: 1538097 - RNA, 12 nt, Human adenovirus A
acaugaggcggu

SEQ ID NO: 1538098 - RNA, 16 nt, Human adenovirus A
aagcacgccaaagcca

SEQ ID NO: 1538099 - RNA, 21 nt, Human adenovirus A
aaccgucgccagcaagugccu

SEQ ID NO: 1538100 - RNA, 21 nt, Human adenovirus A
caagcggcauuccccauccaa

SEQ ID NO: 1538101 - RNA, 13 nt, Human adenovirus A
gugguauuggaac

SEQ ID NO: 1538102 - RNA, 19 nt, Human adenovirus A
uagauacaagcgacagagu

SEQ ID NO: 1538103 - RNA, 14 nt, Human adenovirus A
guacccgccagugc

SEQ ID NO: 1538104 - RNA, 15 nt, Human adenovirus A
uguaaaaugggaaau

SEQ ID NO: 1538105 - RNA, 14 nt, Human adenovirus A
ccgcgaucagccau

SEQ ID NO: 1538106 - RNA, 13 nt, Human adenovirus A
aaggugguggcaa

SEQ ID NO: 1538107 - RNA, 14 nt, Human adenovirus A
acuauagagaggaa

SEQ ID NO: 1538108 - RNA, 23 nt, Human adenovirus A
ugguggaaaaagaucaaggaaau

SEQ ID NO: 1538109 - RNA, 15 nt, Human adenovirus A
aaaucauacaaauca

SEQ ID NO: 1538110 - RNA, 21 nt, Human adenovirus A
guaaaccuugaaaugccagac

SEQ ID NO: 1538111 - RNA, 18 nt, Human adenovirus A
ccacagccagugggucca

SEQ ID NO: 1538112 - RNA, 14 nt, Human adenovirus A
acgagacucccccc

SEQ ID NO: 1538113 - RNA, 15 nt, Human adenovirus A
uuacugguacuauga

SEQ ID NO: 1538114 - RNA, 23 nt, Human adenovirus A
auacacucauguauuuuuucaaa

SEQ ID NO: 1538115 - RNA, 16 nt, Human adenovirus A
cauugaaaccagcgcc

SEQ ID NO: 1538116 - RNA, 15 nt, Human adenovirus A
aucucagaaagccaa

SEQ ID NO: 1538117 - RNA, 14 nt, Human adenovirus A
aagagcugcugcag

SEQ ID NO: 1538118 - RNA, 18 nt, Human adenovirus A
cacugcuuugcucgagac

SEQ ID NO: 1538119 - RNA, 20 nt, Human adenovirus A
ucggcacgagccagcugaac

SEQ ID NO: 1538120 - RNA, 15 nt, Human adenovirus A
ucgcuuuugccagac

SEQ ID NO: 1538121 - RNA, 18 nt, Human adenovirus A
cuugguguuucaggaaaa

SEQ ID NO: 1538122 - RNA, 22 nt, Human adenovirus A
aguaaaucuuccgccaaaggua

SEQ ID NO: 1538123 - RNA, 21 nt, Human adenovirus A
aggcagccguuucaggaagga

SEQ ID NO: 1538124 - RNA, 16 nt, Human adenovirus A
acuuucaaaaaagcuu

SEQ ID NO: 1538125 - RNA, 17 nt, Human adenovirus A
guaaauucaguagauuu

SEQ ID NO: 1538126 - RNA, 13 nt, Human adenovirus A
uaaaaacacacac

SEQ ID NO: 1538127 - RNA, 16 nt, Human adenovirus A
ccaguuuaaaggcugu

SEQ ID NO: 1538128 - RNA, 12 nt, Human adenovirus A
aauuaacugcac

SEQ ID NO: 1538129 - RNA, 14 nt, Human adenovirus A
gccuccgcugugcu

SEQ ID NO: 1538130 - RNA, 16 nt, Human adenovirus A
gucccggucuggugca

SEQ ID NO: 1538131 - RNA, 13 nt, Human adenovirus A
gacugucaguguc

SEQ ID NO: 1538132 - RNA, 13 nt, Human adenovirus A
caaaaaagcuuua

SEQ ID NO: 1538133 - RNA, 19 nt, Human adenovirus A
ccaaaauuuucaacagaaa

SEQ ID NO: 1538134 - RNA, 21 nt, Human adenovirus A
cacugguuaucgcaccucguc

SEQ ID NO: 1538135 - RNA, 19 nt, Human adenovirus A
cccaacuuugacgcaguga

SEQ ID NO: 1538136 - RNA, 16 nt, Human adenovirus A
ggcgaacaggaagagc

SEQ ID NO: 1538137 - RNA, 14 nt, Human adenovirus A
aagguguguaaaca

SEQ ID NO: 1538138 - RNA, 20 nt, Human adenovirus A
gcuuguugaauucgcaggcg

SEQ ID NO: 1538139 - RNA, 16 nt, Human adenovirus A
auugguggaaaaagau

SEQ ID NO: 1538140 - RNA, 21 nt, Human adenovirus A
gcuggaugcuuugggagacag

SEQ ID NO: 1538141 - RNA, 10 nt, Human adenovirus A
caaacagugc

SEQ ID NO: 1538142 - RNA, 23 nt, Human adenovirus A
augaggaagcaauaaaacaagga

SEQ ID NO: 1538143 - RNA, 23 nt, Human adenovirus A
gucuucguacuuaaaaaaacaaa

SEQ ID NO: 1538144 - RNA, 17 nt, Human adenovirus A
aaauguguacuugcuuu

SEQ ID NO: 1538145 - RNA, 16 nt, Human adenovirus A
gcacuggcaacauacc

SEQ ID NO: 1538146 - RNA, 22 nt, Human adenovirus A
cauaaaagcuucaauuugccua

SEQ ID NO: 1538147 - RNA, 13 nt, Human adenovirus A
auuuuaaaguaaa

SEQ ID NO: 1538148 - RNA, 14 nt, Human adenovirus A
caagccgcaggacu

SEQ ID NO: 1538149 - RNA, 16 nt, Human adenovirus A
aacgguuaagcugggu

SEQ ID NO: 1538150 - RNA, 15 nt, Human adenovirus A
cagcauuaguucuuu

SEQ ID NO: 1538151 - RNA, 21 nt, Human adenovirus A
ugaauuguauaaauucuuaaa

SEQ ID NO: 1538152 - RNA, 15 nt, Human adenovirus A
acgauuaagacauau

SEQ ID NO: 1538153 - RNA, 18 nt, Human adenovirus A
agcgucuucguacuuaaa

SEQ ID NO: 1538154 - RNA, 21 nt, Human adenovirus A
ccauuuugguuucgccaagua

SEQ ID NO: 1538155 - RNA, 23 nt, Human adenovirus A
gagcucccggaggaagcggcggu

SEQ ID NO: 1538156 - RNA, 21 nt, Human adenovirus A
gcuuggaagaaaaaaaccuuc

SEQ ID NO: 1538157 - RNA, 14 nt, Human adenovirus A
acauguuauuuaaa

SEQ ID NO: 1538158 - RNA, 19 nt, Human adenovirus A
ugccaccaguuggaagaau

SEQ ID NO: 1538159 - RNA, 12 nt, Human adenovirus A
guaugccaacaa

SEQ ID NO: 1538160 - RNA, 13 nt, Human adenovirus A
aucuccugccacc

SEQ ID NO: 1538161 - RNA, 13 nt, Human adenovirus A
acuagguauugau

SEQ ID NO: 1538162 - RNA, 17 nt, Human adenovirus A
cacuguuguauuauuug

SEQ ID NO: 1538163 - RNA, 21 nt, Human adenovirus A
aucaacgacuaaaacaaaucu

SEQ ID NO: 1538164 - RNA, 15 nt, Human adenovirus A
ucaaaguaugcugca

SEQ ID NO: 1538165 - RNA, 15 nt, Human adenovirus A
agcagagucgagguc

SEQ ID NO: 1538166 - RNA, 20 nt, Human adenovirus A
caagacguuccauggcuucg

SEQ ID NO: 1538167 - RNA, 13 nt, Human adenovirus A
cauucgcagcgca

SEQ ID NO: 1538168 - RNA, 23 nt, Human adenovirus A
uggcucaacgagagcgcuuucau

SEQ ID NO: 1538169 - RNA, 22 nt, Human adenovirus A
gacaccuacuucacccugggaa

SEQ ID NO: 1538170 - RNA, 23 nt, Human adenovirus A
ccaaaguucgccuacacaacaca

SEQ ID NO: 1538171 - RNA, 15 nt, Human adenovirus A
aacgggcagccuguc

SEQ ID NO: 1538172 - RNA, 18 nt, Human adenovirus A
aguucaaagaagagcugc

SEQ ID NO: 1538173 - RNA, 20 nt, Human adenovirus A
aaccugaucuagaaauugau

SEQ ID NO: 1538174 - RNA, 19 nt, Human adenovirus A
caagcuuaccccgccaacu

SEQ ID NO: 1538175 - RNA, 14 nt, Human adenovirus A
ugcgaccucagccc

SEQ ID NO: 1538176 - RNA, 13 nt, Human adenovirus A
ucaccaaaguaau

SEQ ID NO: 1538177 - RNA, 18 nt, Human adenovirus A
agcacaacuccaugugga

SEQ ID NO: 1538178 - RNA, 19 nt, Human adenovirus A
agacaccgcccaggcaggc

SEQ ID NO: 1538179 - RNA, 14 nt, Human adenovirus A
agguuuaauguuua

SEQ ID NO: 1538180 - RNA, 20 nt, Human adenovirus A
cugauggugccuaagcggca

SEQ ID NO: 1538181 - RNA, 19 nt, Human adenovirus A
aauggaguuggaaacugug

SEQ ID NO: 1538182 - RNA, 18 nt, Human adenovirus A
agaucuuaggguuugauu

SEQ ID NO: 1538183 - RNA, 23 nt, Human adenovirus A
ccuggcaguuuuaaagcgcaaua

SEQ ID NO: 1538184 - RNA, 22 nt, Human adenovirus A
uguacagcaaucuguaaguuug

SEQ ID NO: 1538185 - RNA, 17 nt, Human adenovirus A
uuggauaccaagguuuu

SEQ ID NO: 1538186 - RNA, 13 nt, Human adenovirus A
augcagcugugga

SEQ ID NO: 1538187 - RNA, 12 nt, Human adenovirus A
agcaccccuucc

SEQ ID NO: 1538188 - RNA, 20 nt, Human adenovirus A
gcaaaugcauuaucaugaaa

SEQ ID NO: 1538189 - RNA, 22 nt, Human adenovirus A
cgcggagacgggccgcagcugc

SEQ ID NO: 1538190 - RNA, 16 nt, Human adenovirus A
ucagaagccagcagca

SEQ ID NO: 1538191 - RNA, 14 nt, Human adenovirus A
aggcgcuccuaaug

SEQ ID NO: 1538192 - RNA, 14 nt, Human adenovirus A
gaaaugaggcgcgc

SEQ ID NO: 1538193 - RNA, 15 nt, Human adenovirus A
agaaugaucacagca

SEQ ID NO: 1538194 - RNA, 23 nt, Human adenovirus A
agcccccgcguccuccuucuguu

SEQ ID NO: 1538195 - RNA, 15 nt, Human adenovirus A
ugguacuaugacugu

SEQ ID NO: 1538196 - RNA, 19 nt, Human adenovirus A
aucaagcauguuaaaaaac

SEQ ID NO: 1538197 - RNA, 20 nt, Human adenovirus A
ccaugggaauagugcucuaa

SEQ ID NO: 1538198 - RNA, 18 nt, Human adenovirus A
gggauuguguccuuggaa

SEQ ID NO: 1538199 - RNA, 22 nt, Human adenovirus A
cuuggcuucgaaugcugugaca

SEQ ID NO: 1538200 - RNA, 20 nt, Human adenovirus A
cgcagucuuaguuuggcaga

SEQ ID NO: 1538201 - RNA, 20 nt, Human adenovirus A
auccauuuccaccaaaugcu

SEQ ID NO: 1538202 - RNA, 13 nt, Human adenovirus A
caggcaaagaaca

SEQ ID NO: 1538203 - RNA, 17 nt, Human adenovirus A
gcaccaucuccauucca

SEQ ID NO: 1538204 - RNA, 20 nt, Human adenovirus A
cauauuaggcauaaugcagc

SEQ ID NO: 1538205 - RNA, 15 nt, Human adenovirus A
gaugcuuugggagac

SEQ ID NO: 1538206 - RNA, 14 nt, Human adenovirus A
gaggucaagaacac

SEQ ID NO: 1538207 - RNA, 19 nt, Human adenovirus A
cuuaaccgcccccaccgcu

SEQ ID NO: 1538208 - RNA, 16 nt, Human adenovirus A
aagaaugggaggagga

SEQ ID NO: 1538209 - RNA, 17 nt, Human adenovirus A
augugaaggcgccagga

SEQ ID NO: 1538210 - RNA, 21 nt, Human adenovirus A
aggauugguuccuaauacaaa

SEQ ID NO: 1538211 - RNA, 15 nt, Human adenovirus A
gacuucccacagcca

SEQ ID NO: 1538212 - RNA, 21 nt, Human adenovirus A
uacaacauuggauaccaaggu

SEQ ID NO: 1538213 - RNA, 18 nt, Human adenovirus A
cuguucuuaguaggcuaa

SEQ ID NO: 1538214 - RNA, 21 nt, Human adenovirus A
auuucgauaaacaaaagcaaa

SEQ ID NO: 1538215 - RNA, 19 nt, Human adenovirus A
gcugccuccuuugccagaa

SEQ ID NO: 1538216 - RNA, 13 nt, Human adenovirus A
ccgaggaauuuga

SEQ ID NO: 1538217 - RNA, 22 nt, Human adenovirus A
aaagucagacuauuacacucag

SEQ ID NO: 1538218 - RNA, 18 nt, Human adenovirus A
uaauacuuaauuucuaga

SEQ ID NO: 1538219 - RNA, 12 nt, Human adenovirus A
acgagcaagccg

SEQ ID NO: 1538220 - RNA, 17 nt, Human adenovirus A
aaugcucuggacaugga

SEQ ID NO: 1538221 - RNA, 20 nt, Human adenovirus A
ucgcaauuagggccagcauu

SEQ ID NO: 1538222 - RNA, 12 nt, Human adenovirus A
gacuaaaacaaa

SEQ ID NO: 1538223 - RNA, 17 nt, Human adenovirus A
ugcaucguaaacaacag

SEQ ID NO: 1538224 - RNA, 19 nt, Human adenovirus A
ggcgcuuucgggcucuggc

SEQ ID NO: 1538225 - RNA, 16 nt, Human adenovirus A
gauccagaggaggagg

SEQ ID NO: 1538226 - RNA, 16 nt, Human adenovirus A
agaccaaccaccgcca

SEQ ID NO: 1538227 - RNA, 21 nt, Human adenovirus A
gcuugagcaaaaauguuuucu

SEQ ID NO: 1538228 - RNA, 18 nt, Human adenovirus A
ugccgcacggccaaugcc

SEQ ID NO: 1538229 - RNA, 20 nt, Human adenovirus A
aagcuuucauugguccaggc

SEQ ID NO: 1538230 - RNA, 12 nt, Human adenovirus A
ugacuggacagc

SEQ ID NO: 1538231 - RNA, 13 nt, Human adenovirus A
ccaggaagcugag

SEQ ID NO: 1538232 - RNA, 13 nt, Human adenovirus A
auuugucuccucu

SEQ ID NO: 1538233 - RNA, 16 nt, Human adenovirus A
ccagauuguggaauaa

SEQ ID NO: 1538234 - RNA, 22 nt, Human adenovirus A
agccauggaugaauugcagccu

SEQ ID NO: 1538235 - RNA, 14 nt, Human adenovirus A
gguaagugggugga

SEQ ID NO: 1538236 - RNA, 12 nt, Human adenovirus A
agcuaaaacaag

SEQ ID NO: 1538237 - RNA, 20 nt, Human adenovirus A
aacacggaguaaugaacaag

SEQ ID NO: 1538238 - RNA, 21 nt, Human adenovirus A
cggccuguuuuguuguauguu

SEQ ID NO: 1538239 - RNA, 15 nt, Human adenovirus A
auuaccgagcuccau

SEQ ID NO: 1538240 - RNA, 22 nt, Human adenovirus A
ccacaaggaaaugaggaggagg

SEQ ID NO: 1538241 - RNA, 17 nt, Human adenovirus A
agugcuggaaagugaca

SEQ ID NO: 1538242 - RNA, 19 nt, Human adenovirus A
aaauaaagaguuaauugau

SEQ ID NO: 1538243 - RNA, 21 nt, Human adenovirus A
cuccccuguggagccacugcu

SEQ ID NO: 1538244 - RNA, 19 nt, Human adenovirus A
cagaacgugcuacacucaa

SEQ ID NO: 1538245 - RNA, 18 nt, Human adenovirus A
aucaacgacuaaaacaaa

SEQ ID NO: 1538246 - RNA, 19 nt, Human adenovirus A
cggacgagcucccggagga

SEQ ID NO: 1538247 - RNA, 23 nt, Human adenovirus A
cauaccaguuaaugcuggaugcu

SEQ ID NO: 1538248 - RNA, 18 nt, Human adenovirus A
ccguggcucccacccaug

SEQ ID NO: 1538249 - RNA, 20 nt, Human adenovirus A
uccuaccacuguacuuuugc

SEQ ID NO: 1538250 - RNA, 21 nt, Human adenovirus A
gccaugaacggggaauacuuu

SEQ ID NO: 1538251 - RNA, 20 nt, Human adenovirus A
ugccggauugcgaacaacaa

SEQ ID NO: 1538252 - RNA, 19 nt, Human adenovirus A
aaacauaaaacuaccugau

SEQ ID NO: 1538253 - RNA, 19 nt, Human adenovirus A
gcugugagcaaaucucaga

SEQ ID NO: 1538254 - RNA, 15 nt, Human adenovirus A
ucacaagacacauug

SEQ ID NO: 1538255 - RNA, 22 nt, Human adenovirus A
acaucuuuuacuaaaaugcaaa

SEQ ID NO: 1538256 - RNA, 17 nt, Human adenovirus A
ucaaacuuuacaaacca

SEQ ID NO: 1538257 - RNA, 16 nt, Human adenovirus A
cagcggggaggaagcu

SEQ ID NO: 1538258 - RNA, 15 nt, Human adenovirus A
cccuuuaccaacacc

SEQ ID NO: 1538259 - RNA, 13 nt, Human adenovirus A
augcucuggacau

SEQ ID NO: 1538260 - RNA, 14 nt, Human adenovirus A
caaagccaggcaca

SEQ ID NO: 1538261 - RNA, 14 nt, Human adenovirus A
agagagugcccccc

SEQ ID NO: 1538262 - RNA, 23 nt, Human adenovirus A
uugcaaaacggcuugccugacuu

SEQ ID NO: 1538263 - RNA, 11 nt, Human adenovirus A
accacaguggu

SEQ ID NO: 1538264 - RNA, 16 nt, Human adenovirus A
aagcuauuugagccuu

SEQ ID NO: 1538265 - RNA, 17 nt, Human adenovirus A
cccagcuaacgccacca

SEQ ID NO: 1538266 - RNA, 14 nt, Human adenovirus A
uucuaauguggagc

SEQ ID NO: 1538267 - RNA, 18 nt, Human adenovirus A
gcucccacacgcagcaac

SEQ ID NO: 1538268 - RNA, 14 nt, Human adenovirus A
cauauuguggagaa

SEQ ID NO: 1538269 - RNA, 22 nt, Human adenovirus A
aaggauugguuccuaauacaaa

SEQ ID NO: 1538270 - RNA, 20 nt, Human adenovirus A
caaagccacuuuagccccag

SEQ ID NO: 1538271 - RNA, 14 nt, Human adenovirus A
cucugaaacaugcu

SEQ ID NO: 1538272 - RNA, 14 nt, Human adenovirus A
guauggugccaauc

SEQ ID NO: 1538273 - RNA, 15 nt, Human adenovirus A
cucacuuaagucuuu

SEQ ID NO: 1538274 - RNA, 16 nt, Human adenovirus A
ggaagguguugagccc

SEQ ID NO: 1538275 - RNA, 13 nt, Human adenovirus A
ugcuccuuuucuu

SEQ ID NO: 1538276 - RNA, 19 nt, Human adenovirus A
gcucuuuugcagcuccaac

SEQ ID NO: 1538277 - RNA, 16 nt, Human adenovirus A
cuuccauugugcccac

SEQ ID NO: 1538278 - RNA, 14 nt, Human adenovirus A
aaacacaugaugga

SEQ ID NO: 1538279 - RNA, 22 nt, Human adenovirus A
cauggaucguauuauggcuuua

SEQ ID NO: 1538280 - RNA, 18 nt, Human adenovirus A
ugcaggaugaauuucagc

SEQ ID NO: 1538281 - RNA, 18 nt, Human adenovirus A
aaaauuuucccaacaaug

SEQ ID NO: 1538282 - RNA, 22 nt, Human adenovirus A
cuuccaacuuauuacugguacu

SEQ ID NO: 1538283 - RNA, 15 nt, Human adenovirus A
gcccagcuguucuua

SEQ ID NO: 1538284 - RNA, 23 nt, Human adenovirus A
gugaacgcaagcgugcaaacaga

SEQ ID NO: 1538285 - RNA, 16 nt, Human adenovirus A
agcggcugacagagcg

SEQ ID NO: 1538286 - RNA, 13 nt, Human adenovirus A
aucuccauuccau

SEQ ID NO: 1538287 - RNA, 18 nt, Human adenovirus A
cccagcugacauacacug

SEQ ID NO: 1538288 - RNA, 14 nt, Human adenovirus A
cagugaagcaaacc

SEQ ID NO: 1538289 - RNA, 12 nt, Human adenovirus A
ccccuuugaaga

SEQ ID NO: 1538290 - RNA, 20 nt, Human adenovirus A
ucgccagcaagugccuccuc

SEQ ID NO: 1538291 - RNA, 22 nt, Human adenovirus A
aucugcgccacaauaacuacaa

SEQ ID NO: 1538292 - RNA, 16 nt, Human adenovirus A
aaaguaccaggaagcu

SEQ ID NO: 1538293 - RNA, 19 nt, Human adenovirus A
uguuugacaagauugucau

SEQ ID NO: 1538294 - RNA, 15 nt, Human adenovirus A
guacuuaaaaaaaca

SEQ ID NO: 1538295 - RNA, 16 nt, Human adenovirus A
gaaguaagcuguuuua

SEQ ID NO: 1538296 - RNA, 13 nt, Human adenovirus A
aguaaugaacaag

SEQ ID NO: 1538297 - RNA, 20 nt, Human adenovirus A
cuuuaccaacaccaacaguu

SEQ ID NO: 1538298 - RNA, 17 nt, Human adenovirus A
cucccucuuggccagcu

SEQ ID NO: 1538299 - RNA, 16 nt, Human adenovirus A
gccagcucuugcagua

SEQ ID NO: 1538300 - RNA, 18 nt, Human adenovirus A
aaacagauucuggagaau

SEQ ID NO: 1538301 - RNA, 13 nt, Human adenovirus A
ugggaggaagaau

SEQ ID NO: 1538302 - RNA, 18 nt, Human adenovirus A
aauuaauggaguuguaga

SEQ ID NO: 1538303 - RNA, 17 nt, Human adenovirus A
cacuuuauaugcuauuu

SEQ ID NO: 1538304 - RNA, 14 nt, Human adenovirus A
agcuauaaaaagag

SEQ ID NO: 1538305 - RNA, 14 nt, Human adenovirus A
cuucucaucuuuuu

SEQ ID NO: 1538306 - RNA, 18 nt, Human adenovirus A
ucaacacaguuuaacaca

SEQ ID NO: 1538307 - RNA, 16 nt, Human adenovirus A
gcaaaccuagcugcuc

SEQ ID NO: 1538308 - RNA, 14 nt, Human adenovirus A
uucuggaauaacaa

SEQ ID NO: 1538309 - RNA, 21 nt, Human adenovirus A
uuagcucauuggaguacaagc

SEQ ID NO: 1538310 - RNA, 15 nt, Human adenovirus A
aacggaggaggaggu

SEQ ID NO: 1538311 - RNA, 14 nt, Human adenovirus A
auuacugccaguuc

SEQ ID NO: 1538312 - RNA, 18 nt, Human adenovirus A
auaaagcuggguuggugu

SEQ ID NO: 1538313 - RNA, 15 nt, Human adenovirus A
guacauccagggcac

SEQ ID NO: 1538314 - RNA, 20 nt, Human adenovirus A
cugcuacuaacauuaaaaga

SEQ ID NO: 1538315 - RNA, 14 nt, Human adenovirus A
gcacucucugggga

SEQ ID NO: 1538316 - RNA, 17 nt, Human adenovirus A
gaacaucgcaaaacacg

SEQ ID NO: 1538317 - RNA, 22 nt, Human adenovirus A
uccaaccaacgaacacggagga

SEQ ID NO: 1538318 - RNA, 16 nt, Human adenovirus A
caaaaaguaaacuguc

SEQ ID NO: 1538319 - RNA, 14 nt, Human adenovirus A
gacaguuucaucac

SEQ ID NO: 1538320 - RNA, 15 nt, Human adenovirus A
uggaucaaaaacaag

SEQ ID NO: 1538321 - RNA, 12 nt, Human adenovirus A
cuucagcauuuu

SEQ ID NO: 1538322 - RNA, 19 nt, Human adenovirus A
ggccauguacuugacucug

SEQ ID NO: 1538323 - RNA, 15 nt, Human adenovirus A
ggaagaaagagaaca

SEQ ID NO: 1538324 - RNA, 17 nt, Human adenovirus A
cauuggaguuaaguuug

SEQ ID NO: 1538325 - RNA, 23 nt, Human adenovirus A
ugcaaaaagaaaaugaacaaaau

SEQ ID NO: 1538326 - RNA, 23 nt, Human adenovirus A
cagaaggaguaauaaaaccugug

SEQ ID NO: 1538327 - RNA, 16 nt, Human adenovirus A
acagauguaaaggagg

SEQ ID NO: 1538328 - RNA, 16 nt, Human adenovirus A
cccagacacggagagg

SEQ ID NO: 1538329 - RNA, 21 nt, Human adenovirus A
caaauaaacguguacacaaug

SEQ ID NO: 1538330 - RNA, 23 nt, Human adenovirus A
auguaaacccuuuuaaccaccac

SEQ ID NO: 1538331 - RNA, 14 nt, Human adenovirus A
auuaucaugaaacu

SEQ ID NO: 1538332 - RNA, 22 nt, Human adenovirus A
ucuucaucuuuucuagaugaag

SEQ ID NO: 1538333 - RNA, 20 nt, Human adenovirus A
acacaaucugccgcaagugc

SEQ ID NO: 1538334 - RNA, 18 nt, Human adenovirus A
agaccacugucgccaacc

SEQ ID NO: 1538335 - RNA, 18 nt, Human adenovirus A
gccaguacacuugggaaa

SEQ ID NO: 1538336 - RNA, 12 nt, Human adenovirus A
cuguugauguga

SEQ ID NO: 1538337 - RNA, 21 nt, Human adenovirus A
cacaugauggaucuggagcca

SEQ ID NO: 1538338 - RNA, 13 nt, Human adenovirus A
cuaauacaaaugc

SEQ ID NO: 1538339 - RNA, 13 nt, Human adenovirus A
cuuuucauuuucg

SEQ ID NO: 1538340 - RNA, 21 nt, Human adenovirus A
cauugcgauaaacuggauuug

SEQ ID NO: 1538341 - RNA, 14 nt, Human adenovirus A
uuguuggauagcaa

SEQ ID NO: 1538342 - RNA, 13 nt, Human adenovirus A
cuuaucagccaga

SEQ ID NO: 1538343 - RNA, 15 nt, Human adenovirus A
aaggaggaagaacau

SEQ ID NO: 1538344 - RNA, 14 nt, Human adenovirus A
aggguuugcauuua

SEQ ID NO: 1538345 - RNA, 23 nt, Human adenovirus A
caaaauaccccuauccugucgag

SEQ ID NO: 1538346 - RNA, 15 nt, Human adenovirus A
uaugcccagcaugac

SEQ ID NO: 1538347 - RNA, 17 nt, Human adenovirus A
augcgggggaugaagga

SEQ ID NO: 1538348 - RNA, 12 nt, Human adenovirus A
caaacuacauag

SEQ ID NO: 1538349 - RNA, 18 nt, Human adenovirus A
uauaguacugcuuccagg

SEQ ID NO: 1538350 - RNA, 14 nt, Human adenovirus A
uuaaauauaucuuu

SEQ ID NO: 1538351 - RNA, 18 nt, Human adenovirus A
gcuuaauaccuuugcuca

SEQ ID NO: 1538352 - RNA, 19 nt, Human adenovirus A
cuuuucaaacuuuacaaac

SEQ ID NO: 1538353 - RNA, 14 nt, Human adenovirus A
cgauguuauugacu

SEQ ID NO: 1538354 - RNA, 14 nt, Human adenovirus A
cauuaaagcaaacc

SEQ ID NO: 1538355 - RNA, 16 nt, Human adenovirus A
cagccgcuaccaucac

SEQ ID NO: 1538356 - RNA, 17 nt, Human adenovirus A
ccauuacuuuuaaauac

SEQ ID NO: 1538357 - RNA, 14 nt, Human adenovirus A
ucccucuucccaac

SEQ ID NO: 1538358 - RNA, 14 nt, Human adenovirus A
auggaauuacauuu

SEQ ID NO: 1538359 - RNA, 19 nt, Human adenovirus A
ggcuucgaaugcugugaca

SEQ ID NO: 1538360 - RNA, 17 nt, Human adenovirus A
agcuuccaguucuucuu

SEQ ID NO: 1538361 - RNA, 20 nt, Human adenovirus A
aguauacugaugaucuuccc

SEQ ID NO: 1538362 - RNA, 21 nt, Human adenovirus A
caaaccugacagacuugcaaa

SEQ ID NO: 1538363 - RNA, 19 nt, Human adenovirus A
cauugacaaagaugcaaac

SEQ ID NO: 1538364 - RNA, 18 nt, Human adenovirus A
augucaccuaaggcuuca

SEQ ID NO: 1538365 - RNA, 23 nt, Human adenovirus A
uuccacugguaacggucuucaag

SEQ ID NO: 1538366 - RNA, 23 nt, Human adenovirus A
cagguauaaaggucgcacugagc

SEQ ID NO: 1538367 - RNA, 22 nt, Human adenovirus A
uggucuucaucgcuuucuucug

SEQ ID NO: 1538368 - RNA, 14 nt, Human adenovirus A
auguaucagcagcc

SEQ ID NO: 1538369 - RNA, 20 nt, Human adenovirus A
ccuggcaaacggguggaaaa

SEQ ID NO: 1538370 - RNA, 13 nt, Human adenovirus A
cacaugggaaggg

SEQ ID NO: 1538371 - RNA, 16 nt, Human adenovirus A
cacuucuugcugaaau

SEQ ID NO: 1538372 - RNA, 16 nt, Human adenovirus A
acggccggaugcagag

SEQ ID NO: 1538373 - RNA, 13 nt, Human adenovirus A
gcgagcugccacc

SEQ ID NO: 1538374 - RNA, 17 nt, Human adenovirus A
uggcagcugauuucagc

SEQ ID NO: 1538375 - RNA, 17 nt, Human adenovirus A
gaagauuucugcuguca

SEQ ID NO: 1538376 - RNA, 19 nt, Human adenovirus A
cgugucuucucccugugcu

SEQ ID NO: 1538377 - RNA, 21 nt, Human adenovirus A
accucaaaaucuaagccaugc

SEQ ID NO: 1538378 - RNA, 15 nt, Human adenovirus A
auuuguugcuguugc

SEQ ID NO: 1538379 - RNA, 17 nt, Human adenovirus A
ccuucccaacuacuuua

SEQ ID NO: 1538380 - RNA, 13 nt, Human adenovirus A
uccagagcccccg

SEQ ID NO: 1538381 - RNA, 15 nt, Human adenovirus A
aacgcugaugccacu

SEQ ID NO: 1538382 - RNA, 18 nt, Human adenovirus A
cgcucaaaggcaggcauu

SEQ ID NO: 1538383 - RNA, 12 nt, Human adenovirus A
agcaaaguacaa

SEQ ID NO: 1538384 - RNA, 22 nt, Human adenovirus A
guccaggguuugcuucagcagu

SEQ ID NO: 1538385 - RNA, 17 nt, Human adenovirus A
aagggcgcccuccaccg

SEQ ID NO: 1538386 - RNA, 16 nt, Human adenovirus A
acuauugacuuaauga

SEQ ID NO: 1538387 - RNA, 13 nt, Human adenovirus A
cugcaagacagaa

SEQ ID NO: 1538388 - RNA, 20 nt, Human adenovirus A
ucccgaguguuuagcccccu

SEQ ID NO: 1538389 - RNA, 14 nt, Human adenovirus A
uacaacuugcuucc

SEQ ID NO: 1538390 - RNA, 13 nt, Human adenovirus A
gcugauuaugcau

SEQ ID NO: 1538391 - RNA, 18 nt, Human adenovirus A
ugccgccacgaaugcugg

SEQ ID NO: 1538392 - RNA, 14 nt, Human adenovirus A
accauccugcuccu

SEQ ID NO: 1538393 - RNA, 21 nt, Human adenovirus A
ggaacagacaccgcccaggca

SEQ ID NO: 1538394 - RNA, 19 nt, Human adenovirus A
ggcacauugcaacgcaauc

SEQ ID NO: 1538395 - RNA, 20 nt, Human adenovirus A
agugaggacacugaaggcau

SEQ ID NO: 1538396 - RNA, 16 nt, Human adenovirus A
acuuaguuacuuugua

SEQ ID NO: 1538397 - RNA, 14 nt, Human adenovirus A
ucuucaaacaccug

SEQ ID NO: 1538398 - RNA, 23 nt, Human adenovirus A
agcaucccagcugacauacacug

SEQ ID NO: 1538399 - RNA, 13 nt, Human adenovirus A
auuaaaaugugcc

SEQ ID NO: 1538400 - RNA, 21 nt, Human adenovirus A
uaacaguaccaaugugcaggc

SEQ ID NO: 1538401 - RNA, 15 nt, Human adenovirus A
guggcuaggaaaaca

SEQ ID NO: 1538402 - RNA, 13 nt, Human adenovirus A
aaaggacuuuuuu

SEQ ID NO: 1538403 - RNA, 17 nt, Human adenovirus A
ucaauuuugcaagugua

SEQ ID NO: 1538404 - RNA, 15 nt, Human adenovirus A
agccaguacacuugg

SEQ ID NO: 1538405 - RNA, 16 nt, Human adenovirus A
aguuaaugcuggaugc

SEQ ID NO: 1538406 - RNA, 19 nt, Human adenovirus A
aauugagaugguguuauga

SEQ ID NO: 1538407 - RNA, 16 nt, Human adenovirus A
uacucaucagagggaa

SEQ ID NO: 1538408 - RNA, 21 nt, Human adenovirus A
ugcgaccgggcaccacagugg

SEQ ID NO: 1538409 - RNA, 14 nt, Human adenovirus A
auggaacaccagca

SEQ ID NO: 1538410 - RNA, 17 nt, Human adenovirus A
cuugcacaaauggaccc

SEQ ID NO: 1538411 - RNA, 15 nt, Human adenovirus A
guguaauuuuccagc

SEQ ID NO: 1538412 - RNA, 13 nt, Human adenovirus A
acuuaaaagcaag

SEQ ID NO: 1538413 - RNA, 22 nt, Human adenovirus A
accuaagacuuaccccugggcu

SEQ ID NO: 1538414 - RNA, 15 nt, Human adenovirus A
accccauuguaacug

SEQ ID NO: 1538415 - RNA, 16 nt, Human adenovirus A
uuggaaacugugcugc

SEQ ID NO: 1538416 - RNA, 23 nt, Human adenovirus A
ucuaaugcaaguuguaaggcaug

SEQ ID NO: 1538417 - RNA, 17 nt, Human adenovirus A
uacacuuaugcucccac

SEQ ID NO: 1538418 - RNA, 20 nt, Human adenovirus A
gaugcaugggcuaaaccaag

SEQ ID NO: 1538419 - RNA, 16 nt, Human adenovirus A
guacugcuuccagguu

SEQ ID NO: 1538420 - RNA, 21 nt, Human adenovirus A
gcucugauuucgauaaacaaa

SEQ ID NO: 1538421 - RNA, 12 nt, Human adenovirus A
acauuuaauaau

SEQ ID NO: 1538422 - RNA, 19 nt, Human adenovirus A
gauuacaugaagauuucug

SEQ ID NO: 1538423 - RNA, 17 nt, Human adenovirus A
aaagcuuaaccgccccc

SEQ ID NO: 1538424 - RNA, 22 nt, Human adenovirus A
cagcuuuuauaugcgcauggcu

SEQ ID NO: 1538425 - RNA, 16 nt, Human adenovirus A
acgcuaaccaggcaug

SEQ ID NO: 1538426 - RNA, 17 nt, Human adenovirus A
aguaagcgccagucgcc

SEQ ID NO: 1538427 - RNA, 16 nt, Human adenovirus A
guaaacucaugauggc

SEQ ID NO: 1538428 - RNA, 16 nt, Human adenovirus A
acuguccagggcuuuu

SEQ ID NO: 1538429 - RNA, 18 nt, Human adenovirus A
acgaugacgaagaccagu

SEQ ID NO: 1538430 - RNA, 20 nt, Human adenovirus A
cgguggaacugcagacagug

SEQ ID NO: 1538431 - RNA, 17 nt, Human adenovirus A
ccuaauacaaaugcuua

SEQ ID NO: 1538432 - RNA, 16 nt, Human adenovirus A
uacuaacaccaaacuc

SEQ ID NO: 1538433 - RNA, 14 nt, Human adenovirus A
uuuacucacuggcc

SEQ ID NO: 1538434 - RNA, 19 nt, Human adenovirus A
ugacuucccaaauuuucca

SEQ ID NO: 1538435 - RNA, 17 nt, Human adenovirus A
gccuucauuccuucaga

SEQ ID NO: 1538436 - RNA, 21 nt, Human adenovirus A
uccucuguaguuucuuuacaa

SEQ ID NO: 1538437 - RNA, 22 nt, Human adenovirus A
ugaacuauuaagugaaagucaa

SEQ ID NO: 1538438 - RNA, 17 nt, Human adenovirus A
ggcgcccuccaccgcca

SEQ ID NO: 1538439 - RNA, 18 nt, Human adenovirus A
gcggcgagaaugggagga

SEQ ID NO: 1538440 - RNA, 15 nt, Human adenovirus A
ugcgaacaacaacaa

SEQ ID NO: 1538441 - RNA, 16 nt, Human adenovirus A
cauguauaauaaaacu

SEQ ID NO: 1538442 - RNA, 16 nt, Human adenovirus A
acuuaucagccagagc

SEQ ID NO: 1538443 - RNA, 13 nt, Human adenovirus A
gccuccuucccau

SEQ ID NO: 1538444 - RNA, 19 nt, Human adenovirus A
gccgcucugucaccuacca

SEQ ID NO: 1538445 - RNA, 20 nt, Human adenovirus A
cgagguaaugguagaggaaa

SEQ ID NO: 1538446 - RNA, 21 nt, Human adenovirus A
cuuggaagaaugggaggagga

SEQ ID NO: 1538447 - RNA, 13 nt, Human adenovirus A
aaaaaacaguuuc

SEQ ID NO: 1538448 - RNA, 22 nt, Human adenovirus A
cgauccaguaauuggcaaagua

SEQ ID NO: 1538449 - RNA, 21 nt, Human adenovirus A
augaacaaacgguuacagagg

SEQ ID NO: 1538450 - RNA, 21 nt, Human adenovirus A
aguauggugacgguucuucuc

SEQ ID NO: 1538451 - RNA, 21 nt, Human adenovirus A
cuggaagucaacuaaaaauug

SEQ ID NO: 1538452 - RNA, 13 nt, Human adenovirus A
ccuugcaggcuuc

SEQ ID NO: 1538453 - RNA, 20 nt, Human adenovirus A
cgcuuuuuugaguacucagc

SEQ ID NO: 1538454 - RNA, 20 nt, Human adenovirus A
cuuaaggcgggguauguuua

SEQ ID NO: 1538455 - RNA, 12 nt, Human adenovirus A
uucugcugucau

SEQ ID NO: 1538456 - RNA, 23 nt, Human adenovirus A
caaauccauuaauauuguguccu

SEQ ID NO: 1538457 - RNA, 14 nt, Human adenovirus A
gucaaaaaagcaaa

SEQ ID NO: 1538458 - RNA, 17 nt, Human adenovirus A
gaggaauaucaacugcu

SEQ ID NO: 1538459 - RNA, 15 nt, Human adenovirus A
acaguacaaagccag

SEQ ID NO: 1538460 - RNA, 18 nt, Human adenovirus A
auagagauaagcaggaaa

SEQ ID NO: 1538461 - RNA, 16 nt, Human adenovirus A
cuacugcgucucccca

SEQ ID NO: 1538462 - RNA, 18 nt, Human adenovirus A
gcucugucaccuaccacc

SEQ ID NO: 1538463 - RNA, 18 nt, Human adenovirus A
ucagcgccgagccacagc

SEQ ID NO: 1538464 - RNA, 19 nt, Human adenovirus A
cagccaaaacucagguagc

SEQ ID NO: 1538465 - RNA, 19 nt, Human adenovirus A
ugcguagcaguaucagugg

SEQ ID NO: 1538466 - RNA, 14 nt, Human adenovirus A
cuaaaauguauuca

SEQ ID NO: 1538467 - RNA, 20 nt, Human adenovirus A
agucgcgcacugggccagga

SEQ ID NO: 1538468 - RNA, 19 nt, Human adenovirus A
cuugggagagucaggcaga

SEQ ID NO: 1538469 - RNA, 22 nt, Human adenovirus A
aacagcgcaugcguaucucacu

SEQ ID NO: 1538470 - RNA, 16 nt, Human adenovirus A
uaccucacuuacauua

SEQ ID NO: 1538471 - RNA, 19 nt, Human adenovirus A
cugcgggaagcgggggaag

SEQ ID NO: 1538472 - RNA, 20 nt, Human adenovirus A
ccguucccugcguucacuua

SEQ ID NO: 1538473 - RNA, 17 nt, Human adenovirus A
uuuguaccgcgaagcca

SEQ ID NO: 1538474 - RNA, 13 nt, Human adenovirus A
guuuuaaauuguu

SEQ ID NO: 1538475 - RNA, 17 nt, Human adenovirus A
caacagaaaguuguaga

SEQ ID NO: 1538476 - RNA, 19 nt, Human adenovirus A
uuacccuagaccaaaugcc

SEQ ID NO: 1538477 - RNA, 13 nt, Human adenovirus A
auuuuuugggaac

SEQ ID NO: 1538478 - RNA, 16 nt, Human adenovirus A
gcggccauuggagccg

SEQ ID NO: 1538479 - RNA, 16 nt, Human adenovirus A
aaaagaaaaugaacaa

SEQ ID NO: 1538480 - RNA, 13 nt, Human adenovirus A
aagugacauugga

SEQ ID NO: 1538481 - RNA, 16 nt, Human adenovirus A
caauacugaauauuua

SEQ ID NO: 1538482 - RNA, 20 nt, Human adenovirus A
cagcuugcgggcggugcacg

SEQ ID NO: 1538483 - RNA, 23 nt, Human adenovirus A
gcuguacgcaaacucagcccaug

SEQ ID NO: 1538484 - RNA, 18 nt, Human adenovirus A
caugcgcgcggccagagc

SEQ ID NO: 1538485 - RNA, 13 nt, Human adenovirus A
cuuaguauuuguc

SEQ ID NO: 1538486 - RNA, 18 nt, Human adenovirus A
cucuaaguucuguuucau

SEQ ID NO: 1538487 - RNA, 15 nt, Human adenovirus A
ggacaccauugaaac

SEQ ID NO: 1538488 - RNA, 22 nt, Human adenovirus A
ugccuacccggcaguaaaucuu

SEQ ID NO: 1538489 - RNA, 16 nt, Human adenovirus A
ucaauaguugccacgc

SEQ ID NO: 1538490 - RNA, 15 nt, Human adenovirus A
gaauauaagaacuac

SEQ ID NO: 1538491 - RNA, 20 nt, Human adenovirus A
ugaguaaagauauucccacg

SEQ ID NO: 1538492 - RNA, 15 nt, Human adenovirus A
uaacuuuauauugca

SEQ ID NO: 1538493 - RNA, 24 nt, Human adenovirus A
uaacaacagucaguguccaucagc

SEQ ID NO: 1538494 - RNA, 20 nt, Human adenovirus A
guuuaaaucuuucugcuccc

SEQ ID NO: 1538495 - RNA, 12 nt, Human adenovirus A
gcauuaguucuu

SEQ ID NO: 1538496 - RNA, 16 nt, Human adenovirus A
aacgcaccuugcagga

SEQ ID NO: 1538497 - RNA, 18 nt, Human adenovirus A
ugcuccgacaacagcugc

SEQ ID NO: 1538498 - RNA, 18 nt, Human adenovirus A
cgcagaagcucuguucaa

SEQ ID NO: 1538499 - RNA, 16 nt, Human adenovirus A
uccaauggucuucaag

SEQ ID NO: 1538500 - RNA, 22 nt, Human adenovirus A
ucuucguggagaagcggagcca

SEQ ID NO: 1538501 - RNA, 21 nt, Human adenovirus A
caaaaacaccuuuuguuaauu

SEQ ID NO: 1538502 - RNA, 22 nt, Human adenovirus A
agcucugauuucgauaaacaaa

SEQ ID NO: 1538503 - RNA, 18 nt, Human adenovirus A
agauuauacaaacuucau

SEQ ID NO: 1538504 - RNA, 17 nt, Human adenovirus A
ggccauuuuggaagcag

SEQ ID NO: 1538505 - RNA, 11 nt, Human adenovirus A
uuucugccauu

SEQ ID NO: 1538506 - RNA, 18 nt, Human adenovirus A
aggaagcaggugaugaag

SEQ ID NO: 1538507 - RNA, 23 nt, Human adenovirus A
cccggcguaaccaaauacugcua

SEQ ID NO: 1538508 - RNA, 20 nt, Human adenovirus A
agcucaugugaaggcgccag

SEQ ID NO: 1538509 - RNA, 14 nt, Human adenovirus A
cugacauacacugu

SEQ ID NO: 1538510 - RNA, 21 nt, Human adenovirus A
cacauauucgcgugccaggca

SEQ ID NO: 1538511 - RNA, 17 nt, Human adenovirus A
uagacggcaccuuuuac

SEQ ID NO: 1538512 - RNA, 22 nt, Human adenovirus A
ucacacccuccguguucccaca

SEQ ID NO: 1538513 - RNA, 19 nt, Human adenovirus A
guaaacuuaacucaggcuu

SEQ ID NO: 1538514 - RNA, 15 nt, Human adenovirus A
acagucacaagguag

SEQ ID NO: 1538515 - RNA, 15 nt, Human adenovirus A
ugcauuaccagcagc

SEQ ID NO: 1538516 - RNA, 17 nt, Human adenovirus A
aaaaucauacaaaucag

SEQ ID NO: 1538517 - RNA, 16 nt, Human adenovirus A
uggagcuuucaacccc

SEQ ID NO: 1538518 - RNA, 22 nt, Human adenovirus A
ggaccgcagucugacagcaauu

SEQ ID NO: 1538519 - RNA, 12 nt, Human adenovirus A
cuuuggaggcag

SEQ ID NO: 1538520 - RNA, 11 nt, Human adenovirus A
ucagccagagc

SEQ ID NO: 1538521 - RNA, 14 nt, Human adenovirus A
cgcgaaacuggggg

SEQ ID NO: 1538522 - RNA, 16 nt, Human adenovirus A
auuuugcagguuuaaa

SEQ ID NO: 1538523 - RNA, 20 nt, Human adenovirus A
cccucuuggccagcugcccu

SEQ ID NO: 1538524 - RNA, 16 nt, Human adenovirus A
accuccauuauuucuu

SEQ ID NO: 1538525 - RNA, 20 nt, Human adenovirus A
cagcuacuaauuaagcgagc

SEQ ID NO: 1538526 - RNA, 13 nt, Human adenovirus A
caaauccaaaagc

SEQ ID NO: 1538527 - RNA, 20 nt, Human adenovirus A
ccgcuacaccacguaaucaa

SEQ ID NO: 1538528 - RNA, 22 nt, Human adenovirus A
guguacuugguggacaacaagu

SEQ ID NO: 1538529 - RNA, 14 nt, Human adenovirus A
uuuucaguggacaa

SEQ ID NO: 1538530 - RNA, 14 nt, Human adenovirus A
agccauggaugaau

SEQ ID NO: 1538531 - RNA, 16 nt, Human adenovirus A
gagaaggacaaaaguc

SEQ ID NO: 1538532 - RNA, 22 nt, Human adenovirus A
ugcaguuuuuuuuccacacauc

SEQ ID NO: 1538533 - RNA, 20 nt, Human adenovirus A
auuccaugagcccggggacu

SEQ ID NO: 1538534 - RNA, 18 nt, Human adenovirus A
gacagaaauacagagcug

SEQ ID NO: 1538535 - RNA, 14 nt, Human adenovirus A
uuacuaaaacagua

SEQ ID NO: 1538536 - RNA, 21 nt, Human adenovirus A
uaugcauagcuuacaaagggc

SEQ ID NO: 1538537 - RNA, 18 nt, Human adenovirus A
accucuagaaacugugcc

SEQ ID NO: 1538538 - RNA, 23 nt, Human adenovirus A
cccgcgauuaugcaguguaacca

SEQ ID NO: 1538539 - RNA, 17 nt, Human adenovirus A
guguuaaccauuguaaa

SEQ ID NO: 1538540 - RNA, 23 nt, Human adenovirus A
ucccagcuaacgccaccagcgug

SEQ ID NO: 1538541 - RNA, 19 nt, Human adenovirus A
cugagacuucccacagcca

SEQ ID NO: 1538542 - RNA, 17 nt, Human adenovirus A
gguucgacgggccaggc

SEQ ID NO: 1538543 - RNA, 23 nt, Human adenovirus A
caacuuuguccaguuuacuaaca

SEQ ID NO: 1538544 - RNA, 17 nt, Human adenovirus A
auaaacaaaagcaaagc

SEQ ID NO: 1538545 - RNA, 21 nt, Human adenovirus A
acuuuuagggaugcaaugcuu

SEQ ID NO: 1538546 - RNA, 22 nt, Human adenovirus A
uccuaggcaacguuggcagcga

SEQ ID NO: 1538547 - RNA, 19 nt, Human adenovirus A
uuaagaucuucguaggaaa

SEQ ID NO: 1538548 - RNA, 18 nt, Human adenovirus A
uauaccaugauggagugg

SEQ ID NO: 1538549 - RNA, 22 nt, Human adenovirus A
acaccaugguaaaaaggaagca

SEQ ID NO: 1538550 - RNA, 19 nt, Human adenovirus A
ccgcgcgcggacuuucaac

SEQ ID NO: 1538551 - RNA, 20 nt, Human adenovirus A
cuuccguagccuugcagcgg

SEQ ID NO: 1538552 - RNA, 20 nt, Human adenovirus A
gguggcgcuuucgggcucug

SEQ ID NO: 1538553 - RNA, 15 nt, Human adenovirus A
cgucucguacuaacc

SEQ ID NO: 1538554 - RNA, 20 nt, Human adenovirus A
gcuuccaugccuuuuuccca

SEQ ID NO: 1538555 - RNA, 17 nt, Human adenovirus A
ucaacgugucaguuucu

SEQ ID NO: 1538556 - RNA, 16 nt, Human adenovirus A
cuggcuuuuggaugga

SEQ ID NO: 1538557 - RNA, 16 nt, Human adenovirus A
cggucucgcagcucuu

SEQ ID NO: 1538558 - RNA, 11 nt, Human adenovirus A
uuaucuuggua

SEQ ID NO: 1538559 - RNA, 23 nt, Human adenovirus A
cuugcaggacgcagaagcucugu

SEQ ID NO: 1538560 - RNA, 23 nt, Human adenovirus A
cugagcccuauccgucuccagcu

SEQ ID NO: 1538561 - RNA, 18 nt, Human adenovirus A
uguacuugacucuggcga

SEQ ID NO: 1538562 - RNA, 12 nt, Human adenovirus A
gaccugcaacag

SEQ ID NO: 1538563 - RNA, 21 nt, Human adenovirus A
guaggauagcaccugccgcca

SEQ ID NO: 1538564 - RNA, 18 nt, Human adenovirus A
uccuuuuucuacaggcag

SEQ ID NO: 1538565 - RNA, 20 nt, Human adenovirus A
cuaccugcgcacgcccuucu

SEQ ID NO: 1538566 - RNA, 22 nt, Human adenovirus A
ccugacgccuucauacccaacu

SEQ ID NO: 1538567 - RNA, 19 nt, Human adenovirus A
aguacguccgauaaaaaag

SEQ ID NO: 1538568 - RNA, 14 nt, Human adenovirus A
agcccaacccauug

SEQ ID NO: 1538569 - RNA, 23 nt, Human adenovirus A
ucccacgccgcgccccacuuccu

SEQ ID NO: 1538570 - RNA, 17 nt, Human adenovirus A
ucuuucuuuagaaacuu

SEQ ID NO: 1538571 - RNA, 16 nt, Human adenovirus A
guugaacccggccaag

SEQ ID NO: 1538572 - RNA, 13 nt, Human adenovirus A
ccaaccucacugc

SEQ ID NO: 1538573 - RNA, 12 nt, Human adenovirus A
cugaagaggagg

SEQ ID NO: 1538574 - RNA, 22 nt, Human adenovirus A
caguuuuggagccaaaaaaaca

SEQ ID NO: 1538575 - RNA, 20 nt, Human adenovirus A
ucaagacguuccauggcuuc

SEQ ID NO: 1538576 - RNA, 22 nt, Human adenovirus A
gucggaaugauuaaacaacaaa

SEQ ID NO: 1538577 - RNA, 15 nt, Human adenovirus A
uaccaggaagcugag

SEQ ID NO: 1538578 - RNA, 13 nt, Human adenovirus A
cacagcuggcgca

SEQ ID NO: 1538579 - RNA, 16 nt, Human adenovirus A
cuacgagacucccccc

SEQ ID NO: 1538580 - RNA, 13 nt, Human adenovirus A
uagaaaaagcuac

SEQ ID NO: 1538581 - RNA, 17 nt, Human adenovirus A
cuaaaccaagccaugcu

SEQ ID NO: 1538582 - RNA, 19 nt, Human adenovirus A
gauaaacuggauuugcgca

SEQ ID NO: 1538583 - RNA, 17 nt, Human adenovirus A
cgggaguguacacuaau

SEQ ID NO: 1538584 - RNA, 20 nt, Human adenovirus A
gcguagccgcagcaccugga

SEQ ID NO: 1538585 - RNA, 21 nt, Human adenovirus A
gaagaccaguacgaggacuga

SEQ ID NO: 1538586 - RNA, 16 nt, Human adenovirus A
agacgagguccaucac

SEQ ID NO: 1538587 - RNA, 14 nt, Human adenovirus A
cagagcacuaaaau

SEQ ID NO: 1538588 - RNA, 16 nt, Human adenovirus A
ggaaugauuaaacaac

SEQ ID NO: 1538589 - RNA, 21 nt, Human adenovirus A
ugcaucguaaacaacagacuu

SEQ ID NO: 1538590 - RNA, 17 nt, Human adenovirus A
cuuauuuuugauucaaa

SEQ ID NO: 1538591 - RNA, 16 nt, Human adenovirus A
caauuaguaacaagaa

SEQ ID NO: 1538592 - RNA, 13 nt, Human adenovirus A
aacauuaaaagac

SEQ ID NO: 1538593 - RNA, 22 nt, Human adenovirus A
acucagcgacaaaccuuuacug

SEQ ID NO: 1538594 - RNA, 20 nt, Human adenovirus A
aaacuuaaauugagauggug

SEQ ID NO: 1538595 - RNA, 18 nt, Human adenovirus A
cuugccgaaugcgcauac

SEQ ID NO: 1538596 - RNA, 15 nt, Human adenovirus A
gcuauguacagcaau

SEQ ID NO: 1538597 - RNA, 22 nt, Human adenovirus A
uggagcggucuuaaaaauuuug

SEQ ID NO: 1538598 - RNA, 15 nt, Human adenovirus A
cagaaugaauuguau

SEQ ID NO: 1538599 - RNA, 20 nt, Human adenovirus A
agugcucuaauagaacugga

SEQ ID NO: 1538600 - RNA, 20 nt, Human adenovirus A
cuaggcaacguuggcagcga

SEQ ID NO: 1538601 - RNA, 16 nt, Human adenovirus A
ugggcaucuugcauga

SEQ ID NO: 1538602 - RNA, 12 nt, Human adenovirus A
cugcucagcugg

SEQ ID NO: 1538603 - RNA, 23 nt, Human adenovirus A
aaaagcauacuuaccaaagccau

SEQ ID NO: 1538604 - RNA, 14 nt, Human adenovirus A
ugauuuuacagaga

SEQ ID NO: 1538605 - RNA, 18 nt, Human adenovirus A
cagcuucagaugacugga

SEQ ID NO: 1538606 - RNA, 16 nt, Human adenovirus A
ugcaggaucaaaacac

SEQ ID NO: 1538607 - RNA, 20 nt, Human adenovirus A
auguucccaaauauccagga

SEQ ID NO: 1538608 - RNA, 15 nt, Human adenovirus A
agacguuuuugccca

SEQ ID NO: 1538609 - RNA, 11 nt, Human adenovirus A
cuugcuuccag

SEQ ID NO: 1538610 - RNA, 15 nt, Human adenovirus A
aucugugucuuuacc

SEQ ID NO: 1538611 - RNA, 20 nt, Human adenovirus A
cuaguuugguagcaaaagau

SEQ ID NO: 1538612 - RNA, 19 nt, Human adenovirus A
cuugagccuggauaaagcg

SEQ ID NO: 1538613 - RNA, 19 nt, Human adenovirus A
caaacgguuacagaggaac

SEQ ID NO: 1538614 - RNA, 22 nt, Human adenovirus A
cggcgaucaucgcggagagggc

SEQ ID NO: 1538615 - RNA, 17 nt, Human adenovirus A
cugcacucucuggggaa

SEQ ID NO: 1538616 - RNA, 17 nt, Human adenovirus A
aggucgaggacuuggaa

SEQ ID NO: 1538617 - RNA, 22 nt, Human adenovirus A
gcggcauuccccauccaaaacc

SEQ ID NO: 1538618 - RNA, 20 nt, Human adenovirus A
acgucaccaccucaaaaucu

SEQ ID NO: 1538619 - RNA, 16 nt, Human adenovirus A
cccagcggcaguacgu

SEQ ID NO: 1538620 - RNA, 24 nt, Human adenovirus A
gcgcggacgagcucccggaggaag

SEQ ID NO: 1538621 - RNA, 21 nt, Human adenovirus A
uuuaaucgccccgcugcaauu

SEQ ID NO: 1538622 - RNA, 21 nt, Human adenovirus A
cgaugcucgcaaguaccgcgc

SEQ ID NO: 1538623 - RNA, 23 nt, Human adenovirus A
aaguucaaagaagagcugcugca

SEQ ID NO: 1538624 - RNA, 15 nt, Human adenovirus A
uuggcagacaaggug

SEQ ID NO: 1538625 - RNA, 16 nt, Human adenovirus A
ugaaaagacugagaac

SEQ ID NO: 1538626 - RNA, 16 nt, Human adenovirus A
gcaauuagggccagca

SEQ ID NO: 1538627 - RNA, 14 nt, Human adenovirus A
gcucuagacaugac

SEQ ID NO: 1538628 - RNA, 21 nt, Human adenovirus A
gacuuauuuuugauucaaaca

SEQ ID NO: 1538629 - RNA, 14 nt, Human adenovirus A
gaauuacuaaaaca

SEQ ID NO: 1538630 - RNA, 18 nt, Human adenovirus A
caacuuuuaacauuagca

SEQ ID NO: 1538631 - RNA, 14 nt, Human adenovirus A
cuguggcaccugca

SEQ ID NO: 1538632 - RNA, 17 nt, Human adenovirus A
ccauccguggcaggcca

SEQ ID NO: 1538633 - RNA, 18 nt, Human adenovirus A
agcccccgcguccuccuu

SEQ ID NO: 1538634 - RNA, 18 nt, Human adenovirus A
aaaugccuguuuuguauu

SEQ ID NO: 1538635 - RNA, 23 nt, Human adenovirus A
gcugcaauuucuuucauuaggcu

SEQ ID NO: 1538636 - RNA, 19 nt, Human adenovirus A
ugagucgcuguugggacag

SEQ ID NO: 1538637 - RNA, 13 nt, Human adenovirus A
cagguggcagcga

SEQ ID NO: 1538638 - RNA, 20 nt, Human adenovirus A
auauuugcugaaaaaagucu

SEQ ID NO: 1538639 - RNA, 23 nt, Human adenovirus A
acauaggcuggguuuauggaauu

SEQ ID NO: 1538640 - RNA, 18 nt, Human adenovirus A
augcgcauacccauucca

SEQ ID NO: 1538641 - RNA, 13 nt, Human adenovirus A
gcauuaggccauc

SEQ ID NO: 1538642 - RNA, 13 nt, Human adenovirus A
cacugggccagga

SEQ ID NO: 1538643 - RNA, 19 nt, Human adenovirus A
ggcgcgcgaguuaagaaaa

SEQ ID NO: 1538644 - RNA, 17 nt, Human adenovirus A
cuuuaggcauuaaaugg

SEQ ID NO: 1538645 - RNA, 21 nt, Human adenovirus A
cugagucccggucuggugcaa

SEQ ID NO: 1538646 - RNA, 20 nt, Human adenovirus A
cauugugcuaaauguaacug

SEQ ID NO: 1538647 - RNA, 14 nt, Human adenovirus A
cuggcaaacuggga

SEQ ID NO: 1538648 - RNA, 14 nt, Human adenovirus A
cuucuacuuuagaa

SEQ ID NO: 1538649 - RNA, 20 nt, Human adenovirus A
accuaucccaugaccaagcc

SEQ ID NO: 1538650 - RNA, 14 nt, Human adenovirus A
caaauuacacacua

SEQ ID NO: 1538651 - RNA, 22 nt, Human adenovirus A
gaaaaacaguacaaagccaggc

SEQ ID NO: 1538652 - RNA, 14 nt, Human adenovirus A
aagcagccauaaug

SEQ ID NO: 1538653 - RNA, 19 nt, Human adenovirus A
cggcguaguaugcgcagac

SEQ ID NO: 1538654 - RNA, 13 nt, Human adenovirus A
uacagauuuaagg

SEQ ID NO: 1538655 - RNA, 13 nt, Human adenovirus A
ccagacaguuuca

SEQ ID NO: 1538656 - RNA, 17 nt, Human adenovirus A
caaaauaaacaucucau

SEQ ID NO: 1538657 - RNA, 19 nt, Human adenovirus A
gcgugccguuggcagaguc

SEQ ID NO: 1538658 - RNA, 20 nt, Human adenovirus A
uuagucgcgcacugggccag

SEQ ID NO: 1538659 - RNA, 13 nt, Human adenovirus A
ggcugacagagcg

SEQ ID NO: 1538660 - RNA, 16 nt, Human adenovirus A
ucaacagaaaguugua

SEQ ID NO: 1538661 - RNA, 14 nt, Human adenovirus A
ugcauagcuuacaa

SEQ ID NO: 1538662 - RNA, 16 nt, Human adenovirus A
cuuuaccaacaccaac

SEQ ID NO: 1538663 - RNA, 19 nt, Human adenovirus A
acugaccaggucagcucag

SEQ ID NO: 1538664 - RNA, 13 nt, Human adenovirus A
uucuaccuccauu

SEQ ID NO: 1538665 - RNA, 20 nt, Human adenovirus A
guucacuuacccgcagcugu

SEQ ID NO: 1538666 - RNA, 23 nt, Human adenovirus A
acacgggcuggggacugggugcc

SEQ ID NO: 1538667 - RNA, 20 nt, Human adenovirus A
cuuggaauaaaauuucuaga

SEQ ID NO: 1538668 - RNA, 17 nt, Human adenovirus A
ccgcggcgucagcagac

SEQ ID NO: 1538669 - RNA, 21 nt, Human adenovirus A
gcagcugauuucagcuucuac

SEQ ID NO: 1538670 - RNA, 17 nt, Human adenovirus A
aaaaugaugacuucaac

SEQ ID NO: 1538671 - RNA, 15 nt, Human adenovirus A
acuuuaugagucaaa

SEQ ID NO: 1538672 - RNA, 19 nt, Human adenovirus A
aguuugacaccagaaacuu

SEQ ID NO: 1538673 - RNA, 21 nt, Human adenovirus A
gugacaaugcccgccuggcag

SEQ ID NO: 1538674 - RNA, 19 nt, Human adenovirus A
cagagggaaagguauucag

SEQ ID NO: 1538675 - RNA, 20 nt, Human adenovirus A
cuaagggacaaguuaaaaga

SEQ ID NO: 1538676 - RNA, 17 nt, Human adenovirus A
ccagagcaccccuuccc

SEQ ID NO: 1538677 - RNA, 16 nt, Human adenovirus A
caggcauggccaucau

SEQ ID NO: 1538678 - RNA, 23 nt, Human adenovirus A
guacaaggcauuggaaagcagcu

SEQ ID NO: 1538679 - RNA, 17 nt, Human adenovirus A
cuauucggaaaccauga

SEQ ID NO: 1538680 - RNA, 14 nt, Human adenovirus A
aggcuuucuucaaa

SEQ ID NO: 1538681 - RNA, 18 nt, Human adenovirus A
caucaugaaaacagcagc

SEQ ID NO: 1538682 - RNA, 20 nt, Human adenovirus A
agggugccacccccagugcc

SEQ ID NO: 1538683 - RNA, 15 nt, Human adenovirus A
gcugcaggccuuagc

SEQ ID NO: 1538684 - RNA, 16 nt, Human adenovirus A
acauugcauucagaga

SEQ ID NO: 1538685 - RNA, 18 nt, Human adenovirus A
guguucccacaguaggaa

SEQ ID NO: 1538686 - RNA, 18 nt, Human adenovirus A
uaccgugggacaacuuuu

SEQ ID NO: 1538687 - RNA, 23 nt, Human adenovirus A
agucagcugcaaaccgcgcuuuu

SEQ ID NO: 1538688 - RNA, 20 nt, Human adenovirus A
auggaaagccgguuguaagc

SEQ ID NO: 1538689 - RNA, 17 nt, Human adenovirus A
cccgccauuggcgcuac

SEQ ID NO: 1538690 - RNA, 11 nt, Human adenovirus A
ugaacacacug

SEQ ID NO: 1538691 - RNA, 21 nt, Human adenovirus A
cuggggugccuaauuguaugc

SEQ ID NO: 1538692 - RNA, 15 nt, Human adenovirus A
ugaauacuuaaauga

SEQ ID NO: 1538693 - RNA, 23 nt, Human adenovirus A
agcugcagagcuagcugacauaa

SEQ ID NO: 1538694 - RNA, 21 nt, Human adenovirus A
auguaugcccagcaugaccaa

SEQ ID NO: 1538695 - RNA, 16 nt, Human adenovirus A
gguagacgaacaaacu

SEQ ID NO: 1538696 - RNA, 22 nt, Human adenovirus A
cugaugcuuuucgccagcagcc

SEQ ID NO: 1538697 - RNA, 17 nt, Human adenovirus A
gugaauggaacaccagc

SEQ ID NO: 1538698 - RNA, 15 nt, Human adenovirus A
guggcaacguguucu

SEQ ID NO: 1538699 - RNA, 20 nt, Human adenovirus A
accaccaaauuuaaggccag

SEQ ID NO: 1538700 - RNA, 20 nt, Human adenovirus A
ugugcuauuaaagcuuuugc

SEQ ID NO: 1538701 - RNA, 22 nt, Human adenovirus A
ggcagcaaugcuuggaagaaaa

SEQ ID NO: 1538702 - RNA, 22 nt, Human adenovirus A
uacgcaaacucagcccaugcuc

SEQ ID NO: 1538703 - RNA, 17 nt, Human adenovirus A
ucaccuuugugugcuac

SEQ ID NO: 1538704 - RNA, 14 nt, Human adenovirus A
acgacuaaaacaaa

SEQ ID NO: 1538705 - RNA, 13 nt, Human adenovirus A
aacaguuucugga

SEQ ID NO: 1538706 - RNA, 17 nt, Human adenovirus A
agucgcaauuagggcca

SEQ ID NO: 1538707 - RNA, 21 nt, Human adenovirus A
agcaaaugcauuaucaugaaa

SEQ ID NO: 1538708 - RNA, 12 nt, Human adenovirus A
aguaaaaaaagc

SEQ ID NO: 1538709 - RNA, 22 nt, Human adenovirus A
cauuggucaagcgcagguagac

SEQ ID NO: 1538710 - RNA, 19 nt, Human adenovirus A
agguaauuuucauucuucc

SEQ ID NO: 1538711 - RNA, 14 nt, Human adenovirus A
accagaaaaacagu

SEQ ID NO: 1538712 - RNA, 16 nt, Human adenovirus A
auaagcauuagagucg

SEQ ID NO: 1538713 - RNA, 12 nt, Human adenovirus A
auugggaguuca

SEQ ID NO: 1538714 - RNA, 15 nt, Human adenovirus A
auuucacaagacaca

SEQ ID NO: 1538715 - RNA, 15 nt, Human adenovirus A
auguggagcuuucaa

SEQ ID NO: 1538716 - RNA, 19 nt, Human adenovirus A
agugaauggaacaccagca

SEQ ID NO: 1538717 - RNA, 19 nt, Human adenovirus A
cggcgagaaugggaggaaa

SEQ ID NO: 1538718 - RNA, 13 nt, Human adenovirus A
aaacucuaacugc

SEQ ID NO: 1538719 - RNA, 15 nt, Human adenovirus A
gccauguugugcaua

SEQ ID NO: 1538720 - RNA, 12 nt, Human adenovirus A
aaaugaccccau

SEQ ID NO: 1538721 - RNA, 14 nt, Human adenovirus A
ccagaagcacuggc

SEQ ID NO: 1538722 - RNA, 22 nt, Human adenovirus A
acguccaggcaggguuugcaaa

SEQ ID NO: 1538723 - RNA, 20 nt, Human adenovirus A
auuccuuuggacgagggaaa

SEQ ID NO: 1538724 - RNA, 13 nt, Human adenovirus A
cagcauggagugc

SEQ ID NO: 1538725 - RNA, 15 nt, Human adenovirus A
ucaacgugucaguuu

SEQ ID NO: 1538726 - RNA, 19 nt, Human adenovirus A
gaugcuaagggacaaguua

SEQ ID NO: 1538727 - RNA, 14 nt, Human adenovirus A
caaauccaaaagca

SEQ ID NO: 1538728 - RNA, 17 nt, Human adenovirus A
gcaauaaaauaggggua

SEQ ID NO: 1538729 - RNA, 12 nt, Human adenovirus A
aaacaugcugua

SEQ ID NO: 1538730 - RNA, 19 nt, Human adenovirus A
acgaccgccuuuucuagaa

SEQ ID NO: 1538731 - RNA, 15 nt, Human adenovirus A
cuguuagacagagca

SEQ ID NO: 1538732 - RNA, 13 nt, Human adenovirus A
uuauucccgcagc

SEQ ID NO: 1538733 - RNA, 21 nt, Human adenovirus A
uacgagacuccccccgaggaa

SEQ ID NO: 1538734 - RNA, 19 nt, Human adenovirus A
ugccgacguugcaagagga

SEQ ID NO: 1538735 - RNA, 16 nt, Human adenovirus A
acaguaaccauuacuu

SEQ ID NO: 1538736 - RNA, 17 nt, Human adenovirus A
guuaucuugguaggcaa

SEQ ID NO: 1538737 - RNA, 18 nt, Human adenovirus A
uguccccgaaagccgcaa

SEQ ID NO: 1538738 - RNA, 19 nt, Human adenovirus A
gaacacgguacuuuuccuu

SEQ ID NO: 1538739 - RNA, 22 nt, Human adenovirus A
acuguagacgauguuauugacu

SEQ ID NO: 1538740 - RNA, 18 nt, Human adenovirus A
agacuugcaaacagcaaa

SEQ ID NO: 1538741 - RNA, 16 nt, Human adenovirus A
cauggcugaagaggag

SEQ ID NO: 1538742 - RNA, 21 nt, Human adenovirus A
gggcagccaggcgggcugcaa

SEQ ID NO: 1538743 - RNA, 12 nt, Human adenovirus A
gaaugcucugga

SEQ ID NO: 1538744 - RNA, 10 nt, Human adenovirus A
augguuuaac

SEQ ID NO: 1538745 - RNA, 20 nt, Human adenovirus A
acguacuagagcacaugaag

SEQ ID NO: 1538746 - RNA, 13 nt, Human adenovirus A
aaucggcggcgcg

SEQ ID NO: 1538747 - RNA, 14 nt, Human adenovirus A
gaaagaucacagcc

SEQ ID NO: 1538748 - RNA, 13 nt, Human adenovirus A
agacaguuucauc

SEQ ID NO: 1538749 - RNA, 22 nt, Human adenovirus A
gcgcgcccggcucccacgccgc

SEQ ID NO: 1538750 - RNA, 19 nt, Human adenovirus A
cccauaacaucaggagcag

SEQ ID NO: 1538751 - RNA, 13 nt, Human adenovirus A
cgcgcgcauugcg

SEQ ID NO: 1538752 - RNA, 21 nt, Human adenovirus A
caagcuuucauugguccaggc

SEQ ID NO: 1538753 - RNA, 19 nt, Human adenovirus A
acgcaagcgugcaaacaga

SEQ ID NO: 1538754 - RNA, 21 nt, Human adenovirus A
cauguaaaaugggaaaugagg

SEQ ID NO: 1538755 - RNA, 22 nt, Human adenovirus A
acaaaugcgaccucagcccagg

SEQ ID NO: 1538756 - RNA, 13 nt, Human adenovirus A
augccggcagcgg

SEQ ID NO: 1538757 - RNA, 13 nt, Human adenovirus A
caguaacaaacug

SEQ ID NO: 1538758 - RNA, 22 nt, Human adenovirus A
accgcgagcgcauagaaaaagc

SEQ ID NO: 1538759 - RNA, 21 nt, Human adenovirus A
ucagugaaacgcccuagaugu

SEQ ID NO: 1538760 - RNA, 20 nt, Human adenovirus A
gcacaggcggguaagagcag

SEQ ID NO: 1538761 - RNA, 18 nt, Human adenovirus A
uccucuucugcugcauug

SEQ ID NO: 1538762 - RNA, 22 nt, Human adenovirus A
ucgacagugagccguccagcag

SEQ ID NO: 1538763 - RNA, 13 nt, Human adenovirus A
aaagagccacagc

SEQ ID NO: 1538764 - RNA, 22 nt, Human adenovirus A
gcaguaaaucuuccgccaaagg

SEQ ID NO: 1538765 - RNA, 21 nt, Human adenovirus A
cuggcaggggaagguguugag

SEQ ID NO: 1538766 - RNA, 15 nt, Human adenovirus A
agccugaaaaauaaa

SEQ ID NO: 1538767 - RNA, 21 nt, Human adenovirus A
cuuuguagaagcuuauguaca

SEQ ID NO: 1538768 - RNA, 21 nt, Human adenovirus A
ccacuaaagaccgaugcguua

SEQ ID NO: 1538769 - RNA, 16 nt, Human adenovirus A
gggauuaguucugcac

SEQ ID NO: 1538770 - RNA, 21 nt, Human adenovirus A
uugggcgcccacucuccugag

SEQ ID NO: 1538771 - RNA, 17 nt, Human adenovirus A
ggcguacagccuggagc

SEQ ID NO: 1538772 - RNA, 14 nt, Human adenovirus A
uguggaaagcauuu

SEQ ID NO: 1538773 - RNA, 20 nt, Human adenovirus A
gggcauacgcuugugcagcc

SEQ ID NO: 1538774 - RNA, 14 nt, Human adenovirus A
uguaaggaacgagg

SEQ ID NO: 1538775 - RNA, 14 nt, Human adenovirus A
aguauuugucuccu

SEQ ID NO: 1538776 - RNA, 22 nt, Human adenovirus A
uaaauauaucuuuuaacaacaa

SEQ ID NO: 1538777 - RNA, 22 nt, Human adenovirus A
cagaugggaaaaucaauaccac

SEQ ID NO: 1538778 - RNA, 23 nt, Human adenovirus A
guuuugagcggaagccuucaaaa

SEQ ID NO: 1538779 - RNA, 22 nt, Human adenovirus A
cucuguucaauaaauacugcuc

SEQ ID NO: 1538780 - RNA, 12 nt, Human adenovirus A
cuuccuccugga

SEQ ID NO: 1538781 - RNA, 19 nt, Human adenovirus A
acuaaauaucgcagcuggu

SEQ ID NO: 1538782 - RNA, 18 nt, Human adenovirus A
cuccccacagcuggcgca

SEQ ID NO: 1538783 - RNA, 19 nt, Human adenovirus A
aaguaucugcccauuuuug

SEQ ID NO: 1538784 - RNA, 21 nt, Human adenovirus A
ggcgcuguaccgccugaagaa

SEQ ID NO: 1538785 - RNA, 22 nt, Human adenovirus A
ccgcaacagcuauugcaaaccu

SEQ ID NO: 1538786 - RNA, 21 nt, Human adenovirus A
guuaaguuugacaccagaaac

SEQ ID NO: 1538787 - RNA, 15 nt, Human adenovirus A
uuuauuugaaguuuu

SEQ ID NO: 1538788 - RNA, 22 nt, Human adenovirus A
cgccugaaauauauggcccauc

SEQ ID NO: 1538789 - RNA, 21 nt, Human adenovirus A
auuuauaguggcacaacacau

SEQ ID NO: 1538790 - RNA, 22 nt, Human adenovirus A
cuuucaaccaagcccucuccaa

SEQ ID NO: 1538791 - RNA, 16 nt, Human adenovirus A
gcugggcucgaggacc

SEQ ID NO: 1538792 - RNA, 23 nt, Human adenovirus A
caagaccaguucgcccuccuagg

SEQ ID NO: 1538793 - RNA, 13 nt, Human adenovirus A
cgcugcagcuucc

SEQ ID NO: 1538794 - RNA, 16 nt, Human adenovirus A
aauuacuaaaacagua

SEQ ID NO: 1538795 - RNA, 21 nt, Human adenovirus A
cuaccugauaacaagaacacc

SEQ ID NO: 1538796 - RNA, 20 nt, Human adenovirus A
auaauguaauugaaguaagc

SEQ ID NO: 1538797 - RNA, 13 nt, Human adenovirus A
gaaccuuugacaa

SEQ ID NO: 1538798 - RNA, 18 nt, Human adenovirus A
cguggagaagcggagcca

SEQ ID NO: 1538799 - RNA, 16 nt, Human adenovirus A
gcauucaccagccaca

SEQ ID NO: 1538800 - RNA, 21 nt, Human adenovirus A
auggcuaugauuaaugucuaa

SEQ ID NO: 1538801 - RNA, 22 nt, Human adenovirus A
cacgcaucuuguguuuaagccu

SEQ ID NO: 1538802 - RNA, 16 nt, Human adenovirus A
cucacuuugccuaccc

SEQ ID NO: 1538803 - RNA, 16 nt, Human adenovirus A
ccaccaaaugcucuuu

SEQ ID NO: 1538804 - RNA, 14 nt, Human adenovirus A
cugauuuucaucug

SEQ ID NO: 1538805 - RNA, 18 nt, Human adenovirus A
gcagugcggccuguugcc

SEQ ID NO: 1538806 - RNA, 16 nt, Human adenovirus A
cacugggccaggagga

SEQ ID NO: 1538807 - RNA, 14 nt, Human adenovirus A
acaagguggccgcc

SEQ ID NO: 1538808 - RNA, 15 nt, Human adenovirus A
cgggcagccaggcgg

SEQ ID NO: 1538809 - RNA, 17 nt, Human adenovirus A
ccaccuuggcuuucgag

SEQ ID NO: 1538810 - RNA, 17 nt, Human adenovirus A
cuacgcucguccaacca

SEQ ID NO: 1538811 - RNA, 18 nt, Human adenovirus A
acaugcuggauuacaugu

SEQ ID NO: 1538812 - RNA, 16 nt, Human adenovirus A
cgcucgucaagccuac

SEQ ID NO: 1538813 - RNA, 16 nt, Human adenovirus A
cagcccaacccuuccc

SEQ ID NO: 1538814 - RNA, 21 nt, Human adenovirus A
acgagaaaguguuaaccauug

SEQ ID NO: 1538815 - RNA, 18 nt, Human adenovirus A
cauuuacugcagccuguc

SEQ ID NO: 1538816 - RNA, 17 nt, Human adenovirus A
aguggggauugggaagg

SEQ ID NO: 1538817 - RNA, 14 nt, Human adenovirus A
agaaaucuugaagu

SEQ ID NO: 1538818 - RNA, 15 nt, Human adenovirus A
gcgcucaaaggcagg

SEQ ID NO: 1538819 - RNA, 20 nt, Human adenovirus A
aaggcgcuccauccaaaacu

SEQ ID NO: 1538820 - RNA, 14 nt, Human adenovirus A
auuucuuccuccug

SEQ ID NO: 1538821 - RNA, 18 nt, Human adenovirus A
aacccauuugcaucugca

SEQ ID NO: 1538822 - RNA, 21 nt, Human adenovirus A
guagacauagccaaucaggcu

SEQ ID NO: 1538823 - RNA, 18 nt, Human adenovirus A
uaacucuuguaaagauuu

SEQ ID NO: 1538824 - RNA, 23 nt, Human adenovirus A
agcuaugaugcgggcagccaggc

SEQ ID NO: 1538825 - RNA, 23 nt, Human adenovirus A
gaucccguagguuccguuccugu

SEQ ID NO: 1538826 - RNA, 15 nt, Human adenovirus A
ugccagaagcacugg

SEQ ID NO: 1538827 - RNA, 11 nt, Human adenovirus A
gaaacgucacc

SEQ ID NO: 1538828 - RNA, 22 nt, Human adenovirus A
caguguuagucgcgcacugggc

SEQ ID NO: 1538829 - RNA, 22 nt, Human adenovirus A
cuaagugguugggaacagacaa

SEQ ID NO: 1538830 - RNA, 18 nt, Human adenovirus A
cuggacagcggccaugga

SEQ ID NO: 1538831 - RNA, 19 nt, Human adenovirus A
agaaugggaggaaagacag

SEQ ID NO: 1538832 - RNA, 18 nt, Human adenovirus A
uaccuacuccuacaaggc

SEQ ID NO: 1538833 - RNA, 19 nt, Human adenovirus A
ugagcagaacuugggcuac

SEQ ID NO: 1538834 - RNA, 12 nt, Human adenovirus A
augcaaggcgcc

SEQ ID NO: 1538835 - RNA, 23 nt, Human adenovirus A
cuccugacccaccaccaaacugc

SEQ ID NO: 1538836 - RNA, 13 nt, Human adenovirus A
uuacauguggagc

SEQ ID NO: 1538837 - RNA, 13 nt, Human adenovirus A
agggaaauccaac

SEQ ID NO: 1538838 - RNA, 14 nt, Human adenovirus A
ccaacugguugggu

SEQ ID NO: 1538839 - RNA, 19 nt, Human adenovirus A
cgagaaaguguuaaccauu

SEQ ID NO: 1538840 - RNA, 22 nt, Human adenovirus A
cuaauugcccccuuuaccaaca

SEQ ID NO: 1538841 - RNA, 22 nt, Human adenovirus A
acuaaugguuacugaagugccu

SEQ ID NO: 1538842 - RNA, 20 nt, Human adenovirus A
caacguuaaaaauacaguca

SEQ ID NO: 1538843 - RNA, 15 nt, Human adenovirus A
uaccaacaccucaca

SEQ ID NO: 1538844 - RNA, 14 nt, Human adenovirus A
uaacauuagcaguc

SEQ ID NO: 1538845 - RNA, 22 nt, Human adenovirus A
aaaacaguuucuggagcaggug

SEQ ID NO: 1538846 - RNA, 16 nt, Human adenovirus A
auaggccaaacagcug

SEQ ID NO: 1538847 - RNA, 16 nt, Human adenovirus A
gucuuacaugcacauc

SEQ ID NO: 1538848 - RNA, 21 nt, Human adenovirus A
cuguugcgccguagugcgcua

SEQ ID NO: 1538849 - RNA, 16 nt, Human adenovirus A
ugauuuuauccuacaa

SEQ ID NO: 1538850 - RNA, 18 nt, Human adenovirus A
acacuuacccuuuuaaug

SEQ ID NO: 1538851 - RNA, 22 nt, Human adenovirus A
acacuauccugacgccuucaua

SEQ ID NO: 1538852 - RNA, 20 nt, Human adenovirus A
aggggaagguguugagcccg

SEQ ID NO: 1538853 - RNA, 13 nt, Human adenovirus A
guuacugaagugc

SEQ ID NO: 1538854 - RNA, 16 nt, Human adenovirus A
ggacgaccccgccgga

SEQ ID NO: 1538855 - RNA, 17 nt, Human adenovirus A
caacuugcuuccagaca

SEQ ID NO: 1538856 - RNA, 23 nt, Human adenovirus A
ccuucgagaacuaaacaaacugu

SEQ ID NO: 1538857 - RNA, 22 nt, Human adenovirus A
ccagauuucagcacgagagggg

SEQ ID NO: 1538858 - RNA, 12 nt, Human adenovirus A
gacgggccaggc

SEQ ID NO: 1538859 - RNA, 14 nt, Human adenovirus A
ucaugaaaacagca

SEQ ID NO: 1538860 - RNA, 15 nt, Human adenovirus A
guuguggauaccaca

SEQ ID NO: 1538861 - RNA, 15 nt, Human adenovirus A
agcgacagaguugcu

SEQ ID NO: 1538862 - RNA, 19 nt, Human adenovirus A
caacgaaggccaaaccauu

SEQ ID NO: 1538863 - RNA, 18 nt, Human adenovirus A
ccaauuucguuccagacu

SEQ ID NO: 1538864 - RNA, 14 nt, Human adenovirus A
uccuaaugcuucac

SEQ ID NO: 1538865 - RNA, 18 nt, Human adenovirus A
gcugcaaggucauuagau

SEQ ID NO: 1538866 - RNA, 12 nt, Human adenovirus A
aauaauaucaau

SEQ ID NO: 1538867 - RNA, 15 nt, Human adenovirus A
aagcgacgagcaauu

SEQ ID NO: 1538868 - RNA, 23 nt, Human adenovirus A
gagcaaaucucagaaagccaacc

SEQ ID NO: 1538869 - RNA, 23 nt, Human adenovirus A
aaaauuacaaaggcauuaagcca

SEQ ID NO: 1538870 - RNA, 19 nt, Human adenovirus A
aagacacauugacuguuuc

SEQ ID NO: 1538871 - RNA, 23 nt, Human adenovirus A
gcauuuaagcaacauuaaaauca

SEQ ID NO: 1538872 - RNA, 14 nt, Human adenovirus A
guagucggccagca

SEQ ID NO: 1538873 - RNA, 20 nt, Human adenovirus A
gauacagcgcugauuaugca

SEQ ID NO: 1538874 - RNA, 13 nt, Human adenovirus A
acgagugcuuucu

SEQ ID NO: 1538875 - RNA, 22 nt, Human adenovirus A
gagcacuaaaaucccuauggac

SEQ ID NO: 1538876 - RNA, 15 nt, Human adenovirus A
aucauaguugugguc

SEQ ID NO: 1538877 - RNA, 20 nt, Human adenovirus A
acuucacccugggaaacaag

SEQ ID NO: 1538878 - RNA, 12 nt, Human adenovirus A
agcacuggcaac

SEQ ID NO: 1538879 - RNA, 17 nt, Human adenovirus A
cagcccaacccuuccca

SEQ ID NO: 1538880 - RNA, 21 nt, Human adenovirus A
auacacuccaggaaacauaaa

SEQ ID NO: 1538881 - RNA, 12 nt, Human adenovirus A
gaugcagcgacc

SEQ ID NO: 1538882 - RNA, 23 nt, Human adenovirus A
gacaccaacgaccagucuuuuaa

SEQ ID NO: 1538883 - RNA, 17 nt, Human adenovirus A
aacaguaccaaugugca

SEQ ID NO: 1538884 - RNA, 14 nt, Human adenovirus A
cgaggucaagaaca

SEQ ID NO: 1538885 - RNA, 20 nt, Human adenovirus A
acgggaaaaaaaagaggaag

SEQ ID NO: 1538886 - RNA, 22 nt, Human adenovirus A
caagugaauggaacaccagcau

SEQ ID NO: 1538887 - RNA, 16 nt, Human adenovirus A
gaaaagugacgucaca

SEQ ID NO: 1538888 - RNA, 16 nt, Human adenovirus A
aagguacauuggcauu

SEQ ID NO: 1538889 - RNA, 15 nt, Human adenovirus A
caguacaaagccagg

SEQ ID NO: 1538890 - RNA, 16 nt, Human adenovirus A
aauuacaaaggcauua

SEQ ID NO: 1538891 - RNA, 20 nt, Human adenovirus A
cagcguuggcguuccgucaa

SEQ ID NO: 1538892 - RNA, 18 nt, Human adenovirus A
gacuccauaaggcggcgu

SEQ ID NO: 1538893 - RNA, 18 nt, Human adenovirus A
uuuaauccuaggcaaaga

SEQ ID NO: 1538894 - RNA, 17 nt, Human adenovirus A
uaaaggucgcacugagc

SEQ ID NO: 1538895 - RNA, 20 nt, Human adenovirus A
auuaaacaacaaaacacuga

SEQ ID NO: 1538896 - RNA, 14 nt, Human adenovirus A
caagcuucccaacu

SEQ ID NO: 1538897 - RNA, 15 nt, Human adenovirus A
uuucaaacguccagg

SEQ ID NO: 1538898 - RNA, 21 nt, Human adenovirus A
gaaagcuuagccuuaauaacc

SEQ ID NO: 1538899 - RNA, 12 nt, Human adenovirus A
gcuuaucaugug

SEQ ID NO: 1538900 - RNA, 12 nt, Human adenovirus A
guaacuuucaaa

SEQ ID NO: 1538901 - RNA, 23 nt, Human adenovirus A
acacuauacgcgugguuaaacug

SEQ ID NO: 1538902 - RNA, 16 nt, Human adenovirus A
auucuagcaaaaugaa

SEQ ID NO: 1538903 - RNA, 20 nt, Human adenovirus A
ggcggcuccgaacaggugua

SEQ ID NO: 1538904 - RNA, 23 nt, Human adenovirus A
agaaucggcaacagcagcaacaa

SEQ ID NO: 1538905 - RNA, 13 nt, Human adenovirus A
gaagagcugcugc

SEQ ID NO: 1538906 - RNA, 16 nt, Human adenovirus A
cguguacacaaugcau

SEQ ID NO: 1538907 - RNA, 23 nt, Human adenovirus A
ugaauguguuccaguauuuugua

SEQ ID NO: 1538908 - RNA, 16 nt, Human adenovirus A
cuagcguacagccaga

SEQ ID NO: 1538909 - RNA, 21 nt, Human adenovirus A
guggaaagcaucacacagaaa

SEQ ID NO: 1538910 - RNA, 16 nt, Human adenovirus A
ugcuccuuuucuuaca

SEQ ID NO: 1538911 - RNA, 17 nt, Human adenovirus A
auuguagccugcuuuca

SEQ ID NO: 1538912 - RNA, 14 nt, Human adenovirus A
ggaggaagcugagg

SEQ ID NO: 1538913 - RNA, 19 nt, Human adenovirus A
agcgacacuaucaccgccg

SEQ ID NO: 1538914 - RNA, 23 nt, Human adenovirus A
acgaggcggugagcauccaaaug

SEQ ID NO: 1538915 - RNA, 22 nt, Human adenovirus A
cauacacucauguauuuuuuca

SEQ ID NO: 1538916 - RNA, 14 nt, Human adenovirus A
agaaacugugcccg

SEQ ID NO: 1538917 - RNA, 22 nt, Human adenovirus A
cuuccuucagauuuugugccua

SEQ ID NO: 1538918 - RNA, 15 nt, Human adenovirus A
acacugaaggcauuu

SEQ ID NO: 1538919 - RNA, 22 nt, Human adenovirus A
gccacaccuccacccaaucaaa

SEQ ID NO: 1538920 - RNA, 16 nt, Human adenovirus A
gugaauguguuccagu

SEQ ID NO: 1538921 - RNA, 22 nt, Human adenovirus A
acucuacuaacaacuccagaug

SEQ ID NO: 1538922 - RNA, 18 nt, Human adenovirus A
agacguaaaccuugaaau

SEQ ID NO: 1538923 - RNA, 18 nt, Human adenovirus A
uuggguccuacggaggga

SEQ ID NO: 1538924 - RNA, 22 nt, Human adenovirus A
augaaacccgcugugagcaaau

SEQ ID NO: 1538925 - RNA, 18 nt, Human adenovirus A
gcagcaaaugcccugcaa

SEQ ID NO: 1538926 - RNA, 15 nt, Human adenovirus A
ucuccaaaucuuaaa

SEQ ID NO: 1538927 - RNA, 14 nt, Human adenovirus A
uaaaacugauuuac

SEQ ID NO: 1538928 - RNA, 12 nt, Human adenovirus A
ugcagcagaauu

SEQ ID NO: 1538929 - RNA, 15 nt, Human adenovirus A
ugauaucuugaaucu

SEQ ID NO: 1538930 - RNA, 17 nt, Human adenovirus A
aggaaaacaaacaacga

SEQ ID NO: 1538931 - RNA, 10 nt, Human adenovirus A
cuuacaguau

SEQ ID NO: 1538932 - RNA, 17 nt, Human adenovirus A
ucuucugacauugcuuc

SEQ ID NO: 1538933 - RNA, 15 nt, Human adenovirus A
uccaauggucuucaa

SEQ ID NO: 1538934 - RNA, 16 nt, Human adenovirus A
aggcaaguuguggaua

SEQ ID NO: 1538935 - RNA, 21 nt, Human adenovirus A
gcggccauuggagccguuccc

SEQ ID NO: 1538936 - RNA, 13 nt, Human adenovirus A
uuaaaguaaauua

SEQ ID NO: 1538937 - RNA, 17 nt, Human adenovirus A
aagggugguugcaaagu

SEQ ID NO: 1538938 - RNA, 21 nt, Human adenovirus A
cuccaggggaaacccauuugc

SEQ ID NO: 1538939 - RNA, 18 nt, Human adenovirus A
ucaggaagauuauacaaa

SEQ ID NO: 1538940 - RNA, 13 nt, Human adenovirus A
caguaaucuuuuu

SEQ ID NO: 1538941 - RNA, 15 nt, Human adenovirus A
uccaaauggacgagg

SEQ ID NO: 1538942 - RNA, 19 nt, Human adenovirus A
ugaguaggcaaguugugga

SEQ ID NO: 1538943 - RNA, 11 nt, Human adenovirus A
aguuggaaacu

SEQ ID NO: 1538944 - RNA, 14 nt, Human adenovirus A
aaggggaggacccc

SEQ ID NO: 1538945 - RNA, 19 nt, Human adenovirus A
ggccaaacagcuguggaaa

SEQ ID NO: 1538946 - RNA, 17 nt, Human adenovirus A
uuuacuaaaaugcaaaa

SEQ ID NO: 1538947 - RNA, 20 nt, Human adenovirus A
uugaauaguucaucuuagua

SEQ ID NO: 1538948 - RNA, 15 nt, Human adenovirus A
cugucacuuugcaac

SEQ ID NO: 1538949 - RNA, 17 nt, Human adenovirus A
aaggauugguuccuaau

SEQ ID NO: 1538950 - RNA, 20 nt, Human adenovirus A
caccuuuuaccuaaaccaca

SEQ ID NO: 1538951 - RNA, 21 nt, Human adenovirus A
cauggcuuccaugccuuuuuc

SEQ ID NO: 1538952 - RNA, 18 nt, Human adenovirus A
gcuuggaagaaaaaaacc

SEQ ID NO: 1538953 - RNA, 12 nt, Human adenovirus A
uacuuguuguau

SEQ ID NO: 1538954 - RNA, 18 nt, Human adenovirus A
cauaguuucgguuacugc

SEQ ID NO: 1538955 - RNA, 13 nt, Human adenovirus A
acggcggcgcaua

SEQ ID NO: 1538956 - RNA, 12 nt, Human adenovirus A
acccuucccaac

SEQ ID NO: 1538957 - RNA, 16 nt, Human adenovirus A
ucgcagcgcacuggca

SEQ ID NO: 1538958 - RNA, 15 nt, Human adenovirus A
cggcgaacgggcagc

SEQ ID NO: 1538959 - RNA, 13 nt, Human adenovirus A
uuuauccuacaaa

SEQ ID NO: 1538960 - RNA, 16 nt, Human adenovirus A
acuggacagcggccau

SEQ ID NO: 1538961 - RNA, 10 nt, Human adenovirus A
guaaauuaaa

SEQ ID NO: 1538962 - RNA, 12 nt, Human adenovirus A
cuaaaaugcaaa

SEQ ID NO: 1538963 - RNA, 16 nt, Human adenovirus A
gcagagucuauugcgu

SEQ ID NO: 1538964 - RNA, 20 nt, Human adenovirus A
uacacuggcuggcuuuugga

SEQ ID NO: 1538965 - RNA, 20 nt, Human adenovirus A
aggucgaggacuuggaagaa

SEQ ID NO: 1538966 - RNA, 12 nt, Human adenovirus A
gaacacacugau

SEQ ID NO: 1538967 - RNA, 18 nt, Human adenovirus A
acccuauuuuuugggaac

SEQ ID NO: 1538968 - RNA, 14 nt, Human adenovirus A
acguaacuuucaaa

SEQ ID NO: 1538969 - RNA, 19 nt, Human adenovirus A
gauggaucuggagccacag

SEQ ID NO: 1538970 - RNA, 22 nt, Human adenovirus A
uggggugcugcccuuccuaauu

SEQ ID NO: 1538971 - RNA, 14 nt, Human adenovirus A
agggguacuggauc

SEQ ID NO: 1538972 - RNA, 12 nt, Human adenovirus A
gcucagcuggaa

SEQ ID NO: 1538973 - RNA, 22 nt, Human adenovirus A
aaacauucgcagcgcacuggca

SEQ ID NO: 1538974 - RNA, 15 nt, Human adenovirus A
agucugacagcaauu

SEQ ID NO: 1538975 - RNA, 20 nt, Human adenovirus A
cuucaaaguaccuuacaaac

SEQ ID NO: 1538976 - RNA, 16 nt, Human adenovirus A
uuugaguacucagccg

SEQ ID NO: 1538977 - RNA, 13 nt, Human adenovirus A
auaugggcgcaga

SEQ ID NO: 1538978 - RNA, 21 nt, Human adenovirus A
cuuacgaaaccgugauggcag

SEQ ID NO: 1538979 - RNA, 19 nt, Human adenovirus A
ggaacucgagugcaugcau

SEQ ID NO: 1538980 - RNA, 14 nt, Human adenovirus A
cagagcgcggcugc

SEQ ID NO: 1538981 - RNA, 16 nt, Human adenovirus A
uacugucccccaccag

SEQ ID NO: 1538982 - RNA, 22 nt, Human adenovirus A
agauaaguuuaaaggcauuaug

SEQ ID NO: 1538983 - RNA, 19 nt, Human adenovirus A
uucagcagagucgagguca

SEQ ID NO: 1538984 - RNA, 21 nt, Human adenovirus A
acagcaacuuuuuaaccacug

SEQ ID NO: 1538985 - RNA, 13 nt, Human adenovirus A
caaucucaguguc

SEQ ID NO: 1538986 - RNA, 19 nt, Human adenovirus A
auuuuuugggaaccuuuga

SEQ ID NO: 1538987 - RNA, 16 nt, Human adenovirus A
acguugcaagaggaga

SEQ ID NO: 1538988 - RNA, 17 nt, Human adenovirus A
ugcaucauuacuucaaa

SEQ ID NO: 1538989 - RNA, 13 nt, Human adenovirus A
acugaucggccgu

SEQ ID NO: 1538990 - RNA, 17 nt, Human adenovirus A
acuggacagcggccaug

SEQ ID NO: 1538991 - RNA, 13 nt, Human adenovirus A
uggcuuuuggaug

SEQ ID NO: 1538992 - RNA, 15 nt, Human adenovirus A
uaccgccugaagaag

SEQ ID NO: 1538993 - RNA, 17 nt, Human adenovirus A
gacaugguaagcucuug

SEQ ID NO: 1538994 - RNA, 22 nt, Human adenovirus A
ugaguuaucuugguaggcaauu

SEQ ID NO: 1538995 - RNA, 19 nt, Human adenovirus A
aaccacggccucagcagcg

SEQ ID NO: 1538996 - RNA, 21 nt, Human adenovirus A
ccacuugguguuucaggaaaa

SEQ ID NO: 1538997 - RNA, 16 nt, Human adenovirus A
auuuugccagcucuug

SEQ ID NO: 1538998 - RNA, 22 nt, Human adenovirus A
gcgugaaguauuccaugagccc

SEQ ID NO: 1538999 - RNA, 18 nt, Human adenovirus A
ccaaauuuaaggccaggg

SEQ ID NO: 1539000 - RNA, 17 nt, Human adenovirus A
cgcgcacugggccagga

SEQ ID NO: 1539001 - RNA, 13 nt, Human adenovirus A
cucccacccauga

SEQ ID NO: 1539002 - RNA, 18 nt, Human adenovirus A
gagaucuaggcuguggac

SEQ ID NO: 1539003 - RNA, 12 nt, Human adenovirus A
cccgccuggcag

SEQ ID NO: 1539004 - RNA, 20 nt, Human adenovirus A
aucuacagcgacaaagcacu

SEQ ID NO: 1539005 - RNA, 13 nt, Human adenovirus A
auugcgcaggggu

SEQ ID NO: 1539006 - RNA, 14 nt, Human adenovirus A
aaccaaauacugcu

SEQ ID NO: 1539007 - RNA, 15 nt, Human adenovirus A
uucgacgggccaggc

SEQ ID NO: 1539008 - RNA, 17 nt, Human adenovirus A
gagggucaggaaaccca

SEQ ID NO: 1539009 - RNA, 15 nt, Human adenovirus A
cauucuugagccugg

SEQ ID NO: 1539010 - RNA, 17 nt, Human adenovirus A
ucgcuaugaaucuuuac

SEQ ID NO: 1539011 - RNA, 15 nt, Human adenovirus A
aagguuuaauguuua

SEQ ID NO: 1539012 - RNA, 12 nt, Human adenovirus A
gcccagcuguuc

SEQ ID NO: 1539013 - RNA, 12 nt, Human adenovirus A
ggaggcagcugg

SEQ ID NO: 1539014 - RNA, 20 nt, Human adenovirus A
cuccaaccaugaaaacagca

SEQ ID NO: 1539015 - RNA, 16 nt, Human adenovirus A
agcugugaaaaugcgu

SEQ ID NO: 1539016 - RNA, 13 nt, Human adenovirus A
cuguuuacuucaa

SEQ ID NO: 1539017 - RNA, 23 nt, Human adenovirus A
cagagcguugguucgacgggcca

SEQ ID NO: 1539018 - RNA, 15 nt, Human adenovirus A
uuaucuucaaaucau

SEQ ID NO: 1539019 - RNA, 13 nt, Human adenovirus A
uaaguuuaaaggc

SEQ ID NO: 1539020 - RNA, 19 nt, Human adenovirus A
ugaauaagccaccgcucau

SEQ ID NO: 1539021 - RNA, 12 nt, Human adenovirus A
agccgucaaaau

SEQ ID NO: 1539022 - RNA, 17 nt, Human adenovirus A
acuagaguguauggaaa

SEQ ID NO: 1539023 - RNA, 18 nt, Human adenovirus A
uacuaaagaaacaaacua

SEQ ID NO: 1539024 - RNA, 14 nt, Human adenovirus A
agauuguaauuuuu

SEQ ID NO: 1539025 - RNA, 18 nt, Human adenovirus A
gaaaacaauguucccaaa

SEQ ID NO: 1539026 - RNA, 15 nt, Human adenovirus A
ugguggguuuggaug

SEQ ID NO: 1539027 - RNA, 20 nt, Human adenovirus A
uagaaucggcaacagcagca

SEQ ID NO: 1539028 - RNA, 23 nt, Human adenovirus A
uuuaaaggaagcugcuguucuua

SEQ ID NO: 1539029 - RNA, 19 nt, Human adenovirus A
aggcgcuccauccaaaacu

SEQ ID NO: 1539030 - RNA, 21 nt, Human adenovirus A
guaacuuucaaaaaagcuuua

SEQ ID NO: 1539031 - RNA, 14 nt, Human adenovirus A
agacuucccacagc

SEQ ID NO: 1539032 - RNA, 15 nt, Human adenovirus A
ugauucuucagagca

SEQ ID NO: 1539033 - RNA, 20 nt, Human adenovirus A
caccaaauuuaaggccaggg

SEQ ID NO: 1539034 - RNA, 20 nt, Human adenovirus A
gcgugaaguauuccaugagc

SEQ ID NO: 1539035 - RNA, 13 nt, Human adenovirus A
ccaacccuuccca

SEQ ID NO: 1539036 - RNA, 22 nt, Human adenovirus A
gccacacuuaacuuuuuacuaa

SEQ ID NO: 1539037 - RNA, 14 nt, Human adenovirus A
cuuucucugugaca

SEQ ID NO: 1539038 - RNA, 13 nt, Human adenovirus A
ugaacaaaaucac

SEQ ID NO: 1539039 - RNA, 15 nt, Human adenovirus A
acccucgccuuugga

SEQ ID NO: 1539040 - RNA, 15 nt, Human adenovirus A
acgggcgugugacug

SEQ ID NO: 1539041 - RNA, 16 nt, Human adenovirus A
cgacauuuagaccacu

SEQ ID NO: 1539042 - RNA, 21 nt, Human adenovirus A
caauuuacauuuuaacuguga

SEQ ID NO: 1539043 - RNA, 14 nt, Human adenovirus A
acgcucaaagaaac

SEQ ID NO: 1539044 - RNA, 19 nt, Human adenovirus A
uuugcgguguaccugauuu

SEQ ID NO: 1539045 - RNA, 14 nt, Human adenovirus A
uuuaaaaaccaucu

SEQ ID NO: 1539046 - RNA, 18 nt, Human adenovirus A
ggcgugguuaaacaggga

SEQ ID NO: 1539047 - RNA, 19 nt, Human adenovirus A
gcuuucaagauggccacuc

SEQ ID NO: 1539048 - RNA, 16 nt, Human adenovirus A
guugggauuacaugcu

SEQ ID NO: 1539049 - RNA, 13 nt, Human adenovirus A
aacggguggaaaa

SEQ ID NO: 1539050 - RNA, 18 nt, Human adenovirus A
cacccaaucaaauuacac

SEQ ID NO: 1539051 - RNA, 12 nt, Human adenovirus A
cuccccacagcu

SEQ ID NO: 1539052 - RNA, 16 nt, Human adenovirus A
ggaagaauggcuguug

SEQ ID NO: 1539053 - RNA, 13 nt, Human adenovirus A
caacagcacagga

SEQ ID NO: 1539054 - RNA, 14 nt, Human adenovirus A
aaagaucaguagcu

SEQ ID NO: 1539055 - RNA, 14 nt, Human adenovirus A
gcacuuccuucaga

SEQ ID NO: 1539056 - RNA, 15 nt, Human adenovirus A
auagaaaaagcuaca

SEQ ID NO: 1539057 - RNA, 17 nt, Human adenovirus A
acaaauuugcauuuccc

SEQ ID NO: 1539058 - RNA, 19 nt, Human adenovirus A
ucaccgcgcugcggccaug

SEQ ID NO: 1539059 - RNA, 12 nt, Human adenovirus A
uagaugugcugu

SEQ ID NO: 1539060 - RNA, 18 nt, Human adenovirus A
ucuugaaugcucuggaca

SEQ ID NO: 1539061 - RNA, 15 nt, Human adenovirus A
aggaaaagcugccac

SEQ ID NO: 1539062 - RNA, 16 nt, Human adenovirus A
acuccaggaaacauaa

SEQ ID NO: 1539063 - RNA, 13 nt, Human adenovirus A
agcugugaaaaug

SEQ ID NO: 1539064 - RNA, 14 nt, Human adenovirus A
gcccagcaugacca

SEQ ID NO: 1539065 - RNA, 15 nt, Human adenovirus A
auguguugugcacuu

SEQ ID NO: 1539066 - RNA, 15 nt, Human adenovirus A
aacuuaacaacugau

SEQ ID NO: 1539067 - RNA, 20 nt, Human adenovirus A
auugccgcacggccaaugcc

SEQ ID NO: 1539068 - RNA, 17 nt, Human adenovirus A
cagaccuacgguggcag

SEQ ID NO: 1539069 - RNA, 14 nt, Human adenovirus A
ugaaagucaaguca

SEQ ID NO: 1539070 - RNA, 17 nt, Human adenovirus A
aagucaacccaaacugu

SEQ ID NO: 1539071 - RNA, 18 nt, Human adenovirus A
acacucaggccauaaaga

SEQ ID NO: 1539072 - RNA, 19 nt, Human adenovirus A
gucccgacuuacaggagga

SEQ ID NO: 1539073 - RNA, 13 nt, Human adenovirus A
acaacaaaacacu

SEQ ID NO: 1539074 - RNA, 14 nt, Human adenovirus A
caagaugaguaaag

SEQ ID NO: 1539075 - RNA, 21 nt, Human adenovirus A
aggcauuuccagguggggaaa

SEQ ID NO: 1539076 - RNA, 18 nt, Human adenovirus A
agcugaugcuacuaccca

SEQ ID NO: 1539077 - RNA, 17 nt, Human adenovirus A
aaaagcauacuuaccaa

SEQ ID NO: 1539078 - RNA, 14 nt, Human adenovirus A
uacccaccaucuuc

SEQ ID NO: 1539079 - RNA, 17 nt, Human adenovirus A
ucgcugguccccagaug

SEQ ID NO: 1539080 - RNA, 21 nt, Human adenovirus A
uuuacaguacaaauacaguuu

SEQ ID NO: 1539081 - RNA, 20 nt, Human adenovirus A
agguagaggcauaaaaacuu

SEQ ID NO: 1539082 - RNA, 10 nt, Human adenovirus A
agcagugaaa

SEQ ID NO: 1539083 - RNA, 17 nt, Human adenovirus A
gaaaagcugccaccucu

SEQ ID NO: 1539084 - RNA, 16 nt, Human adenovirus A
ucacaucaaccccuac

SEQ ID NO: 1539085 - RNA, 17 nt, Human adenovirus A
agcaaccaaaugagcaa

SEQ ID NO: 1539086 - RNA, 22 nt, Human adenovirus A
cacuagaccuuuguuaccacuu

SEQ ID NO: 1539087 - RNA, 16 nt, Human adenovirus A
acuuguaacuguggaa

SEQ ID NO: 1539088 - RNA, 16 nt, Human adenovirus A
ccgacuaacaggugaa

SEQ ID NO: 1539089 - RNA, 15 nt, Human adenovirus A
caaaugcgaccucag

SEQ ID NO: 1539090 - RNA, 15 nt, Human adenovirus A
agcgcgcgacuggcu

SEQ ID NO: 1539091 - RNA, 12 nt, Human adenovirus A
cuuggaguguac

SEQ ID NO: 1539092 - RNA, 13 nt, Human adenovirus A
ucucauaaucagu

SEQ ID NO: 1539093 - RNA, 17 nt, Human adenovirus A
augauagagauaagcag

SEQ ID NO: 1539094 - RNA, 20 nt, Human adenovirus A
ucuccuaaauauccaaagua

SEQ ID NO: 1539095 - RNA, 13 nt, Human adenovirus A
aggaagacagcau

SEQ ID NO: 1539096 - RNA, 19 nt, Human adenovirus A
ucccgauaccaaaaacacc

SEQ ID NO: 1539097 - RNA, 24 nt, Human adenovirus A
aucucacuuaagucuuuacaauaa

SEQ ID NO: 1539098 - RNA, 18 nt, Human adenovirus A
gcaggcuggaggugcagg

SEQ ID NO: 1539099 - RNA, 16 nt, Human adenovirus A
gaaucggcaacagcag

SEQ ID NO: 1539100 - RNA, 13 nt, Human adenovirus A
aagaaacagcagc

SEQ ID NO: 1539101 - RNA, 18 nt, Human adenovirus A
gccauaauguaacccuuc

SEQ ID NO: 1539102 - RNA, 13 nt, Human adenovirus A
aaaccuagcugcu

SEQ ID NO: 1539103 - RNA, 23 nt, Human adenovirus A
gcaggaaaucugggaggaagaau

SEQ ID NO: 1539104 - RNA, 19 nt, Human adenovirus A
cuggcgaacaggaagagcc

SEQ ID NO: 1539105 - RNA, 18 nt, Human adenovirus A
cagauuaagcaacauacu

SEQ ID NO: 1539106 - RNA, 15 nt, Human adenovirus A
cugcagacaguggcu

SEQ ID NO: 1539107 - RNA, 15 nt, Human adenovirus A
agccgccauggaaau

SEQ ID NO: 1539108 - RNA, 21 nt, Human adenovirus A
augugcaaauauaaaagcaca

SEQ ID NO: 1539109 - RNA, 14 nt, Human adenovirus A
ugcacuuccuucag

SEQ ID NO: 1539110 - RNA, 14 nt, Human adenovirus A
gcuuaugcauagcu

SEQ ID NO: 1539111 - RNA, 11 nt, Human adenovirus A
agguggaaacc

SEQ ID NO: 1539112 - RNA, 12 nt, Human adenovirus A
guggucaggaag

SEQ ID NO: 1539113 - RNA, 19 nt, Human adenovirus A
uguauacucuggaaccauu

SEQ ID NO: 1539114 - RNA, 18 nt, Human adenovirus A
cacugaaaaaccaacaaa

SEQ ID NO: 1539115 - RNA, 14 nt, Human adenovirus A
aaguuuuguuucuu

SEQ ID NO: 1539116 - RNA, 17 nt, Human adenovirus A
acacgguacuuuuccuu

SEQ ID NO: 1539117 - RNA, 20 nt, Human adenovirus A
uuucaauugcagaacuaucu

SEQ ID NO: 1539118 - RNA, 12 nt, Human adenovirus A
cauccaaaacca

SEQ ID NO: 1539119 - RNA, 20 nt, Human adenovirus A
ugguuacugaagugccucaa

SEQ ID NO: 1539120 - RNA, 23 nt, Human adenovirus A
caaauauaaaagcacaacuccau

SEQ ID NO: 1539121 - RNA, 16 nt, Human adenovirus A
cacuaccgucagugaa

SEQ ID NO: 1539122 - RNA, 16 nt, Human adenovirus A
accuaaacgagggaga

SEQ ID NO: 1539123 - RNA, 19 nt, Human adenovirus A
uuauuugcugcguaggaac

SEQ ID NO: 1539124 - RNA, 14 nt, Human adenovirus A
augcagcaaacacu

SEQ ID NO: 1539125 - RNA, 20 nt, Human adenovirus A
caauuugccuaaaagcuauu

SEQ ID NO: 1539126 - RNA, 16 nt, Human adenovirus A
gcaagacagaaauaca

SEQ ID NO: 1539127 - RNA, 15 nt, Human adenovirus A
uucccaaauuuucca

SEQ ID NO: 1539128 - RNA, 15 nt, Human adenovirus A
caccaccaaacugca

SEQ ID NO: 1539129 - RNA, 19 nt, Human adenovirus A
aauuuuuuagauuguuaua

SEQ ID NO: 1539130 - RNA, 15 nt, Human adenovirus A
acgggcagccugucu

SEQ ID NO: 1539131 - RNA, 20 nt, Human adenovirus A
guagaggaaaagcugccacc

SEQ ID NO: 1539132 - RNA, 19 nt, Human adenovirus A
aggaagccacaugggaagg

SEQ ID NO: 1539133 - RNA, 18 nt, Human adenovirus A
agucauugguaccuucga

SEQ ID NO: 1539134 - RNA, 19 nt, Human adenovirus A
cuguugcuacugcagaccc

SEQ ID NO: 1539135 - RNA, 18 nt, Human adenovirus A
gcuuccaugccuuuuucc

SEQ ID NO: 1539136 - RNA, 13 nt, Human adenovirus A
aauucuuaaacaa

SEQ ID NO: 1539137 - RNA, 12 nt, Human adenovirus A
aguaacaaacug

SEQ ID NO: 1539138 - RNA, 13 nt, Human adenovirus A
agccaaaaaaaca

SEQ ID NO: 1539139 - RNA, 12 nt, Human adenovirus A
accccugggcuu

SEQ ID NO: 1539140 - RNA, 19 nt, Human adenovirus A
acuuuagccccagcggcag

SEQ ID NO: 1539141 - RNA, 16 nt, Human adenovirus A
uuacaaaggcauuaag

SEQ ID NO: 1539142 - RNA, 14 nt, Human adenovirus A
auaugggcucuuuu

SEQ ID NO: 1539143 - RNA, 22 nt, Human adenovirus A
aaacgcugggcucgaggaccau

SEQ ID NO: 1539144 - RNA, 13 nt, Human adenovirus A
gcuucuugcuuua

SEQ ID NO: 1539145 - RNA, 12 nt, Human adenovirus A
aaagaucacagc

SEQ ID NO: 1539146 - RNA, 13 nt, Human adenovirus A
cagaaagccaacc

SEQ ID NO: 1539147 - RNA, 20 nt, Human adenovirus A
aaaaauuuucccaacaaugg

SEQ ID NO: 1539148 - RNA, 21 nt, Human adenovirus A
acugcgucaguaacaaacugg

SEQ ID NO: 1539149 - RNA, 20 nt, Human adenovirus A
ccacgccgcgccccacuucc

SEQ ID NO: 1539150 - RNA, 21 nt, Human adenovirus A
gccaaacagcuguggaaagca

SEQ ID NO: 1539151 - RNA, 11 nt, Human adenovirus A
cauuacaguag

SEQ ID NO: 1539152 - RNA, 22 nt, Human adenovirus A
cacugucgccaaccucacugcu

SEQ ID NO: 1539153 - RNA, 19 nt, Human adenovirus A
uuccagcgccaccugccau

SEQ ID NO: 1539154 - RNA, 16 nt, Human adenovirus A
gaauaaaauuucuaga

SEQ ID NO: 1539155 - RNA, 13 nt, Human adenovirus A
guaguugcgcaag

SEQ ID NO: 1539156 - RNA, 21 nt, Human adenovirus A
uguugugcauauuuucuugua

SEQ ID NO: 1539157 - RNA, 11 nt, Human adenovirus A
uccaaaaccag

SEQ ID NO: 1539158 - RNA, 12 nt, Human adenovirus A
cagaagcacugg

SEQ ID NO: 1539159 - RNA, 21 nt, Human adenovirus A
gaguacacgcgcucaaaggca

SEQ ID NO: 1539160 - RNA, 20 nt, Human adenovirus A
uccauuuccaccaaaugcuc

SEQ ID NO: 1539161 - RNA, 22 nt, Human adenovirus A
uuaaauugagaugguguuauga

SEQ ID NO: 1539162 - RNA, 16 nt, Human adenovirus A
cagcuaacaaugcagc

SEQ ID NO: 1539163 - RNA, 13 nt, Human adenovirus A
cuucaucuuuucu

SEQ ID NO: 1539164 - RNA, 18 nt, Human adenovirus A
cuuagucauuacaacauu

SEQ ID NO: 1539165 - RNA, 16 nt, Human adenovirus A
cauacaucaccucuuu

SEQ ID NO: 1539166 - RNA, 19 nt, Human adenovirus A
uuuaccaaugaauuaaaua

SEQ ID NO: 1539167 - RNA, 23 nt, Human adenovirus A
ccuccgugaguuggccuggaaau

SEQ ID NO: 1539168 - RNA, 14 nt, Human adenovirus A
ccgccgccaaaccg

SEQ ID NO: 1539169 - RNA, 22 nt, Human adenovirus A
gugcccccuaaacggcaagcca

SEQ ID NO: 1539170 - RNA, 17 nt, Human adenovirus A
gcgcaccaucuccauuc

SEQ ID NO: 1539171 - RNA, 18 nt, Human adenovirus A
caggaaaaaaaagaaagu

SEQ ID NO: 1539172 - RNA, 20 nt, Human adenovirus A
uggcagcaaugcuuggaaga

SEQ ID NO: 1539173 - RNA, 17 nt, Human adenovirus A
uguucaacaacagcuuc

SEQ ID NO: 1539174 - RNA, 17 nt, Human adenovirus A
ucgggaauuaauggagu

SEQ ID NO: 1539175 - RNA, 18 nt, Human adenovirus A
acuagguauaagaaagag

SEQ ID NO: 1539176 - RNA, 17 nt, Human adenovirus A
uauugccaccuuuuguu

SEQ ID NO: 1539177 - RNA, 23 nt, Human adenovirus A
gcugcccugauauaucaggaaaa

SEQ ID NO: 1539178 - RNA, 12 nt, Human adenovirus A
cacagccagugg

SEQ ID NO: 1539179 - RNA, 17 nt, Human adenovirus A
aguuguggauaccacag

SEQ ID NO: 1539180 - RNA, 21 nt, Human adenovirus A
cucuaaguucuguuucaugua

SEQ ID NO: 1539181 - RNA, 16 nt, Human adenovirus A
ugcaggacgcagaagc

SEQ ID NO: 1539182 - RNA, 21 nt, Human adenovirus A
caacggcaggaaaucugggag

SEQ ID NO: 1539183 - RNA, 18 nt, Human adenovirus A
ggaaagcauuuuggauuu

SEQ ID NO: 1539184 - RNA, 21 nt, Human adenovirus A
gcauuccccauccaaaaccag

SEQ ID NO: 1539185 - RNA, 13 nt, Human adenovirus A
guccucuuccucu

SEQ ID NO: 1539186 - RNA, 18 nt, Human adenovirus A
uucagccacucaaacauu

SEQ ID NO: 1539187 - RNA, 13 nt, Human adenovirus A
uaaccgcccccac

SEQ ID NO: 1539188 - RNA, 13 nt, Human adenovirus A
guggaggaauuua

SEQ ID NO: 1539189 - RNA, 14 nt, Human adenovirus A
auuuaauuucagau

SEQ ID NO: 1539190 - RNA, 15 nt, Human adenovirus A
cuuaaaaaaacaaaa

SEQ ID NO: 1539191 - RNA, 22 nt, Human adenovirus A
gccaugcuaugcaggcagccgu

SEQ ID NO: 1539192 - RNA, 16 nt, Human adenovirus A
uaaacugucuguaaaa

SEQ ID NO: 1539193 - RNA, 13 nt, Human adenovirus A
ucccauuacagua

SEQ ID NO: 1539194 - RNA, 15 nt, Human adenovirus A
uuuaaugcaucuuug

SEQ ID NO: 1539195 - RNA, 19 nt, Human adenovirus A
cacaacacauacauacacu

SEQ ID NO: 1539196 - RNA, 15 nt, Human adenovirus A
uaauguaacccuucc

SEQ ID NO: 1539197 - RNA, 21 nt, Human adenovirus A
cgggucggagaaccuuucaag

SEQ ID NO: 1539198 - RNA, 21 nt, Human adenovirus A
aagcugaaacuaggggcuggc

SEQ ID NO: 1539199 - RNA, 16 nt, Human adenovirus A
cauaccuuaaaaacug

SEQ ID NO: 1539200 - RNA, 17 nt, Human adenovirus A
ccauuauuauggcaauu

SEQ ID NO: 1539201 - RNA, 16 nt, Human adenovirus A
cagguauuacuaaaag

SEQ ID NO: 1539202 - RNA, 20 nt, Human adenovirus A
acugccccgggguuggugga

SEQ ID NO: 1539203 - RNA, 20 nt, Human adenovirus A
ccaacggcacaugcgagcca

SEQ ID NO: 1539204 - RNA, 19 nt, Human adenovirus A
aaaaauguguacuugcuuu

SEQ ID NO: 1539205 - RNA, 15 nt, Human adenovirus A
uaccucaaaagcgaa

SEQ ID NO: 1539206 - RNA, 23 nt, Human adenovirus A
gggccaggcgcauugggcggcga

SEQ ID NO: 1539207 - RNA, 17 nt, Human adenovirus A
acauucgcagcgcacug

SEQ ID NO: 1539208 - RNA, 13 nt, Human adenovirus A
gcggcacaacaga

SEQ ID NO: 1539209 - RNA, 16 nt, Human adenovirus A
cgcuggggcacagcuu

SEQ ID NO: 1539210 - RNA, 15 nt, Human adenovirus A
cuuaaauugagaugg

SEQ ID NO: 1539211 - RNA, 22 nt, Human adenovirus A
aaugcuuagucauuacaacauu

SEQ ID NO: 1539212 - RNA, 21 nt, Human adenovirus A
auggaacaauugcuucugagu

SEQ ID NO: 1539213 - RNA, 22 nt, Human adenovirus A
cuagaggcgugccguuggcaga

SEQ ID NO: 1539214 - RNA, 10 nt, Human adenovirus A
augcuggaac

SEQ ID NO: 1539215 - RNA, 16 nt, Human adenovirus A
ucacaacacagcacua

SEQ ID NO: 1539216 - RNA, 22 nt, Human adenovirus A
caaaaguaauaucauuaaauaa

SEQ ID NO: 1539217 - RNA, 13 nt, Human adenovirus A
cagaaaaaaauug

SEQ ID NO: 1539218 - RNA, 20 nt, Human adenovirus A
auugaaccgguugaaacaga

SEQ ID NO: 1539219 - RNA, 17 nt, Human adenovirus A
uuggcuucgaaugcugu

SEQ ID NO: 1539220 - RNA, 21 nt, Human adenovirus A
caacaagucuucugacauugc

SEQ ID NO: 1539221 - RNA, 14 nt, Human adenovirus A
uugugcauauuuuc

SEQ ID NO: 1539222 - RNA, 18 nt, Human adenovirus A
caaggaccgcauguauuc

SEQ ID NO: 1539223 - RNA, 22 nt, Human adenovirus A
caaaucagaagccagcagcaaa

SEQ ID NO: 1539224 - RNA, 14 nt, Human adenovirus A
auuuacugcagccu

SEQ ID NO: 1539225 - RNA, 20 nt, Human adenovirus A
ucccgauaccaaaaacaccu

SEQ ID NO: 1539226 - RNA, 13 nt, Human adenovirus A
auagcugaacccc

SEQ ID NO: 1539227 - RNA, 16 nt, Human adenovirus A
gcucuaauagaacugg

SEQ ID NO: 1539228 - RNA, 16 nt, Human adenovirus A
guuacugaagugccuc

SEQ ID NO: 1539229 - RNA, 17 nt, Human adenovirus A
gcgaacaggagcugacg

SEQ ID NO: 1539230 - RNA, 13 nt, Human adenovirus A
cuaacuaccuagc

SEQ ID NO: 1539231 - RNA, 22 nt, Human adenovirus A
acaaacaacgaaggccaaacca

SEQ ID NO: 1539232 - RNA, 21 nt, Human adenovirus A
uggcuguugcuguaaggaacg

SEQ ID NO: 1539233 - RNA, 15 nt, Human adenovirus A
aagacugagaaccgu

SEQ ID NO: 1539234 - RNA, 12 nt, Human adenovirus A
caauuucugcca

SEQ ID NO: 1539235 - RNA, 14 nt, Human adenovirus A
gaaacagaagaaaa

SEQ ID NO: 1539236 - RNA, 15 nt, Human adenovirus A
uauguuaaauuaaag

SEQ ID NO: 1539237 - RNA, 22 nt, Human adenovirus A
aaggaaaguaacucuuguaaag

SEQ ID NO: 1539238 - RNA, 16 nt, Human adenovirus A
gggcauggugauuaaa

SEQ ID NO: 1539239 - RNA, 19 nt, Human adenovirus A
gucauuuacugcagccugu

SEQ ID NO: 1539240 - RNA, 20 nt, Human adenovirus A
uaugccaucucgauccagca

SEQ ID NO: 1539241 - RNA, 15 nt, Human adenovirus A
gugaagauagacagc

SEQ ID NO: 1539242 - RNA, 17 nt, Human adenovirus A
ggacaauccaaggauga

SEQ ID NO: 1539243 - RNA, 14 nt, Human adenovirus A
gugguugggaacag

SEQ ID NO: 1539244 - RNA, 20 nt, Human adenovirus A
accgcagucugacagcaauu

SEQ ID NO: 1539245 - RNA, 12 nt, Human adenovirus A
uaaccuuuccac

SEQ ID NO: 1539246 - RNA, 19 nt, Human adenovirus A
uguauauuaagguacauug

SEQ ID NO: 1539247 - RNA, 23 nt, Human adenovirus A
aacgagggagauguccuguuuaa

SEQ ID NO: 1539248 - RNA, 12 nt, Human adenovirus A
agagacaaugaa

SEQ ID NO: 1539249 - RNA, 14 nt, Human adenovirus A
agacugcuguaaug

SEQ ID NO: 1539250 - RNA, 15 nt, Human adenovirus A
cuuacccgcagcugu

SEQ ID NO: 1539251 - RNA, 19 nt, Human adenovirus A
ggccagugugcgcuuuaaa

SEQ ID NO: 1539252 - RNA, 17 nt, Human adenovirus A
caguaucaguggaguuc

SEQ ID NO: 1539253 - RNA, 23 nt, Human adenovirus A
uucuaccaaggaaaacuuuugua

SEQ ID NO: 1539254 - RNA, 15 nt, Human adenovirus A
cagccuagacgagga

SEQ ID NO: 1539255 - RNA, 16 nt, Human adenovirus A
ccagaagcacuggcaa

SEQ ID NO: 1539256 - RNA, 19 nt, Human adenovirus A
cgcgauacaacggccagcc

SEQ ID NO: 1539257 - RNA, 17 nt, Human adenovirus A
ugccaggcauuuccagg

SEQ ID NO: 1539258 - RNA, 14 nt, Human adenovirus A
agcauuaaacgcuu

SEQ ID NO: 1539259 - RNA, 19 nt, Human adenovirus A
ggaaauuaauuugcaggcu

SEQ ID NO: 1539260 - RNA, 14 nt, Human adenovirus A
gcugcaaacaugcu

SEQ ID NO: 1539261 - RNA, 13 nt, Human adenovirus A
guuccagaaggag

SEQ ID NO: 1539262 - RNA, 16 nt, Human adenovirus A
aauaaagaaaaaacuu

SEQ ID NO: 1539263 - RNA, 16 nt, Human adenovirus A
agaaucgcaagcaggc

SEQ ID NO: 1539264 - RNA, 23 nt, Human adenovirus A
ggagcggaacccugcgguggugg

SEQ ID NO: 1539265 - RNA, 15 nt, Human adenovirus A
gcagcaaacacugcu

SEQ ID NO: 1539266 - RNA, 14 nt, Human adenovirus A
agcguucuguggau

SEQ ID NO: 1539267 - RNA, 20 nt, Human adenovirus A
ccauguaucagcagccaacu

SEQ ID NO: 1539268 - RNA, 14 nt, Human adenovirus A
aacuacucagaaca

SEQ ID NO: 1539269 - RNA, 23 nt, Human adenovirus A
cuguuacauaccuggcaaacugg

SEQ ID NO: 1539270 - RNA, 15 nt, Human adenovirus A
gauuucugcugucau

SEQ ID NO: 1539271 - RNA, 17 nt, Human adenovirus A
ggcaguacuucauauuu

SEQ ID NO: 1539272 - RNA, 16 nt, Human adenovirus A
ccaggcgggcugcaac

SEQ ID NO: 1539273 - RNA, 15 nt, Human adenovirus A
gauugcgaacaacaa

SEQ ID NO: 1539274 - RNA, 17 nt, Human adenovirus A
uaaaaaauuacaaaggc

SEQ ID NO: 1539275 - RNA, 15 nt, Human adenovirus A
cgucuucguggagaa

SEQ ID NO: 1539276 - RNA, 17 nt, Human adenovirus A
gcuguaucuguugaaug

SEQ ID NO: 1539277 - RNA, 15 nt, Human adenovirus A
caaugaaacccgcug

SEQ ID NO: 1539278 - RNA, 14 nt, Human adenovirus A
caacaguacaggca

SEQ ID NO: 1539279 - RNA, 17 nt, Human adenovirus A
cggucgaccuguggcac

SEQ ID NO: 1539280 - RNA, 16 nt, Human adenovirus A
cuacucacgagaaagu

SEQ ID NO: 1539281 - RNA, 21 nt, Human adenovirus A
gucuagccaacauccagugcg

SEQ ID NO: 1539282 - RNA, 21 nt, Human adenovirus A
caaaaauuuucccaacaaugg

SEQ ID NO: 1539283 - RNA, 17 nt, Human adenovirus A
ugcaaauucaucaacau

SEQ ID NO: 1539284 - RNA, 20 nt, Human adenovirus A
cugccugacugaaccauucc

SEQ ID NO: 1539285 - RNA, 17 nt, Human adenovirus A
cuugauggauuaccuuc

SEQ ID NO: 1539286 - RNA, 20 nt, Human adenovirus A
auuuccagguggggaaaaug

SEQ ID NO: 1539287 - RNA, 14 nt, Human adenovirus A
aucccgaguguuua

SEQ ID NO: 1539288 - RNA, 21 nt, Human adenovirus A
agaaccuuucaagaaaggcau

SEQ ID NO: 1539289 - RNA, 23 nt, Human adenovirus A
uguucaacaacagcuucuaaaag

SEQ ID NO: 1539290 - RNA, 16 nt, Human adenovirus A
gccaaccucacugcuu

SEQ ID NO: 1539291 - RNA, 14 nt, Human adenovirus A
acaacgaaggccaa

SEQ ID NO: 1539292 - RNA, 13 nt, Human adenovirus A
gaagcacuggcaa

SEQ ID NO: 1539293 - RNA, 18 nt, Human adenovirus A
cuccccuguggagccacu

SEQ ID NO: 1539294 - RNA, 15 nt, Human adenovirus A
acugcucagcuggaa

SEQ ID NO: 1539295 - RNA, 16 nt, Human adenovirus A
uggaaaacauaugcac

SEQ ID NO: 1539296 - RNA, 22 nt, Human adenovirus A
accaggcauggccaucauacau

SEQ ID NO: 1539297 - RNA, 14 nt, Human adenovirus A
cuguguauacgccu

SEQ ID NO: 1539298 - RNA, 17 nt, Human adenovirus A
ucagaagccagcagcaa

SEQ ID NO: 1539299 - RNA, 23 nt, Human adenovirus A
gacccaccaccaaacugcagccu

SEQ ID NO: 1539300 - RNA, 15 nt, Human adenovirus A
uguuuguuugaaaaa

SEQ ID NO: 1539301 - RNA, 22 nt, Human adenovirus A
cagggcauacgcuugugcagcc

SEQ ID NO: 1539302 - RNA, 15 nt, Human adenovirus A
acaguaucaauuuuu

SEQ ID NO: 1539303 - RNA, 16 nt, Human adenovirus A
cugagacgaagaaaua

SEQ ID NO: 1539304 - RNA, 15 nt, Human adenovirus A
caggaagagccucaa

SEQ ID NO: 1539305 - RNA, 21 nt, Human adenovirus A
caacucuacuuaaaagcaagc

SEQ ID NO: 1539306 - RNA, 14 nt, Human adenovirus A
gcgggaagcggggg

SEQ ID NO: 1539307 - RNA, 16 nt, Human adenovirus A
auauuaaaaagcucug

SEQ ID NO: 1539308 - RNA, 14 nt, Human adenovirus A
auuucucuuuucuu

SEQ ID NO: 1539309 - RNA, 21 nt, Human adenovirus A
gcgccacccuacgugccuccc

SEQ ID NO: 1539310 - RNA, 16 nt, Human adenovirus A
gugccuauauauuuua

SEQ ID NO: 1539311 - RNA, 19 nt, Human adenovirus A
accccuaacugcccagcug

SEQ ID NO: 1539312 - RNA, 21 nt, Human adenovirus A
ccguacaugggcaccuggaac

SEQ ID NO: 1539313 - RNA, 16 nt, Human adenovirus A
agacuauaaucccuug

SEQ ID NO: 1539314 - RNA, 19 nt, Human adenovirus A
acacuuacgaauggaacuu

SEQ ID NO: 1539315 - RNA, 23 nt, Human adenovirus A
aaaugcuuuguuggauagcaaag

SEQ ID NO: 1539316 - RNA, 13 nt, Human adenovirus A
caaaaaaacagau

SEQ ID NO: 1539317 - RNA, 20 nt, Human adenovirus A
cggacaccuacuucacccug

SEQ ID NO: 1539318 - RNA, 15 nt, Human adenovirus A
gcgcucagugcgagg

SEQ ID NO: 1539319 - RNA, 23 nt, Human adenovirus A
guaauuuuccagcgccaccugcc

SEQ ID NO: 1539320 - RNA, 15 nt, Human adenovirus A
caacgcuuugcuuga

SEQ ID NO: 1539321 - RNA, 23 nt, Human adenovirus A
ugcgaccucagcccagggcaacc

SEQ ID NO: 1539322 - RNA, 13 nt, Human adenovirus A
gcaaguaggacca

SEQ ID NO: 1539323 - RNA, 21 nt, Human adenovirus A
acaguuuugaacaauuaaaaa

SEQ ID NO: 1539324 - RNA, 16 nt, Human adenovirus A
acagcggggaggaagc

SEQ ID NO: 1539325 - RNA, 16 nt, Human adenovirus A
ugucuacaacugcucc

SEQ ID NO: 1539326 - RNA, 10 nt, Human adenovirus A
cgacaaaugc

SEQ ID NO: 1539327 - RNA, 17 nt, Human adenovirus A
cuuuacaaaugcaauuc

SEQ ID NO: 1539328 - RNA, 16 nt, Human adenovirus A
agauguaauuaaugga

SEQ ID NO: 1539329 - RNA, 15 nt, Human adenovirus A
caaauuacacacuac

SEQ ID NO: 1539330 - RNA, 18 nt, Human adenovirus A
ugcaggcuaauuugugga

SEQ ID NO: 1539331 - RNA, 15 nt, Human adenovirus A
cagcagcgguggcgc

SEQ ID NO: 1539332 - RNA, 13 nt, Human adenovirus A
uccuccuggaggu

SEQ ID NO: 1539333 - RNA, 22 nt, Human adenovirus A
gauacagcgcugauuaugcauu

SEQ ID NO: 1539334 - RNA, 14 nt, Human adenovirus A
auguaaaaaaauac

SEQ ID NO: 1539335 - RNA, 17 nt, Human adenovirus A
caacuuaacccucccuc

SEQ ID NO: 1539336 - RNA, 14 nt, Human adenovirus A
guuccaguauuuug

SEQ ID NO: 1539337 - RNA, 15 nt, Human adenovirus A
auuacuuuuaaauac

SEQ ID NO: 1539338 - RNA, 20 nt, Human adenovirus A
uacaaagccaggcacagcag

SEQ ID NO: 1539339 - RNA, 20 nt, Human adenovirus A
agcuauugcaaaccuagcug

SEQ ID NO: 1539340 - RNA, 19 nt, Human adenovirus A
ugccgucuucguggagaag

SEQ ID NO: 1539341 - RNA, 17 nt, Human adenovirus A
cgucggggcuacugcuc

SEQ ID NO: 1539342 - RNA, 13 nt, Human adenovirus A
guaugcugaagaa

SEQ ID NO: 1539343 - RNA, 13 nt, Human adenovirus A
gugugacugcccc

SEQ ID NO: 1539344 - RNA, 22 nt, Human adenovirus A
cauugccgcacggccaaugccc

SEQ ID NO: 1539345 - RNA, 10 nt, Human adenovirus A
agaggcuggc

SEQ ID NO: 1539346 - RNA, 19 nt, Human adenovirus A
ccugacgcucuggcagggg

SEQ ID NO: 1539347 - RNA, 19 nt, Human adenovirus A
uuuccauuuuuugaaaaga

SEQ ID NO: 1539348 - RNA, 13 nt, Human adenovirus A
acuuuuuucccau

SEQ ID NO: 1539349 - RNA, 18 nt, Human adenovirus A
auaagcauuagagucgcc

SEQ ID NO: 1539350 - RNA, 23 nt, Human adenovirus A
cuggugguauuggaacucuccaa

SEQ ID NO: 1539351 - RNA, 19 nt, Human adenovirus A
cagaaaaaaauugccaacc

SEQ ID NO: 1539352 - RNA, 19 nt, Human adenovirus A
ugagugggcagaauuugug

SEQ ID NO: 1539353 - RNA, 20 nt, Human adenovirus A
gcaggagaaaauaacacaua

SEQ ID NO: 1539354 - RNA, 20 nt, Human adenovirus A
cagugagugaaucuguggau

SEQ ID NO: 1539355 - RNA, 12 nt, Human adenovirus A
uaccaaugaggc

SEQ ID NO: 1539356 - RNA, 20 nt, Human adenovirus A
ccgcgaaaaaaaucacuucc

SEQ ID NO: 1539357 - RNA, 13 nt, Human adenovirus A
aacauucgcagcg

SEQ ID NO: 1539358 - RNA, 18 nt, Human adenovirus A
gaagaauggcuguugaug

SEQ ID NO: 1539359 - RNA, 22 nt, Human adenovirus A
cguccaggcaggguuugcaaac

SEQ ID NO: 1539360 - RNA, 13 nt, Human adenovirus A
ugucuuguuaaug

SEQ ID NO: 1539361 - RNA, 14 nt, Human adenovirus A
aagaaacagcagca

SEQ ID NO: 1539362 - RNA, 22 nt, Human adenovirus A
aaagcaaauuacgcaacaacug

SEQ ID NO: 1539363 - RNA, 22 nt, Human adenovirus A
ucaaacagccgaaagaccacua

SEQ ID NO: 1539364 - RNA, 22 nt, Human adenovirus A
auuuugcaaguguaauuuucca

SEQ ID NO: 1539365 - RNA, 16 nt, Human adenovirus A
cuuuucuuacauuacc

SEQ ID NO: 1539366 - RNA, 22 nt, Human adenovirus A
caggcuaaacgaccgccuuuuc

SEQ ID NO: 1539367 - RNA, 20 nt, Human adenovirus A
gcccagacguaggguacagu

SEQ ID NO: 1539368 - RNA, 18 nt, Human adenovirus A
ugcaggcuucucgaaaaa

SEQ ID NO: 1539369 - RNA, 16 nt, Human adenovirus A
cggaacuauuucuugu

SEQ ID NO: 1539370 - RNA, 14 nt, Human adenovirus A
uuuuguuucuucua

SEQ ID NO: 1539371 - RNA, 19 nt, Human adenovirus A
ccauuguaaaugcuuuguu

SEQ ID NO: 1539372 - RNA, 19 nt, Human adenovirus A
cauggaugaauugcagccu

SEQ ID NO: 1539373 - RNA, 17 nt, Human adenovirus A
uagaaucggcaacagca

SEQ ID NO: 1539374 - RNA, 17 nt, Human adenovirus A
gacaucaccacauugcg

SEQ ID NO: 1539375 - RNA, 14 nt, Human adenovirus A
uaaugaaaacaaug

SEQ ID NO: 1539376 - RNA, 21 nt, Human adenovirus A
ggauuacaugaagauuucugc

SEQ ID NO: 1539377 - RNA, 16 nt, Human adenovirus A
acauuacaauuaacug

SEQ ID NO: 1539378 - RNA, 12 nt, Human adenovirus A
cugcagcuuccg

SEQ ID NO: 1539379 - RNA, 12 nt, Human adenovirus A
cugacugaacca

SEQ ID NO: 1539380 - RNA, 14 nt, Human adenovirus A
gaacugcagacagu

SEQ ID NO: 1539381 - RNA, 15 nt, Human adenovirus A
cuggccccgcgacac

SEQ ID NO: 1539382 - RNA, 23 nt, Human adenovirus A
cacuuacgaauggaacuuuagaa

SEQ ID NO: 1539383 - RNA, 22 nt, Human adenovirus A
cguucuuugguuugcaauacug

SEQ ID NO: 1539384 - RNA, 11 nt, Human adenovirus A
ggaucuucaaa

SEQ ID NO: 1539385 - RNA, 17 nt, Human adenovirus A
ugaaaaacgagcagcaa

SEQ ID NO: 1539386 - RNA, 19 nt, Human adenovirus A
auuucuuccuccuggaggu

SEQ ID NO: 1539387 - RNA, 14 nt, Human adenovirus A
ccacggccucagca

SEQ ID NO: 1539388 - RNA, 16 nt, Human adenovirus A
ccugcgacaaaugcga

SEQ ID NO: 1539389 - RNA, 19 nt, Human adenovirus A
ccauggaucguauuauggc

SEQ ID NO: 1539390 - RNA, 23 nt, Human adenovirus A
cgugaauauuaaaaagcucugua

SEQ ID NO: 1539391 - RNA, 19 nt, Human adenovirus A
guguagguuucuacaucau

SEQ ID NO: 1539392 - RNA, 23 nt, Human adenovirus A
agcuuaccacucagaccuuauga

SEQ ID NO: 1539393 - RNA, 21 nt, Human adenovirus A
gucuacaaaucuuucaaucau

SEQ ID NO: 1539394 - RNA, 15 nt, Human adenovirus A
acgcucuggcagggg

SEQ ID NO: 1539395 - RNA, 14 nt, Human adenovirus A
gagcugccaccguc

SEQ ID NO: 1539396 - RNA, 21 nt, Human adenovirus A
aaaaugcaaaauggacucaaa

SEQ ID NO: 1539397 - RNA, 22 nt, Human adenovirus A
gcugccaccucuagaaacugug

SEQ ID NO: 1539398 - RNA, 16 nt, Human adenovirus A
gcuauguacagcaauc

SEQ ID NO: 1539399 - RNA, 15 nt, Human adenovirus A
gaugauggaaagccg

SEQ ID NO: 1539400 - RNA, 10 nt, Human adenovirus A
augcaaagcc

SEQ ID NO: 1539401 - RNA, 22 nt, Human adenovirus A
ucuaacaagcugcgcugccguu

SEQ ID NO: 1539402 - RNA, 21 nt, Human adenovirus A
acauacuagguauaagaaaga

SEQ ID NO: 1539403 - RNA, 17 nt, Human adenovirus A
agcaagugccuccucag

SEQ ID NO: 1539404 - RNA, 22 nt, Human adenovirus A
uggcuacgugcgccaagccugu

SEQ ID NO: 1539405 - RNA, 14 nt, Human adenovirus A
uccauaccugggau

SEQ ID NO: 1539406 - RNA, 15 nt, Human adenovirus A
caccuuuuaccuaaa

SEQ ID NO: 1539407 - RNA, 17 nt, Human adenovirus A
caugcuauuaagcaagc

SEQ ID NO: 1539408 - RNA, 21 nt, Human adenovirus A
cagaaaaacaguacaaagcca

SEQ ID NO: 1539409 - RNA, 13 nt, Human adenovirus A
cccccguuaccaa

SEQ ID NO: 1539410 - RNA, 19 nt, Human adenovirus A
caaucccuacccaccaucu

SEQ ID NO: 1539411 - RNA, 21 nt, Human adenovirus A
agauuguaauuuuuuucuccu

SEQ ID NO: 1539412 - RNA, 17 nt, Human adenovirus A
aaggcauuggaaagcag

SEQ ID NO: 1539413 - RNA, 21 nt, Human adenovirus A
caaacccccaggaugauuuac

SEQ ID NO: 1539414 - RNA, 14 nt, Human adenovirus A
guuucaggaaggau

SEQ ID NO: 1539415 - RNA, 13 nt, Human adenovirus A
gcccgccgccgga

SEQ ID NO: 1539416 - RNA, 19 nt, Human adenovirus A
aguucaccuccagguacaa

SEQ ID NO: 1539417 - RNA, 22 nt, Human adenovirus A
cgucuucguacuuaaaaaaaca

SEQ ID NO: 1539418 - RNA, 17 nt, Human adenovirus A
guguuaucuucaaauca

SEQ ID NO: 1539419 - RNA, 15 nt, Human adenovirus A
uuaaagcaaaccacu

SEQ ID NO: 1539420 - RNA, 16 nt, Human adenovirus A
ugggcggcauuuagag

SEQ ID NO: 1539421 - RNA, 16 nt, Human adenovirus A
cucccucuuggccagc

SEQ ID NO: 1539422 - RNA, 19 nt, Human adenovirus A
aacgaccgccuuuucuaga

SEQ ID NO: 1539423 - RNA, 21 nt, Human adenovirus A
cuuacccgcagcugucucuac

SEQ ID NO: 1539424 - RNA, 23 nt, Human adenovirus A
cugcuccgacaacagcugcuguc

SEQ ID NO: 1539425 - RNA, 23 nt, Human adenovirus A
gacuguccagggcuuuuggcuuc

SEQ ID NO: 1539426 - RNA, 15 nt, Human adenovirus A
agcaauuacuugaac

SEQ ID NO: 1539427 - RNA, 14 nt, Human adenovirus A
ggaacaacaggugc

SEQ ID NO: 1539428 - RNA, 20 nt, Human adenovirus A
aaggggaggaccccaaggca

SEQ ID NO: 1539429 - RNA, 16 nt, Human adenovirus A
uccuuuucuuacauua

SEQ ID NO: 1539430 - RNA, 22 nt, Human adenovirus A
cagucuugaaugcucuggacau

SEQ ID NO: 1539431 - RNA, 20 nt, Human adenovirus A
cgcggccguacaugggcacc

SEQ ID NO: 1539432 - RNA, 14 nt, Human adenovirus A
cgucuuauuuuccu

SEQ ID NO: 1539433 - RNA, 20 nt, Human adenovirus A
ccaagaauaaaaacacacac

SEQ ID NO: 1539434 - RNA, 11 nt, Human adenovirus A
aguuucuggag

SEQ ID NO: 1539435 - RNA, 13 nt, Human adenovirus A
uuuaaggccaggg

SEQ ID NO: 1539436 - RNA, 14 nt, Human adenovirus A
auggaucuggagcc

SEQ ID NO: 1539437 - RNA, 14 nt, Human adenovirus A
auuccauaauuaaa

SEQ ID NO: 1539438 - RNA, 17 nt, Human adenovirus A
cuuuccaccucuaccuc

SEQ ID NO: 1539439 - RNA, 12 nt, Human adenovirus A
uaccaaagccau

SEQ ID NO: 1539440 - RNA, 19 nt, Human adenovirus A
uuuguagcugaaaacaacu

SEQ ID NO: 1539441 - RNA, 18 nt, Human adenovirus A
gggggaugaaggaagcga

SEQ ID NO: 1539442 - RNA, 21 nt, Human adenovirus A
gaaacucuaacugcucagcug

SEQ ID NO: 1539443 - RNA, 16 nt, Human adenovirus A
cggggaggaagcugag

SEQ ID NO: 1539444 - RNA, 17 nt, Human adenovirus A
ggcagcgguaguuguug

SEQ ID NO: 1539445 - RNA, 18 nt, Human adenovirus A
uccuccuuauccuuccag

SEQ ID NO: 1539446 - RNA, 11 nt, Human adenovirus A
cacaaaacaca

SEQ ID NO: 1539447 - RNA, 23 nt, Human adenovirus A
auuuauaaauguuagguuugcug

SEQ ID NO: 1539448 - RNA, 18 nt, Human adenovirus A
agcggggaggaagcugag

SEQ ID NO: 1539449 - RNA, 16 nt, Human adenovirus A
guuuaaaggaagcugc

SEQ ID NO: 1539450 - RNA, 22 nt, Human adenovirus A
ucuaaugcaaguuguaaggcau

SEQ ID NO: 1539451 - RNA, 20 nt, Human adenovirus A
agucgcacuuuuuaaaaaag

SEQ ID NO: 1539452 - RNA, 22 nt, Human adenovirus A
gcaguuuuucuaccaaugaggc

SEQ ID NO: 1539453 - RNA, 20 nt, Human adenovirus A
acacugaaggcauuuaaggg

SEQ ID NO: 1539454 - RNA, 16 nt, Human adenovirus A
agugcuggaaagugac

SEQ ID NO: 1539455 - RNA, 17 nt, Human adenovirus A
cacucagcgacaaaccu

SEQ ID NO: 1539456 - RNA, 16 nt, Human adenovirus A
uggcagcugauuucag

SEQ ID NO: 1539457 - RNA, 16 nt, Human adenovirus A
cagcagcagcaacacu

SEQ ID NO: 1539458 - RNA, 17 nt, Human adenovirus A
acccuuacacucaagcu

SEQ ID NO: 1539459 - RNA, 13 nt, Human adenovirus A
auuaaaagggaag

SEQ ID NO: 1539460 - RNA, 20 nt, Human adenovirus A
agucccauuacaguaauaaa

SEQ ID NO: 1539461 - RNA, 18 nt, Human adenovirus A
gucaaaccugacagacuu

SEQ ID NO: 1539462 - RNA, 17 nt, Human adenovirus A
acauacaucaccucuuu

SEQ ID NO: 1539463 - RNA, 17 nt, Human adenovirus A
agcggcauuccccaucc

SEQ ID NO: 1539464 - RNA, 16 nt, Human adenovirus A
aauaaaauuucuagaa

SEQ ID NO: 1539465 - RNA, 15 nt, Human adenovirus A
uggaacccuuacacu

SEQ ID NO: 1539466 - RNA, 18 nt, Human adenovirus A
cuagcccaauugcaugcu

SEQ ID NO: 1539467 - RNA, 14 nt, Human adenovirus A
cuuucagcccauga

SEQ ID NO: 1539468 - RNA, 20 nt, Human adenovirus A
aaaauaacacauaagcauua

SEQ ID NO: 1539469 - RNA, 17 nt, Human adenovirus A
uagauacaagcgacaga

SEQ ID NO: 1539470 - RNA, 21 nt, Human adenovirus A
agcggcgagaaugggaggaaa

SEQ ID NO: 1539471 - RNA, 21 nt, Human adenovirus A
ccacaccuccacccaaucaaa

SEQ ID NO: 1539472 - RNA, 22 nt, Human adenovirus A
gucgcgcacugggccaggagga

SEQ ID NO: 1539473 - RNA, 19 nt, Human adenovirus A
cacuuauugcugcggccau

SEQ ID NO: 1539474 - RNA, 17 nt, Human adenovirus A
gcaaauauaaaagcaca

SEQ ID NO: 1539475 - RNA, 14 nt, Human adenovirus A
cccaacccuuccca

SEQ ID NO: 1539476 - RNA, 19 nt, Human adenovirus A
gagcuaagcgacaaagagc

SEQ ID NO: 1539477 - RNA, 19 nt, Human adenovirus A
acaacacggaguaaugaac

SEQ ID NO: 1539478 - RNA, 13 nt, Human adenovirus A
aucuucaaacacc

SEQ ID NO: 1539479 - RNA, 23 nt, Human adenovirus A
gaacuggaaggugacaaugcccg

SEQ ID NO: 1539480 - RNA, 19 nt, Human adenovirus A
cuucaagacguuccauggc

SEQ ID NO: 1539481 - RNA, 14 nt, Human adenovirus A
auauaaaguuuaaa

SEQ ID NO: 1539482 - RNA, 14 nt, Human adenovirus A
ucaaggaaauacua

SEQ ID NO: 1539483 - RNA, 15 nt, Human adenovirus A
agauuauacaaacuu

SEQ ID NO: 1539484 - RNA, 23 nt, Human adenovirus A
aaagcuggguugguguugcuuug

SEQ ID NO: 1539485 - RNA, 19 nt, Human adenovirus A
cgcacuggucgcaccacug

SEQ ID NO: 1539486 - RNA, 16 nt, Human adenovirus A
uuggaguuggaagaag

SEQ ID NO: 1539487 - RNA, 15 nt, Human adenovirus A
gaacaucaacugugc

SEQ ID NO: 1539488 - RNA, 22 nt, Human adenovirus A
cuguaguuucuuuacaacugua

SEQ ID NO: 1539489 - RNA, 23 nt, Human adenovirus A
caugcgcgcggccagagcguugg

SEQ ID NO: 1539490 - RNA, 20 nt, Human adenovirus A
aaguaggauagcaccugccg

SEQ ID NO: 1539491 - RNA, 20 nt, Human adenovirus A
acaaaucagaagccagcagc

SEQ ID NO: 1539492 - RNA, 15 nt, Human adenovirus A
acaggugaaagugaa

SEQ ID NO: 1539493 - RNA, 20 nt, Human adenovirus A
uaugugaucauaacauguuu

SEQ ID NO: 1539494 - RNA, 15 nt, Human adenovirus A
cggcaacagcagcaa

SEQ ID NO: 1539495 - RNA, 14 nt, Human adenovirus A
uauuuuuucaaaau

SEQ ID NO: 1539496 - RNA, 23 nt, Human adenovirus A
cuggaaccauucccuauuuagac

SEQ ID NO: 1539497 - RNA, 21 nt, Human adenovirus A
gucugccauuccccacacguc

SEQ ID NO: 1539498 - RNA, 18 nt, Human adenovirus A
gccuaugugauaacccug

SEQ ID NO: 1539499 - RNA, 18 nt, Human adenovirus A
auaucaauguuauccaca

SEQ ID NO: 1539500 - RNA, 20 nt, Human adenovirus A
aaaauagggguaaugugguu

SEQ ID NO: 1539501 - RNA, 16 nt, Human adenovirus A
caagcgaacaggagcu

SEQ ID NO: 1539502 - RNA, 13 nt, Human adenovirus A
ucuuaaaaauuuu

SEQ ID NO: 1539503 - RNA, 22 nt, Human adenovirus A
aaucagaagccagcagcaaaga

SEQ ID NO: 1539504 - RNA, 22 nt, Human adenovirus A
cguaacuuucaaaaaagcuuua

SEQ ID NO: 1539505 - RNA, 22 nt, Human adenovirus A
cuagacgaggauccagaggagg

SEQ ID NO: 1539506 - RNA, 19 nt, Human adenovirus A
acgccuuacauguggagcu

SEQ ID NO: 1539507 - RNA, 18 nt, Human adenovirus A
cuuuuaaaaauuugcaag

SEQ ID NO: 1539508 - RNA, 20 nt, Human adenovirus A
ccgcugugagcaaaucucag

SEQ ID NO: 1539509 - RNA, 22 nt, Human adenovirus A
ggucaagaacacgaacugaaaa

SEQ ID NO: 1539510 - RNA, 14 nt, Human adenovirus A
uacgacccucugac

SEQ ID NO: 1539511 - RNA, 15 nt, Human adenovirus A
guaccgcgaagccau

SEQ ID NO: 1539512 - RNA, 22 nt, Human adenovirus A
aacaacagcuucuaaaagagcc

SEQ ID NO: 1539513 - RNA, 22 nt, Human adenovirus A
aggugacaugauaugaaguuuu

SEQ ID NO: 1539514 - RNA, 20 nt, Human adenovirus A
uuacaagcacgccaaagcca

SEQ ID NO: 1539515 - RNA, 14 nt, Human adenovirus A
guccuuccagggac

SEQ ID NO: 1539516 - RNA, 18 nt, Human adenovirus A
ggaugaauuucagcgggg

SEQ ID NO: 1539517 - RNA, 22 nt, Human adenovirus A
uugauucagcuaacaaugcagc

SEQ ID NO: 1539518 - RNA, 22 nt, Human adenovirus A
aagaccccauuguaacugaaaa

SEQ ID NO: 1539519 - RNA, 19 nt, Human adenovirus A
uuccagacaaaaaaaauac

SEQ ID NO: 1539520 - RNA, 13 nt, Human adenovirus A
uaauacuggcuaa

SEQ ID NO: 1539521 - RNA, 20 nt, Human adenovirus A
uccugcuccuuuucuuacau

SEQ ID NO: 1539522 - RNA, 19 nt, Human adenovirus A
cugguugagcgcuggccag

SEQ ID NO: 1539523 - RNA, 17 nt, Human adenovirus A
cgggacccugccgcugc

SEQ ID NO: 1539524 - RNA, 22 nt, Human adenovirus A
ccauaaggcggcguccuuucuc

SEQ ID NO: 1539525 - RNA, 13 nt, Human adenovirus A
ucacgccguagac

SEQ ID NO: 1539526 - RNA, 21 nt, Human adenovirus A
uucauauauguaucuggacau

SEQ ID NO: 1539527 - RNA, 24 nt, Human adenovirus A
ugagcccgaaguugacuggcaugg

SEQ ID NO: 1539528 - RNA, 14 nt, Human adenovirus A
caauuucugccauu

SEQ ID NO: 1539529 - RNA, 14 nt, Human adenovirus A
ugaagauagacagc

SEQ ID NO: 1539530 - RNA, 18 nt, Human adenovirus A
auggaguuuagaaggaaa

SEQ ID NO: 1539531 - RNA, 20 nt, Human adenovirus A
cauacuuaccaaagccaugg

SEQ ID NO: 1539532 - RNA, 13 nt, Human adenovirus A
aaagucacaaggg

SEQ ID NO: 1539533 - RNA, 21 nt, Human adenovirus A
acuuugagcuuccagaggagc

SEQ ID NO: 1539534 - RNA, 18 nt, Human adenovirus A
ccagcuaacgccaccagc

SEQ ID NO: 1539535 - RNA, 17 nt, Human adenovirus A
acucuggcgaagggccu

SEQ ID NO: 1539536 - RNA, 15 nt, Human adenovirus A
ucuuaggguuugauu

SEQ ID NO: 1539537 - RNA, 13 nt, Human adenovirus A
gaauuugaaaaca

SEQ ID NO: 1539538 - RNA, 18 nt, Human adenovirus A
agaaaaaccaccaggugu

SEQ ID NO: 1539539 - RNA, 21 nt, Human adenovirus A
cauaaagagucucaaaagcag

SEQ ID NO: 1539540 - RNA, 21 nt, Human adenovirus A
uaaagaaaaaacuuaaauuga

SEQ ID NO: 1539541 - RNA, 20 nt, Human adenovirus A
uuuccuguuacauaccuggc

SEQ ID NO: 1539542 - RNA, 21 nt, Human adenovirus A
cauuugugccucgucagaaca

SEQ ID NO: 1539543 - RNA, 13 nt, Human adenovirus A
caauauuccagcu

SEQ ID NO: 1539544 - RNA, 12 nt, Human adenovirus A
uugcauuuccca

SEQ ID NO: 1539545 - RNA, 16 nt, Human adenovirus A
caggcuggaggugcag

SEQ ID NO: 1539546 - RNA, 21 nt, Human adenovirus A
guugcuuuccaaaugccccca

SEQ ID NO: 1539547 - RNA, 16 nt, Human adenovirus A
gcuuggccaguucccc

SEQ ID NO: 1539548 - RNA, 18 nt, Human adenovirus A
caugauggaucaaaaaca

SEQ ID NO: 1539549 - RNA, 13 nt, Human adenovirus A
ccuuggaagaggu

SEQ ID NO: 1539550 - RNA, 17 nt, Human adenovirus A
gacgcucuggcagggga

SEQ ID NO: 1539551 - RNA, 14 nt, Human adenovirus A
uucuuaagcaguga

SEQ ID NO: 1539552 - RNA, 20 nt, Human adenovirus A
agcaagcagcgccaaauaga

SEQ ID NO: 1539553 - RNA, 19 nt, Human adenovirus A
ucauugaauuaccagaaug

SEQ ID NO: 1539554 - RNA, 18 nt, Human adenovirus A
cauugcgauaaacuggau

SEQ ID NO: 1539555 - RNA, 14 nt, Human adenovirus A
acaagccgcaggac

SEQ ID NO: 1539556 - RNA, 21 nt, Human adenovirus A
uacuuggcuaguagagacauc

SEQ ID NO: 1539557 - RNA, 21 nt, Human adenovirus A
aucucaccuggaccuuuaacg

SEQ ID NO: 1539558 - RNA, 13 nt, Human adenovirus A
aaaaggcuggaag

SEQ ID NO: 1539559 - RNA, 16 nt, Human adenovirus A
gccuacccuucuuuau

SEQ ID NO: 1539560 - RNA, 15 nt, Human adenovirus A
agcgaacaggagcug

SEQ ID NO: 1539561 - RNA, 18 nt, Human adenovirus A
acaauaaucacaacacag

SEQ ID NO: 1539562 - RNA, 16 nt, Human adenovirus A
caccucgcuccaauuu

SEQ ID NO: 1539563 - RNA, 17 nt, Human adenovirus A
aacaucgcaaaacacgu

SEQ ID NO: 1539564 - RNA, 13 nt, Human adenovirus A
guaacucuuguaa

SEQ ID NO: 1539565 - RNA, 14 nt, Human adenovirus A
cacagucacaaggu

SEQ ID NO: 1539566 - RNA, 14 nt, Human adenovirus A
caugcuaaaagcuu

SEQ ID NO: 1539567 - RNA, 23 nt, Human adenovirus A
cuaauggagcggcugacagagcg

SEQ ID NO: 1539568 - RNA, 12 nt, Human adenovirus A
cuaauagcacuu

SEQ ID NO: 1539569 - RNA, 20 nt, Human adenovirus A
aaucauacaaaucagaagcc

SEQ ID NO: 1539570 - RNA, 16 nt, Human adenovirus A
cgcgcacugggccagg

SEQ ID NO: 1539571 - RNA, 18 nt, Human adenovirus A
cggcgauugauaucuuga

SEQ ID NO: 1539572 - RNA, 16 nt, Human adenovirus A
acagaccccaaaggac

SEQ ID NO: 1539573 - RNA, 14 nt, Human adenovirus A
cccacagccagugg

SEQ ID NO: 1539574 - RNA, 12 nt, Human adenovirus A
cgagcugccacc

SEQ ID NO: 1539575 - RNA, 22 nt, Human adenovirus A
aggagcggaacccugcgguggu

SEQ ID NO: 1539576 - RNA, 14 nt, Human adenovirus A
uaacgaggugcagc

SEQ ID NO: 1539577 - RNA, 12 nt, Human adenovirus A
ucagcugcaaac

SEQ ID NO: 1539578 - RNA, 18 nt, Human adenovirus A
agaaaguucaccuccagg

SEQ ID NO: 1539579 - RNA, 23 nt, Human adenovirus A
aggaguaauaaaaccugugccuc

SEQ ID NO: 1539580 - RNA, 14 nt, Human adenovirus A
ggucuuaaacuuuc

SEQ ID NO: 1539581 - RNA, 18 nt, Human adenovirus A
gcagaccuacgguggcag

SEQ ID NO: 1539582 - RNA, 19 nt, Human adenovirus A
ucccucuuggccagcugcc

SEQ ID NO: 1539583 - RNA, 21 nt, Human adenovirus A
uguaaaaaaguguuuguuuga

SEQ ID NO: 1539584 - RNA, 19 nt, Human adenovirus A
uuaaauugagaugguguua

SEQ ID NO: 1539585 - RNA, 22 nt, Human adenovirus A
uaaccacgguuccacggugcac

SEQ ID NO: 1539586 - RNA, 16 nt, Human adenovirus A
gcgccaggauguuggg

SEQ ID NO: 1539587 - RNA, 13 nt, Human adenovirus A
uccuuucucugug

SEQ ID NO: 1539588 - RNA, 20 nt, Human adenovirus A
aaccauucccuauuuagacg

SEQ ID NO: 1539589 - RNA, 16 nt, Human adenovirus A
acaucacucuauuuca

SEQ ID NO: 1539590 - RNA, 20 nt, Human adenovirus A
caaauacugcuagaacaagc

SEQ ID NO: 1539591 - RNA, 15 nt, Human adenovirus A
agcuaaaucugccac

SEQ ID NO: 1539592 - RNA, 17 nt, Human adenovirus A
ugcguagcaguaucagu

SEQ ID NO: 1539593 - RNA, 23 nt, Human adenovirus A
gcgcggacuuucaacaggcggga

SEQ ID NO: 1539594 - RNA, 15 nt, Human adenovirus A
agcagcuuggcuaua

SEQ ID NO: 1539595 - RNA, 19 nt, Human adenovirus A
acaccuuuuguuaauuaag

SEQ ID NO: 1539596 - RNA, 16 nt, Human adenovirus A
acuuaccccugggcuu

SEQ ID NO: 1539597 - RNA, 16 nt, Human adenovirus A
cgcaguuuuucuacca

SEQ ID NO: 1539598 - RNA, 14 nt, Human adenovirus A
cuacagacaaacaa

SEQ ID NO: 1539599 - RNA, 17 nt, Human adenovirus A
guguaaacacuaccggc

SEQ ID NO: 1539600 - RNA, 14 nt, Human adenovirus A
gagccacaggaaag

SEQ ID NO: 1539601 - RNA, 16 nt, Human adenovirus A
aagcgucccaugagcu

SEQ ID NO: 1539602 - RNA, 16 nt, Human adenovirus A
auccuacaaaaaguaa

SEQ ID NO: 1539603 - RNA, 23 nt, Human adenovirus A
acuaaccgucgccagcaagugcc

SEQ ID NO: 1539604 - RNA, 22 nt, Human adenovirus A
gucacuacagacaaacaaguuc

SEQ ID NO: 1539605 - RNA, 19 nt, Human adenovirus A
uagacaucgcgcauaggag

SEQ ID NO: 1539606 - RNA, 18 nt, Human adenovirus A
caaagccauggcgaccag

SEQ ID NO: 1539607 - RNA, 20 nt, Human adenovirus A
uaauggaguuguagacauag

SEQ ID NO: 1539608 - RNA, 23 nt, Human adenovirus A
ucuuaguuuggcagacaaggugg

SEQ ID NO: 1539609 - RNA, 14 nt, Human adenovirus A
gagcguucugggau

SEQ ID NO: 1539610 - RNA, 18 nt, Human adenovirus A
ugccaccucuagaaacug

SEQ ID NO: 1539611 - RNA, 20 nt, Human adenovirus A
ugcgcaagcgcugaaacagg

SEQ ID NO: 1539612 - RNA, 13 nt, Human adenovirus A
gacguaaugugcg

SEQ ID NO: 1539613 - RNA, 17 nt, Human adenovirus A
ccggaguacgucagaau

SEQ ID NO: 1539614 - RNA, 22 nt, Human adenovirus A
gcaaacgcugaugccacuugaa

SEQ ID NO: 1539615 - RNA, 16 nt, Human adenovirus A
agcaaaacgcugggcu

SEQ ID NO: 1539616 - RNA, 16 nt, Human adenovirus A
aacuuaguaacagcau

SEQ ID NO: 1539617 - RNA, 16 nt, Human adenovirus A
gccaugcaaagccagc

SEQ ID NO: 1539618 - RNA, 18 nt, Human adenovirus A
agccagcagcaaagaaag

SEQ ID NO: 1539619 - RNA, 17 nt, Human adenovirus A
cuuaguuuuaaauuguu

SEQ ID NO: 1539620 - RNA, 18 nt, Human adenovirus A
uagccugcuuucagcacu

SEQ ID NO: 1539621 - RNA, 13 nt, Human adenovirus A
cauugcgcaaaau

SEQ ID NO: 1539622 - RNA, 21 nt, Human adenovirus A
cacgggcuggggacugggugc

SEQ ID NO: 1539623 - RNA, 14 nt, Human adenovirus A
cuguucauauugug

SEQ ID NO: 1539624 - RNA, 20 nt, Human adenovirus A
acugauuuugcagguuuaaa

SEQ ID NO: 1539625 - RNA, 22 nt, Human adenovirus A
ccuggagcgagaucuuccaaca

SEQ ID NO: 1539626 - RNA, 15 nt, Human adenovirus A
cuagaguguguuuaa

SEQ ID NO: 1539627 - RNA, 13 nt, Human adenovirus A
guuaaauuaaaga

SEQ ID NO: 1539628 - RNA, 19 nt, Human adenovirus A
auuuuucuuuuauuucucu

SEQ ID NO: 1539629 - RNA, 22 nt, Human adenovirus A
ugaaguuuugauuguauuuuga

SEQ ID NO: 1539630 - RNA, 21 nt, Human adenovirus A
aaugguggcuaggaaaacaaa

SEQ ID NO: 1539631 - RNA, 16 nt, Human adenovirus A
gcagcgccaaauagag

SEQ ID NO: 1539632 - RNA, 18 nt, Human adenovirus A
uguaauugaaguaagcug

SEQ ID NO: 1539633 - RNA, 15 nt, Human adenovirus A
guguugcuuugaaua

SEQ ID NO: 1539634 - RNA, 17 nt, Human adenovirus A
caguguuuucagcaauu

SEQ ID NO: 1539635 - RNA, 23 nt, Human adenovirus A
uuccccgauaagauuguaauuuu

SEQ ID NO: 1539636 - RNA, 13 nt, Human adenovirus A
gcgacggcggcgc

SEQ ID NO: 1539637 - RNA, 21 nt, Human adenovirus A
caugguuugcuaacagcucuc

SEQ ID NO: 1539638 - RNA, 18 nt, Human adenovirus A
ucacaccaaacuggccau

SEQ ID NO: 1539639 - RNA, 18 nt, Human adenovirus A
guaagagcaggcuggagg

SEQ ID NO: 1539640 - RNA, 22 nt, Human adenovirus A
aggaaagacagccaagaccagu

SEQ ID NO: 1539641 - RNA, 13 nt, Human adenovirus A
cugccuguugaau

SEQ ID NO: 1539642 - RNA, 13 nt, Human adenovirus A
uggcugaagagga

SEQ ID NO: 1539643 - RNA, 18 nt, Human adenovirus A
gcugguaacuacuucacc

SEQ ID NO: 1539644 - RNA, 17 nt, Human adenovirus A
gugccccucgaccugca

SEQ ID NO: 1539645 - RNA, 23 nt, Human adenovirus A
aaagcccgcgcgcggacuuucaa

SEQ ID NO: 1539646 - RNA, 19 nt, Human adenovirus A
ucaagacuauucuagcaaa

SEQ ID NO: 1539647 - RNA, 20 nt, Human adenovirus A
auucaggugccgcaaaaauu

SEQ ID NO: 1539648 - RNA, 21 nt, Human adenovirus A
gaaagaggcagccguuucagg

SEQ ID NO: 1539649 - RNA, 22 nt, Human adenovirus A
uacacucauguauuuuuucaaa

SEQ ID NO: 1539650 - RNA, 18 nt, Human adenovirus A
ucugaucaacgacuaaaa

SEQ ID NO: 1539651 - RNA, 21 nt, Human adenovirus A
acaacagcggcguaaacucau

SEQ ID NO: 1539652 - RNA, 18 nt, Human adenovirus A
acugaauauuuagacuau

SEQ ID NO: 1539653 - RNA, 20 nt, Human adenovirus A
uuugacccauuugacacauc

SEQ ID NO: 1539654 - RNA, 18 nt, Human adenovirus A
aaagcagaugggaaaauc

SEQ ID NO: 1539655 - RNA, 21 nt, Human adenovirus A
accuccauuauuucuuccucg

SEQ ID NO: 1539656 - RNA, 15 nt, Human adenovirus A
uaguucuuuucuuua

SEQ ID NO: 1539657 - RNA, 19 nt, Human adenovirus A
gcgacucccuuccgugguu

SEQ ID NO: 1539658 - RNA, 12 nt, Human adenovirus A
aaccaaauacug

SEQ ID NO: 1539659 - RNA, 14 nt, Human adenovirus A
acgaguacaugaac

SEQ ID NO: 1539660 - RNA, 23 nt, Human adenovirus A
acaugcgggggaugaaggaagcg

SEQ ID NO: 1539661 - RNA, 18 nt, Human adenovirus A
gcggcguaguaugcgcag

SEQ ID NO: 1539662 - RNA, 22 nt, Human adenovirus A
caguaggcgaucguucaacuuu

SEQ ID NO: 1539663 - RNA, 21 nt, Human adenovirus A
uaaaucuuccgccaaagguaa

SEQ ID NO: 1539664 - RNA, 13 nt, Human adenovirus A
cagaauauaagaa

SEQ ID NO: 1539665 - RNA, 12 nt, Human adenovirus A
cgcuccauccaa

SEQ ID NO: 1539666 - RNA, 19 nt, Human adenovirus A
agccgcagcaccuggagcg

SEQ ID NO: 1539667 - RNA, 15 nt, Human adenovirus A
ggcaaagaacaucaa

SEQ ID NO: 1539668 - RNA, 13 nt, Human adenovirus A
caacacagcacua

SEQ ID NO: 1539669 - RNA, 16 nt, Human adenovirus A
uguaucagucuggacc

SEQ ID NO: 1539670 - RNA, 20 nt, Human adenovirus A
uuaauccuaggcaaagaaac

SEQ ID NO: 1539671 - RNA, 23 nt, Human adenovirus A
guucaacaacagcuucuaaaaga

SEQ ID NO: 1539672 - RNA, 22 nt, Human adenovirus A
gauugggcgcccacucuccuga

SEQ ID NO: 1539673 - RNA, 22 nt, Human adenovirus A
cucuuauaggccaaacagcugu

SEQ ID NO: 1539674 - RNA, 15 nt, Human adenovirus A
cagaacauacaacuu

SEQ ID NO: 1539675 - RNA, 16 nt, Human adenovirus A
cuuugaccggucaggc

SEQ ID NO: 1539676 - RNA, 13 nt, Human adenovirus A
gaggacuuggaag

SEQ ID NO: 1539677 - RNA, 13 nt, Human adenovirus A
augcuuggaagaa

SEQ ID NO: 1539678 - RNA, 15 nt, Human adenovirus A
ggaauaauaguuccc

SEQ ID NO: 1539679 - RNA, 18 nt, Human adenovirus A
accucacaaggucuuaaa

SEQ ID NO: 1539680 - RNA, 19 nt, Human adenovirus A
agaucuucguaggaaagau

SEQ ID NO: 1539681 - RNA, 20 nt, Human adenovirus A
ggaggagcuaaaacaagguc

SEQ ID NO: 1539682 - RNA, 19 nt, Human adenovirus A
guccaauuucguuccagac

SEQ ID NO: 1539683 - RNA, 17 nt, Human adenovirus A
ggaggguuugcauuuac

SEQ ID NO: 1539684 - RNA, 18 nt, Human adenovirus A
uuacaagcacgccaaagc

SEQ ID NO: 1539685 - RNA, 14 nt, Human adenovirus A
aagaaucgcaagca

SEQ ID NO: 1539686 - RNA, 19 nt, Human adenovirus A
uaaaagagccacagcucug

SEQ ID NO: 1539687 - RNA, 17 nt, Human adenovirus A
ugcugagguuaaaagga

SEQ ID NO: 1539688 - RNA, 20 nt, Human adenovirus A
aagauguaugaguaagagca

SEQ ID NO: 1539689 - RNA, 14 nt, Human adenovirus A
ugguuaaacugccu

SEQ ID NO: 1539690 - RNA, 20 nt, Human adenovirus A
gauaauggggucaugaaagu

SEQ ID NO: 1539691 - RNA, 17 nt, Human adenovirus A
gccacacuuaacuuuuu

SEQ ID NO: 1539692 - RNA, 21 nt, Human adenovirus A
agggagauguccuguuuaaac

SEQ ID NO: 1539693 - RNA, 16 nt, Human adenovirus A
gugaugaaaguagaaa

SEQ ID NO: 1539694 - RNA, 17 nt, Human adenovirus A
cauggacucuacuaaca

SEQ ID NO: 1539695 - RNA, 20 nt, Human adenovirus A
cuacuucaccgcgcaagcuu

SEQ ID NO: 1539696 - RNA, 15 nt, Human adenovirus A
caaacaauaacauug

SEQ ID NO: 1539697 - RNA, 21 nt, Human adenovirus A
ucauacaaaucagaagccagc

SEQ ID NO: 1539698 - RNA, 22 nt, Human adenovirus A
uguccacuugcggaacaauaaa

SEQ ID NO: 1539699 - RNA, 21 nt, Human adenovirus A
cgucacccaagggugcagcuc

SEQ ID NO: 1539700 - RNA, 14 nt, Human adenovirus A
cagcaagcagcgcc

SEQ ID NO: 1539701 - RNA, 14 nt, Human adenovirus A
cuucacccugggaa

SEQ ID NO: 1539702 - RNA, 22 nt, Human adenovirus A
uucaagcgcgacuaguccguuu

SEQ ID NO: 1539703 - RNA, 17 nt, Human adenovirus A
gaucguguuauguggcg

SEQ ID NO: 1539704 - RNA, 18 nt, Human adenovirus A
accauguaauaauugagu

SEQ ID NO: 1539705 - RNA, 20 nt, Human adenovirus A
accuacgguggcagccaagc

SEQ ID NO: 1539706 - RNA, 16 nt, Human adenovirus A
cucgcaccagaaagca

SEQ ID NO: 1539707 - RNA, 19 nt, Human adenovirus A
uauuguauuuccagagccc

SEQ ID NO: 1539708 - RNA, 16 nt, Human adenovirus A
acguaaaccuugaaau

SEQ ID NO: 1539709 - RNA, 20 nt, Human adenovirus A
cauuguaacugaaaauggaa

SEQ ID NO: 1539710 - RNA, 17 nt, Human adenovirus A
cagcgguaguuguugcu

SEQ ID NO: 1539711 - RNA, 21 nt, Human adenovirus A
gccugaaccuaauagcacuuu

SEQ ID NO: 1539712 - RNA, 23 nt, Human adenovirus A
cugcgucuccccauucgcagcau

SEQ ID NO: 1539713 - RNA, 17 nt, Human adenovirus A
cagcugauuucagcuuc

SEQ ID NO: 1539714 - RNA, 16 nt, Human adenovirus A
gacaccgcccaggcag

SEQ ID NO: 1539715 - RNA, 18 nt, Human adenovirus A
acgcgaugaagcacgcag

SEQ ID NO: 1539716 - RNA, 13 nt, Human adenovirus A
ccacaugggaagg

SEQ ID NO: 1539717 - RNA, 19 nt, Human adenovirus A
aauccaaggaugacaacau

SEQ ID NO: 1539718 - RNA, 18 nt, Human adenovirus A
accuugaaaugccagaca

SEQ ID NO: 1539719 - RNA, 18 nt, Human adenovirus A
caucuaaaccuauaacaa

SEQ ID NO: 1539720 - RNA, 17 nt, Human adenovirus A
gaucaacgacuaaaaca

SEQ ID NO: 1539721 - RNA, 11 nt, Human adenovirus A
uaguucaucuu

SEQ ID NO: 1539722 - RNA, 19 nt, Human adenovirus A
guaauugaaguaagcuguu

SEQ ID NO: 1539723 - RNA, 17 nt, Human adenovirus A
cagucgccgcagagagc

SEQ ID NO: 1539724 - RNA, 18 nt, Human adenovirus A
cgaugaugccgcaguggu

SEQ ID NO: 1539725 - RNA, 23 nt, Human adenovirus A
gagacuucccacagccagugggu

SEQ ID NO: 1539726 - RNA, 20 nt, Human adenovirus A
cgcggcgguguaugccaaca

SEQ ID NO: 1539727 - RNA, 15 nt, Human adenovirus A
cugaagugccucaaa

SEQ ID NO: 1539728 - RNA, 15 nt, Human adenovirus A
uccugcgacaaaugc

SEQ ID NO: 1539729 - RNA, 17 nt, Human adenovirus A
ugugcuauuaaagcuuu

SEQ ID NO: 1539730 - RNA, 15 nt, Human adenovirus A
cuuuccgccauggcu

SEQ ID NO: 1539731 - RNA, 23 nt, Human adenovirus A
cugccgcugcaaucuuugcaccc

SEQ ID NO: 1539732 - RNA, 21 nt, Human adenovirus A
agucaaugcuucugaaacaaa

SEQ ID NO: 1539733 - RNA, 22 nt, Human adenovirus A
ugcuccaguuauugacaaacgc

SEQ ID NO: 1539734 - RNA, 18 nt, Human adenovirus A
cggacgcuggcaaugaca

SEQ ID NO: 1539735 - RNA, 17 nt, Human adenovirus A
gcauaaccacuugcgcc

SEQ ID NO: 1539736 - RNA, 17 nt, Human adenovirus A
ugcguaaaucucgcagg

SEQ ID NO: 1539737 - RNA, 17 nt, Human adenovirus A
gacagcuuuuauaugcg

SEQ ID NO: 1539738 - RNA, 13 nt, Human adenovirus A
cuguacugcaaac

SEQ ID NO: 1539739 - RNA, 16 nt, Human adenovirus A
uuccaccaaaugcucu

SEQ ID NO: 1539740 - RNA, 15 nt, Human adenovirus A
cgcuuuugccagacu

SEQ ID NO: 1539741 - RNA, 22 nt, Human adenovirus A
accugagucccggucuggugca

SEQ ID NO: 1539742 - RNA, 14 nt, Human adenovirus A
agcgguuauugauu

SEQ ID NO: 1539743 - RNA, 21 nt, Human adenovirus A
cgaccuucauuuuuucugggg

SEQ ID NO: 1539744 - RNA, 17 nt, Human adenovirus A
cauggaaaaacuuggaa

SEQ ID NO: 1539745 - RNA, 14 nt, Human adenovirus A
cacggcacgcggcc

SEQ ID NO: 1539746 - RNA, 14 nt, Human adenovirus A
gauagcaaagccau

SEQ ID NO: 1539747 - RNA, 15 nt, Human adenovirus A
cgcagcaacgcucaa

SEQ ID NO: 1539748 - RNA, 15 nt, Human adenovirus A
gucauggagaaggac

SEQ ID NO: 1539749 - RNA, 14 nt, Human adenovirus A
augagccugaaccu

SEQ ID NO: 1539750 - RNA, 17 nt, Human adenovirus A
uggaggcagcuggagug

SEQ ID NO: 1539751 - RNA, 22 nt, Human adenovirus A
aaccaccgccaugcgcgcggcc

SEQ ID NO: 1539752 - RNA, 12 nt, Human adenovirus A
caauaaaacaag

SEQ ID NO: 1539753 - RNA, 15 nt, Human adenovirus A
uggaguuggaagaag

SEQ ID NO: 1539754 - RNA, 15 nt, Human adenovirus A
aagcgugaguaagcc

SEQ ID NO: 1539755 - RNA, 20 nt, Human adenovirus A
uguaguggggauugggaagg

SEQ ID NO: 1539756 - RNA, 17 nt, Human adenovirus A
cugccuccuucccauuu

SEQ ID NO: 1539757 - RNA, 15 nt, Human adenovirus A
uuaaaaauuugcaag

SEQ ID NO: 1539758 - RNA, 21 nt, Human adenovirus A
gcguagaccaaccaccgccau

SEQ ID NO: 1539759 - RNA, 18 nt, Human adenovirus A
caguuugggcuaguucuu

SEQ ID NO: 1539760 - RNA, 21 nt, Human adenovirus A
aaaagcaaccaaaugagcaaa

SEQ ID NO: 1539761 - RNA, 17 nt, Human adenovirus A
gaacagacaccgcccag

SEQ ID NO: 1539762 - RNA, 16 nt, Human adenovirus A
gacccggaggcaacag

SEQ ID NO: 1539763 - RNA, 12 nt, Human adenovirus A
caauaaauacug

SEQ ID NO: 1539764 - RNA, 13 nt, Human adenovirus A
acauuauguaaag

SEQ ID NO: 1539765 - RNA, 22 nt, Human adenovirus A
cugccauuaauugaucaauuuc

SEQ ID NO: 1539766 - RNA, 17 nt, Human adenovirus A
ugcaucuacgaacgcaa

SEQ ID NO: 1539767 - RNA, 13 nt, Human adenovirus A
gagcgcccuuaac

SEQ ID NO: 1539768 - RNA, 18 nt, Human adenovirus A
acacgcuuuuacucacug

SEQ ID NO: 1539769 - RNA, 23 nt, Human adenovirus A
auguauucuuucuuuagaaacuu

SEQ ID NO: 1539770 - RNA, 15 nt, Human adenovirus A
gccaccauagccccu

SEQ ID NO: 1539771 - RNA, 16 nt, Human adenovirus A
uuggaaagcagcuugg

SEQ ID NO: 1539772 - RNA, 16 nt, Human adenovirus A
ucuagaacaaaaagga

SEQ ID NO: 1539773 - RNA, 14 nt, Human adenovirus A
ggaagaacauccaa

SEQ ID NO: 1539774 - RNA, 17 nt, Human adenovirus A
gcugggcucgaggacca

SEQ ID NO: 1539775 - RNA, 14 nt, Human adenovirus A
aauaaaacuuccaa

SEQ ID NO: 1539776 - RNA, 13 nt, Human adenovirus A
gcugaaacaggua

SEQ ID NO: 1539777 - RNA, 15 nt, Human adenovirus A
gcguguuagacaugg

SEQ ID NO: 1539778 - RNA, 21 nt, Human adenovirus A
ggugaaugggguacgagcccg

SEQ ID NO: 1539779 - RNA, 12 nt, Human adenovirus A
acauuuuaacug

SEQ ID NO: 1539780 - RNA, 15 nt, Human adenovirus A
cagaagccagcagca

SEQ ID NO: 1539781 - RNA, 12 nt, Human adenovirus A
ucaugaaacucu

SEQ ID NO: 1539782 - RNA, 22 nt, Human adenovirus A
acaguauugugggacugggagu

SEQ ID NO: 1539783 - RNA, 17 nt, Human adenovirus A
caguacgaggacugauc

SEQ ID NO: 1539784 - RNA, 15 nt, Human adenovirus A
aguacacuugggaaa

SEQ ID NO: 1539785 - RNA, 15 nt, Human adenovirus A
cuuagaugcauccug

SEQ ID NO: 1539786 - RNA, 17 nt, Human adenovirus A
acaucguccaagaucuu

SEQ ID NO: 1539787 - RNA, 23 nt, Human adenovirus A
aagaaucuugggagagucaggca

SEQ ID NO: 1539788 - RNA, 21 nt, Human adenovirus A
acgcuauaacaguaccaaugu

SEQ ID NO: 1539789 - RNA, 23 nt, Human adenovirus A
caccucaaaaucuaagccaugca

SEQ ID NO: 1539790 - RNA, 17 nt, Human adenovirus A
caguuacaacuugcuuc

SEQ ID NO: 1539791 - RNA, 20 nt, Human adenovirus A
cggcucuuuugcagcuccaa

SEQ ID NO: 1539792 - RNA, 14 nt, Human adenovirus A
gaagagcugcugca

SEQ ID NO: 1539793 - RNA, 15 nt, Human adenovirus A
gauaaacaaaagcaa

SEQ ID NO: 1539794 - RNA, 20 nt, Human adenovirus A
guuuuggcuuaagguggaaa

SEQ ID NO: 1539795 - RNA, 16 nt, Human adenovirus A
ucugggguuaagcagu

SEQ ID NO: 1539796 - RNA, 13 nt, Human adenovirus A
ggcacgagccagc

SEQ ID NO: 1539797 - RNA, 14 nt, Human adenovirus A
caccuuuuguuaau

SEQ ID NO: 1539798 - RNA, 16 nt, Human adenovirus A
cagagagaaaagcaug

SEQ ID NO: 1539799 - RNA, 21 nt, Human adenovirus A
aguuaggucaucguaggacaa

SEQ ID NO: 1539800 - RNA, 20 nt, Human adenovirus A
gaaaaacaguacaaagccag

SEQ ID NO: 1539801 - RNA, 13 nt, Human adenovirus A
ggacaccauggua

SEQ ID NO: 1539802 - RNA, 19 nt, Human adenovirus A
aaaucagaagccagcagca

SEQ ID NO: 1539803 - RNA, 13 nt, Human adenovirus A
auacuaaagaaac

SEQ ID NO: 1539804 - RNA, 20 nt, Human adenovirus A
auacgcgugguuaaacugcc

SEQ ID NO: 1539805 - RNA, 19 nt, Human adenovirus A
agccaugcuaugcaggcag

SEQ ID NO: 1539806 - RNA, 15 nt, Human adenovirus A
gcauaugaacaaacg

SEQ ID NO: 1539807 - RNA, 17 nt, Human adenovirus A
cuaucaucaaacugccu

SEQ ID NO: 1539808 - RNA, 18 nt, Human adenovirus A
aucgccccgcugcaauuu

SEQ ID NO: 1539809 - RNA, 14 nt, Human adenovirus A
aacgggcagccugu

SEQ ID NO: 1539810 - RNA, 14 nt, Human adenovirus A
gacacaaaagcucu

SEQ ID NO: 1539811 - RNA, 18 nt, Human adenovirus A
cauuuuuugaaaagacug

SEQ ID NO: 1539812 - RNA, 17 nt, Human adenovirus A
cauuuaagcaacauuaa

SEQ ID NO: 1539813 - RNA, 13 nt, Human adenovirus A
uacggcugucaug

SEQ ID NO: 1539814 - RNA, 23 nt, Human adenovirus A
acaugauggaucuggagccacag

SEQ ID NO: 1539815 - RNA, 17 nt, Human adenovirus A
cagaauuugugcuaccc

SEQ ID NO: 1539816 - RNA, 17 nt, Human adenovirus A
cgagcucccggaggaag

SEQ ID NO: 1539817 - RNA, 23 nt, Human adenovirus A
caacaguuuaagucgagauucau

SEQ ID NO: 1539818 - RNA, 14 nt, Human adenovirus A
ggagacguuuuugc

SEQ ID NO: 1539819 - RNA, 11 nt, Human adenovirus A
caccugccauu

SEQ ID NO: 1539820 - RNA, 13 nt, Human adenovirus A
gucaaaaaagcaa

SEQ ID NO: 1539821 - RNA, 16 nt, Human adenovirus A
cgccauccgcaggcag

SEQ ID NO: 1539822 - RNA, 21 nt, Human adenovirus A
uaagagcaaagguaucucuga

SEQ ID NO: 1539823 - RNA, 11 nt, Human adenovirus A
acuaacaccaa

SEQ ID NO: 1539824 - RNA, 13 nt, Human adenovirus A
guuuagaaggaaa

SEQ ID NO: 1539825 - RNA, 12 nt, Human adenovirus A
gcaggaguugca

SEQ ID NO: 1539826 - RNA, 14 nt, Human adenovirus A
uucugcugucauuu

SEQ ID NO: 1539827 - RNA, 19 nt, Human adenovirus A
gcuuccguagccuugcagc

SEQ ID NO: 1539828 - RNA, 16 nt, Human adenovirus A
gcauuaaaugguuaac

SEQ ID NO: 1539829 - RNA, 12 nt, Human adenovirus A
uacacuggcugg

SEQ ID NO: 1539830 - RNA, 22 nt, Human adenovirus A
ggcguuccgucaaaaaagcaaa

SEQ ID NO: 1539831 - RNA, 18 nt, Human adenovirus A
uacacgcugcccacucag

SEQ ID NO: 1539832 - RNA, 21 nt, Human adenovirus A
ccuacauuggaguuggaagaa

SEQ ID NO: 1539833 - RNA, 16 nt, Human adenovirus A
cgcugaaacagcaggg

SEQ ID NO: 1539834 - RNA, 22 nt, Human adenovirus A
cacuuaugcucccacacgcagc

SEQ ID NO: 1539835 - RNA, 20 nt, Human adenovirus A
ggacggucgaccuguggcac

SEQ ID NO: 1539836 - RNA, 22 nt, Human adenovirus A
ggcagucacaaguacauccagg

SEQ ID NO: 1539837 - RNA, 18 nt, Human adenovirus A
agguacagaggaaauugu

SEQ ID NO: 1539838 - RNA, 16 nt, Human adenovirus A
gacugcugcgugagga

SEQ ID NO: 1539839 - RNA, 12 nt, Human adenovirus A
uuuggaggcagc

SEQ ID NO: 1539840 - RNA, 14 nt, Human adenovirus A
agcggucuuaaaaa

SEQ ID NO: 1539841 - RNA, 22 nt, Human adenovirus A
aacugcuccccucaacagcaca

SEQ ID NO: 1539842 - RNA, 16 nt, Human adenovirus A
cuuugggagacagaac

SEQ ID NO: 1539843 - RNA, 21 nt, Human adenovirus A
caugucgcauaaugaaaacaa

SEQ ID NO: 1539844 - RNA, 14 nt, Human adenovirus A
gaacuaaacaaacu

SEQ ID NO: 1539845 - RNA, 22 nt, Human adenovirus A
ugccauuaauugaucaauuucu

SEQ ID NO: 1539846 - RNA, 22 nt, Human adenovirus A
aguugcacauauucgcgugcca

SEQ ID NO: 1539847 - RNA, 13 nt, Human adenovirus A
ggcggucugccau

SEQ ID NO: 1539848 - RNA, 17 nt, Human adenovirus A
gcuacaaaguccucagg

SEQ ID NO: 1539849 - RNA, 14 nt, Human adenovirus A
cucuuggccagcug

SEQ ID NO: 1539850 - RNA, 17 nt, Human adenovirus A
uacaucuuuuacuaaaa

SEQ ID NO: 1539851 - RNA, 20 nt, Human adenovirus A
uagagcacaugaagguggau

SEQ ID NO: 1539852 - RNA, 20 nt, Human adenovirus A
agaacccaguaugcugaaga

SEQ ID NO: 1539853 - RNA, 14 nt, Human adenovirus A
gauucuucuuccca

SEQ ID NO: 1539854 - RNA, 15 nt, Human adenovirus A
ucaccacauugcgca

SEQ ID NO: 1539855 - RNA, 16 nt, Human adenovirus A
uacauacacucaugua

SEQ ID NO: 1539856 - RNA, 16 nt, Human adenovirus A
aagcauauaaaacuga

SEQ ID NO: 1539857 - RNA, 19 nt, Human adenovirus A
aaccauuuuauuagcucau

SEQ ID NO: 1539858 - RNA, 12 nt, Human adenovirus A
auggucuucaag

SEQ ID NO: 1539859 - RNA, 17 nt, Human adenovirus A
agcuggcgggagggcau

SEQ ID NO: 1539860 - RNA, 22 nt, Human adenovirus A
ucaccaugggaauagugcucua

SEQ ID NO: 1539861 - RNA, 15 nt, Human adenovirus A
cagcugguauuuggc

SEQ ID NO: 1539862 - RNA, 12 nt, Human adenovirus A
cauucaccagcc

SEQ ID NO: 1539863 - RNA, 19 nt, Human adenovirus A
cguuuugugcccguggauc

SEQ ID NO: 1539864 - RNA, 14 nt, Human adenovirus A
ucccagacugcugu

SEQ ID NO: 1539865 - RNA, 16 nt, Human adenovirus A
aagcaucacacagaaa

SEQ ID NO: 1539866 - RNA, 15 nt, Human adenovirus A
caacuuuauugccuu

SEQ ID NO: 1539867 - RNA, 21 nt, Human adenovirus A
gcgcucgcgcuuuggaggcag

SEQ ID NO: 1539868 - RNA, 20 nt, Human adenovirus A
ggcgagaaugggaggaaaga

SEQ ID NO: 1539869 - RNA, 14 nt, Human adenovirus A
cgccgcgacggcgg

SEQ ID NO: 1539870 - RNA, 13 nt, Human adenovirus A
cugucaccuacca

SEQ ID NO: 1539871 - RNA, 22 nt, Human adenovirus A
gaucuucggguggacggagcca

SEQ ID NO: 1539872 - RNA, 14 nt, Human adenovirus A
cugacgucacuggc

SEQ ID NO: 1539873 - RNA, 20 nt, Human adenovirus A
auuuuaaaguaaauuaaaug

SEQ ID NO: 1539874 - RNA, 20 nt, Human adenovirus A
aacaaaagcaaagcaaaugc

SEQ ID NO: 1539875 - RNA, 16 nt, Human adenovirus A
caaaauugaaaaacug

SEQ ID NO: 1539876 - RNA, 18 nt, Human adenovirus A
uacaaaaaguaacaacag

SEQ ID NO: 1539877 - RNA, 22 nt, Human adenovirus A
caacaagaugaguaaagauauu

SEQ ID NO: 1539878 - RNA, 18 nt, Human adenovirus A
caagguuuuuacauucca

SEQ ID NO: 1539879 - RNA, 20 nt, Human adenovirus A
ggcauuccccauccaaaacc

SEQ ID NO: 1539880 - RNA, 16 nt, Human adenovirus A
ucaguguccaucagcc

SEQ ID NO: 1539881 - RNA, 12 nt, Human adenovirus A
gacccauauuag

SEQ ID NO: 1539882 - RNA, 16 nt, Human adenovirus A
uaugcuacaaaguccu

SEQ ID NO: 1539883 - RNA, 23 nt, Human adenovirus A
gcuuuguuggauagcaaagccau

SEQ ID NO: 1539884 - RNA, 14 nt, Human adenovirus A
gauuucagcuucua

SEQ ID NO: 1539885 - RNA, 15 nt, Human adenovirus A
cugacuauuucacaa

SEQ ID NO: 1539886 - RNA, 17 nt, Human adenovirus A
aaaccacguacgaccac

SEQ ID NO: 1539887 - RNA, 15 nt, Human adenovirus A
gacaacuuaacaaau

SEQ ID NO: 1539888 - RNA, 16 nt, Human adenovirus A
gguuaagcuggguggg

SEQ ID NO: 1539889 - RNA, 19 nt, Human adenovirus A
aauuuuaaaggguccaggg

SEQ ID NO: 1539890 - RNA, 11 nt, Human adenovirus A
auaaaaaauua

SEQ ID NO: 1539891 - RNA, 23 nt, Human adenovirus A
agcugccaccgucaauucuucuu

SEQ ID NO: 1539892 - RNA, 17 nt, Human adenovirus A
uacucggaauugucacc

SEQ ID NO: 1539893 - RNA, 17 nt, Human adenovirus A
caaauuuaaggccaggg

SEQ ID NO: 1539894 - RNA, 17 nt, Human adenovirus A
guaucuguuuggcucua

SEQ ID NO: 1539895 - RNA, 20 nt, Human adenovirus A
acaaaaagacugucaguguc

SEQ ID NO: 1539896 - RNA, 14 nt, Human adenovirus A
accaagcccucucc

SEQ ID NO: 1539897 - RNA, 16 nt, Human adenovirus A
cauggugauuaaauau

SEQ ID NO: 1539898 - RNA, 20 nt, Human adenovirus A
guucgcgauacaacggccag

SEQ ID NO: 1539899 - RNA, 23 nt, Human adenovirus A
uucauguggucaggucuaucaaa

SEQ ID NO: 1539900 - RNA, 12 nt, Human adenovirus A
gugccaggcauu

SEQ ID NO: 1539901 - RNA, 13 nt, Human adenovirus A
agcccaacccuuc

SEQ ID NO: 1539902 - RNA, 14 nt, Human adenovirus A
caaaccuuuacugc

SEQ ID NO: 1539903 - RNA, 12 nt, Human adenovirus A
uaaaagcaagcg

SEQ ID NO: 1539904 - RNA, 23 nt, Human adenovirus A
ccugcaguuauuggacaccaugg

SEQ ID NO: 1539905 - RNA, 18 nt, Human adenovirus A
acacuuuaauaaaaacac

SEQ ID NO: 1539906 - RNA, 22 nt, Human adenovirus A
agguuuaggucgggaugaaaaa

SEQ ID NO: 1539907 - RNA, 22 nt, Human adenovirus A
agauuguaauuuuuuucuccuu

SEQ ID NO: 1539908 - RNA, 22 nt, Human adenovirus A
gucacaaguacauccagggcac

SEQ ID NO: 1539909 - RNA, 14 nt, Human adenovirus A
uuuaauuaacauuc

SEQ ID NO: 1539910 - RNA, 14 nt, Human adenovirus A
ggcagccaggcggg

SEQ ID NO: 1539911 - RNA, 16 nt, Human adenovirus A
cagccugucuacaaau

SEQ ID NO: 1539912 - RNA, 21 nt, Human adenovirus A
guuagcaacuauccuguaguu

SEQ ID NO: 1539913 - RNA, 21 nt, Human adenovirus A
aggaacuccgcgcaaggagcu

SEQ ID NO: 1539914 - RNA, 14 nt, Human adenovirus A
uuaguguuguagau

SEQ ID NO: 1539915 - RNA, 15 nt, Human adenovirus A
guggcacaacacaua

SEQ ID NO: 1539916 - RNA, 22 nt, Human adenovirus A
aggggucuauccuucaguggua

SEQ ID NO: 1539917 - RNA, 22 nt, Human adenovirus A
cggcaggaaaucugggaggaag

SEQ ID NO: 1539918 - RNA, 14 nt, Human adenovirus A
caucgcaaaacacg

SEQ ID NO: 1539919 - RNA, 19 nt, Human adenovirus A
gcacccccaggggccagcu

SEQ ID NO: 1539920 - RNA, 14 nt, Human adenovirus A
accugaaagaaagu

SEQ ID NO: 1539921 - RNA, 17 nt, Human adenovirus A
uguagauaauccaguca

SEQ ID NO: 1539922 - RNA, 16 nt, Human adenovirus A
acugguacuaugacug

SEQ ID NO: 1539923 - RNA, 18 nt, Human adenovirus A
caaguaacaacacgggcu

SEQ ID NO: 1539924 - RNA, 15 nt, Human adenovirus A
aacgcaagcgugcaa

SEQ ID NO: 1539925 - RNA, 14 nt, Human adenovirus A
gagguguaccuggc

SEQ ID NO: 1539926 - RNA, 21 nt, Human adenovirus A
uaguugcagcagaauuacugc

SEQ ID NO: 1539927 - RNA, 18 nt, Human adenovirus A
ccgugcguuaccacccua

SEQ ID NO: 1539928 - RNA, 14 nt, Human adenovirus A
cuuugugacuuccc

SEQ ID NO: 1539929 - RNA, 15 nt, Human adenovirus A
cugguccccagaugu

SEQ ID NO: 1539930 - RNA, 16 nt, Human adenovirus A
augguguuaugaaucu

SEQ ID NO: 1539931 - RNA, 13 nt, Human adenovirus A
cguucuguggaug

SEQ ID NO: 1539932 - RNA, 22 nt, Human adenovirus A
uaccaaauuauugcuuuccucu

SEQ ID NO: 1539933 - RNA, 19 nt, Human adenovirus A
auuuucuuuaaaaaucaca

SEQ ID NO: 1539934 - RNA, 20 nt, Human adenovirus A
caucuagccagucacaguca

SEQ ID NO: 1539935 - RNA, 15 nt, Human adenovirus A
caaauuuaaggccag

SEQ ID NO: 1539936 - RNA, 17 nt, Human adenovirus A
guucgacgggccaggcg

SEQ ID NO: 1539937 - RNA, 18 nt, Human adenovirus A
agaacuacaaaaaaguaa

SEQ ID NO: 1539938 - RNA, 18 nt, Human adenovirus A
guaggaacuccgcgcaag

SEQ ID NO: 1539939 - RNA, 22 nt, Human adenovirus A
augucuaugggggcgcuaacgg

SEQ ID NO: 1539940 - RNA, 23 nt, Human adenovirus A
aaggccauguacuugacucuggc

SEQ ID NO: 1539941 - RNA, 14 nt, Human adenovirus A
ucuggaucuucaaa

SEQ ID NO: 1539942 - RNA, 16 nt, Human adenovirus A
ggcuguauacuacccc

SEQ ID NO: 1539943 - RNA, 14 nt, Human adenovirus A
cacaacacagcacu

SEQ ID NO: 1539944 - RNA, 15 nt, Human adenovirus A
augugaugaaaguag

SEQ ID NO: 1539945 - RNA, 20 nt, Human adenovirus A
ccauaucugaucgcucuuca

SEQ ID NO: 1539946 - RNA, 13 nt, Human adenovirus A
agaugaggcuggu

SEQ ID NO: 1539947 - RNA, 13 nt, Human adenovirus A
cccuccuaccacu

SEQ ID NO: 1539948 - RNA, 21 nt, Human adenovirus A
aguuccguaaagacuccggaa

SEQ ID NO: 1539949 - RNA, 12 nt, Human adenovirus A
cgauuccaagga

SEQ ID NO: 1539950 - RNA, 22 nt, Human adenovirus A
ccagacacgcaucuuguguuua

SEQ ID NO: 1539951 - RNA, 15 nt, Human adenovirus A
aauggagugucacug

SEQ ID NO: 1539952 - RNA, 12 nt, Human adenovirus A
uuuuuucuucuu

SEQ ID NO: 1539953 - RNA, 18 nt, Human adenovirus A
ucacuuaagucuuuacaa

SEQ ID NO: 1539954 - RNA, 15 nt, Human adenovirus A
gcaacagaugaugga

SEQ ID NO: 1539955 - RNA, 21 nt, Human adenovirus A
aauauaaaagcacaacuccau

SEQ ID NO: 1539956 - RNA, 17 nt, Human adenovirus A
cgauuccaaggaauguc

SEQ ID NO: 1539957 - RNA, 21 nt, Human adenovirus A
ugcagcgugcggccuguuuug

SEQ ID NO: 1539958 - RNA, 12 nt, Human adenovirus A
aaaacagcagcg

SEQ ID NO: 1539959 - RNA, 22 nt, Human adenovirus A
uggccauaauguaacccuuccc

SEQ ID NO: 1539960 - RNA, 19 nt, Human adenovirus A
ucuguguauacgccuccua

SEQ ID NO: 1539961 - RNA, 16 nt, Human adenovirus A
agaaacagcagcaacg

SEQ ID NO: 1539962 - RNA, 14 nt, Human adenovirus A
acacauuaaaaugu

SEQ ID NO: 1539963 - RNA, 18 nt, Human adenovirus A
uuuauuaaaaaucaaaug

SEQ ID NO: 1539964 - RNA, 19 nt, Human adenovirus A
aacugaccaggucagcuca

SEQ ID NO: 1539965 - RNA, 22 nt, Human adenovirus A
ucugccauuaauugaucaauuu

SEQ ID NO: 1539966 - RNA, 20 nt, Human adenovirus A
aguaacuccgggaguguaca

SEQ ID NO: 1539967 - RNA, 14 nt, Human adenovirus A
ugcgcgcggccaga

SEQ ID NO: 1539968 - RNA, 14 nt, Human adenovirus A
gcucagcuccaccc

SEQ ID NO: 1539969 - RNA, 18 nt, Human adenovirus A
auuuuauccuacaaaaag

SEQ ID NO: 1539970 - RNA, 15 nt, Human adenovirus A
uaguucugcacgggc

SEQ ID NO: 1539971 - RNA, 17 nt, Human adenovirus A
uuucuucaaauccaaaa

SEQ ID NO: 1539972 - RNA, 22 nt, Human adenovirus A
caacugagacuucccacagcca

SEQ ID NO: 1539973 - RNA, 20 nt, Human adenovirus A
caacaacagcuucuaaaaga

SEQ ID NO: 1539974 - RNA, 11 nt, Human adenovirus A
ccagcagccaa

SEQ ID NO: 1539975 - RNA, 17 nt, Human adenovirus A
ucgggcgaguucuccau

SEQ ID NO: 1539976 - RNA, 20 nt, Human adenovirus A
ucacguggucguaacucaaa

SEQ ID NO: 1539977 - RNA, 18 nt, Human adenovirus A
ccucccucuuggccagcu

SEQ ID NO: 1539978 - RNA, 24 nt, Human adenovirus A
cugccgcugcguagcaguaucagu

SEQ ID NO: 1539979 - RNA, 13 nt, Human adenovirus A
aucagcagccaac

SEQ ID NO: 1539980 - RNA, 17 nt, Human adenovirus A
ugagucgcuguugggac

SEQ ID NO: 1539981 - RNA, 15 nt, Human adenovirus A
auugaguugcacaua

SEQ ID NO: 1539982 - RNA, 15 nt, Human adenovirus A
aaccgucgcuuucaa

SEQ ID NO: 1539983 - RNA, 21 nt, Human adenovirus A
guaauggguucaagcgaacag

SEQ ID NO: 1539984 - RNA, 18 nt, Human adenovirus A
agagcacaugaaggugga

SEQ ID NO: 1539985 - RNA, 15 nt, Human adenovirus A
aagaaaaugaacaaa

SEQ ID NO: 1539986 - RNA, 12 nt, Human adenovirus A
cgcgccacggac

SEQ ID NO: 1539987 - RNA, 20 nt, Human adenovirus A
ugguaacauguccauuuugg

SEQ ID NO: 1539988 - RNA, 16 nt, Human adenovirus A
auacaguuuugaacaa

SEQ ID NO: 1539989 - RNA, 14 nt, Human adenovirus A
aaauggaacccuua

SEQ ID NO: 1539990 - RNA, 18 nt, Human adenovirus A
acacuguggacaacuccu

SEQ ID NO: 1539991 - RNA, 12 nt, Human adenovirus A
ucauaagcugug

SEQ ID NO: 1539992 - RNA, 21 nt, Human adenovirus A
acagcuucagaugacuggaca

SEQ ID NO: 1539993 - RNA, 15 nt, Human adenovirus A
uauauccuugcaaaa

SEQ ID NO: 1539994 - RNA, 11 nt, Human adenovirus A
aacggagaggg

SEQ ID NO: 1539995 - RNA, 21 nt, Human adenovirus A
ccugaaccuaauagcacuuug

SEQ ID NO: 1539996 - RNA, 22 nt, Human adenovirus A
cugggggcguacacuggcuggc

SEQ ID NO: 1539997 - RNA, 14 nt, Human adenovirus A
caagccuguaaaau

SEQ ID NO: 1539998 - RNA, 14 nt, Human adenovirus A
gccauccgcaggca

SEQ ID NO: 1539999 - RNA, 13 nt, Human adenovirus A
agcauguuaaaaa

SEQ ID NO: 1540000 - RNA, 19 nt, Human adenovirus A
gcgcggacgagcucccgga

SEQ ID NO: 1540001 - RNA, 14 nt, Human adenovirus A
cuauauuaacuuua

SEQ ID NO: 1540002 - RNA, 15 nt, Human adenovirus A
caggcaguacuucau

SEQ ID NO: 1540003 - RNA, 14 nt, Human adenovirus A
cucaggacaugaug

SEQ ID NO: 1540004 - RNA, 23 nt, Human adenovirus A
ugagaaccgucugcaugaugcau

SEQ ID NO: 1540005 - RNA, 18 nt, Human adenovirus A
gucaaaguaugcugcaca

SEQ ID NO: 1540006 - RNA, 14 nt, Human adenovirus A
ccuacgguggcagc

SEQ ID NO: 1540007 - RNA, 17 nt, Human adenovirus A
cgaugaagcacgcagag

SEQ ID NO: 1540008 - RNA, 18 nt, Human adenovirus A
cuugcauuaaccuuucca

SEQ ID NO: 1540009 - RNA, 15 nt, Human adenovirus A
cguggaauuaaaagg

SEQ ID NO: 1540010 - RNA, 16 nt, Human adenovirus A
caagaggagaaggagg

SEQ ID NO: 1540011 - RNA, 19 nt, Human adenovirus A
cgcgugucuucucccugug

SEQ ID NO: 1540012 - RNA, 21 nt, Human adenovirus A
aauaggggaugguuuaacauu

SEQ ID NO: 1540013 - RNA, 18 nt, Human adenovirus A
cuugugcagccuuucuua

SEQ ID NO: 1540014 - RNA, 11 nt, Human adenovirus A
aagcaggaaaa

SEQ ID NO: 1540015 - RNA, 15 nt, Human adenovirus A
agucgcacuuuuuaa

SEQ ID NO: 1540016 - RNA, 15 nt, Human adenovirus A
aauuacuugaacaac

SEQ ID NO: 1540017 - RNA, 19 nt, Human adenovirus A
gcuuugcgcgaacaucgca

SEQ ID NO: 1540018 - RNA, 15 nt, Human adenovirus A
agacggcugcgucgc

SEQ ID NO: 1540019 - RNA, 18 nt, Human adenovirus A
uccgcguggucaggaaga

SEQ ID NO: 1540020 - RNA, 22 nt, Human adenovirus A
uucuacuuuagaagccauguua

SEQ ID NO: 1540021 - RNA, 18 nt, Human adenovirus A
ggcugcgucgccggcgua

SEQ ID NO: 1540022 - RNA, 17 nt, Human adenovirus A
ccccagcggcaguacgu

SEQ ID NO: 1540023 - RNA, 14 nt, Human adenovirus A
aacuuuaauguuuc

SEQ ID NO: 1540024 - RNA, 20 nt, Human adenovirus A
gucagauaacgcuaagcuua

SEQ ID NO: 1540025 - RNA, 19 nt, Human adenovirus A
cgguguaugccaacaaaac

SEQ ID NO: 1540026 - RNA, 14 nt, Human adenovirus A
auuugaucagaaaa

SEQ ID NO: 1540027 - RNA, 20 nt, Human adenovirus A
gccaccgucaauucuucuuc

SEQ ID NO: 1540028 - RNA, 15 nt, Human adenovirus A
agauguaaaggaggc

SEQ ID NO: 1540029 - RNA, 15 nt, Human adenovirus A
ucaaagaaacagcag

SEQ ID NO: 1540030 - RNA, 15 nt, Human adenovirus A
uagagauaagcagga

SEQ ID NO: 1540031 - RNA, 16 nt, Human adenovirus A
aagcuugaaacucuaa

SEQ ID NO: 1540032 - RNA, 18 nt, Human adenovirus A
gccaagcgcucgcgcuuu

SEQ ID NO: 1540033 - RNA, 15 nt, Human adenovirus A
gacagucgcguggca

SEQ ID NO: 1540034 - RNA, 14 nt, Human adenovirus A
aacgucgccugagu

SEQ ID NO: 1540035 - RNA, 22 nt, Human adenovirus A
aaauaaagcguucuguggaugg

SEQ ID NO: 1540036 - RNA, 11 nt, Human adenovirus A
cucaagacuau

SEQ ID NO: 1540037 - RNA, 18 nt, Human adenovirus A
gaucauaacauguuuaug

SEQ ID NO: 1540038 - RNA, 20 nt, Human adenovirus A
aauggcuguugaugugauga

SEQ ID NO: 1540039 - RNA, 18 nt, Human adenovirus A
uaagaggagacaacuuua

SEQ ID NO: 1540040 - RNA, 15 nt, Human adenovirus A
accaaacuggccaug

SEQ ID NO: 1540041 - RNA, 15 nt, Human adenovirus A
cgggcaccacagugg

SEQ ID NO: 1540042 - RNA, 19 nt, Human adenovirus A
guaaugagcgcagugauga

SEQ ID NO: 1540043 - RNA, 14 nt, Human adenovirus A
cccuaucuguugcu

SEQ ID NO: 1540044 - RNA, 15 nt, Human adenovirus A
auggugauuaaauau

SEQ ID NO: 1540045 - RNA, 19 nt, Human adenovirus A
acuggggaauuugcauaug

SEQ ID NO: 1540046 - RNA, 20 nt, Human adenovirus A
uuacccgcagcugucucuac

SEQ ID NO: 1540047 - RNA, 18 nt, Human adenovirus A
auuagcacuuaauuacaa

SEQ ID NO: 1540048 - RNA, 17 nt, Human adenovirus A
acauaggcauugggaau

SEQ ID NO: 1540049 - RNA, 16 nt, Human adenovirus A
ccugaccauccaaugg

SEQ ID NO: 1540050 - RNA, 20 nt, Human adenovirus A
auuugucugaaaauugcaug

SEQ ID NO: 1540051 - RNA, 14 nt, Human adenovirus A
ccaaguaacaacac

SEQ ID NO: 1540052 - RNA, 14 nt, Human adenovirus A
auugguuccuaaua

SEQ ID NO: 1540053 - RNA, 22 nt, Human adenovirus A
cagcuguggagggcauggcuga

SEQ ID NO: 1540054 - RNA, 13 nt, Human adenovirus A
uaaacugucugua

SEQ ID NO: 1540055 - RNA, 15 nt, Human adenovirus A
cuuguguuuaagccu

SEQ ID NO: 1540056 - RNA, 17 nt, Human adenovirus A
gucagauagcaagcgua

SEQ ID NO: 1540057 - RNA, 17 nt, Human adenovirus A
gcaggcuggaggugcag

SEQ ID NO: 1540058 - RNA, 22 nt, Human adenovirus A
uacaaaguccucagguaguggg

SEQ ID NO: 1540059 - RNA, 20 nt, Human adenovirus A
cugugagcaaaucucagaaa

SEQ ID NO: 1540060 - RNA, 14 nt, Human adenovirus A
ggcaucuugcauga

SEQ ID NO: 1540061 - RNA, 21 nt, Human adenovirus A
aaccacuugcgccaaguugag

SEQ ID NO: 1540062 - RNA, 22 nt, Human adenovirus A
ucgcuuucaaccaagcccucuc

SEQ ID NO: 1540063 - RNA, 17 nt, Human adenovirus A
aaaauuuucaacagaaa

SEQ ID NO: 1540064 - RNA, 21 nt, Human adenovirus A
cgucaagacccacugcgucag

SEQ ID NO: 1540065 - RNA, 20 nt, Human adenovirus A
auccauuaauauuguguccu

SEQ ID NO: 1540066 - RNA, 14 nt, Human adenovirus A
gccugaagaagaac

SEQ ID NO: 1540067 - RNA, 15 nt, Human adenovirus A
ugacaaacguuuucc

SEQ ID NO: 1540068 - RNA, 20 nt, Human adenovirus A
uccgcauugguugcccccuc

SEQ ID NO: 1540069 - RNA, 19 nt, Human adenovirus A
caccaugguaaaaaggaag

SEQ ID NO: 1540070 - RNA, 22 nt, Human adenovirus A
acucacuggccugaccauccaa

SEQ ID NO: 1540071 - RNA, 12 nt, Human adenovirus A
guccuuccaggg

SEQ ID NO: 1540072 - RNA, 12 nt, Human adenovirus A
auacuaaagaaa

SEQ ID NO: 1540073 - RNA, 20 nt, Human adenovirus A
gugguacgcauucaccagcc

SEQ ID NO: 1540074 - RNA, 15 nt, Human adenovirus A
caacugauauuagua

SEQ ID NO: 1540075 - RNA, 21 nt, Human adenovirus A
ccaaggucaacuuacagcuag

SEQ ID NO: 1540076 - RNA, 21 nt, Human adenovirus A
uaauugcuaauggaagaccuu

SEQ ID NO: 1540077 - RNA, 21 nt, Human adenovirus A
gagaucggcacgagccagcug

SEQ ID NO: 1540078 - RNA, 19 nt, Human adenovirus A
gcggccuguuuuguuguau

SEQ ID NO: 1540079 - RNA, 20 nt, Human adenovirus A
gaaaggcauggaaaaacuug

SEQ ID NO: 1540080 - RNA, 16 nt, Human adenovirus A
aaaagcacaacuccau

SEQ ID NO: 1540081 - RNA, 23 nt, Human adenovirus A
aggaaaagcugccaccucuagaa

SEQ ID NO: 1540082 - RNA, 14 nt, Human adenovirus A
ucagaauaaaacaa

SEQ ID NO: 1540083 - RNA, 15 nt, Human adenovirus A
caacagucagugucc

SEQ ID NO: 1540084 - RNA, 20 nt, Human adenovirus A
ccaagcauauaaaacugauu

SEQ ID NO: 1540085 - RNA, 15 nt, Human adenovirus A
cccguuccgcaagca

SEQ ID NO: 1540086 - RNA, 17 nt, Human adenovirus A
augcuuagucauuacaa

SEQ ID NO: 1540087 - RNA, 16 nt, Human adenovirus A
cuuaaaaaaacaaaac

SEQ ID NO: 1540088 - RNA, 12 nt, Human adenovirus A
uacugcuuccag

SEQ ID NO: 1540089 - RNA, 13 nt, Human adenovirus A
ucucagugucauu

SEQ ID NO: 1540090 - RNA, 15 nt, Human adenovirus A
cuuaaaaaaggacac

SEQ ID NO: 1540091 - RNA, 11 nt, Human adenovirus A
uguccuuccag

SEQ ID NO: 1540092 - RNA, 13 nt, Human adenovirus A
aagaaugggagga

SEQ ID NO: 1540093 - RNA, 15 nt, Human adenovirus A
cgaacaguguuuuca

SEQ ID NO: 1540094 - RNA, 22 nt, Human adenovirus A
cauggcacauaacacagcuucu

SEQ ID NO: 1540095 - RNA, 13 nt, Human adenovirus A
auuugcugaaaaa

SEQ ID NO: 1540096 - RNA, 21 nt, Human adenovirus A
uaacauugccuuaggcagcag

SEQ ID NO: 1540097 - RNA, 19 nt, Human adenovirus A
agcaggcuggaggugcagg

SEQ ID NO: 1540098 - RNA, 21 nt, Human adenovirus A
gcucaaaggcaggcauuaccu

SEQ ID NO: 1540099 - RNA, 19 nt, Human adenovirus A
ccauuugaucagaaaaaac

SEQ ID NO: 1540100 - RNA, 23 nt, Human adenovirus A
agucagacccgacggaguguuuc

SEQ ID NO: 1540101 - RNA, 18 nt, Human adenovirus A
ucaaacgccgacgcugcu

SEQ ID NO: 1540102 - RNA, 20 nt, Human adenovirus A
guagccauugguuuaaugca

SEQ ID NO: 1540103 - RNA, 12 nt, Human adenovirus A
ggauauaaagcu

SEQ ID NO: 1540104 - RNA, 19 nt, Human adenovirus A
cucacgacacgucacaucc

SEQ ID NO: 1540105 - RNA, 21 nt, Human adenovirus A
guagccugcuuucagcacugc

SEQ ID NO: 1540106 - RNA, 16 nt, Human adenovirus A
augcacaagagcggcg

SEQ ID NO: 1540107 - RNA, 14 nt, Human adenovirus A
acccuuuagcaguu

SEQ ID NO: 1540108 - RNA, 21 nt, Human adenovirus A
augggaggaaagacagccaag

SEQ ID NO: 1540109 - RNA, 15 nt, Human adenovirus A
gcuaagggacaaguu

SEQ ID NO: 1540110 - RNA, 18 nt, Human adenovirus A
ggucagauccuuagauuu

SEQ ID NO: 1540111 - RNA, 18 nt, Human adenovirus A
aguucuaaugcaaguugu

SEQ ID NO: 1540112 - RNA, 21 nt, Human adenovirus A
cguuucagcgccaacaaaaac

SEQ ID NO: 1540113 - RNA, 16 nt, Human adenovirus A
accuaaggcuucaaga

SEQ ID NO: 1540114 - RNA, 15 nt, Human adenovirus A
auuuugccagcucuu

SEQ ID NO: 1540115 - RNA, 16 nt, Human adenovirus A
gugcaaauauaaaagc

SEQ ID NO: 1540116 - RNA, 14 nt, Human adenovirus A
cacaaguacaucca

SEQ ID NO: 1540117 - RNA, 15 nt, Human adenovirus A
acugauuuucaucug

SEQ ID NO: 1540118 - RNA, 20 nt, Human adenovirus A
ugggauacuaccgcugcuca

SEQ ID NO: 1540119 - RNA, 23 nt, Human adenovirus A
ucguccaaccaacgaacacggag

SEQ ID NO: 1540120 - RNA, 18 nt, Human adenovirus A
cucgcaguauggcagcug

SEQ ID NO: 1540121 - RNA, 14 nt, Human adenovirus A
aaucaaauuacaca

SEQ ID NO: 1540122 - RNA, 15 nt, Human adenovirus A
uuugaccggucaggc

SEQ ID NO: 1540123 - RNA, 21 nt, Human adenovirus A
ugacaaugcccgccuggcagu

SEQ ID NO: 1540124 - RNA, 20 nt, Human adenovirus A
gcgguuuaagaaaucuuuua

SEQ ID NO: 1540125 - RNA, 13 nt, Human adenovirus A
cgcucucaccgcu

SEQ ID NO: 1540126 - RNA, 17 nt, Human adenovirus A
guacgcaaacucagccc

SEQ ID NO: 1540127 - RNA, 12 nt, Human adenovirus A
cgccuuaauuuu

SEQ ID NO: 1540128 - RNA, 12 nt, Human adenovirus A
gugcacgucaca

SEQ ID NO: 1540129 - RNA, 22 nt, Human adenovirus A
auacuaaagaaacaaacuacau

SEQ ID NO: 1540130 - RNA, 23 nt, Human adenovirus A
aacugauggugccuaagcggcaa

SEQ ID NO: 1540131 - RNA, 16 nt, Human adenovirus A
cauguguugugcacuu

SEQ ID NO: 1540132 - RNA, 14 nt, Human adenovirus A
ggguucgugcucca

SEQ ID NO: 1540133 - RNA, 17 nt, Human adenovirus A
ggcagacaagguggccg

SEQ ID NO: 1540134 - RNA, 20 nt, Human adenovirus A
augaaaaagucagcugcaaa

SEQ ID NO: 1540135 - RNA, 19 nt, Human adenovirus A
aacucuacuuaaaagcaag

SEQ ID NO: 1540136 - RNA, 14 nt, Human adenovirus A
uugcgagcugccac

SEQ ID NO: 1540137 - RNA, 19 nt, Human adenovirus A
cauucgcagcgcacuggca

SEQ ID NO: 1540138 - RNA, 20 nt, Human adenovirus A
ccagcucacggugucagaau

SEQ ID NO: 1540139 - RNA, 20 nt, Human adenovirus A
aaacuuucuaccaaggaaaa

SEQ ID NO: 1540140 - RNA, 18 nt, Human adenovirus A
ccaccgacgaagcgucag

SEQ ID NO: 1540141 - RNA, 16 nt, Human adenovirus A
agcuaaaucugccacu

SEQ ID NO: 1540142 - RNA, 19 nt, Human adenovirus A
uggagccaaaaaaacagau

SEQ ID NO: 1540143 - RNA, 13 nt, Human adenovirus A
cacacgcagcaac

SEQ ID NO: 1540144 - RNA, 13 nt, Human adenovirus A
uacaaaucuuuca

SEQ ID NO: 1540145 - RNA, 14 nt, Human adenovirus A
cgggccgcagcugc

SEQ ID NO: 1540146 - RNA, 10 nt, Human adenovirus A
cuaaaacaga

SEQ ID NO: 1540147 - RNA, 23 nt, Human adenovirus A
cacaauaacuacaaacaguuuca

SEQ ID NO: 1540148 - RNA, 17 nt, Human adenovirus A
gcggguaagagcaggcu

SEQ ID NO: 1540149 - RNA, 22 nt, Human adenovirus A
accuagguuuaaaucuuucugc

SEQ ID NO: 1540150 - RNA, 14 nt, Human adenovirus A
uggaagaaaaaaac

SEQ ID NO: 1540151 - RNA, 21 nt, Human adenovirus A
uuuuaaauuguuccuguucua

SEQ ID NO: 1540152 - RNA, 18 nt, Human adenovirus A
cuggagcagguguaacca

SEQ ID NO: 1540153 - RNA, 12 nt, Human adenovirus A
caaaacacaaau

SEQ ID NO: 1540154 - RNA, 13 nt, Human adenovirus A
gggcgacuacccg

SEQ ID NO: 1540155 - RNA, 18 nt, Human adenovirus A
aaaagugugguaacaugu

SEQ ID NO: 1540156 - RNA, 21 nt, Human adenovirus A
aauaaacgguuccuuagccuu

SEQ ID NO: 1540157 - RNA, 22 nt, Human adenovirus A
uugcagcagaauuacugccagu

SEQ ID NO: 1540158 - RNA, 15 nt, Human adenovirus A
ucaaccuauuaaccu

SEQ ID NO: 1540159 - RNA, 21 nt, Human adenovirus A
agguggaaaccuagguuuaaa

SEQ ID NO: 1540160 - RNA, 13 nt, Human adenovirus A
gucaguguccauc

SEQ ID NO: 1540161 - RNA, 18 nt, Human adenovirus A
aacaacaggugcaagaag

SEQ ID NO: 1540162 - RNA, 18 nt, Human adenovirus A
ccuucgaaaugcagggac

SEQ ID NO: 1540163 - RNA, 18 nt, Human adenovirus A
cauuggaguacaagcuug

SEQ ID NO: 1540164 - RNA, 17 nt, Human adenovirus A
ucauacaaaucagaagc

SEQ ID NO: 1540165 - RNA, 15 nt, Human adenovirus A
agcugacggccauug

SEQ ID NO: 1540166 - RNA, 21 nt, Human adenovirus A
ucauaagacaaagccucugua

SEQ ID NO: 1540167 - RNA, 13 nt, Human adenovirus A
ucguuacuuuugc

SEQ ID NO: 1540168 - RNA, 15 nt, Human adenovirus A
cuacuaauaauguaa

SEQ ID NO: 1540169 - RNA, 12 nt, Human adenovirus A
aaccagcugggc

SEQ ID NO: 1540170 - RNA, 23 nt, Human adenovirus A
gcuuucgagggguucucuuucaa

SEQ ID NO: 1540171 - RNA, 15 nt, Human adenovirus A
aaagaucacagccag

SEQ ID NO: 1540172 - RNA, 18 nt, Human adenovirus A
cauacuuaccaaagccau

SEQ ID NO: 1540173 - RNA, 19 nt, Human adenovirus A
ugacacuguggacaacucc

SEQ ID NO: 1540174 - RNA, 20 nt, Human adenovirus A
cugcggggggaauaucucau

SEQ ID NO: 1540175 - RNA, 18 nt, Human adenovirus A
cucuaacugcucagcugg

SEQ ID NO: 1540176 - RNA, 20 nt, Human adenovirus A
gggauuauaaaaggcuggaa

SEQ ID NO: 1540177 - RNA, 14 nt, Human adenovirus A
auuugaacacacug

SEQ ID NO: 1540178 - RNA, 22 nt, Human adenovirus A
cguucaacuuuguccaguuuac

SEQ ID NO: 1540179 - RNA, 14 nt, Human adenovirus A
gucacaacaagaug

SEQ ID NO: 1540180 - RNA, 15 nt, Human adenovirus A
gaaggaaaugauggc

SEQ ID NO: 1540181 - RNA, 21 nt, Human adenovirus A
ggcuagcuugcgaaacccacg

SEQ ID NO: 1540182 - RNA, 15 nt, Human adenovirus A
acuguaagaggagac

SEQ ID NO: 1540183 - RNA, 20 nt, Human adenovirus A
cuucuccagacaacuucauu

SEQ ID NO: 1540184 - RNA, 13 nt, Human adenovirus A
aagcaaaguacaa

SEQ ID NO: 1540185 - RNA, 17 nt, Human adenovirus A
aguuauauuuucuaugc

SEQ ID NO: 1540186 - RNA, 14 nt, Human adenovirus A
aggcgcgcggugga

SEQ ID NO: 1540187 - RNA, 18 nt, Human adenovirus A
aguuaauugauuuacaaa

SEQ ID NO: 1540188 - RNA, 21 nt, Human adenovirus A
gacugagaaccgucugcauga

SEQ ID NO: 1540189 - RNA, 23 nt, Human adenovirus A
acuggccugaccauccaauggau

SEQ ID NO: 1540190 - RNA, 21 nt, Human adenovirus A
cacggccggaugcagaggaaa

SEQ ID NO: 1540191 - RNA, 20 nt, Human adenovirus A
uugaguaacuucaacauuua

SEQ ID NO: 1540192 - RNA, 12 nt, Human adenovirus A
aauaacacauaa

SEQ ID NO: 1540193 - RNA, 15 nt, Human adenovirus A
agccgcagcaccugg

SEQ ID NO: 1540194 - RNA, 15 nt, Human adenovirus A
uuuauuaaaaaucaa

SEQ ID NO: 1540195 - RNA, 20 nt, Human adenovirus A
ugaaugcguaaaucucgcag

SEQ ID NO: 1540196 - RNA, 22 nt, Human adenovirus A
cuuaaggcgggguauguuuaga

SEQ ID NO: 1540197 - RNA, 15 nt, Human adenovirus A
agauucuucuuccca

SEQ ID NO: 1540198 - RNA, 14 nt, Human adenovirus A
aggcgcucagugcg

SEQ ID NO: 1540199 - RNA, 14 nt, Human adenovirus A
acucauaagcugug

SEQ ID NO: 1540200 - RNA, 15 nt, Human adenovirus A
caaggucaacuuaca

SEQ ID NO: 1540201 - RNA, 13 nt, Human adenovirus A
acgccaaagccac

SEQ ID NO: 1540202 - RNA, 17 nt, Human adenovirus A
uagagccaugggaggau

SEQ ID NO: 1540203 - RNA, 15 nt, Human adenovirus A
gaaccgucugcauga

SEQ ID NO: 1540204 - RNA, 21 nt, Human adenovirus A
aggccuaauggagugucacug

SEQ ID NO: 1540205 - RNA, 18 nt, Human adenovirus A
gaugacuggacagcggcc

SEQ ID NO: 1540206 - RNA, 11 nt, Human adenovirus A
gcauaaugaaa

SEQ ID NO: 1540207 - RNA, 23 nt, Human adenovirus A
gaaaagcauguccgcggggacag

SEQ ID NO: 1540208 - RNA, 20 nt, Human adenovirus A
acagaguugcuuuuagaugu

SEQ ID NO: 1540209 - RNA, 22 nt, Human adenovirus A
aggaagcaauaaaacaaggagc

SEQ ID NO: 1540210 - RNA, 17 nt, Human adenovirus A
gguaccuucgaaaugca

SEQ ID NO: 1540211 - RNA, 15 nt, Human adenovirus A
aguguacuuggugga

SEQ ID NO: 1540212 - RNA, 17 nt, Human adenovirus A
auccuagcguacagcca

SEQ ID NO: 1540213 - RNA, 22 nt, Human adenovirus A
cuauggaccgguuuugacgaac

SEQ ID NO: 1540214 - RNA, 19 nt, Human adenovirus A
uugcaacgcaccuugcagg

SEQ ID NO: 1540215 - RNA, 14 nt, Human adenovirus A
ucaaacguccaggc

SEQ ID NO: 1540216 - RNA, 21 nt, Human adenovirus A
ggaagacagcauggagugcug

SEQ ID NO: 1540217 - RNA, 12 nt, Human adenovirus A
gcguuuggaaac

SEQ ID NO: 1540218 - RNA, 14 nt, Human adenovirus A
acagaaaaaaauug

SEQ ID NO: 1540219 - RNA, 15 nt, Human adenovirus A
cgguggaacugcaga

SEQ ID NO: 1540220 - RNA, 17 nt, Human adenovirus A
gccgacguugcaagagg

SEQ ID NO: 1540221 - RNA, 13 nt, Human adenovirus A
gaugcuuugggag

SEQ ID NO: 1540222 - RNA, 19 nt, Human adenovirus A
auacauaauuuuaaaguaa

SEQ ID NO: 1540223 - RNA, 20 nt, Human adenovirus A
cuaagaaggcacccucccag

SEQ ID NO: 1540224 - RNA, 14 nt, Human adenovirus A
cgaaacuguugacc

SEQ ID NO: 1540225 - RNA, 15 nt, Human adenovirus A
gcaaaaaaggggcac

SEQ ID NO: 1540226 - RNA, 12 nt, Human adenovirus A
aaauauccagga

SEQ ID NO: 1540227 - RNA, 13 nt, Human adenovirus A
uacccgccagugu

SEQ ID NO: 1540228 - RNA, 23 nt, Human adenovirus A
ccacuuuaagucugucuguugcc

SEQ ID NO: 1540229 - RNA, 19 nt, Human adenovirus A
augcccugcaaaaagaaaa

SEQ ID NO: 1540230 - RNA, 15 nt, Human adenovirus A
agucaacuaaaaauu

SEQ ID NO: 1540231 - RNA, 21 nt, Human adenovirus A
uccauguggagguauaacaaa

SEQ ID NO: 1540232 - RNA, 17 nt, Human adenovirus A
gauccuuagauuuuuca

SEQ ID NO: 1540233 - RNA, 17 nt, Human adenovirus A
caaguuaaaagaccaaa

SEQ ID NO: 1540234 - RNA, 12 nt, Human adenovirus A
cgagacugcagg

SEQ ID NO: 1540235 - RNA, 20 nt, Human adenovirus A
uuugagccagaugaacauuc

SEQ ID NO: 1540236 - RNA, 15 nt, Human adenovirus A
uucuaccaaggaaaa

SEQ ID NO: 1540237 - RNA, 20 nt, Human adenovirus A
aaccaagcccucuccaauga

SEQ ID NO: 1540238 - RNA, 14 nt, Human adenovirus A
agcaguaucagugg

SEQ ID NO: 1540239 - RNA, 20 nt, Human adenovirus A
uguagcugaaaacaacugca

SEQ ID NO: 1540240 - RNA, 23 nt, Human adenovirus A
uauuucuuguucuuccucuucua

SEQ ID NO: 1540241 - RNA, 14 nt, Human adenovirus A
cccuacgugccucc

SEQ ID NO: 1540242 - RNA, 16 nt, Human adenovirus A
acaagcugcgcugccg

SEQ ID NO: 1540243 - RNA, 13 nt, Human adenovirus A
aaagcaaaguaca

SEQ ID NO: 1540244 - RNA, 18 nt, Human adenovirus A
gucggaaugauuaaacaa

SEQ ID NO: 1540245 - RNA, 12 nt, Human adenovirus A
ucugcugucauu

SEQ ID NO: 1540246 - RNA, 19 nt, Human adenovirus A
uucaucuuaguaauggagu

SEQ ID NO: 1540247 - RNA, 14 nt, Human adenovirus A
aagcaggagaacaa

SEQ ID NO: 1540248 - RNA, 14 nt, Human adenovirus A
gauggguacagaug

SEQ ID NO: 1540249 - RNA, 16 nt, Human adenovirus A
ccuggaggucuccaug

SEQ ID NO: 1540250 - RNA, 15 nt, Human adenovirus A
cauaagcugugaaaa

SEQ ID NO: 1540251 - RNA, 18 nt, Human adenovirus A
ccaguuuacuaacaccaa

SEQ ID NO: 1540252 - RNA, 16 nt, Human adenovirus A
ggauuuuuuuguaaaa

SEQ ID NO: 1540253 - RNA, 20 nt, Human adenovirus A
cuacggcugucauggagaag

SEQ ID NO: 1540254 - RNA, 13 nt, Human adenovirus A
aaacauaaaacua

SEQ ID NO: 1540255 - RNA, 23 nt, Human adenovirus A
gaacgcauauugcgcuauguaca

SEQ ID NO: 1540256 - RNA, 19 nt, Human adenovirus A
uaagggcgcccuccaccgc

SEQ ID NO: 1540257 - RNA, 22 nt, Human adenovirus A
cagaaaaacaguacaaagccag

SEQ ID NO: 1540258 - RNA, 13 nt, Human adenovirus A
ucgaccugcaugu

SEQ ID NO: 1540259 - RNA, 23 nt, Human adenovirus A
gaacaaacgguuacagaggaacg

SEQ ID NO: 1540260 - RNA, 21 nt, Human adenovirus A
uaugaugcgggcagccaggcg

SEQ ID NO: 1540261 - RNA, 20 nt, Human adenovirus A
cucgcauaaauucgcgggcu

SEQ ID NO: 1540262 - RNA, 19 nt, Human adenovirus A
aaacacaugauggaucugg

SEQ ID NO: 1540263 - RNA, 23 nt, Human adenovirus A
ucgcagcugacaucuuaaugcca

SEQ ID NO: 1540264 - RNA, 14 nt, Human adenovirus A
auuaacaguuugcg

SEQ ID NO: 1540265 - RNA, 23 nt, Human adenovirus A
ccuaggcaacguuggcagcgacg

SEQ ID NO: 1540266 - RNA, 13 nt, Human adenovirus A
uuucagcacugcg

SEQ ID NO: 1540267 - RNA, 20 nt, Human adenovirus A
ucuugcuuuaagggcuggcg

SEQ ID NO: 1540268 - RNA, 15 nt, Human adenovirus A
ccuauccgucuccag

SEQ ID NO: 1540269 - RNA, 23 nt, Human adenovirus A
aagcaaaccacugcaaugcagcc

SEQ ID NO: 1540270 - RNA, 22 nt, Human adenovirus A
aauuugucugaaaauugcauga

SEQ ID NO: 1540271 - RNA, 18 nt, Human adenovirus A
cuuugagccagaugaaca

SEQ ID NO: 1540272 - RNA, 15 nt, Human adenovirus A
guauacagauuuaag

SEQ ID NO: 1540273 - RNA, 22 nt, Human adenovirus A
acuucaauccuuuuucgggcuc

SEQ ID NO: 1540274 - RNA, 19 nt, Human adenovirus A
uacugcccugguuccccaa

SEQ ID NO: 1540275 - RNA, 19 nt, Human adenovirus A
cuuuuacuaaaaugcaaaa

SEQ ID NO: 1540276 - RNA, 14 nt, Human adenovirus A
cggacaguagcugc

SEQ ID NO: 1540277 - RNA, 19 nt, Human adenovirus A
ccagaaaguaucugcccau

SEQ ID NO: 1540278 - RNA, 14 nt, Human adenovirus A
aagccaacggcaca

SEQ ID NO: 1540279 - RNA, 17 nt, Human adenovirus A
ucccacauacaucaccu

SEQ ID NO: 1540280 - RNA, 20 nt, Human adenovirus A
agggcuggcgcuuccauacc

SEQ ID NO: 1540281 - RNA, 13 nt, Human adenovirus A
aaauaucauauac

SEQ ID NO: 1540282 - RNA, 17 nt, Human adenovirus A
uucccaagauuuaauuu

SEQ ID NO: 1540283 - RNA, 15 nt, Human adenovirus A
aacagacaauuccaa

SEQ ID NO: 1540284 - RNA, 16 nt, Human adenovirus A
auacaacggccagcca

SEQ ID NO: 1540285 - RNA, 22 nt, Human adenovirus A
cauuacccaagaauaaaaacac

SEQ ID NO: 1540286 - RNA, 12 nt, Human adenovirus A
uaucgcagcugg

SEQ ID NO: 1540287 - RNA, 14 nt, Human adenovirus A
ucaagaaaggcauc

SEQ ID NO: 1540288 - RNA, 18 nt, Human adenovirus A
cagugaagcaaaccacau

SEQ ID NO: 1540289 - RNA, 14 nt, Human adenovirus A
ucuaccaaggaaaa

SEQ ID NO: 1540290 - RNA, 11 nt, Human adenovirus A
ccacaggaaag

SEQ ID NO: 1540291 - RNA, 12 nt, Human adenovirus A
ccaccagacccc

SEQ ID NO: 1540292 - RNA, 18 nt, Human adenovirus A
aggagacguuuuugccca

SEQ ID NO: 1540293 - RNA, 14 nt, Human adenovirus A
cagauguaaaagua

SEQ ID NO: 1540294 - RNA, 21 nt, Human adenovirus A
gcaaauaguuccguaaagacu

SEQ ID NO: 1540295 - RNA, 11 nt, Human adenovirus A
acaagccgcag

SEQ ID NO: 1540296 - RNA, 16 nt, Human adenovirus A
ugcauuaccagcagcc

SEQ ID NO: 1540297 - RNA, 16 nt, Human adenovirus A
cgaccgccgccaaacc

SEQ ID NO: 1540298 - RNA, 15 nt, Human adenovirus A
auaaaaccugugccu

SEQ ID NO: 1540299 - RNA, 23 nt, Human adenovirus A
cuuauaaaauuucccucuuccca

SEQ ID NO: 1540300 - RNA, 18 nt, Human adenovirus A
aagcgaagaucaguugca

SEQ ID NO: 1540301 - RNA, 17 nt, Human adenovirus A
gucaauucuucuuccaa

SEQ ID NO: 1540302 - RNA, 20 nt, Human adenovirus A
aacaagcgaccucugaaaca

SEQ ID NO: 1540303 - RNA, 18 nt, Human adenovirus A
cgccgcgacggcggcgca

SEQ ID NO: 1540304 - RNA, 21 nt, Human adenovirus A
gcauuacgucgcuaaauggau

SEQ ID NO: 1540305 - RNA, 16 nt, Human adenovirus A
acugggccaggaggac

SEQ ID NO: 1540306 - RNA, 19 nt, Human adenovirus A
cgauaaacaaaagcaaagc

SEQ ID NO: 1540307 - RNA, 13 nt, Human adenovirus A
aauaaauacugcu

SEQ ID NO: 1540308 - RNA, 17 nt, Human adenovirus A
ccuuucucugugacaaa

SEQ ID NO: 1540309 - RNA, 13 nt, Human adenovirus A
augcauaauuaaa

SEQ ID NO: 1540310 - RNA, 11 nt, Human adenovirus A
uggaacaccag

SEQ ID NO: 1540311 - RNA, 23 nt, Human adenovirus A
cagucagagagaaaagcaugucc

SEQ ID NO: 1540312 - RNA, 17 nt, Human adenovirus A
aauguggagcugagcaa

SEQ ID NO: 1540313 - RNA, 15 nt, Human adenovirus A
aguaacaacacgggc

SEQ ID NO: 1540314 - RNA, 23 nt, Human adenovirus A
uuaaugguguagcugcaguuugu

SEQ ID NO: 1540315 - RNA, 13 nt, Human adenovirus A
gcaggcuggaggu

SEQ ID NO: 1540316 - RNA, 17 nt, Human adenovirus A
aaugcauuaccagcagc

SEQ ID NO: 1540317 - RNA, 16 nt, Human adenovirus A
cccaacugucaaaccu

SEQ ID NO: 1540318 - RNA, 12 nt, Human adenovirus A
uuugcauuuacu

SEQ ID NO: 1540319 - RNA, 19 nt, Human adenovirus A
aaagccaggcacagcagac

SEQ ID NO: 1540320 - RNA, 15 nt, Human adenovirus A
cugccuaccugcgca

SEQ ID NO: 1540321 - RNA, 22 nt, Human adenovirus A
agcuugaaacucuaacugcuca

SEQ ID NO: 1540322 - RNA, 20 nt, Human adenovirus A
uccaaguucuaaugcaaguu

SEQ ID NO: 1540323 - RNA, 13 nt, Human adenovirus A
cccaacccuuccc

SEQ ID NO: 1540324 - RNA, 20 nt, Human adenovirus A
ggcguaaccaaauacugcua

SEQ ID NO: 1540325 - RNA, 14 nt, Human adenovirus A
acauaacacagcuu

SEQ ID NO: 1540326 - RNA, 23 nt, Human adenovirus A
aacacaguuuaacacauacagua

SEQ ID NO: 1540327 - RNA, 15 nt, Human adenovirus A
gaagcaauaaaacaa

SEQ ID NO: 1540328 - RNA, 18 nt, Human adenovirus A
acaauggcauagaaaguu

SEQ ID NO: 1540329 - RNA, 16 nt, Human adenovirus A
gcugacauacacugua

SEQ ID NO: 1540330 - RNA, 18 nt, Human adenovirus A
cagcuaacgccaccagcg

SEQ ID NO: 1540331 - RNA, 17 nt, Human adenovirus A
cuugugcagccuuucuu

SEQ ID NO: 1540332 - RNA, 13 nt, Human adenovirus A
cuacacaugaagg

SEQ ID NO: 1540333 - RNA, 19 nt, Human adenovirus A
caaaacuuucuaccaagga

SEQ ID NO: 1540334 - RNA, 18 nt, Human adenovirus A
augcccugcaaaaagaaa

SEQ ID NO: 1540335 - RNA, 17 nt, Human adenovirus A
aaagacuccggaaacaa

SEQ ID NO: 1540336 - RNA, 15 nt, Human adenovirus A
cuucaauaccaguuu

SEQ ID NO: 1540337 - RNA, 20 nt, Human adenovirus A
cagaugacuggacagcggcc

SEQ ID NO: 1540338 - RNA, 12 nt, Human adenovirus A
ugauaugaaguu

SEQ ID NO: 1540339 - RNA, 14 nt, Human adenovirus A
gcgcucaaaggcag

SEQ ID NO: 1540340 - RNA, 15 nt, Human adenovirus A
acgcuugugcagccu

SEQ ID NO: 1540341 - RNA, 13 nt, Human adenovirus A
acauaccuggcaa

SEQ ID NO: 1540342 - RNA, 22 nt, Human adenovirus A
uucugaucaacgacuaaaacaa

SEQ ID NO: 1540343 - RNA, 23 nt, Human adenovirus A
gcaacuuuuuaaccacuguagug

SEQ ID NO: 1540344 - RNA, 11 nt, Human adenovirus A
aaaacacugag

SEQ ID NO: 1540345 - RNA, 20 nt, Human adenovirus A
uaagcgccggaccccacaug

SEQ ID NO: 1540346 - RNA, 14 nt, Human adenovirus A
cguuacagcuucag

SEQ ID NO: 1540347 - RNA, 19 nt, Human adenovirus A
gcgcgcauacccgaggacg

SEQ ID NO: 1540348 - RNA, 17 nt, Human adenovirus A
guacucaucagagggaa

SEQ ID NO: 1540349 - RNA, 22 nt, Human adenovirus A
ucuucguaggaaagaucuucaa

SEQ ID NO: 1540350 - RNA, 15 nt, Human adenovirus A
agacaauuccaacga

SEQ ID NO: 1540351 - RNA, 20 nt, Human adenovirus A
ggagcgccccccuagcagua

SEQ ID NO: 1540352 - RNA, 15 nt, Human adenovirus A
cacgcuuugaccggu

SEQ ID NO: 1540353 - RNA, 14 nt, Human adenovirus A
cagggauauguuuc

SEQ ID NO: 1540354 - RNA, 14 nt, Human adenovirus A
caauuaguaacaag

SEQ ID NO: 1540355 - RNA, 19 nt, Human adenovirus A
auaauaguucccucugguc

SEQ ID NO: 1540356 - RNA, 18 nt, Human adenovirus A
aagagcuuaugcauagcu

SEQ ID NO: 1540357 - RNA, 16 nt, Human adenovirus A
cauauagcucauguga

SEQ ID NO: 1540358 - RNA, 19 nt, Human adenovirus A
uaagaucuucguaggaaag

SEQ ID NO: 1540359 - RNA, 23 nt, Human adenovirus A
uaaauggauacucuuuaacauuc

SEQ ID NO: 1540360 - RNA, 20 nt, Human adenovirus A
cuuguggaauuccgcagugg

SEQ ID NO: 1540361 - RNA, 13 nt, Human adenovirus A
cggaagaaaagcg

SEQ ID NO: 1540362 - RNA, 19 nt, Human adenovirus A
ucaaacaccugcaguaaau

SEQ ID NO: 1540363 - RNA, 17 nt, Human adenovirus A
gcgaacgggcagccugu

SEQ ID NO: 1540364 - RNA, 23 nt, Human adenovirus A
caauauugagguuacucacuuug

SEQ ID NO: 1540365 - RNA, 18 nt, Human adenovirus A
uucuccuuuuuuuuucca

SEQ ID NO: 1540366 - RNA, 14 nt, Human adenovirus A
agauccauguugcu

SEQ ID NO: 1540367 - RNA, 20 nt, Human adenovirus A
cacuuggcuucgaaugcugu

SEQ ID NO: 1540368 - RNA, 19 nt, Human adenovirus A
caucuaaaccuauaacaau

SEQ ID NO: 1540369 - RNA, 15 nt, Human adenovirus A
caaacagccgaaaga

SEQ ID NO: 1540370 - RNA, 18 nt, Human adenovirus A
ugaauuguauaaauucuu

SEQ ID NO: 1540371 - RNA, 14 nt, Human adenovirus A
acucacuggccuga

SEQ ID NO: 1540372 - RNA, 20 nt, Human adenovirus A
cggcacaacagacuggggaa

SEQ ID NO: 1540373 - RNA, 17 nt, Human adenovirus A
accaugaaaacagcauu

SEQ ID NO: 1540374 - RNA, 20 nt, Human adenovirus A
cuuccauuugaucagaaaaa

SEQ ID NO: 1540375 - RNA, 14 nt, Human adenovirus A
guuuagaaacccca

SEQ ID NO: 1540376 - RNA, 14 nt, Human adenovirus A
agacgaacaaacuu

SEQ ID NO: 1540377 - RNA, 12 nt, Human adenovirus A
uagcaaagccau

SEQ ID NO: 1540378 - RNA, 14 nt, Human adenovirus A
uucuaaaagagcca

SEQ ID NO: 1540379 - RNA, 18 nt, Human adenovirus A
ggcaauauuccagcucuu

SEQ ID NO: 1540380 - RNA, 15 nt, Human adenovirus A
gauucuucuucccaa

SEQ ID NO: 1540381 - RNA, 14 nt, Human adenovirus A
ucugcaugaugcau

SEQ ID NO: 1540382 - RNA, 16 nt, Human adenovirus A
ggcauuccccauccaa

SEQ ID NO: 1540383 - RNA, 17 nt, Human adenovirus A
auuucaugguuugcuaa

SEQ ID NO: 1540384 - RNA, 19 nt, Human adenovirus A
augcuuuagguuagccuga

SEQ ID NO: 1540385 - RNA, 19 nt, Human adenovirus A
gcaguuuagaggccacacu

SEQ ID NO: 1540386 - RNA, 12 nt, Human adenovirus A
caacaguacagg

SEQ ID NO: 1540387 - RNA, 18 nt, Human adenovirus A
cauagccaaucaggcugu

SEQ ID NO: 1540388 - RNA, 16 nt, Human adenovirus A
cuaauacuuccauccg

SEQ ID NO: 1540389 - RNA, 19 nt, Human adenovirus A
uaugcgugagggugccacc

SEQ ID NO: 1540390 - RNA, 19 nt, Human adenovirus A
aggaacuaaaccuuccauc

SEQ ID NO: 1540391 - RNA, 18 nt, Human adenovirus A
cucuguaguuucuuuaca

SEQ ID NO: 1540392 - RNA, 16 nt, Human adenovirus A
guucacuuacccgcag

SEQ ID NO: 1540393 - RNA, 15 nt, Human adenovirus A
gcugcauugccacua

SEQ ID NO: 1540394 - RNA, 14 nt, Human adenovirus A
gcauuaaagcaaac

SEQ ID NO: 1540395 - RNA, 17 nt, Human adenovirus A
ucaaugcagcuguggag

SEQ ID NO: 1540396 - RNA, 12 nt, Human adenovirus A
aguguuucagcu

SEQ ID NO: 1540397 - RNA, 12 nt, Human adenovirus A
ccugcagcacug

SEQ ID NO: 1540398 - RNA, 15 nt, Human adenovirus A
ugccaguuguauaaa

SEQ ID NO: 1540399 - RNA, 11 nt, Human adenovirus A
agcaaguaaac

SEQ ID NO: 1540400 - RNA, 13 nt, Human adenovirus A
cggccucagcagc

SEQ ID NO: 1540401 - RNA, 16 nt, Human adenovirus A
ccguaaaauacacaua

SEQ ID NO: 1540402 - RNA, 12 nt, Human adenovirus A
ggauacagagga

SEQ ID NO: 1540403 - RNA, 13 nt, Human adenovirus A
gcuggcuguugcu

SEQ ID NO: 1540404 - RNA, 18 nt, Human adenovirus A
auuccuccuuauccuucc

SEQ ID NO: 1540405 - RNA, 17 nt, Human adenovirus A
aacggcgcgcaguccug

SEQ ID NO: 1540406 - RNA, 17 nt, Human adenovirus A
aagugucuuguuaaugu

SEQ ID NO: 1540407 - RNA, 14 nt, Human adenovirus A
caagaggagaagga

SEQ ID NO: 1540408 - RNA, 18 nt, Human adenovirus A
ugaaguguaucagucugg

SEQ ID NO: 1540409 - RNA, 13 nt, Human adenovirus A
aagagcugcugca

SEQ ID NO: 1540410 - RNA, 16 nt, Human adenovirus A
caaggcguggaacagc

SEQ ID NO: 1540411 - RNA, 13 nt, Human adenovirus A
cgccguccuauga

SEQ ID NO: 1540412 - RNA, 13 nt, Human adenovirus A
uguuaucuucaaa

SEQ ID NO: 1540413 - RNA, 16 nt, Human adenovirus A
ucacacuuaacacaag

SEQ ID NO: 1540414 - RNA, 17 nt, Human adenovirus A
cauccgaggugacauga

SEQ ID NO: 1540415 - RNA, 13 nt, Human adenovirus A
ucgcgacaacagc

SEQ ID NO: 1540416 - RNA, 14 nt, Human adenovirus A
augaagcacgcaga

SEQ ID NO: 1540417 - RNA, 22 nt, Human adenovirus A
cccacgguauuggccauuccug

SEQ ID NO: 1540418 - RNA, 19 nt, Human adenovirus A
aaagaccccauuguaacug

SEQ ID NO: 1540419 - RNA, 20 nt, Human adenovirus A
uucccuaucauuaagaacac

SEQ ID NO: 1540420 - RNA, 15 nt, Human adenovirus A
cugcacuaacucuga

SEQ ID NO: 1540421 - RNA, 17 nt, Human adenovirus A
cuaugaugcgggcagcc

SEQ ID NO: 1540422 - RNA, 23 nt, Human adenovirus A
guaauuggcaaaguacccuaaac

SEQ ID NO: 1540423 - RNA, 13 nt, Human adenovirus A
caugcaaagccag

SEQ ID NO: 1540424 - RNA, 17 nt, Human adenovirus A
guuuaugcgcuguacca

SEQ ID NO: 1540425 - RNA, 17 nt, Human adenovirus A
ugaggagcugagaagug

SEQ ID NO: 1540426 - RNA, 16 nt, Human adenovirus A
ugcugaagaaacagaa

SEQ ID NO: 1540427 - RNA, 19 nt, Human adenovirus A
uacacacuacgcccacuuc

SEQ ID NO: 1540428 - RNA, 14 nt, Human adenovirus A
cggaaaucugaaaa

SEQ ID NO: 1540429 - RNA, 19 nt, Human adenovirus A
uaaaauuucuaauguggag

SEQ ID NO: 1540430 - RNA, 21 nt, Human adenovirus A
auccaaguucuaaugcaaguu

SEQ ID NO: 1540431 - RNA, 22 nt, Human adenovirus A
gauggauuaccuucaccgcgcu

SEQ ID NO: 1540432 - RNA, 15 nt, Human adenovirus A
gggacagcaagcagc

SEQ ID NO: 1540433 - RNA, 16 nt, Human adenovirus A
gaaaaagcuacaucuu

SEQ ID NO: 1540434 - RNA, 14 nt, Human adenovirus A
agcuuagccuuaau

SEQ ID NO: 1540435 - RNA, 19 nt, Human adenovirus A
ccaucagaaauuuguugcu

SEQ ID NO: 1540436 - RNA, 19 nt, Human adenovirus A
acaugauucuucagagcac

SEQ ID NO: 1540437 - RNA, 14 nt, Human adenovirus A
auggaaaaaacgaa

SEQ ID NO: 1540438 - RNA, 20 nt, Human adenovirus A
aguaaagauauucccacgcc

SEQ ID NO: 1540439 - RNA, 18 nt, Human adenovirus A
cugagaaccgucugcaug

SEQ ID NO: 1540440 - RNA, 13 nt, Human adenovirus A
cauaacauguuua

SEQ ID NO: 1540441 - RNA, 21 nt, Human adenovirus A
acgucaccaccucaaaaucua

SEQ ID NO: 1540442 - RNA, 22 nt, Human adenovirus A
aucccgcgguuuuggcggccau

SEQ ID NO: 1540443 - RNA, 19 nt, Human adenovirus A
cacgccaaagccacaccuc

SEQ ID NO: 1540444 - RNA, 13 nt, Human adenovirus A
gggugauaugcau

SEQ ID NO: 1540445 - RNA, 15 nt, Human adenovirus A
cugcaauuucuuuca

SEQ ID NO: 1540446 - RNA, 16 nt, Human adenovirus A
uaagcgauuuuccaaa

SEQ ID NO: 1540447 - RNA, 19 nt, Human adenovirus A
uaguaggcuaacuguuaau

SEQ ID NO: 1540448 - RNA, 18 nt, Human adenovirus A
cucauguauuuuuucaaa

SEQ ID NO: 1540449 - RNA, 13 nt, Human adenovirus A
caaugugcaggcu

SEQ ID NO: 1540450 - RNA, 15 nt, Human adenovirus A
gcgguggaacugcag

SEQ ID NO: 1540451 - RNA, 15 nt, Human adenovirus A
gacaaggaagugaag

SEQ ID NO: 1540452 - RNA, 17 nt, Human adenovirus A
ccuguaguugcagcaga

SEQ ID NO: 1540453 - RNA, 21 nt, Human adenovirus A
aacacgggcuggggacugggu

SEQ ID NO: 1540454 - RNA, 13 nt, Human adenovirus A
cccaagggugcag

SEQ ID NO: 1540455 - RNA, 13 nt, Human adenovirus A
agcaaaaugaauu

SEQ ID NO: 1540456 - RNA, 19 nt, Human adenovirus A
caaccuauuaaccugggau

SEQ ID NO: 1540457 - RNA, 19 nt, Human adenovirus A
gccucgcaccagaaagcag

SEQ ID NO: 1540458 - RNA, 18 nt, Human adenovirus A
gacaaagagcuuaugcau

SEQ ID NO: 1540459 - RNA, 18 nt, Human adenovirus A
cuacuaacaacuccagau

SEQ ID NO: 1540460 - RNA, 15 nt, Human adenovirus A
cauuaucaugaaacu

SEQ ID NO: 1540461 - RNA, 13 nt, Human adenovirus A
ugccgacaacacu

SEQ ID NO: 1540462 - RNA, 20 nt, Human adenovirus A
cgcguggcauuugugccucg

SEQ ID NO: 1540463 - RNA, 13 nt, Human adenovirus A
aacauaaaacuac

SEQ ID NO: 1540464 - RNA, 15 nt, Human adenovirus A
agagagcuaagcgac

SEQ ID NO: 1540465 - RNA, 22 nt, Human adenovirus A
uccauaaggcggcguccuuucu

SEQ ID NO: 1540466 - RNA, 13 nt, Human adenovirus A
agaggaaaagcug

SEQ ID NO: 1540467 - RNA, 18 nt, Human adenovirus A
uugcauauauccuugcaa

SEQ ID NO: 1540468 - RNA, 16 nt, Human adenovirus A
cuucacuacacuuucc

SEQ ID NO: 1540469 - RNA, 10 nt, Human adenovirus A
aaagaaacuc

SEQ ID NO: 1540470 - RNA, 14 nt, Human adenovirus A
gagcagcaaaugcc

SEQ ID NO: 1540471 - RNA, 23 nt, Human adenovirus A
ggcgguucggguccugcgggaag

SEQ ID NO: 1540472 - RNA, 21 nt, Human adenovirus A
cccugcuccgacaacagcugc

SEQ ID NO: 1540473 - RNA, 14 nt, Human adenovirus A
uaagauuguaauuu

SEQ ID NO: 1540474 - RNA, 15 nt, Human adenovirus A
gguggggugcugccc

SEQ ID NO: 1540475 - RNA, 19 nt, Human adenovirus A
ugcaagaggagaaggagga

SEQ ID NO: 1540476 - RNA, 17 nt, Human adenovirus A
caucuauaguaaaaaug

SEQ ID NO: 1540477 - RNA, 17 nt, Human adenovirus A
ugggaguucaaacagug

SEQ ID NO: 1540478 - RNA, 15 nt, Human adenovirus A
cugacgucacuggcg

SEQ ID NO: 1540479 - RNA, 16 nt, Human adenovirus A
ggaggcagcuggagug

SEQ ID NO: 1540480 - RNA, 18 nt, Human adenovirus A
uucgcaggagaaaauaac

SEQ ID NO: 1540481 - RNA, 14 nt, Human adenovirus A
cuaacucugauuac

SEQ ID NO: 1540482 - RNA, 15 nt, Human adenovirus A
uacugcucccucucg

SEQ ID NO: 1540483 - RNA, 20 nt, Human adenovirus A
acaucgccggucaggaugcc

SEQ ID NO: 1540484 - RNA, 15 nt, Human adenovirus A
gugugcugcaaacau

SEQ ID NO: 1540485 - RNA, 15 nt, Human adenovirus A
cuuaguuguaaauuc

SEQ ID NO: 1540486 - RNA, 18 nt, Human adenovirus A
cagaauauaagaacuaca

SEQ ID NO: 1540487 - RNA, 17 nt, Human adenovirus A
aaccaugacuauugacu

SEQ ID NO: 1540488 - RNA, 11 nt, Human adenovirus A
ccacagcucug

SEQ ID NO: 1540489 - RNA, 14 nt, Human adenovirus A
ccgcugcucagcuc

SEQ ID NO: 1540490 - RNA, 18 nt, Human adenovirus A
gcaaaccacugcaaugca

SEQ ID NO: 1540491 - RNA, 17 nt, Human adenovirus A
uuagaaggaaaggcaug

SEQ ID NO: 1540492 - RNA, 20 nt, Human adenovirus A
ugacuggacagcggccaugg

SEQ ID NO: 1540493 - RNA, 18 nt, Human adenovirus A
aaccagcugggcagaaag

SEQ ID NO: 1540494 - RNA, 16 nt, Human adenovirus A
gacuggcugcuuugcg

SEQ ID NO: 1540495 - RNA, 18 nt, Human adenovirus A
cacccuuaauugcagggg

SEQ ID NO: 1540496 - RNA, 19 nt, Human adenovirus A
cauuuuggagcaagcggca

SEQ ID NO: 1540497 - RNA, 14 nt, Human adenovirus A
ccagucgccgcaga

SEQ ID NO: 1540498 - RNA, 13 nt, Human adenovirus A
aacuuuuaacauu

SEQ ID NO: 1540499 - RNA, 19 nt, Human adenovirus A
ccagcugaacgggggcgcc

SEQ ID NO: 1540500 - RNA, 23 nt, Human adenovirus A
auccugucgagcuaaccgcagcc

SEQ ID NO: 1540501 - RNA, 16 nt, Human adenovirus A
ccaccguggcucccac

SEQ ID NO: 1540502 - RNA, 12 nt, Human adenovirus A
uuaugaaucuuu

SEQ ID NO: 1540503 - RNA, 14 nt, Human adenovirus A
agcacacugggaaa

SEQ ID NO: 1540504 - RNA, 24 nt, Human adenovirus A
aaacaaggucuagccaacauccag

SEQ ID NO: 1540505 - RNA, 18 nt, Human adenovirus A
uaacuuuauauugcauuu

SEQ ID NO: 1540506 - RNA, 18 nt, Human adenovirus A
aaauuuguugcuguugcc

SEQ ID NO: 1540507 - RNA, 15 nt, Human adenovirus A
uguggcccaaugcaa

SEQ ID NO: 1540508 - RNA, 23 nt, Human adenovirus A
uagguguaagucacguguucaca

SEQ ID NO: 1540509 - RNA, 17 nt, Human adenovirus A
ccugaguugggauuaca

SEQ ID NO: 1540510 - RNA, 17 nt, Human adenovirus A
accacguacgaccacug

SEQ ID NO: 1540511 - RNA, 20 nt, Human adenovirus A
uuccagcgccaccugccauu

SEQ ID NO: 1540512 - RNA, 22 nt, Human adenovirus A
agcuucuaaaagagccacagcu

SEQ ID NO: 1540513 - RNA, 21 nt, Human adenovirus A
gaacggucgauuucggcggcg

SEQ ID NO: 1540514 - RNA, 21 nt, Human adenovirus A
gcuacgagacuccccccgagg

SEQ ID NO: 1540515 - RNA, 13 nt, Human adenovirus A
cgagacugcauuu

SEQ ID NO: 1540516 - RNA, 22 nt, Human adenovirus A
gagacgggccgcagcugcggcc

SEQ ID NO: 1540517 - RNA, 23 nt, Human adenovirus A
gcuguggaaagcauuuuggauuu

SEQ ID NO: 1540518 - RNA, 22 nt, Human adenovirus A
uggcaggaguugcaggaugaau

SEQ ID NO: 1540519 - RNA, 13 nt, Human adenovirus A
caaagcacugggc

SEQ ID NO: 1540520 - RNA, 21 nt, Human adenovirus A
cggaguucccacagaacauac

SEQ ID NO: 1540521 - RNA, 15 nt, Human adenovirus A
ggguccugcgggaag

SEQ ID NO: 1540522 - RNA, 12 nt, Human adenovirus A
uccccuguggag

SEQ ID NO: 1540523 - RNA, 17 nt, Human adenovirus A
ccacugcaaugcagccg

SEQ ID NO: 1540524 - RNA, 21 nt, Human adenovirus A
cucccgauaccaaaaacaccu

SEQ ID NO: 1540525 - RNA, 17 nt, Human adenovirus A
caaaugcgaccucagcc

SEQ ID NO: 1540526 - RNA, 21 nt, Human adenovirus A
uccaggggaaacccauuugca

SEQ ID NO: 1540527 - RNA, 21 nt, Human adenovirus A
guacgcauucaccagccacac

SEQ ID NO: 1540528 - RNA, 16 nt, Human adenovirus A
ggacaaguugcuuucc

SEQ ID NO: 1540529 - RNA, 21 nt, Human adenovirus A
cuaaacgaccgccuuuucuag

SEQ ID NO: 1540530 - RNA, 21 nt, Human adenovirus A
gggccggaguacgucagaaug

SEQ ID NO: 1540531 - RNA, 16 nt, Human adenovirus A
uaaaaaucacaaaaua

SEQ ID NO: 1540532 - RNA, 14 nt, Human adenovirus A
aauuccgcagugga

SEQ ID NO: 1540533 - RNA, 13 nt, Human adenovirus A
gcaaagaugaggc

SEQ ID NO: 1540534 - RNA, 13 nt, Human adenovirus A
cagauucuggaga

SEQ ID NO: 1540535 - RNA, 13 nt, Human adenovirus A
auaaaaacacaca

SEQ ID NO: 1540536 - RNA, 17 nt, Human adenovirus A
uuugagccagaugaaca

SEQ ID NO: 1540537 - RNA, 16 nt, Human adenovirus A
guuuuaugcucguaaa

SEQ ID NO: 1540538 - RNA, 22 nt, Human adenovirus A
ugugagggccgaugcauacaug

SEQ ID NO: 1540539 - RNA, 14 nt, Human adenovirus A
aaagaaacagcagc

SEQ ID NO: 1540540 - RNA, 19 nt, Human adenovirus A
gcaaaugcccugcaaaaag

SEQ ID NO: 1540541 - RNA, 14 nt, Human adenovirus A
aagcagcgccaaau

SEQ ID NO: 1540542 - RNA, 17 nt, Human adenovirus A
aacuauggaaauccaaa

SEQ ID NO: 1540543 - RNA, 16 nt, Human adenovirus A
gucgcuuucaaccaag

SEQ ID NO: 1540544 - RNA, 16 nt, Human adenovirus A
ccuuuaccaacaccaa

SEQ ID NO: 1540545 - RNA, 21 nt, Human adenovirus A
auuuguuccuuuucacauuca

SEQ ID NO: 1540546 - RNA, 13 nt, Human adenovirus A
acaacauugaacu

SEQ ID NO: 1540547 - RNA, 15 nt, Human adenovirus A
ccaguacacuuggga

SEQ ID NO: 1540548 - RNA, 15 nt, Human adenovirus A
uacaaaucuuucaau

SEQ ID NO: 1540549 - RNA, 22 nt, Human adenovirus A
uaaggcggcguccuuucucugu

SEQ ID NO: 1540550 - RNA, 13 nt, Human adenovirus A
accccaaggcaug

SEQ ID NO: 1540551 - RNA, 18 nt, Human adenovirus A
gauuuaggagggucagga

SEQ ID NO: 1540552 - RNA, 14 nt, Human adenovirus A
cucaguagccuugc

SEQ ID NO: 1540553 - RNA, 11 nt, Human adenovirus A
uuuuccaaaug

SEQ ID NO: 1540554 - RNA, 18 nt, Human adenovirus A
auugcaacgcaaucagaa

SEQ ID NO: 1540555 - RNA, 15 nt, Human adenovirus A
auuguuggccuguau

SEQ ID NO: 1540556 - RNA, 19 nt, Human adenovirus A
gcaaugcagccgugcuaug

SEQ ID NO: 1540557 - RNA, 21 nt, Human adenovirus A
gcgcccauaacaucaggagca

SEQ ID NO: 1540558 - RNA, 13 nt, Human adenovirus A
uguaauaaagcua

SEQ ID NO: 1540559 - RNA, 18 nt, Human adenovirus A
auuacuaccgucaucucu

SEQ ID NO: 1540560 - RNA, 23 nt, Human adenovirus A
ucauacauaauuuuaaaguaaau

SEQ ID NO: 1540561 - RNA, 16 nt, Human adenovirus A
uuaaccacuguagugc

SEQ ID NO: 1540562 - RNA, 20 nt, Human adenovirus A
acuuagaccggauggguaca

SEQ ID NO: 1540563 - RNA, 16 nt, Human adenovirus A
cuuuuacucacuggcc

SEQ ID NO: 1540564 - RNA, 23 nt, Human adenovirus A
aaaucucgucggcggacagagca

SEQ ID NO: 1540565 - RNA, 18 nt, Human adenovirus A
aaccacauaggcauuggg

SEQ ID NO: 1540566 - RNA, 23 nt, Human adenovirus A
agugcccucacacuuaacacaag

SEQ ID NO: 1540567 - RNA, 19 nt, Human adenovirus A
acaccuuggucucgcagcu

SEQ ID NO: 1540568 - RNA, 16 nt, Human adenovirus A
ccuucuacgcuuccaa

SEQ ID NO: 1540569 - RNA, 22 nt, Human adenovirus A
gcgucacccaagggugcagcuc

SEQ ID NO: 1540570 - RNA, 16 nt, Human adenovirus A
uaauuaucccuuugau

SEQ ID NO: 1540571 - RNA, 12 nt, Human adenovirus A
ccuccuucccau

SEQ ID NO: 1540572 - RNA, 21 nt, Human adenovirus A
uggcauagaaaguuugguaga

SEQ ID NO: 1540573 - RNA, 14 nt, Human adenovirus A
aaaauaaucaauuu

SEQ ID NO: 1540574 - RNA, 21 nt, Human adenovirus A
accaagcccucuccaaugaaa

SEQ ID NO: 1540575 - RNA, 20 nt, Human adenovirus A
ccaccgccaugcgcgcggcc

SEQ ID NO: 1540576 - RNA, 18 nt, Human adenovirus A
uauuucacaagacacauu

SEQ ID NO: 1540577 - RNA, 23 nt, Human adenovirus A
uaauaucauuaaauaauauuuug

SEQ ID NO: 1540578 - RNA, 20 nt, Human adenovirus A
gcgcuuuggaggcagcugga

SEQ ID NO: 1540579 - RNA, 21 nt, Human adenovirus A
gaaaguucaccuccagguaca

SEQ ID NO: 1540580 - RNA, 12 nt, Human adenovirus A
cuagauggggug

SEQ ID NO: 1540581 - RNA, 21 nt, Human adenovirus A
cugcgacauuuagaccacugu

SEQ ID NO: 1540582 - RNA, 17 nt, Human adenovirus A
accacuguagugcaaaa

SEQ ID NO: 1540583 - RNA, 17 nt, Human adenovirus A
uaacauucugcagagca

SEQ ID NO: 1540584 - RNA, 20 nt, Human adenovirus A
cacaauuuucuggugguggg

SEQ ID NO: 1540585 - RNA, 11 nt, Human adenovirus A
agcaaagccau

SEQ ID NO: 1540586 - RNA, 23 nt, Human adenovirus A
uaccaccaaauuuaaggccaggg

SEQ ID NO: 1540587 - RNA, 17 nt, Human adenovirus A
caugugcgcacacuaau

SEQ ID NO: 1540588 - RNA, 16 nt, Human adenovirus A
cacccucccagacugc

SEQ ID NO: 1540589 - RNA, 21 nt, Human adenovirus A
cagcaaacuuucuccaaaucu

SEQ ID NO: 1540590 - RNA, 18 nt, Human adenovirus A
gacaacagcugcugucac

SEQ ID NO: 1540591 - RNA, 14 nt, Human adenovirus A
aggcauuaaauggu

SEQ ID NO: 1540592 - RNA, 19 nt, Human adenovirus A
uaugcaaggcgccgcagac

SEQ ID NO: 1540593 - RNA, 16 nt, Human adenovirus A
auuucucuuuucuuua

SEQ ID NO: 1540594 - RNA, 17 nt, Human adenovirus A
ggcaucuugcaugaaaa

SEQ ID NO: 1540595 - RNA, 15 nt, Human adenovirus A
uaccgucaucucuac

SEQ ID NO: 1540596 - RNA, 18 nt, Human adenovirus A
cucguaaaaucuacaaaa

SEQ ID NO: 1540597 - RNA, 14 nt, Human adenovirus A
ucgacgggccaggc

SEQ ID NO: 1540598 - RNA, 21 nt, Human adenovirus A
cugacuauuucacaagacaca

SEQ ID NO: 1540599 - RNA, 17 nt, Human adenovirus A
ggaauuuacuccaucug

SEQ ID NO: 1540600 - RNA, 23 nt, Human adenovirus A
aaacaggcuauugcgcagcaacg

SEQ ID NO: 1540601 - RNA, 15 nt, Human adenovirus A
ccgcccaggcaggcg

SEQ ID NO: 1540602 - RNA, 19 nt, Human adenovirus A
ugaggacacugaaggcauu

SEQ ID NO: 1540603 - RNA, 12 nt, Human adenovirus A
gauuuuuguccc

SEQ ID NO: 1540604 - RNA, 21 nt, Human adenovirus A
auaaugcagcuucagaaaaug

SEQ ID NO: 1540605 - RNA, 11 nt, Human adenovirus A
caagauuuaau

SEQ ID NO: 1540606 - RNA, 19 nt, Human adenovirus A
auuaccagcagccaaaacu

SEQ ID NO: 1540607 - RNA, 15 nt, Human adenovirus A
gugauaugcauuuac

SEQ ID NO: 1540608 - RNA, 12 nt, Human adenovirus A
ggagggucagga

SEQ ID NO: 1540609 - RNA, 20 nt, Human adenovirus A
accguucuuugguuugcaau

SEQ ID NO: 1540610 - RNA, 20 nt, Human adenovirus A
cauuguuggccuguauguga

SEQ ID NO: 1540611 - RNA, 21 nt, Human adenovirus A
agaaucaaucucagugucauu

SEQ ID NO: 1540612 - RNA, 20 nt, Human adenovirus A
ucaagccuaccugacacuac

SEQ ID NO: 1540613 - RNA, 18 nt, Human adenovirus A
ugaccaccuuacccuguc

SEQ ID NO: 1540614 - RNA, 20 nt, Human adenovirus A
agccaugcuaugcaggcagc

SEQ ID NO: 1540615 - RNA, 12 nt, Human adenovirus A
ugacuggcaugg

SEQ ID NO: 1540616 - RNA, 16 nt, Human adenovirus A
cggggcuacugcucau

SEQ ID NO: 1540617 - RNA, 21 nt, Human adenovirus A
agcguuucagcgccaacaaaa

SEQ ID NO: 1540618 - RNA, 13 nt, Human adenovirus A
cugcauuggguga

SEQ ID NO: 1540619 - RNA, 22 nt, Human adenovirus A
uguaacuguggaacucgagugc

SEQ ID NO: 1540620 - RNA, 15 nt, Human adenovirus A
ccgcgccccacuucc

SEQ ID NO: 1540621 - RNA, 19 nt, Human adenovirus A
caauaguggcugcaagguc

SEQ ID NO: 1540622 - RNA, 14 nt, Human adenovirus A
cugggaguaaaguc

SEQ ID NO: 1540623 - RNA, 22 nt, Human adenovirus A
agucgugguggaagcuggccau

SEQ ID NO: 1540624 - RNA, 12 nt, Human adenovirus A
aaagagccacag

SEQ ID NO: 1540625 - RNA, 18 nt, Human adenovirus A
auucauauuguggagaac

SEQ ID NO: 1540626 - RNA, 17 nt, Human adenovirus A
ucaacauaguagagaca

SEQ ID NO: 1540627 - RNA, 17 nt, Human adenovirus A
cuugggaaauuugucau

SEQ ID NO: 1540628 - RNA, 23 nt, Human adenovirus A
gggcuguaucuguugaaugaggu

SEQ ID NO: 1540629 - RNA, 17 nt, Human adenovirus A
auuuucuccccacagcu

SEQ ID NO: 1540630 - RNA, 17 nt, Human adenovirus A
auacuaacaaugcuuuc

SEQ ID NO: 1540631 - RNA, 19 nt, Human adenovirus A
caaaaauguuuucuggauc

SEQ ID NO: 1540632 - RNA, 13 nt, Human adenovirus A
aggaagcugagga

SEQ ID NO: 1540633 - RNA, 11 nt, Human adenovirus A
guacacuggcu

SEQ ID NO: 1540634 - RNA, 16 nt, Human adenovirus A
uuggcuuucgaggggu

SEQ ID NO: 1540635 - RNA, 16 nt, Human adenovirus A
caacuuaacccucccu

SEQ ID NO: 1540636 - RNA, 20 nt, Human adenovirus A
ucucaccacugaaacucccu

SEQ ID NO: 1540637 - RNA, 13 nt, Human adenovirus A
aaaagaucaagga

SEQ ID NO: 1540638 - RNA, 20 nt, Human adenovirus A
acauucgcagcgcacuggca

SEQ ID NO: 1540639 - RNA, 17 nt, Human adenovirus A
agucccggucuggugca

SEQ ID NO: 1540640 - RNA, 21 nt, Human adenovirus A
ugucggccugacgcucuggca

SEQ ID NO: 1540641 - RNA, 15 nt, Human adenovirus A
aucaucaaacugccu

SEQ ID NO: 1540642 - RNA, 20 nt, Human adenovirus A
aaugucucgcuggaaaacau

SEQ ID NO: 1540643 - RNA, 16 nt, Human adenovirus A
cauucuuuucauuuuc

SEQ ID NO: 1540644 - RNA, 16 nt, Human adenovirus A
acacuaauacuuccau

SEQ ID NO: 1540645 - RNA, 20 nt, Human adenovirus A
ccgccaugcgcgcggccaga

SEQ ID NO: 1540646 - RNA, 21 nt, Human adenovirus A
ccagcugcccugauauaucag

SEQ ID NO: 1540647 - RNA, 13 nt, Human adenovirus A
caacguagcuuuu

SEQ ID NO: 1540648 - RNA, 15 nt, Human adenovirus A
auauauccuugcaaa

SEQ ID NO: 1540649 - RNA, 15 nt, Human adenovirus A
cgcucauuugcgccc

SEQ ID NO: 1540650 - RNA, 23 nt, Human adenovirus A
uuacaacuugcuuccagacaaaa

SEQ ID NO: 1540651 - RNA, 13 nt, Human adenovirus A
cuaggggcuggcu

SEQ ID NO: 1540652 - RNA, 23 nt, Human adenovirus A
guugaccgaccuucauuuuuucu

SEQ ID NO: 1540653 - RNA, 22 nt, Human adenovirus A
gaggcguagaugugcuguggaa

SEQ ID NO: 1540654 - RNA, 17 nt, Human adenovirus A
guagaggaaaagcugcc

SEQ ID NO: 1540655 - RNA, 20 nt, Human adenovirus A
gcaguaggugaaauaaaaaa

SEQ ID NO: 1540656 - RNA, 11 nt, Human adenovirus A
uaaagaaacuc

SEQ ID NO: 1540657 - RNA, 19 nt, Human adenovirus A
guccuccucguacaggaau

SEQ ID NO: 1540658 - RNA, 18 nt, Human adenovirus A
agcugaaaacaacugcac

SEQ ID NO: 1540659 - RNA, 19 nt, Human adenovirus A
auguuaaauuaaagaugcc

SEQ ID NO: 1540660 - RNA, 16 nt, Human adenovirus A
gauuuaucuguggaau

SEQ ID NO: 1540661 - RNA, 23 nt, Human adenovirus A
cauaauuaaacccuuuagcaguu

SEQ ID NO: 1540662 - RNA, 15 nt, Human adenovirus A
uuuuaacugugaaaa

SEQ ID NO: 1540663 - RNA, 20 nt, Human adenovirus A
ugauucaagaggaagaaaga

SEQ ID NO: 1540664 - RNA, 11 nt, Human adenovirus A
ccuguggagcc

SEQ ID NO: 1540665 - RNA, 15 nt, Human adenovirus A
aguaggcuaacuguu

SEQ ID NO: 1540666 - RNA, 23 nt, Human adenovirus A
caggaugaauuucagcgggguga

SEQ ID NO: 1540667 - RNA, 15 nt, Human adenovirus A
acccucccucuuggc

SEQ ID NO: 1540668 - RNA, 20 nt, Human adenovirus A
auggaccuacuuacuggggu

SEQ ID NO: 1540669 - RNA, 16 nt, Human adenovirus A
auuggaguacaagcuu

SEQ ID NO: 1540670 - RNA, 22 nt, Human adenovirus A
aacaacugcacuugaauauuuc

SEQ ID NO: 1540671 - RNA, 13 nt, Human adenovirus A
caaggaaaugagg

SEQ ID NO: 1540672 - RNA, 18 nt, Human adenovirus A
ugcucuuggugguucugc

SEQ ID NO: 1540673 - RNA, 22 nt, Human adenovirus A
cuaaauguaacugaggagcuga

SEQ ID NO: 1540674 - RNA, 17 nt, Human adenovirus A
cuuaguuguaaauucua

SEQ ID NO: 1540675 - RNA, 22 nt, Human adenovirus A
uacagaggaacguaacuuucaa

SEQ ID NO: 1540676 - RNA, 12 nt, Human adenovirus A
gacgcaaaaaag

SEQ ID NO: 1540677 - RNA, 13 nt, Human adenovirus A
cgauuccaaggaa

SEQ ID NO: 1540678 - RNA, 13 nt, Human adenovirus A
cuuauuuuccuuc

SEQ ID NO: 1540679 - RNA, 17 nt, Human adenovirus A
uaauagcacuuuggaug

SEQ ID NO: 1540680 - RNA, 12 nt, Human adenovirus A
cugagcggcaag

SEQ ID NO: 1540681 - RNA, 20 nt, Human adenovirus A
agauauaguacugcuuccag

SEQ ID NO: 1540682 - RNA, 20 nt, Human adenovirus A
uaugaacacuuagagggagg

SEQ ID NO: 1540683 - RNA, 12 nt, Human adenovirus A
cuuaauuucuag

SEQ ID NO: 1540684 - RNA, 15 nt, Human adenovirus A
cuugagccuggauaa

SEQ ID NO: 1540685 - RNA, 21 nt, Human adenovirus A
acaugaagauuucugcuguca

SEQ ID NO: 1540686 - RNA, 12 nt, Human adenovirus A
auuucuuccucc

SEQ ID NO: 1540687 - RNA, 19 nt, Human adenovirus A
aggccaaacagcuguggaa

SEQ ID NO: 1540688 - RNA, 18 nt, Human adenovirus A
gacaccgcccaggcaggc

SEQ ID NO: 1540689 - RNA, 17 nt, Human adenovirus A
ugggaggcguagaugug

SEQ ID NO: 1540690 - RNA, 17 nt, Human adenovirus A
gcggccgcaacagcuau

SEQ ID NO: 1540691 - RNA, 23 nt, Human adenovirus A
caaacguuuuccggguuuugugu

SEQ ID NO: 1540692 - RNA, 13 nt, Human adenovirus A
caaggaaauacua

SEQ ID NO: 1540693 - RNA, 19 nt, Human adenovirus A
ugguuacugaagugccuca

SEQ ID NO: 1540694 - RNA, 17 nt, Human adenovirus A
caaacguccaggcaggg

SEQ ID NO: 1540695 - RNA, 20 nt, Human adenovirus A
uagaccaaaugccagugagg

SEQ ID NO: 1540696 - RNA, 22 nt, Human adenovirus A
cguaccuuuuguuagaugcagc

SEQ ID NO: 1540697 - RNA, 20 nt, Human adenovirus A
gagggcauggcugaagagga

SEQ ID NO: 1540698 - RNA, 14 nt, Human adenovirus A
acaucuuaaugcca

SEQ ID NO: 1540699 - RNA, 15 nt, Human adenovirus A
ugaacccggccaagg

SEQ ID NO: 1540700 - RNA, 18 nt, Human adenovirus A
cgcgugccaggcauuucc

SEQ ID NO: 1540701 - RNA, 17 nt, Human adenovirus A
gaggcguagaugugcug

SEQ ID NO: 1540702 - RNA, 18 nt, Human adenovirus A
gcccauguaucagcagcc

SEQ ID NO: 1540703 - RNA, 22 nt, Human adenovirus A
cacccugugcuuaacaaaaaac

SEQ ID NO: 1540704 - RNA, 19 nt, Human adenovirus A
auuugaaauuuuuaagugg

SEQ ID NO: 1540705 - RNA, 15 nt, Human adenovirus A
augugauaacccuga

SEQ ID NO: 1540706 - RNA, 19 nt, Human adenovirus A
cugcuaaacucacauugug

SEQ ID NO: 1540707 - RNA, 13 nt, Human adenovirus A
auucauauugugg

SEQ ID NO: 1540708 - RNA, 14 nt, Human adenovirus A
gccauuuuggaagc

SEQ ID NO: 1540709 - RNA, 13 nt, Human adenovirus A
ccaauccaaaccc

SEQ ID NO: 1540710 - RNA, 20 nt, Human adenovirus A
ucaauaccacuuggcagcug

SEQ ID NO: 1540711 - RNA, 15 nt, Human adenovirus A
aaccacgaaaacggu

SEQ ID NO: 1540712 - RNA, 16 nt, Human adenovirus A
ucacuacagacaaaca

SEQ ID NO: 1540713 - RNA, 18 nt, Human adenovirus A
ccaccgaucgcucgcagc

SEQ ID NO: 1540714 - RNA, 19 nt, Human adenovirus A
ugggacaaguugcuuucca

SEQ ID NO: 1540715 - RNA, 19 nt, Human adenovirus A
gcauuggaaagcagcuugg

SEQ ID NO: 1540716 - RNA, 21 nt, Human adenovirus A
ccacagcuggcgcacaaguug

SEQ ID NO: 1540717 - RNA, 23 nt, Human adenovirus A
cgcaugcguaucucacuuaaguc

SEQ ID NO: 1540718 - RNA, 21 nt, Human adenovirus A
acugccggucgcgaaacuggg

SEQ ID NO: 1540719 - RNA, 20 nt, Human adenovirus A
ucagcucggaggguccggac

SEQ ID NO: 1540720 - RNA, 22 nt, Human adenovirus A
ggugagcuccgauggguuggga

SEQ ID NO: 1540721 - RNA, 16 nt, Human adenovirus A
caaacaguggacauuc

SEQ ID NO: 1540722 - RNA, 16 nt, Human adenovirus A
gccagaagcacuggca

SEQ ID NO: 1540723 - RNA, 13 nt, Human adenovirus A
aguucuguuucau

SEQ ID NO: 1540724 - RNA, 23 nt, Human adenovirus A
agguaaugguagaggaaaagcug

SEQ ID NO: 1540725 - RNA, 18 nt, Human adenovirus A
caccgcccaggcaggcgc

SEQ ID NO: 1540726 - RNA, 13 nt, Human adenovirus A
agcuaauaccugu

SEQ ID NO: 1540727 - RNA, 16 nt, Human adenovirus A
cuaaauaucgcagcug

SEQ ID NO: 1540728 - RNA, 14 nt, Human adenovirus A
cucuccaauuugug

SEQ ID NO: 1540729 - RNA, 16 nt, Human adenovirus A
uggcaggaguugcagg

SEQ ID NO: 1540730 - RNA, 18 nt, Human adenovirus A
caaguuguggauaccaca

SEQ ID NO: 1540731 - RNA, 12 nt, Human adenovirus A
cuuaaucuguuu

SEQ ID NO: 1540732 - RNA, 17 nt, Human adenovirus A
aaggcugcuaggauuga

SEQ ID NO: 1540733 - RNA, 19 nt, Human adenovirus A
gcauggaaaaacuuggaaa

SEQ ID NO: 1540734 - RNA, 16 nt, Human adenovirus A
gccagcaagugccucc

SEQ ID NO: 1540735 - RNA, 20 nt, Human adenovirus A
aaacagcaaacuuucuccaa

SEQ ID NO: 1540736 - RNA, 19 nt, Human adenovirus A
ggaacagacaccgcccagg

SEQ ID NO: 1540737 - RNA, 23 nt, Human adenovirus A
acacgcuuuuacucacuggccug

SEQ ID NO: 1540738 - RNA, 13 nt, Human adenovirus A
ccaaaaacaccuu

SEQ ID NO: 1540739 - RNA, 17 nt, Human adenovirus A
agcgaucccauagcuca

SEQ ID NO: 1540740 - RNA, 18 nt, Human adenovirus A
gaagagcucgacaaggaa

SEQ ID NO: 1540741 - RNA, 23 nt, Human adenovirus A
ugaagcaaaccacauaggcauug

SEQ ID NO: 1540742 - RNA, 15 nt, Human adenovirus A
ggagaaccuuucaag

SEQ ID NO: 1540743 - RNA, 19 nt, Human adenovirus A
ugagcaaaucucagaaagc

SEQ ID NO: 1540744 - RNA, 19 nt, Human adenovirus A
caccugcaguaaauucagu

SEQ ID NO: 1540745 - RNA, 19 nt, Human adenovirus A
agcugaacgggggcgccuu

SEQ ID NO: 1540746 - RNA, 20 nt, Human adenovirus A
uuuccaccaaaugcucuuug

SEQ ID NO: 1540747 - RNA, 19 nt, Human adenovirus A
cggcacaacagacugggga

SEQ ID NO: 1540748 - RNA, 18 nt, Human adenovirus A
cucaacgugucaguuucu

SEQ ID NO: 1540749 - RNA, 13 nt, Human adenovirus A
caccaccucccuc

SEQ ID NO: 1540750 - RNA, 21 nt, Human adenovirus A
gcaaguaggaccaagugaaug

SEQ ID NO: 1540751 - RNA, 21 nt, Human adenovirus A
acaggaauucugaccacucug

SEQ ID NO: 1540752 - RNA, 13 nt, Human adenovirus A
caggaguugcagg

SEQ ID NO: 1540753 - RNA, 12 nt, Human adenovirus A
ccuuugacaaac

SEQ ID NO: 1540754 - RNA, 15 nt, Human adenovirus A
ccguuccuguugcau

SEQ ID NO: 1540755 - RNA, 21 nt, Human adenovirus A
gccacgcuuugaccggucagg

SEQ ID NO: 1540756 - RNA, 17 nt, Human adenovirus A
ccgcugcucagcuccac

SEQ ID NO: 1540757 - RNA, 19 nt, Human adenovirus A
uacaacugcuccccucaac

SEQ ID NO: 1540758 - RNA, 16 nt, Human adenovirus A
auaaaacugauuuacc

SEQ ID NO: 1540759 - RNA, 21 nt, Human adenovirus A
cacuacccguuccgcaagcac

SEQ ID NO: 1540760 - RNA, 16 nt, Human adenovirus A
aauaucucauuugcaa

SEQ ID NO: 1540761 - RNA, 16 nt, Human adenovirus A
caacaguacaggcaac

SEQ ID NO: 1540762 - RNA, 23 nt, Human adenovirus A
gccuccuauguuagcgccagagg

SEQ ID NO: 1540763 - RNA, 13 nt, Human adenovirus A
cauuaccucugua

SEQ ID NO: 1540764 - RNA, 13 nt, Human adenovirus A
aggguccagggac

SEQ ID NO: 1540765 - RNA, 16 nt, Human adenovirus A
aucuuccgccaaaggu

SEQ ID NO: 1540766 - RNA, 20 nt, Human adenovirus A
cuccuccgugaguuggccug

SEQ ID NO: 1540767 - RNA, 22 nt, Human adenovirus A
caccuuuuguuaauuaaggcgc

SEQ ID NO: 1540768 - RNA, 12 nt, Human adenovirus A
aaacagcagcaa

SEQ ID NO: 1540769 - RNA, 21 nt, Human adenovirus A
aaacaggcuauugcgcagcaa

SEQ ID NO: 1540770 - RNA, 13 nt, Human adenovirus A
aaacgagcagcaa

SEQ ID NO: 1540771 - RNA, 21 nt, Human adenovirus A
aaagagucucaaaagcagcca

SEQ ID NO: 1540772 - RNA, 23 nt, Human adenovirus A
aaauaaugcauuaccagcagcca

SEQ ID NO: 1540773 - RNA, 16 nt, Human adenovirus A
aaauauaaaagcacaa

SEQ ID NO: 1540774 - RNA, 19 nt, Human adenovirus A
aaaucagaagccagcagca

SEQ ID NO: 1540775 - RNA, 19 nt, Human adenovirus A
aaaucugaaaauacaucau

SEQ ID NO: 1540776 - RNA, 21 nt, Human adenovirus A
aaauggaacccuuacacucaa

SEQ ID NO: 1540777 - RNA, 17 nt, Human adenovirus A
caaaauaaacaucucau

SEQ ID NO: 1540778 - RNA, 20 nt, Human adenovirus A
caaauuuuccauacacucau

SEQ ID NO: 1540779 - RNA, 18 nt, Human adenovirus A
caacauaacaacucagga

SEQ ID NO: 1540780 - RNA, 21 nt, Human adenovirus A
cauuccagagagcuacaagga

SEQ ID NO: 1540781 - RNA, 19 nt, Human adenovirus A
cagcgucccaaaagcaucc

SEQ ID NO: 1540782 - RNA, 19 nt, Human adenovirus A
cagcgcacuggcauaagga

SEQ ID NO: 1540783 - RNA, 15 nt, Human adenovirus A
cauaauuaaaggcgc

SEQ ID NO: 1540784 - RNA, 15 nt, Human adenovirus A
cauacauacacucau

SEQ ID NO: 1540785 - RNA, 19 nt, Human adenovirus A
guaccauagcgaggaaccc

SEQ ID NO: 1540786 - RNA, 19 nt, Human adenovirus A
cuuagucauuacaacauug

SEQ ID NO: 1540787 - RNA, 14 nt, Human adenovirus A
cuucgcgaaauugg

SEQ ID NO: 1540788 - RNA, 21 nt, Human adenovirus A
aagcagcgccaaauagagcaa

SEQ ID NO: 1540789 - RNA, 12 nt, Human adenovirus A
cacgccguagac

SEQ ID NO: 1540790 - RNA, 20 nt, Human adenovirus A
cacacuuuuaagaagguguc

SEQ ID NO: 1540791 - RNA, 20 nt, Human adenovirus A
cacagccccuagccguagac

SEQ ID NO: 1540792 - RNA, 20 nt, Human adenovirus A
cacacuuaacacaagagcgc

SEQ ID NO: 1540793 - RNA, 20 nt, Human adenovirus A
cuacuuaaaagcaagcgcgc

SEQ ID NO: 1540794 - RNA, 15 nt, Human adenovirus A
acaucaggagcagaa

SEQ ID NO: 1540795 - RNA, 18 nt, Human adenovirus A
aaucggcaacagcagcaa

SEQ ID NO: 1540796 - RNA, 20 nt, Human adenovirus A
caggauccgcuaugagcaca

SEQ ID NO: 1540797 - RNA, 17 nt, Human adenovirus A
cagcuucuaaaagagcc

SEQ ID NO: 1540798 - RNA, 21 nt, Human adenovirus A
cacaaucugccgcaagugcgc

SEQ ID NO: 1540799 - RNA, 17 nt, Human adenovirus A
aucagccagagccgcaa

SEQ ID NO: 1540800 - RNA, 20 nt, Human adenovirus A
caacccaaacuguacaagga

SEQ ID NO: 1540801 - RNA, 14 nt, Human adenovirus A
caauaaaacaagga

SEQ ID NO: 1540802 - RNA, 23 nt, Human adenovirus A
caauccaaggaugacaacauuga

SEQ ID NO: 1540803 - RNA, 20 nt, Human adenovirus A
caaugcaauaugacuaagga

SEQ ID NO: 1540804 - RNA, 20 nt, Human adenovirus A
gugacaaugcccgccuggca

SEQ ID NO: 1540805 - RNA, 16 nt, Human adenovirus A
cuuguuuaaacauucg

SEQ ID NO: 1540806 - RNA, 14 nt, Human adenovirus A
cuuugacaacauug

SEQ ID NO: 1540807 - RNA, 15 nt, Human adenovirus A
cuuugacaacauugc

SEQ ID NO: 1540808 - RNA, 14 nt, Human adenovirus A
ugcagagcauugug

SEQ ID NO: 1540809 - RNA, 21 nt, Human adenovirus A
uaucgcaccucguccuuuuug

SEQ ID NO: 1540810 - RNA, 17 nt, Human adenovirus A
ucuaaauccgcauuggu

SEQ ID NO: 1540811 - RNA, 14 nt, Human adenovirus A
ucuaaugcaaguug

SEQ ID NO: 1540812 - RNA, 19 nt, Human adenovirus A
uugguuaagcgccggaccc

SEQ ID NO: 1540813 - RNA, 15 nt, Human adenovirus A
uguuugacaagauug

SEQ ID NO: 1540814 - RNA, 11 nt, Human adenovirus A
uuauuggccug

SEQ ID NO: 1540815 - RNA, 17 nt, Human adenovirus A
uucaccgcgcaagcuuu

SEQ ID NO: 1540816 - RNA, 15 nt, Human adenovirus A
uguaaaugcuuuguu

SEQ ID NO: 1540817 - RNA, 21 nt, Human adenovirus A
uguauuggccgggcaagcuuc

SEQ ID NO: 1540818 - RNA, 20 nt, Human adenovirus A
uguuaugcuugccaagcuug

SEQ ID NO: 1540819 - RNA, 13 nt, Human adenovirus A
cuauuacacucag

SEQ ID NO: 1540820 - RNA, 20 nt, Human adenovirus A
gagcccggcguaaccaaaua

SEQ ID NO: 1540821 - RNA, 15 nt, Human adenovirus A
uggaguacaagcuug

SEQ ID NO: 1540822 - RNA, 20 nt, Human adenovirus A
gcugugacacgcaccgcagu

SEQ ID NO: 1540823 - RNA, 20 nt, Human adenovirus A
ugcuauuauugagcauuauu

SEQ ID NO: 1540824 - RNA, 21 nt, Human adenovirus A
uaugcgggagggacaagcuua

SEQ ID NO: 1540825 - RNA, 17 nt, Human adenovirus A
gcagcugacaucuuaau

SEQ ID NO: 1540826 - RNA, 19 nt, Human adenovirus A
aacauuagcagucugguac

SEQ ID NO: 1540827 - RNA, 19 nt, Human adenovirus A
agcgccccccuagcaguaa

SEQ ID NO: 1540828 - RNA, 20 nt, Human adenovirus A
agugaacccggacgcuggca

SEQ ID NO: 1540829 - RNA, 19 nt, Human adenovirus A
agugccagaagcacuggca

SEQ ID NO: 1540830 - RNA, 18 nt, Human adenovirus A
agugucacugccgcugca

SEQ ID NO: 1540831 - RNA, 22 nt, Human adenovirus A
aguugacgccccauccguggca

SEQ ID NO: 1540832 - RNA, 18 nt, Human adenovirus A
ccacgccuggguaccgug

SEQ ID NO: 1540833 - RNA, 21 nt, Human adenovirus A
auucagcuaacaaugcagcaa

SEQ ID NO: 1540834 - RNA, 20 nt, Human adenovirus A
gguacccgccagugcuuuca

SEQ ID NO: 1540835 - RNA, 15 nt, Human adenovirus B (HAdV-B)
caguacaggacaggc

SEQ ID NO: 1540836 - RNA, 20 nt, Human adenovirus B (HAdV-B)
acaagugagaucggacaggg

SEQ ID NO: 1540837 - RNA, 20 nt, Human adenovirus B (HAdV-B)
auccuacgagaucaccgcua

SEQ ID NO: 1540838 - RNA, 21 nt, Human adenovirus B (HAdV-B)
gacugccgcuucuucaacccg

SEQ ID NO: 1540839 - RNA, 14 nt, Human adenovirus B (HAdV-B)
ucaaguacaaccac

SEQ ID NO: 1540840 - RNA, 20 nt, Human adenovirus B (HAdV-B)
cucauaaugacaaaauaucu

SEQ ID NO: 1540841 - RNA, 20 nt, Human adenovirus B (HAdV-B)
ugggauuguuucugaugcaa

SEQ ID NO: 1540842 - RNA, 14 nt, Human adenovirus B (HAdV-B)
gacuuggaagaggg

SEQ ID NO: 1540843 - RNA, 18 nt, Human adenovirus B (HAdV-B)
auuugccaaaaaaacauu

SEQ ID NO: 1540844 - RNA, 18 nt, Human adenovirus B (HAdV-B)
uugcuccugugucaccug

SEQ ID NO: 1540845 - RNA, 13 nt, Human adenovirus B (HAdV-B)
auuaugugcauuu

SEQ ID NO: 1540846 - RNA, 23 nt, Human adenovirus B (HAdV-B)
cagaagacaugcaugacccagau

SEQ ID NO: 1540847 - RNA, 12 nt, Human adenovirus B (HAdV-B)
agacauggaaac

SEQ ID NO: 1540848 - RNA, 18 nt, Human adenovirus B (HAdV-B)
uauagcuuccuuggaaga

SEQ ID NO: 1540849 - RNA, 15 nt, Human adenovirus B (HAdV-B)
ccaucuuccagcaga

SEQ ID NO: 1540850 - RNA, 16 nt, Human adenovirus B (HAdV-B)
ugccaucuuccagcag

SEQ ID NO: 1540851 - RNA, 14 nt, Human adenovirus B (HAdV-B)
cuuagaaaaugcaa

SEQ ID NO: 1540852 - RNA, 16 nt, Human adenovirus B (HAdV-B)
auuuccacuucaacaa

SEQ ID NO: 1540853 - RNA, 15 nt, Human adenovirus B (HAdV-B)
aacaaggucgcagug

SEQ ID NO: 1540854 - RNA, 23 nt, Human adenovirus B (HAdV-B)
cauuacuaccgucaccuccacag

SEQ ID NO: 1540855 - RNA, 12 nt, Human adenovirus B (HAdV-B)
acuuggaagacu

SEQ ID NO: 1540856 - RNA, 13 nt, Human adenovirus B (HAdV-B)
uaucggaggagga

SEQ ID NO: 1540857 - RNA, 18 nt, Human adenovirus B (HAdV-B)
aaucuauggcgaaguuuc

SEQ ID NO: 1540858 - RNA, 21 nt, Human adenovirus B (HAdV-B)
acagagacgagccugggauca

SEQ ID NO: 1540859 - RNA, 16 nt, Human adenovirus B (HAdV-B)
acaaguacugcgcgcu

SEQ ID NO: 1540860 - RNA, 16 nt, Human adenovirus B (HAdV-B)
acaugaaucaugugaa

SEQ ID NO: 1540861 - RNA, 17 nt, Human adenovirus B (HAdV-B)
uccaaggucuuccuaca

SEQ ID NO: 1540862 - RNA, 15 nt, Human adenovirus B (HAdV-B)
ugaauuggcucagcg

SEQ ID NO: 1540863 - RNA, 20 nt, Human adenovirus B (HAdV-B)
uuacaguggaugacaccaac

SEQ ID NO: 1540864 - RNA, 17 nt, Human adenovirus B (HAdV-B)
cuccaucagcagacaca

SEQ ID NO: 1540865 - RNA, 12 nt, Human adenovirus B (HAdV-B)
ccaaugccaucu

SEQ ID NO: 1540866 - RNA, 12 nt, Human adenovirus B (HAdV-B)
ucgcugcuuugc

SEQ ID NO: 1540867 - RNA, 17 nt, Human adenovirus B (HAdV-B)
ucgcagaaaacaaacuu

SEQ ID NO: 1540868 - RNA, 12 nt, Human adenovirus B (HAdV-B)
ccuacuccuggu

SEQ ID NO: 1540869 - RNA, 14 nt, Human adenovirus B (HAdV-B)
acaguaaaggaaga

SEQ ID NO: 1540870 - RNA, 20 nt, Human adenovirus B (HAdV-B)
aagcucuaaagugacucucc

SEQ ID NO: 1540871 - RNA, 16 nt, Human adenovirus B (HAdV-B)
cgagaagguggcugcc

SEQ ID NO: 1540872 - RNA, 14 nt, Human adenovirus B (HAdV-B)
uauggagcccagca

SEQ ID NO: 1540873 - RNA, 17 nt, Human adenovirus B (HAdV-B)
caccuuaaucccagaaa

SEQ ID NO: 1540874 - RNA, 15 nt, Human adenovirus B (HAdV-B)
gcugucaaccugccc

SEQ ID NO: 1540875 - RNA, 16 nt, Human adenovirus B (HAdV-B)
ggaccgaagacgagug

SEQ ID NO: 1540876 - RNA, 22 nt, Human adenovirus B (HAdV-B)
cuccacagccccuacuauagcc

SEQ ID NO: 1540877 - RNA, 14 nt, Human adenovirus B (HAdV-B)
accaaucacagccu

SEQ ID NO: 1540878 - RNA, 21 nt, Human adenovirus B (HAdV-B)
cucaaugcuucuuuugccauc

SEQ ID NO: 1540879 - RNA, 14 nt, Human adenovirus B (HAdV-B)
agacacggcuuugu

SEQ ID NO: 1540880 - RNA, 14 nt, Human adenovirus B (HAdV-B)
cccuaugaaaucaa

SEQ ID NO: 1540881 - RNA, 22 nt, Human adenovirus B (HAdV-B)
uugcaagccauccaaaaauccc

SEQ ID NO: 1540882 - RNA, 22 nt, Human adenovirus B (HAdV-B)
gcggcccuggcagaacacacuc

SEQ ID NO: 1540883 - RNA, 19 nt, Human adenovirus B (HAdV-B)
gcguucgcucaccagaagu

SEQ ID NO: 1540884 - RNA, 19 nt, Human adenovirus B (HAdV-B)
aacgaggaggcagaggagg

SEQ ID NO: 1540885 - RNA, 20 nt, Human adenovirus B (HAdV-B)
aagcugcuacagcugcugca

SEQ ID NO: 1540886 - RNA, 22 nt, Human adenovirus B (HAdV-B)
aaaaaguucuugugugacagaa

SEQ ID NO: 1540887 - RNA, 20 nt, Human adenovirus B (HAdV-B)
accagacggaaucuuucaga

SEQ ID NO: 1540888 - RNA, 22 nt, Human adenovirus B (HAdV-B)
ucauagauaauuacuugaaagu

SEQ ID NO: 1540889 - RNA, 13 nt, Human adenovirus B (HAdV-B)
cagccaugcauug

SEQ ID NO: 1540890 - RNA, 20 nt, Human adenovirus B (HAdV-B)
uagaccuacagagucucuga

SEQ ID NO: 1540891 - RNA, 21 nt, Human adenovirus B (HAdV-B)
cuagcuuguuaacuccgaacu

SEQ ID NO: 1540892 - RNA, 15 nt, Human adenovirus B (HAdV-B)
ggaggagaggauccu

SEQ ID NO: 1540893 - RNA, 17 nt, Human adenovirus B (HAdV-B)
cuggagugucacugccg

SEQ ID NO: 1540894 - RNA, 14 nt, Human adenovirus B (HAdV-B)
cgccagcaggaggc

SEQ ID NO: 1540895 - RNA, 17 nt, Human adenovirus B (HAdV-B)
aggaggcggaggaggac

SEQ ID NO: 1540896 - RNA, 16 nt, Human adenovirus B (HAdV-B)
cucugacacuccuggu

SEQ ID NO: 1540897 - RNA, 17 nt, Human adenovirus B (HAdV-B)
ccagugaaucuaaugau

SEQ ID NO: 1540898 - RNA, 19 nt, Human adenovirus B (HAdV-B)
agguuguaucugguggaca

SEQ ID NO: 1540899 - RNA, 19 nt, Human adenovirus B (HAdV-B)
ugaacaugcaaaucuggaa

SEQ ID NO: 1540900 - RNA, 14 nt, Human adenovirus B (HAdV-B)
gaaggacucccagu

SEQ ID NO: 1540901 - RNA, 18 nt, Human adenovirus B (HAdV-B)
agauugggacagucaggc

SEQ ID NO: 1540902 - RNA, 19 nt, Human adenovirus B (HAdV-B)
cgaagccuuuagacagcaa

SEQ ID NO: 1540903 - RNA, 19 nt, Human adenovirus B (HAdV-B)
uggcgugagaauuggaaga

SEQ ID NO: 1540904 - RNA, 19 nt, Human adenovirus B (HAdV-B)
cagcauuggcaaugcugaa

SEQ ID NO: 1540905 - RNA, 12 nt, Human adenovirus B (HAdV-B)
cuggccacaucc

SEQ ID NO: 1540906 - RNA, 21 nt, Human adenovirus B (HAdV-B)
gaugaaguuucuguauugcag

SEQ ID NO: 1540907 - RNA, 16 nt, Human adenovirus B (HAdV-B)
acccugucuaccccua

SEQ ID NO: 1540908 - RNA, 16 nt, Human adenovirus B (HAdV-B)
accagggaaaaguaca

SEQ ID NO: 1540909 - RNA, 16 nt, Human adenovirus B (HAdV-B)
auucugcaugagaauc

SEQ ID NO: 1540910 - RNA, 16 nt, Human adenovirus B (HAdV-B)
ggaaucauguccaccu

SEQ ID NO: 1540911 - RNA, 16 nt, Human adenovirus B (HAdV-B)
ugagaauuggaagaga

SEQ ID NO: 1540912 - RNA, 15 nt, Human adenovirus B (HAdV-B)
ugggaugggugagug

SEQ ID NO: 1540913 - RNA, 18 nt, Human adenovirus B (HAdV-B)
cagccgccgcccccagaa

SEQ ID NO: 1540914 - RNA, 23 nt, Human adenovirus B (HAdV-B)
ucucuguugaaauuuucucccag

SEQ ID NO: 1540915 - RNA, 11 nt, Human adenovirus B (HAdV-B)
ugggaccuggu

SEQ ID NO: 1540916 - RNA, 19 nt, Human adenovirus B (HAdV-B)
ucacaucucguccucagcg

SEQ ID NO: 1540917 - RNA, 15 nt, Human adenovirus B (HAdV-B)
auccgguggggccau

SEQ ID NO: 1540918 - RNA, 21 nt, Human adenovirus B (HAdV-B)
auacucauuugugcauuuaau

SEQ ID NO: 1540919 - RNA, 22 nt, Human adenovirus B (HAdV-B)
caacgagcagauaacuaucacc

SEQ ID NO: 1540920 - RNA, 18 nt, Human adenovirus B (HAdV-B)
cagcagcaccucacuucc

SEQ ID NO: 1540921 - RNA, 15 nt, Human adenovirus B (HAdV-B)
gaccagaacuuccaa

SEQ ID NO: 1540922 - RNA, 11 nt, Human adenovirus B (HAdV-B)
gggugggagag

SEQ ID NO: 1540923 - RNA, 18 nt, Human adenovirus B (HAdV-B)
aaugcgggcggcgcugca

SEQ ID NO: 1540924 - RNA, 23 nt, Human adenovirus B (HAdV-B)
acuccauacguucccauagacaa

SEQ ID NO: 1540925 - RNA, 16 nt, Human adenovirus B (HAdV-B)
auuguuucugaugcaa

SEQ ID NO: 1540926 - RNA, 14 nt, Human adenovirus B (HAdV-B)
cagaaguacuggcu

SEQ ID NO: 1540927 - RNA, 16 nt, Human adenovirus B (HAdV-B)
cacagggucuccagcu

SEQ ID NO: 1540928 - RNA, 18 nt, Human adenovirus B (HAdV-B)
aaguccuggcgggggcau

SEQ ID NO: 1540929 - RNA, 16 nt, Human adenovirus B (HAdV-B)
aggaggacagucugga

SEQ ID NO: 1540930 - RNA, 18 nt, Human adenovirus B (HAdV-B)
aucuaacguggaacucac

SEQ ID NO: 1540931 - RNA, 12 nt, Human adenovirus B (HAdV-B)
uauggagcccag

SEQ ID NO: 1540932 - RNA, 20 nt, Human adenovirus B (HAdV-B)
gcagccgccgcccccagaag

SEQ ID NO: 1540933 - RNA, 12 nt, Human adenovirus B (HAdV-B)
ggucagcugcaa

SEQ ID NO: 1540934 - RNA, 13 nt, Human adenovirus B (HAdV-B)
gucuaucuguacc

SEQ ID NO: 1540935 - RNA, 16 nt, Human adenovirus B (HAdV-B)
cucacuauucaaccug

SEQ ID NO: 1540936 - RNA, 16 nt, Human adenovirus B (HAdV-B)
gagccugggccuggcc

SEQ ID NO: 1540937 - RNA, 23 nt, Human adenovirus B (HAdV-B)
uugaugaaaugacagggaucagu

SEQ ID NO: 1540938 - RNA, 18 nt, Human adenovirus B (HAdV-B)
gcagcuccuuuagccaga

SEQ ID NO: 1540939 - RNA, 17 nt, Human adenovirus B (HAdV-B)
guuggauaaaaguuugg

SEQ ID NO: 1540940 - RNA, 17 nt, Human adenovirus B (HAdV-B)
aagaugaaagcaccucc

SEQ ID NO: 1540941 - RNA, 23 nt, Human adenovirus B (HAdV-B)
gaaccucagcugggagaugaaac

SEQ ID NO: 1540942 - RNA, 16 nt, Human adenovirus B (HAdV-B)
acugcagcacuggaca

SEQ ID NO: 1540943 - RNA, 16 nt, Human adenovirus B (HAdV-B)
acgucuagggcgcagu

SEQ ID NO: 1540944 - RNA, 21 nt, Human adenovirus B (HAdV-B)
ggcauuaacuccucggacgau

SEQ ID NO: 1540945 - RNA, 17 nt, Human adenovirus B (HAdV-B)
uccaaggaugagacagu

SEQ ID NO: 1540946 - RNA, 16 nt, Human adenovirus B (HAdV-B)
aagcucuugcagaaca

SEQ ID NO: 1540947 - RNA, 19 nt, Human adenovirus B (HAdV-B)
acgagaaaaaacagccaac

SEQ ID NO: 1540948 - RNA, 19 nt, Human adenovirus B (HAdV-B)
gcccgucuucucaaagagc

SEQ ID NO: 1540949 - RNA, 18 nt, Human adenovirus B (HAdV-B)
acagauaagcccuuggug

SEQ ID NO: 1540950 - RNA, 22 nt, Human adenovirus B (HAdV-B)
ucuagcggaaacccgucuuugu

SEQ ID NO: 1540951 - RNA, 22 nt, Human adenovirus B (HAdV-B)
agaagaggcggaugaaggcgag

SEQ ID NO: 1540952 - RNA, 20 nt, Human adenovirus B (HAdV-B)
cuugagaaugaaaaauaucu

SEQ ID NO: 1540953 - RNA, 15 nt, Human adenovirus B (HAdV-B)
cugagaguuucauga

SEQ ID NO: 1540954 - RNA, 15 nt, Human adenovirus B (HAdV-B)
ucaccaaggccaugg

SEQ ID NO: 1540955 - RNA, 20 nt, Human adenovirus B (HAdV-B)
accaaaguuuaauauaaauu

SEQ ID NO: 1540956 - RNA, 18 nt, Human adenovirus B (HAdV-B)
agaggaggcggaggagga

SEQ ID NO: 1540957 - RNA, 15 nt, Human adenovirus B (HAdV-B)
guaacuuuuguaaau

SEQ ID NO: 1540958 - RNA, 23 nt, Human adenovirus B (HAdV-B)
cuccgguauccugcccgccaccu

SEQ ID NO: 1540959 - RNA, 16 nt, Human adenovirus B (HAdV-B)
cucuaccccauuccug

SEQ ID NO: 1540960 - RNA, 22 nt, Human adenovirus B (HAdV-B)
agccguuaaccccacagccaau

SEQ ID NO: 1540961 - RNA, 12 nt, Human adenovirus B (HAdV-B)
caguggacggcu

SEQ ID NO: 1540962 - RNA, 22 nt, Human adenovirus B (HAdV-B)
ccauaauuaaaagcgcuccagc

SEQ ID NO: 1540963 - RNA, 22 nt, Human adenovirus B (HAdV-B)
augacuuuaccccuacggaagc

SEQ ID NO: 1540964 - RNA, 16 nt, Human adenovirus B (HAdV-B)
gcagcacuggacauga

SEQ ID NO: 1540965 - RNA, 14 nt, Human adenovirus B (HAdV-B)
gcaggucaggagcc

SEQ ID NO: 1540966 - RNA, 12 nt, Human adenovirus B (HAdV-B)
gugaacaccaau

SEQ ID NO: 1540967 - RNA, 21 nt, Human adenovirus B (HAdV-B)
ccggcaucauucacacagcag

SEQ ID NO: 1540968 - RNA, 16 nt, Human adenovirus B (HAdV-B)
gugaugcaauccccac

SEQ ID NO: 1540969 - RNA, 19 nt, Human adenovirus B (HAdV-B)
uuauaauggaauaguguuu

SEQ ID NO: 1540970 - RNA, 19 nt, Human adenovirus B (HAdV-B)
ucccaggacuacuccaccc

SEQ ID NO: 1540971 - RNA, 18 nt, Human adenovirus B (HAdV-B)
cguuaaccccacagccaa

SEQ ID NO: 1540972 - RNA, 13 nt, Human adenovirus B (HAdV-B)
ccgccggucccac

SEQ ID NO: 1540973 - RNA, 16 nt, Human adenovirus B (HAdV-B)
agugcaaacggaucca

SEQ ID NO: 1540974 - RNA, 20 nt, Human adenovirus B (HAdV-B)
cugcuuugcccgggaacuca

SEQ ID NO: 1540975 - RNA, 23 nt, Human adenovirus B (HAdV-B)
aaccgguauaucgggcaggaugu

SEQ ID NO: 1540976 - RNA, 20 nt, Human adenovirus B (HAdV-B)
gacuuuaugagccagagcau

SEQ ID NO: 1540977 - RNA, 13 nt, Human adenovirus B (HAdV-B)
cgguucuggagga

SEQ ID NO: 1540978 - RNA, 16 nt, Human adenovirus B (HAdV-B)
cauagauaauuacuug

SEQ ID NO: 1540979 - RNA, 14 nt, Human adenovirus B (HAdV-B)
gggaacugaugcac

SEQ ID NO: 1540980 - RNA, 14 nt, Human adenovirus B (HAdV-B)
aguagcugacuugu

SEQ ID NO: 1540981 - RNA, 17 nt, Human adenovirus B (HAdV-B)
aacagaaaaccagcagc

SEQ ID NO: 1540982 - RNA, 19 nt, Human adenovirus B (HAdV-B)
cggggucaucuugcagguc

SEQ ID NO: 1540983 - RNA, 16 nt, Human adenovirus B (HAdV-B)
ucccagaguuggaagu

SEQ ID NO: 1540984 - RNA, 17 nt, Human adenovirus B (HAdV-B)
ggcggagcgguggugua

SEQ ID NO: 1540985 - RNA, 13 nt, Human adenovirus B (HAdV-B)
agaaauauaaauu

SEQ ID NO: 1540986 - RNA, 11 nt, Human adenovirus B (HAdV-B)
cauucagaacc

SEQ ID NO: 1540987 - RNA, 15 nt, Human adenovirus B (HAdV-B)
acuucccucuuccca

SEQ ID NO: 1540988 - RNA, 17 nt, Human adenovirus B (HAdV-B)
aggucucuguugaaauu

SEQ ID NO: 1540989 - RNA, 16 nt, Human adenovirus B (HAdV-B)
aacuuauauugcaugg

SEQ ID NO: 1540990 - RNA, 14 nt, Human adenovirus B (HAdV-B)
gaucaugccuggag

SEQ ID NO: 1540991 - RNA, 21 nt, Human adenovirus B (HAdV-B)
cugaagugcccaucagugugg

SEQ ID NO: 1540992 - RNA, 22 nt, Human adenovirus B (HAdV-B)
aagacgcgcuccuuaaacaucu

SEQ ID NO: 1540993 - RNA, 18 nt, Human adenovirus B (HAdV-B)
cuguguagaugccugggg

SEQ ID NO: 1540994 - RNA, 24 nt, Human adenovirus B (HAdV-B)
aggguuuauuuccccaaauggcuu

SEQ ID NO: 1540995 - RNA, 19 nt, Human adenovirus B (HAdV-B)
guccguucucgcuggccac

SEQ ID NO: 1540996 - RNA, 17 nt, Human adenovirus B (HAdV-B)
acgccuuacauguggag

SEQ ID NO: 1540997 - RNA, 15 nt, Human adenovirus B (HAdV-B)
auaucuggaaauggg

SEQ ID NO: 1540998 - RNA, 16 nt, Human adenovirus B (HAdV-B)
ugaugcagcagcagca

SEQ ID NO: 1540999 - RNA, 22 nt, Human adenovirus B (HAdV-B)
gcaguagccacagcaaccccag

SEQ ID NO: 1541000 - RNA, 14 nt, Human adenovirus B (HAdV-B)
cuauaucucccaga

SEQ ID NO: 1541001 - RNA, 14 nt, Human adenovirus B (HAdV-B)
cuccuaggcagaga

SEQ ID NO: 1541002 - RNA, 14 nt, Human adenovirus B (HAdV-B)
cagcacgacugccu

SEQ ID NO: 1541003 - RNA, 21 nt, Human adenovirus B (HAdV-B)
uauuauggaaccgacuauaaa

SEQ ID NO: 1541004 - RNA, 14 nt, Human adenovirus B (HAdV-B)
uuucagaagacaug

SEQ ID NO: 1541005 - RNA, 16 nt, Human adenovirus B (HAdV-B)
gaauaccgcaaccaaa

SEQ ID NO: 1541006 - RNA, 11 nt, Human adenovirus B (HAdV-B)
gaucuccuggg

SEQ ID NO: 1541007 - RNA, 14 nt, Human adenovirus B (HAdV-B)
agcccgagucugca

SEQ ID NO: 1541008 - RNA, 19 nt, Human adenovirus B (HAdV-B)
cauugcuuauugcuugugc

SEQ ID NO: 1541009 - RNA, 16 nt, Human adenovirus B (HAdV-B)
uagcugaaacccacug

SEQ ID NO: 1541010 - RNA, 14 nt, Human adenovirus B (HAdV-B)
ccagacgccgcacc

SEQ ID NO: 1541011 - RNA, 21 nt, Human adenovirus B (HAdV-B)
cugcaacgaauuuucucccag

SEQ ID NO: 1541012 - RNA, 16 nt, Human adenovirus B (HAdV-B)
ugacggcggucaugga

SEQ ID NO: 1541013 - RNA, 18 nt, Human adenovirus B (HAdV-B)
uccuucgcggcuggccau

SEQ ID NO: 1541014 - RNA, 16 nt, Human adenovirus B (HAdV-B)
gacuccguagccugga

SEQ ID NO: 1541015 - RNA, 14 nt, Human adenovirus B (HAdV-B)
uuaaacacacccuc

SEQ ID NO: 1541016 - RNA, 14 nt, Human adenovirus B (HAdV-B)
gguacaacacauua

SEQ ID NO: 1541017 - RNA, 19 nt, Human adenovirus B (HAdV-B)
caguaacuuuuguaaaugu

SEQ ID NO: 1541018 - RNA, 17 nt, Human adenovirus B (HAdV-B)
auugccggcugcgggag

SEQ ID NO: 1541019 - RNA, 19 nt, Human adenovirus B (HAdV-B)
uuaaaauguuuaaccccac

SEQ ID NO: 1541020 - RNA, 15 nt, Human adenovirus B (HAdV-B)
ccaguccugccacca

SEQ ID NO: 1541021 - RNA, 17 nt, Human adenovirus B (HAdV-B)
acguguacccgugcgca

SEQ ID NO: 1541022 - RNA, 20 nt, Human adenovirus B (HAdV-B)
gguaagaaggaucggcaggg

SEQ ID NO: 1541023 - RNA, 20 nt, Human adenovirus B (HAdV-B)
cuauggagucacugcuaccu

SEQ ID NO: 1541024 - RNA, 15 nt, Human adenovirus B (HAdV-B)
agacccgggcuaugu

SEQ ID NO: 1541025 - RNA, 20 nt, Human adenovirus B (HAdV-B)
uagucaccuccccauuuacc

SEQ ID NO: 1541026 - RNA, 22 nt, Human adenovirus B (HAdV-B)
aggaugcuucggaguaccugag

SEQ ID NO: 1541027 - RNA, 18 nt, Human adenovirus B (HAdV-B)
ccagaaguuggaggacgu

SEQ ID NO: 1541028 - RNA, 19 nt, Human adenovirus B (HAdV-B)
ggcggccagacgugcagcu

SEQ ID NO: 1541029 - RNA, 14 nt, Human adenovirus B (HAdV-B)
uaagcauuccaccg

SEQ ID NO: 1541030 - RNA, 23 nt, Human adenovirus B (HAdV-B)
aaggcgaugggucuucuccuggg

SEQ ID NO: 1541031 - RNA, 22 nt, Human adenovirus B (HAdV-B)
gcccuggugcggcaaguguacc

SEQ ID NO: 1541032 - RNA, 16 nt, Human adenovirus B (HAdV-B)
uagugccuucccgcuc

SEQ ID NO: 1541033 - RNA, 14 nt, Human adenovirus B (HAdV-B)
gaggauuugcaugu

SEQ ID NO: 1541034 - RNA, 16 nt, Human adenovirus B (HAdV-B)
acaucgccggacagga

SEQ ID NO: 1541035 - RNA, 22 nt, Human adenovirus B (HAdV-B)
cgaagccauagggcaaagucag

SEQ ID NO: 1541036 - RNA, 17 nt, Human adenovirus B (HAdV-B)
gguucuuugcucuuccu

SEQ ID NO: 1541037 - RNA, 19 nt, Human adenovirus B (HAdV-B)
uugaaauuuucucccagca

SEQ ID NO: 1541038 - RNA, 15 nt, Human adenovirus B (HAdV-B)
aguaacuugcaacau

SEQ ID NO: 1541039 - RNA, 12 nt, Human adenovirus B (HAdV-B)
uauaaaacaucc

SEQ ID NO: 1541040 - RNA, 21 nt, Human adenovirus B (HAdV-B)
agucaugacggcggucaugga

SEQ ID NO: 1541041 - RNA, 23 nt, Human adenovirus B (HAdV-B)
gccgccaagaucccgucuugggu

SEQ ID NO: 1541042 - RNA, 18 nt, Human adenovirus B (HAdV-B)
acuuuuggcaaugcuccu

SEQ ID NO: 1541043 - RNA, 16 nt, Human adenovirus B (HAdV-B)
augaugggcuggcgga

SEQ ID NO: 1541044 - RNA, 14 nt, Human adenovirus B (HAdV-B)
ccgcgagugccccc

SEQ ID NO: 1541045 - RNA, 16 nt, Human adenovirus B (HAdV-B)
guuuaguaacaaguuc

SEQ ID NO: 1541046 - RNA, 17 nt, Human adenovirus B (HAdV-B)
accuugcuucacuuucu

SEQ ID NO: 1541047 - RNA, 16 nt, Human adenovirus B (HAdV-B)
ggcggcgcugcagagc

SEQ ID NO: 1541048 - RNA, 15 nt, Human adenovirus B (HAdV-B)
agaacaguaaagcug

SEQ ID NO: 1541049 - RNA, 14 nt, Human adenovirus B (HAdV-B)
ccuguaugccaucu

SEQ ID NO: 1541050 - RNA, 18 nt, Human adenovirus B (HAdV-B)
cuggcccaauugcaagcc

SEQ ID NO: 1541051 - RNA, 23 nt, Human adenovirus B (HAdV-B)
aacagccccccucgcagcagcag

SEQ ID NO: 1541052 - RNA, 22 nt, Human adenovirus B (HAdV-B)
ugccagcacggugggaucugca

SEQ ID NO: 1541053 - RNA, 13 nt, Human adenovirus B (HAdV-B)
ccuuaaucccaga

SEQ ID NO: 1541054 - RNA, 14 nt, Human adenovirus B (HAdV-B)
aguaacuugcaaca

SEQ ID NO: 1541055 - RNA, 16 nt, Human adenovirus B (HAdV-B)
ugaucacaagcaggau

SEQ ID NO: 1541056 - RNA, 14 nt, Human adenovirus B (HAdV-B)
caaguguuucuuga

SEQ ID NO: 1541057 - RNA, 20 nt, Human adenovirus B (HAdV-B)
ccucagcgacgaggaaaagg

SEQ ID NO: 1541058 - RNA, 23 nt, Human adenovirus B (HAdV-B)
caaagcuauucguccagaugagg

SEQ ID NO: 1541059 - RNA, 22 nt, Human adenovirus B (HAdV-B)
ggugcuaccgcggcugagcccg

SEQ ID NO: 1541060 - RNA, 13 nt, Human adenovirus B (HAdV-B)
ucaugcaacccaa

SEQ ID NO: 1541061 - RNA, 19 nt, Human adenovirus B (HAdV-B)
ugucucugaagaaaugcau

SEQ ID NO: 1541062 - RNA, 16 nt, Human adenovirus B (HAdV-B)
cgaugugucugaagga

SEQ ID NO: 1541063 - RNA, 20 nt, Human adenovirus B (HAdV-B)
caaagcgugcugcacagcac

SEQ ID NO: 1541064 - RNA, 16 nt, Human adenovirus B (HAdV-B)
aggaagacaguuugga

SEQ ID NO: 1541065 - RNA, 17 nt, Human adenovirus B (HAdV-B)
cugaugggagugggguc

SEQ ID NO: 1541066 - RNA, 14 nt, Human adenovirus B (HAdV-B)
gcgauaccuggcac

SEQ ID NO: 1541067 - RNA, 19 nt, Human adenovirus B (HAdV-B)
cugggaugggaucccgaaa

SEQ ID NO: 1541068 - RNA, 21 nt, Human adenovirus B (HAdV-B)
cacuuagaagauacugagcag

SEQ ID NO: 1541069 - RNA, 19 nt, Human adenovirus B (HAdV-B)
uccaugccuuucucccaag

SEQ ID NO: 1541070 - RNA, 18 nt, Human adenovirus B (HAdV-B)
uccgaccuggcagaccuc

SEQ ID NO: 1541071 - RNA, 18 nt, Human adenovirus B (HAdV-B)
caucuacuguggaugcag

SEQ ID NO: 1541072 - RNA, 18 nt, Human adenovirus B (HAdV-B)
cuccagacacucauguag

SEQ ID NO: 1541073 - RNA, 14 nt, Human adenovirus B (HAdV-B)
caguacaggacagg

SEQ ID NO: 1541074 - RNA, 13 nt, Human adenovirus B (HAdV-B)
ccgacugcagaau

SEQ ID NO: 1541075 - RNA, 15 nt, Human adenovirus B (HAdV-B)
ucuagcaagacaguc

SEQ ID NO: 1541076 - RNA, 14 nt, Human adenovirus B (HAdV-B)
guuacauggcuccg

SEQ ID NO: 1541077 - RNA, 14 nt, Human adenovirus B (HAdV-B)
gagacgcuggugac

SEQ ID NO: 1541078 - RNA, 22 nt, Human adenovirus B (HAdV-B)
agcaauggggccgugggcagcg

SEQ ID NO: 1541079 - RNA, 16 nt, Human adenovirus B (HAdV-B)
ugggucuucuccuggg

SEQ ID NO: 1541080 - RNA, 16 nt, Human adenovirus B (HAdV-B)
augccuuucaugaggu

SEQ ID NO: 1541081 - RNA, 15 nt, Human adenovirus B (HAdV-B)
ccaugcuuagggcgg

SEQ ID NO: 1541082 - RNA, 16 nt, Human adenovirus B (HAdV-B)
gcucuauaucucccag

SEQ ID NO: 1541083 - RNA, 21 nt, Human adenovirus B (HAdV-B)
cuugcuggagugucacugccg

SEQ ID NO: 1541084 - RNA, 16 nt, Human adenovirus B (HAdV-B)
ugcguucgcucaccag

SEQ ID NO: 1541085 - RNA, 19 nt, Human adenovirus B (HAdV-B)
gaggaaaaggagcagagcu

SEQ ID NO: 1541086 - RNA, 21 nt, Human adenovirus B (HAdV-B)
cauaauauugccaugcaggca

SEQ ID NO: 1541087 - RNA, 13 nt, Human adenovirus B (HAdV-B)
aucuuccagcaga

SEQ ID NO: 1541088 - RNA, 20 nt, Human adenovirus B (HAdV-B)
gccgagaagguggcugccau

SEQ ID NO: 1541089 - RNA, 23 nt, Human adenovirus B (HAdV-B)
uggagcaguaucuggagcgggcu

SEQ ID NO: 1541090 - RNA, 22 nt, Human adenovirus B (HAdV-B)
uuacaaaagaaggacucccagu

SEQ ID NO: 1541091 - RNA, 12 nt, Human adenovirus B (HAdV-B)
uacauggcuccg

SEQ ID NO: 1541092 - RNA, 13 nt, Human adenovirus B (HAdV-B)
agacgagccuggg

SEQ ID NO: 1541093 - RNA, 20 nt, Human adenovirus B (HAdV-B)
aguacagcgggcacacaaag

SEQ ID NO: 1541094 - RNA, 16 nt, Human adenovirus B (HAdV-B)
aggcagaggaggugga

SEQ ID NO: 1541095 - RNA, 16 nt, Human adenovirus B (HAdV-B)
gaucaccugggcagcu

SEQ ID NO: 1541096 - RNA, 17 nt, Human adenovirus B (HAdV-B)
ugcgccuaauuggaagg

SEQ ID NO: 1541097 - RNA, 18 nt, Human adenovirus B (HAdV-B)
ugcagccaugaggccaca

SEQ ID NO: 1541098 - RNA, 15 nt, Human adenovirus B (HAdV-B)
agaugccugugauga

SEQ ID NO: 1541099 - RNA, 21 nt, Human adenovirus B (HAdV-B)
gugcugcacagcacccugaag

SEQ ID NO: 1541100 - RNA, 15 nt, Human adenovirus B (HAdV-B)
aguacucagccugcu

SEQ ID NO: 1541101 - RNA, 14 nt, Human adenovirus B (HAdV-B)
gcaaaucuggaaga

SEQ ID NO: 1541102 - RNA, 17 nt, Human adenovirus B (HAdV-B)
aauucaccaaugcaaaa

SEQ ID NO: 1541103 - RNA, 16 nt, Human adenovirus B (HAdV-B)
accuugacccccagac

SEQ ID NO: 1541104 - RNA, 21 nt, Human adenovirus B (HAdV-B)
ugagagccgaucgggaagaac

SEQ ID NO: 1541105 - RNA, 18 nt, Human adenovirus B (HAdV-B)
cggcaggcgccucccagg

SEQ ID NO: 1541106 - RNA, 20 nt, Human adenovirus B (HAdV-B)
aaccucccgacggugcugca

SEQ ID NO: 1541107 - RNA, 11 nt, Human adenovirus B (HAdV-B)
cuuuaaguuua

SEQ ID NO: 1541108 - RNA, 21 nt, Human adenovirus B (HAdV-B)
acacaucauaguuauguuccu

SEQ ID NO: 1541109 - RNA, 15 nt, Human adenovirus B (HAdV-B)
gacucgggccgcaaa

SEQ ID NO: 1541110 - RNA, 12 nt, Human adenovirus B (HAdV-B)
caauccccacug

SEQ ID NO: 1541111 - RNA, 21 nt, Human adenovirus B (HAdV-B)
ugcgccuucacccgagcggca

SEQ ID NO: 1541112 - RNA, 14 nt, Human adenovirus B (HAdV-B)
ccuugacccccaga

SEQ ID NO: 1541113 - RNA, 16 nt, Human adenovirus B (HAdV-B)
gcagagacaaugaggc

SEQ ID NO: 1541114 - RNA, 16 nt, Human adenovirus B (HAdV-B)
gcauacaugccacaga

SEQ ID NO: 1541115 - RNA, 12 nt, Human adenovirus B (HAdV-B)
uucgcugcuuug

SEQ ID NO: 1541116 - RNA, 22 nt, Human adenovirus B (HAdV-B)
agugcuguuuguaacugguccc

SEQ ID NO: 1541117 - RNA, 16 nt, Human adenovirus B (HAdV-B)
ccaugccuuucuccca

SEQ ID NO: 1541118 - RNA, 17 nt, Human adenovirus B (HAdV-B)
gaaucaccaacuuggga

SEQ ID NO: 1541119 - RNA, 21 nt, Human adenovirus B (HAdV-B)
ugcaacgaauuuucucccagc

SEQ ID NO: 1541120 - RNA, 17 nt, Human adenovirus B (HAdV-B)
gucugcgcgcuccaagc

SEQ ID NO: 1541121 - RNA, 19 nt, Human adenovirus B (HAdV-B)
cuugaauucgggaaucacc

SEQ ID NO: 1541122 - RNA, 18 nt, Human adenovirus B (HAdV-B)
uccggaagauuaccaccc

SEQ ID NO: 1541123 - RNA, 16 nt, Human adenovirus B (HAdV-B)
augcuuuuauaugcuu

SEQ ID NO: 1541124 - RNA, 21 nt, Human adenovirus B (HAdV-B)
cgcaucucaugacaugcagaa

SEQ ID NO: 1541125 - RNA, 13 nt, Human adenovirus B (HAdV-B)
ugguuugaugcau

SEQ ID NO: 1541126 - RNA, 17 nt, Human adenovirus B (HAdV-B)
augaucuggacuuggaa

SEQ ID NO: 1541127 - RNA, 17 nt, Human adenovirus B (HAdV-B)
uuccaucgagugcaccu

SEQ ID NO: 1541128 - RNA, 16 nt, Human adenovirus B (HAdV-B)
guauugcaggagaaau

SEQ ID NO: 1541129 - RNA, 22 nt, Human adenovirus B (HAdV-B)
aaccgucuaucggccaucaugg

SEQ ID NO: 1541130 - RNA, 20 nt, Human adenovirus B (HAdV-B)
aguuuacuuugccagaaggc

SEQ ID NO: 1541131 - RNA, 16 nt, Human adenovirus B (HAdV-B)
auauguggccuggggu

SEQ ID NO: 1541132 - RNA, 20 nt, Human adenovirus B (HAdV-B)
caacgaauuuucucccagcg

SEQ ID NO: 1541133 - RNA, 20 nt, Human adenovirus B (HAdV-B)
ccaaugaauuaaaaaaugau

SEQ ID NO: 1541134 - RNA, 20 nt, Human adenovirus B (HAdV-B)
cucaggauuuagaaacauau

SEQ ID NO: 1541135 - RNA, 16 nt, Human adenovirus B (HAdV-B)
caucacuuccaugccu

SEQ ID NO: 1541136 - RNA, 18 nt, Human adenovirus B (HAdV-B)
gcgucccgauuuggaaga

SEQ ID NO: 1541137 - RNA, 15 nt, Human adenovirus B (HAdV-B)
ugcugcuucucccag

SEQ ID NO: 1541138 - RNA, 15 nt, Human adenovirus B (HAdV-B)
cuuaacauuuaauuu

SEQ ID NO: 1541139 - RNA, 23 nt, Human adenovirus B (HAdV-B)
ucgcuuuuggaaccggguucugc

SEQ ID NO: 1541140 - RNA, 14 nt, Human adenovirus B (HAdV-B)
ucuccgcuccgagu

SEQ ID NO: 1541141 - RNA, 22 nt, Human adenovirus B (HAdV-B)
ccccuucuccggaucuccuggg

SEQ ID NO: 1541142 - RNA, 21 nt, Human adenovirus B (HAdV-B)
ccuggcaccuacggagggcag

SEQ ID NO: 1541143 - RNA, 18 nt, Human adenovirus B (HAdV-B)
cgaggaggcagaggaggu

SEQ ID NO: 1541144 - RNA, 16 nt, Human adenovirus B (HAdV-B)
ugcaggcacuucagcu

SEQ ID NO: 1541145 - RNA, 21 nt, Human adenovirus B (HAdV-B)
gcgcugccaggguucgguccu

SEQ ID NO: 1541146 - RNA, 13 nt, Human adenovirus B (HAdV-B)
ccucggugcuccu

SEQ ID NO: 1541147 - RNA, 22 nt, Human adenovirus B (HAdV-B)
aaucuucaugucuuucuuccca

SEQ ID NO: 1541148 - RNA, 22 nt, Human adenovirus B (HAdV-B)
uaacgagaaaaaacagccaaca

SEQ ID NO: 1541149 - RNA, 19 nt, Human adenovirus B (HAdV-B)
gacgaggaaaaggagcaga

SEQ ID NO: 1541150 - RNA, 20 nt, Human adenovirus B (HAdV-B)
augauuugcggugcuuccga

SEQ ID NO: 1541151 - RNA, 15 nt, Human adenovirus B (HAdV-B)
caaucaccacacgau

SEQ ID NO: 1541152 - RNA, 19 nt, Human adenovirus B (HAdV-B)
uacaguuucacuuccgcaa

SEQ ID NO: 1541153 - RNA, 21 nt, Human adenovirus B (HAdV-B)
cguuccugcucucacagauca

SEQ ID NO: 1541154 - RNA, 19 nt, Human adenovirus B (HAdV-B)
acagagucucugacaaagu

SEQ ID NO: 1541155 - RNA, 11 nt, Human adenovirus B (HAdV-B)
ugcagcacuga

SEQ ID NO: 1541156 - RNA, 21 nt, Human adenovirus B (HAdV-B)
caaacugcuggacuacuugca

SEQ ID NO: 1541157 - RNA, 15 nt, Human adenovirus B (HAdV-B)
ugccaagauagcuuu

SEQ ID NO: 1541158 - RNA, 16 nt, Human adenovirus B (HAdV-B)
cccaauuggcuccagc

SEQ ID NO: 1541159 - RNA, 16 nt, Human adenovirus B (HAdV-B)
cuucuuuugccauccu

SEQ ID NO: 1541160 - RNA, 20 nt, Human adenovirus B (HAdV-B)
uggcagcaauguuuagaaga

SEQ ID NO: 1541161 - RNA, 16 nt, Human adenovirus B (HAdV-B)
cugcacacuuacuuuu

SEQ ID NO: 1541162 - RNA, 20 nt, Human adenovirus B (HAdV-B)
aucguugucaaccagggggu

SEQ ID NO: 1541163 - RNA, 10 nt, Human adenovirus B (HAdV-B)
aaccccacua

SEQ ID NO: 1541164 - RNA, 21 nt, Human adenovirus B (HAdV-B)
ccuuuggguguagcgggaauc

SEQ ID NO: 1541165 - RNA, 13 nt, Human adenovirus B (HAdV-B)
ccugcugcuucuc

SEQ ID NO: 1541166 - RNA, 12 nt, Human adenovirus B (HAdV-B)
augugauuggcu

SEQ ID NO: 1541167 - RNA, 12 nt, Human adenovirus B (HAdV-B)
auugccacagcu

SEQ ID NO: 1541168 - RNA, 14 nt, Human adenovirus B (HAdV-B)
gcagcagcagcaau

SEQ ID NO: 1541169 - RNA, 19 nt, Human adenovirus B (HAdV-B)
ccguagacgcacaagcaaa

SEQ ID NO: 1541170 - RNA, 12 nt, Human adenovirus B (HAdV-B)
ucaccugggcag

SEQ ID NO: 1541171 - RNA, 14 nt, Human adenovirus B (HAdV-B)
gagacgagccuggg

SEQ ID NO: 1541172 - RNA, 16 nt, Human adenovirus B (HAdV-B)
gccaacugucaaauca

SEQ ID NO: 1541173 - RNA, 21 nt, Human adenovirus B (HAdV-B)
gaagauugggacagucaggca

SEQ ID NO: 1541174 - RNA, 13 nt, Human adenovirus B (HAdV-B)
accuccacugaag

SEQ ID NO: 1541175 - RNA, 17 nt, Human adenovirus B (HAdV-B)
accaguguaacaugaau

SEQ ID NO: 1541176 - RNA, 13 nt, Human adenovirus B (HAdV-B)
agauccugaggua

SEQ ID NO: 1541177 - RNA, 22 nt, Human adenovirus B (HAdV-B)
aucaagaaauuacccaagucag

SEQ ID NO: 1541178 - RNA, 19 nt, Human adenovirus B (HAdV-B)
uaacaauuuucgcucuuuc

SEQ ID NO: 1541179 - RNA, 13 nt, Human adenovirus B (HAdV-B)
caggcgacggcgg

SEQ ID NO: 1541180 - RNA, 14 nt, Human adenovirus B (HAdV-B)
cguaguugagcgcc

SEQ ID NO: 1541181 - RNA, 17 nt, Human adenovirus B (HAdV-B)
ccguucucgcuggccac

SEQ ID NO: 1541182 - RNA, 18 nt, Human adenovirus B (HAdV-B)
uacacaccuugcuucacu

SEQ ID NO: 1541183 - RNA, 12 nt, Human adenovirus B (HAdV-B)
agccggccugga

SEQ ID NO: 1541184 - RNA, 22 nt, Human adenovirus B (HAdV-B)
aaugagccuaacaggaauuuuu

SEQ ID NO: 1541185 - RNA, 16 nt, Human adenovirus B (HAdV-B)
gccaaagagcucagag

SEQ ID NO: 1541186 - RNA, 13 nt, Human adenovirus B (HAdV-B)
cugcgcacugccc

SEQ ID NO: 1541187 - RNA, 16 nt, Human adenovirus B (HAdV-B)
guuggauugccacagc

SEQ ID NO: 1541188 - RNA, 15 nt, Human adenovirus B (HAdV-B)
uucuuguagugagga

SEQ ID NO: 1541189 - RNA, 19 nt, Human adenovirus B (HAdV-B)
ggcgacggcggugaugcaa

SEQ ID NO: 1541190 - RNA, 18 nt, Human adenovirus B (HAdV-B)
uugcaugguuguagcuuu

SEQ ID NO: 1541191 - RNA, 23 nt, Human adenovirus B (HAdV-B)
uaguugccagcgacucuacaagg

SEQ ID NO: 1541192 - RNA, 17 nt, Human adenovirus B (HAdV-B)
ggcguccagcgcugcca

SEQ ID NO: 1541193 - RNA, 16 nt, Human adenovirus B (HAdV-B)
ccuguacauucccaau

SEQ ID NO: 1541194 - RNA, 18 nt, Human adenovirus B (HAdV-B)
gauuacagccaacgagcc

SEQ ID NO: 1541195 - RNA, 14 nt, Human adenovirus B (HAdV-B)
cuuuaugagccaga

SEQ ID NO: 1541196 - RNA, 12 nt, Human adenovirus B (HAdV-B)
gacccaggccau

SEQ ID NO: 1541197 - RNA, 17 nt, Human adenovirus B (HAdV-B)
uugacugaugucuugca

SEQ ID NO: 1541198 - RNA, 22 nt, Human adenovirus B (HAdV-B)
agcaggggacgcuacagugcag

SEQ ID NO: 1541199 - RNA, 13 nt, Human adenovirus B (HAdV-B)
uuacucccucugu

SEQ ID NO: 1541200 - RNA, 17 nt, Human adenovirus B (HAdV-B)
gcccucgcuuggguggu

SEQ ID NO: 1541201 - RNA, 23 nt, Human adenovirus B (HAdV-B)
ccuacauggguauucugcaugag

SEQ ID NO: 1541202 - RNA, 14 nt, Human adenovirus B (HAdV-B)
auucaaacaacauu

SEQ ID NO: 1541203 - RNA, 16 nt, Human adenovirus B (HAdV-B)
cgacaugaguaaagaa

SEQ ID NO: 1541204 - RNA, 16 nt, Human adenovirus B (HAdV-B)
agauacuggauguuuu

SEQ ID NO: 1541205 - RNA, 18 nt, Human adenovirus B (HAdV-B)
aggcucaaacugcacacu

SEQ ID NO: 1541206 - RNA, 22 nt, Human adenovirus B (HAdV-B)
guugcggaacugauacuugggu

SEQ ID NO: 1541207 - RNA, 17 nt, Human adenovirus B (HAdV-B)
aauccaauccacacauu

SEQ ID NO: 1541208 - RNA, 18 nt, Human adenovirus B (HAdV-B)
uccguucucgcuggccac

SEQ ID NO: 1541209 - RNA, 20 nt, Human adenovirus B (HAdV-B)
ugugggagggguagcgaucg

SEQ ID NO: 1541210 - RNA, 20 nt, Human adenovirus B (HAdV-B)
ggugcuaccgcggcugagcc

SEQ ID NO: 1541211 - RNA, 18 nt, Human adenovirus B (HAdV-B)
aaggcgcauugccagacg

SEQ ID NO: 1541212 - RNA, 17 nt, Human adenovirus B (HAdV-B)
uaacuuuuguaaauguu

SEQ ID NO: 1541213 - RNA, 17 nt, Human adenovirus B (HAdV-B)
gucacuuugcagcaagu

SEQ ID NO: 1541214 - RNA, 18 nt, Human adenovirus B (HAdV-B)
aagauguaaccugggcau

SEQ ID NO: 1541215 - RNA, 23 nt, Human adenovirus B (HAdV-B)
ugcacaugaucauccacaagacc

SEQ ID NO: 1541216 - RNA, 13 nt, Human adenovirus B (HAdV-B)
uguaagggcagca

SEQ ID NO: 1541217 - RNA, 18 nt, Human adenovirus B (HAdV-B)
cagucuccgauguugugu

SEQ ID NO: 1541218 - RNA, 13 nt, Human adenovirus B (HAdV-B)
uuggaagagaugg

SEQ ID NO: 1541219 - RNA, 12 nt, Human adenovirus B (HAdV-B)
ccgacucuccca

SEQ ID NO: 1541220 - RNA, 15 nt, Human adenovirus B (HAdV-B)
agucuguuccacagu

SEQ ID NO: 1541221 - RNA, 15 nt, Human adenovirus B (HAdV-B)
uaccuuuuacuacau

SEQ ID NO: 1541222 - RNA, 15 nt, Human adenovirus B (HAdV-B)
ucauccuuggcuccg

SEQ ID NO: 1541223 - RNA, 20 nt, Human adenovirus B (HAdV-B)
acguggaacucaccaaccug

SEQ ID NO: 1541224 - RNA, 13 nt, Human adenovirus B (HAdV-B)
ucaguguggaaga

SEQ ID NO: 1541225 - RNA, 16 nt, Human adenovirus B (HAdV-B)
accggggugaugaaac

SEQ ID NO: 1541226 - RNA, 18 nt, Human adenovirus B (HAdV-B)
gaugagcgaaacccagau

SEQ ID NO: 1541227 - RNA, 23 nt, Human adenovirus B (HAdV-B)
ccacaacccccacuacucccugc

SEQ ID NO: 1541228 - RNA, 18 nt, Human adenovirus B (HAdV-B)
cuaccgucaccuccacag

SEQ ID NO: 1541229 - RNA, 19 nt, Human adenovirus B (HAdV-B)
aggacaaagcgugcugcac

SEQ ID NO: 1541230 - RNA, 11 nt, Human adenovirus B (HAdV-B)
ggaggcagagg

SEQ ID NO: 1541231 - RNA, 22 nt, Human adenovirus B (HAdV-B)
caagugcagcaacaggaggauu

SEQ ID NO: 1541232 - RNA, 23 nt, Human adenovirus B (HAdV-B)
uuuggggucuggauuugaccccu

SEQ ID NO: 1541233 - RNA, 13 nt, Human adenovirus B (HAdV-B)
ucugagacagaca

SEQ ID NO: 1541234 - RNA, 22 nt, Human adenovirus B (HAdV-B)
cgagucaguggacggcuacgau

SEQ ID NO: 1541235 - RNA, 20 nt, Human adenovirus B (HAdV-B)
gcacagcuagaucaaaagaa

SEQ ID NO: 1541236 - RNA, 16 nt, Human adenovirus B (HAdV-B)
cucccaagcagacacc

SEQ ID NO: 1541237 - RNA, 20 nt, Human adenovirus B (HAdV-B)
guaucauucccugcagaaau

SEQ ID NO: 1541238 - RNA, 21 nt, Human adenovirus B (HAdV-B)
ggggcaacuccgacugcagca

SEQ ID NO: 1541239 - RNA, 16 nt, Human adenovirus B (HAdV-B)
guucgcucaccagaag

SEQ ID NO: 1541240 - RNA, 18 nt, Human adenovirus B (HAdV-B)
caguaacuacccuguggu

SEQ ID NO: 1541241 - RNA, 19 nt, Human adenovirus B (HAdV-B)
caaaagaaggacucccagu

SEQ ID NO: 1541242 - RNA, 14 nt, Human adenovirus B (HAdV-B)
uguuaacuguucac

SEQ ID NO: 1541243 - RNA, 23 nt, Human adenovirus B (HAdV-B)
uggcugggcaccgacucucccag

SEQ ID NO: 1541244 - RNA, 20 nt, Human adenovirus B (HAdV-B)
ggauucuuaacagugcaggc

SEQ ID NO: 1541245 - RNA, 18 nt, Human adenovirus B (HAdV-B)
ugaugaacaaugccauca

SEQ ID NO: 1541246 - RNA, 15 nt, Human adenovirus B (HAdV-B)
cgagggucugggcaa

SEQ ID NO: 1541247 - RNA, 15 nt, Human adenovirus B (HAdV-B)
uggcaguuuggaagc

SEQ ID NO: 1541248 - RNA, 15 nt, Human adenovirus B (HAdV-B)
ugcgggacagcccgc

SEQ ID NO: 1541249 - RNA, 20 nt, Human adenovirus B (HAdV-B)
caggcauuaguuuaaaagag

SEQ ID NO: 1541250 - RNA, 13 nt, Human adenovirus B (HAdV-B)
ccauguuaauuuu

SEQ ID NO: 1541251 - RNA, 17 nt, Human adenovirus B (HAdV-B)
cacagcuuucuggucag

SEQ ID NO: 1541252 - RNA, 18 nt, Human adenovirus B (HAdV-B)
ucuugcuugacucucugg

SEQ ID NO: 1541253 - RNA, 14 nt, Human adenovirus B (HAdV-B)
cagggcucugagcg

SEQ ID NO: 1541254 - RNA, 13 nt, Human adenovirus B (HAdV-B)
cggcgucccagca

SEQ ID NO: 1541255 - RNA, 16 nt, Human adenovirus B (HAdV-B)
gaguucauaccgaacu

SEQ ID NO: 1541256 - RNA, 21 nt, Human adenovirus B (HAdV-B)
cgaggaaaaggagcagagcuu

SEQ ID NO: 1541257 - RNA, 13 nt, Human adenovirus B (HAdV-B)
cggcucugggcau

SEQ ID NO: 1541258 - RNA, 19 nt, Human adenovirus B (HAdV-B)
aggacaggcgcuuagaaau

SEQ ID NO: 1541259 - RNA, 15 nt, Human adenovirus B (HAdV-B)
uccugcaccauuccc

SEQ ID NO: 1541260 - RNA, 13 nt, Human adenovirus B (HAdV-B)
caggcagaggagg

SEQ ID NO: 1541261 - RNA, 14 nt, Human adenovirus B (HAdV-B)
agcuuaccuuugga

SEQ ID NO: 1541262 - RNA, 20 nt, Human adenovirus B (HAdV-B)
acagugcaggcagcagcucc

SEQ ID NO: 1541263 - RNA, 19 nt, Human adenovirus B (HAdV-B)
aagugcagcaacaggagga

SEQ ID NO: 1541264 - RNA, 23 nt, Human adenovirus B (HAdV-B)
uccuaggcagagaaacaacagac

SEQ ID NO: 1541265 - RNA, 20 nt, Human adenovirus B (HAdV-B)
acuggcaguuuggaagccac

SEQ ID NO: 1541266 - RNA, 17 nt, Human adenovirus B (HAdV-B)
cagcgugaugccaaccu

SEQ ID NO: 1541267 - RNA, 22 nt, Human adenovirus B (HAdV-B)
accaaaauaucgcggcacuucu

SEQ ID NO: 1541268 - RNA, 16 nt, Human adenovirus B (HAdV-B)
agaucugaguuggcuu

SEQ ID NO: 1541269 - RNA, 20 nt, Human adenovirus B (HAdV-B)
cugucaaaucaugaacucca

SEQ ID NO: 1541270 - RNA, 15 nt, Human adenovirus B (HAdV-B)
ucaaugauugcaauu

SEQ ID NO: 1541271 - RNA, 13 nt, Human adenovirus B (HAdV-B)
uauagcaaagcca

SEQ ID NO: 1541272 - RNA, 20 nt, Human adenovirus B (HAdV-B)
aaagaauguaucauucccug

SEQ ID NO: 1541273 - RNA, 21 nt, Human adenovirus B (HAdV-B)
agcaagauguacggaggcgca

SEQ ID NO: 1541274 - RNA, 20 nt, Human adenovirus B (HAdV-B)
aagauucccacugaaaguau

SEQ ID NO: 1541275 - RNA, 20 nt, Human adenovirus B (HAdV-B)
ggucuuuacacccggcgagc

SEQ ID NO: 1541276 - RNA, 17 nt, Human adenovirus B (HAdV-B)
uaccugauauagcuucc

SEQ ID NO: 1541277 - RNA, 13 nt, Human adenovirus B (HAdV-B)
aggcagaggaggc

SEQ ID NO: 1541278 - RNA, 22 nt, Human adenovirus B (HAdV-B)
cagagucggggucaagagcagg

SEQ ID NO: 1541279 - RNA, 16 nt, Human adenovirus B (HAdV-B)
agauaauuacuugaaa

SEQ ID NO: 1541280 - RNA, 17 nt, Human adenovirus B (HAdV-B)
accucccaacaccccuu

SEQ ID NO: 1541281 - RNA, 11 nt, Human adenovirus B (HAdV-B)
aaccugacccc

SEQ ID NO: 1541282 - RNA, 13 nt, Human adenovirus B (HAdV-B)
aaaauaaacuuug

SEQ ID NO: 1541283 - RNA, 13 nt, Human adenovirus B (HAdV-B)
acccagggggcaa

SEQ ID NO: 1541284 - RNA, 17 nt, Human adenovirus B (HAdV-B)
aaguacgucuagggcgc

SEQ ID NO: 1541285 - RNA, 23 nt, Human adenovirus B (HAdV-B)
ucagaugucaccugcggagcaga

SEQ ID NO: 1541286 - RNA, 13 nt, Human adenovirus B (HAdV-B)
aagaggcggauga

SEQ ID NO: 1541287 - RNA, 15 nt, Human adenovirus B (HAdV-B)
uggaaguuuucuugc

SEQ ID NO: 1541288 - RNA, 17 nt, Human adenovirus B (HAdV-B)
ucuggggguacaaacug

SEQ ID NO: 1541289 - RNA, 13 nt, Human adenovirus B (HAdV-B)
cuugggacagaau

SEQ ID NO: 1541290 - RNA, 12 nt, Human adenovirus B (HAdV-B)
cuuaccuuuggu

SEQ ID NO: 1541291 - RNA, 20 nt, Human adenovirus B (HAdV-B)
gcacauagucauauaguuca

SEQ ID NO: 1541292 - RNA, 16 nt, Human adenovirus B (HAdV-B)
ccaugcaugcaggugg

SEQ ID NO: 1541293 - RNA, 19 nt, Human adenovirus B (HAdV-B)
gcauuguggagaacaugga

SEQ ID NO: 1541294 - RNA, 19 nt, Human adenovirus B (HAdV-B)
gaugggugcauucggggug

SEQ ID NO: 1541295 - RNA, 17 nt, Human adenovirus B (HAdV-B)
ccaguguaacaugaauc

SEQ ID NO: 1541296 - RNA, 17 nt, Human adenovirus B (HAdV-B)
gcaccgacucucccagg

SEQ ID NO: 1541297 - RNA, 14 nt, Human adenovirus B (HAdV-B)
uucacucaaaucuu

SEQ ID NO: 1541298 - RNA, 18 nt, Human adenovirus B (HAdV-B)
cagguuguaucuggugga

SEQ ID NO: 1541299 - RNA, 14 nt, Human adenovirus B (HAdV-B)
gugcggcaggcaug

SEQ ID NO: 1541300 - RNA, 22 nt, Human adenovirus B (HAdV-B)
ugauggauauguggccuggggu

SEQ ID NO: 1541301 - RNA, 22 nt, Human adenovirus B (HAdV-B)
ugaugaaggauccugucacuuu

SEQ ID NO: 1541302 - RNA, 15 nt, Human adenovirus B (HAdV-B)
cugucgcuuggcgcc

SEQ ID NO: 1541303 - RNA, 15 nt, Human adenovirus B (HAdV-B)
cgaggaggaagaggg

SEQ ID NO: 1541304 - RNA, 17 nt, Human adenovirus B (HAdV-B)
ccugcccgccaccugcu

SEQ ID NO: 1541305 - RNA, 17 nt, Human adenovirus B (HAdV-B)
acgcauccgccagcagc

SEQ ID NO: 1541306 - RNA, 16 nt, Human adenovirus B (HAdV-B)
agagcgucgcaagcuu

SEQ ID NO: 1541307 - RNA, 22 nt, Human adenovirus B (HAdV-B)
aacuggauuuccugccaccagu

SEQ ID NO: 1541308 - RNA, 16 nt, Human adenovirus B (HAdV-B)
ucauccaaauucacca

SEQ ID NO: 1541309 - RNA, 20 nt, Human adenovirus B (HAdV-B)
ggcacacguggcugcagcca

SEQ ID NO: 1541310 - RNA, 15 nt, Human adenovirus B (HAdV-B)
uuaauaaaaacugaa

SEQ ID NO: 1541311 - RNA, 19 nt, Human adenovirus B (HAdV-B)
caaaccucugcuacaaccc

SEQ ID NO: 1541312 - RNA, 23 nt, Human adenovirus B (HAdV-B)
aacuuauauugcaugguuguagc

SEQ ID NO: 1541313 - RNA, 16 nt, Human adenovirus B (HAdV-B)
cagaagauauggagga

SEQ ID NO: 1541314 - RNA, 19 nt, Human adenovirus B (HAdV-B)
auuccacauuccaaacagu

SEQ ID NO: 1541315 - RNA, 20 nt, Human adenovirus B (HAdV-B)
ccagggcacacguggcugca

SEQ ID NO: 1541316 - RNA, 23 nt, Human adenovirus B (HAdV-B)
gucaugccagcgguucuggagga

SEQ ID NO: 1541317 - RNA, 22 nt, Human adenovirus B (HAdV-B)
ugcgcccccaacaacagccccc

SEQ ID NO: 1541318 - RNA, 16 nt, Human adenovirus B (HAdV-B)
aaccaggggguccacc

SEQ ID NO: 1541319 - RNA, 19 nt, Human adenovirus B (HAdV-B)
cuccaacauuguuaguuuu

SEQ ID NO: 1541320 - RNA, 21 nt, Human adenovirus B (HAdV-B)
uaugcucaggaucacagagac

SEQ ID NO: 1541321 - RNA, 15 nt, Human adenovirus B (HAdV-B)
gguggacaacaaguc

SEQ ID NO: 1541322 - RNA, 13 nt, Human adenovirus B (HAdV-B)
gaugugagcuucc

SEQ ID NO: 1541323 - RNA, 12 nt, Human adenovirus B (HAdV-B)
cugccccauggc

SEQ ID NO: 1541324 - RNA, 23 nt, Human adenovirus B (HAdV-B)
ugcuaccuguuccgucuggccaa

SEQ ID NO: 1541325 - RNA, 14 nt, Human adenovirus B (HAdV-B)
cugggcgacagaac

SEQ ID NO: 1541326 - RNA, 15 nt, Human adenovirus B (HAdV-B)
ggaacagcaagagga

SEQ ID NO: 1541327 - RNA, 23 nt, Human adenovirus B (HAdV-B)
ugcgccugcuugggcgcuugcca

SEQ ID NO: 1541328 - RNA, 20 nt, Human adenovirus B (HAdV-B)
ugcaaauuaauucuaacacu

SEQ ID NO: 1541329 - RNA, 16 nt, Human adenovirus B (HAdV-B)
aauugcaaggccccag

SEQ ID NO: 1541330 - RNA, 15 nt, Human adenovirus B (HAdV-B)
aagauucuugaagcu

SEQ ID NO: 1541331 - RNA, 16 nt, Human adenovirus B (HAdV-B)
gacagucaggcagagg

SEQ ID NO: 1541332 - RNA, 17 nt, Human adenovirus B (HAdV-B)
cacuagucacugcauuu

SEQ ID NO: 1541333 - RNA, 20 nt, Human adenovirus B (HAdV-B)
uacuuuuauauuagauaaau

SEQ ID NO: 1541334 - RNA, 15 nt, Human adenovirus B (HAdV-B)
gaagccguacauggg

SEQ ID NO: 1541335 - RNA, 15 nt, Human adenovirus B (HAdV-B)
accuuuggaaguuuu

SEQ ID NO: 1541336 - RNA, 18 nt, Human adenovirus B (HAdV-B)
aauugagauuugccacau

SEQ ID NO: 1541337 - RNA, 13 nt, Human adenovirus B (HAdV-B)
ucaucuucccaga

SEQ ID NO: 1541338 - RNA, 13 nt, Human adenovirus B (HAdV-B)
ugcaggcagcagc

SEQ ID NO: 1541339 - RNA, 15 nt, Human adenovirus B (HAdV-B)
ccccucccccugcug

SEQ ID NO: 1541340 - RNA, 16 nt, Human adenovirus B (HAdV-B)
uuuggaccgaagacga

SEQ ID NO: 1541341 - RNA, 21 nt, Human adenovirus B (HAdV-B)
ugaacaccaaucaugguaccu

SEQ ID NO: 1541342 - RNA, 12 nt, Human adenovirus B (HAdV-B)
acuuggaagagg

SEQ ID NO: 1541343 - RNA, 14 nt, Human adenovirus B (HAdV-B)
gugucaccuguagc

SEQ ID NO: 1541344 - RNA, 16 nt, Human adenovirus B (HAdV-B)
uggacccaggccaugc

SEQ ID NO: 1541345 - RNA, 12 nt, Human adenovirus B (HAdV-B)
ucccuggcuccu

SEQ ID NO: 1541346 - RNA, 23 nt, Human adenovirus B (HAdV-B)
gugguugacuugcaggacagaaa

SEQ ID NO: 1541347 - RNA, 21 nt, Human adenovirus B (HAdV-B)
aaaccauuugguggcaugagg

SEQ ID NO: 1541348 - RNA, 18 nt, Human adenovirus B (HAdV-B)
cgagagcgugaugcagca

SEQ ID NO: 1541349 - RNA, 20 nt, Human adenovirus B (HAdV-B)
ucauccuggaacgcuccggu

SEQ ID NO: 1541350 - RNA, 15 nt, Human adenovirus B (HAdV-B)
guaucaaggcucugc

SEQ ID NO: 1541351 - RNA, 20 nt, Human adenovirus B (HAdV-B)
cuuugugccucucaccuacc

SEQ ID NO: 1541352 - RNA, 19 nt, Human adenovirus B (HAdV-B)
ccaacaccgcucccccagc

SEQ ID NO: 1541353 - RNA, 15 nt, Human adenovirus B (HAdV-B)
caaacgucagccaaa

SEQ ID NO: 1541354 - RNA, 17 nt, Human adenovirus B (HAdV-B)
cugcugcuucucccagg

SEQ ID NO: 1541355 - RNA, 16 nt, Human adenovirus B (HAdV-B)
agaacgaaacuuuucc

SEQ ID NO: 1541356 - RNA, 21 nt, Human adenovirus B (HAdV-B)
ucagagcgagccaaucugggg

SEQ ID NO: 1541357 - RNA, 18 nt, Human adenovirus B (HAdV-B)
agaacaccgacuaccuca

SEQ ID NO: 1541358 - RNA, 20 nt, Human adenovirus B (HAdV-B)
cagaaccaagagucaauugu

SEQ ID NO: 1541359 - RNA, 14 nt, Human adenovirus B (HAdV-B)
cuugaaagugggua

SEQ ID NO: 1541360 - RNA, 14 nt, Human adenovirus B (HAdV-B)
gaguacuuggaaga

SEQ ID NO: 1541361 - RNA, 22 nt, Human adenovirus B (HAdV-B)
caaugcugaacggggucaucuu

SEQ ID NO: 1541362 - RNA, 18 nt, Human adenovirus B (HAdV-B)
ucccgacgaaaguacggu

SEQ ID NO: 1541363 - RNA, 18 nt, Human adenovirus B (HAdV-B)
acagcuagaucaaaagaa

SEQ ID NO: 1541364 - RNA, 15 nt, Human adenovirus B (HAdV-B)
uaacagugcaggcag

SEQ ID NO: 1541365 - RNA, 13 nt, Human adenovirus B (HAdV-B)
guccuuucaagcc

SEQ ID NO: 1541366 - RNA, 18 nt, Human adenovirus B (HAdV-B)
cggaggaggacagucugg

SEQ ID NO: 1541367 - RNA, 18 nt, Human adenovirus B (HAdV-B)
cucaguggauugcagaag

SEQ ID NO: 1541368 - RNA, 19 nt, Human adenovirus B (HAdV-B)
cccaacaacagccccccuc

SEQ ID NO: 1541369 - RNA, 19 nt, Human adenovirus B (HAdV-B)
caggccucuucuccagugg

SEQ ID NO: 1541370 - RNA, 11 nt, Human adenovirus B (HAdV-B)
cuccaagcaag

SEQ ID NO: 1541371 - RNA, 22 nt, Human adenovirus B (HAdV-B)
cugccaggguucgguccuucca

SEQ ID NO: 1541372 - RNA, 15 nt, Human adenovirus B (HAdV-B)
cuugguuugaugcau

SEQ ID NO: 1541373 - RNA, 20 nt, Human adenovirus B (HAdV-B)
uccccaaauggcuucacaca

SEQ ID NO: 1541374 - RNA, 19 nt, Human adenovirus B (HAdV-B)
ucaaaugcucacuugugcu

SEQ ID NO: 1541375 - RNA, 21 nt, Human adenovirus B (HAdV-B)
aauugcaaggccccagcagcc

SEQ ID NO: 1541376 - RNA, 12 nt, Human adenovirus B (HAdV-B)
uaaucccagaaa

SEQ ID NO: 1541377 - RNA, 13 nt, Human adenovirus B (HAdV-B)
aauacaauuucca

SEQ ID NO: 1541378 - RNA, 20 nt, Human adenovirus B (HAdV-B)
ccgacuuugugccucucacc

SEQ ID NO: 1541379 - RNA, 17 nt, Human adenovirus B (HAdV-B)
uguaaauguuaaguuua

SEQ ID NO: 1541380 - RNA, 13 nt, Human adenovirus B (HAdV-B)
gcguguuggauug

SEQ ID NO: 1541381 - RNA, 17 nt, Human adenovirus B (HAdV-B)
uaaccccacuaacaacc

SEQ ID NO: 1541382 - RNA, 23 nt, Human adenovirus B (HAdV-B)
aagggagaaaauggcauggauga

SEQ ID NO: 1541383 - RNA, 12 nt, Human adenovirus B (HAdV-B)
ggccgguaacgc

SEQ ID NO: 1541384 - RNA, 21 nt, Human adenovirus B (HAdV-B)
gcgaguuugcuuauggcaagc

SEQ ID NO: 1541385 - RNA, 17 nt, Human adenovirus B (HAdV-B)
ugaucaugccuggagug

SEQ ID NO: 1541386 - RNA, 18 nt, Human adenovirus B (HAdV-B)
augaauuaaaaaaugauu

SEQ ID NO: 1541387 - RNA, 14 nt, Human adenovirus B (HAdV-B)
ccacacgauccaca

SEQ ID NO: 1541388 - RNA, 22 nt, Human adenovirus B (HAdV-B)
ccaucgugaacgcguuggugga

SEQ ID NO: 1541389 - RNA, 18 nt, Human adenovirus B (HAdV-B)
aagugccaccacaccacu

SEQ ID NO: 1541390 - RNA, 22 nt, Human adenovirus B (HAdV-B)
gucgacgcugaguuacuuucaa

SEQ ID NO: 1541391 - RNA, 12 nt, Human adenovirus B (HAdV-B)
aguggaggaggc

SEQ ID NO: 1541392 - RNA, 13 nt, Human adenovirus B (HAdV-B)
uuggcuccagcaa

SEQ ID NO: 1541393 - RNA, 18 nt, Human adenovirus B (HAdV-B)
agaauaaaaaauauaauu

SEQ ID NO: 1541394 - RNA, 19 nt, Human adenovirus B (HAdV-B)
cgcccucaagggccgcacu

SEQ ID NO: 1541395 - RNA, 14 nt, Human adenovirus B (HAdV-B)
aauuucuuuuuaua

SEQ ID NO: 1541396 - RNA, 20 nt, Human adenovirus B (HAdV-B)
cuucagcgcacucucgagga

SEQ ID NO: 1541397 - RNA, 12 nt, Human adenovirus B (HAdV-B)
uucacagcagua

SEQ ID NO: 1541398 - RNA, 19 nt, Human adenovirus B (HAdV-B)
aagaucccgacgaaaguac

SEQ ID NO: 1541399 - RNA, 20 nt, Human adenovirus B (HAdV-B)
gcuaugaacucugauuauuu

SEQ ID NO: 1541400 - RNA, 15 nt, Human adenovirus B (HAdV-B)
caauuggcuccagca

SEQ ID NO: 1541401 - RNA, 16 nt, Human adenovirus B (HAdV-B)
uccgaacucccgccua

SEQ ID NO: 1541402 - RNA, 17 nt, Human adenovirus B (HAdV-B)
cucuucgggggcagagg

SEQ ID NO: 1541403 - RNA, 21 nt, Human adenovirus B (HAdV-B)
agaaaucucuuaagguucugu

SEQ ID NO: 1541404 - RNA, 20 nt, Human adenovirus B (HAdV-B)
gaauugcaaggccccagcag

SEQ ID NO: 1541405 - RNA, 19 nt, Human adenovirus B (HAdV-B)
uccaacagaaaaccagcag

SEQ ID NO: 1541406 - RNA, 20 nt, Human adenovirus B (HAdV-B)
ugaaagcaucauauugcuug

SEQ ID NO: 1541407 - RNA, 16 nt, Human adenovirus B (HAdV-B)
cgccacgagugccauc

SEQ ID NO: 1541408 - RNA, 12 nt, Human adenovirus B (HAdV-B)
auagccacagca

SEQ ID NO: 1541409 - RNA, 15 nt, Human adenovirus B (HAdV-B)
ucaugccuggagugu

SEQ ID NO: 1541410 - RNA, 22 nt, Human adenovirus B (HAdV-B)
cggauucuuaacagugcaggca

SEQ ID NO: 1541411 - RNA, 15 nt, Human adenovirus B (HAdV-B)
agccugggaucaugg

SEQ ID NO: 1541412 - RNA, 14 nt, Human adenovirus B (HAdV-B)
gauaugugcagcag

SEQ ID NO: 1541413 - RNA, 17 nt, Human adenovirus B (HAdV-B)
ggaaaaggagcagagcu

SEQ ID NO: 1541414 - RNA, 21 nt, Human adenovirus B (HAdV-B)
gaccuccaacagaaaaccagc

SEQ ID NO: 1541415 - RNA, 23 nt, Human adenovirus B (HAdV-B)
gccugcaacgaauuuucucccag

SEQ ID NO: 1541416 - RNA, 20 nt, Human adenovirus B (HAdV-B)
cgggccgcaaaugcucugca

SEQ ID NO: 1541417 - RNA, 15 nt, Human adenovirus B (HAdV-B)
uuuaacuuguuuauu

SEQ ID NO: 1541418 - RNA, 16 nt, Human adenovirus B (HAdV-B)
cuggacuuggaagagg

SEQ ID NO: 1541419 - RNA, 24 nt, Human adenovirus B (HAdV-B)
gccagcacccagaccauuaacuuu

SEQ ID NO: 1541420 - RNA, 11 nt, Human adenovirus B (HAdV-B)
aaaccuucuca

SEQ ID NO: 1541421 - RNA, 14 nt, Human adenovirus B (HAdV-B)
ccuucaccccucgu

SEQ ID NO: 1541422 - RNA, 19 nt, Human adenovirus B (HAdV-B)
uaaccccacuaacaaccac

SEQ ID NO: 1541423 - RNA, 18 nt, Human adenovirus B (HAdV-B)
aagguucccucaggaugu

SEQ ID NO: 1541424 - RNA, 13 nt, Human adenovirus B (HAdV-B)
gcuuauugcuugu

SEQ ID NO: 1541425 - RNA, 21 nt, Human adenovirus B (HAdV-B)
augauuaauaaaaaaucacuu

SEQ ID NO: 1541426 - RNA, 13 nt, Human adenovirus B (HAdV-B)
cugugccagaagu

SEQ ID NO: 1541427 - RNA, 14 nt, Human adenovirus B (HAdV-B)
uuggaacagcagua

SEQ ID NO: 1541428 - RNA, 19 nt, Human adenovirus B (HAdV-B)
ggguuuauuuccccaaaug

SEQ ID NO: 1541429 - RNA, 21 nt, Human adenovirus B (HAdV-B)
gugccuccgcgauaccuggca

SEQ ID NO: 1541430 - RNA, 18 nt, Human adenovirus B (HAdV-B)
caugcuucuggguaacgg

SEQ ID NO: 1541431 - RNA, 15 nt, Human adenovirus B (HAdV-B)
ugcaacacagcagag

SEQ ID NO: 1541432 - RNA, 19 nt, Human adenovirus B (HAdV-B)
aucccggcagucucgacag

SEQ ID NO: 1541433 - RNA, 19 nt, Human adenovirus B (HAdV-B)
gcugccaccggucaacgug

SEQ ID NO: 1541434 - RNA, 20 nt, Human adenovirus B (HAdV-B)
caagugcagcaacaggagga

SEQ ID NO: 1541435 - RNA, 19 nt, Human adenovirus B (HAdV-B)
gcugggcaccgacucuccc

SEQ ID NO: 1541436 - RNA, 13 nt, Human adenovirus B (HAdV-B)
ugagaauuggaag

SEQ ID NO: 1541437 - RNA, 20 nt, Human adenovirus B (HAdV-B)
ugaugauagcaaauuucuga

SEQ ID NO: 1541438 - RNA, 15 nt, Human adenovirus B (HAdV-B)
ccacaacccccacua

SEQ ID NO: 1541439 - RNA, 19 nt, Human adenovirus B (HAdV-B)
gggcacccaauuaggcuug

SEQ ID NO: 1541440 - RNA, 18 nt, Human adenovirus B (HAdV-B)
aaguuuaaaacugacccc

SEQ ID NO: 1541441 - RNA, 12 nt, Human adenovirus B (HAdV-B)
gccagaggguca

SEQ ID NO: 1541442 - RNA, 17 nt, Human adenovirus B (HAdV-B)
acuacaccgcuuuucca

SEQ ID NO: 1541443 - RNA, 21 nt, Human adenovirus B (HAdV-B)
caccgucgcuuccgaccuggc

SEQ ID NO: 1541444 - RNA, 22 nt, Human adenovirus B (HAdV-B)
cacacguggcugcagccaaccu

SEQ ID NO: 1541445 - RNA, 16 nt, Human adenovirus B (HAdV-B)
aacaaccaguuacaaa

SEQ ID NO: 1541446 - RNA, 16 nt, Human adenovirus B (HAdV-B)
uugggcgcuugccagg

SEQ ID NO: 1541447 - RNA, 19 nt, Human adenovirus B (HAdV-B)
cuucuccggaucuccuggg

SEQ ID NO: 1541448 - RNA, 21 nt, Human adenovirus B (HAdV-B)
uacuaagaugaaaccaugcua

SEQ ID NO: 1541449 - RNA, 15 nt, Human adenovirus B (HAdV-B)
caccguuucuggggc

SEQ ID NO: 1541450 - RNA, 21 nt, Human adenovirus B (HAdV-B)
uccagaagcauuuucccuacu

SEQ ID NO: 1541451 - RNA, 21 nt, Human adenovirus B (HAdV-B)
cggcgaggauguccaagcgca

SEQ ID NO: 1541452 - RNA, 12 nt, Human adenovirus B (HAdV-B)
agucgcagggcu

SEQ ID NO: 1541453 - RNA, 19 nt, Human adenovirus B (HAdV-B)
cugcaaccauggccugcgg

SEQ ID NO: 1541454 - RNA, 13 nt, Human adenovirus B (HAdV-B)
acgcucuucuccu

SEQ ID NO: 1541455 - RNA, 17 nt, Human adenovirus B (HAdV-B)
caaauucaccaaugcaa

SEQ ID NO: 1541456 - RNA, 19 nt, Human adenovirus B (HAdV-B)
ucgaggucacacacuucgc

SEQ ID NO: 1541457 - RNA, 12 nt, Human adenovirus B (HAdV-B)
aucgcagugcag

SEQ ID NO: 1541458 - RNA, 15 nt, Human adenovirus B (HAdV-B)
aauuacuugaaagug

SEQ ID NO: 1541459 - RNA, 17 nt, Human adenovirus B (HAdV-B)
aucuaacguggaacuca

SEQ ID NO: 1541460 - RNA, 19 nt, Human adenovirus B (HAdV-B)
gugcgcgaguuugccccac

SEQ ID NO: 1541461 - RNA, 13 nt, Human adenovirus B (HAdV-B)
cagauucaaugau

SEQ ID NO: 1541462 - RNA, 13 nt, Human adenovirus B (HAdV-B)
ugcagaacaguaa

SEQ ID NO: 1541463 - RNA, 21 nt, Human adenovirus B (HAdV-B)
guuuuggagaaaguaaaagug

SEQ ID NO: 1541464 - RNA, 18 nt, Human adenovirus B (HAdV-B)
ucagaccgucagccaugg

SEQ ID NO: 1541465 - RNA, 16 nt, Human adenovirus B (HAdV-B)
uaaaaccugucaucau

SEQ ID NO: 1541466 - RNA, 23 nt, Human adenovirus B (HAdV-B)
ccaacucuugcuugacucucugg

SEQ ID NO: 1541467 - RNA, 19 nt, Human adenovirus B (HAdV-B)
aggccccagcagccaaggc

SEQ ID NO: 1541468 - RNA, 14 nt, Human adenovirus B (HAdV-B)
gugcacgccccacc

SEQ ID NO: 1541469 - RNA, 15 nt, Human adenovirus B (HAdV-B)
uacaaagacuucaag

SEQ ID NO: 1541470 - RNA, 19 nt, Human adenovirus B (HAdV-B)
gaugcaauccccacuggag

SEQ ID NO: 1541471 - RNA, 12 nt, Human adenovirus B (HAdV-B)
aaacaacauuug

SEQ ID NO: 1541472 - RNA, 22 nt, Human adenovirus B (HAdV-B)
uugcaaggccccagcagccaag

SEQ ID NO: 1541473 - RNA, 16 nt, Human adenovirus B (HAdV-B)
aggaggcggaggagga

SEQ ID NO: 1541474 - RNA, 13 nt, Human adenovirus B (HAdV-B)
uagugcaggagcg

SEQ ID NO: 1541475 - RNA, 21 nt, Human adenovirus B (HAdV-B)
cgcgcuaaucgcacccgcgcc

SEQ ID NO: 1541476 - RNA, 21 nt, Human adenovirus B (HAdV-B)
cuugaaagagcuugacaagcu

SEQ ID NO: 1541477 - RNA, 18 nt, Human adenovirus B (HAdV-B)
uuugaagcucuuaauuug

SEQ ID NO: 1541478 - RNA, 20 nt, Human adenovirus B (HAdV-B)
caagcguaguagaauaacuu

SEQ ID NO: 1541479 - RNA, 13 nt, Human adenovirus B (HAdV-B)
cagucaggcagag

SEQ ID NO: 1541480 - RNA, 12 nt, Human adenovirus B (HAdV-B)
auguggccuggg

SEQ ID NO: 1541481 - RNA, 12 nt, Human adenovirus B (HAdV-B)
aauaugcuggcu

SEQ ID NO: 1541482 - RNA, 21 nt, Human adenovirus B (HAdV-B)
caagaaguugaaggugcagcc

SEQ ID NO: 1541483 - RNA, 13 nt, Human adenovirus B (HAdV-B)
uuacaucucucau

SEQ ID NO: 1541484 - RNA, 19 nt, Human adenovirus B (HAdV-B)
auugucucugaagaaaugc

SEQ ID NO: 1541485 - RNA, 16 nt, Human adenovirus B (HAdV-B)
caacucccuggcuccu

SEQ ID NO: 1541486 - RNA, 14 nt, Human adenovirus B (HAdV-B)
uagcuugcaacccc

SEQ ID NO: 1541487 - RNA, 21 nt, Human adenovirus B (HAdV-B)
agcaacagcgcuaccaucucc

SEQ ID NO: 1541488 - RNA, 18 nt, Human adenovirus B (HAdV-B)
ucaaccccuucuccggau

SEQ ID NO: 1541489 - RNA, 18 nt, Human adenovirus B (HAdV-B)
gucaauugucucugaaga

SEQ ID NO: 1541490 - RNA, 23 nt, Human adenovirus B (HAdV-B)
uuccccuacaaaacaugcaacau

SEQ ID NO: 1541491 - RNA, 19 nt, Human adenovirus B (HAdV-B)
ccagaccggcgaggaacuc

SEQ ID NO: 1541492 - RNA, 13 nt, Human adenovirus B (HAdV-B)
cauuugugcauuu

SEQ ID NO: 1541493 - RNA, 15 nt, Human adenovirus B (HAdV-B)
uacugacgccagacg

SEQ ID NO: 1541494 - RNA, 20 nt, Human adenovirus B (HAdV-B)
uccaacagaaaaccagcagc

SEQ ID NO: 1541495 - RNA, 15 nt, Human adenovirus B (HAdV-B)
ggauuggcggcaggc

SEQ ID NO: 1541496 - RNA, 21 nt, Human adenovirus B (HAdV-B)
uacaaaagaaggacucccagu

SEQ ID NO: 1541497 - RNA, 14 nt, Human adenovirus B (HAdV-B)
ucuugcuugcuauc

SEQ ID NO: 1541498 - RNA, 18 nt, Human adenovirus B (HAdV-B)
aaaugacgagacaucaua

SEQ ID NO: 1541499 - RNA, 18 nt, Human adenovirus B (HAdV-B)
cagaauggagugcuugaa

SEQ ID NO: 1541500 - RNA, 14 nt, Human adenovirus B (HAdV-B)
cagcagcagcaggc

SEQ ID NO: 1541501 - RNA, 19 nt, Human adenovirus B (HAdV-B)
acaacaagugcagcaacag

SEQ ID NO: 1541502 - RNA, 19 nt, Human adenovirus B (HAdV-B)
cagacgguaaaucugagcc

SEQ ID NO: 1541503 - RNA, 12 nt, Human adenovirus B (HAdV-B)
cagcgugcugga

SEQ ID NO: 1541504 - RNA, 20 nt, Human adenovirus B (HAdV-B)
cuggcggcuccacccuaugu

SEQ ID NO: 1541505 - RNA, 16 nt, Human adenovirus B (HAdV-B)
cucaugaaagcaucau

SEQ ID NO: 1541506 - RNA, 13 nt, Human adenovirus B (HAdV-B)
gaacgaaacuuuu

SEQ ID NO: 1541507 - RNA, 13 nt, Human adenovirus B (HAdV-B)
ccuuaucaaaugc

SEQ ID NO: 1541508 - RNA, 17 nt, Human adenovirus B (HAdV-B)
gcgaagcaucgagguca

SEQ ID NO: 1541509 - RNA, 22 nt, Human adenovirus B (HAdV-B)
ugagcaauugagauuugccaca

SEQ ID NO: 1541510 - RNA, 14 nt, Human adenovirus B (HAdV-B)
accacugccaugcg

SEQ ID NO: 1541511 - RNA, 19 nt, Human adenovirus B (HAdV-B)
cugccugguuauuaauuuu

SEQ ID NO: 1541512 - RNA, 15 nt, Human adenovirus B (HAdV-B)
gacacuccugguccu

SEQ ID NO: 1541513 - RNA, 12 nt, Human adenovirus B (HAdV-B)
cuugaaaucaca

SEQ ID NO: 1541514 - RNA, 18 nt, Human adenovirus B (HAdV-B)
cucgaaaacugguuagcu

SEQ ID NO: 1541515 - RNA, 19 nt, Human adenovirus B (HAdV-B)
cuguuaaaaaccugcugcu

SEQ ID NO: 1541516 - RNA, 17 nt, Human adenovirus B (HAdV-B)
uaugaagauuuagaagg

SEQ ID NO: 1541517 - RNA, 20 nt, Human adenovirus B (HAdV-B)
gguucuauucccuaccugga

SEQ ID NO: 1541518 - RNA, 18 nt, Human adenovirus B (HAdV-B)
gggagcugacuugcagug

SEQ ID NO: 1541519 - RNA, 15 nt, Human adenovirus B (HAdV-B)
gcaguuauugacagu

SEQ ID NO: 1541520 - RNA, 17 nt, Human adenovirus B (HAdV-B)
cugcgguccgaccugga

SEQ ID NO: 1541521 - RNA, 17 nt, Human adenovirus B (HAdV-B)
gaaguugaaggugcagc

SEQ ID NO: 1541522 - RNA, 22 nt, Human adenovirus B (HAdV-B)
gcugaaauuacaaaagaaggac

SEQ ID NO: 1541523 - RNA, 20 nt, Human adenovirus B (HAdV-B)
cauaggacccccaaucacuu

SEQ ID NO: 1541524 - RNA, 19 nt, Human adenovirus B (HAdV-B)
uacgagagcgugaugcagc

SEQ ID NO: 1541525 - RNA, 14 nt, Human adenovirus B (HAdV-B)
cuagaccacugccg

SEQ ID NO: 1541526 - RNA, 20 nt, Human adenovirus B (HAdV-B)
auucauuuuucagaaacuuc

SEQ ID NO: 1541527 - RNA, 15 nt, Human adenovirus B (HAdV-B)
aaauuuucucccagc

SEQ ID NO: 1541528 - RNA, 21 nt, Human adenovirus B (HAdV-B)
guagaagaaccugaccccaca

SEQ ID NO: 1541529 - RNA, 19 nt, Human adenovirus B (HAdV-B)
caaccguugaaggaugaaa

SEQ ID NO: 1541530 - RNA, 21 nt, Human adenovirus B (HAdV-B)
ccggccuggacccuccagugg

SEQ ID NO: 1541531 - RNA, 15 nt, Human adenovirus B (HAdV-B)
ugacuugucuccuga

SEQ ID NO: 1541532 - RNA, 19 nt, Human adenovirus B (HAdV-B)
aauucuucgcuguuaaaaa

SEQ ID NO: 1541533 - RNA, 14 nt, Human adenovirus B (HAdV-B)
uaacagugcaggca

SEQ ID NO: 1541534 - RNA, 16 nt, Human adenovirus B (HAdV-B)
ccaucuuccagcagag

SEQ ID NO: 1541535 - RNA, 17 nt, Human adenovirus B (HAdV-B)
cucgggauucuccuuua

SEQ ID NO: 1541536 - RNA, 16 nt, Human adenovirus B (HAdV-B)
ugggacagucaggcag

SEQ ID NO: 1541537 - RNA, 9 nt, Human adenovirus B (HAdV-B)
ccugcugcu

SEQ ID NO: 1541538 - RNA, 22 nt, Human adenovirus B (HAdV-B)
ggucuccaugaguucguguccu

SEQ ID NO: 1541539 - RNA, 23 nt, Human adenovirus B (HAdV-B)
caugauggauauguggccugggg

SEQ ID NO: 1541540 - RNA, 22 nt, Human adenovirus B (HAdV-B)
agaugcaucccgugcugcgaca

SEQ ID NO: 1541541 - RNA, 17 nt, Human adenovirus B (HAdV-B)
cccaauuggcuccagca

SEQ ID NO: 1541542 - RNA, 17 nt, Human adenovirus B (HAdV-B)
uacauucaauucaaaca

SEQ ID NO: 1541543 - RNA, 15 nt, Human adenovirus B (HAdV-B)
cuccacagccccuac

SEQ ID NO: 1541544 - RNA, 15 nt, Human adenovirus B (HAdV-B)
aggcgcugcugaaca

SEQ ID NO: 1541545 - RNA, 12 nt, Human adenovirus B (HAdV-B)
gagaauaaaaaa

SEQ ID NO: 1541546 - RNA, 23 nt, Human adenovirus B (HAdV-B)
gcagcgugcuggacuuggguggg

SEQ ID NO: 1541547 - RNA, 19 nt, Human adenovirus B (HAdV-B)
aggagccgaaaucuugaaa

SEQ ID NO: 1541548 - RNA, 18 nt, Human adenovirus B (HAdV-B)
ccagaggugcaaaccucu

SEQ ID NO: 1541549 - RNA, 16 nt, Human adenovirus B (HAdV-B)
cucuauaucucccaga

SEQ ID NO: 1541550 - RNA, 16 nt, Human adenovirus B (HAdV-B)
gcugaaacccacugcu

SEQ ID NO: 1541551 - RNA, 13 nt, Human adenovirus B (HAdV-B)
gacuauaaaagua

SEQ ID NO: 1541552 - RNA, 24 nt, Human adenovirus B (HAdV-B)
aguaccucagagcgaaguguauca

SEQ ID NO: 1541553 - RNA, 15 nt, Human adenovirus B (HAdV-B)
uagcgccagcaggag

SEQ ID NO: 1541554 - RNA, 19 nt, Human adenovirus B (HAdV-B)
cuaagaugaaaccaugcua

SEQ ID NO: 1541555 - RNA, 18 nt, Human adenovirus B (HAdV-B)
ugagcugcgucacgguuu

SEQ ID NO: 1541556 - RNA, 22 nt, Human adenovirus B (HAdV-B)
acccuguaugccaucuuccagc

SEQ ID NO: 1541557 - RNA, 14 nt, Human adenovirus B (HAdV-B)
aaaaugccaaauau

SEQ ID NO: 1541558 - RNA, 15 nt, Human adenovirus B (HAdV-B)
acaaguuuuccgcca

SEQ ID NO: 1541559 - RNA, 19 nt, Human adenovirus B (HAdV-B)
ugcaggagcggagccuggg

SEQ ID NO: 1541560 - RNA, 18 nt, Human adenovirus B (HAdV-B)
ucucuuaagguucugugg

SEQ ID NO: 1541561 - RNA, 15 nt, Human adenovirus B (HAdV-B)
gugggcgcaaaguuc

SEQ ID NO: 1541562 - RNA, 19 nt, Human adenovirus B (HAdV-B)
agagcgugaugcagcagca

SEQ ID NO: 1541563 - RNA, 14 nt, Human adenovirus B (HAdV-B)
ugccccccgccgcu

SEQ ID NO: 1541564 - RNA, 15 nt, Human adenovirus B (HAdV-B)
ucuggaagauccuga

SEQ ID NO: 1541565 - RNA, 17 nt, Human adenovirus B (HAdV-B)
gaugacuggcagaaccc

SEQ ID NO: 1541566 - RNA, 14 nt, Human adenovirus B (HAdV-B)
ggccccagcagcca

SEQ ID NO: 1541567 - RNA, 17 nt, Human adenovirus B (HAdV-B)
uaggagccggauuggga

SEQ ID NO: 1541568 - RNA, 18 nt, Human adenovirus B (HAdV-B)
aaucaaguucuaugagga

SEQ ID NO: 1541569 - RNA, 18 nt, Human adenovirus B (HAdV-B)
auggauauguggccuggg

SEQ ID NO: 1541570 - RNA, 23 nt, Human adenovirus B (HAdV-B)
agaggggucuugugugggacgau

SEQ ID NO: 1541571 - RNA, 13 nt, Human adenovirus B (HAdV-B)
cauugcagccaug

SEQ ID NO: 1541572 - RNA, 13 nt, Human adenovirus B (HAdV-B)
cagacaugaugaa

SEQ ID NO: 1541573 - RNA, 18 nt, Human adenovirus B (HAdV-B)
guuuagauacaugggcau

SEQ ID NO: 1541574 - RNA, 18 nt, Human adenovirus B (HAdV-B)
uugcuagauggaacagca

SEQ ID NO: 1541575 - RNA, 21 nt, Human adenovirus B (HAdV-B)
uugcaguagguacaacacauu

SEQ ID NO: 1541576 - RNA, 18 nt, Human adenovirus B (HAdV-B)
cauuauuggccgaugugu

SEQ ID NO: 1541577 - RNA, 17 nt, Human adenovirus B (HAdV-B)
acguggaaaaaggaagg

SEQ ID NO: 1541578 - RNA, 16 nt, Human adenovirus B (HAdV-B)
ccaugugaccaaccug

SEQ ID NO: 1541579 - RNA, 23 nt, Human adenovirus B (HAdV-B)
gaugggcguccagcgcugccagg

SEQ ID NO: 1541580 - RNA, 15 nt, Human adenovirus B (HAdV-B)
cuucagcuugcccuc

SEQ ID NO: 1541581 - RNA, 11 nt, Human adenovirus B (HAdV-B)
uagaaacuuuu

SEQ ID NO: 1541582 - RNA, 23 nt, Human adenovirus B (HAdV-B)
ccaugccuuucucccaagcagac

SEQ ID NO: 1541583 - RNA, 17 nt, Human adenovirus B (HAdV-B)
accuuaaucccagaaau

SEQ ID NO: 1541584 - RNA, 19 nt, Human adenovirus B (HAdV-B)
ccucaaaaacacacuaccc

SEQ ID NO: 1541585 - RNA, 12 nt, Human adenovirus B (HAdV-B)
aagagccaugcu

SEQ ID NO: 1541586 - RNA, 23 nt, Human adenovirus B (HAdV-B)
ucggucucaaaagaucccuccuc

SEQ ID NO: 1541587 - RNA, 17 nt, Human adenovirus B (HAdV-B)
augaauuaaaaaaugau

SEQ ID NO: 1541588 - RNA, 15 nt, Human adenovirus B (HAdV-B)
ccacaacgcacagcc

SEQ ID NO: 1541589 - RNA, 18 nt, Human adenovirus B (HAdV-B)
aucugcuccuucugaauc

SEQ ID NO: 1541590 - RNA, 18 nt, Human adenovirus B (HAdV-B)
ggggucaaaaacaaguuu

SEQ ID NO: 1541591 - RNA, 19 nt, Human adenovirus B (HAdV-B)
gcaugaccaucauaccaaa

SEQ ID NO: 1541592 - RNA, 17 nt, Human adenovirus B (HAdV-B)
uaccuguguagaugccu

SEQ ID NO: 1541593 - RNA, 11 nt, Human adenovirus B (HAdV-B)
ucgcagcagca

SEQ ID NO: 1541594 - RNA, 16 nt, Human adenovirus B (HAdV-B)
acaguaaaggaagagc

SEQ ID NO: 1541595 - RNA, 14 nt, Human adenovirus B (HAdV-B)
caguauaggcauuu

SEQ ID NO: 1541596 - RNA, 16 nt, Human adenovirus B (HAdV-B)
gcaguuuaccaugagu

SEQ ID NO: 1541597 - RNA, 22 nt, Human adenovirus B (HAdV-B)
cgaguuuaaugggcgaagagga

SEQ ID NO: 1541598 - RNA, 19 nt, Human adenovirus B (HAdV-B)
uguaugucggccaaguagc

SEQ ID NO: 1541599 - RNA, 19 nt, Human adenovirus B (HAdV-B)
aaaguggguagacagaaug

SEQ ID NO: 1541600 - RNA, 20 nt, Human adenovirus B (HAdV-B)
cgguaugcccuagaccaccg

SEQ ID NO: 1541601 - RNA, 16 nt, Human adenovirus B (HAdV-B)
ugaaggugcagccgcc

SEQ ID NO: 1541602 - RNA, 13 nt, Human adenovirus B (HAdV-B)
aaucaauucacaa

SEQ ID NO: 1541603 - RNA, 23 nt, Human adenovirus B (HAdV-B)
caugaacaugcaaaucuggaaga

SEQ ID NO: 1541604 - RNA, 13 nt, Human adenovirus B (HAdV-B)
acuuauauugcau

SEQ ID NO: 1541605 - RNA, 20 nt, Human adenovirus B (HAdV-B)
gauacucaagacaaggcagu

SEQ ID NO: 1541606 - RNA, 20 nt, Human adenovirus B (HAdV-B)
gacguuaugugccuuuccac

SEQ ID NO: 1541607 - RNA, 20 nt, Human adenovirus B (HAdV-B)
uggaagacugauggcacaac

SEQ ID NO: 1541608 - RNA, 18 nt, Human adenovirus B (HAdV-B)
ugaugacgaaguguacca

SEQ ID NO: 1541609 - RNA, 15 nt, Human adenovirus B (HAdV-B)
uccagcgcugccagg

SEQ ID NO: 1541610 - RNA, 18 nt, Human adenovirus B (HAdV-B)
uugcagcacugaaacacc

SEQ ID NO: 1541611 - RNA, 13 nt, Human adenovirus B (HAdV-B)
aaggauacaaaga

SEQ ID NO: 1541612 - RNA, 23 nt, Human adenovirus B (HAdV-B)
ugaccugggguccccgcuggggg

SEQ ID NO: 1541613 - RNA, 23 nt, Human adenovirus B (HAdV-B)
ugggucgcgguguaccccgguuc

SEQ ID NO: 1541614 - RNA, 20 nt, Human adenovirus B (HAdV-B)
cuguggacaguuaugauccu

SEQ ID NO: 1541615 - RNA, 20 nt, Human adenovirus B (HAdV-B)
ugaaaguguuguuggaacca

SEQ ID NO: 1541616 - RNA, 23 nt, Human adenovirus B (HAdV-B)
aucauagauaauuacuugaaagu

SEQ ID NO: 1541617 - RNA, 15 nt, Human adenovirus B (HAdV-B)
ucgggcgccagcgcc

SEQ ID NO: 1541618 - RNA, 13 nt, Human adenovirus B (HAdV-B)
caguguggaagag

SEQ ID NO: 1541619 - RNA, 21 nt, Human adenovirus B (HAdV-B)
aggacguuuuggagaaaguaa

SEQ ID NO: 1541620 - RNA, 21 nt, Human adenovirus B (HAdV-B)
auacuaaggguugcauucacu

SEQ ID NO: 1541621 - RNA, 18 nt, Human adenovirus B (HAdV-B)
ugacgccgccggucccac

SEQ ID NO: 1541622 - RNA, 14 nt, Human adenovirus B (HAdV-B)
caugacagacagag

SEQ ID NO: 1541623 - RNA, 21 nt, Human adenovirus B (HAdV-B)
gagaugcgagcuucccgcuuu

SEQ ID NO: 1541624 - RNA, 14 nt, Human adenovirus B (HAdV-B)
ccaccaccucuacc

SEQ ID NO: 1541625 - RNA, 18 nt, Human adenovirus B (HAdV-B)
augcaugcaggugggcgu

SEQ ID NO: 1541626 - RNA, 19 nt, Human adenovirus B (HAdV-B)
auuguugaucaccugggca

SEQ ID NO: 1541627 - RNA, 15 nt, Human adenovirus B (HAdV-B)
aggccuuaucaaaug

SEQ ID NO: 1541628 - RNA, 17 nt, Human adenovirus B (HAdV-B)
auaaaaauccaucggga

SEQ ID NO: 1541629 - RNA, 19 nt, Human adenovirus B (HAdV-B)
gaaucauaauauugccaug

SEQ ID NO: 1541630 - RNA, 19 nt, Human adenovirus B (HAdV-B)
gugggucuagcauaaguuc

SEQ ID NO: 1541631 - RNA, 21 nt, Human adenovirus B (HAdV-B)
aaguuucagaugaagaaagua

SEQ ID NO: 1541632 - RNA, 23 nt, Human adenovirus B (HAdV-B)
aacuucuugaccacgguggugca

SEQ ID NO: 1541633 - RNA, 13 nt, Human adenovirus B (HAdV-B)
ucagguggacgag

SEQ ID NO: 1541634 - RNA, 14 nt, Human adenovirus B (HAdV-B)
augacuggcagaac

SEQ ID NO: 1541635 - RNA, 20 nt, Human adenovirus B (HAdV-B)
ccuggacccuccaguggagg

SEQ ID NO: 1541636 - RNA, 23 nt, Human adenovirus B (HAdV-B)
agagccauuguccaagaccuggg

SEQ ID NO: 1541637 - RNA, 16 nt, Human adenovirus B (HAdV-B)
uccaaccucuccacaa

SEQ ID NO: 1541638 - RNA, 17 nt, Human adenovirus B (HAdV-B)
gcgccaaggucaacccu

SEQ ID NO: 1541639 - RNA, 17 nt, Human adenovirus B (HAdV-B)
accgucagccaugggca

SEQ ID NO: 1541640 - RNA, 17 nt, Human adenovirus B (HAdV-B)
uuguugguagauugccc

SEQ ID NO: 1541641 - RNA, 16 nt, Human adenovirus B (HAdV-B)
cagggaacugaugcac

SEQ ID NO: 1541642 - RNA, 12 nt, Human adenovirus B (HAdV-B)
cuguggaguucu

SEQ ID NO: 1541643 - RNA, 21 nt, Human adenovirus B (HAdV-B)
aacaagauuggaauaagcaua

SEQ ID NO: 1541644 - RNA, 21 nt, Human adenovirus B (HAdV-B)
ucaaauuuuagcuccucuccu

SEQ ID NO: 1541645 - RNA, 14 nt, Human adenovirus B (HAdV-B)
gauugcccaggacu

SEQ ID NO: 1541646 - RNA, 20 nt, Human adenovirus B (HAdV-B)
gccuggacccuccaguggag

SEQ ID NO: 1541647 - RNA, 23 nt, Human adenovirus B (HAdV-B)
uuacuuugcgaaacggauugccu

SEQ ID NO: 1541648 - RNA, 18 nt, Human adenovirus B (HAdV-B)
ccuggcagaacacacucu

SEQ ID NO: 1541649 - RNA, 16 nt, Human adenovirus B (HAdV-B)
aucuagaccacugccg

SEQ ID NO: 1541650 - RNA, 12 nt, Human adenovirus B (HAdV-B)
acccggcggcgu

SEQ ID NO: 1541651 - RNA, 13 nt, Human adenovirus B (HAdV-B)
uccguagccugga

SEQ ID NO: 1541652 - RNA, 21 nt, Human adenovirus B (HAdV-B)
ucagugacuccuucaacccug

SEQ ID NO: 1541653 - RNA, 21 nt, Human adenovirus B (HAdV-B)
gaaugacccgcaggcagugau

SEQ ID NO: 1541654 - RNA, 19 nt, Human adenovirus B (HAdV-B)
gaucuaccgccagugcugu

SEQ ID NO: 1541655 - RNA, 19 nt, Human adenovirus B (HAdV-B)
cucgauaaucugcuccuuc

SEQ ID NO: 1541656 - RNA, 22 nt, Human adenovirus B (HAdV-B)
gcggcaggcgccucccaggacu

SEQ ID NO: 1541657 - RNA, 17 nt, Human adenovirus B (HAdV-B)
uucuaacuccucaauca

SEQ ID NO: 1541658 - RNA, 15 nt, Human adenovirus B (HAdV-B)
aagcaacgaagcuug

SEQ ID NO: 1541659 - RNA, 20 nt, Human adenovirus B (HAdV-B)
gagaaaaaacagccaacaua

SEQ ID NO: 1541660 - RNA, 14 nt, Human adenovirus B (HAdV-B)
auugucaaguuugg

SEQ ID NO: 1541661 - RNA, 16 nt, Human adenovirus B (HAdV-B)
uguuacauaucuggaa

SEQ ID NO: 1541662 - RNA, 20 nt, Human adenovirus B (HAdV-B)
cuauugauuugaugaacaau

SEQ ID NO: 1541663 - RNA, 20 nt, Human adenovirus B (HAdV-B)
auauagcuuccuuggaagag

SEQ ID NO: 1541664 - RNA, 17 nt, Human adenovirus B (HAdV-B)
guuuggacggcuccugg

SEQ ID NO: 1541665 - RNA, 15 nt, Human adenovirus B (HAdV-B)
ucaggguuacuuugc

SEQ ID NO: 1541666 - RNA, 16 nt, Human adenovirus B (HAdV-B)
caccgacucucccagg

SEQ ID NO: 1541667 - RNA, 18 nt, Human adenovirus B (HAdV-B)
ugcaaggccccagcagcc

SEQ ID NO: 1541668 - RNA, 15 nt, Human adenovirus B (HAdV-B)
gcugcugcuguggcu

SEQ ID NO: 1541669 - RNA, 16 nt, Human adenovirus B (HAdV-B)
gguuguaucuggugga

SEQ ID NO: 1541670 - RNA, 15 nt, Human adenovirus B (HAdV-B)
gucucugaccaugac

SEQ ID NO: 1541671 - RNA, 14 nt, Human adenovirus B (HAdV-B)
uaagaaugccauca

SEQ ID NO: 1541672 - RNA, 16 nt, Human adenovirus B (HAdV-B)
cucacuugccacccuc

SEQ ID NO: 1541673 - RNA, 18 nt, Human adenovirus B (HAdV-B)
uccggaucgcuguccagg

SEQ ID NO: 1541674 - RNA, 21 nt, Human adenovirus B (HAdV-B)
aaauguuuaaccccacuaaca

SEQ ID NO: 1541675 - RNA, 13 nt, Human adenovirus B (HAdV-B)
uucuggaggagga

SEQ ID NO: 1541676 - RNA, 19 nt, Human adenovirus B (HAdV-B)
ugccucccccuucccauuu

SEQ ID NO: 1541677 - RNA, 15 nt, Human adenovirus B (HAdV-B)
acaccgcuuccaccc

SEQ ID NO: 1541678 - RNA, 16 nt, Human adenovirus B (HAdV-B)
agaacagaacuugaaa

SEQ ID NO: 1541679 - RNA, 12 nt, Human adenovirus B (HAdV-B)
acaugccacaga

SEQ ID NO: 1541680 - RNA, 12 nt, Human adenovirus B (HAdV-B)
ucgcuggccaca

SEQ ID NO: 1541681 - RNA, 19 nt, Human adenovirus B (HAdV-B)
aaggacaaaaaagaagagg

SEQ ID NO: 1541682 - RNA, 11 nt, Human adenovirus B (HAdV-B)
uggaagagcuc

SEQ ID NO: 1541683 - RNA, 17 nt, Human adenovirus B (HAdV-B)
ggcuuugugcggcaggc

SEQ ID NO: 1541684 - RNA, 16 nt, Human adenovirus B (HAdV-B)
uucgugcaggugagga

SEQ ID NO: 1541685 - RNA, 16 nt, Human adenovirus B (HAdV-B)
cagccaacgagccagc

SEQ ID NO: 1541686 - RNA, 20 nt, Human adenovirus B (HAdV-B)
ggcaggugguugaugagguc

SEQ ID NO: 1541687 - RNA, 15 nt, Human adenovirus B (HAdV-B)
aguacuggcuaccua

SEQ ID NO: 1541688 - RNA, 22 nt, Human adenovirus B (HAdV-B)
aacaggaauuuuugacaugaac

SEQ ID NO: 1541689 - RNA, 21 nt, Human adenovirus B (HAdV-B)
caucaucuccugcuugcauga

SEQ ID NO: 1541690 - RNA, 23 nt, Human adenovirus B (HAdV-B)
ccgcguucgggggugugcucccu

SEQ ID NO: 1541691 - RNA, 14 nt, Human adenovirus B (HAdV-B)
uuccuucaccccuc

SEQ ID NO: 1541692 - RNA, 14 nt, Human adenovirus B (HAdV-B)
ccgcacuggcugcc

SEQ ID NO: 1541693 - RNA, 15 nt, Human adenovirus B (HAdV-B)
uagcuuugaggccug

SEQ ID NO: 1541694 - RNA, 15 nt, Human adenovirus B (HAdV-B)
caucgccggacagga

SEQ ID NO: 1541695 - RNA, 22 nt, Human adenovirus B (HAdV-B)
agcgcauacaacuugggcgcaa

SEQ ID NO: 1541696 - RNA, 13 nt, Human adenovirus B (HAdV-B)
cucgcccccacug

SEQ ID NO: 1541697 - RNA, 22 nt, Human adenovirus B (HAdV-B)
ugagaggccuuaucaaaugcuc

SEQ ID NO: 1541698 - RNA, 22 nt, Human adenovirus B (HAdV-B)
uaauaugcuggcuacugugcau

SEQ ID NO: 1541699 - RNA, 22 nt, Human adenovirus B (HAdV-B)
acuuuuaagaagguuuccauca

SEQ ID NO: 1541700 - RNA, 17 nt, Human adenovirus B (HAdV-B)
ugcaaggccccagcagc

SEQ ID NO: 1541701 - RNA, 16 nt, Human adenovirus B (HAdV-B)
cagacuugggacagaa

SEQ ID NO: 1541702 - RNA, 20 nt, Human adenovirus B (HAdV-B)
ucuggggucuuguugccauc

SEQ ID NO: 1541703 - RNA, 21 nt, Human adenovirus B (HAdV-B)
gcaggaacugaaaauaaaaaa

SEQ ID NO: 1541704 - RNA, 17 nt, Human adenovirus B (HAdV-B)
caauccccacuggaggc

SEQ ID NO: 1541705 - RNA, 19 nt, Human adenovirus B (HAdV-B)
acaaugaggcuuucagaga

SEQ ID NO: 1541706 - RNA, 12 nt, Human adenovirus B (HAdV-B)
aggugucucuga

SEQ ID NO: 1541707 - RNA, 16 nt, Human adenovirus B (HAdV-B)
caguccugccaccacc

SEQ ID NO: 1541708 - RNA, 23 nt, Human adenovirus B (HAdV-B)
ucccgacgaaaguacgguccagc

SEQ ID NO: 1541709 - RNA, 22 nt, Human adenovirus B (HAdV-B)
ugaaagcaccucccaacacccc

SEQ ID NO: 1541710 - RNA, 17 nt, Human adenovirus B (HAdV-B)
ggucauuucuugcuugc

SEQ ID NO: 1541711 - RNA, 23 nt, Human adenovirus B (HAdV-B)
caggagaaauauucacuggaaca

SEQ ID NO: 1541712 - RNA, 15 nt, Human adenovirus B (HAdV-B)
agaaaagacaaacau

SEQ ID NO: 1541713 - RNA, 17 nt, Human adenovirus B (HAdV-B)
guauucugcaugagaau

SEQ ID NO: 1541714 - RNA, 21 nt, Human adenovirus B (HAdV-B)
aaacucgcgccguagaagagg

SEQ ID NO: 1541715 - RNA, 12 nt, Human adenovirus B (HAdV-B)
uuacacucucau

SEQ ID NO: 1541716 - RNA, 21 nt, Human adenovirus B (HAdV-B)
cuuguagugaggaaaaguuuu

SEQ ID NO: 1541717 - RNA, 19 nt, Human adenovirus B (HAdV-B)
ggugcaacacagcagagac

SEQ ID NO: 1541718 - RNA, 15 nt, Human adenovirus B (HAdV-B)
gucccuacguguaca

SEQ ID NO: 1541719 - RNA, 16 nt, Human adenovirus B (HAdV-B)
cugcugcuguggcuuu

SEQ ID NO: 1541720 - RNA, 17 nt, Human adenovirus B (HAdV-B)
auuuccauuccuucucg

SEQ ID NO: 1541721 - RNA, 18 nt, Human adenovirus B (HAdV-B)
ccauaguuaucacccagc

SEQ ID NO: 1541722 - RNA, 15 nt, Human adenovirus B (HAdV-B)
cagagacgagccugg

SEQ ID NO: 1541723 - RNA, 18 nt, Human adenovirus B (HAdV-B)
uuggauggaaaagcgugg

SEQ ID NO: 1541724 - RNA, 23 nt, Human adenovirus B (HAdV-B)
ugagcaucacagcguucuggugg

SEQ ID NO: 1541725 - RNA, 13 nt, Human adenovirus B (HAdV-B)
cugaguuggcuuu

SEQ ID NO: 1541726 - RNA, 22 nt, Human adenovirus B (HAdV-B)
ggaauuuuugacaugaacaugc

SEQ ID NO: 1541727 - RNA, 15 nt, Human adenovirus B (HAdV-B)
caaggccccagcagc

SEQ ID NO: 1541728 - RNA, 20 nt, Human adenovirus B (HAdV-B)
gcuguguacucccagcagcu

SEQ ID NO: 1541729 - RNA, 14 nt, Human adenovirus B (HAdV-B)
uacuaagaugaaac

SEQ ID NO: 1541730 - RNA, 14 nt, Human adenovirus B (HAdV-B)
gacagaauggagug

SEQ ID NO: 1541731 - RNA, 17 nt, Human adenovirus B (HAdV-B)
aucauguccaccugggg

SEQ ID NO: 1541732 - RNA, 21 nt, Human adenovirus B (HAdV-B)
auuaauauccggaaugcuugu

SEQ ID NO: 1541733 - RNA, 16 nt, Human adenovirus B (HAdV-B)
aauuaucgcugcugca

SEQ ID NO: 1541734 - RNA, 20 nt, Human adenovirus B (HAdV-B)
uaagauucccacugaaagua

SEQ ID NO: 1541735 - RNA, 21 nt, Human adenovirus B (HAdV-B)
cccgacgaaaguacgguccag

SEQ ID NO: 1541736 - RNA, 13 nt, Human adenovirus B (HAdV-B)
aucuugaaaucac

SEQ ID NO: 1541737 - RNA, 14 nt, Human adenovirus B (HAdV-B)
acagugcaggcagc

SEQ ID NO: 1541738 - RNA, 17 nt, Human adenovirus B (HAdV-B)
aacaccguuucuggggc

SEQ ID NO: 1541739 - RNA, 20 nt, Human adenovirus B (HAdV-B)
ccacguaagaagcuucuugc

SEQ ID NO: 1541740 - RNA, 19 nt, Human adenovirus B (HAdV-B)
agcaucauauugcuugaaa

SEQ ID NO: 1541741 - RNA, 18 nt, Human adenovirus B (HAdV-B)
uggaaaagcguggaaaaa

SEQ ID NO: 1541742 - RNA, 19 nt, Human adenovirus B (HAdV-B)
ucugacgagaaucagaaug

SEQ ID NO: 1541743 - RNA, 15 nt, Human adenovirus B (HAdV-B)
acacugguggccacc

SEQ ID NO: 1541744 - RNA, 15 nt, Human adenovirus B (HAdV-B)
agguggcugccauca

SEQ ID NO: 1541745 - RNA, 15 nt, Human adenovirus B (HAdV-B)
caaucgcgaagaggc

SEQ ID NO: 1541746 - RNA, 18 nt, Human adenovirus B (HAdV-B)
cagaaguacuggcuaccu

SEQ ID NO: 1541747 - RNA, 18 nt, Human adenovirus B (HAdV-B)
gagguucagaaagaggga

SEQ ID NO: 1541748 - RNA, 19 nt, Human adenovirus B (HAdV-B)
aaccaguggucagugauga

SEQ ID NO: 1541749 - RNA, 17 nt, Human adenovirus B (HAdV-B)
gaagaugaacuucccaa

SEQ ID NO: 1541750 - RNA, 21 nt, Human adenovirus B (HAdV-B)
cccgcacuggcugcccccacc

SEQ ID NO: 1541751 - RNA, 18 nt, Human adenovirus B (HAdV-B)
guugaaggugcagccgcc

SEQ ID NO: 1541752 - RNA, 12 nt, Human adenovirus B (HAdV-B)
auaaaacauccc

SEQ ID NO: 1541753 - RNA, 23 nt, Human adenovirus B (HAdV-B)
ccgauguugugucccagcggcga

SEQ ID NO: 1541754 - RNA, 15 nt, Human adenovirus B (HAdV-B)
cuugugacuagugaa

SEQ ID NO: 1541755 - RNA, 16 nt, Human adenovirus B (HAdV-B)
ugcgucaucacccagg

SEQ ID NO: 1541756 - RNA, 20 nt, Human adenovirus B (HAdV-B)
ucucgacagauaaagacagc

SEQ ID NO: 1541757 - RNA, 14 nt, Human adenovirus B (HAdV-B)
acagcaacuucuug

SEQ ID NO: 1541758 - RNA, 21 nt, Human adenovirus B (HAdV-B)
gugcagccgccgcccccagaa

SEQ ID NO: 1541759 - RNA, 22 nt, Human adenovirus B (HAdV-B)
cuucuuagacucaucuaaaacc

SEQ ID NO: 1541760 - RNA, 22 nt, Human adenovirus B (HAdV-B)
uaugaagaugaaagcaccuccc

SEQ ID NO: 1541761 - RNA, 12 nt, Human adenovirus B (HAdV-B)
ggagugcaugcc

SEQ ID NO: 1541762 - RNA, 21 nt, Human adenovirus B (HAdV-B)
uuguagugcuaggaauucuug

SEQ ID NO: 1541763 - RNA, 17 nt, Human adenovirus B (HAdV-B)
gccagacucgcaguacu

SEQ ID NO: 1541764 - RNA, 22 nt, Human adenovirus B (HAdV-B)
ucuucgcugucuugacugaugu

SEQ ID NO: 1541765 - RNA, 18 nt, Human adenovirus B (HAdV-B)
auuucugugggacgacgu

SEQ ID NO: 1541766 - RNA, 17 nt, Human adenovirus B (HAdV-B)
uuggcaauauugccgcc

SEQ ID NO: 1541767 - RNA, 19 nt, Human adenovirus B (HAdV-B)
uccaugcacucauccauga

SEQ ID NO: 1541768 - RNA, 22 nt, Human adenovirus B (HAdV-B)
cgcguucgggggugugcucccu

SEQ ID NO: 1541769 - RNA, 19 nt, Human adenovirus B (HAdV-B)
gcgcgauaccaggcauagc

SEQ ID NO: 1541770 - RNA, 18 nt, Human adenovirus B (HAdV-B)
uccgcgauaccuggcacc

SEQ ID NO: 1541771 - RNA, 14 nt, Human adenovirus B (HAdV-B)
gcugcgcacugccc

SEQ ID NO: 1541772 - RNA, 22 nt, Human adenovirus B (HAdV-B)
ggaagguucgcaagaugaggac

SEQ ID NO: 1541773 - RNA, 14 nt, Human adenovirus B (HAdV-B)
cguagccuggagga

SEQ ID NO: 1541774 - RNA, 14 nt, Human adenovirus B (HAdV-B)
cuucuccugggcaa

SEQ ID NO: 1541775 - RNA, 22 nt, Human adenovirus B (HAdV-B)
uuccacccuugaagccaugcug

SEQ ID NO: 1541776 - RNA, 19 nt, Human adenovirus B (HAdV-B)
cgaacccgaggggagaugg

SEQ ID NO: 1541777 - RNA, 17 nt, Human adenovirus B (HAdV-B)
aucaccaacuugggaac

SEQ ID NO: 1541778 - RNA, 16 nt, Human adenovirus B (HAdV-B)
caguagaugggacgag

SEQ ID NO: 1541779 - RNA, 16 nt, Human adenovirus B (HAdV-B)
gccugugaugagggua

SEQ ID NO: 1541780 - RNA, 17 nt, Human adenovirus B (HAdV-B)
cgaggaggcagaggagg

SEQ ID NO: 1541781 - RNA, 14 nt, Human adenovirus B (HAdV-B)
cauccuuggcuccg

SEQ ID NO: 1541782 - RNA, 14 nt, Human adenovirus B (HAdV-B)
cagaaguuggagga

SEQ ID NO: 1541783 - RNA, 12 nt, Human adenovirus B (HAdV-B)
caauaaacauca

SEQ ID NO: 1541784 - RNA, 15 nt, Human adenovirus B (HAdV-B)
cuggcuacugugcau

SEQ ID NO: 1541785 - RNA, 14 nt, Human adenovirus B (HAdV-B)
cugaagugcccauc

SEQ ID NO: 1541786 - RNA, 20 nt, Human adenovirus B (HAdV-B)
ucccggcgcccuggugcggc

SEQ ID NO: 1541787 - RNA, 12 nt, Human adenovirus B (HAdV-B)
ucacaccucacu

SEQ ID NO: 1541788 - RNA, 12 nt, Human adenovirus B (HAdV-B)
uuucuguucugu

SEQ ID NO: 1541789 - RNA, 11 nt, Human adenovirus B (HAdV-B)
ggggagugcau

SEQ ID NO: 1541790 - RNA, 17 nt, Human adenovirus B (HAdV-B)
acacccugcugaagacc

SEQ ID NO: 1541791 - RNA, 22 nt, Human adenovirus B (HAdV-B)
uacaacaauuuccacuucaaca

SEQ ID NO: 1541792 - RNA, 14 nt, Human adenovirus B (HAdV-B)
ccaaccucuccaca

SEQ ID NO: 1541793 - RNA, 19 nt, Human adenovirus B (HAdV-B)
uacuggucgcuuccagaca

SEQ ID NO: 1541794 - RNA, 16 nt, Human adenovirus B (HAdV-B)
ggggccgugggcagcg

SEQ ID NO: 1541795 - RNA, 16 nt, Human adenovirus B (HAdV-B)
uucuacagauacugga

SEQ ID NO: 1541796 - RNA, 12 nt, Human adenovirus B (HAdV-B)
uuuucucccagc

SEQ ID NO: 1541797 - RNA, 23 nt, Human adenovirus B (HAdV-B)
ugacggauuucugugggacgacg

SEQ ID NO: 1541798 - RNA, 13 nt, Human adenovirus B (HAdV-B)
cagaagacaugca

SEQ ID NO: 1541799 - RNA, 22 nt, Human adenovirus B (HAdV-B)
uacgcugucucaaccccagcug

SEQ ID NO: 1541800 - RNA, 19 nt, Human adenovirus B (HAdV-B)
cagcgggcacacaaagcac

SEQ ID NO: 1541801 - RNA, 17 nt, Human adenovirus B (HAdV-B)
uuccaacccuguaugcc

SEQ ID NO: 1541802 - RNA, 18 nt, Human adenovirus B (HAdV-B)
acagaacuuucuuaccaa

SEQ ID NO: 1541803 - RNA, 13 nt, Human adenovirus B (HAdV-B)
uugcuucccuacg

SEQ ID NO: 1541804 - RNA, 19 nt, Human adenovirus B (HAdV-B)
accguugauguuguguccu

SEQ ID NO: 1541805 - RNA, 12 nt, Human adenovirus B (HAdV-B)
ggcggaggagga

SEQ ID NO: 1541806 - RNA, 18 nt, Human adenovirus B (HAdV-B)
agcuagacgcguggggcg

SEQ ID NO: 1541807 - RNA, 19 nt, Human adenovirus B (HAdV-B)
aguccugccaccaccucua

SEQ ID NO: 1541808 - RNA, 15 nt, Human adenovirus B (HAdV-B)
agcgaucuucucaau

SEQ ID NO: 1541809 - RNA, 19 nt, Human adenovirus B (HAdV-B)
ccuguaugccaucuuccag

SEQ ID NO: 1541810 - RNA, 21 nt, Human adenovirus B (HAdV-B)
ucacaucucguccucagcgac

SEQ ID NO: 1541811 - RNA, 23 nt, Human adenovirus B (HAdV-B)
cggugcuuccgaugagaggccuu

SEQ ID NO: 1541812 - RNA, 13 nt, Human adenovirus B (HAdV-B)
gugcagcagagcg

SEQ ID NO: 1541813 - RNA, 22 nt, Human adenovirus B (HAdV-B)
gcacuucagcuugcccucauaa

SEQ ID NO: 1541814 - RNA, 14 nt, Human adenovirus B (HAdV-B)
ccaaacggaguucu

SEQ ID NO: 1541815 - RNA, 15 nt, Human adenovirus B (HAdV-B)
gccaaguagcaguuu

SEQ ID NO: 1541816 - RNA, 17 nt, Human adenovirus B (HAdV-B)
gcugcuacagcugcugc

SEQ ID NO: 1541817 - RNA, 11 nt, Human adenovirus B (HAdV-B)
cgaagugggua

SEQ ID NO: 1541818 - RNA, 14 nt, Human adenovirus B (HAdV-B)
gagugcgggggcaa

SEQ ID NO: 1541819 - RNA, 16 nt, Human adenovirus B (HAdV-B)
auuugaugaacaaugc

SEQ ID NO: 1541820 - RNA, 22 nt, Human adenovirus B (HAdV-B)
cugcaacgaauuuucucccagc

SEQ ID NO: 1541821 - RNA, 19 nt, Human adenovirus B (HAdV-B)
aaaacaagcgucauaucau

SEQ ID NO: 1541822 - RNA, 22 nt, Human adenovirus B (HAdV-B)
augcucaggaucacagagacga

SEQ ID NO: 1541823 - RNA, 21 nt, Human adenovirus B (HAdV-B)
ggcauggguguauggcagcaa

SEQ ID NO: 1541824 - RNA, 13 nt, Human adenovirus B (HAdV-B)
uuccgagggugga

SEQ ID NO: 1541825 - RNA, 15 nt, Human adenovirus B (HAdV-B)
ggguucgcugguggc

SEQ ID NO: 1541826 - RNA, 18 nt, Human adenovirus B (HAdV-B)
cuugaccacgguggugca

SEQ ID NO: 1541827 - RNA, 14 nt, Human adenovirus B (HAdV-B)
uacaccgcuuuucc

SEQ ID NO: 1541828 - RNA, 15 nt, Human adenovirus B (HAdV-B)
gagggucugcaucca

SEQ ID NO: 1541829 - RNA, 15 nt, Human adenovirus B (HAdV-B)
cucacuugccacccu

SEQ ID NO: 1541830 - RNA, 19 nt, Human adenovirus B (HAdV-B)
uaacgcuggagaggucaga

SEQ ID NO: 1541831 - RNA, 16 nt, Human adenovirus B (HAdV-B)
gcgccuucacccgagc

SEQ ID NO: 1541832 - RNA, 16 nt, Human adenovirus B (HAdV-B)
ugccuaugagaacagu

SEQ ID NO: 1541833 - RNA, 15 nt, Human adenovirus B (HAdV-B)
ccacgagugccauca

SEQ ID NO: 1541834 - RNA, 21 nt, Human adenovirus B (HAdV-B)
agcaccucacuucccucuucc

SEQ ID NO: 1541835 - RNA, 17 nt, Human adenovirus B (HAdV-B)
agcggagacggcuugcu

SEQ ID NO: 1541836 - RNA, 15 nt, Human adenovirus B (HAdV-B)
cuuacauagaagagg

SEQ ID NO: 1541837 - RNA, 14 nt, Human adenovirus B (HAdV-B)
cagauacuggaugu

SEQ ID NO: 1541838 - RNA, 15 nt, Human adenovirus B (HAdV-B)
gcuggauauggccag

SEQ ID NO: 1541839 - RNA, 21 nt, Human adenovirus B (HAdV-B)
gagacucgggccgcaaaugcu

SEQ ID NO: 1541840 - RNA, 16 nt, Human adenovirus B (HAdV-B)
aggacagucuggagga

SEQ ID NO: 1541841 - RNA, 12 nt, Human adenovirus B (HAdV-B)
gcauauucuguu

SEQ ID NO: 1541842 - RNA, 14 nt, Human adenovirus B (HAdV-B)
ucaacgacuacacc

SEQ ID NO: 1541843 - RNA, 22 nt, Human adenovirus B (HAdV-B)
uucuaugcguguuggauugcca

SEQ ID NO: 1541844 - RNA, 22 nt, Human adenovirus B (HAdV-B)
agggaucaguccugccagggca

SEQ ID NO: 1541845 - RNA, 21 nt, Human adenovirus B (HAdV-B)
uggcucgcuacaacaguagca

SEQ ID NO: 1541846 - RNA, 19 nt, Human adenovirus B (HAdV-B)
agggcuugacggggaagac

SEQ ID NO: 1541847 - RNA, 14 nt, Human adenovirus B (HAdV-B)
auugaauaaaagaa

SEQ ID NO: 1541848 - RNA, 22 nt, Human adenovirus B (HAdV-B)
gcuggacuacuugcacagagcu

SEQ ID NO: 1541849 - RNA, 18 nt, Human adenovirus B (HAdV-B)
accugcugcgcacugccc

SEQ ID NO: 1541850 - RNA, 19 nt, Human adenovirus B (HAdV-B)
gcaaggguccgccacugcg

SEQ ID NO: 1541851 - RNA, 23 nt, Human adenovirus B (HAdV-B)
gcagcaauguuuagaagaacaga

SEQ ID NO: 1541852 - RNA, 20 nt, Human adenovirus B (HAdV-B)
gcccaucaguguggaagagc

SEQ ID NO: 1541853 - RNA, 21 nt, Human adenovirus B (HAdV-B)
augagaacaguaagaaagaac

SEQ ID NO: 1541854 - RNA, 17 nt, Human adenovirus B (HAdV-B)
agguucccucaggaugu

SEQ ID NO: 1541855 - RNA, 22 nt, Human adenovirus B (HAdV-B)
aaaacacacuacccacauacau

SEQ ID NO: 1541856 - RNA, 23 nt, Human adenovirus B (HAdV-B)
cuucguacgagagcgugaugcag

SEQ ID NO: 1541857 - RNA, 16 nt, Human adenovirus B (HAdV-B)
cagaacccuacuagca

SEQ ID NO: 1541858 - RNA, 14 nt, Human adenovirus B (HAdV-B)
caggcgccucccag

SEQ ID NO: 1541859 - RNA, 13 nt, Human adenovirus B (HAdV-B)
ggugaccagcaug

SEQ ID NO: 1541860 - RNA, 23 nt, Human adenovirus B (HAdV-B)
cgggacccugccguugcgcagca

SEQ ID NO: 1541861 - RNA, 21 nt, Human adenovirus B (HAdV-B)
caaaugacaaaggcuucuauu

SEQ ID NO: 1541862 - RNA, 19 nt, Human adenovirus B (HAdV-B)
cugugcgaggaugagagcc

SEQ ID NO: 1541863 - RNA, 21 nt, Human adenovirus B (HAdV-B)
ccgguauaucgggcaggaugu

SEQ ID NO: 1541864 - RNA, 15 nt, Human adenovirus B (HAdV-B)
ugggacaggaagaca

SEQ ID NO: 1541865 - RNA, 22 nt, Human adenovirus B (HAdV-B)
cauguugguuggagccugagga

SEQ ID NO: 1541866 - RNA, 12 nt, Human adenovirus B (HAdV-B)
aaggcuacaacg

SEQ ID NO: 1541867 - RNA, 22 nt, Human adenovirus B (HAdV-B)
cagaacuugaaagagcuugaca

SEQ ID NO: 1541868 - RNA, 20 nt, Human adenovirus B (HAdV-B)
gcacacguggcugcagccaa

SEQ ID NO: 1541869 - RNA, 14 nt, Human adenovirus B (HAdV-B)
cuagucacugcauu

SEQ ID NO: 1541870 - RNA, 17 nt, Human adenovirus B (HAdV-B)
cagcuaacccgauggcu

SEQ ID NO: 1541871 - RNA, 16 nt, Human adenovirus B (HAdV-B)
uagcgaucuucucaau

SEQ ID NO: 1541872 - RNA, 21 nt, Human adenovirus B (HAdV-B)
gcacauccaagaacaaaagaa

SEQ ID NO: 1541873 - RNA, 12 nt, Human adenovirus B (HAdV-B)
ccuuucucccaa

SEQ ID NO: 1541874 - RNA, 14 nt, Human adenovirus B (HAdV-B)
ccaucuuccagcag

SEQ ID NO: 1541875 - RNA, 16 nt, Human adenovirus B (HAdV-B)
gcaccgacucucccag

SEQ ID NO: 1541876 - RNA, 15 nt, Human adenovirus B (HAdV-B)
gagcucagccgcgcc

SEQ ID NO: 1541877 - RNA, 17 nt, Human adenovirus B (HAdV-B)
gcaaggccccagcagcc

SEQ ID NO: 1541878 - RNA, 17 nt, Human adenovirus B (HAdV-B)
ccgauccaugcuucugg

SEQ ID NO: 1541879 - RNA, 23 nt, Human adenovirus B (HAdV-B)
gacacggcuuugugcggcaggca

SEQ ID NO: 1541880 - RNA, 18 nt, Human adenovirus B (HAdV-B)
guacuggugacagaugcg

SEQ ID NO: 1541881 - RNA, 14 nt, Human adenovirus B (HAdV-B)
acaguuucacuucc

SEQ ID NO: 1541882 - RNA, 19 nt, Human adenovirus B (HAdV-B)
guugaucaccugggcagcu

SEQ ID NO: 1541883 - RNA, 11 nt, Human adenovirus B (HAdV-B)
gcucagccgcg

SEQ ID NO: 1541884 - RNA, 12 nt, Human adenovirus B (HAdV-B)
uuuccauuccuu

SEQ ID NO: 1541885 - RNA, 16 nt, Human adenovirus B (HAdV-B)
ccuggcaccuacggag

SEQ ID NO: 1541886 - RNA, 18 nt, Human adenovirus B (HAdV-B)
acaagcucuaaagugacu

SEQ ID NO: 1541887 - RNA, 19 nt, Human adenovirus B (HAdV-B)
cuggaggaagacaguuugg

SEQ ID NO: 1541888 - RNA, 15 nt, Human adenovirus B (HAdV-B)
gauguagaugccuau

SEQ ID NO: 1541889 - RNA, 14 nt, Human adenovirus B (HAdV-B)
auuuugccuccccc

SEQ ID NO: 1541890 - RNA, 13 nt, Human adenovirus B (HAdV-B)
acugguggccacc

SEQ ID NO: 1541891 - RNA, 22 nt, Human adenovirus B (HAdV-B)
gcccucauaaucauugcagcca

SEQ ID NO: 1541892 - RNA, 14 nt, Human adenovirus B (HAdV-B)
acaacuacuuucuc

SEQ ID NO: 1541893 - RNA, 19 nt, Human adenovirus B (HAdV-B)
cguguuggauugccacagc

SEQ ID NO: 1541894 - RNA, 16 nt, Human adenovirus B (HAdV-B)
gcagacaguaaaggaa

SEQ ID NO: 1541895 - RNA, 13 nt, Human adenovirus B (HAdV-B)
aggaggcggagga

SEQ ID NO: 1541896 - RNA, 14 nt, Human adenovirus B (HAdV-B)
gcaaaaauaaaaaa

SEQ ID NO: 1541897 - RNA, 14 nt, Human adenovirus B (HAdV-B)
uauauauacacaag

SEQ ID NO: 1541898 - RNA, 15 nt, Human adenovirus B (HAdV-B)
aauggggcugaggug

SEQ ID NO: 1541899 - RNA, 13 nt, Human adenovirus B (HAdV-B)
uccaucagcagac

SEQ ID NO: 1541900 - RNA, 14 nt, Human adenovirus B (HAdV-B)
aguuaacuggaugc

SEQ ID NO: 1541901 - RNA, 15 nt, Human adenovirus B (HAdV-B)
uucaaguacaaccac

SEQ ID NO: 1541902 - RNA, 20 nt, Human adenovirus B (HAdV-B)
augugcauauuaacaaucug

SEQ ID NO: 1541903 - RNA, 16 nt, Human adenovirus B (HAdV-B)
aacugcuuagccagaa

SEQ ID NO: 1541904 - RNA, 13 nt, Human adenovirus B (HAdV-B)
ggaggaggagagg

SEQ ID NO: 1541905 - RNA, 12 nt, Human adenovirus B (HAdV-B)
gaugacaccaac

SEQ ID NO: 1541906 - RNA, 20 nt, Human adenovirus B (HAdV-B)
ucaccugcggagcagagcag

SEQ ID NO: 1541907 - RNA, 22 nt, Human adenovirus B (HAdV-B)
agauucuugaagcuugguuacc

SEQ ID NO: 1541908 - RNA, 17 nt, Human adenovirus B (HAdV-B)
cuauuuagagacagaag

SEQ ID NO: 1541909 - RNA, 22 nt, Human adenovirus B (HAdV-B)
ucauagaagcucggguuucauu

SEQ ID NO: 1541910 - RNA, 22 nt, Human adenovirus B (HAdV-B)
caagcucuuacagaaaucucuu

SEQ ID NO: 1541911 - RNA, 22 nt, Human adenovirus B (HAdV-B)
gaaggggugugcgccugcuugg

SEQ ID NO: 1541912 - RNA, 13 nt, Human adenovirus B (HAdV-B)
auauguggccugg

SEQ ID NO: 1541913 - RNA, 19 nt, Human adenovirus B (HAdV-B)
cuaaccaggcugugcagaa

SEQ ID NO: 1541914 - RNA, 15 nt, Human adenovirus B (HAdV-B)
uacagcugcugcaga

SEQ ID NO: 1541915 - RNA, 18 nt, Human adenovirus B (HAdV-B)
cuagugaucgcacugcuu

SEQ ID NO: 1541916 - RNA, 20 nt, Human adenovirus B (HAdV-B)
cagaagcggcgaggagccgg

SEQ ID NO: 1541917 - RNA, 20 nt, Human adenovirus B (HAdV-B)
cucccagacucguacaaaua

SEQ ID NO: 1541918 - RNA, 14 nt, Human adenovirus B (HAdV-B)
gauggaacagcaag

SEQ ID NO: 1541919 - RNA, 17 nt, Human adenovirus B (HAdV-B)
gaagcauuuucccuacu

SEQ ID NO: 1541920 - RNA, 21 nt, Human adenovirus B (HAdV-B)
uggccauuguguucuccuagg

SEQ ID NO: 1541921 - RNA, 12 nt, Human adenovirus B (HAdV-B)
aauuuggggcgg

SEQ ID NO: 1541922 - RNA, 18 nt, Human adenovirus B (HAdV-B)
uuggaauaucuauucuug

SEQ ID NO: 1541923 - RNA, 17 nt, Human adenovirus B (HAdV-B)
cuuacauucaauucaaa

SEQ ID NO: 1541924 - RNA, 22 nt, Human adenovirus B (HAdV-B)
gccuccuugcagauauggcccu

SEQ ID NO: 1541925 - RNA, 22 nt, Human adenovirus B (HAdV-B)
gugcuggugggcauuguaauau

SEQ ID NO: 1541926 - RNA, 16 nt, Human adenovirus B (HAdV-B)
cgccaaacccaacaca

SEQ ID NO: 1541927 - RNA, 21 nt, Human adenovirus B (HAdV-B)
caggcgacggcggugaugcaa

SEQ ID NO: 1541928 - RNA, 17 nt, Human adenovirus B (HAdV-B)
cgcgccguagaagaggg

SEQ ID NO: 1541929 - RNA, 22 nt, Human adenovirus B (HAdV-B)
ugacuuuaugagccagagcaug

SEQ ID NO: 1541930 - RNA, 14 nt, Human adenovirus B (HAdV-B)
gacaguuuggagga

SEQ ID NO: 1541931 - RNA, 19 nt, Human adenovirus B (HAdV-B)
caugccuuucucccaagca

SEQ ID NO: 1541932 - RNA, 18 nt, Human adenovirus B (HAdV-B)
auauaaucuguugcacca

SEQ ID NO: 1541933 - RNA, 19 nt, Human adenovirus B (HAdV-B)
ggcacacguggcugcagcc

SEQ ID NO: 1541934 - RNA, 14 nt, Human adenovirus B (HAdV-B)
aacagcaagcaccg

SEQ ID NO: 1541935 - RNA, 21 nt, Human adenovirus B (HAdV-B)
uauagcuuccuuggaagaggu

SEQ ID NO: 1541936 - RNA, 19 nt, Human adenovirus B (HAdV-B)
cugccguugcgcagcagua

SEQ ID NO: 1541937 - RNA, 20 nt, Human adenovirus B (HAdV-B)
aagcuaauuugggacaacaa

SEQ ID NO: 1541938 - RNA, 22 nt, Human adenovirus B (HAdV-B)
cuagucuguuccacaguucagu

SEQ ID NO: 1541939 - RNA, 15 nt, Human adenovirus B (HAdV-B)
acacucaccaccucc

SEQ ID NO: 1541940 - RNA, 21 nt, Human adenovirus B (HAdV-B)
cuucgacccagaaaacugcac

SEQ ID NO: 1541941 - RNA, 15 nt, Human adenovirus B (HAdV-B)
uaccgauccaugcuu

SEQ ID NO: 1541942 - RNA, 18 nt, Human adenovirus B (HAdV-B)
agaaaauggcauggauga

SEQ ID NO: 1541943 - RNA, 19 nt, Human adenovirus B (HAdV-B)
aagacaguuuggaggagga

SEQ ID NO: 1541944 - RNA, 13 nt, Human adenovirus B (HAdV-B)
cgugaugcagcag

SEQ ID NO: 1541945 - RNA, 15 nt, Human adenovirus B (HAdV-B)
cuucaacauccagga

SEQ ID NO: 1541946 - RNA, 20 nt, Human adenovirus B (HAdV-B)
ugaggccacaacgcacagcc

SEQ ID NO: 1541947 - RNA, 16 nt, Human adenovirus B (HAdV-B)
ccagcggcgaggaugu

SEQ ID NO: 1541948 - RNA, 22 nt, Human adenovirus B (HAdV-B)
gcaaagagcucugacuggagcu

SEQ ID NO: 1541949 - RNA, 19 nt, Human adenovirus B (HAdV-B)
gcagaggaggcggaggagg

SEQ ID NO: 1541950 - RNA, 20 nt, Human adenovirus B (HAdV-B)
guagucgguauggaagcagu

SEQ ID NO: 1541951 - RNA, 20 nt, Human adenovirus B (HAdV-B)
guaagaaggaucggcaggga

SEQ ID NO: 1541952 - RNA, 13 nt, Human adenovirus B (HAdV-B)
cugguggccaccu

SEQ ID NO: 1541953 - RNA, 17 nt, Human adenovirus B (HAdV-B)
cccuugaagccaugcug

SEQ ID NO: 1541954 - RNA, 16 nt, Human adenovirus B (HAdV-B)
cauuaacuuugaugaa

SEQ ID NO: 1541955 - RNA, 17 nt, Human adenovirus B (HAdV-B)
augucauaaccugguug

SEQ ID NO: 1541956 - RNA, 17 nt, Human adenovirus B (HAdV-B)
cauugcuucucugaacu

SEQ ID NO: 1541957 - RNA, 19 nt, Human adenovirus B (HAdV-B)
agaaugacccgcaggcagu

SEQ ID NO: 1541958 - RNA, 22 nt, Human adenovirus B (HAdV-B)
uacaauuauggcgaucccgaaa

SEQ ID NO: 1541959 - RNA, 20 nt, Human adenovirus B (HAdV-B)
uaauaugcuaacuacacaca

SEQ ID NO: 1541960 - RNA, 13 nt, Human adenovirus B (HAdV-B)
aucgcgaagccau

SEQ ID NO: 1541961 - RNA, 19 nt, Human adenovirus B (HAdV-B)
ugagacccauuaagcaggu

SEQ ID NO: 1541962 - RNA, 12 nt, Human adenovirus B (HAdV-B)
gagaauuacuuc

SEQ ID NO: 1541963 - RNA, 15 nt, Human adenovirus B (HAdV-B)
ggcggcgaccuccaa

SEQ ID NO: 1541964 - RNA, 16 nt, Human adenovirus B (HAdV-B)
gagcuuaagcauucca

SEQ ID NO: 1541965 - RNA, 13 nt, Human adenovirus B (HAdV-B)
ugcuauuccacca

SEQ ID NO: 1541966 - RNA, 11 nt, Human adenovirus B (HAdV-B)
cggcaccugcg

SEQ ID NO: 1541967 - RNA, 18 nt, Human adenovirus B (HAdV-B)
ccggucacuuugcagcaa

SEQ ID NO: 1541968 - RNA, 15 nt, Human adenovirus B (HAdV-B)
cuacggaagccagca

SEQ ID NO: 1541969 - RNA, 19 nt, Human adenovirus B (HAdV-B)
caacgaauuuucucccagc

SEQ ID NO: 1541970 - RNA, 13 nt, Human adenovirus B (HAdV-B)
augugucugaagg

SEQ ID NO: 1541971 - RNA, 21 nt, Human adenovirus B (HAdV-B)
cuucuccggaucuccugggca

SEQ ID NO: 1541972 - RNA, 15 nt, Human adenovirus B (HAdV-B)
gagugcuugaaagug

SEQ ID NO: 1541973 - RNA, 23 nt, Human adenovirus B (HAdV-B)
accaccauucuuaaacacacccu

SEQ ID NO: 1541974 - RNA, 13 nt, Human adenovirus B (HAdV-B)
ccuaucacaucuu

SEQ ID NO: 1541975 - RNA, 16 nt, Human adenovirus B (HAdV-B)
uuaaaccggucacuuu

SEQ ID NO: 1541976 - RNA, 19 nt, Human adenovirus B (HAdV-B)
cuggacuacuugcacagag

SEQ ID NO: 1541977 - RNA, 12 nt, Human adenovirus B (HAdV-B)
gucacaggccuc

SEQ ID NO: 1541978 - RNA, 23 nt, Human adenovirus B (HAdV-B)
uggcaugagguucagaaagaggg

SEQ ID NO: 1541979 - RNA, 23 nt, Human adenovirus B (HAdV-B)
cacaacccccacuacucccugcu

SEQ ID NO: 1541980 - RNA, 15 nt, Human adenovirus B (HAdV-B)
cauagugcaggagcg

SEQ ID NO: 1541981 - RNA, 12 nt, Human adenovirus B (HAdV-B)
gaugccugggga

SEQ ID NO: 1541982 - RNA, 19 nt, Human adenovirus B (HAdV-B)
uacaccggauugcagcacu

SEQ ID NO: 1541983 - RNA, 15 nt, Human adenovirus B (HAdV-B)
uuaccccuacggaag

SEQ ID NO: 1541984 - RNA, 20 nt, Human adenovirus B (HAdV-B)
ucaccagggaaaaguacagu

SEQ ID NO: 1541985 - RNA, 14 nt, Human adenovirus B (HAdV-B)
caaucacaaaaggc

SEQ ID NO: 1541986 - RNA, 18 nt, Human adenovirus B (HAdV-B)
ccuuaucaaaugcucacu

SEQ ID NO: 1541987 - RNA, 18 nt, Human adenovirus B (HAdV-B)
gcacccaauuaggcuugu

SEQ ID NO: 1541988 - RNA, 12 nt, Human adenovirus B (HAdV-B)
uaugugcagcag

SEQ ID NO: 1541989 - RNA, 20 nt, Human adenovirus B (HAdV-B)
cucgcaacucugacuucugc

SEQ ID NO: 1541990 - RNA, 19 nt, Human adenovirus B (HAdV-B)
uaugcggccuaagagaccu

SEQ ID NO: 1541991 - RNA, 21 nt, Human adenovirus B (HAdV-B)
gggauaggggcguuaagaggg

SEQ ID NO: 1541992 - RNA, 13 nt, Human adenovirus B (HAdV-B)
gcacgccccaccg

SEQ ID NO: 1541993 - RNA, 15 nt, Human adenovirus B (HAdV-B)
uauggccuccuagca

SEQ ID NO: 1541994 - RNA, 20 nt, Human adenovirus B (HAdV-B)
ugaaggcgaggaggaagagg

SEQ ID NO: 1541995 - RNA, 20 nt, Human adenovirus B (HAdV-B)
cgaucucgcaguacuucaaa

SEQ ID NO: 1541996 - RNA, 19 nt, Human adenovirus B (HAdV-B)
caacgugacagcaaaugac

SEQ ID NO: 1541997 - RNA, 16 nt, Human adenovirus B (HAdV-B)
gcaaaacaaugacuuu

SEQ ID NO: 1541998 - RNA, 13 nt, Human adenovirus B (HAdV-B)
cagcagcaggcga

SEQ ID NO: 1541999 - RNA, 14 nt, Human adenovirus B (HAdV-B)
ugaccacagcaacu

SEQ ID NO: 1542000 - RNA, 17 nt, Human adenovirus B (HAdV-B)
cccaggacuacuccacc

SEQ ID NO: 1542001 - RNA, 23 nt, Human adenovirus B (HAdV-B)
cuugccagggugcgcuucagacu

SEQ ID NO: 1542002 - RNA, 21 nt, Human adenovirus B (HAdV-B)
cagaggcauacaugccacaga

SEQ ID NO: 1542003 - RNA, 17 nt, Human adenovirus B (HAdV-B)
auccaagaacaaaagaa

SEQ ID NO: 1542004 - RNA, 12 nt, Human adenovirus B (HAdV-B)
acaacacuuuca

SEQ ID NO: 1542005 - RNA, 17 nt, Human adenovirus B (HAdV-B)
cuguauaggagcauuug

SEQ ID NO: 1542006 - RNA, 19 nt, Human adenovirus B (HAdV-B)
aacugaauuaagacucucc

SEQ ID NO: 1542007 - RNA, 16 nt, Human adenovirus B (HAdV-B)
agauuacagccaacga

SEQ ID NO: 1542008 - RNA, 19 nt, Human adenovirus B (HAdV-B)
ucugcaacggcagagaccu

SEQ ID NO: 1542009 - RNA, 12 nt, Human adenovirus B (HAdV-B)
acggcaggaugu

SEQ ID NO: 1542010 - RNA, 19 nt, Human adenovirus B (HAdV-B)
ucaugucuuucuucccaga

SEQ ID NO: 1542011 - RNA, 21 nt, Human adenovirus B (HAdV-B)
gaggucccaguuucaaacccu

SEQ ID NO: 1542012 - RNA, 18 nt, Human adenovirus B (HAdV-B)
agacuagcagacagggcu

SEQ ID NO: 1542013 - RNA, 22 nt, Human adenovirus B (HAdV-B)
ugacuugucuccugaacugcaa

SEQ ID NO: 1542014 - RNA, 14 nt, Human adenovirus B (HAdV-B)
uacacugucucugu

SEQ ID NO: 1542015 - RNA, 18 nt, Human adenovirus B (HAdV-B)
cuuuuaaaacgcacugug

SEQ ID NO: 1542016 - RNA, 22 nt, Human adenovirus B (HAdV-B)
gcauccgcgaguucaacugaaa

SEQ ID NO: 1542017 - RNA, 12 nt, Human adenovirus B (HAdV-B)
guaagggcagca

SEQ ID NO: 1542018 - RNA, 20 nt, Human adenovirus B (HAdV-B)
uccugcccgccaccugcugc

SEQ ID NO: 1542019 - RNA, 14 nt, Human adenovirus B (HAdV-B)
cgaggaggaagagg

SEQ ID NO: 1542020 - RNA, 18 nt, Human adenovirus B (HAdV-B)
gcaguagaugggacgaga

SEQ ID NO: 1542021 - RNA, 21 nt, Human adenovirus B (HAdV-B)
ucaccaagaugcuggaaauag

SEQ ID NO: 1542022 - RNA, 15 nt, Human adenovirus B (HAdV-B)
ugauuaauugugaug

SEQ ID NO: 1542023 - RNA, 15 nt, Human adenovirus B (HAdV-B)
uugggugggagagga

SEQ ID NO: 1542024 - RNA, 19 nt, Human adenovirus B (HAdV-B)
gaguucuuacuuuaaaaug

SEQ ID NO: 1542025 - RNA, 13 nt, Human adenovirus B (HAdV-B)
agugucacugccg

SEQ ID NO: 1542026 - RNA, 12 nt, Human adenovirus B (HAdV-B)
gucaccucccca

SEQ ID NO: 1542027 - RNA, 11 nt, Human adenovirus B (HAdV-B)
gccacuugaau

SEQ ID NO: 1542028 - RNA, 14 nt, Human adenovirus B (HAdV-B)
gagccugggaucau

SEQ ID NO: 1542029 - RNA, 19 nt, Human adenovirus B (HAdV-B)
cgaugggucuucuccuggg

SEQ ID NO: 1542030 - RNA, 19 nt, Human adenovirus B (HAdV-B)
uacacacaauaacaaaacc

SEQ ID NO: 1542031 - RNA, 13 nt, Human adenovirus B (HAdV-B)
acuuuaaaauguu

SEQ ID NO: 1542032 - RNA, 18 nt, Human adenovirus B (HAdV-B)
ugcacaguuugcaaagag

SEQ ID NO: 1542033 - RNA, 16 nt, Human adenovirus B (HAdV-B)
ucauucacacagcagc

SEQ ID NO: 1542034 - RNA, 14 nt, Human adenovirus B (HAdV-B)
gcgcgcgcagucau

SEQ ID NO: 1542035 - RNA, 21 nt, Human adenovirus B (HAdV-B)
gacaugcaugacccagaugcc

SEQ ID NO: 1542036 - RNA, 18 nt, Human adenovirus B (HAdV-B)
aauaugcaugcuuuuaua

SEQ ID NO: 1542037 - RNA, 13 nt, Human adenovirus B (HAdV-B)
gcugcacagcacc

SEQ ID NO: 1542038 - RNA, 17 nt, Human adenovirus B (HAdV-B)
ccguagaagagggaugu

SEQ ID NO: 1542039 - RNA, 16 nt, Human adenovirus B (HAdV-B)
ggacaaugucaaccca

SEQ ID NO: 1542040 - RNA, 14 nt, Human adenovirus B (HAdV-B)
ucccggcagucucg

SEQ ID NO: 1542041 - RNA, 21 nt, Human adenovirus B (HAdV-B)
cggugcgggacagcccgccua

SEQ ID NO: 1542042 - RNA, 16 nt, Human adenovirus B (HAdV-B)
aguuggaggauuggcu

SEQ ID NO: 1542043 - RNA, 20 nt, Human adenovirus B (HAdV-B)
ggugacgcgcguagaugaac

SEQ ID NO: 1542044 - RNA, 12 nt, Human adenovirus B (HAdV-B)
acaaucuggcaa

SEQ ID NO: 1542045 - RNA, 15 nt, Human adenovirus B (HAdV-B)
gagcaguaucuggag

SEQ ID NO: 1542046 - RNA, 16 nt, Human adenovirus B (HAdV-B)
cgggguugggcaaagc

SEQ ID NO: 1542047 - RNA, 18 nt, Human adenovirus B (HAdV-B)
gaaugaaaauaaacuuug

SEQ ID NO: 1542048 - RNA, 17 nt, Human adenovirus B (HAdV-B)
ugugcgaauugccuacc

SEQ ID NO: 1542049 - RNA, 22 nt, Human adenovirus B (HAdV-B)
cccuguggugggugcagagcuu

SEQ ID NO: 1542050 - RNA, 14 nt, Human adenovirus B (HAdV-B)
uauccggaaugcuu

SEQ ID NO: 1542051 - RNA, 12 nt, Human adenovirus B (HAdV-B)
gauguccaagcg

SEQ ID NO: 1542052 - RNA, 17 nt, Human adenovirus B (HAdV-B)
gcuagaucugaguuggc

SEQ ID NO: 1542053 - RNA, 15 nt, Human adenovirus B (HAdV-B)
ucacgcuugccagca

SEQ ID NO: 1542054 - RNA, 20 nt, Human adenovirus B (HAdV-B)
cacuugaauucgggaaucac

SEQ ID NO: 1542055 - RNA, 16 nt, Human adenovirus B (HAdV-B)
aaaguuaacuggaugc

SEQ ID NO: 1542056 - RNA, 18 nt, Human adenovirus B (HAdV-B)
caccacacgauccacacu

SEQ ID NO: 1542057 - RNA, 21 nt, Human adenovirus B (HAdV-B)
aucggauucuuaacagugcag

SEQ ID NO: 1542058 - RNA, 14 nt, Human adenovirus B (HAdV-B)
gugugacagugcaa

SEQ ID NO: 1542059 - RNA, 13 nt, Human adenovirus B (HAdV-B)
guagagcgagccg

SEQ ID NO: 1542060 - RNA, 23 nt, Human adenovirus B (HAdV-B)
cauacuuuaaaggggaugucaaa

SEQ ID NO: 1542061 - RNA, 16 nt, Human adenovirus B (HAdV-B)
ggacgauuggacccag

SEQ ID NO: 1542062 - RNA, 17 nt, Human adenovirus B (HAdV-B)
ucuauugcuucccuacg

SEQ ID NO: 1542063 - RNA, 22 nt, Human adenovirus B (HAdV-B)
caguuugcaaagagcucugacu

SEQ ID NO: 1542064 - RNA, 16 nt, Human adenovirus B (HAdV-B)
guacguagcagcgaag

SEQ ID NO: 1542065 - RNA, 20 nt, Human adenovirus B (HAdV-B)
gaucucuacagcuaaaagug

SEQ ID NO: 1542066 - RNA, 14 nt, Human adenovirus B (HAdV-B)
ccgacucucccagg

SEQ ID NO: 1542067 - RNA, 20 nt, Human adenovirus B (HAdV-B)
ucucugcguucgcucaccag

SEQ ID NO: 1542068 - RNA, 17 nt, Human adenovirus B (HAdV-B)
uucggccugcgucauca

SEQ ID NO: 1542069 - RNA, 12 nt, Human adenovirus B (HAdV-B)
auccuucucaac

SEQ ID NO: 1542070 - RNA, 20 nt, Human adenovirus B (HAdV-B)
guaggcacgguuugaccagu

SEQ ID NO: 1542071 - RNA, 18 nt, Human adenovirus B (HAdV-B)
caaucacagccuccaaag

SEQ ID NO: 1542072 - RNA, 21 nt, Human adenovirus B (HAdV-B)
cugcguucgcucaccagaagu

SEQ ID NO: 1542073 - RNA, 23 nt, Human adenovirus B (HAdV-B)
agaaaugcauauuucaaagaugu

SEQ ID NO: 1542074 - RNA, 12 nt, Human adenovirus B (HAdV-B)
cagcgcuaccau

SEQ ID NO: 1542075 - RNA, 15 nt, Human adenovirus B (HAdV-B)
cauuauuggacagaa

SEQ ID NO: 1542076 - RNA, 13 nt, Human adenovirus B (HAdV-B)
ucaauaaacauca

SEQ ID NO: 1542077 - RNA, 15 nt, Human adenovirus B (HAdV-B)
cugcaacuacugcaa

SEQ ID NO: 1542078 - RNA, 14 nt, Human adenovirus B (HAdV-B)
gcaggcaagcagcc

SEQ ID NO: 1542079 - RNA, 22 nt, Human adenovirus B (HAdV-B)
ggcacucccgucucgacccagc

SEQ ID NO: 1542080 - RNA, 22 nt, Human adenovirus B (HAdV-B)
cuggcacgauucucacuugcca

SEQ ID NO: 1542081 - RNA, 17 nt, Human adenovirus B (HAdV-B)
agcuugcccucauaauc

SEQ ID NO: 1542082 - RNA, 15 nt, Human adenovirus B (HAdV-B)
auaagcauauuggga

SEQ ID NO: 1542083 - RNA, 22 nt, Human adenovirus B (HAdV-B)
gcagagcaggucuacuggucgc

SEQ ID NO: 1542084 - RNA, 17 nt, Human adenovirus B (HAdV-B)
caucuacuucgaacucc

SEQ ID NO: 1542085 - RNA, 16 nt, Human adenovirus B (HAdV-B)
ucccauagacaaggag

SEQ ID NO: 1542086 - RNA, 18 nt, Human adenovirus B (HAdV-B)
gacagacaucgagcaaga

SEQ ID NO: 1542087 - RNA, 18 nt, Human adenovirus B (HAdV-B)
uguugaucaccugggcag

SEQ ID NO: 1542088 - RNA, 22 nt, Human adenovirus B (HAdV-B)
uacuuuuggaacagucagcucu

SEQ ID NO: 1542089 - RNA, 22 nt, Human adenovirus B (HAdV-B)
guacgagagcgugaugcagcag

SEQ ID NO: 1542090 - RNA, 23 nt, Human adenovirus B (HAdV-B)
guuggauugccacagcuggcaga

SEQ ID NO: 1542091 - RNA, 19 nt, Human adenovirus B (HAdV-B)
aacgcaaaaaauggccugu

SEQ ID NO: 1542092 - RNA, 23 nt, Human adenovirus B (HAdV-B)
caaaguuuacagcgguuacuauu

SEQ ID NO: 1542093 - RNA, 16 nt, Human adenovirus B (HAdV-B)
agcaaccccaggccaa

SEQ ID NO: 1542094 - RNA, 15 nt, Human adenovirus B (HAdV-B)
ggugggugcagagcu

SEQ ID NO: 1542095 - RNA, 20 nt, Human adenovirus B (HAdV-B)
cagaccucaucuucccagag

SEQ ID NO: 1542096 - RNA, 17 nt, Human adenovirus B (HAdV-B)
accucugaccgcccagc

SEQ ID NO: 1542097 - RNA, 17 nt, Human adenovirus B (HAdV-B)
acaucacuuccaugccu

SEQ ID NO: 1542098 - RNA, 20 nt, Human adenovirus B (HAdV-B)
auagccacagcauuguggag

SEQ ID NO: 1542099 - RNA, 12 nt, Human adenovirus B (HAdV-B)
agaaauuacuug

SEQ ID NO: 1542100 - RNA, 17 nt, Human adenovirus B (HAdV-B)
gaugccuuuuccagaau

SEQ ID NO: 1542101 - RNA, 14 nt, Human adenovirus B (HAdV-B)
gcaaggccccagca

SEQ ID NO: 1542102 - RNA, 21 nt, Human adenovirus B (HAdV-B)
gagccagcgcaaacccgagag

SEQ ID NO: 1542103 - RNA, 16 nt, Human adenovirus B (HAdV-B)
cgagagcgugaugcag

SEQ ID NO: 1542104 - RNA, 18 nt, Human adenovirus B (HAdV-B)
cacuaugcaacugauggu

SEQ ID NO: 1542105 - RNA, 19 nt, Human adenovirus B (HAdV-B)
cuucaaccccuucuccgga

SEQ ID NO: 1542106 - RNA, 15 nt, Human adenovirus B (HAdV-B)
aagacaaacauaaag

SEQ ID NO: 1542107 - RNA, 20 nt, Human adenovirus B (HAdV-B)
aaacccaggguuuauuuccc

SEQ ID NO: 1542108 - RNA, 16 nt, Human adenovirus B (HAdV-B)
cucuuacagaaaucuc

SEQ ID NO: 1542109 - RNA, 15 nt, Human adenovirus B (HAdV-B)
ucuaccacuccagca

SEQ ID NO: 1542110 - RNA, 14 nt, Human adenovirus B (HAdV-B)
cagcacccagacca

SEQ ID NO: 1542111 - RNA, 22 nt, Human adenovirus B (HAdV-B)
cauaaaggugauccauuacuua

SEQ ID NO: 1542112 - RNA, 19 nt, Human adenovirus B (HAdV-B)
ucagcaauaaggucucugu

SEQ ID NO: 1542113 - RNA, 14 nt, Human adenovirus B (HAdV-B)
cuugcaggacagaa

SEQ ID NO: 1542114 - RNA, 14 nt, Human adenovirus B (HAdV-B)
cagcagcuccuuua

SEQ ID NO: 1542115 - RNA, 20 nt, Human adenovirus B (HAdV-B)
ugguuuuagauuccacauuc

SEQ ID NO: 1542116 - RNA, 14 nt, Human adenovirus B (HAdV-B)
cagcugcugcagaa

SEQ ID NO: 1542117 - RNA, 19 nt, Human adenovirus B (HAdV-B)
uuaccccuacggaagccag

SEQ ID NO: 1542118 - RNA, 17 nt, Human adenovirus B (HAdV-B)
aggcugauugccacaga

SEQ ID NO: 1542119 - RNA, 14 nt, Human adenovirus B (HAdV-B)
ugaaggaugaaaaa

SEQ ID NO: 1542120 - RNA, 16 nt, Human adenovirus B (HAdV-B)
gcugcugcuguggcuu

SEQ ID NO: 1542121 - RNA, 19 nt, Human adenovirus B (HAdV-B)
gcaaugcugaacgggguca

SEQ ID NO: 1542122 - RNA, 13 nt, Human adenovirus B (HAdV-B)
gacgaaguguacc

SEQ ID NO: 1542123 - RNA, 15 nt, Human adenovirus B (HAdV-B)
ccagguggucucugg

SEQ ID NO: 1542124 - RNA, 23 nt, Human adenovirus B (HAdV-B)
cacucggaugugaucgaggaugu

SEQ ID NO: 1542125 - RNA, 15 nt, Human adenovirus B (HAdV-B)
aacauucuacagagu

SEQ ID NO: 1542126 - RNA, 12 nt, Human adenovirus B (HAdV-B)
ccuuggaagagg

SEQ ID NO: 1542127 - RNA, 17 nt, Human adenovirus B (HAdV-B)
acccuccaguggaggag

SEQ ID NO: 1542128 - RNA, 18 nt, Human adenovirus B (HAdV-B)
gcuguuucugguggugca

SEQ ID NO: 1542129 - RNA, 14 nt, Human adenovirus B (HAdV-B)
gguggcaugagguu

SEQ ID NO: 1542130 - RNA, 23 nt, Human adenovirus B (HAdV-B)
cacggcuuugugcggcaggcaug

SEQ ID NO: 1542131 - RNA, 13 nt, Human adenovirus B (HAdV-B)
agaugccugggga

SEQ ID NO: 1542132 - RNA, 19 nt, Human adenovirus B (HAdV-B)
ugagaagguccuggccauc

SEQ ID NO: 1542133 - RNA, 14 nt, Human adenovirus B (HAdV-B)
ugugcucccugugg

SEQ ID NO: 1542134 - RNA, 15 nt, Human adenovirus B (HAdV-B)
auuuuggauuggauu

SEQ ID NO: 1542135 - RNA, 13 nt, Human adenovirus B (HAdV-B)
ccgucaccuccac

SEQ ID NO: 1542136 - RNA, 19 nt, Human adenovirus B (HAdV-B)
uccgcauuaguaacaacac

SEQ ID NO: 1542137 - RNA, 19 nt, Human adenovirus B (HAdV-B)
guuccugcucucacagauc

SEQ ID NO: 1542138 - RNA, 21 nt, Human adenovirus B (HAdV-B)
caguccgguccugauuacuuc

SEQ ID NO: 1542139 - RNA, 21 nt, Human adenovirus B (HAdV-B)
cacccgcaugaauuggcucag

SEQ ID NO: 1542140 - RNA, 18 nt, Human adenovirus B (HAdV-B)
agcaucauauugcuugaa

SEQ ID NO: 1542141 - RNA, 19 nt, Human adenovirus B (HAdV-B)
augcuaacuacacacagaa

SEQ ID NO: 1542142 - RNA, 18 nt, Human adenovirus B (HAdV-B)
aauggagugcuugaaagu

SEQ ID NO: 1542143 - RNA, 19 nt, Human adenovirus B (HAdV-B)
ccaaacuuauauugcaugg

SEQ ID NO: 1542144 - RNA, 13 nt, Human adenovirus B (HAdV-B)
gcgcccuccacca

SEQ ID NO: 1542145 - RNA, 13 nt, Human adenovirus B (HAdV-B)
ucauagccacagc

SEQ ID NO: 1542146 - RNA, 17 nt, Human adenovirus B (HAdV-B)
ccaauuaucgcugcugc

SEQ ID NO: 1542147 - RNA, 18 nt, Human adenovirus B (HAdV-B)
aaacccaacacacacccc

SEQ ID NO: 1542148 - RNA, 18 nt, Human adenovirus B (HAdV-B)
ucaccaaacugcuuagcc

SEQ ID NO: 1542149 - RNA, 21 nt, Human adenovirus B (HAdV-B)
aggaugugagcggagacggcu

SEQ ID NO: 1542150 - RNA, 20 nt, Human adenovirus B (HAdV-B)
gccaugcgagccgcaagagc

SEQ ID NO: 1542151 - RNA, 22 nt, Human adenovirus B (HAdV-B)
auuacuucuuucagacuagcag

SEQ ID NO: 1542152 - RNA, 23 nt, Human adenovirus B (HAdV-B)
gcucgaaaacugguuagcugcac

SEQ ID NO: 1542153 - RNA, 21 nt, Human adenovirus B (HAdV-B)
aguugaaggugcagccgccgc

SEQ ID NO: 1542154 - RNA, 17 nt, Human adenovirus B (HAdV-B)
uuccgaugagaggccuu

SEQ ID NO: 1542155 - RNA, 23 nt, Human adenovirus B (HAdV-B)
cccagggggcaauucuggcccaa

SEQ ID NO: 1542156 - RNA, 15 nt, Human adenovirus B (HAdV-B)
acucugaacuucuug

SEQ ID NO: 1542157 - RNA, 18 nt, Human adenovirus B (HAdV-B)
cuaccgcgagugcccccc

SEQ ID NO: 1542158 - RNA, 20 nt, Human adenovirus B (HAdV-B)
gcaggcacuucagcuugccc

SEQ ID NO: 1542159 - RNA, 19 nt, Human adenovirus B (HAdV-B)
uguggguuacauggcuccg

SEQ ID NO: 1542160 - RNA, 15 nt, Human adenovirus B (HAdV-B)
gucagccaugggcau

SEQ ID NO: 1542161 - RNA, 21 nt, Human adenovirus B (HAdV-B)
ccaaugucacucuuccagaaa

SEQ ID NO: 1542162 - RNA, 18 nt, Human adenovirus B (HAdV-B)
uaccagacaaaguacagc

SEQ ID NO: 1542163 - RNA, 21 nt, Human adenovirus B (HAdV-B)
ugcagaggcauacaugccaca

SEQ ID NO: 1542164 - RNA, 12 nt, Human adenovirus B (HAdV-B)
acaaaccuggaa

SEQ ID NO: 1542165 - RNA, 18 nt, Human adenovirus B (HAdV-B)
aguucgacaccaggaacu

SEQ ID NO: 1542166 - RNA, 13 nt, Human adenovirus B (HAdV-B)
uaccuuuggaagu

SEQ ID NO: 1542167 - RNA, 21 nt, Human adenovirus B (HAdV-B)
cgaagcaucgaggucacacac

SEQ ID NO: 1542168 - RNA, 19 nt, Human adenovirus B (HAdV-B)
ggggucuaccuugaccccc

SEQ ID NO: 1542169 - RNA, 22 nt, Human adenovirus B (HAdV-B)
ugguaaagauucccggaaguaa

SEQ ID NO: 1542170 - RNA, 14 nt, Human adenovirus B (HAdV-B)
cuccauggggcgcc

SEQ ID NO: 1542171 - RNA, 14 nt, Human adenovirus B (HAdV-B)
gaagauauggagga

SEQ ID NO: 1542172 - RNA, 16 nt, Human adenovirus B (HAdV-B)
ugcugcuucucccagg

SEQ ID NO: 1542173 - RNA, 16 nt, Human adenovirus B (HAdV-B)
cagaagacaugcauga

SEQ ID NO: 1542174 - RNA, 15 nt, Human adenovirus B (HAdV-B)
agguccguugaaauu

SEQ ID NO: 1542175 - RNA, 23 nt, Human adenovirus B (HAdV-B)
acaacagacauggaaacucagcc

SEQ ID NO: 1542176 - RNA, 18 nt, Human adenovirus B (HAdV-B)
gguggaacacgaggaaga

SEQ ID NO: 1542177 - RNA, 15 nt, Human adenovirus B (HAdV-B)
ucaaccccagguaga

SEQ ID NO: 1542178 - RNA, 18 nt, Human adenovirus B (HAdV-B)
acuggauuuccugccacc

SEQ ID NO: 1542179 - RNA, 14 nt, Human adenovirus B (HAdV-B)
agaaucgccuagga

SEQ ID NO: 1542180 - RNA, 17 nt, Human adenovirus B (HAdV-B)
uaugccaucuuccagca

SEQ ID NO: 1542181 - RNA, 16 nt, Human adenovirus B (HAdV-B)
ccacagggucuccagc

SEQ ID NO: 1542182 - RNA, 17 nt, Human adenovirus B (HAdV-B)
aggacagucuggaggac

SEQ ID NO: 1542183 - RNA, 22 nt, Human adenovirus B (HAdV-B)
cucacuucccucuucccaacuc

SEQ ID NO: 1542184 - RNA, 18 nt, Human adenovirus B (HAdV-B)
cuuacauugauuaauguu

SEQ ID NO: 1542185 - RNA, 16 nt, Human adenovirus B (HAdV-B)
gaucugaguuggcuuu

SEQ ID NO: 1542186 - RNA, 18 nt, Human adenovirus B (HAdV-B)
aaauuuucucccagcagc

SEQ ID NO: 1542187 - RNA, 16 nt, Human adenovirus B (HAdV-B)
uacauggguauucugc

SEQ ID NO: 1542188 - RNA, 14 nt, Human adenovirus B (HAdV-B)
cuccuuaaacaucu

SEQ ID NO: 1542189 - RNA, 16 nt, Human adenovirus B (HAdV-B)
ugcaaggccccagcag

SEQ ID NO: 1542190 - RNA, 22 nt, Human adenovirus B (HAdV-B)
caaccacaggcggaucucuaca

SEQ ID NO: 1542191 - RNA, 22 nt, Human adenovirus B (HAdV-B)
cagcaccgaaaguuccucgcgg

SEQ ID NO: 1542192 - RNA, 23 nt, Human adenovirus B (HAdV-B)
caggacuacuccacccgcaugaa

SEQ ID NO: 1542193 - RNA, 19 nt, Human adenovirus B (HAdV-B)
ugccuuaccaguguaacau

SEQ ID NO: 1542194 - RNA, 13 nt, Human adenovirus B (HAdV-B)
ugugugacagaac

SEQ ID NO: 1542195 - RNA, 16 nt, Human adenovirus B (HAdV-B)
auaguaucacaaucug

SEQ ID NO: 1542196 - RNA, 14 nt, Human adenovirus B (HAdV-B)
gaagguucuggggu

SEQ ID NO: 1542197 - RNA, 13 nt, Human adenovirus B (HAdV-B)
uucacucaaaucu

SEQ ID NO: 1542198 - RNA, 17 nt, Human adenovirus B (HAdV-B)
cugguuuuuauugcuuu

SEQ ID NO: 1542199 - RNA, 15 nt, Human adenovirus B (HAdV-B)
cauuacccggacgag

SEQ ID NO: 1542200 - RNA, 13 nt, Human adenovirus B (HAdV-B)
acccaacacacac

SEQ ID NO: 1542201 - RNA, 22 nt, Human adenovirus B (HAdV-B)
aagagcuagacgcguggggcga

SEQ ID NO: 1542202 - RNA, 17 nt, Human adenovirus B (HAdV-B)
ggauacguuuuggauuu

SEQ ID NO: 1542203 - RNA, 21 nt, Human adenovirus B (HAdV-B)
ccuccccaauuggcuccagca

SEQ ID NO: 1542204 - RNA, 17 nt, Human adenovirus B (HAdV-B)
acagcugcugcagaagc

SEQ ID NO: 1542205 - RNA, 17 nt, Human adenovirus B (HAdV-B)
uaaauccaauccacaca

SEQ ID NO: 1542206 - RNA, 14 nt, Human adenovirus B (HAdV-B)
agagccggccugga

SEQ ID NO: 1542207 - RNA, 21 nt, Human adenovirus B (HAdV-B)
gaugcauuauuggacagaacu

SEQ ID NO: 1542208 - RNA, 23 nt, Human adenovirus B (HAdV-B)
gagcuuccuuacauagaagaggc

SEQ ID NO: 1542209 - RNA, 18 nt, Human adenovirus B (HAdV-B)
ggauuucauagccacagc

SEQ ID NO: 1542210 - RNA, 17 nt, Human adenovirus B (HAdV-B)
cacuggacaugacagcg

SEQ ID NO: 1542211 - RNA, 12 nt, Human adenovirus B (HAdV-B)
ugcacgccccac

SEQ ID NO: 1542212 - RNA, 12 nt, Human adenovirus B (HAdV-B)
uggcaaugcuga

SEQ ID NO: 1542213 - RNA, 14 nt, Human adenovirus B (HAdV-B)
ccugguccugugac

SEQ ID NO: 1542214 - RNA, 13 nt, Human adenovirus B (HAdV-B)
agauauggaggaa

SEQ ID NO: 1542215 - RNA, 18 nt, Human adenovirus B (HAdV-B)
aguuggugcgauuggguu

SEQ ID NO: 1542216 - RNA, 20 nt, Human adenovirus B (HAdV-B)
ugcaacgaauuuucucccag

SEQ ID NO: 1542217 - RNA, 19 nt, Human adenovirus B (HAdV-B)
ugcuuagggcggccagacg

SEQ ID NO: 1542218 - RNA, 23 nt, Human adenovirus B (HAdV-B)
cugagcaauugagauuugccaca

SEQ ID NO: 1542219 - RNA, 14 nt, Human adenovirus B (HAdV-B)
aaugccaucaucuc

SEQ ID NO: 1542220 - RNA, 13 nt, Human adenovirus B (HAdV-B)
cuaugagaacagu

SEQ ID NO: 1542221 - RNA, 16 nt, Human adenovirus B (HAdV-B)
uacuugaaaucagcaa

SEQ ID NO: 1542222 - RNA, 21 nt, Human adenovirus B (HAdV-B)
cugcaaucaugcccacaucca

SEQ ID NO: 1542223 - RNA, 14 nt, Human adenovirus B (HAdV-B)
cuaaugauugcaaa

SEQ ID NO: 1542224 - RNA, 16 nt, Human adenovirus B (HAdV-B)
ugacaugaacaugcaa

SEQ ID NO: 1542225 - RNA, 13 nt, Human adenovirus B (HAdV-B)
ccgauccaugcuu

SEQ ID NO: 1542226 - RNA, 16 nt, Human adenovirus B (HAdV-B)
cuuccagaaaacaaaa

SEQ ID NO: 1542227 - RNA, 20 nt, Human adenovirus B (HAdV-B)
acaccuugcuucacuuucuu

SEQ ID NO: 1542228 - RNA, 22 nt, Human adenovirus B (HAdV-B)
aacaagugcagcaacaggagga

SEQ ID NO: 1542229 - RNA, 22 nt, Human adenovirus B (HAdV-B)
gcugaguuacuuucaagauggc

SEQ ID NO: 1542230 - RNA, 21 nt, Human adenovirus B (HAdV-B)
cagcauucguuauucggaacu

SEQ ID NO: 1542231 - RNA, 13 nt, Human adenovirus B (HAdV-B)
ccuaacaggaauu

SEQ ID NO: 1542232 - RNA, 21 nt, Human adenovirus B (HAdV-B)
auuccagucuccugccgcgcu

SEQ ID NO: 1542233 - RNA, 20 nt, Human adenovirus B (HAdV-B)
ugagaaauugguauuugaag

SEQ ID NO: 1542234 - RNA, 17 nt, Human adenovirus B (HAdV-B)
cucgguauaaaacaucc

SEQ ID NO: 1542235 - RNA, 22 nt, Human adenovirus B (HAdV-B)
accgcaaugguagugcggaacc

SEQ ID NO: 1542236 - RNA, 15 nt, Human adenovirus B (HAdV-B)
cgguccuuccagggu

SEQ ID NO: 1542237 - RNA, 19 nt, Human adenovirus B (HAdV-B)
gcggucaggcaaaacaaaa

SEQ ID NO: 1542238 - RNA, 22 nt, Human adenovirus B (HAdV-B)
gcgcgguuagcgccagcaggag

SEQ ID NO: 1542239 - RNA, 18 nt, Human adenovirus B (HAdV-B)
cacacugguggccaccuc

SEQ ID NO: 1542240 - RNA, 14 nt, Human adenovirus B (HAdV-B)
cauguaugcagaaa

SEQ ID NO: 1542241 - RNA, 16 nt, Human adenovirus B (HAdV-B)
agcucugacuggagcu

SEQ ID NO: 1542242 - RNA, 17 nt, Human adenovirus B (HAdV-B)
ccuauccuuucaaugau

SEQ ID NO: 1542243 - RNA, 21 nt, Human adenovirus B (HAdV-B)
acagaguucccucgguaacga

SEQ ID NO: 1542244 - RNA, 16 nt, Human adenovirus B (HAdV-B)
uaucaccaaacugcuu

SEQ ID NO: 1542245 - RNA, 16 nt, Human adenovirus B (HAdV-B)
cuguauaggagcauuu

SEQ ID NO: 1542246 - RNA, 17 nt, Human adenovirus B (HAdV-B)
ugcggaggaggagagga

SEQ ID NO: 1542247 - RNA, 13 nt, Human adenovirus B (HAdV-B)
guggaagaugaac

SEQ ID NO: 1542248 - RNA, 19 nt, Human adenovirus B (HAdV-B)
ccccuacuauagccagcaa

SEQ ID NO: 1542249 - RNA, 16 nt, Human adenovirus B (HAdV-B)
aagcugaaauuacaaa

SEQ ID NO: 1542250 - RNA, 16 nt, Human adenovirus B (HAdV-B)
agccggcgaaggcgca

SEQ ID NO: 1542251 - RNA, 18 nt, Human adenovirus B (HAdV-B)
uccugcaccauucccaga

SEQ ID NO: 1542252 - RNA, 23 nt, Human adenovirus B (HAdV-B)
gacauggaaacucagccauugcu

SEQ ID NO: 1542253 - RNA, 15 nt, Human adenovirus B (HAdV-B)
acaguuuggaggagg

SEQ ID NO: 1542254 - RNA, 21 nt, Human adenovirus B (HAdV-B)
caggcauuaguuuaaaagagg

SEQ ID NO: 1542255 - RNA, 13 nt, Human adenovirus B (HAdV-B)
agaucggacaggg

SEQ ID NO: 1542256 - RNA, 20 nt, Human adenovirus B (HAdV-B)
agcgugaguaagggcaaagg

SEQ ID NO: 1542257 - RNA, 20 nt, Human adenovirus B (HAdV-B)
augagucgcagacguccuga

SEQ ID NO: 1542258 - RNA, 18 nt, Human adenovirus B (HAdV-B)
uaagguucuguggacagg

SEQ ID NO: 1542259 - RNA, 17 nt, Human adenovirus B (HAdV-B)
aauuacaaagacuucaa

SEQ ID NO: 1542260 - RNA, 17 nt, Human adenovirus B (HAdV-B)
cuuaccggcucugggca

SEQ ID NO: 1542261 - RNA, 14 nt, Human adenovirus B (HAdV-B)
aucaaggcucugca

SEQ ID NO: 1542262 - RNA, 14 nt, Human adenovirus B (HAdV-B)
cuucucauaauuuu

SEQ ID NO: 1542263 - RNA, 21 nt, Human adenovirus B (HAdV-B)
gauaacuaucaccaagaugcu

SEQ ID NO: 1542264 - RNA, 15 nt, Human adenovirus B (HAdV-B)
gacccuaugcggccu

SEQ ID NO: 1542265 - RNA, 10 nt, Human adenovirus B (HAdV-B)
gaccucccca

SEQ ID NO: 1542266 - RNA, 14 nt, Human adenovirus B (HAdV-B)
acuggccagugcag

SEQ ID NO: 1542267 - RNA, 21 nt, Human adenovirus B (HAdV-B)
aaaugggauuggcggcaggcg

SEQ ID NO: 1542268 - RNA, 22 nt, Human adenovirus B (HAdV-B)
gaacaaagcuuggaacagcagu

SEQ ID NO: 1542269 - RNA, 21 nt, Human adenovirus B (HAdV-B)
acauauccuucacgcggcgcu

SEQ ID NO: 1542270 - RNA, 14 nt, Human adenovirus B (HAdV-B)
cuucucaaagagcu

SEQ ID NO: 1542271 - RNA, 22 nt, Human adenovirus B (HAdV-B)
cccagggaauaggaagcucuug

SEQ ID NO: 1542272 - RNA, 16 nt, Human adenovirus B (HAdV-B)
cagcacugaaacacca

SEQ ID NO: 1542273 - RNA, 17 nt, Human adenovirus B (HAdV-B)
augccuuaccaguguaa

SEQ ID NO: 1542274 - RNA, 16 nt, Human adenovirus B (HAdV-B)
ucgcagcagcagcagc

SEQ ID NO: 1542275 - RNA, 23 nt, Human adenovirus B (HAdV-B)
aguggucagugaugagcagcuaa

SEQ ID NO: 1542276 - RNA, 19 nt, Human adenovirus B (HAdV-B)
cagcucuuaccaccacgcc

SEQ ID NO: 1542277 - RNA, 16 nt, Human adenovirus B (HAdV-B)
aggucaauuacaaaga

SEQ ID NO: 1542278 - RNA, 19 nt, Human adenovirus B (HAdV-B)
uuccagccuugaauuauuc

SEQ ID NO: 1542279 - RNA, 21 nt, Human adenovirus B (HAdV-B)
ugggacaggaagacacuggca

SEQ ID NO: 1542280 - RNA, 14 nt, Human adenovirus B (HAdV-B)
ccugcugcuacugc

SEQ ID NO: 1542281 - RNA, 17 nt, Human adenovirus B (HAdV-B)
ccccuacuauagccagc

SEQ ID NO: 1542282 - RNA, 17 nt, Human adenovirus B (HAdV-B)
cgggcggcgcugcagag

SEQ ID NO: 1542283 - RNA, 19 nt, Human adenovirus B (HAdV-B)
agacucucgccugcaacga

SEQ ID NO: 1542284 - RNA, 17 nt, Human adenovirus B (HAdV-B)
augcaucccgugcugcg

SEQ ID NO: 1542285 - RNA, 16 nt, Human adenovirus B (HAdV-B)
uaggcugauugccaca

SEQ ID NO: 1542286 - RNA, 21 nt, Human adenovirus B (HAdV-B)
aacgaauuuucucccagcggc

SEQ ID NO: 1542287 - RNA, 21 nt, Human adenovirus B (HAdV-B)
ugaaguuucuguauugcagga

SEQ ID NO: 1542288 - RNA, 17 nt, Human adenovirus B (HAdV-B)
ugaaagcaccucccaac

SEQ ID NO: 1542289 - RNA, 13 nt, Human adenovirus B (HAdV-B)
uagcccuuaacau

SEQ ID NO: 1542290 - RNA, 18 nt, Human adenovirus B (HAdV-B)
ccggagacagggaggauu

SEQ ID NO: 1542291 - RNA, 14 nt, Human adenovirus B (HAdV-B)
cagaggugcaaacc

SEQ ID NO: 1542292 - RNA, 21 nt, Human adenovirus B (HAdV-B)
cagaagacaugcaugacccag

SEQ ID NO: 1542293 - RNA, 20 nt, Human adenovirus B (HAdV-B)
caucgcgcgguuagcgccag

SEQ ID NO: 1542294 - RNA, 17 nt, Human adenovirus B (HAdV-B)
ggagccggaggagaugc

SEQ ID NO: 1542295 - RNA, 22 nt, Human adenovirus B (HAdV-B)
gcauaugcaaaucccaaccaag

SEQ ID NO: 1542296 - RNA, 22 nt, Human adenovirus B (HAdV-B)
aucagagaagacgacugacaaa

SEQ ID NO: 1542297 - RNA, 12 nt, Human adenovirus B (HAdV-B)
aaugacagaaug

SEQ ID NO: 1542298 - RNA, 20 nt, Human adenovirus B (HAdV-B)
auagcaauggggccgugggc

SEQ ID NO: 1542299 - RNA, 14 nt, Human adenovirus B (HAdV-B)
agcgggcuuaaaaa

SEQ ID NO: 1542300 - RNA, 11 nt, Human adenovirus B (HAdV-B)
aacugcacacu

SEQ ID NO: 1542301 - RNA, 18 nt, Human adenovirus B (HAdV-B)
aaaggcgcgcguccaggc

SEQ ID NO: 1542302 - RNA, 18 nt, Human adenovirus B (HAdV-B)
gcgccaugacagacagag

SEQ ID NO: 1542303 - RNA, 14 nt, Human adenovirus B (HAdV-B)
acacuucugcccca

SEQ ID NO: 1542304 - RNA, 17 nt, Human adenovirus B (HAdV-B)
cauuuucccuacuaaua

SEQ ID NO: 1542305 - RNA, 22 nt, Human adenovirus B (HAdV-B)
ccuaacaggaauuuuugacaug

SEQ ID NO: 1542306 - RNA, 20 nt, Human adenovirus B (HAdV-B)
aagcaccucccaacaccccu

SEQ ID NO: 1542307 - RNA, 16 nt, Human adenovirus B (HAdV-B)
cagcuccgccagucca

SEQ ID NO: 1542308 - RNA, 13 nt, Human adenovirus B (HAdV-B)
acaagcgcagacc

SEQ ID NO: 1542309 - RNA, 14 nt, Human adenovirus B (HAdV-B)
ggauugccacagcu

SEQ ID NO: 1542310 - RNA, 14 nt, Human adenovirus B (HAdV-B)
ugacauuggaaaaa

SEQ ID NO: 1542311 - RNA, 14 nt, Human adenovirus B (HAdV-B)
acggcuugcuggag

SEQ ID NO: 1542312 - RNA, 20 nt, Human adenovirus B (HAdV-B)
cauccaaaaaucccgccaag

SEQ ID NO: 1542313 - RNA, 14 nt, Human adenovirus B (HAdV-B)
ucucacuugccacc

SEQ ID NO: 1542314 - RNA, 21 nt, Human adenovirus B (HAdV-B)
cacaugggagccaggaguucc

SEQ ID NO: 1542315 - RNA, 20 nt, Human adenovirus B (HAdV-B)
uuacugugcguaugcauaca

SEQ ID NO: 1542316 - RNA, 18 nt, Human adenovirus B (HAdV-B)
ccuuaccaguguaacaug

SEQ ID NO: 1542317 - RNA, 15 nt, Human adenovirus B (HAdV-B)
acgcacaagcaaacc

SEQ ID NO: 1542318 - RNA, 15 nt, Human adenovirus B (HAdV-B)
gcugauugccacaga

SEQ ID NO: 1542319 - RNA, 20 nt, Human adenovirus B (HAdV-B)
ugggcauuacccggacgagu

SEQ ID NO: 1542320 - RNA, 22 nt, Human adenovirus B (HAdV-B)
aacccggcggcgucccagcagu

SEQ ID NO: 1542321 - RNA, 16 nt, Human adenovirus B (HAdV-B)
cggaucuccugggcau

SEQ ID NO: 1542322 - RNA, 13 nt, Human adenovirus B (HAdV-B)
uaauucuacaacu

SEQ ID NO: 1542323 - RNA, 17 nt, Human adenovirus B (HAdV-B)
acauacaacaauuucca

SEQ ID NO: 1542324 - RNA, 15 nt, Human adenovirus B (HAdV-B)
aaauauucacuggaa

SEQ ID NO: 1542325 - RNA, 22 nt, Human adenovirus B (HAdV-B)
ggacaggguucgacgagcgcac

SEQ ID NO: 1542326 - RNA, 15 nt, Human adenovirus B (HAdV-B)
gaucuucgagggucu

SEQ ID NO: 1542327 - RNA, 16 nt, Human adenovirus B (HAdV-B)
ccacacuucugcccca

SEQ ID NO: 1542328 - RNA, 19 nt, Human adenovirus B (HAdV-B)
ccugcagaaaucuucccau

SEQ ID NO: 1542329 - RNA, 16 nt, Human adenovirus B (HAdV-B)
ucaaaaccucugggau

SEQ ID NO: 1542330 - RNA, 22 nt, Human adenovirus B (HAdV-B)
uggcaauauugccgccaagauc

SEQ ID NO: 1542331 - RNA, 20 nt, Human adenovirus B (HAdV-B)
gccugacuuuaugagccaga

SEQ ID NO: 1542332 - RNA, 13 nt, Human adenovirus B (HAdV-B)
uggcuuccagcaa

SEQ ID NO: 1542333 - RNA, 20 nt, Human adenovirus B (HAdV-B)
auggcuuaccagacaaagua

SEQ ID NO: 1542334 - RNA, 19 nt, Human adenovirus B (HAdV-B)
uacgauugaugucugguga

SEQ ID NO: 1542335 - RNA, 13 nt, Human adenovirus B (HAdV-B)
acuuuuuucccca

SEQ ID NO: 1542336 - RNA, 13 nt, Human adenovirus B (HAdV-B)
ccaauccaaccuu

SEQ ID NO: 1542337 - RNA, 11 nt, Human adenovirus B (HAdV-B)
ccagaaugagc

SEQ ID NO: 1542338 - RNA, 18 nt, Human adenovirus B (HAdV-B)
ggacagucuggaggaaga

SEQ ID NO: 1542339 - RNA, 15 nt, Human adenovirus B (HAdV-B)
uggaaugcucccaau

SEQ ID NO: 1542340 - RNA, 14 nt, Human adenovirus B (HAdV-B)
acaacaauuuccac

SEQ ID NO: 1542341 - RNA, 18 nt, Human adenovirus B (HAdV-B)
cgaagagcaauaaaugac

SEQ ID NO: 1542342 - RNA, 19 nt, Human adenovirus B (HAdV-B)
cgcugucaaccugcccccu

SEQ ID NO: 1542343 - RNA, 14 nt, Human adenovirus B (HAdV-B)
cugugcgaggauga

SEQ ID NO: 1542344 - RNA, 22 nt, Human adenovirus B (HAdV-B)
ucuucccagagcgucucagggu

SEQ ID NO: 1542345 - RNA, 13 nt, Human adenovirus B (HAdV-B)
acagcagagacaa

SEQ ID NO: 1542346 - RNA, 17 nt, Human adenovirus B (HAdV-B)
ugcaguuauugacagug

SEQ ID NO: 1542347 - RNA, 23 nt, Human adenovirus B (HAdV-B)
acaccuguuccgacugcagaauc

SEQ ID NO: 1542348 - RNA, 23 nt, Human adenovirus B (HAdV-B)
ccaagauagcuuugaggccugau

SEQ ID NO: 1542349 - RNA, 13 nt, Human adenovirus B (HAdV-B)
agcggguuaaaaa

SEQ ID NO: 1542350 - RNA, 15 nt, Human adenovirus B (HAdV-B)
aucaugcccacaucc

SEQ ID NO: 1542351 - RNA, 22 nt, Human adenovirus B (HAdV-B)
gcuggacuugggugggagagga

SEQ ID NO: 1542352 - RNA, 18 nt, Human adenovirus B (HAdV-B)
ugcuuaaccgaagagcaa

SEQ ID NO: 1542353 - RNA, 23 nt, Human adenovirus B (HAdV-B)
caguuuggaagccacucugaacu

SEQ ID NO: 1542354 - RNA, 17 nt, Human adenovirus B (HAdV-B)
ucaccuccacagccccu

SEQ ID NO: 1542355 - RNA, 15 nt, Human adenovirus B (HAdV-B)
cuugcaggucugccu

SEQ ID NO: 1542356 - RNA, 16 nt, Human adenovirus B (HAdV-B)
agcagcgugcuggacu

SEQ ID NO: 1542357 - RNA, 13 nt, Human adenovirus B (HAdV-B)
ccaccccucgcgg

SEQ ID NO: 1542358 - RNA, 23 nt, Human adenovirus B (HAdV-B)
gacgaaaguacgguccagcaagu

SEQ ID NO: 1542359 - RNA, 22 nt, Human adenovirus B (HAdV-B)
cagugguugacuugcaggacag

SEQ ID NO: 1542360 - RNA, 15 nt, Human adenovirus B (HAdV-B)
uacuuugccagaagg

SEQ ID NO: 1542361 - RNA, 23 nt, Human adenovirus B (HAdV-B)
gucucaguguucgagucaggguu

SEQ ID NO: 1542362 - RNA, 23 nt, Human adenovirus B (HAdV-B)
gaagauugggacagucaggcaga

SEQ ID NO: 1542363 - RNA, 19 nt, Human adenovirus B (HAdV-B)
aaaccucugcuacaacccu

SEQ ID NO: 1542364 - RNA, 18 nt, Human adenovirus B (HAdV-B)
guaucauucccugcagaa

SEQ ID NO: 1542365 - RNA, 20 nt, Human adenovirus B (HAdV-B)
auguguugagaccuggaacu

SEQ ID NO: 1542366 - RNA, 19 nt, Human adenovirus B (HAdV-B)
cugguggugcaacacagca

SEQ ID NO: 1542367 - RNA, 15 nt, Human adenovirus B (HAdV-B)
gcugcaaaaguucua

SEQ ID NO: 1542368 - RNA, 14 nt, Human adenovirus B (HAdV-B)
cugcaaucaugccc

SEQ ID NO: 1542369 - RNA, 23 nt, Human adenovirus B (HAdV-B)
caagcgcaaauacaaggaagaaa

SEQ ID NO: 1542370 - RNA, 17 nt, Human adenovirus B (HAdV-B)
gaugauugggagguggc

SEQ ID NO: 1542371 - RNA, 14 nt, Human adenovirus B (HAdV-B)
gaaaucuucccauc

SEQ ID NO: 1542372 - RNA, 16 nt, Human adenovirus B (HAdV-B)
ugcauuauuggacaga

SEQ ID NO: 1542373 - RNA, 16 nt, Human adenovirus B (HAdV-B)
uaagucgcccgaguuu

SEQ ID NO: 1542374 - RNA, 16 nt, Human adenovirus B (HAdV-B)
agcugcugcagaagcu

SEQ ID NO: 1542375 - RNA, 18 nt, Human adenovirus B (HAdV-B)
ggcgacggcggugaugca

SEQ ID NO: 1542376 - RNA, 16 nt, Human adenovirus B (HAdV-B)
cuaggcggagcggugg

SEQ ID NO: 1542377 - RNA, 12 nt, Human adenovirus B (HAdV-B)
gcucaccagaag

SEQ ID NO: 1542378 - RNA, 17 nt, Human adenovirus B (HAdV-B)
ucuacagauacuggaug

SEQ ID NO: 1542379 - RNA, 16 nt, Human adenovirus B (HAdV-B)
aaucaugcccacaucc

SEQ ID NO: 1542380 - RNA, 18 nt, Human adenovirus B (HAdV-B)
uggaacaauaccuuaucc

SEQ ID NO: 1542381 - RNA, 20 nt, Human adenovirus B (HAdV-B)
cgcgguuagcgccagcagga

SEQ ID NO: 1542382 - RNA, 11 nt, Human adenovirus B (HAdV-B)
uuccagucucc

SEQ ID NO: 1542383 - RNA, 19 nt, Human adenovirus B (HAdV-B)
ucuuaaacccgcacuggcu

SEQ ID NO: 1542384 - RNA, 23 nt, Human adenovirus B (HAdV-B)
cugcuugggcgcuugccagggug

SEQ ID NO: 1542385 - RNA, 13 nt, Human adenovirus B (HAdV-B)
aaagcacaagcuc

SEQ ID NO: 1542386 - RNA, 16 nt, Human adenovirus B (HAdV-B)
uccugcccgccaccug

SEQ ID NO: 1542387 - RNA, 15 nt, Human adenovirus B (HAdV-B)
uccuaggcagagaaa

SEQ ID NO: 1542388 - RNA, 21 nt, Human adenovirus B (HAdV-B)
aaacuuaaagaccagaacuuc

SEQ ID NO: 1542389 - RNA, 12 nt, Human adenovirus B (HAdV-B)
ccgucuggccaa

SEQ ID NO: 1542390 - RNA, 13 nt, Human adenovirus B (HAdV-B)
agcaacaggagga

SEQ ID NO: 1542391 - RNA, 14 nt, Human adenovirus B (HAdV-B)
caggcuguccgugu

SEQ ID NO: 1542392 - RNA, 15 nt, Human adenovirus B (HAdV-B)
uucccagauaauuuu

SEQ ID NO: 1542393 - RNA, 20 nt, Human adenovirus B (HAdV-B)
cuuaucaacauucuacagag

SEQ ID NO: 1542394 - RNA, 12 nt, Human adenovirus B (HAdV-B)
caguugaaaacc

SEQ ID NO: 1542395 - RNA, 17 nt, Human adenovirus B (HAdV-B)
ggcccaauugcaagcca

SEQ ID NO: 1542396 - RNA, 18 nt, Human adenovirus B (HAdV-B)
acgcaaaaaauggccugu

SEQ ID NO: 1542397 - RNA, 13 nt, Human adenovirus B (HAdV-B)
ccggcaggucccg

SEQ ID NO: 1542398 - RNA, 21 nt, Human adenovirus B (HAdV-B)
gucgcuuccgaccuggcagac

SEQ ID NO: 1542399 - RNA, 13 nt, Human adenovirus B (HAdV-B)
ucacacagcagcg

SEQ ID NO: 1542400 - RNA, 18 nt, Human adenovirus B (HAdV-B)
ugccacauccgguggggc

SEQ ID NO: 1542401 - RNA, 14 nt, Human adenovirus B (HAdV-B)
cuauuuagagacag

SEQ ID NO: 1542402 - RNA, 18 nt, Human adenovirus B (HAdV-B)
acgcggcccuggcagaac

SEQ ID NO: 1542403 - RNA, 11 nt, Human adenovirus B (HAdV-B)
auugccacagc

SEQ ID NO: 1542404 - RNA, 20 nt, Human adenovirus B (HAdV-B)
ggcgcccuccaccaccauuc

SEQ ID NO: 1542405 - RNA, 20 nt, Human adenovirus B (HAdV-B)
cgcucgauuguugaucaccu

SEQ ID NO: 1542406 - RNA, 22 nt, Human adenovirus B (HAdV-B)
ccgaccuggcagaccucaucuu

SEQ ID NO: 1542407 - RNA, 23 nt, Human adenovirus B (HAdV-B)
accacgguggugcaaaacaauga

SEQ ID NO: 1542408 - RNA, 16 nt, Human adenovirus B (HAdV-B)
gcugcgcuccaacauu

SEQ ID NO: 1542409 - RNA, 11 nt, Human adenovirus B (HAdV-B)
agugcagcaac

SEQ ID NO: 1542410 - RNA, 15 nt, Human adenovirus B (HAdV-B)
cauagauaauuacuu

SEQ ID NO: 1542411 - RNA, 22 nt, Human adenovirus B (HAdV-B)
ggaggaaaacgaggaggcagag

SEQ ID NO: 1542412 - RNA, 23 nt, Human adenovirus B (HAdV-B)
gggcccauacuagucuugcuugu

SEQ ID NO: 1542413 - RNA, 18 nt, Human adenovirus B (HAdV-B)
ugguuaccgaggaagaaa

SEQ ID NO: 1542414 - RNA, 18 nt, Human adenovirus B (HAdV-B)
cuuugauauaaucugcaa

SEQ ID NO: 1542415 - RNA, 16 nt, Human adenovirus B (HAdV-B)
ggaggagaugcgagcu

SEQ ID NO: 1542416 - RNA, 19 nt, Human adenovirus B (HAdV-B)
cgcuuccgaccuggcagac

SEQ ID NO: 1542417 - RNA, 12 nt, Human adenovirus B (HAdV-B)
cauagccacagc

SEQ ID NO: 1542418 - RNA, 16 nt, Human adenovirus B (HAdV-B)
cuaccuugacccccag

SEQ ID NO: 1542419 - RNA, 12 nt, Human adenovirus B (HAdV-B)
auuacagccaac

SEQ ID NO: 1542420 - RNA, 19 nt, Human adenovirus B (HAdV-B)
gagagcccauucgugcagg

SEQ ID NO: 1542421 - RNA, 15 nt, Human adenovirus B (HAdV-B)
ggucgcagugcaugg

SEQ ID NO: 1542422 - RNA, 21 nt, Human adenovirus B (HAdV-B)
auguugaaaugggcaugaggu

SEQ ID NO: 1542423 - RNA, 13 nt, Human adenovirus B (HAdV-B)
cugcagaaucauu

SEQ ID NO: 1542424 - RNA, 16 nt, Human adenovirus B (HAdV-B)
uacaguuucacuuccg

SEQ ID NO: 1542425 - RNA, 20 nt, Human adenovirus B (HAdV-B)
guaaaaauugaauaaaagaa

SEQ ID NO: 1542426 - RNA, 12 nt, Human adenovirus B (HAdV-B)
ggugacaaguac

SEQ ID NO: 1542427 - RNA, 20 nt, Human adenovirus B (HAdV-B)
uuauaaacccaggguuuauu

SEQ ID NO: 1542428 - RNA, 14 nt, Human adenovirus B (HAdV-B)
ugcaguggcagccu

SEQ ID NO: 1542429 - RNA, 15 nt, Human adenovirus B (HAdV-B)
ucuaccgccagugcu

SEQ ID NO: 1542430 - RNA, 14 nt, Human adenovirus B (HAdV-B)
aaggcuacaacgua

SEQ ID NO: 1542431 - RNA, 19 nt, Human adenovirus B (HAdV-B)
auucuacugguaauuuacu

SEQ ID NO: 1542432 - RNA, 23 nt, Human adenovirus B (HAdV-B)
ugcaucgcuguccggggucaugg

SEQ ID NO: 1542433 - RNA, 18 nt, Human adenovirus B (HAdV-B)
ugauuucacucaaaucuu

SEQ ID NO: 1542434 - RNA, 21 nt, Human adenovirus B (HAdV-B)
ggcggaugaaggcgaggagga

SEQ ID NO: 1542435 - RNA, 19 nt, Human adenovirus B (HAdV-B)
acaguuucacauuccacca

SEQ ID NO: 1542436 - RNA, 13 nt, Human adenovirus B (HAdV-B)
uugaaacgcuuuc

SEQ ID NO: 1542437 - RNA, 13 nt, Human adenovirus B (HAdV-B)
cucccuggcuccu

SEQ ID NO: 1542438 - RNA, 20 nt, Human adenovirus B (HAdV-B)
caccaccucuacccuagaag

SEQ ID NO: 1542439 - RNA, 14 nt, Human adenovirus B (HAdV-B)
gagacaagcaacag

SEQ ID NO: 1542440 - RNA, 22 nt, Human adenovirus B (HAdV-B)
aucucuccuaccacucggaugu

SEQ ID NO: 1542441 - RNA, 22 nt, Human adenovirus B (HAdV-B)
cuuagauuugauauuuaauuug

SEQ ID NO: 1542442 - RNA, 19 nt, Human adenovirus B (HAdV-B)
auaugcuggcuacugugca

SEQ ID NO: 1542443 - RNA, 18 nt, Human adenovirus B (HAdV-B)
caacaauaccuguguaga

SEQ ID NO: 1542444 - RNA, 14 nt, Human adenovirus B (HAdV-B)
uacuauagccagca

SEQ ID NO: 1542445 - RNA, 17 nt, Human adenovirus B (HAdV-B)
acaguaaagcuggcaga

SEQ ID NO: 1542446 - RNA, 19 nt, Human adenovirus B (HAdV-B)
auaaaaaaaaaaacaagcg

SEQ ID NO: 1542447 - RNA, 23 nt, Human adenovirus B (HAdV-B)
gauccauggaugcccaugccuau

SEQ ID NO: 1542448 - RNA, 19 nt, Human adenovirus B (HAdV-B)
ucaacgguggcuuccagca

SEQ ID NO: 1542449 - RNA, 21 nt, Human adenovirus B (HAdV-B)
ggcaacuccgacugcagcacu

SEQ ID NO: 1542450 - RNA, 13 nt, Human adenovirus B (HAdV-B)
gcaguggcagccu

SEQ ID NO: 1542451 - RNA, 15 nt, Human adenovirus B (HAdV-B)
cugaacgggggcgcc

SEQ ID NO: 1542452 - RNA, 13 nt, Human adenovirus B (HAdV-B)
aacuacauuuacg

SEQ ID NO: 1542453 - RNA, 17 nt, Human adenovirus B (HAdV-B)
cucgagcugccagugcg

SEQ ID NO: 1542454 - RNA, 21 nt, Human adenovirus B (HAdV-B)
aauacauacucuuacaaagug

SEQ ID NO: 1542455 - RNA, 15 nt, Human adenovirus B (HAdV-B)
ugacagaugcgcuug

SEQ ID NO: 1542456 - RNA, 20 nt, Human adenovirus B (HAdV-B)
caaugaggcuuucagagagg

SEQ ID NO: 1542457 - RNA, 12 nt, Human adenovirus B (HAdV-B)
aaucugcaacaa

SEQ ID NO: 1542458 - RNA, 21 nt, Human adenovirus B (HAdV-B)
ccgcccuaguguaccaggaaa

SEQ ID NO: 1542459 - RNA, 21 nt, Human adenovirus B (HAdV-B)
agggcugcgguccgaccugga

SEQ ID NO: 1542460 - RNA, 16 nt, Human adenovirus B (HAdV-B)
ccaggaacgucagcug

SEQ ID NO: 1542461 - RNA, 16 nt, Human adenovirus B (HAdV-B)
cccagaaauuggcccg

SEQ ID NO: 1542462 - RNA, 11 nt, Human adenovirus B (HAdV-B)
ucugugggguc

SEQ ID NO: 1542463 - RNA, 14 nt, Human adenovirus B (HAdV-B)
auaugugcagcaga

SEQ ID NO: 1542464 - RNA, 16 nt, Human adenovirus B (HAdV-B)
ugccauccuucucaac

SEQ ID NO: 1542465 - RNA, 18 nt, Human adenovirus B (HAdV-B)
ucccagggauuuggaaga

SEQ ID NO: 1542466 - RNA, 15 nt, Human adenovirus B (HAdV-B)
gcacgucuucaaccg

SEQ ID NO: 1542467 - RNA, 13 nt, Human adenovirus B (HAdV-B)
agagagaggauga

SEQ ID NO: 1542468 - RNA, 15 nt, Human adenovirus B (HAdV-B)
acacguuccgugggu

SEQ ID NO: 1542469 - RNA, 23 nt, Human adenovirus B (HAdV-B)
gccuggggacagguuaguguacg

SEQ ID NO: 1542470 - RNA, 19 nt, Human adenovirus B (HAdV-B)
ccucuucuccaguggagug

SEQ ID NO: 1542471 - RNA, 15 nt, Human adenovirus B (HAdV-B)
gaacagcaguacagg

SEQ ID NO: 1542472 - RNA, 22 nt, Human adenovirus B (HAdV-B)
agcaaaacgcggcccuggcaga

SEQ ID NO: 1542473 - RNA, 19 nt, Human adenovirus B (HAdV-B)
gcagcaauguuuagaagaa

SEQ ID NO: 1542474 - RNA, 22 nt, Human adenovirus B (HAdV-B)
cucacagaucacgggacccugc

SEQ ID NO: 1542475 - RNA, 14 nt, Human adenovirus B (HAdV-B)
aacaaagcuuggaa

SEQ ID NO: 1542476 - RNA, 14 nt, Human adenovirus B (HAdV-B)
cucgcuggccacau

SEQ ID NO: 1542477 - RNA, 14 nt, Human adenovirus B (HAdV-B)
uacuuuaaaauguu

SEQ ID NO: 1542478 - RNA, 18 nt, Human adenovirus B (HAdV-B)
ggcggaugacuggcagaa

SEQ ID NO: 1542479 - RNA, 19 nt, Human adenovirus B (HAdV-B)
ccaaaggaucccauccagg

SEQ ID NO: 1542480 - RNA, 16 nt, Human adenovirus B (HAdV-B)
gcgcugcgcuccaaca

SEQ ID NO: 1542481 - RNA, 20 nt, Human adenovirus B (HAdV-B)
acgcgcaugcgaaugcggag

SEQ ID NO: 1542482 - RNA, 22 nt, Human adenovirus B (HAdV-B)
gccuccgcgauaccuggcaccu

SEQ ID NO: 1542483 - RNA, 20 nt, Human adenovirus B (HAdV-B)
aacugguuagcugcacagcc

SEQ ID NO: 1542484 - RNA, 18 nt, Human adenovirus B (HAdV-B)
aucauggggauuacaagu

SEQ ID NO: 1542485 - RNA, 21 nt, Human adenovirus B (HAdV-B)
ccaucagcagacacaucacuu

SEQ ID NO: 1542486 - RNA, 22 nt, Human adenovirus B (HAdV-B)
caagcggguuaaaaaggacaaa

SEQ ID NO: 1542487 - RNA, 19 nt, Human adenovirus B (HAdV-B)
cuagucuuaaaccggucac

SEQ ID NO: 1542488 - RNA, 14 nt, Human adenovirus B (HAdV-B)
ccaccacaccacuc

SEQ ID NO: 1542489 - RNA, 20 nt, Human adenovirus B (HAdV-B)
uagaagcugcuacagcugcu

SEQ ID NO: 1542490 - RNA, 23 nt, Human adenovirus B (HAdV-B)
cauuagggguguguuggacagag

SEQ ID NO: 1542491 - RNA, 11 nt, Human adenovirus B (HAdV-B)
uccgaccuggc

SEQ ID NO: 1542492 - RNA, 16 nt, Human adenovirus B (HAdV-B)
gguuagcugcacagcc

SEQ ID NO: 1542493 - RNA, 22 nt, Human adenovirus B (HAdV-B)
gcagcagcuccuuuagccagag

SEQ ID NO: 1542494 - RNA, 14 nt, Human adenovirus B (HAdV-B)
ucgcuuccgaccug

SEQ ID NO: 1542495 - RNA, 21 nt, Human adenovirus B (HAdV-B)
uauuguuucccaucaacgcaa

SEQ ID NO: 1542496 - RNA, 17 nt, Human adenovirus B (HAdV-B)
cagucaggcagaggagg

SEQ ID NO: 1542497 - RNA, 14 nt, Human adenovirus B (HAdV-B)
gcugucucaacccc

SEQ ID NO: 1542498 - RNA, 12 nt, Human adenovirus B (HAdV-B)
ggugagugcaga

SEQ ID NO: 1542499 - RNA, 19 nt, Human adenovirus B (HAdV-B)
gcagccuagucgcagggcu

SEQ ID NO: 1542500 - RNA, 13 nt, Human adenovirus B (HAdV-B)
cacuugugcuggu

SEQ ID NO: 1542501 - RNA, 16 nt, Human adenovirus B (HAdV-B)
ugagaacaguaagaaa

SEQ ID NO: 1542502 - RNA, 22 nt, Human adenovirus B (HAdV-B)
aguucaaguacaaccacacucu

SEQ ID NO: 1542503 - RNA, 13 nt, Human adenovirus B (HAdV-B)
ccaguggaggagg

SEQ ID NO: 1542504 - RNA, 15 nt, Human adenovirus B (HAdV-B)
augacccgcaggcag

SEQ ID NO: 1542505 - RNA, 18 nt, Human adenovirus B (HAdV-B)
aaauuuaccugcauggug

SEQ ID NO: 1542506 - RNA, 14 nt, Human adenovirus B (HAdV-B)
cccccaaauuuaau

SEQ ID NO: 1542507 - RNA, 14 nt, Human adenovirus B (HAdV-B)
gcuguuucuggugg

SEQ ID NO: 1542508 - RNA, 21 nt, Human adenovirus B (HAdV-B)
aauggagugcuugaaagugac

SEQ ID NO: 1542509 - RNA, 23 nt, Human adenovirus B (HAdV-B)
aacgcuaccacguaagaagcuuc

SEQ ID NO: 1542510 - RNA, 13 nt, Human adenovirus B (HAdV-B)
auccccacuggag

SEQ ID NO: 1542511 - RNA, 19 nt, Human adenovirus B (HAdV-B)
accccuacggaagccagca

SEQ ID NO: 1542512 - RNA, 13 nt, Human adenovirus B (HAdV-B)
acacaucacuucc

SEQ ID NO: 1542513 - RNA, 17 nt, Human adenovirus B (HAdV-B)
caccuuuccuacucaca

SEQ ID NO: 1542514 - RNA, 13 nt, Human adenovirus B (HAdV-B)
cuucuccugggca

SEQ ID NO: 1542515 - RNA, 20 nt, Human adenovirus B (HAdV-B)
ccaggcauagcuuccguggc

SEQ ID NO: 1542516 - RNA, 14 nt, Human adenovirus B (HAdV-B)
gagugcuugaaagu

SEQ ID NO: 1542517 - RNA, 23 nt, Human adenovirus B (HAdV-B)
agugcaauguaauaaaaauaugu

SEQ ID NO: 1542518 - RNA, 17 nt, Human adenovirus B (HAdV-B)
ggugagugcagaggcau

SEQ ID NO: 1542519 - RNA, 17 nt, Human adenovirus B (HAdV-B)
acauaauuacacucuca

SEQ ID NO: 1542520 - RNA, 19 nt, Human adenovirus B (HAdV-B)
cugggaccugguucacgcu

SEQ ID NO: 1542521 - RNA, 23 nt, Human adenovirus B (HAdV-B)
ggcaaaguuuaaaacugaccccg

SEQ ID NO: 1542522 - RNA, 15 nt, Human adenovirus B (HAdV-B)
uuuuugaucacaaug

SEQ ID NO: 1542523 - RNA, 15 nt, Human adenovirus B (HAdV-B)
acacccuuguguccu

SEQ ID NO: 1542524 - RNA, 18 nt, Human adenovirus B (HAdV-B)
ccgcuuucgcagcggcga

SEQ ID NO: 1542525 - RNA, 16 nt, Human adenovirus B (HAdV-B)
accucaucuucccaga

SEQ ID NO: 1542526 - RNA, 13 nt, Human adenovirus B (HAdV-B)
gagcgugaugcag

SEQ ID NO: 1542527 - RNA, 13 nt, Human adenovirus B (HAdV-B)
cagcuguuggggu

SEQ ID NO: 1542528 - RNA, 19 nt, Human adenovirus B (HAdV-B)
uaugaagaugaaagcaccu

SEQ ID NO: 1542529 - RNA, 17 nt, Human adenovirus B (HAdV-B)
gacuugucuccugaacu

SEQ ID NO: 1542530 - RNA, 15 nt, Human adenovirus B (HAdV-B)
caaaaaagaagagga

SEQ ID NO: 1542531 - RNA, 19 nt, Human adenovirus B (HAdV-B)
ucacgcuugccagcacggu

SEQ ID NO: 1542532 - RNA, 14 nt, Human adenovirus B (HAdV-B)
aacgaagcuuggaa

SEQ ID NO: 1542533 - RNA, 16 nt, Human adenovirus B (HAdV-B)
acccgucaccuuggau

SEQ ID NO: 1542534 - RNA, 16 nt, Human adenovirus B (HAdV-B)
uugggacagucaggca

SEQ ID NO: 1542535 - RNA, 22 nt, Human adenovirus B (HAdV-B)
ccugcaacgaauuuucucccag

SEQ ID NO: 1542536 - RNA, 20 nt, Human adenovirus B (HAdV-B)
aaaaauuucccaaacaaugg

SEQ ID NO: 1542537 - RNA, 20 nt, Human adenovirus B (HAdV-B)
agugauguguucuauggcau

SEQ ID NO: 1542538 - RNA, 13 nt, Human adenovirus B (HAdV-B)
cccaucgaugcug

SEQ ID NO: 1542539 - RNA, 13 nt, Human adenovirus B (HAdV-B)
gggaaucaacccc

SEQ ID NO: 1542540 - RNA, 19 nt, Human adenovirus B (HAdV-B)
agcucauaggagcuggcuu

SEQ ID NO: 1542541 - RNA, 14 nt, Human adenovirus B (HAdV-B)
uaugagccagagca

SEQ ID NO: 1542542 - RNA, 18 nt, Human adenovirus B (HAdV-B)
aucuacguccacuggacg

SEQ ID NO: 1542543 - RNA, 15 nt, Human adenovirus B (HAdV-B)
acagcuggcagaacc

SEQ ID NO: 1542544 - RNA, 21 nt, Human adenovirus B (HAdV-B)
ugaaaccauuugguggcauga

SEQ ID NO: 1542545 - RNA, 16 nt, Human adenovirus B (HAdV-B)
caaucugggaccuggu

SEQ ID NO: 1542546 - RNA, 12 nt, Human adenovirus B (HAdV-B)
uguaucuggugg

SEQ ID NO: 1542547 - RNA, 17 nt, Human adenovirus B (HAdV-B)
ccuucgcggcuggccau

SEQ ID NO: 1542548 - RNA, 12 nt, Human adenovirus B (HAdV-B)
guuggggauacu

SEQ ID NO: 1542549 - RNA, 16 nt, Human adenovirus B (HAdV-B)
ccagacgccaccgagc

SEQ ID NO: 1542550 - RNA, 20 nt, Human adenovirus B (HAdV-B)
ucaacccggauuuuacaacc

SEQ ID NO: 1542551 - RNA, 16 nt, Human adenovirus B (HAdV-B)
gcggaggaggagagga

SEQ ID NO: 1542552 - RNA, 17 nt, Human adenovirus B (HAdV-B)
cagcacuggacaugaca

SEQ ID NO: 1542553 - RNA, 19 nt, Human adenovirus B (HAdV-B)
ugauuaacugccuuguaag

SEQ ID NO: 1542554 - RNA, 13 nt, Human adenovirus B (HAdV-B)
cuuagagauggaa

SEQ ID NO: 1542555 - RNA, 21 nt, Human adenovirus B (HAdV-B)
uucccgaacccaaccagcgcu

SEQ ID NO: 1542556 - RNA, 16 nt, Human adenovirus B (HAdV-B)
gcaggcgccucccagg

SEQ ID NO: 1542557 - RNA, 19 nt, Human adenovirus B (HAdV-B)
ugauauucuugagcaggcg

SEQ ID NO: 1542558 - RNA, 18 nt, Human adenovirus B (HAdV-B)
cggcgcccuggugcggca

SEQ ID NO: 1542559 - RNA, 18 nt, Human adenovirus B (HAdV-B)
cuacagcugcugcagaag

SEQ ID NO: 1542560 - RNA, 21 nt, Human adenovirus B (HAdV-B)
cgacgcaucucaugacaugca

SEQ ID NO: 1542561 - RNA, 22 nt, Human adenovirus B (HAdV-B)
ucgacgcaucucaugacaugca

SEQ ID NO: 1542562 - RNA, 23 nt, Human adenovirus B (HAdV-B)
ucaagagcaggaacugaaaauaa

SEQ ID NO: 1542563 - RNA, 12 nt, Human adenovirus B (HAdV-B)
uaaugccagacu

SEQ ID NO: 1542564 - RNA, 13 nt, Human adenovirus B (HAdV-B)
gcguuaagaggga

SEQ ID NO: 1542565 - RNA, 23 nt, Human adenovirus B (HAdV-B)
aauucuaacacuaguuaaaacug

SEQ ID NO: 1542566 - RNA, 20 nt, Human adenovirus B (HAdV-B)
cuaaggccauuugccauucu

SEQ ID NO: 1542567 - RNA, 19 nt, Human adenovirus B (HAdV-B)
uguaucgcaaugacagaau

SEQ ID NO: 1542568 - RNA, 24 nt, Human adenovirus B (HAdV-B)
cuggaauaggguaugagacgaugg

SEQ ID NO: 1542569 - RNA, 17 nt, Human adenovirus B (HAdV-B)
caucaguuaacgagaaa

SEQ ID NO: 1542570 - RNA, 20 nt, Human adenovirus B (HAdV-B)
cuaugggggcccuuacagac

SEQ ID NO: 1542571 - RNA, 19 nt, Human adenovirus B (HAdV-B)
auuuuugauauacccccua

SEQ ID NO: 1542572 - RNA, 21 nt, Human adenovirus B (HAdV-B)
aggccaugcaacguaucaugg

SEQ ID NO: 1542573 - RNA, 19 nt, Human adenovirus B (HAdV-B)
ccagcgguucuggaggagg

SEQ ID NO: 1542574 - RNA, 21 nt, Human adenovirus B (HAdV-B)
augccagcgguucuggaggag

SEQ ID NO: 1542575 - RNA, 21 nt, Human adenovirus B (HAdV-B)
gguggugcaacacagcagaga

SEQ ID NO: 1542576 - RNA, 21 nt, Human adenovirus B (HAdV-B)
uguuggacagaggucccaguu

SEQ ID NO: 1542577 - RNA, 12 nt, Human adenovirus B (HAdV-B)
uaucaaaugcuc

SEQ ID NO: 1542578 - RNA, 23 nt, Human adenovirus B (HAdV-B)
agacagucgcucauagucaagga

SEQ ID NO: 1542579 - RNA, 18 nt, Human adenovirus B (HAdV-B)
aaaaccugcugcuucucc

SEQ ID NO: 1542580 - RNA, 19 nt, Human adenovirus B (HAdV-B)
gacaauucucuagaaacuu

SEQ ID NO: 1542581 - RNA, 15 nt, Human adenovirus B (HAdV-B)
acggagggcagaaac

SEQ ID NO: 1542582 - RNA, 20 nt, Human adenovirus B (HAdV-B)
acucauguaguguacaaacc

SEQ ID NO: 1542583 - RNA, 23 nt, Human adenovirus B (HAdV-B)
cagcagcggcaguuagaaaauac

SEQ ID NO: 1542584 - RNA, 15 nt, Human adenovirus B (HAdV-B)
ugcuaaagguuucau

SEQ ID NO: 1542585 - RNA, 21 nt, Human adenovirus B (HAdV-B)
accuguagcgaauugagaaug

SEQ ID NO: 1542586 - RNA, 17 nt, Human adenovirus B (HAdV-B)
ucgcagcagcagcagca

SEQ ID NO: 1542587 - RNA, 17 nt, Human adenovirus B (HAdV-B)
ggaugacuggcagaacc

SEQ ID NO: 1542588 - RNA, 14 nt, Human adenovirus B (HAdV-B)
cagaggcuggucau

SEQ ID NO: 1542589 - RNA, 14 nt, Human adenovirus B (HAdV-B)
cgauggcugggcac

SEQ ID NO: 1542590 - RNA, 14 nt, Human adenovirus B (HAdV-B)
auucccacugaaag

SEQ ID NO: 1542591 - RNA, 18 nt, Human adenovirus B (HAdV-B)
gaugucucacgcuugcca

SEQ ID NO: 1542592 - RNA, 16 nt, Human adenovirus B (HAdV-B)
cagccgccgcccccag

SEQ ID NO: 1542593 - RNA, 21 nt, Human adenovirus B (HAdV-B)
aguaugcaaacacaugucacc

SEQ ID NO: 1542594 - RNA, 20 nt, Human adenovirus B (HAdV-B)
cuugcuggagugucacugcc

SEQ ID NO: 1542595 - RNA, 18 nt, Human adenovirus B (HAdV-B)
aucaccaagaugcuggaa

SEQ ID NO: 1542596 - RNA, 20 nt, Human adenovirus B (HAdV-B)
uaccuguuccgucuggccaa

SEQ ID NO: 1542597 - RNA, 13 nt, Human adenovirus B (HAdV-B)
ugaugcagcagca

SEQ ID NO: 1542598 - RNA, 18 nt, Human adenovirus B (HAdV-B)
ucaccccucgucaggcug

SEQ ID NO: 1542599 - RNA, 15 nt, Human adenovirus B (HAdV-B)
caugacagacagagg

SEQ ID NO: 1542600 - RNA, 17 nt, Human adenovirus B (HAdV-B)
gaagcguugauuacuuu

SEQ ID NO: 1542601 - RNA, 17 nt, Human adenovirus B (HAdV-B)
acagcuuuaaacauuug

SEQ ID NO: 1542602 - RNA, 20 nt, Human adenovirus B (HAdV-B)
ugaugcaauccccacuggag

SEQ ID NO: 1542603 - RNA, 22 nt, Human adenovirus B (HAdV-B)
acgagccugggaucauggggau

SEQ ID NO: 1542604 - RNA, 19 nt, Human adenovirus B (HAdV-B)
guucggcggugacaaguac

SEQ ID NO: 1542605 - RNA, 17 nt, Human adenovirus B (HAdV-B)
ucuccggaucuccuggg

SEQ ID NO: 1542606 - RNA, 18 nt, Human adenovirus B (HAdV-B)
uaacuuguuuauuugaaa

SEQ ID NO: 1542607 - RNA, 16 nt, Human adenovirus B (HAdV-B)
acucuugcuugacucu

SEQ ID NO: 1542608 - RNA, 21 nt, Human adenovirus B (HAdV-B)
acaucuagcaagacagucgcu

SEQ ID NO: 1542609 - RNA, 22 nt, Human adenovirus B (HAdV-B)
ugcuggacuugggugggagagg

SEQ ID NO: 1542610 - RNA, 18 nt, Human adenovirus B (HAdV-B)
caccucagaugucaccug

SEQ ID NO: 1542611 - RNA, 17 nt, Human adenovirus B (HAdV-B)
uggaggaggaacagcaa

SEQ ID NO: 1542612 - RNA, 14 nt, Human adenovirus B (HAdV-B)
uaugcucaggauca

SEQ ID NO: 1542613 - RNA, 13 nt, Human adenovirus B (HAdV-B)
cacgaggaagagu

SEQ ID NO: 1542614 - RNA, 14 nt, Human adenovirus B (HAdV-B)
uccaccagaacacc

SEQ ID NO: 1542615 - RNA, 19 nt, Human adenovirus B (HAdV-B)
ccagguuguaucuggugga

SEQ ID NO: 1542616 - RNA, 22 nt, Human adenovirus B (HAdV-B)
uggcaccuacggagggcagaaa

SEQ ID NO: 1542617 - RNA, 22 nt, Human adenovirus B (HAdV-B)
caaaguaaaaggcacaggagaa

SEQ ID NO: 1542618 - RNA, 17 nt, Human adenovirus B (HAdV-B)
cagccaugaggccacaa

SEQ ID NO: 1542619 - RNA, 21 nt, Human adenovirus B (HAdV-B)
gguugcaaucgcagugcaggg

SEQ ID NO: 1542620 - RNA, 19 nt, Human adenovirus B (HAdV-B)
cauauuuuuugaugcguuu

SEQ ID NO: 1542621 - RNA, 23 nt, Human adenovirus B (HAdV-B)
cagaaccuauuuagagacagaag

SEQ ID NO: 1542622 - RNA, 17 nt, Human adenovirus B (HAdV-B)
gugcaggagcggagccu

SEQ ID NO: 1542623 - RNA, 15 nt, Human adenovirus B (HAdV-B)
ugcggcaggcaugca

SEQ ID NO: 1542624 - RNA, 22 nt, Human adenovirus B (HAdV-B)
caaaugcucugcaaaagggaga

SEQ ID NO: 1542625 - RNA, 22 nt, Human adenovirus B (HAdV-B)
gaauugagaauggcaacaucaa

SEQ ID NO: 1542626 - RNA, 21 nt, Human adenovirus B (HAdV-B)
ccugauuacuucuuucagacu

SEQ ID NO: 1542627 - RNA, 17 nt, Human adenovirus B (HAdV-B)
gcgacaucggcacgagc

SEQ ID NO: 1542628 - RNA, 23 nt, Human adenovirus B (HAdV-B)
cugccaugcgagccgcaagagcu

SEQ ID NO: 1542629 - RNA, 12 nt, Human adenovirus B (HAdV-B)
gcauacuuucuc

SEQ ID NO: 1542630 - RNA, 12 nt, Human adenovirus B (HAdV-B)
ugcuugaaagug

SEQ ID NO: 1542631 - RNA, 15 nt, Human adenovirus B (HAdV-B)
ugaugcagcagcagc

SEQ ID NO: 1542632 - RNA, 19 nt, Human adenovirus B (HAdV-B)
agcaggauauuuugaaaua

SEQ ID NO: 1542633 - RNA, 19 nt, Human adenovirus B (HAdV-B)
cucaguacgauaccaccag

SEQ ID NO: 1542634 - RNA, 14 nt, Human adenovirus B (HAdV-B)
uucucccagcagca

SEQ ID NO: 1542635 - RNA, 17 nt, Human adenovirus B (HAdV-B)
aaucuucccaucaucgu

SEQ ID NO: 1542636 - RNA, 17 nt, Human adenovirus B (HAdV-B)
ugguguugcacaauauc

SEQ ID NO: 1542637 - RNA, 15 nt, Human adenovirus B (HAdV-B)
auauaaucugcaaca

SEQ ID NO: 1542638 - RNA, 21 nt, Human adenovirus B (HAdV-B)
acauagccuuuggguauaauu

SEQ ID NO: 1542639 - RNA, 13 nt, Human adenovirus B (HAdV-B)
caguacaggacag

SEQ ID NO: 1542640 - RNA, 23 nt, Human adenovirus B (HAdV-B)
aauaucuauaguggcacaacaua

SEQ ID NO: 1542641 - RNA, 14 nt, Human adenovirus B (HAdV-B)
acuuacuugaaauc

SEQ ID NO: 1542642 - RNA, 22 nt, Human adenovirus B (HAdV-B)
cuccacagcuuucuggucagcu

SEQ ID NO: 1542643 - RNA, 20 nt, Human adenovirus B (HAdV-B)
uauuugcaccacacuucugc

SEQ ID NO: 1542644 - RNA, 20 nt, Human adenovirus B (HAdV-B)
auucaaccugagguuaaagu

SEQ ID NO: 1542645 - RNA, 14 nt, Human adenovirus B (HAdV-B)
ugcaggcagcagcu

SEQ ID NO: 1542646 - RNA, 18 nt, Human adenovirus B (HAdV-B)
ccccagcagccaaggcga

SEQ ID NO: 1542647 - RNA, 17 nt, Human adenovirus B (HAdV-B)
cacagcaguagccacag

SEQ ID NO: 1542648 - RNA, 15 nt, Human adenovirus B (HAdV-B)
accagacaaaguaca

SEQ ID NO: 1542649 - RNA, 15 nt, Human adenovirus B (HAdV-B)
cuauccgcaagcaau

SEQ ID NO: 1542650 - RNA, 12 nt, Human adenovirus B (HAdV-B)
ugcgggacgagg

SEQ ID NO: 1542651 - RNA, 22 nt, Human adenovirus B (HAdV-B)
auuugugggauuugauggaagc

SEQ ID NO: 1542652 - RNA, 17 nt, Human adenovirus B (HAdV-B)
ccaucaguguggaagag

SEQ ID NO: 1542653 - RNA, 22 nt, Human adenovirus B (HAdV-B)
aaaccuggaacagaagacacaa

SEQ ID NO: 1542654 - RNA, 15 nt, Human adenovirus B (HAdV-B)
caggcgccucccagg

SEQ ID NO: 1542655 - RNA, 15 nt, Human adenovirus B (HAdV-B)
gugauagaaguucuu

SEQ ID NO: 1542656 - RNA, 13 nt, Human adenovirus B (HAdV-B)
auuaccaccccua

SEQ ID NO: 1542657 - RNA, 15 nt, Human adenovirus B (HAdV-B)
acagucaggcagagg

SEQ ID NO: 1542658 - RNA, 13 nt, Human adenovirus B (HAdV-B)
gcuggcuggucaa

SEQ ID NO: 1542659 - RNA, 17 nt, Human adenovirus B (HAdV-B)
gucauggaccaguuacu

SEQ ID NO: 1542660 - RNA, 19 nt, Human adenovirus B (HAdV-B)
ucccaguagguuuggaagu

SEQ ID NO: 1542661 - RNA, 14 nt, Human adenovirus B (HAdV-B)
accagcgcuuccaa

SEQ ID NO: 1542662 - RNA, 19 nt, Human adenovirus B (HAdV-B)
acuggauuuccugccacca

SEQ ID NO: 1542663 - RNA, 15 nt, Human adenovirus B (HAdV-B)
uucagaaacuuccag

SEQ ID NO: 1542664 - RNA, 19 nt, Human adenovirus B (HAdV-B)
uggcucuauaucucccaga

SEQ ID NO: 1542665 - RNA, 21 nt, Human adenovirus B (HAdV-B)
caagaacaaaagaauaccaaa

SEQ ID NO: 1542666 - RNA, 20 nt, Human adenovirus B (HAdV-B)
ggacugccccauggcauggg

SEQ ID NO: 1542667 - RNA, 15 nt, Human adenovirus B (HAdV-B)
cgcugucaaccugcc

SEQ ID NO: 1542668 - RNA, 12 nt, Human adenovirus B (HAdV-B)
gaauacaccaau

SEQ ID NO: 1542669 - RNA, 15 nt, Human adenovirus B (HAdV-B)
cugcuacgaagagcu

SEQ ID NO: 1542670 - RNA, 19 nt, Human adenovirus B (HAdV-B)
aacaccguuucuggggcgg

SEQ ID NO: 1542671 - RNA, 13 nt, Human adenovirus B (HAdV-B)
acaacaguagcaa

SEQ ID NO: 1542672 - RNA, 23 nt, Human adenovirus B (HAdV-B)
acccugauugcccgcgaagaagu

SEQ ID NO: 1542673 - RNA, 18 nt, Human adenovirus B (HAdV-B)
cuggcuuucauccaugga

SEQ ID NO: 1542674 - RNA, 16 nt, Human adenovirus B (HAdV-B)
uucucuagcagcagug

SEQ ID NO: 1542675 - RNA, 17 nt, Human adenovirus B (HAdV-B)
gaggcagucuaccugcg

SEQ ID NO: 1542676 - RNA, 14 nt, Human adenovirus B (HAdV-B)
cuacaaaacaugca

SEQ ID NO: 1542677 - RNA, 20 nt, Human adenovirus B (HAdV-B)
aucuagaccacugccgccgc

SEQ ID NO: 1542678 - RNA, 15 nt, Human adenovirus B (HAdV-B)
aagguccggcccacg

SEQ ID NO: 1542679 - RNA, 23 nt, Human adenovirus B (HAdV-B)
cagagcuuaagcauuccaccgcc

SEQ ID NO: 1542680 - RNA, 18 nt, Human adenovirus B (HAdV-B)
ggugaaauuaugugcauu

SEQ ID NO: 1542681 - RNA, 13 nt, Human adenovirus B (HAdV-B)
gcaggaggcgcaa

SEQ ID NO: 1542682 - RNA, 16 nt, Human adenovirus B (HAdV-B)
ucguuauccagccugu

SEQ ID NO: 1542683 - RNA, 15 nt, Human adenovirus B (HAdV-B)
ucccgacggugcugc

SEQ ID NO: 1542684 - RNA, 23 nt, Human adenovirus B (HAdV-B)
cuccuacggacugccgcuucuuc

SEQ ID NO: 1542685 - RNA, 18 nt, Human adenovirus B (HAdV-B)
cugccaaugcaaccaaua

SEQ ID NO: 1542686 - RNA, 19 nt, Human adenovirus B (HAdV-B)
ucaaaaacacacuacccac

SEQ ID NO: 1542687 - RNA, 23 nt, Human adenovirus B (HAdV-B)
cucugagcgccgcgacggcagga

SEQ ID NO: 1542688 - RNA, 16 nt, Human adenovirus B (HAdV-B)
ccggccggagccgcgg

SEQ ID NO: 1542689 - RNA, 23 nt, Human adenovirus B (HAdV-B)
ggugcaacacagcagagacaaug

SEQ ID NO: 1542690 - RNA, 15 nt, Human adenovirus B (HAdV-B)
gagacgcccaggccg

SEQ ID NO: 1542691 - RNA, 14 nt, Human adenovirus B (HAdV-B)
agccagcacccaga

SEQ ID NO: 1542692 - RNA, 14 nt, Human adenovirus B (HAdV-B)
gcuccauggggcgc

SEQ ID NO: 1542693 - RNA, 22 nt, Human adenovirus B (HAdV-B)
ccucggcugcguggccuuuggc

SEQ ID NO: 1542694 - RNA, 16 nt, Human adenovirus B (HAdV-B)
gguggacgagcagacc

SEQ ID NO: 1542695 - RNA, 14 nt, Human adenovirus B (HAdV-B)
acaauauuaacacc

SEQ ID NO: 1542696 - RNA, 23 nt, Human adenovirus B (HAdV-B)
cucaacacaagguucccucagga

SEQ ID NO: 1542697 - RNA, 12 nt, Human adenovirus B (HAdV-B)
cucaaaacucca

SEQ ID NO: 1542698 - RNA, 14 nt, Human adenovirus B (HAdV-B)
caugaaagccuuug

SEQ ID NO: 1542699 - RNA, 17 nt, Human adenovirus B (HAdV-B)
caacuucacauacaaca

SEQ ID NO: 1542700 - RNA, 16 nt, Human adenovirus B (HAdV-B)
gcgggcaaacacguuc

SEQ ID NO: 1542701 - RNA, 15 nt, Human adenovirus B (HAdV-B)
ccucaucuucccaga

SEQ ID NO: 1542702 - RNA, 16 nt, Human adenovirus B (HAdV-B)
auuucauagccacagc

SEQ ID NO: 1542703 - RNA, 18 nt, Human adenovirus B (HAdV-B)
aucuguggaguucuuauu

SEQ ID NO: 1542704 - RNA, 13 nt, Human adenovirus B (HAdV-B)
ccuaugcacuuuu

SEQ ID NO: 1542705 - RNA, 14 nt, Human adenovirus B (HAdV-B)
cuuggguugccacu

SEQ ID NO: 1542706 - RNA, 16 nt, Human adenovirus B (HAdV-B)
gccugcgucaucaccc

SEQ ID NO: 1542707 - RNA, 12 nt, Human adenovirus B (HAdV-B)
aucaaaacucca

SEQ ID NO: 1542708 - RNA, 19 nt, Human adenovirus B (HAdV-B)
uaauauugccaugcaggca

SEQ ID NO: 1542709 - RNA, 16 nt, Human adenovirus B (HAdV-B)
caggagcggagccugg

SEQ ID NO: 1542710 - RNA, 22 nt, Human adenovirus B (HAdV-B)
uagugcaggagcggagccuggg

SEQ ID NO: 1542711 - RNA, 14 nt, Human adenovirus B (HAdV-B)
uacucccagcagcu

SEQ ID NO: 1542712 - RNA, 17 nt, Human adenovirus B (HAdV-B)
ggacaaagcgugcugca

SEQ ID NO: 1542713 - RNA, 20 nt, Human adenovirus B (HAdV-B)
gguagaagaaccugacccca

SEQ ID NO: 1542714 - RNA, 17 nt, Human adenovirus B (HAdV-B)
ggcuugcuggaguguca

SEQ ID NO: 1542715 - RNA, 22 nt, Human adenovirus B (HAdV-B)
uggaagucuacccguuucuugu

SEQ ID NO: 1542716 - RNA, 22 nt, Human adenovirus B (HAdV-B)
ggauccuuagauaugugcagca

SEQ ID NO: 1542717 - RNA, 17 nt, Human adenovirus B (HAdV-B)
acucaagcgaagcaucg

SEQ ID NO: 1542718 - RNA, 20 nt, Human adenovirus B (HAdV-B)
gucgccguagacgcacaagc

SEQ ID NO: 1542719 - RNA, 19 nt, Human adenovirus B (HAdV-B)
cguacgagagcgugaugca

SEQ ID NO: 1542720 - RNA, 20 nt, Human adenovirus B (HAdV-B)
agcucugacuggagcuggaa

SEQ ID NO: 1542721 - RNA, 12 nt, Human adenovirus B (HAdV-B)
caguaucaucuu

SEQ ID NO: 1542722 - RNA, 16 nt, Human adenovirus B (HAdV-B)
uugugauuauucuuug

SEQ ID NO: 1542723 - RNA, 12 nt, Human adenovirus B (HAdV-B)
ccgaccuggcag

SEQ ID NO: 1542724 - RNA, 11 nt, Human adenovirus B (HAdV-B)
gcgcuccagcc

SEQ ID NO: 1542725 - RNA, 17 nt, Human adenovirus B (HAdV-B)
aguacaggacaggcgcu

SEQ ID NO: 1542726 - RNA, 22 nt, Human adenovirus B (HAdV-B)
ucuggcccaauugcaagccauc

SEQ ID NO: 1542727 - RNA, 13 nt, Human adenovirus B (HAdV-B)
cugcagagccagc

SEQ ID NO: 1542728 - RNA, 16 nt, Human adenovirus B (HAdV-B)
agucacugcuaccugu

SEQ ID NO: 1542729 - RNA, 17 nt, Human adenovirus B (HAdV-B)
gagcugacuugcagugg

SEQ ID NO: 1542730 - RNA, 11 nt, Human adenovirus B (HAdV-B)
acuccacagcu

SEQ ID NO: 1542731 - RNA, 17 nt, Human adenovirus B (HAdV-B)
agugcuugaaagugaca

SEQ ID NO: 1542732 - RNA, 21 nt, Human adenovirus B (HAdV-B)
cgguugagaugccuuucauga

SEQ ID NO: 1542733 - RNA, 14 nt, Human adenovirus B (HAdV-B)
ccaguuggaggauu

SEQ ID NO: 1542734 - RNA, 13 nt, Human adenovirus B (HAdV-B)
uucaauucaaaca

SEQ ID NO: 1542735 - RNA, 11 nt, Human adenovirus B (HAdV-B)
uuggaggagga

SEQ ID NO: 1542736 - RNA, 17 nt, Human adenovirus B (HAdV-B)
gguaaaucugagccaag

SEQ ID NO: 1542737 - RNA, 17 nt, Human adenovirus B (HAdV-B)
guuaugaaggaccacca

SEQ ID NO: 1542738 - RNA, 22 nt, Human adenovirus B (HAdV-B)
ucaacccggauuuuacaaccag

SEQ ID NO: 1542739 - RNA, 15 nt, Human adenovirus B (HAdV-B)
acuacuuucaaaacc

SEQ ID NO: 1542740 - RNA, 22 nt, Human adenovirus B (HAdV-B)
gcgccugcuugggcgcuugcca

SEQ ID NO: 1542741 - RNA, 22 nt, Human adenovirus B (HAdV-B)
gguaaauccaauccacacauua

SEQ ID NO: 1542742 - RNA, 15 nt, Human adenovirus B (HAdV-B)
aauaaguuuagaaau

SEQ ID NO: 1542743 - RNA, 18 nt, Human adenovirus B (HAdV-B)
ugaggaccaaucacagcc

SEQ ID NO: 1542744 - RNA, 20 nt, Human adenovirus B (HAdV-B)
agugcuggauauggccagca

SEQ ID NO: 1542745 - RNA, 17 nt, Human adenovirus B (HAdV-B)
guaugagacgaugggcg

SEQ ID NO: 1542746 - RNA, 13 nt, Human adenovirus B (HAdV-B)
uacaaggaagaaa

SEQ ID NO: 1542747 - RNA, 22 nt, Human adenovirus B (HAdV-B)
uuccaacaaccaguuacaaauc

SEQ ID NO: 1542748 - RNA, 23 nt, Human adenovirus B (HAdV-B)
ugaguuacuuucaagauggccac

SEQ ID NO: 1542749 - RNA, 18 nt, Human adenovirus B (HAdV-B)
cgauccagcagaccuccu

SEQ ID NO: 1542750 - RNA, 17 nt, Human adenovirus B (HAdV-B)
acaguauggugaacacc

SEQ ID NO: 1542751 - RNA, 12 nt, Human adenovirus B (HAdV-B)
cagaagcggcga

SEQ ID NO: 1542752 - RNA, 16 nt, Human adenovirus B (HAdV-B)
aauaauucuacaacuu

SEQ ID NO: 1542753 - RNA, 15 nt, Human adenovirus B (HAdV-B)
acaagcucuuacaga

SEQ ID NO: 1542754 - RNA, 19 nt, Human adenovirus B (HAdV-B)
gaacugauuaacugccuug

SEQ ID NO: 1542755 - RNA, 13 nt, Human adenovirus B (HAdV-B)
cggaugacuggca

SEQ ID NO: 1542756 - RNA, 18 nt, Human adenovirus B (HAdV-B)
cccgucuucucaaagagc

SEQ ID NO: 1542757 - RNA, 15 nt, Human adenovirus B (HAdV-B)
acuccguagccugga

SEQ ID NO: 1542758 - RNA, 17 nt, Human adenovirus B (HAdV-B)
gugcgcacccguccccc

SEQ ID NO: 1542759 - RNA, 16 nt, Human adenovirus B (HAdV-B)
gcugucucaaccccag

SEQ ID NO: 1542760 - RNA, 20 nt, Human adenovirus B (HAdV-B)
ggucgaaaacuucugucgcu

SEQ ID NO: 1542761 - RNA, 20 nt, Human adenovirus B (HAdV-B)
cuucccagagcgucucaggg

SEQ ID NO: 1542762 - RNA, 21 nt, Human adenovirus B (HAdV-B)
cgaguuaaugauauacgcgcc

SEQ ID NO: 1542763 - RNA, 22 nt, Human adenovirus B (HAdV-B)
caucggcuaucagggcuucuac

SEQ ID NO: 1542764 - RNA, 16 nt, Human adenovirus B (HAdV-B)
aaauuucuucuucacc

SEQ ID NO: 1542765 - RNA, 15 nt, Human adenovirus B (HAdV-B)
uugaaaaucaauuca

SEQ ID NO: 1542766 - RNA, 12 nt, Human adenovirus B (HAdV-B)
cucuucucuuuc

SEQ ID NO: 1542767 - RNA, 14 nt, Human adenovirus B (HAdV-B)
aaaagaaaaauuug

SEQ ID NO: 1542768 - RNA, 14 nt, Human adenovirus B (HAdV-B)
uggguagacagaau

SEQ ID NO: 1542769 - RNA, 16 nt, Human adenovirus B (HAdV-B)
cccgaacccaaccagc

SEQ ID NO: 1542770 - RNA, 15 nt, Human adenovirus B (HAdV-B)
guauaucgggcagga

SEQ ID NO: 1542771 - RNA, 18 nt, Human adenovirus B (HAdV-B)
uauuuccccaaauggcuu

SEQ ID NO: 1542772 - RNA, 14 nt, Human adenovirus B (HAdV-B)
agcaagggggccac

SEQ ID NO: 1542773 - RNA, 22 nt, Human adenovirus B (HAdV-B)
ggcaggaugucacuccacagcu

SEQ ID NO: 1542774 - RNA, 11 nt, Human adenovirus B (HAdV-B)
ugaaagagcuu

SEQ ID NO: 1542775 - RNA, 16 nt, Human adenovirus B (HAdV-B)
cgcaaaaaauggccug

SEQ ID NO: 1542776 - RNA, 22 nt, Human adenovirus B (HAdV-B)
gagcuuaagcauuccaccgccc

SEQ ID NO: 1542777 - RNA, 13 nt, Human adenovirus B (HAdV-B)
guagccaggucac

SEQ ID NO: 1542778 - RNA, 17 nt, Human adenovirus B (HAdV-B)
cauaaaugcaugcaucu

SEQ ID NO: 1542779 - RNA, 15 nt, Human adenovirus B (HAdV-B)
aaugaaaauaaacuu

SEQ ID NO: 1542780 - RNA, 16 nt, Human adenovirus B (HAdV-B)
ugguggaauuggaagg

SEQ ID NO: 1542781 - RNA, 17 nt, Human adenovirus B (HAdV-B)
ccacagggucuccagcu

SEQ ID NO: 1542782 - RNA, 14 nt, Human adenovirus B (HAdV-B)
ucuacuucaacccc

SEQ ID NO: 1542783 - RNA, 16 nt, Human adenovirus B (HAdV-B)
ccacaacgcacagccu

SEQ ID NO: 1542784 - RNA, 20 nt, Human adenovirus B (HAdV-B)
uauccagcuuuugcugugcc

SEQ ID NO: 1542785 - RNA, 16 nt, Human adenovirus B (HAdV-B)
augccuggaguguaua

SEQ ID NO: 1542786 - RNA, 19 nt, Human adenovirus B (HAdV-B)
gcacgguuugaccagugag

SEQ ID NO: 1542787 - RNA, 17 nt, Human adenovirus B (HAdV-B)
ccgccgcccccagaaga

SEQ ID NO: 1542788 - RNA, 20 nt, Human adenovirus B (HAdV-B)
cuggaggacagucuggagga

SEQ ID NO: 1542789 - RNA, 13 nt, Human adenovirus B (HAdV-B)
cccagcagccaag

SEQ ID NO: 1542790 - RNA, 14 nt, Human adenovirus B (HAdV-B)
uaugugcagcagag

SEQ ID NO: 1542791 - RNA, 15 nt, Human adenovirus B (HAdV-B)
ccauuugguggcaug

SEQ ID NO: 1542792 - RNA, 12 nt, Human adenovirus B (HAdV-B)
acucacaaacua

SEQ ID NO: 1542793 - RNA, 13 nt, Human adenovirus B (HAdV-B)
caccaaacugcuu

SEQ ID NO: 1542794 - RNA, 14 nt, Human adenovirus B (HAdV-B)
ccgcaggaccugcu

SEQ ID NO: 1542795 - RNA, 13 nt, Human adenovirus B (HAdV-B)
gcagaauaaaaaa

SEQ ID NO: 1542796 - RNA, 20 nt, Human adenovirus B (HAdV-B)
uggcacgucuaggugcgccu

SEQ ID NO: 1542797 - RNA, 20 nt, Human adenovirus B (HAdV-B)
uauugcuugaaagccugcug

SEQ ID NO: 1542798 - RNA, 20 nt, Human adenovirus B (HAdV-B)
ugccaucaucuccugcuugc

SEQ ID NO: 1542799 - RNA, 12 nt, Human adenovirus B (HAdV-B)
cucgacccagcc

SEQ ID NO: 1542800 - RNA, 11 nt, Human adenovirus B (HAdV-B)
acugcuggacu

SEQ ID NO: 1542801 - RNA, 14 nt, Human adenovirus B (HAdV-B)
auauuagauaaaug

SEQ ID NO: 1542802 - RNA, 21 nt, Human adenovirus B (HAdV-B)
ugcgggcggcgcugcagagcc

SEQ ID NO: 1542803 - RNA, 17 nt, Human adenovirus B (HAdV-B)
ugcagcagcagcaggcg

SEQ ID NO: 1542804 - RNA, 21 nt, Human adenovirus B (HAdV-B)
uuccuagaacagaaaggggga

SEQ ID NO: 1542805 - RNA, 23 nt, Human adenovirus B (HAdV-B)
uuagacagcaaccccaggccaac

SEQ ID NO: 1542806 - RNA, 15 nt, Human adenovirus B (HAdV-B)
cgagucgaggaaccc

SEQ ID NO: 1542807 - RNA, 14 nt, Human adenovirus B (HAdV-B)
ugcuauuccaccau

SEQ ID NO: 1542808 - RNA, 18 nt, Human adenovirus B (HAdV-B)
cgguaaaucugagccaag

SEQ ID NO: 1542809 - RNA, 19 nt, Human adenovirus B (HAdV-B)
acagcaguacaggacaggc

SEQ ID NO: 1542810 - RNA, 19 nt, Human adenovirus B (HAdV-B)
cguccuuucaagccgcacu

SEQ ID NO: 1542811 - RNA, 16 nt, Human adenovirus B (HAdV-B)
uaguuuaaaagagguu

SEQ ID NO: 1542812 - RNA, 20 nt, Human adenovirus B (HAdV-B)
cccuccgacuuugugccucu

SEQ ID NO: 1542813 - RNA, 18 nt, Human adenovirus B (HAdV-B)
gauagccccaauggccac

SEQ ID NO: 1542814 - RNA, 16 nt, Human adenovirus B (HAdV-B)
ucaccuccacagcccc

SEQ ID NO: 1542815 - RNA, 15 nt, Human adenovirus B (HAdV-B)
uaggcugauugccac

SEQ ID NO: 1542816 - RNA, 13 nt, Human adenovirus B (HAdV-B)
uucacuuccgcaa

SEQ ID NO: 1542817 - RNA, 17 nt, Human adenovirus B (HAdV-B)
augcacaugaucaucca

SEQ ID NO: 1542818 - RNA, 16 nt, Human adenovirus B (HAdV-B)
aagagacggaagaacc

SEQ ID NO: 1542819 - RNA, 14 nt, Human adenovirus B (HAdV-B)
cguucgcucaccag

SEQ ID NO: 1542820 - RNA, 22 nt, Human adenovirus B (HAdV-B)
gucgcgcuuugggacaggaaga

SEQ ID NO: 1542821 - RNA, 22 nt, Human adenovirus B (HAdV-B)
augcaucugcgccgcaggaggc

SEQ ID NO: 1542822 - RNA, 19 nt, Human adenovirus B (HAdV-B)
cagcaaccccaggccaacc

SEQ ID NO: 1542823 - RNA, 15 nt, Human adenovirus B (HAdV-B)
gcuguuucugguggu

SEQ ID NO: 1542824 - RNA, 17 nt, Human adenovirus B (HAdV-B)
cgagaaaaaacagccaa

SEQ ID NO: 1542825 - RNA, 20 nt, Human adenovirus B (HAdV-B)
aggggacugccccauggcau

SEQ ID NO: 1542826 - RNA, 16 nt, Human adenovirus B (HAdV-B)
ucaucuucccagagcg

SEQ ID NO: 1542827 - RNA, 21 nt, Human adenovirus B (HAdV-B)
cuccaacagaaaaccagcagc

SEQ ID NO: 1542828 - RNA, 22 nt, Human adenovirus B (HAdV-B)
cucuccaaccucuccacaauau

SEQ ID NO: 1542829 - RNA, 12 nt, Human adenovirus B (HAdV-B)
acuacacagcua

SEQ ID NO: 1542830 - RNA, 15 nt, Human adenovirus B (HAdV-B)
cauuuuaaugaauuu

SEQ ID NO: 1542831 - RNA, 12 nt, Human adenovirus B (HAdV-B)
agucuggaggaa

SEQ ID NO: 1542832 - RNA, 15 nt, Human adenovirus B (HAdV-B)
agucuggaggaagac

SEQ ID NO: 1542833 - RNA, 22 nt, Human adenovirus B (HAdV-B)
ugagcagcuaacccgauggcug

SEQ ID NO: 1542834 - RNA, 19 nt, Human adenovirus B (HAdV-B)
gggucuugugugggacgau

SEQ ID NO: 1542835 - RNA, 19 nt, Human adenovirus B (HAdV-B)
cguuccuaugaugaggugu

SEQ ID NO: 1542836 - RNA, 22 nt, Human adenovirus B (HAdV-B)
aacauguugguuggagccugag

SEQ ID NO: 1542837 - RNA, 14 nt, Human adenovirus B (HAdV-B)
cucuucuccagugg

SEQ ID NO: 1542838 - RNA, 14 nt, Human adenovirus B (HAdV-B)
agaauuucuacuga

SEQ ID NO: 1542839 - RNA, 20 nt, Human adenovirus B (HAdV-B)
uccuaugcacuuuuugcuuu

SEQ ID NO: 1542840 - RNA, 16 nt, Human adenovirus B (HAdV-B)
ugauuaaacaacagca

SEQ ID NO: 1542841 - RNA, 21 nt, Human adenovirus B (HAdV-B)
gaaugaaggcgaagcaagggu

SEQ ID NO: 1542842 - RNA, 18 nt, Human adenovirus B (HAdV-B)
aggacgccgaggcucucu

SEQ ID NO: 1542843 - RNA, 19 nt, Human adenovirus B (HAdV-B)
agccaaucaccacacgauc

SEQ ID NO: 1542844 - RNA, 12 nt, Human adenovirus B (HAdV-B)
ggauacaaagua

SEQ ID NO: 1542845 - RNA, 18 nt, Human adenovirus B (HAdV-B)
gaauggcagggaagugag

SEQ ID NO: 1542846 - RNA, 12 nt, Human adenovirus B (HAdV-B)
ucaacauccagg

SEQ ID NO: 1542847 - RNA, 21 nt, Human adenovirus B (HAdV-B)
uagcucauaggagcuggcuuu

SEQ ID NO: 1542848 - RNA, 19 nt, Human adenovirus B (HAdV-B)
uugggcgcuugccagggug

SEQ ID NO: 1542849 - RNA, 15 nt, Human adenovirus B (HAdV-B)
gagaugcgagcuucc

SEQ ID NO: 1542850 - RNA, 19 nt, Human adenovirus B (HAdV-B)
cucugggaugcaaaugcaa

SEQ ID NO: 1542851 - RNA, 18 nt, Human adenovirus B (HAdV-B)
ugaucuggacuuggaaga

SEQ ID NO: 1542852 - RNA, 17 nt, Human adenovirus B (HAdV-B)
ccaucagcgacggaugu

SEQ ID NO: 1542853 - RNA, 19 nt, Human adenovirus B (HAdV-B)
cauccgaguaucaucacuu

SEQ ID NO: 1542854 - RNA, 16 nt, Human adenovirus B (HAdV-B)
caaggucgcagugcau

SEQ ID NO: 1542855 - RNA, 16 nt, Human adenovirus B (HAdV-B)
ccuucuccggaucucc

SEQ ID NO: 1542856 - RNA, 13 nt, Human adenovirus B (HAdV-B)
aggagucaacccc

SEQ ID NO: 1542857 - RNA, 12 nt, Human adenovirus B (HAdV-B)
acccaaccagcg

SEQ ID NO: 1542858 - RNA, 21 nt, Human adenovirus B (HAdV-B)
ucagcugcaaagcuccaagca

SEQ ID NO: 1542859 - RNA, 18 nt, Human adenovirus B (HAdV-B)
aucgaaguugcuggaaau

SEQ ID NO: 1542860 - RNA, 16 nt, Human adenovirus B (HAdV-B)
ugcggaggaggagagg

SEQ ID NO: 1542861 - RNA, 14 nt, Human adenovirus B (HAdV-B)
uaagggaaaugcca

SEQ ID NO: 1542862 - RNA, 17 nt, Human adenovirus B (HAdV-B)
gaagacaguuuggagga

SEQ ID NO: 1542863 - RNA, 12 nt, Human adenovirus B (HAdV-B)
gccccagcagcc

SEQ ID NO: 1542864 - RNA, 15 nt, Human adenovirus B (HAdV-B)
uguugaaaugggcau

SEQ ID NO: 1542865 - RNA, 18 nt, Human adenovirus B (HAdV-B)
accgcuuuccugagaacc

SEQ ID NO: 1542866 - RNA, 21 nt, Human adenovirus B (HAdV-B)
cagcaguacaggacaggcgcu

SEQ ID NO: 1542867 - RNA, 14 nt, Human adenovirus B (HAdV-B)
uuucuacacgggcg

SEQ ID NO: 1542868 - RNA, 13 nt, Human adenovirus B (HAdV-B)
aaaauguugaaau

SEQ ID NO: 1542869 - RNA, 15 nt, Human adenovirus B (HAdV-B)
ucgccaacuacaaca

SEQ ID NO: 1542870 - RNA, 15 nt, Human adenovirus B (HAdV-B)
gacuccuucaacccu

SEQ ID NO: 1542871 - RNA, 21 nt, Human adenovirus B (HAdV-B)
agcuguguacucccagcagcu

SEQ ID NO: 1542872 - RNA, 12 nt, Human adenovirus B (HAdV-B)
uguguagaugcc

SEQ ID NO: 1542873 - RNA, 19 nt, Human adenovirus B (HAdV-B)
ccaugcgagccgcaagagc

SEQ ID NO: 1542874 - RNA, 22 nt, Human adenovirus B (HAdV-B)
caggccucuucuccaguggagu

SEQ ID NO: 1542875 - RNA, 17 nt, Human adenovirus B (HAdV-B)
uuaugcucaggaucaca

SEQ ID NO: 1542876 - RNA, 20 nt, Human adenovirus B (HAdV-B)
uacccuguggugggugcaga

SEQ ID NO: 1542877 - RNA, 16 nt, Human adenovirus B (HAdV-B)
cugacacuccuggucc

SEQ ID NO: 1542878 - RNA, 17 nt, Human adenovirus B (HAdV-B)
caucuagaccacugccg

SEQ ID NO: 1542879 - RNA, 12 nt, Human adenovirus B (HAdV-B)
agaggaauguuu

SEQ ID NO: 1542880 - RNA, 17 nt, Human adenovirus B (HAdV-B)
uaccaacacaacaacuc

SEQ ID NO: 1542881 - RNA, 13 nt, Human adenovirus B (HAdV-B)
gcggagcagagca

SEQ ID NO: 1542882 - RNA, 23 nt, Human adenovirus B (HAdV-B)
caucauuucccuuacaugcauau

SEQ ID NO: 1542883 - RNA, 13 nt, Human adenovirus B (HAdV-B)
guuauuagaugcu

SEQ ID NO: 1542884 - RNA, 17 nt, Human adenovirus B (HAdV-B)
augauauucuugagcag

SEQ ID NO: 1542885 - RNA, 18 nt, Human adenovirus B (HAdV-B)
augccagcgguucuggag

SEQ ID NO: 1542886 - RNA, 11 nt, Human adenovirus B (HAdV-B)
gauucugggga

SEQ ID NO: 1542887 - RNA, 14 nt, Human adenovirus B (HAdV-B)
gucucugaagaaau

SEQ ID NO: 1542888 - RNA, 11 nt, Human adenovirus B (HAdV-B)
aauuaaaugac

SEQ ID NO: 1542889 - RNA, 15 nt, Human adenovirus B (HAdV-B)
aauuggcuccagcaa

SEQ ID NO: 1542890 - RNA, 20 nt, Human adenovirus B (HAdV-B)
gaaggcgauaaugccagacu

SEQ ID NO: 1542891 - RNA, 15 nt, Human adenovirus B (HAdV-B)
aacaucauugaagag

SEQ ID NO: 1542892 - RNA, 21 nt, Human adenovirus B (HAdV-B)
ccggauuuuacaaccagaaga

SEQ ID NO: 1542893 - RNA, 12 nt, Human adenovirus B (HAdV-B)
gagcagacagua

SEQ ID NO: 1542894 - RNA, 23 nt, Human adenovirus B (HAdV-B)
uuacuagucucgcaacucugacu

SEQ ID NO: 1542895 - RNA, 20 nt, Human adenovirus B (HAdV-B)
ggcaacuccgacugcagcac

SEQ ID NO: 1542896 - RNA, 16 nt, Human adenovirus B (HAdV-B)
augggacgagaccgga

SEQ ID NO: 1542897 - RNA, 19 nt, Human adenovirus B (HAdV-B)
uccuagcaaggacaacauc

SEQ ID NO: 1542898 - RNA, 12 nt, Human adenovirus B (HAdV-B)
gaugagcaucac

SEQ ID NO: 1542899 - RNA, 15 nt, Human adenovirus B (HAdV-B)
cagcagacacaucac

SEQ ID NO: 1542900 - RNA, 15 nt, Human adenovirus B (HAdV-B)
gagacgagccuggga

SEQ ID NO: 1542901 - RNA, 19 nt, Human adenovirus B (HAdV-B)
agacgaugggcguccagcg

SEQ ID NO: 1542902 - RNA, 12 nt, Human adenovirus B (HAdV-B)
guauaaugaggc

SEQ ID NO: 1542903 - RNA, 16 nt, Human adenovirus B (HAdV-B)
guugcuaacgcuggag

SEQ ID NO: 1542904 - RNA, 18 nt, Human adenovirus B (HAdV-B)
cuauucaaccuguagaaa

SEQ ID NO: 1542905 - RNA, 20 nt, Human adenovirus B (HAdV-B)
ccagcagcaccucacuuccc

SEQ ID NO: 1542906 - RNA, 19 nt, Human adenovirus B (HAdV-B)
cuauaggcucaaacugcac

SEQ ID NO: 1542907 - RNA, 16 nt, Human adenovirus B (HAdV-B)
ggacagucaggcagag

SEQ ID NO: 1542908 - RNA, 18 nt, Human adenovirus B (HAdV-B)
cccagggauuuggaagag

SEQ ID NO: 1542909 - RNA, 23 nt, Human adenovirus B (HAdV-B)
cuacacacagaaauauaaauuuu

SEQ ID NO: 1542910 - RNA, 14 nt, Human adenovirus B (HAdV-B)
cuccgacugcagca

SEQ ID NO: 1542911 - RNA, 12 nt, Human adenovirus B (HAdV-B)
auucacuggaac

SEQ ID NO: 1542912 - RNA, 17 nt, Human adenovirus B (HAdV-B)
cuagagagagaggauga

SEQ ID NO: 1542913 - RNA, 17 nt, Human adenovirus B (HAdV-B)
aucgaaguugcuggaaa

SEQ ID NO: 1542914 - RNA, 18 nt, Human adenovirus B (HAdV-B)
acgaucgcgguggggcgg

SEQ ID NO: 1542915 - RNA, 12 nt, Human adenovirus B (HAdV-B)
agugcaggagcg

SEQ ID NO: 1542916 - RNA, 17 nt, Human adenovirus B (HAdV-B)
cuaaaauugucauguau

SEQ ID NO: 1542917 - RNA, 19 nt, Human adenovirus B (HAdV-B)
gauccagauauucaaccug

SEQ ID NO: 1542918 - RNA, 16 nt, Human adenovirus B (HAdV-B)
ggacaggaagacacug

SEQ ID NO: 1542919 - RNA, 13 nt, Human adenovirus B (HAdV-B)
cagcgaccgcgcu

SEQ ID NO: 1542920 - RNA, 14 nt, Human adenovirus B (HAdV-B)
uacggaagccagca

SEQ ID NO: 1542921 - RNA, 17 nt, Human adenovirus B (HAdV-B)
cucccgacggugcugca

SEQ ID NO: 1542922 - RNA, 17 nt, Human adenovirus B (HAdV-B)
uagacagaauggagugc

SEQ ID NO: 1542923 - RNA, 12 nt, Human adenovirus B (HAdV-B)
acaacuuacacu

SEQ ID NO: 1542924 - RNA, 18 nt, Human adenovirus B (HAdV-B)
ccugcugcuucucccagg

SEQ ID NO: 1542925 - RNA, 15 nt, Human adenovirus B (HAdV-B)
acaccuacgacuaca

SEQ ID NO: 1542926 - RNA, 18 nt, Human adenovirus B (HAdV-B)
uaaacacacccucauaau

SEQ ID NO: 1542927 - RNA, 16 nt, Human adenovirus B (HAdV-B)
uacuaaggguugcauu

SEQ ID NO: 1542928 - RNA, 23 nt, Human adenovirus B (HAdV-B)
ugaugaagcauacaauccagaca

SEQ ID NO: 1542929 - RNA, 22 nt, Human adenovirus B (HAdV-B)
cuggaaauggggcugagguggu

SEQ ID NO: 1542930 - RNA, 17 nt, Human adenovirus B (HAdV-B)
ugagcggagacggcuug

SEQ ID NO: 1542931 - RNA, 12 nt, Human adenovirus B (HAdV-B)
gucuccaugagu

SEQ ID NO: 1542932 - RNA, 13 nt, Human adenovirus B (HAdV-B)
cucggcugcggag

SEQ ID NO: 1542933 - RNA, 16 nt, Human adenovirus B (HAdV-B)
ccgcuuuuccagaagc

SEQ ID NO: 1542934 - RNA, 12 nt, Human adenovirus B (HAdV-B)
ccaaaucagaaa

SEQ ID NO: 1542935 - RNA, 22 nt, Human
aagagucgcugugccacaggcu

SEQ ID NO: 1542936 - RNA, 15 nt, Human
aagagucgcugugcc

SEQ ID NO: 1542937 - RNA, 19 nt, Human
accacgggcccggguuggg

SEQ ID NO: 1542938 - RNA, 13 nt, Human
agcaucuaucaga

SEQ ID NO: 1542939 - RNA, 21 nt, Human
agggacaggaccccagcucug

SEQ ID NO: 1542940 - RNA, 17 nt, Human
gccggccaguggccuuc

SEQ ID NO: 1542941 - RNA, 17 nt, Human
gccaccccgagggcuga

SEQ ID NO: 1542942 - RNA, 23 nt, Human
gccaccccgagggcugagccugg

SEQ ID NO: 1542943 - RNA, 16 nt, Human
gccaccccgagggcug

SEQ ID NO: 1542944 - RNA, 13 nt, Human
ggaccccagcucu

SEQ ID NO: 1542945 - RNA, 15 nt, Human
ggaccccagcucugc

SEQ ID NO: 1542946 - RNA, 12 nt, Human
ggaccccagcuc

SEQ ID NO: 1542947 - RNA, 17 nt, Human
aaaagcuggauuuucuu

SEQ ID NO: 1542948 - RNA, 18 nt, Human
gaccucgugccaccccga

SEQ ID NO: 1542949 - RNA, 20 nt, Human
gagggcugagccugguccca

SEQ ID NO: 1542950 - RNA, 20 nt, Human
cuuauuagaaaaauauuaua

SEQ ID NO: 1542951 - RNA, 15 nt, Human
cuggaugcccaggaa

SEQ ID NO: 1542952 - RNA, 14 nt, Human
cuggaugcccagga

SEQ ID NO: 1542953 - RNA, 13 nt, Human
cuggaugcccagg

SEQ ID NO: 1542954 - RNA, 16 nt, Human
cuggaugcccaggaau

SEQ ID NO: 1542955 - RNA, 14 nt, Human
cuggaugauauuuu

SEQ ID NO: 1542956 - RNA, 11 nt, Human
cuggugcccug

SEQ ID NO: 1542957 - RNA, 15 nt, Human
cugcagccugcagga

SEQ ID NO: 1542958 - RNA, 19 nt, Human
cugcagccugcaggaccuc

SEQ ID NO: 1542959 - RNA, 14 nt, Human
cugcagccugcagg

SEQ ID NO: 1542960 - RNA, 12 nt, Human
cugcagccugca

SEQ ID NO: 1542961 - RNA, 21 nt, Human
cucgugccaccccgagggcug

SEQ ID NO: 1542962 - RNA, 13 nt, Human
ccuuccccagcau

SEQ ID NO: 1542963 - RNA, 12 nt, Human
ccuuccccagca

SEQ ID NO: 1542964 - RNA, 14 nt, Human
cuaagucauucaua

SEQ ID NO: 1542965 - RNA, 16 nt, Human
cccugacagggccagu

SEQ ID NO: 1542966 - RNA, 13 nt, Human
cccugacagggcc

SEQ ID NO: 1542967 - RNA, 16 nt, Human
cccuggaugcccagga

SEQ ID NO: 1542968 - RNA, 15 nt, Human
cccuggaugcccagg

SEQ ID NO: 1542969 - RNA, 19 nt, Human
cccagcaugcaccacgggc

SEQ ID NO: 1542970 - RNA, 23 nt, Human
cccagcaugcaccacgggcccgg

SEQ ID NO: 1542971 - RNA, 15 nt, Human
ccagacggggcugga

SEQ ID NO: 1542972 - RNA, 15 nt, Human
ccagaucaaggaugu

SEQ ID NO: 1542973 - RNA, 18 nt, Human
ccagacuugggaggaugu

SEQ ID NO: 1542974 - RNA, 15 nt, Human
caggaccccagcucu

SEQ ID NO: 1542975 - RNA, 14 nt, Human
caggaccccagcuc

SEQ ID NO: 1542976 - RNA, 13 nt, Human
caggaccccagcu

SEQ ID NO: 1542977 - RNA, 12 nt, Human
caggaccccagc

SEQ ID NO: 1542978 - RNA, 18 nt, Human
caggaccucgugccaccc

SEQ ID NO: 1542979 - RNA, 17 nt, Human
caggaccucgugccacc

SEQ ID NO: 1542980 - RNA, 14 nt, Human
cauuuguuguuuga

SEQ ID NO: 1542981 - RNA, 16 nt, Human
aacauuugcugucagc

SEQ ID NO: 1542982 - RNA, 23 nt, Human
gugccguguccccugacagggcc

SEQ ID NO: 1542983 - RNA, 22 nt, Human
gugccguguccccugacagggc

SEQ ID NO: 1542984 - RNA, 18 nt, Human
uaguuuugugaaggugau

SEQ ID NO: 1542985 - RNA, 12 nt, Human
accauuauuuuu

SEQ ID NO: 1542986 - RNA, 16 nt, Human
accagacggggcugga

SEQ ID NO: 1542987 - RNA, 21 nt, Human
accagacggggcuggagugug

SEQ ID NO: 1542988 - RNA, 15 nt, Human
accagacggggcugg

SEQ ID NO: 1542989 - RNA, 14 nt, Human
accagacggggcug

SEQ ID NO: 1542990 - RNA, 18 nt, Human
acaguugcuguuguguga

SEQ ID NO: 1542991 - RNA, 23 nt, Human
accucgugccaccccgagggcug

SEQ ID NO: 1542992 - RNA, 19 nt, Human
accucgugccaccccgagg

SEQ ID NO: 1542993 - RNA, 17 nt, Human
acgggcccggguugggu

SEQ ID NO: 1542994 - RNA, 16 nt, Human
acgggcccggguuggg

SEQ ID NO: 1542995 - RNA, 21 nt, Human
acgggcccggguugggucacc

SEQ ID NO: 1542996 - RNA, 20 nt, Human
acgggcccggguugggucac

SEQ ID NO: 1542997 - RNA, 16 nt, Human
ucgguccuggugcccu

SEQ ID NO: 1542998 - RNA, 13 nt, Human
ucgguccuggugc

SEQ ID NO: 1542999 - RNA, 15 nt, Human
acuuauagauugaaa

SEQ ID NO: 1543000 - RNA, 19 nt, Human
acuugaauaaccaucugaa

SEQ ID NO: 1543001 - RNA, 20 nt, Human
acuugaauaaccaucugaaa

SEQ ID NO: 1543002 - RNA, 15 nt, Human
agagucuccauuuaa

SEQ ID NO: 1543003 - RNA, 18 nt, Human
aggagccgaagcccaggg

SEQ ID NO: 1543004 - RNA, 16 nt, Human
aggagccgaagcccag

SEQ ID NO: 1543005 - RNA, 21 nt, Human
uggagugugaggguccugcag

SEQ ID NO: 1543006 - RNA, 13 nt, Human
agggaggcagggg

SEQ ID NO: 1543007 - RNA, 20 nt, Human
uggggccaugccuccucagg

SEQ ID NO: 1543008 - RNA, 21 nt, Human
uggggccaugccuccucagga

SEQ ID NO: 1543009 - RNA, 19 nt, Human
uggggccaugccuccucag

SEQ ID NO: 1543010 - RNA, 14 nt, Human
uggggccaugccuc

SEQ ID NO: 1543011 - RNA, 23 nt, Human
aggggugcggcggucccagcucc

SEQ ID NO: 1543012 - RNA, 21 nt, Human
aggggugcggcggucccagcu

SEQ ID NO: 1543013 - RNA, 20 nt, Human
aggggugcggcggucccagc

SEQ ID NO: 1543014 - RNA, 22 nt, Human
aggggugcggcggucccagcuc

SEQ ID NO: 1543015 - RNA, 18 nt, Human
aggugauauuuuucuuau

SEQ ID NO: 1543016 - RNA, 19 nt, Human
uggugcccuggaugcccag

SEQ ID NO: 1543017 - RNA, 14 nt, Human
uguaguaucucaua

SEQ ID NO: 1543018 - RNA, 21 nt, Human
agucucaugccuugagaucug

SEQ ID NO: 1543019 - RNA, 19 nt, Human
agucucaugccuugagauc

SEQ ID NO: 1543020 - RNA, 16 nt, Human
ugugccacaggcuuag

SEQ ID NO: 1543021 - RNA, 12 nt, Human
ugugccacaggc

SEQ ID NO: 1543022 - RNA, 20 nt, Human
uuuacuucuaagucauucau

SEQ ID NO: 1543023 - RNA, 23 nt, Human
uuuaggauguguauuucauuuau

SEQ ID NO: 1543024 - RNA, 12 nt, Human
uuuuugauauau

SEQ ID NO: 1543025 - RNA, 16 nt, Human
auuauaaaguuuucua

SEQ ID NO: 1543026 - RNA, 13 nt, Human
auuauaaaguuuu

SEQ ID NO: 1543027 - RNA, 16 nt, Human
auuauaacucauuugu

SEQ ID NO: 1543028 - RNA, 21 nt, Human
uuugacacuuauagauugaaa

SEQ ID NO: 1543029 - RNA, 18 nt, Human
uuuuccaaucauuugacu

SEQ ID NO: 1543030 - RNA, 16 nt, Human
caccagacggggcugg

SEQ ID NO: 1543031 - RNA, 17 nt, Human
caccagacggggcugga

SEQ ID NO: 1543032 - RNA, 21 nt, Human
ccacaggcuuagggacaggac

SEQ ID NO: 1543033 - RNA, 19 nt, Human
ccacaggcuuagggacagg

SEQ ID NO: 1543034 - RNA, 18 nt, Human
ccacaggcuuagggacag

SEQ ID NO: 1543035 - RNA, 15 nt, Human
ccacaggcuuaggga

SEQ ID NO: 1543036 - RNA, 15 nt, Human
ccaugccuccucagg

SEQ ID NO: 1543037 - RNA, 12 nt, Human
cccaggggccgg

SEQ ID NO: 1543038 - RNA, 16 nt, Human
cccaggugauauuuuu

SEQ ID NO: 1543039 - RNA, 9 nt, Human
cccagcucc

SEQ ID NO: 1543040 - RNA, 19 nt, Human
ccccaggagggaggcaggg

SEQ ID NO: 1543041 - RNA, 18 nt, Human
ccccaggagggaggcagg

SEQ ID NO: 1543042 - RNA, 22 nt, Human
ccgagggcugagccugguccca

SEQ ID NO: 1543043 - RNA, 16 nt, Human
ccgagggcugagccug

SEQ ID NO: 1543044 - RNA, 13 nt, Human
ccgagggcugagc

SEQ ID NO: 1543045 - RNA, 16 nt, Human
ccugaagaacuauuuu

SEQ ID NO: 1543046 - RNA, 21 nt, Human
cgggcaggguguggggccaug

SEQ ID NO: 1543047 - RNA, 15 nt, Human
cgucgguccuggugc

SEQ ID NO: 1543048 - RNA, 24 nt, Human
cuuacuugcauaccaaguugauac

SEQ ID NO: 1543049 - RNA, 18 nt, Human
gacagggccagugcaguu

SEQ ID NO: 1543050 - RNA, 19 nt, Human
gaauaaucaaauacauuuu

SEQ ID NO: 1543051 - RNA, 16 nt, Human
gaagcccaggggccgg

SEQ ID NO: 1543052 - RNA, 19 nt, Human
gcaagcucuuuuauaugcu

SEQ ID NO: 1543053 - RNA, 15 nt, Human
gcaugcaccacgggc

SEQ ID NO: 1543054 - RNA, 14 nt, Human
gcaugcaccacggg

SEQ ID NO: 1543055 - RNA, 15 nt, Human
gcaccacgggcccgg

SEQ ID NO: 1543056 - RNA, 13 nt, Human
gcagccugcagga

SEQ ID NO: 1543057 - RNA, 16 nt, Human
gcagccugcaggaccu

SEQ ID NO: 1543058 - RNA, 15 nt, Human
gcaggaccucgugcc

SEQ ID NO: 1543059 - RNA, 22 nt, Human
gcggucccagcucccuggcucc

SEQ ID NO: 1543060 - RNA, 18 nt, Human
gcggucccagcucccugg

SEQ ID NO: 1543061 - RNA, 14 nt, Human
gcggucccagcucc

SEQ ID NO: 1543062 - RNA, 13 nt, Human
gcggucccagcuc

SEQ ID NO: 1543063 - RNA, 23 nt, Human
gccugcaggaccucgugccaccc

SEQ ID NO: 1543064 - RNA, 18 nt, Human
gccugcaggaccucgugc

SEQ ID NO: 1543065 - RNA, 17 nt, Human
gccugcaggaccucgug

SEQ ID NO: 1543066 - RNA, 13 nt, Human
gccugcaggaccu

SEQ ID NO: 1543067 - RNA, 17 nt, Human
gccgggcaggguguggg

SEQ ID NO: 1543068 - RNA, 19 nt, Human
ggagccgaagcccaggggc

SEQ ID NO: 1543069 - RNA, 17 nt, Human
ggagccgaagcccaggg

SEQ ID NO: 1543070 - RNA, 15 nt, Human
ggagccgaagcccag

SEQ ID NO: 1543071 - RNA, 22 nt, Human
ggagccgaagcccaggggccgg

SEQ ID NO: 1543072 - RNA, 11 nt, Human
ggcugagccug

SEQ ID NO: 1543073 - RNA, 19 nt, Human
ggucaccagacggggcugg

SEQ ID NO: 1543074 - RNA, 21 nt, Human
gggugcggcggucccagcucc

SEQ ID NO: 1543075 - RNA, 22 nt, Human
ggggugcggcggucccagcucc

SEQ ID NO: 1543076 - RNA, 20 nt, Human
uacuugaauaaccaucugaa

SEQ ID NO: 1543077 - RNA, 18 nt, Human
uacuugaauaaccaucug

SEQ ID NO: 1543078 - RNA, 16 nt, Human
uacagaaauauccaug

SEQ ID NO: 1543079 - RNA, 16 nt, Human
uaagagguugauuaua

SEQ ID NO: 1543080 - RNA, 14 nt, Human
guuuucuaaauuua

SEQ ID NO: 1543081 - RNA, 22 nt, Human
uccuggugcccuggaugcccag

SEQ ID NO: 1543082 - RNA, 13 nt, Human
uccuggugcccug

SEQ ID NO: 1543083 - RNA, 12 nt, Human
uccuggugcccu

SEQ ID NO: 1543084 - RNA, 18 nt, Human
ugccaccccgagggcuga

SEQ ID NO: 1543085 - RNA, 17 nt, Human
ugccaccccgagggcug

SEQ ID NO: 1543086 - RNA, 13 nt, Human
uggaugcccagga

SEQ ID NO: 1543087 - RNA, 14 nt, Human
uggaugcccaggaa

SEQ ID NO: 1543088 - RNA, 19 nt, Human
uggaugauauuuuuuauca

SEQ ID NO: 1543089 - RNA, 14 nt, Human
uguguaguuccagc

SEQ ID NO: 1543090 - RNA, 15 nt, Human
uguuguuuuuggaug

SEQ ID NO: 1543091 - RNA, 23 nt, Human
uguggggccaugccuccucagga

SEQ ID NO: 1543092 - RNA, 17 nt, Human
ugugaggguccugcagc

SEQ ID NO: 1543093 - RNA, 22 nt, Human
uuccccagcaugcaccacgggc

SEQ ID NO: 1543094 - RNA, 14 nt, Human
uuugauauaugaaa

SEQ ID NO: 1543095 - RNA, 21 nt, Human
ggccaugccuccucaggagcc

SEQ ID NO: 1543096 - RNA, 18 nt, Human
ggccaugccuccucagga

SEQ ID NO: 1543097 - RNA, 17 nt, Human
ggccaugccuccucagg

SEQ ID NO: 1543098 - RNA, 22 nt, Human
ggccaguggccuuccccagcau

SEQ ID NO: 1543099 - RNA, 19 nt, Human
ggccaguggccuuccccag

SEQ ID NO: 1543100 - RNA, 22 nt, Human
gggacaggaccccagcucugcg

SEQ ID NO: 1543101 - RNA, 21 nt, Human
gggacaggaccccagcucugc

SEQ ID NO: 1543102 - RNA, 19 nt, Human
gggacaggaccccagcucu

SEQ ID NO: 1543103 - RNA, 17 nt, Human
gggacaggaccccagcu

SEQ ID NO: 1543104 - RNA, 15 nt, Human
gggacaggaccccag

SEQ ID NO: 1543105 - RNA, 22 nt, Human
gggccaugccuccucaggagcc

SEQ ID NO: 1543106 - RNA, 23 nt, Human
gggccaugccuccucaggagccg

SEQ ID NO: 1543107 - RNA, 13 nt, Human
gggccaugccucc

SEQ ID NO: 1543108 - RNA, 13 nt, Human
gguccuggugccc

SEQ ID NO: 1543109 - RNA, 12 nt, Human
gguccuggugcc

SEQ ID NO: 1543110 - RNA, 24 nt, Human
gguccuggugcccuggaugcccag

SEQ ID NO: 1543111 - RNA, 14 nt, Human
gguccuggugcccu

SEQ ID NO: 1543112 - RNA, 21 nt, Human
gcuggagugugaggguccugc

SEQ ID NO: 1543113 - RNA, 15 nt, Human
gcuggagugugaggg

SEQ ID NO: 1543114 - RNA, 13 nt, Human
gcugugccacagg

SEQ ID NO: 1543115 - RNA, 19 nt, Human
gcugugccacaggcuuagg

SEQ ID NO: 1543116 - RNA, 20 nt, Human
gcugugccacaggcuuaggg

SEQ ID NO: 1543117 - RNA, 15 nt, Human
gcugugccacaggcu

SEQ ID NO: 1543118 - RNA, 14 nt, Human
gcugugccacaggc

SEQ ID NO: 1543119 - RNA, 21 nt, Human
gccaguggccuuccccagcau

SEQ ID NO: 1543120 - RNA, 17 nt, Human
cuucuaagucauucaua

SEQ ID NO: 1543121 - RNA, 17 nt, Human
cuccgccuuaccaggag

SEQ ID NO: 1543122 - RNA, 22 nt, Human
cucugcgucgguccuggugccc

SEQ ID NO: 1543123 - RNA, 21 nt, Human
cucugcgucgguccuggugcc

SEQ ID NO: 1543124 - RNA, 20 nt, Human
cucugcgucgguccuggugc

SEQ ID NO: 1543125 - RNA, 19 nt, Human
cucugcgucgguccuggug

SEQ ID NO: 1543126 - RNA, 19 nt, Human
cggcggucccagcucccug

SEQ ID NO: 1543127 - RNA, 16 nt, Human
cggcggucccagcucc

SEQ ID NO: 1543128 - RNA, 15 nt, Human
cggcggucccagcuc

SEQ ID NO: 1543129 - RNA, 18 nt, Human
ccugcaggaccucgugcc

SEQ ID NO: 1543130 - RNA, 17 nt, Human
ccugcaggaccucgugc

SEQ ID NO: 1543131 - RNA, 19 nt, Human
ccugcagccugcaggaccu

SEQ ID NO: 1543132 - RNA, 22 nt, Human
ccaugucaagagucgcugugcc

SEQ ID NO: 1543133 - RNA, 21 nt, Human
cagccugcaggaccucgugcc

SEQ ID NO: 1543134 - RNA, 12 nt, Human
cagccugcagga

SEQ ID NO: 1543135 - RNA, 18 nt, Human
gugccaccccgagggcug

SEQ ID NO: 1543136 - RNA, 15 nt, Human
gugaggguccugcag

SEQ ID NO: 1543137 - RNA, 14 nt, Human
gugaggguccugca

SEQ ID NO: 1543138 - RNA, 23 nt, Human
gugaggguccugcagccugcagg

SEQ ID NO: 1543139 - RNA, 24 nt, Human
gugaggguccugcagccugcagga

SEQ ID NO: 1543140 - RNA, 11 nt, Human
aaauuguguua

SEQ ID NO: 1543141 - RNA, 23 nt, Human
guguggggccaugccuccucagg

SEQ ID NO: 1543142 - RNA, 14 nt, Human
guguauuucauuua

SEQ ID NO: 1543143 - RNA, 19 nt, Human
guggccuuccccagcaugc

SEQ ID NO: 1543144 - RNA, 21 nt, Human
guggccuuccccagcaugcac

SEQ ID NO: 1543145 - RNA, 18 nt, Human
guggccuuccccagcaug

SEQ ID NO: 1543146 - RNA, 17 nt, Human
guggccuuccccagcau

SEQ ID NO: 1543147 - RNA, 21 nt, Human
guggggccaugccuccucagg

SEQ ID NO: 1543148 - RNA, 22 nt, Human
guggggccaugccuccucagga

SEQ ID NO: 1543149 - RNA, 15 nt, Human
aagcccaggggccgg

SEQ ID NO: 1543150 - RNA, 18 nt, Human
uaccauuauuuuuaggau

SEQ ID NO: 1543151 - RNA, 20 nt, Human
aauuacuuacguauguuugu

SEQ ID NO: 1543152 - RNA, 15 nt, Human
uauaacucauuuguu

SEQ ID NO: 1543153 - RNA, 17 nt, Human
uagaaacauguaauccu

SEQ ID NO: 1543154 - RNA, 14 nt, Human
acgagggugccgug

SEQ ID NO: 1543155 - RNA, 15 nt, Human
uccccugacagggcc

SEQ ID NO: 1543156 - RNA, 12 nt, Human
uccccugacagg

SEQ ID NO: 1543157 - RNA, 11 nt, Human
accccagcucu

SEQ ID NO: 1543158 - RNA, 16 nt, Human
ucgcugugccacaggc

SEQ ID NO: 1543159 - RNA, 20 nt, Human
acuugaucauuuuuaccauu

SEQ ID NO: 1543160 - RNA, 20 nt, Human
agaaauuacuaauuuuacuu

SEQ ID NO: 1543161 - RNA, 17 nt, Human
agaauaaucaaauacau

SEQ ID NO: 1543162 - RNA, 20 nt, Human
ugaaaaagcuggauuuucuu

SEQ ID NO: 1543163 - RNA, 12 nt, Human
agauuuuguugg

SEQ ID NO: 1543164 - RNA, 22 nt, Human
ugaccccaggagggaggcaggg

SEQ ID NO: 1543165 - RNA, 20 nt, Human
ugaccccaggagggaggcag

SEQ ID NO: 1543166 - RNA, 17 nt, Human
agccacauauugagaug

SEQ ID NO: 1543167 - RNA, 17 nt, Human
ugaucaaacaugucucu

SEQ ID NO: 1543168 - RNA, 19 nt, Human
ugauauuuuuuaucauaaa

SEQ ID NO: 1543169 - RNA, 17 nt, Human
ugauauuuuuuaucaua

SEQ ID NO: 1543170 - RNA, 14 nt, Human
ugaguagucucaug

SEQ ID NO: 1543171 - RNA, 17 nt, Human
ugcagccugcaggaccu

SEQ ID NO: 1543172 - RNA, 18 nt, Human
ugcagccugcaggaccuc

SEQ ID NO: 1543173 - RNA, 22 nt, Human
agccuggucccacgagggugcc

SEQ ID NO: 1543174 - RNA, 17 nt, Human
ugcggcggucccagcuc

SEQ ID NO: 1543175 - RNA, 14 nt, Human
ugcggcggucccag

SEQ ID NO: 1543176 - RNA, 13 nt, Human
ugcggcgguccca

SEQ ID NO: 1543177 - RNA, 18 nt, Human
ugcggcggucccagcucc

SEQ ID NO: 1543178 - RNA, 15 nt, Human
uggccuuccccagca

SEQ ID NO: 1543179 - RNA, 23 nt, Human
uggccuuccccagcaugcaccac

SEQ ID NO: 1543180 - RNA, 13 nt, Human
uggccuuccccag

SEQ ID NO: 1543181 - RNA, 23 nt, Human
aggguguggggccaugccuccuc

SEQ ID NO: 1543182 - RNA, 22 nt, Human
aggguguggggccaugccuccu

SEQ ID NO: 1543183 - RNA, 19 nt, Human
ugucaagagucgcugugcc

SEQ ID NO: 1543184 - RNA, 17 nt, Human
ugucaagagucgcugug

SEQ ID NO: 1543185 - RNA, 15 nt, Human
aguuagaacauuugc

SEQ ID NO: 1543186 - RNA, 16 nt, Human
uuacaggcacuaaagu

SEQ ID NO: 1543187 - RNA, 16 nt, Human
auaaccaucugaaagu

SEQ ID NO: 1543188 - RNA, 21 nt, Human
auaaucccuggaugauauuuu

SEQ ID NO: 1543189 - RNA, 20 nt, Human
auaaucccuggaugauauuu

SEQ ID NO: 1543190 - RNA, 22 nt, Human
uuagggacaggaccccagcucu

SEQ ID NO: 1543191 - RNA, 21 nt, Human
uuagggacaggaccccagcuc

SEQ ID NO: 1543192 - RNA, 20 nt, Human
auaguucccaggugauauuu

SEQ ID NO: 1543193 - RNA, 18 nt, Human
uuaguuuugugaagguga

SEQ ID NO: 1543194 - RNA, 13 nt, Human
uugaaauuuccua

SEQ ID NO: 1543195 - RNA, 14 nt, Human
uuccuuuuuuugau

SEQ ID NO: 1543196 - RNA, 17 nt, Human
uuuaagcaaguuaagug

SEQ ID NO: 1543197 - RNA, 16 nt, Human
uuuaagcaaguuaagu

SEQ ID NO: 1543198 - RNA, 14 nt, Human
auggccgggcaggg

SEQ ID NO: 1543199 - RNA, 22 nt, Human
uuggaugguguuacauauuaua

SEQ ID NO: 1543200 - RNA, 23 nt, Human
aguugauacuugaauaaccaucu

SEQ ID NO: 1543201 - RNA, 17 nt, Human
aguggccuuccccagca

SEQ ID NO: 1543202 - RNA, 18 nt, Human
aguggccuuccccagcau

SEQ ID NO: 1543203 - RNA, 13 nt, Human
agggacuuagcaa

SEQ ID NO: 1543204 - RNA, 21 nt, Human
aggguccugcagccugcagga

SEQ ID NO: 1543205 - RNA, 19 nt, Human
aggguccugcagccugcag

SEQ ID NO: 1543206 - RNA, 17 nt, Human
aggguccugcagccugc

SEQ ID NO: 1543207 - RNA, 16 nt, Human
aggguccugcagccug

SEQ ID NO: 1543208 - RNA, 23 nt, Human
aggcuuagggacaggaccccagc

SEQ ID NO: 1543209 - RNA, 21 nt, Human
aacuuacuugcauaccaaguu

SEQ ID NO: 1543210 - RNA, 17 nt, Human
acagggccagugcaguu

SEQ ID NO: 1543211 - RNA, 22 nt, Human
accaucugaaagugguacuuga

SEQ ID NO: 1543212 - RNA, 22 nt, Human
caagagucgcugugccacaggc

SEQ ID NO: 1543213 - RNA, 19 nt, Human
caagagucgcugugccaca

SEQ ID NO: 1543214 - RNA, 16 nt, Human
ccaugccuccucagga

SEQ ID NO: 1543215 - RNA, 17 nt, Human
cccacgagggugccgug

SEQ ID NO: 1543216 - RNA, 12 nt, Human
cccagcucugcg

SEQ ID NO: 1543217 - RNA, 11 nt, Human
cccagcucugc

SEQ ID NO: 1543218 - RNA, 22 nt, Human
ccagcucugcgucgguccuggu

SEQ ID NO: 1543219 - RNA, 17 nt, Human
ccagugcuuuauguugu

SEQ ID NO: 1543220 - RNA, 15 nt, Human
caugccuccucagga

SEQ ID NO: 1543221 - RNA, 19 nt, Human
cauagaaaacacuacagug

SEQ ID NO: 1543222 - RNA, 19 nt, Human
caguggccuuccccagcau

SEQ ID NO: 1543223 - RNA, 17 nt, Human
caguggccuuccccagc

SEQ ID NO: 1543224 - RNA, 18 nt, Human
caguggccuuccccagca

SEQ ID NO: 1543225 - RNA, 22 nt, Human
cggccaguggccuuccccagca

SEQ ID NO: 1543226 - RNA, 12 nt, Human
cggucccagcuc

SEQ ID NO: 1543227 - RNA, 13 nt, Human
cggucccagcucc

SEQ ID NO: 1543228 - RNA, 13 nt, Human
cgguccuggugcc

SEQ ID NO: 1543229 - RNA, 19 nt, Human
cgugccaccccgagggcug

SEQ ID NO: 1543230 - RNA, 22 nt, Human
cgugccaccccgagggcugagc

SEQ ID NO: 1543231 - RNA, 15 nt, Human
cgugccaccccgagg

SEQ ID NO: 1543232 - RNA, 12 nt, Human
cugacagggcca

SEQ ID NO: 1543233 - RNA, 17 nt, Human
cugacagggccagugca

SEQ ID NO: 1543234 - RNA, 12 nt, Human
cugagccugguc

SEQ ID NO: 1543235 - RNA, 19 nt, Human
cuggucccacgagggugcc

SEQ ID NO: 1543236 - RNA, 17 nt, Human
cuggucccacgagggug

SEQ ID NO: 1543237 - RNA, 14 nt, Human
cuggucccacgagg

SEQ ID NO: 1543238 - RNA, 19 nt, Human
gaaauuacuaauuuuacuu

SEQ ID NO: 1543239 - RNA, 20 nt, Human
gaaauuuccuaauuuauucu

SEQ ID NO: 1543240 - RNA, 20 nt, Human
gaaauuacuaauuuuacuuc

SEQ ID NO: 1543241 - RNA, 16 nt, Human
gaaggugauuuauucu

SEQ ID NO: 1543242 - RNA, 20 nt, Human
gacaugggugaacuuacuug

SEQ ID NO: 1543243 - RNA, 14 nt, Human
gaccccagcucugc

SEQ ID NO: 1543244 - RNA, 12 nt, Human
gaccccagcucu

SEQ ID NO: 1543245 - RNA, 15 nt, Human
gagccgaagcccagg

SEQ ID NO: 1543246 - RNA, 14 nt, Human
gagccgaagcccag

SEQ ID NO: 1543247 - RNA, 15 nt, Human
gccaugccuccucag

SEQ ID NO: 1543248 - RNA, 18 nt, Human
gccguguccccugacagg

SEQ ID NO: 1543249 - RNA, 13 nt, Human
gccgaagcccagg

SEQ ID NO: 1543250 - RNA, 12 nt, Human
gccuccucagga

SEQ ID NO: 1543251 - RNA, 15 nt, Human
gccuccucaggagcc

SEQ ID NO: 1543252 - RNA, 15 nt, Human
gcgucgguccuggug

SEQ ID NO: 1543253 - RNA, 18 nt, Human
uuuuggaugguguuacau

SEQ ID NO: 1543254 - RNA, 15 nt, Human
uuuucuaaauuuauc

SEQ ID NO: 1543255 - RNA, 13 nt, Human
uuuuuugauauau

SEQ ID NO: 1543256 - RNA, 13 nt, Human
uuugaauaugaaa

SEQ ID NO: 1543257 - RNA, 15 nt, Human
guauguuuguacuug

SEQ ID NO: 1543258 - RNA, 16 nt, Human
gucaccagacggggcu

SEQ ID NO: 1543259 - RNA, 17 nt, Human
gucaccagacggggcug

SEQ ID NO: 1543260 - RNA, 17 nt, Human
gucgcugugccacaggc

SEQ ID NO: 1543261 - RNA, 18 nt, Human
gucgguccuggugcccug

SEQ ID NO: 1543262 - RNA, 17 nt, Human
gucgguccuggugcccu

SEQ ID NO: 1543263 - RNA, 15 nt, Human
gucgguccuggugcc

SEQ ID NO: 1543264 - RNA, 14 nt, Human
gugauauuuuucuu

SEQ ID NO: 1543265 - RNA, 22 nt, Human
gugcggcggucccagcucccug

SEQ ID NO: 1543266 - RNA, 19 nt, Human
gugcggcggucccagcucc

SEQ ID NO: 1543267 - RNA, 18 nt, Human
gugcggcggucccagcuc

SEQ ID NO: 1543268 - RNA, 21 nt, Human
gugcaguuugguguguccucc

SEQ ID NO: 1543269 - RNA, 14 nt, Human
gugguacuugauca

SEQ ID NO: 1543270 - RNA, 16 nt, Human
guggugaccccaggag

SEQ ID NO: 1543271 - RNA, 18 nt, Human
guggugaccccaggaggg

SEQ ID NO: 1543272 - RNA, 23 nt, Human
guguuacuagccucaaaauacau

SEQ ID NO: 1543273 - RNA, 18 nt, Human
guguccccugacagggcc

SEQ ID NO: 1543274 - RNA, 21 nt, Human
guguggggccaugccuccuca

SEQ ID NO: 1543275 - RNA, 20 nt, Human
guuacauauuauauguucua

SEQ ID NO: 1543276 - RNA, 21 nt, Human
uaaagaaaaguuuaccaucug

SEQ ID NO: 1543277 - RNA, 15 nt, Human
uaaaguuaguaaaga

SEQ ID NO: 1543278 - RNA, 22 nt, Human
uaagugguucuuugguuccagu

SEQ ID NO: 1543279 - RNA, 18 nt, Human
uaagucauucauaaaccu

SEQ ID NO: 1543280 - RNA, 14 nt, Human
uacagcuccuuuga

SEQ ID NO: 1543281 - RNA, 20 nt, Human
uacagcuccuuugaaaacuc

SEQ ID NO: 1543282 - RNA, 18 nt, Human
uccagcaaaucaagcuga

SEQ ID NO: 1543283 - RNA, 18 nt, Human
ucccacgagggugccgug

SEQ ID NO: 1543284 - RNA, 18 nt, Human
uccuccgccuuaccagga

SEQ ID NO: 1543285 - RNA, 16 nt, Human
ugcgucgguccuggug

SEQ ID NO: 1543286 - RNA, 17 nt, Human
ugcuaaaggagcaucua

SEQ ID NO: 1543287 - RNA, 21 nt, Human
uguccuccgccuuaccaggag

SEQ ID NO: 1543288 - RNA, 13 nt, Human
uuaaauauuuagu

SEQ ID NO: 1543289 - RNA, 21 nt, Human
uuaagagguugauuauaaagu

SEQ ID NO: 1543290 - RNA, 15 nt, Human
uuaagcaaguuaagu

SEQ ID NO: 1543291 - RNA, 22 nt, Human
ggccagugcaguuugguguguc

SEQ ID NO: 1543292 - RNA, 16 nt, Human
ggggccggccaguggc

SEQ ID NO: 1543293 - RNA, 16 nt, Human
gguccugcagccugca

SEQ ID NO: 1543294 - RNA, 15 nt, Human
gguccugcagccugc

SEQ ID NO: 1543295 - RNA, 15 nt, Human
aaauauuauaacuca

SEQ ID NO: 1543296 - RNA, 17 nt, Human
ggacaggaccccagcuc

SEQ ID NO: 1543297 - RNA, 16 nt, Human
ggacaggaccccagcu

SEQ ID NO: 1543298 - RNA, 15 nt, Human
ggacaggaccccagc

SEQ ID NO: 1543299 - RNA, 14 nt, Human
ggacaggaccccag

SEQ ID NO: 1543300 - RNA, 20 nt, Human
ggacaggaccccagcucugc

SEQ ID NO: 1543301 - RNA, 18 nt, Human
ggacaggaccccagcucu

SEQ ID NO: 1543302 - RNA, 21 nt, Human
ggacaggaccccagcucugcg

SEQ ID NO: 1543303 - RNA, 22 nt, Human
cuuagggacaggaccccagcuc

SEQ ID NO: 1543304 - RNA, 21 nt, Human
cuuagggacaggaccccagcu

SEQ ID NO: 1543305 - RNA, 23 nt, Human
cuuagggacaggaccccagcucu

SEQ ID NO: 1543306 - RNA, 20 nt, Human
cuuagggacaggaccccagc

SEQ ID NO: 1543307 - RNA, 18 nt, Human
cuuagggacaggacccca

SEQ ID NO: 1543308 - RNA, 18 nt, Human
cguguccccugacagggc

SEQ ID NO: 1543309 - RNA, 16 nt, Human
cguguccccugacagg

SEQ ID NO: 1543310 - RNA, 19 nt, Human
cguguccccugacagggcc

SEQ ID NO: 1543311 - RNA, 14 nt, Human
ccccgagggcugag

SEQ ID NO: 1543312 - RNA, 21 nt, Human
ccccgagggcugagccugguc

SEQ ID NO: 1543313 - RNA, 19 nt, Human
ccccgagggcugagccugg

SEQ ID NO: 1543314 - RNA, 16 nt, Human
ccccugacagggccag

SEQ ID NO: 1543315 - RNA, 17 nt, Human
ccgaagcccaggggccg

SEQ ID NO: 1543316 - RNA, 16 nt, Human
ccgaagcccaggggcc

SEQ ID NO: 1543317 - RNA, 15 nt, Human
ccgaagcccaggggc

SEQ ID NO: 1543318 - RNA, 14 nt, Human
ccuggaugcccagg

SEQ ID NO: 1543319 - RNA, 17 nt, Human
caggaccccagcucugc

SEQ ID NO: 1543320 - RNA, 16 nt, Human
caggaccccagcucug

SEQ ID NO: 1543321 - RNA, 18 nt, Human
caggaccccagcucugcg

SEQ ID NO: 1543322 - RNA, 21 nt, Human
caggagggaggcaggggaggg

SEQ ID NO: 1543323 - RNA, 15 nt, Human
caggagggaggcagg

SEQ ID NO: 1543324 - RNA, 22 nt, Human
caggguguggggccaugccucc

SEQ ID NO: 1543325 - RNA, 17 nt, Human
caggguguggggccaug

SEQ ID NO: 1543326 - RNA, 16 nt, Human
caggguguggggccau

SEQ ID NO: 1543327 - RNA, 22 nt, Human
cagugcaguuugguguguccuc

SEQ ID NO: 1543328 - RNA, 16 nt, Human
ccacgagggugccgug

SEQ ID NO: 1543329 - RNA, 21 nt, Human
caugucaagagucgcugugcc

SEQ ID NO: 1543330 - RNA, 19 nt, Human
caugucaagagucgcugug

SEQ ID NO: 1543331 - RNA, 14 nt, Human
caugcaccacgggc

SEQ ID NO: 1543332 - RNA, 18 nt, Human
cacaggcuuagggacagg

SEQ ID NO: 1543333 - RNA, 22 nt, Human
cacaggcuuagggacaggaccc

SEQ ID NO: 1543334 - RNA, 19 nt, Human
cacaggcuuagggacagga

SEQ ID NO: 1543335 - RNA, 14 nt, Human
guccugcagccugc

SEQ ID NO: 1543336 - RNA, 18 nt, Human
guccugcagccugcagga

SEQ ID NO: 1543337 - RNA, 10 nt, Human
guccugcagc

SEQ ID NO: 1543338 - RNA, 16 nt, Human
aagaaaaguuuaccau

SEQ ID NO: 1543339 - RNA, 21 nt, Human
aagauguagcgcuuugaauau

SEQ ID NO: 1543340 - RNA, 17 nt, Human
gugugaggguccugcag

SEQ ID NO: 1543341 - RNA, 14 nt, Human
aaguuuaccaucug

SEQ ID NO: 1543342 - RNA, 19 nt, Human
aaguuagaacauuugcugu

SEQ ID NO: 1543343 - RNA, 24 nt, Human
guuuuuggaugguguuacauauua

SEQ ID NO: 1543344 - RNA, 12 nt, Human
aaggagcaucua

SEQ ID NO: 1543345 - RNA, 21 nt, Human
guugggucaccagacggggcu

SEQ ID NO: 1543346 - RNA, 14 nt, Human
guugggucaccaga

SEQ ID NO: 1543347 - RNA, 22 nt, Human
aauuuacccucuugaauauaau

SEQ ID NO: 1543348 - RNA, 19 nt, Human
aauuuacccucuugaauau

SEQ ID NO: 1543349 - RNA, 17 nt, Human
aauuuaucaguaccuaa

SEQ ID NO: 1543350 - RNA, 19 nt, Human
uauagauugaaauuuccua

SEQ ID NO: 1543351 - RNA, 16 nt, Human
uauggccgggcagggu

SEQ ID NO: 1543352 - RNA, 13 nt, Human
uauuucauuuauu

SEQ ID NO: 1543353 - RNA, 18 nt, Human
ucauuugacuaagagucu

SEQ ID NO: 1543354 - RNA, 18 nt, Human
accgacguugccaucaaa

SEQ ID NO: 1543355 - RNA, 13 nt, Human
uccugcagccugc

SEQ ID NO: 1543356 - RNA, 11 nt, Human
ugagccugguc

SEQ ID NO: 1543357 - RNA, 19 nt, Human
ugaggguccugcagccugc

SEQ ID NO: 1543358 - RNA, 18 nt, Human
ugaggguccugcagccug

SEQ ID NO: 1543359 - RNA, 15 nt, Human
ugaggguccugcagc

SEQ ID NO: 1543360 - RNA, 14 nt, Human
ugaggguccugcag

SEQ ID NO: 1543361 - RNA, 22 nt, Human
ugaggguccugcagccugcagg

SEQ ID NO: 1543362 - RNA, 21 nt, Human
ugaggguccugcagccugcag

SEQ ID NO: 1543363 - RNA, 23 nt, Human
ugaggguccugcagccugcagga

SEQ ID NO: 1543364 - RNA, 14 nt, Human
agagucgcugugcc

SEQ ID NO: 1543365 - RNA, 19 nt, Human
agagucgcugugccacagg

SEQ ID NO: 1543366 - RNA, 15 nt, Human
agagucgcugugcca

SEQ ID NO: 1543367 - RNA, 14 nt, Human
ugaauauaaucccu

SEQ ID NO: 1543368 - RNA, 22 nt, Human
ucuggucuaaauuguguuacua

SEQ ID NO: 1543369 - RNA, 21 nt, Human
agccugcaggaccucgugcca

SEQ ID NO: 1543370 - RNA, 20 nt, Human
agccugcaggaccucgugcc

SEQ ID NO: 1543371 - RNA, 21 nt, Human
ugcaguuugguguguccuccg

SEQ ID NO: 1543372 - RNA, 22 nt, Human
agcucugcgucgguccuggugc

SEQ ID NO: 1543373 - RNA, 23 nt, Human
agcucugcgucgguccuggugcc

SEQ ID NO: 1543374 - RNA, 17 nt, Human
agggcugagccuggucc

SEQ ID NO: 1543375 - RNA, 16 nt, Human
agggcugagccugguc

SEQ ID NO: 1543376 - RNA, 18 nt, Human
agucgcugugccacaggc

SEQ ID NO: 1543377 - RNA, 18 nt, Human
uguccccugacagggcca

SEQ ID NO: 1543378 - RNA, 16 nt, Human
uguccccugacagggc

SEQ ID NO: 1543379 - RNA, 15 nt, Human
uguccccugacaggg

SEQ ID NO: 1543380 - RNA, 19 nt, Human
agugugaggguccugcagc

SEQ ID NO: 1543381 - RNA, 16 nt, Human
aguuuaccaucugaaa

SEQ ID NO: 1543382 - RNA, 12 nt, Human
aguuuaccaucu

SEQ ID NO: 1543383 - RNA, 21 nt, Human
aguuuugugaaggugauuuau

SEQ ID NO: 1543384 - RNA, 19 nt, Human
auaacucauuuguuguuug

SEQ ID NO: 1543385 - RNA, 17 nt, Human
auaaucaaauacauuuu

SEQ ID NO: 1543386 - RNA, 22 nt, Human
uugacacuuauagauugaaauu

SEQ ID NO: 1543387 - RNA, 13 nt, Human
uugauuauaaagu

SEQ ID NO: 1543388 - RNA, 18 nt, Human
auccuaaauuuacccucu

SEQ ID NO: 1543389 - RNA, 16 nt, Human
auauuuuuuaucauaa

SEQ ID NO: 1543390 - RNA, 18 nt, Human
augccuccucaggagccg

SEQ ID NO: 1543391 - RNA, 14 nt, Human
augccuccucagga

SEQ ID NO: 1543392 - RNA, 15 nt, Human
augccuccucaggag

SEQ ID NO: 1543393 - RNA, 13 nt, Human
augccuccucagg

SEQ ID NO: 1543394 - RNA, 21 nt, Human
auguagcgcuuugaauaugaa

SEQ ID NO: 1543395 - RNA, 19 nt, Human
auguagcgcuuugaauaug

SEQ ID NO: 1543396 - RNA, 18 nt, Human
uuugugaaggugauuuau

SEQ ID NO: 1543397 - RNA, 14 nt, Human
augguguuacauau

SEQ ID NO: 1543398 - RNA, 22 nt, Human
auugguuuuccaaucauuugac

SEQ ID NO: 1543399 - RNA, 22 nt, Human
aauauuauaacucauuuguugu

SEQ ID NO: 1543400 - RNA, 16 nt, Human
agggacaggaccccag

SEQ ID NO: 1543401 - RNA, 13 nt, Human
agggacaggaccc

SEQ ID NO: 1543402 - RNA, 18 nt, Human
agggacaggaccccagcu

SEQ ID NO: 1543403 - RNA, 17 nt, Human
agggacaggaccccagc

SEQ ID NO: 1543404 - RNA, 20 nt, Human
agggacaggaccccagcucu

SEQ ID NO: 1543405 - RNA, 19 nt, Human
aguggccuuccccagcaug

SEQ ID NO: 1543406 - RNA, 13 nt, Human
caaauacauuuua

SEQ ID NO: 1543407 - RNA, 15 nt, Human
caccccgagggcuga

SEQ ID NO: 1543408 - RNA, 19 nt, Human
ccaguggccuuccccagca

SEQ ID NO: 1543409 - RNA, 17 nt, Human
ccaguggccuuccccag

SEQ ID NO: 1543410 - RNA, 23 nt, Human
ccagugcaguuugguguguccuc

SEQ ID NO: 1543411 - RNA, 15 nt, Human
ccgggcagggugugg

SEQ ID NO: 1543412 - RNA, 16 nt, Human
cgaagcccaggggccg

SEQ ID NO: 1543413 - RNA, 13 nt, Human
cggaauauauuuu

SEQ ID NO: 1543414 - RNA, 15 nt, Human
cgcugugccacaggc

SEQ ID NO: 1543415 - RNA, 11 nt, Human
cuaaaaacaua

SEQ ID NO: 1543416 - RNA, 14 nt, Human
cuaaauuuuaagug

SEQ ID NO: 1543417 - RNA, 21 nt, Human
cucaggagccgaagcccaggg

SEQ ID NO: 1543418 - RNA, 23 nt, Human
cucaggagccgaagcccaggggc

SEQ ID NO: 1543419 - RNA, 22 nt, Human
cuguauauauuuauggccgggc

SEQ ID NO: 1543420 - RNA, 13 nt, Human
cugugccacaggc

SEQ ID NO: 1543421 - RNA, 20 nt, Human
gacaggaccccagcucugcg

SEQ ID NO: 1543422 - RNA, 18 nt, Human
gacaggaccccagcucug

SEQ ID NO: 1543423 - RNA, 17 nt, Human
gacaggaccccagcucu

SEQ ID NO: 1543424 - RNA, 16 nt, Human
gacaggaccccagcuc

SEQ ID NO: 1543425 - RNA, 15 nt, Human
gacaggaccccagcu

SEQ ID NO: 1543426 - RNA, 14 nt, Human
gacaggaccccagc

SEQ ID NO: 1543427 - RNA, 19 nt, Human
gacaggaccccagcucugc

SEQ ID NO: 1543428 - RNA, 22 nt, Human
gaggggugcggcggucccagcu

SEQ ID NO: 1543429 - RNA, 19 nt, Human
gaggggugcggcgguccca

SEQ ID NO: 1543430 - RNA, 23 nt, Human
gagggugccguguccccugacag

SEQ ID NO: 1543431 - RNA, 18 nt, Human
gaggguccugcagccugc

SEQ ID NO: 1543432 - RNA, 21 nt, Human
gaggguccugcagccugcagg

SEQ ID NO: 1543433 - RNA, 17 nt, Human
gaggguccugcagccug

SEQ ID NO: 1543434 - RNA, 13 nt, Human
gaggguccugcag

SEQ ID NO: 1543435 - RNA, 20 nt, Human
gcccuggaugcccaggaauc

SEQ ID NO: 1543436 - RNA, 20 nt, Human
gcucugcgucgguccuggug

SEQ ID NO: 1543437 - RNA, 21 nt, Human
gcucugcgucgguccuggugc

SEQ ID NO: 1543438 - RNA, 23 nt, Human
gcuuagggacaggaccccagcuc

SEQ ID NO: 1543439 - RNA, 22 nt, Human
gcuuagggacaggaccccagcu

SEQ ID NO: 1543440 - RNA, 13 nt, Human
ggaccucgugcca

SEQ ID NO: 1543441 - RNA, 23 nt, Human
guacaguugcuguugugugauca

SEQ ID NO: 1543442 - RNA, 21 nt, Human
gguuuuccaaucauuugacua

SEQ ID NO: 1543443 - RNA, 19 nt, Human
ggugcggcggucccagcuc

SEQ ID NO: 1543444 - RNA, 20 nt, Human
ggugcccuggaugcccagga

SEQ ID NO: 1543445 - RNA, 19 nt, Human
ggugcccuggaugcccagg

SEQ ID NO: 1543446 - RNA, 18 nt, Human
ggugcccuggaugcccag

SEQ ID NO: 1543447 - RNA, 15 nt, Human
ggugcccuggaugcc

SEQ ID NO: 1543448 - RNA, 15 nt, Human
ggucccagcucccug

SEQ ID NO: 1543449 - RNA, 14 nt, Human
ggucccagcucccu

SEQ ID NO: 1543450 - RNA, 12 nt, Human
ggucccagcucc

SEQ ID NO: 1543451 - RNA, 20 nt, Human
ggucccagcucccuggcucc

SEQ ID NO: 1543452 - RNA, 13 nt, Human
gggcugagccugg

SEQ ID NO: 1543453 - RNA, 23 nt, Human
gggcugagccuggucccacgagg

SEQ ID NO: 1543454 - RNA, 15 nt, Human
gggcugagccugguc

SEQ ID NO: 1543455 - RNA, 22 nt, Human
gggcccggguugggucaccaga

SEQ ID NO: 1543456 - RNA, 21 nt, Human
gggcccggguugggucaccag

SEQ ID NO: 1543457 - RNA, 19 nt, Human
ggggugcggcggucccagc

SEQ ID NO: 1543458 - RNA, 20 nt, Human
ggggugcggcggucccagcu

SEQ ID NO: 1543459 - RNA, 11 nt, Human
gucccagcucc

SEQ ID NO: 1543460 - RNA, 18 nt, Human
guccuccgccuuaccagg

SEQ ID NO: 1543461 - RNA, 23 nt, Human
guccuggugcccuggaugcccag

SEQ ID NO: 1543462 - RNA, 20 nt, Human
guccuggugcccuggaugcc

SEQ ID NO: 1543463 - RNA, 12 nt, Human
guccuggugccc

SEQ ID NO: 1543464 - RNA, 11 nt, Human
guccuggugcc

SEQ ID NO: 1543465 - RNA, 15 nt, Human
gucccagcucccugg

SEQ ID NO: 1543466 - RNA, 18 nt, Human
gugcccuggaugcccagg

SEQ ID NO: 1543467 - RNA, 19 nt, Human
gugcccuggaugcccagga

SEQ ID NO: 1543468 - RNA, 19 nt, Human
ucaccagacggggcuggag

SEQ ID NO: 1543469 - RNA, 15 nt, Human
ucaccagacggggcu

SEQ ID NO: 1543470 - RNA, 17 nt, Human
uauuauauguucuagaa

SEQ ID NO: 1543471 - RNA, 14 nt, Human
uauuauauguucua

SEQ ID NO: 1543472 - RNA, 20 nt, Human
uccccagcaugcaccacggg

SEQ ID NO: 1543473 - RNA, 19 nt, Human
uccccagcaugcaccacgg

SEQ ID NO: 1543474 - RNA, 21 nt, Human
uccccagcaugcaccacgggc

SEQ ID NO: 1543475 - RNA, 19 nt, Human
uccgccuuaccaggagaag

SEQ ID NO: 1543476 - RNA, 16 nt, Human
ucuaucagauuaaguu

SEQ ID NO: 1543477 - RNA, 13 nt, Human
ugccuccucagga

SEQ ID NO: 1543478 - RNA, 12 nt, Human
ugccuccucagg

SEQ ID NO: 1543479 - RNA, 16 nt, Human
ugccuccucaggagcc

SEQ ID NO: 1543480 - RNA, 19 nt, Human
ugggucaccagacggggcu

SEQ ID NO: 1543481 - RNA, 21 nt, Human
ugggucaccagacggggcugg

SEQ ID NO: 1543482 - RNA, 20 nt, Human
ugggucaccagacggggcug

SEQ ID NO: 1543483 - RNA, 20 nt, Human
uuauugguuuuccaaucauu

SEQ ID NO: 1543484 - RNA, 16 nt, Human
uuauggccgggcaggg

SEQ ID NO: 1543485 - RNA, 13 nt, Human
uuuccuaauuuau

SEQ ID NO: 1543486 - RNA, 21 nt, Human
uuuacccucuugaauauaauc

SEQ ID NO: 1543487 - RNA, 13 nt, Human
uuuaccaucugaa

SEQ ID NO: 1543488 - RNA, 14 nt, Human
uuuaccaucugaaa

SEQ ID NO: 1543489 - RNA, 13 nt, Human
uuguuugguuaua

SEQ ID NO: 1543490 - RNA, 18 nt, Human
uucuaagucauucauaaa

SEQ ID NO: 1543491 - RNA, 20 nt, Human
ggagugugaggguccugcag

SEQ ID NO: 1543492 - RNA, 18 nt, Human
aaaaaguuugucuuaguu

SEQ ID NO: 1543493 - RNA, 11 nt, Human
aaaaaguuugu

SEQ ID NO: 1543494 - RNA, 13 nt, Human
ggccuuccccagc

SEQ ID NO: 1543495 - RNA, 14 nt, Human
ggccuuccccagca

SEQ ID NO: 1543496 - RNA, 17 nt, Human
gggccggccaguggccu

SEQ ID NO: 1543497 - RNA, 23 nt, Human
ggggccaugccuccucaggagcc

SEQ ID NO: 1543498 - RNA, 19 nt, Human
ggggccaugccuccucagg

SEQ ID NO: 1543499 - RNA, 17 nt, Human
ggggccaugccuccuca

SEQ ID NO: 1543500 - RNA, 14 nt, Human
ggggccaugccucc

SEQ ID NO: 1543501 - RNA, 19 nt, Human
ggguccugcagccugcagg

SEQ ID NO: 1543502 - RNA, 23 nt, Human
ggguccugcagccugcaggaccu

SEQ ID NO: 1543503 - RNA, 18 nt, Human
ggguccugcagccugcag

SEQ ID NO: 1543504 - RNA, 13 nt, Human
guaauccuaaauu

SEQ ID NO: 1543505 - RNA, 23 nt, Human
aaagugguacuugaucauuuuua

SEQ ID NO: 1543506 - RNA, 20 nt, Human
aaagugguacuugaucauuu

SEQ ID NO: 1543507 - RNA, 14 nt, Human
aaagugguacuuga

SEQ ID NO: 1543508 - RNA, 17 nt, Human
gcggcggucccagcucc

SEQ ID NO: 1543509 - RNA, 16 nt, Human
gcggcggucccagcuc

SEQ ID NO: 1543510 - RNA, 14 nt, Human
gcggcggucccagc

SEQ ID NO: 1543511 - RNA, 16 nt, Human
gauacuugaauaacca

SEQ ID NO: 1543512 - RNA, 21 nt, Human
cuggugcccuggaugcccagg

SEQ ID NO: 1543513 - RNA, 20 nt, Human
cuggugcccuggaugcccag

SEQ ID NO: 1543514 - RNA, 17 nt, Human
cuggugcccuggaugcc

SEQ ID NO: 1543515 - RNA, 23 nt, Human
cuggagugugaggguccugcagc

SEQ ID NO: 1543516 - RNA, 17 nt, Human
cuaauuuauucuaaauu

SEQ ID NO: 1543517 - RNA, 16 nt, Human
ccugcagccugcagga

SEQ ID NO: 1543518 - RNA, 22 nt, Human
ccucaggagccgaagcccaggg

SEQ ID NO: 1543519 - RNA, 19 nt, Human
ccucaggagccgaagccca

SEQ ID NO: 1543520 - RNA, 12 nt, Human
ccucaggagccg

SEQ ID NO: 1543521 - RNA, 21 nt, Human
ccucaggagccgaagcccagg

SEQ ID NO: 1543522 - RNA, 22 nt, Human
ccaggagggaggcaggggaggg

SEQ ID NO: 1543523 - RNA, 15 nt, Human
ccaggagggaggcag

SEQ ID NO: 1543524 - RNA, 19 nt, Human
ccaggggccggccaguggc

SEQ ID NO: 1543525 - RNA, 21 nt, Human
ccaggagggaggcaggggagg

SEQ ID NO: 1543526 - RNA, 20 nt, Human
cagaauaaucaaauacauuu

SEQ ID NO: 1543527 - RNA, 16 nt, Human
gucgcugugccacagg

SEQ ID NO: 1543528 - RNA, 14 nt, Human
guccccugacaggg

SEQ ID NO: 1543529 - RNA, 14 nt, Human
aagaaacaacagaa

SEQ ID NO: 1543530 - RNA, 21 nt, Human
uagggacaggaccccagcucu

SEQ ID NO: 1543531 - RNA, 22 nt, Human
uagggacaggaccccagcucug

SEQ ID NO: 1543532 - RNA, 20 nt, Human
uagggacaggaccccagcuc

SEQ ID NO: 1543533 - RNA, 19 nt, Human
uagggacaggaccccagcu

SEQ ID NO: 1543534 - RNA, 15 nt, Human
uaguucccaggugau

SEQ ID NO: 1543535 - RNA, 16 nt, Human
acaggcuuagggacag

SEQ ID NO: 1543536 - RNA, 18 nt, Human
acaggaccccagcucugc

SEQ ID NO: 1543537 - RNA, 19 nt, Human
acaggaccccagcucugcg

SEQ ID NO: 1543538 - RNA, 17 nt, Human
acaggaccccagcucug

SEQ ID NO: 1543539 - RNA, 16 nt, Human
acaggaccccagcucu

SEQ ID NO: 1543540 - RNA, 15 nt, Human
acaggaccccagcuc

SEQ ID NO: 1543541 - RNA, 14 nt, Human
acaggaccccagcu

SEQ ID NO: 1543542 - RNA, 13 nt, Human
acaggaccccagc

SEQ ID NO: 1543543 - RNA, 12 nt, Human
acaggaccccag

SEQ ID NO: 1543544 - RNA, 21 nt, Human
aauuaguacagaaauauccau

SEQ ID NO: 1543545 - RNA, 21 nt, Human
uaagcaaguuaaguguccucc

SEQ ID NO: 1543546 - RNA, 10 nt, Human
ucccagcucc

SEQ ID NO: 1543547 - RNA, 15 nt, Human
acuaauuuuacuucu

SEQ ID NO: 1543548 - RNA, 22 nt, Human
uccucaggagccgaagcccagg

SEQ ID NO: 1543549 - RNA, 21 nt, Human
uccucaggagccgaagcccag

SEQ ID NO: 1543550 - RNA, 17 nt, Human
uccugcagccugcagga

SEQ ID NO: 1543551 - RNA, 20 nt, Human
ucugcgucgguccuggugcc

SEQ ID NO: 1543552 - RNA, 19 nt, Human
ugaaauuuccuaauuuauu

SEQ ID NO: 1543553 - RNA, 19 nt, Human
ugacagggccagugcaguu

SEQ ID NO: 1543554 - RNA, 16 nt, Human
ugacagggccagugca

SEQ ID NO: 1543555 - RNA, 22 nt, Human
aggagggaggcaggggaggggu

SEQ ID NO: 1543556 - RNA, 13 nt, Human
uggccgggcaggg

SEQ ID NO: 1543557 - RNA, 12 nt, Human
uggccgggcagg

SEQ ID NO: 1543558 - RNA, 13 nt, Human
agcccaggggccg

SEQ ID NO: 1543559 - RNA, 14 nt, Human
agccgaagcccagg

SEQ ID NO: 1543560 - RNA, 15 nt, Human
agggugccguguccc

SEQ ID NO: 1543561 - RNA, 24 nt, Human
agggugccguguccccugacaggg

SEQ ID NO: 1543562 - RNA, 22 nt, Human
auaaaccuugucuaugaaauga

SEQ ID NO: 1543563 - RNA, 19 nt, Human
auaccaaguugauacuuga

SEQ ID NO: 1543564 - RNA, 16 nt, Human
aguuugguguguccuc

SEQ ID NO: 1543565 - RNA, 13 nt, Human
agugguuuagaaa

SEQ ID NO: 1543566 - RNA, 19 nt, Human
aucaauucuguauuccaga

SEQ ID NO: 1543567 - RNA, 23 nt, Human
auauauuuauggccgggcagggu

SEQ ID NO: 1543568 - RNA, 22 nt, Human
uuugaaaacucuguguuuggaa

SEQ ID NO: 1543569 - RNA, 14 nt, Human
augaaaugacuucu

SEQ ID NO: 1543570 - RNA, 24 nt, Human
auuacuuacguauguuuguacuug

SEQ ID NO: 1543571 - RNA, 15 nt, Human
uuuugauauaugaaa

SEQ ID NO: 1543572 - RNA, 16 nt, Human
uuuuguuugguuauau

SEQ ID NO: 1543573 - RNA, 13 nt, Human
uuuuguuugguua

SEQ ID NO: 1543574 - RNA, 21 nt, Human
uuuuguuugguuauaucgaaa

SEQ ID NO: 1543575 - RNA, 14 nt, Human
aaaaauuuuuguuu

SEQ ID NO: 1543576 - RNA, 13 nt, Human
aaaaauuuuuguu

SEQ ID NO: 1543577 - RNA, 15 nt, Human
accccgagggcugag

SEQ ID NO: 1543578 - RNA, 13 nt, Human
agacggggcugga

SEQ ID NO: 1543579 - RNA, 15 nt, Human
agcaugcaccacggg

SEQ ID NO: 1543580 - RNA, 17 nt, Human
aggaccccagcucugcg

SEQ ID NO: 1543581 - RNA, 16 nt, Human
aggaccccagcucugc

SEQ ID NO: 1543582 - RNA, 14 nt, Human
aggaccccagcucu

SEQ ID NO: 1543583 - RNA, 13 nt, Human
aggaccccagcuc

SEQ ID NO: 1543584 - RNA, 14 nt, Human
aggaccucgugcca

SEQ ID NO: 1543585 - RNA, 13 nt, Human
cagacggggcugg

SEQ ID NO: 1543586 - RNA, 19 nt, Human
cagacggggcuggagugug

SEQ ID NO: 1543587 - RNA, 17 nt, Human
cagcaugcaccacgggc

SEQ ID NO: 1543588 - RNA, 19 nt, Human
caggaaucuguauauauuu

SEQ ID NO: 1543589 - RNA, 19 nt, Human
caggagaagaaccugaaga

SEQ ID NO: 1543590 - RNA, 21 nt, Human
caggagccgaagcccaggggc

SEQ ID NO: 1543591 - RNA, 18 nt, Human
caggagccgaagcccagg

SEQ ID NO: 1543592 - RNA, 17 nt, Human
caggagccgaagcccag

SEQ ID NO: 1543593 - RNA, 17 nt, Human
caggcuuagggacagga

SEQ ID NO: 1543594 - RNA, 16 nt, Human
caggcuuagggacagg

SEQ ID NO: 1543595 - RNA, 16 nt, Human
cagggccagugcaguu

SEQ ID NO: 1543596 - RNA, 13 nt, Human
caggggaggggug

SEQ ID NO: 1543597 - RNA, 22 nt, Human
caggggccggccaguggccuuc

SEQ ID NO: 1543598 - RNA, 17 nt, Human
caggggccggccagugg

SEQ ID NO: 1543599 - RNA, 14 nt, Human
cauuuuuaccauua

SEQ ID NO: 1543600 - RNA, 19 nt, Human
cauucauaaaccuugucua

SEQ ID NO: 1543601 - RNA, 23 nt, Human
ccaccccgagggcugagccuggu

SEQ ID NO: 1543602 - RNA, 20 nt, Human
ccagcaugcaccacgggccc

SEQ ID NO: 1543603 - RNA, 18 nt, Human
ccagcaugcaccacgggc

SEQ ID NO: 1543604 - RNA, 18 nt, Human
ccauuauuuuuaggaugu

SEQ ID NO: 1543605 - RNA, 17 nt, Human
ccaucugaaagugguac

SEQ ID NO: 1543606 - RNA, 18 nt, Human
cccggguugggucaccag

SEQ ID NO: 1543607 - RNA, 23 nt, Human
cccgagggcugagccugguccca

SEQ ID NO: 1543608 - RNA, 19 nt, Human
ccguguccccugacagggc

SEQ ID NO: 1543609 - RNA, 17 nt, Human
ccguguccccugacagg

SEQ ID NO: 1543610 - RNA, 13 nt, Human
ccgccuuaccagg

SEQ ID NO: 1543611 - RNA, 20 nt, Human
ccuggucccacgagggugcc

SEQ ID NO: 1543612 - RNA, 20 nt, Human
ccuggugcccuggaugccca

SEQ ID NO: 1543613 - RNA, 18 nt, Human
ccuggugcccuggaugcc

SEQ ID NO: 1543614 - RNA, 12 nt, Human
ccuggugcccug

SEQ ID NO: 1543615 - RNA, 21 nt, Human
ccuggugcccuggaugcccag

SEQ ID NO: 1543616 - RNA, 22 nt, Human
ccuggugcccuggaugcccagg

SEQ ID NO: 1543617 - RNA, 13 nt, Human
cuccucaggagcc

SEQ ID NO: 1543618 - RNA, 12 nt, Human
cuccucaggagc

SEQ ID NO: 1543619 - RNA, 14 nt, Human
cugaagaacuauuu

SEQ ID NO: 1543620 - RNA, 17 nt, Human
cugcgucgguccuggug

SEQ ID NO: 1543621 - RNA, 18 nt, Human
cugcgucgguccuggugc

SEQ ID NO: 1543622 - RNA, 16 nt, Human
gaaucuguauauauuu

SEQ ID NO: 1543623 - RNA, 18 nt, Human
gaacuuacuugcauacca

SEQ ID NO: 1543624 - RNA, 18 nt, Human
gaaccugaagaacuauuu

SEQ ID NO: 1543625 - RNA, 23 nt, Human
gagccuggucccacgagggugcc

SEQ ID NO: 1543626 - RNA, 19 nt, Human
gagccuggucccacgaggg

SEQ ID NO: 1543627 - RNA, 14 nt, Human
gauagacugcuaca

SEQ ID NO: 1543628 - RNA, 13 nt, Human
gagucgcugugcc

SEQ ID NO: 1543629 - RNA, 17 nt, Human
gcacuaaaguuaguaaa

SEQ ID NO: 1543630 - RNA, 12 nt, Human
gcaggggagggg

SEQ ID NO: 1543631 - RNA, 21 nt, Human
gccuggucccacgagggugcc

SEQ ID NO: 1543632 - RNA, 15 nt, Human
ggcggucccagcucc

SEQ ID NO: 1543633 - RNA, 14 nt, Human
ggcggucccagcuc

SEQ ID NO: 1543634 - RNA, 17 nt, Human
ggcucccaugucaagag

SEQ ID NO: 1543635 - RNA, 22 nt, Human
ggcuuagggacaggaccccagc

SEQ ID NO: 1543636 - RNA, 23 nt, Human
ucaggagccgaagcccaggggcc

SEQ ID NO: 1543637 - RNA, 22 nt, Human
uauuccagacuugggaggaugu

SEQ ID NO: 1543638 - RNA, 22 nt, Human
ucgugccaccccgagggcugag

SEQ ID NO: 1543639 - RNA, 18 nt, Human
ugcccuggaugcccagga

SEQ ID NO: 1543640 - RNA, 16 nt, Human
ugcccuggaugcccag

SEQ ID NO: 1543641 - RNA, 21 nt, Human
ugccguguccccugacagggc

SEQ ID NO: 1543642 - RNA, 20 nt, Human
ugccacaggcuuagggacag

SEQ ID NO: 1543643 - RNA, 21 nt, Human
ugccacaggcuuagggacagg

SEQ ID NO: 1543644 - RNA, 17 nt, Human
ugccacaggcuuaggga

SEQ ID NO: 1543645 - RNA, 19 nt, Human
uuauuagaaaaauauuaua

SEQ ID NO: 1543646 - RNA, 23 nt, Human
uuauguuguuguuguuuuuggau

SEQ ID NO: 1543647 - RNA, 21 nt, Human
uuauaucgaaauaguuacagg

SEQ ID NO: 1543648 - RNA, 21 nt, Human adenovirus B [HAdV-B]
cuguacuucuccaucagcaga

SEQ ID NO: 1543649 - RNA, 21 nt, Human adenovirus B [HAdV-B]
cgcaaaaaauggccuguuuuu

SEQ ID NO: 1543650 - RNA, 22 nt, Human adenovirus B [HAdV-B]
aagagcucugacuggagcugga

SEQ ID NO: 1543651 - RNA, 17 nt, Human adenovirus B [HAdV-B]
caaaauagaagcugcua

SEQ ID NO: 1543652 - RNA, 15 nt, Human adenovirus B [HAdV-B]
cuaccuauacacacc

SEQ ID NO: 1543653 - RNA, 23 nt, Human adenovirus B [HAdV-B]
ugcugaacggggucaucuugcag

SEQ ID NO: 1543654 - RNA, 18 nt, Human adenovirus B [HAdV-B]
cuccgacugcagcacugg

SEQ ID NO: 1543655 - RNA, 16 nt, Human adenovirus B [HAdV-B]
guggcgguucaggccu

SEQ ID NO: 1543656 - RNA, 18 nt, Human adenovirus B [HAdV-B]
cucaggaucacagagacg

SEQ ID NO: 1543657 - RNA, 17 nt, Human adenovirus B [HAdV-B]
cuauaggcucaaacugc

SEQ ID NO: 1543658 - RNA, 11 nt, Human adenovirus B [HAdV-B]
ucaugccugga

SEQ ID NO: 1543659 - RNA, 14 nt, Human adenovirus B [HAdV-B]
ccaccacaccacuc

SEQ ID NO: 1543660 - RNA, 17 nt, Human adenovirus B [HAdV-B]
acagcauuguggagaac

SEQ ID NO: 1543661 - RNA, 15 nt, Human adenovirus B [HAdV-B]
cuccucguccaaaug

SEQ ID NO: 1543662 - RNA, 14 nt, Human adenovirus B [HAdV-B]
gccuacugccaccu

SEQ ID NO: 1543663 - RNA, 15 nt, Human adenovirus B [HAdV-B]
auacugacgaaaaug

SEQ ID NO: 1543664 - RNA, 22 nt, Human adenovirus B [HAdV-B]
auuguguucuccuaggcagaga

SEQ ID NO: 1543665 - RNA, 14 nt, Human adenovirus B [HAdV-B]
ggacuacuccaccc

SEQ ID NO: 1543666 - RNA, 23 nt, Human adenovirus B [HAdV-B]
aaacaucccgcaggaccugcucg

SEQ ID NO: 1543667 - RNA, 23 nt, Human adenovirus B [HAdV-B]
cuagucucgcaacucugacuucu

SEQ ID NO: 1543668 - RNA, 16 nt, Human adenovirus B [HAdV-B]
ccuucuuacugcuuua

SEQ ID NO: 1543669 - RNA, 13 nt, Human adenovirus B [HAdV-B]
cgguccagcaagu

SEQ ID NO: 1543670 - RNA, 18 nt, Human adenovirus B [HAdV-B]
cacaucacuuccaugccu

SEQ ID NO: 1543671 - RNA, 13 nt, Human adenovirus B [HAdV-B]
gagugucacugcc

SEQ ID NO: 1543672 - RNA, 21 nt, Human adenovirus B [HAdV-B]
ugccuuucucccaagcagaca

SEQ ID NO: 1543673 - RNA, 22 nt, Human adenovirus B [HAdV-B]
auuuuggagagaguuugcugca

SEQ ID NO: 1543674 - RNA, 14 nt, Human adenovirus B [HAdV-B]
gaacaaaagaauac

SEQ ID NO: 1543675 - RNA, 15 nt, Human adenovirus B [HAdV-B]
ugcacucauccauga

SEQ ID NO: 1543676 - RNA, 20 nt, Human adenovirus B [HAdV-B]
acuacuguuuuccacuggac

SEQ ID NO: 1543677 - RNA, 16 nt, Human adenovirus B [HAdV-B]
ugggaugggugcauuc

SEQ ID NO: 1543678 - RNA, 20 nt, Human adenovirus B [HAdV-B]
aaucuuagguuacuggccag

SEQ ID NO: 1543679 - RNA, 17 nt, Human adenovirus B [HAdV-B]
uuuccaucacaagacaa

SEQ ID NO: 1543680 - RNA, 19 nt, Human adenovirus B [HAdV-B]
uggucagugaugagcagcu

SEQ ID NO: 1543681 - RNA, 14 nt, Human adenovirus B [HAdV-B]
auuacaaagacuuc

SEQ ID NO: 1543682 - RNA, 14 nt, Human adenovirus B [HAdV-B]
cggcgucccagcag

SEQ ID NO: 1543683 - RNA, 13 nt, Human adenovirus B [HAdV-B]
auggaaaucccac

SEQ ID NO: 1543684 - RNA, 18 nt, Human adenovirus B [HAdV-B]
agcucgccugugccauug

SEQ ID NO: 1543685 - RNA, 19 nt, Human adenovirus B [HAdV-B]
ugcaacaaaacaaaaccaa

SEQ ID NO: 1543686 - RNA, 15 nt, Human adenovirus B [HAdV-B]
cauccucgacaugag

SEQ ID NO: 1543687 - RNA, 16 nt, Human adenovirus B [HAdV-B]
cgaggcagucuaccug

SEQ ID NO: 1543688 - RNA, 12 nt, Human adenovirus B [HAdV-B]
caucuuccagca

SEQ ID NO: 1543689 - RNA, 23 nt, Human adenovirus B [HAdV-B]
agauugggguaugaauguuccuu

SEQ ID NO: 1543690 - RNA, 21 nt, Human adenovirus B [HAdV-B]
cuuaaagaguaggcagcgacc

SEQ ID NO: 1543691 - RNA, 18 nt, Human adenovirus B [HAdV-B]
cucauauuugucagcauu

SEQ ID NO: 1543692 - RNA, 13 nt, Human adenovirus B [HAdV-B]
augaucacaagca

SEQ ID NO: 1543693 - RNA, 14 nt, Human adenovirus B [HAdV-B]
uaugagccagagca

SEQ ID NO: 1543694 - RNA, 17 nt, Human adenovirus B [HAdV-B]
ucgacuccguagccugg

SEQ ID NO: 1543695 - RNA, 17 nt, Human adenovirus B [HAdV-B]
caccaagaugcuggaaa

SEQ ID NO: 1543696 - RNA, 17 nt, Human adenovirus B [HAdV-B]
uggcuccgaccaugcgc

SEQ ID NO: 1543697 - RNA, 19 nt, Human adenovirus B [HAdV-B]
gaccggcgaggaacucaac

SEQ ID NO: 1543698 - RNA, 15 nt, Human adenovirus B [HAdV-B]
aggagucaaccccac

SEQ ID NO: 1543699 - RNA, 11 nt, Human adenovirus B [HAdV-B]
cggaggaggac

SEQ ID NO: 1543700 - RNA, 17 nt, Human adenovirus B [HAdV-B]
ugccaucuuccagcaga

SEQ ID NO: 1543701 - RNA, 16 nt, Human adenovirus B [HAdV-B]
cucauggacaaacagu

SEQ ID NO: 1543702 - RNA, 13 nt, Human adenovirus B [HAdV-B]
uauuuuugcuucu

SEQ ID NO: 1543703 - RNA, 18 nt, Human adenovirus B [HAdV-B]
ugcaaaccucugcuacaa

SEQ ID NO: 1543704 - RNA, 23 nt, Human adenovirus B [HAdV-B]
gaaaaugccggccaauugccauu

SEQ ID NO: 1543705 - RNA, 18 nt, Human adenovirus B [HAdV-B]
aaauuuucucccagcagc

SEQ ID NO: 1543706 - RNA, 13 nt, Human adenovirus B [HAdV-B]
cgcuuccacccuu

SEQ ID NO: 1543707 - RNA, 19 nt, Human adenovirus B [HAdV-B]
aaguuugguggcaaaugau

SEQ ID NO: 1543708 - RNA, 17 nt, Human adenovirus B [HAdV-B]
accagacaaaguacagc

SEQ ID NO: 1543709 - RNA, 19 nt, Human adenovirus B [HAdV-B]
gcgggacgaggauuucgaa

SEQ ID NO: 1543710 - RNA, 16 nt, Human adenovirus B [HAdV-B]
ucguucaucauuuccc

SEQ ID NO: 1543711 - RNA, 23 nt, Human adenovirus B [HAdV-B]
uccuacauggguauucugcauga

SEQ ID NO: 1543712 - RNA, 21 nt, Human adenovirus B [HAdV-B]
acagagccuaccuccuuuccu

SEQ ID NO: 1543713 - RNA, 18 nt, Human adenovirus B [HAdV-B]
gauuaagggaaaugccag

SEQ ID NO: 1543714 - RNA, 19 nt, Human adenovirus B [HAdV-B]
gacaggaagacacuggcag

SEQ ID NO: 1543715 - RNA, 14 nt, Human adenovirus B [HAdV-B]
uacucacaaacuag

SEQ ID NO: 1543716 - RNA, 11 nt, Human adenovirus B [HAdV-B]
guaugaagauu

SEQ ID NO: 1543717 - RNA, 15 nt, Human adenovirus B [HAdV-B]
aacagccaacauagc

SEQ ID NO: 1543718 - RNA, 21 nt, Human adenovirus B [HAdV-B]
ugaugacaauauuaacaccuu

SEQ ID NO: 1543719 - RNA, 23 nt, Human adenovirus B [HAdV-B]
ggaccguucaauuuguggaggag

SEQ ID NO: 1543720 - RNA, 17 nt, Human adenovirus B [HAdV-B]
cuuaaacccgcacuggc

SEQ ID NO: 1543721 - RNA, 16 nt, Human adenovirus B [HAdV-B]
ccugucaucaugauua

SEQ ID NO: 1543722 - RNA, 23 nt, Human adenovirus B [HAdV-B]
caauggaugguuuacaaaaccau

SEQ ID NO: 1543723 - RNA, 12 nt, Human adenovirus B [HAdV-B]
guaugcaaacac

SEQ ID NO: 1543724 - RNA, 21 nt, Human adenovirus B [HAdV-B]
gcaacuccgacugcagcacug

SEQ ID NO: 1543725 - RNA, 20 nt, Human adenovirus B [HAdV-B]
ggacauaauuacacucucau

SEQ ID NO: 1543726 - RNA, 15 nt, Human adenovirus B [HAdV-B]
acguggcaaaccggc

SEQ ID NO: 1543727 - RNA, 14 nt, Human adenovirus B [HAdV-B]
uguauacugggugc

SEQ ID NO: 1543728 - RNA, 16 nt, Human adenovirus B [HAdV-B]
agauaacuaucaccaa

SEQ ID NO: 1543729 - RNA, 16 nt, Human adenovirus B [HAdV-B]
auaguuauguuccuga

SEQ ID NO: 1543730 - RNA, 15 nt, Human adenovirus B [HAdV-B]
acagugcaguacaag

SEQ ID NO: 1543731 - RNA, 14 nt, Human adenovirus B [HAdV-B]
cugcggaggaggag

SEQ ID NO: 1543732 - RNA, 18 nt, Human adenovirus B [HAdV-B]
cugcucgcucacaccuca

SEQ ID NO: 1543733 - RNA, 15 nt, Human adenovirus B [HAdV-B]
agugagaucggacag

SEQ ID NO: 1543734 - RNA, 18 nt, Human adenovirus B [HAdV-B]
cuucgagggucugggcaa

SEQ ID NO: 1543735 - RNA, 12 nt, Human adenovirus B [HAdV-B]
gugccaccacac

SEQ ID NO: 1543736 - RNA, 23 nt, Human adenovirus B [HAdV-B]
gcaagagcucugcuacgaagagc

SEQ ID NO: 1543737 - RNA, 22 nt, Human adenovirus B [HAdV-B]
auucccugcagaaaucuuccca

SEQ ID NO: 1543738 - RNA, 15 nt, Human adenovirus B [HAdV-B]
ccucugcacucaggu

SEQ ID NO: 1543739 - RNA, 17 nt, Human adenovirus B [HAdV-B]
gcggaguagcugacuug

SEQ ID NO: 1543740 - RNA, 15 nt, Human adenovirus B [HAdV-B]
auucuuaaacacacc

SEQ ID NO: 1543741 - RNA, 18 nt, Human adenovirus B [HAdV-B]
uuaagauucccacugaaa

SEQ ID NO: 1543742 - RNA, 18 nt, Human adenovirus B [HAdV-B]
aggacagucuggaggaag

SEQ ID NO: 1543743 - RNA, 18 nt, Human adenovirus B [HAdV-B]
gccaacuaucucuccuac

SEQ ID NO: 1543744 - RNA, 17 nt, Human adenovirus B [HAdV-B]
ccugcuuguaaccacuc

SEQ ID NO: 1543745 - RNA, 16 nt, Human adenovirus B [HAdV-B]
cacaacuuacacuaug

SEQ ID NO: 1543746 - RNA, 16 nt, Human adenovirus B [HAdV-B]
uuugcaguagguacaa

SEQ ID NO: 1543747 - RNA, 17 nt, Human adenovirus B [HAdV-B]
ggaagugaguccuauuu

SEQ ID NO: 1543748 - RNA, 15 nt, Human adenovirus B [HAdV-B]
cgcaguacuucaaau

SEQ ID NO: 1543749 - RNA, 15 nt, Human adenovirus B [HAdV-B]
acgguagcauaugca

SEQ ID NO: 1543750 - RNA, 20 nt, Human adenovirus B [HAdV-B]
ucacaggcucccuguuccca

SEQ ID NO: 1543751 - RNA, 20 nt, Human adenovirus B [HAdV-B]
ggcgagucgugcuaggcgga

SEQ ID NO: 1543752 - RNA, 13 nt, Human adenovirus B [HAdV-B]
aaccgaucucugc

SEQ ID NO: 1543753 - RNA, 13 nt, Human adenovirus B [HAdV-B]
guucuggaggagg

SEQ ID NO: 1543754 - RNA, 15 nt, Human adenovirus B [HAdV-B]
uccaguacucuucua

SEQ ID NO: 1543755 - RNA, 18 nt, Human adenovirus B [HAdV-B]
gaugucaccugcggagca

SEQ ID NO: 1543756 - RNA, 17 nt, Human adenovirus B [HAdV-B]
ucgcuacaaaaaguuuc

SEQ ID NO: 1543757 - RNA, 19 nt, Human adenovirus B [HAdV-B]
acccagaggaacacauucc

SEQ ID NO: 1543758 - RNA, 18 nt, Human adenovirus B [HAdV-B]
caagcuguguacucccag

SEQ ID NO: 1543759 - RNA, 23 nt, Human adenovirus B [HAdV-B]
ggauagcuuccggcaucaaugga

SEQ ID NO: 1543760 - RNA, 12 nt, Human adenovirus B [HAdV-B]
guuaauucaucu

SEQ ID NO: 1543761 - RNA, 13 nt, Human adenovirus B [HAdV-B]
caugggcauuuug

SEQ ID NO: 1543762 - RNA, 13 nt, Human adenovirus B [HAdV-B]
cuucuccaucagc

SEQ ID NO: 1543763 - RNA, 18 nt, Human adenovirus B [HAdV-B]
gguagucgguauggaagc

SEQ ID NO: 1543764 - RNA, 12 nt, Human adenovirus B [HAdV-B]
caacaaaacaaa

SEQ ID NO: 1543765 - RNA, 18 nt, Human adenovirus B [HAdV-B]
ugcaggugaggauuugca

SEQ ID NO: 1543766 - RNA, 13 nt, Human adenovirus B [HAdV-B]
ggagcgguggugu

SEQ ID NO: 1543767 - RNA, 21 nt, Human adenovirus B [HAdV-B]
cagaugucaccugcggagcag

SEQ ID NO: 1543768 - RNA, 16 nt, Human adenovirus B [HAdV-B]
uaagggggucuaccuu

SEQ ID NO: 1543769 - RNA, 14 nt, Human adenovirus B [HAdV-B]
caaagaaacucccu

SEQ ID NO: 1543770 - RNA, 12 nt, Human adenovirus B [HAdV-B]
ccaacagaaaac

SEQ ID NO: 1543771 - RNA, 18 nt, Human adenovirus B [HAdV-B]
caguacugguaacauggg

SEQ ID NO: 1543772 - RNA, 23 nt, Human adenovirus B [HAdV-B]
uggaggaggaaaacgaggaggca

SEQ ID NO: 1543773 - RNA, 14 nt, Human adenovirus B [HAdV-B]
caucuuccagcaga

SEQ ID NO: 1543774 - RNA, 20 nt, Human adenovirus B [HAdV-B]
gccuacccauggcgggcacc

SEQ ID NO: 1543775 - RNA, 14 nt, Human adenovirus B [HAdV-B]
gaugaaaugacagg

SEQ ID NO: 1543776 - RNA, 20 nt, Human adenovirus B [HAdV-B]
augacugaaacacucaccac

SEQ ID NO: 1543777 - RNA, 19 nt, Human adenovirus B [HAdV-B]
gcauccgccagcagcagga

SEQ ID NO: 1543778 - RNA, 14 nt, Human adenovirus B [HAdV-B]
cgccucccaggacu

SEQ ID NO: 1543779 - RNA, 15 nt, Human adenovirus B [HAdV-B]
ccgcaagacaccugc

SEQ ID NO: 1543780 - RNA, 18 nt, Human adenovirus B [HAdV-B]
uaccgucaccuccacagc

SEQ ID NO: 1543781 - RNA, 17 nt, Human adenovirus B [HAdV-B]
acccggcggcgucccag

SEQ ID NO: 1543782 - RNA, 12 nt, Human adenovirus B [HAdV-B]
cgucgcugcuuu

SEQ ID NO: 1543783 - RNA, 15 nt, Human adenovirus B [HAdV-B]
gcaggauauuuugaa

SEQ ID NO: 1543784 - RNA, 15 nt, Human adenovirus B [HAdV-B]
ugccaucgaucccac

SEQ ID NO: 1543785 - RNA, 15 nt, Human adenovirus B [HAdV-B]
agcgccggcaggucc

SEQ ID NO: 1543786 - RNA, 20 nt, Human adenovirus B [HAdV-B]
ccuggggacagguuagugua

SEQ ID NO: 1543787 - RNA, 19 nt, Human adenovirus B [HAdV-B]
caccucgcuuacgcacguc

SEQ ID NO: 1543788 - RNA, 20 nt, Human adenovirus B [HAdV-B]
ccugacgaacagauggauaa

SEQ ID NO: 1543789 - RNA, 23 nt, Human adenovirus B [HAdV-B]
cuugaaaguggguagacagaaug

SEQ ID NO: 1543790 - RNA, 15 nt, Human adenovirus B [HAdV-B]
cugacacuccugguc

SEQ ID NO: 1543791 - RNA, 16 nt, Human adenovirus B [HAdV-B]
aauuauggcgaucccg

SEQ ID NO: 1543792 - RNA, 18 nt, Human adenovirus B [HAdV-B]
ucccugcagaaaucuucc

SEQ ID NO: 1543793 - RNA, 22 nt, Human adenovirus B [HAdV-B]
auacuaacaugccaaacgugaa

SEQ ID NO: 1543794 - RNA, 18 nt, Human adenovirus B [HAdV-B]
gacucugacacuccuggu

SEQ ID NO: 1543795 - RNA, 17 nt, Human adenovirus B [HAdV-B]
ggcucagcgccgggccu

SEQ ID NO: 1543796 - RNA, 17 nt, Human adenovirus B [HAdV-B]
acgguaaaucugagcca

SEQ ID NO: 1543797 - RNA, 18 nt, Human adenovirus B [HAdV-B]
ucuuaaguuggucaaaag

SEQ ID NO: 1543798 - RNA, 20 nt, Human adenovirus B [HAdV-B]
caugaaaggaacuaguuguu

SEQ ID NO: 1543799 - RNA, 11 nt, Human adenovirus B [HAdV-B]
uuguugccauc

SEQ ID NO: 1543800 - RNA, 17 nt, Human adenovirus B [HAdV-B]
aaagugacauugguguu

SEQ ID NO: 1543801 - RNA, 16 nt, Human adenovirus B [HAdV-B]
ccuucgcggcuggcca

SEQ ID NO: 1543802 - RNA, 11 nt, Human adenovirus B [HAdV-B]
caagaggacaa

SEQ ID NO: 1543803 - RNA, 14 nt, Human adenovirus B [HAdV-B]
cuagucuugcuugu

SEQ ID NO: 1543804 - RNA, 15 nt, Human adenovirus B [HAdV-B]
caggcagcagcuccu

SEQ ID NO: 1543805 - RNA, 15 nt, Human adenovirus B [HAdV-B]
auuuucccuacuaau

SEQ ID NO: 1543806 - RNA, 24 nt, Human adenovirus B [HAdV-B]
cagucuuuccaucacaagacaagc

SEQ ID NO: 1543807 - RNA, 18 nt, Human adenovirus B [HAdV-B]
cuugaccacgguggugca

SEQ ID NO: 1543808 - RNA, 21 nt, Human adenovirus B [HAdV-B]
uuuaugccuuaccaguguaac

SEQ ID NO: 1543809 - RNA, 11 nt, Human adenovirus B [HAdV-B]
gaugcuggaaa

SEQ ID NO: 1543810 - RNA, 15 nt, Human adenovirus B [HAdV-B]
ucccagcagcaccuc

SEQ ID NO: 1543811 - RNA, 20 nt, Human adenovirus B [HAdV-B]
gaugucucacgcuugccagc

SEQ ID NO: 1543812 - RNA, 19 nt, Human adenovirus B [HAdV-B]
uugcuggagugucacugcc

SEQ ID NO: 1543813 - RNA, 14 nt, Human adenovirus B [HAdV-B]
ggugccaggugguc

SEQ ID NO: 1543814 - RNA, 18 nt, Human adenovirus B [HAdV-B]
gcaucucaugacaugcag

SEQ ID NO: 1543815 - RNA, 14 nt, Human adenovirus B [HAdV-B]
cuuggaagagguuc

SEQ ID NO: 1543816 - RNA, 16 nt, Human adenovirus B [HAdV-B]
guuucugaugcaagag

SEQ ID NO: 1543817 - RNA, 19 nt, Human adenovirus B [HAdV-B]
ccagaagauauggaggaag

SEQ ID NO: 1543818 - RNA, 19 nt, Human adenovirus B [HAdV-B]
aucacaaucuggcaacagc

SEQ ID NO: 1543819 - RNA, 23 nt, Human adenovirus B [HAdV-B]
uacccuguggugggugcagagcu

SEQ ID NO: 1543820 - RNA, 21 nt, Human adenovirus B [HAdV-B]
cggcgcugcagagccagccgu

SEQ ID NO: 1543821 - RNA, 18 nt, Human adenovirus B [HAdV-B]
ggagacggcuugcuggag

SEQ ID NO: 1543822 - RNA, 18 nt, Human adenovirus B [HAdV-B]
agccgcuuucgcagcggc

SEQ ID NO: 1543823 - RNA, 20 nt, Human adenovirus B [HAdV-B]
uauggaagcaguaacuuuug

SEQ ID NO: 1543824 - RNA, 20 nt, Human adenovirus B [HAdV-B]
cagcacggugggaucugcaa

SEQ ID NO: 1543825 - RNA, 12 nt, Human adenovirus B [HAdV-B]
uauggccagcac

SEQ ID NO: 1543826 - RNA, 18 nt, Human adenovirus B [HAdV-B]
aggggcguuaagagggag

SEQ ID NO: 1543827 - RNA, 22 nt, Human adenovirus B [HAdV-B]
cguuguccguucucgcuggcca

SEQ ID NO: 1543828 - RNA, 20 nt, Human adenovirus B [HAdV-B]
aaaaaauacaauggacucug

SEQ ID NO: 1543829 - RNA, 20 nt, Human adenovirus B [HAdV-B]
ugggagggggacuuacagug

SEQ ID NO: 1543830 - RNA, 19 nt, Human adenovirus B [HAdV-B]
caucucccaccacacccga

SEQ ID NO: 1543831 - RNA, 18 nt, Human adenovirus B [HAdV-B]
uuuagcgaucuucucaau

SEQ ID NO: 1543832 - RNA, 17 nt, Human adenovirus B [HAdV-B]
cagguagaacugcugcu

SEQ ID NO: 1543833 - RNA, 15 nt, Human adenovirus B [HAdV-B]
cgugaugcagcagca

SEQ ID NO: 1543834 - RNA, 18 nt, Human adenovirus B [HAdV-B]
guuugggccauuuuggaa

SEQ ID NO: 1543835 - RNA, 15 nt, Human adenovirus B [HAdV-B]
gacauggcuucucuu

SEQ ID NO: 1543836 - RNA, 23 nt, Human adenovirus B [HAdV-B]
uaaguuuaggggagaugguuaua

SEQ ID NO: 1543837 - RNA, 18 nt, Human adenovirus B [HAdV-B]
acccuaugucgucacagg

SEQ ID NO: 1543838 - RNA, 16 nt, Human adenovirus B [HAdV-B]
acuaccgucaccucca

SEQ ID NO: 1543839 - RNA, 22 nt, Human adenovirus B [HAdV-B]
aucccgccaaacccaacacaca

SEQ ID NO: 1543840 - RNA, 18 nt, Human adenovirus B [HAdV-B]
ccugauauagcuuccuug

SEQ ID NO: 1543841 - RNA, 13 nt, Human adenovirus B [HAdV-B]
ccuccgccagaaa

SEQ ID NO: 1543842 - RNA, 21 nt, Human adenovirus B [HAdV-B]
cacacauuacaaacagguccc

SEQ ID NO: 1543843 - RNA, 14 nt, Human adenovirus B [HAdV-B]
ugucuuucuuccca

SEQ ID NO: 1543844 - RNA, 14 nt, Human adenovirus B [HAdV-B]
ucacaaucuggcaa

SEQ ID NO: 1543845 - RNA, 13 nt, Human adenovirus B [HAdV-B]
ucaauaaacauca

SEQ ID NO: 1543846 - RNA, 18 nt, Human adenovirus B [HAdV-B]
auuauacuccuacugcgc

SEQ ID NO: 1543847 - RNA, 19 nt, Human adenovirus B [HAdV-B]
gcaauauugccgccaagau

SEQ ID NO: 1543848 - RNA, 15 nt, Human adenovirus B [HAdV-B]
acagacauggcuucu

SEQ ID NO: 1543849 - RNA, 15 nt, Human adenovirus B [HAdV-B]
acuuuaugagccaga

SEQ ID NO: 1543850 - RNA, 19 nt, Human adenovirus B [HAdV-B]
aguugagcgccucggcugc

SEQ ID NO: 1543851 - RNA, 15 nt, Human adenovirus B [HAdV-B]
uaaaacuggagcacu

SEQ ID NO: 1543852 - RNA, 18 nt, Human adenovirus B [HAdV-B]
gcaaagccuacugccacc

SEQ ID NO: 1543853 - RNA, 11 nt, Human adenovirus B [HAdV-B]
uaucuggagcg

SEQ ID NO: 1543854 - RNA, 18 nt, Human adenovirus B [HAdV-B]
gcuauggagucacugcua

SEQ ID NO: 1543855 - RNA, 14 nt, Human adenovirus B [HAdV-B]
gccccaauggccac

SEQ ID NO: 1543856 - RNA, 17 nt, Human adenovirus B [HAdV-B]
ccugcaacgaauuuucu

SEQ ID NO: 1543857 - RNA, 14 nt, Human adenovirus B [HAdV-B]
ucacugguuuuuau

SEQ ID NO: 1543858 - RNA, 20 nt, Human adenovirus B [HAdV-B]
acccuguggugggugcagag

SEQ ID NO: 1543859 - RNA, 15 nt, Human adenovirus B [HAdV-B]
uccagaugaggccgg

SEQ ID NO: 1543860 - RNA, 15 nt, Human adenovirus B [HAdV-B]
caguagccacagcaa

SEQ ID NO: 1543861 - RNA, 20 nt, Human adenovirus B [HAdV-B]
accagacugaaaaccaaaga

SEQ ID NO: 1543862 - RNA, 21 nt, Human adenovirus B [HAdV-B]
gagcccagcauguaugccagu

SEQ ID NO: 1543863 - RNA, 16 nt, Human adenovirus B [HAdV-B]
cauggaaacucagcca

SEQ ID NO: 1543864 - RNA, 20 nt, Human adenovirus B [HAdV-B]
auuuuacaggccucuucucc

SEQ ID NO: 1543865 - RNA, 20 nt, Human adenovirus B [HAdV-B]
ugcuacagcugcugcagaag

SEQ ID NO: 1543866 - RNA, 13 nt, Human adenovirus B [HAdV-B]
caggcaaaacaaa

SEQ ID NO: 1543867 - RNA, 17 nt, Human adenovirus B [HAdV-B]
uuucuuuucccacaguu

SEQ ID NO: 1543868 - RNA, 22 nt, Human adenovirus B [HAdV-B]
caauggacucugacacuccugg

SEQ ID NO: 1543869 - RNA, 15 nt, Human adenovirus B [HAdV-B]
cauaucagccagaac

SEQ ID NO: 1543870 - RNA, 20 nt, Human adenovirus B [HAdV-B]
augaguggaacuuuaggaag

SEQ ID NO: 1543871 - RNA, 21 nt, Human adenovirus B [HAdV-B]
cuccuaaaggcgcuccaaaua

SEQ ID NO: 1543872 - RNA, 13 nt, Human adenovirus B [HAdV-B]
ucauagccacagc

SEQ ID NO: 1543873 - RNA, 13 nt, Human adenovirus B [HAdV-B]
acggauucugggg

SEQ ID NO: 1543874 - RNA, 17 nt, Human adenovirus B [HAdV-B]
gggcggucagcuaaaga

SEQ ID NO: 1543875 - RNA, 20 nt, Human adenovirus B [HAdV-B]
ugccaaacguggcaaaccgg

SEQ ID NO: 1543876 - RNA, 19 nt, Human adenovirus B [HAdV-B]
cacacccgacgaaaaaaac

SEQ ID NO: 1543877 - RNA, 17 nt, Human adenovirus B [HAdV-B]
guucucgcuggccacau

SEQ ID NO: 1543878 - RNA, 20 nt, Human adenovirus B [HAdV-B]
acuuuaggaaggaugugaac

SEQ ID NO: 1543879 - RNA, 13 nt, Human adenovirus B [HAdV-B]
aguucaaguacaa

SEQ ID NO: 1543880 - RNA, 12 nt, Human adenovirus B [HAdV-B]
caaaucuggaag

SEQ ID NO: 1543881 - RNA, 21 nt, Human adenovirus B [HAdV-B]
gaccgcgcuuauucaaaaaag

SEQ ID NO: 1543882 - RNA, 14 nt, Human adenovirus B [HAdV-B]
gcaaaacaaugacu

SEQ ID NO: 1543883 - RNA, 19 nt, Human adenovirus B [HAdV-B]
uacagccaacgagccagcg

SEQ ID NO: 1543884 - RNA, 18 nt, Human adenovirus B [HAdV-B]
gacaaaaaagaagaggaa

SEQ ID NO: 1543885 - RNA, 14 nt, Human adenovirus B [HAdV-B]
acccacgaugugac

SEQ ID NO: 1543886 - RNA, 13 nt, Human adenovirus B [HAdV-B]
agaaccugacccc

SEQ ID NO: 1543887 - RNA, 14 nt, Human adenovirus B [HAdV-B]
gacgagaaaacaag

SEQ ID NO: 1543888 - RNA, 15 nt, Human adenovirus B [HAdV-B]
caggaucacagagac

SEQ ID NO: 1543889 - RNA, 21 nt, Human adenovirus B [HAdV-B]
ucuuagguuacuggccagugc

SEQ ID NO: 1543890 - RNA, 19 nt, Human adenovirus B [HAdV-B]
uguauaggagcauuugcuu

SEQ ID NO: 1543891 - RNA, 22 nt, Human adenovirus B [HAdV-B]
cagcgcgaaauauggagcccag

SEQ ID NO: 1543892 - RNA, 15 nt, Human adenovirus B [HAdV-B]
cacauuccaccagcc

SEQ ID NO: 1543893 - RNA, 22 nt, Human adenovirus B [HAdV-B]
uugugcggcaggcaugcaagau

SEQ ID NO: 1543894 - RNA, 22 nt, Human adenovirus B [HAdV-B]
gcagucucgacagauaaagaca

SEQ ID NO: 1543895 - RNA, 20 nt, Human adenovirus B [HAdV-B]
aaaaauuucccaaacaaugg

SEQ ID NO: 1543896 - RNA, 16 nt, Human adenovirus B [HAdV-B]
ccguucucgcuggcca

SEQ ID NO: 1543897 - RNA, 16 nt, Human adenovirus B [HAdV-B]
caccccguccaauguc

SEQ ID NO: 1543898 - RNA, 12 nt, Human adenovirus B [HAdV-B]
guguuggacaga

SEQ ID NO: 1543899 - RNA, 19 nt, Human adenovirus B [HAdV-B]
ucgacagauaaagacagcg

SEQ ID NO: 1543900 - RNA, 19 nt, Human adenovirus B [HAdV-B]
augcaguuauugacagugu

SEQ ID NO: 1543901 - RNA, 21 nt, Human adenovirus B [HAdV-B]
cuuccaaggaugagacagugu

SEQ ID NO: 1543902 - RNA, 21 nt, Human adenovirus B [HAdV-B]
ccagccuguacuucuccauca

SEQ ID NO: 1543903 - RNA, 21 nt, Human adenovirus B [HAdV-B]
gcauagcuuccguggcgguuc

SEQ ID NO: 1543904 - RNA, 18 nt, Human adenovirus B [HAdV-B]
cugcccgccaccugcugc

SEQ ID NO: 1543905 - RNA, 19 nt, Human adenovirus B [HAdV-B]
gaagcaacgaagcuuggaa

SEQ ID NO: 1543906 - RNA, 20 nt, Human adenovirus B [HAdV-B]
aagcaaggguccgccacugc

SEQ ID NO: 1543907 - RNA, 19 nt, Human adenovirus B [HAdV-B]
guacaugggcaccuggagc

SEQ ID NO: 1543908 - RNA, 16 nt, Human adenovirus B [HAdV-B]
cgggcaugaccucugc

SEQ ID NO: 1543909 - RNA, 16 nt, Human adenovirus B [HAdV-B]
uccagucuccugccgc

SEQ ID NO: 1543910 - RNA, 15 nt, Human adenovirus B [HAdV-B]
ucgcgauccuuccag

SEQ ID NO: 1543911 - RNA, 20 nt, Human adenovirus B [HAdV-B]
ggaaaacgaggaggcagagg

SEQ ID NO: 1543912 - RNA, 15 nt, Human adenovirus B [HAdV-B]
agugcuuugagacug

SEQ ID NO: 1543913 - RNA, 20 nt, Human adenovirus B [HAdV-B]
ggcauggguguauggcagca

SEQ ID NO: 1543914 - RNA, 20 nt, Human adenovirus B [HAdV-B]
cguagacugauuuuacaggc

SEQ ID NO: 1543915 - RNA, 22 nt, Human adenovirus B [HAdV-B]
caaagaucuaccgccagugcug

SEQ ID NO: 1543916 - RNA, 17 nt, Human adenovirus B [HAdV-B]
gacagcccgccuaugau

SEQ ID NO: 1543917 - RNA, 23 nt, Human adenovirus B [HAdV-B]
cacaagguucccucaggaugucc

SEQ ID NO: 1543918 - RNA, 21 nt, Human adenovirus B [HAdV-B]
cgcaugaauuggcucagcgcc

SEQ ID NO: 1543919 - RNA, 13 nt, Human adenovirus B [HAdV-B]
cuaaauacacaua

SEQ ID NO: 1543920 - RNA, 19 nt, Human adenovirus B [HAdV-B]
caucuauuauuccuacucc

SEQ ID NO: 1543921 - RNA, 21 nt, Human adenovirus B [HAdV-B]
gaaacccagauaauaggcacc

SEQ ID NO: 1543922 - RNA, 16 nt, Human adenovirus B [HAdV-B]
uaccgcggcugagccc

SEQ ID NO: 1543923 - RNA, 21 nt, Human adenovirus B [HAdV-B]
acgcuggagaggucagaggag

SEQ ID NO: 1543924 - RNA, 19 nt, Human adenovirus B [HAdV-B]
agaaaaaaauuucccaaac

SEQ ID NO: 1543925 - RNA, 14 nt, Human adenovirus B [HAdV-B]
cugcaaucugugca

SEQ ID NO: 1543926 - RNA, 12 nt, Human adenovirus B [HAdV-B]
ugcagaaaucuu

SEQ ID NO: 1543927 - RNA, 20 nt, Human adenovirus B [HAdV-B]
ucuucaaccgcuuuccugag

SEQ ID NO: 1543928 - RNA, 15 nt, Human adenovirus B [HAdV-B]
ucaccaaggccaugg

SEQ ID NO: 1543929 - RNA, 15 nt, Human adenovirus B [HAdV-B]
accggcucugggcau

SEQ ID NO: 1543930 - RNA, 16 nt, Human adenovirus B [HAdV-B]
cagcaaccccaggcca

SEQ ID NO: 1543931 - RNA, 14 nt, Human adenovirus B [HAdV-B]
cugauuacuucuuu

SEQ ID NO: 1543932 - RNA, 18 nt, Human adenovirus B [HAdV-B]
gccgcuaugaacucugau

SEQ ID NO: 1543933 - RNA, 14 nt, Human adenovirus B [HAdV-B]
ugccaaaaaaacau

SEQ ID NO: 1543934 - RNA, 16 nt, Human adenovirus B [HAdV-B]
uccagcgcugccaggg

SEQ ID NO: 1543935 - RNA, 22 nt, Human adenovirus B [HAdV-B]
gauauucuugagcaggcggcug

SEQ ID NO: 1543936 - RNA, 18 nt, Human adenovirus B [HAdV-B]
gcuaccaucuccgcuccg

SEQ ID NO: 1543937 - RNA, 24 nt, Human adenovirus B [HAdV-B]
auuucuaucgaaggcaaaauagac

SEQ ID NO: 1543938 - RNA, 22 nt, Human adenovirus B [HAdV-B]
cauaggacccccaaucacuuca

SEQ ID NO: 1543939 - RNA, 15 nt, Human adenovirus B [HAdV-B]
cucccccagccaugc

SEQ ID NO: 1543940 - RNA, 15 nt, Human adenovirus B [HAdV-B]
gaacagcaagaggac

SEQ ID NO: 1543941 - RNA, 14 nt, Human adenovirus B [HAdV-B]
auuguguuucaagc

SEQ ID NO: 1543942 - RNA, 13 nt, Human adenovirus B [HAdV-B]
auggacaggaguc

SEQ ID NO: 1543943 - RNA, 16 nt, Human adenovirus B [HAdV-B]
ccucugggaugcaaau

SEQ ID NO: 1543944 - RNA, 14 nt, Human adenovirus B [HAdV-B]
cggcgcugcagagc

SEQ ID NO: 1543945 - RNA, 13 nt, Human adenovirus B [HAdV-B]
agcagcagcaauc

SEQ ID NO: 1543946 - RNA, 12 nt, Human adenovirus B [HAdV-B]
cagagcugccgc

SEQ ID NO: 1543947 - RNA, 19 nt, Human adenovirus B [HAdV-B]
agaaugagccuaacaggaa

SEQ ID NO: 1543948 - RNA, 22 nt, Human adenovirus B [HAdV-B]
cucaacacaagguucccucagg

SEQ ID NO: 1543949 - RNA, 20 nt, Human adenovirus B [HAdV-B]
cuaccuguuccgucuggcca

SEQ ID NO: 1543950 - RNA, 15 nt, Human adenovirus B [HAdV-B]
cucgcagcagcagca

SEQ ID NO: 1543951 - RNA, 20 nt, Human adenovirus B [HAdV-B]
guuaccuacuaaaccuguau

SEQ ID NO: 1543952 - RNA, 19 nt, Human adenovirus B [HAdV-B]
caaggucgcagugcauggu

SEQ ID NO: 1543953 - RNA, 16 nt, Human adenovirus B [HAdV-B]
gaugaaaugacaggga

SEQ ID NO: 1543954 - RNA, 22 nt, Human adenovirus B [HAdV-B]
gcuucucugaacuaucagaaug

SEQ ID NO: 1543955 - RNA, 18 nt, Human adenovirus B [HAdV-B]
ggccaccucguucaucau

SEQ ID NO: 1543956 - RNA, 19 nt, Human adenovirus B [HAdV-B]
gcaugauggauauguggcc

SEQ ID NO: 1543957 - RNA, 16 nt, Human adenovirus B [HAdV-B]
cguuauccagccugua

SEQ ID NO: 1543958 - RNA, 15 nt, Human adenovirus B [HAdV-B]
cccuaguguaccagg

SEQ ID NO: 1543959 - RNA, 12 nt, Human adenovirus B [HAdV-B]
aaggaugugaac

SEQ ID NO: 1543960 - RNA, 21 nt, Human adenovirus B [HAdV-B]
uacaagcgcagaccuccccaa

SEQ ID NO: 1543961 - RNA, 19 nt, Human adenovirus B [HAdV-B]
ggaaaacggauucugggga

SEQ ID NO: 1543962 - RNA, 16 nt, Human adenovirus B [HAdV-B]
uguaucgcaaugacag

SEQ ID NO: 1543963 - RNA, 23 nt, Human adenovirus B [HAdV-B]
ugcccuacucaaucugggaccug

SEQ ID NO: 1543964 - RNA, 14 nt, Human adenovirus B [HAdV-B]
caggucaggagccg

SEQ ID NO: 1543965 - RNA, 22 nt, Human adenovirus B [HAdV-B]
gcuggaaccgagggugagaauu

SEQ ID NO: 1543966 - RNA, 13 nt, Human adenovirus B [HAdV-B]
uggauaaaucagu

SEQ ID NO: 1543967 - RNA, 12 nt, Human adenovirus B [HAdV-B]
ggaggcagagga

SEQ ID NO: 1543968 - RNA, 17 nt, Human adenovirus B [HAdV-B]
gagcgugaugcagcagc

SEQ ID NO: 1543969 - RNA, 14 nt, Human adenovirus B [HAdV-B]
cucguccucagcga

SEQ ID NO: 1543970 - RNA, 20 nt, Human adenovirus B [HAdV-B]
ccucguuuacguacugguga

SEQ ID NO: 1543971 - RNA, 14 nt, Human adenovirus B [HAdV-B]
gaucuccuacuaag

SEQ ID NO: 1543972 - RNA, 18 nt, Human adenovirus B [HAdV-B]
gaucgcgguggggcgguc

SEQ ID NO: 1543973 - RNA, 21 nt, Human adenovirus B [HAdV-B]
aaaaagcacagcuagaucaaa

SEQ ID NO: 1543974 - RNA, 21 nt, Human adenovirus B [HAdV-B]
gaaccacacugccaacaccgc

SEQ ID NO: 1543975 - RNA, 18 nt, Human adenovirus B [HAdV-B]
cagauaaagacagcggcg

SEQ ID NO: 1543976 - RNA, 17 nt, Human adenovirus B [HAdV-B]
ucacaucucguccucag

SEQ ID NO: 1543977 - RNA, 21 nt, Human adenovirus B [HAdV-B]
aacucagcucaugcucuggac

SEQ ID NO: 1543978 - RNA, 22 nt, Human adenovirus B [HAdV-B]
auaaaucagucuuuccaucaca

SEQ ID NO: 1543979 - RNA, 20 nt, Human adenovirus B [HAdV-B]
ucaccagggaaaaguacagu

SEQ ID NO: 1543980 - RNA, 20 nt, Human adenovirus B [HAdV-B]
cagggggcaauucuggccca

SEQ ID NO: 1543981 - RNA, 16 nt, Human adenovirus B [HAdV-B]
guacaaacuguagaca

SEQ ID NO: 1543982 - RNA, 13 nt, Human adenovirus B [HAdV-B]
gucgcuacaaaaa

SEQ ID NO: 1543983 - RNA, 19 nt, Human adenovirus B [HAdV-B]
uuccucgagacgcccaggc

SEQ ID NO: 1543984 - RNA, 12 nt, Human adenovirus B [HAdV-B]
cuacuccugguu

SEQ ID NO: 1543985 - RNA, 20 nt, Human adenovirus B [HAdV-B]
ggaacaaagcuuggaacagc

SEQ ID NO: 1543986 - RNA, 19 nt, Human adenovirus B [HAdV-B]
uauuuugccucccccuucc

SEQ ID NO: 1543987 - RNA, 13 nt, Human adenovirus B [HAdV-B]
acgugaccugggg

SEQ ID NO: 1543988 - RNA, 19 nt, Human adenovirus B [HAdV-B]
gaaugccaucaucuccugc

SEQ ID NO: 1543989 - RNA, 13 nt, Human adenovirus B [HAdV-B]
ugggccauuuugg

SEQ ID NO: 1543990 - RNA, 16 nt, Human adenovirus B [HAdV-B]
auugccacagcuggca

SEQ ID NO: 1543991 - RNA, 15 nt, Human adenovirus B [HAdV-B]
cugccuggcugcgga

SEQ ID NO: 1543992 - RNA, 20 nt, Human adenovirus B [HAdV-B]
agagcucugacuggagcugg

SEQ ID NO: 1543993 - RNA, 15 nt, Human adenovirus B [HAdV-B]
ccucccaacaccccu

SEQ ID NO: 1543994 - RNA, 18 nt, Human adenovirus B [HAdV-B]
ugacucuccaaccucucc

SEQ ID NO: 1543995 - RNA, 13 nt, Human adenovirus B [HAdV-B]
ggcacgagccaac

SEQ ID NO: 1543996 - RNA, 12 nt, Human adenovirus B [HAdV-B]
ucagaacaccga

SEQ ID NO: 1543997 - RNA, 12 nt, Human adenovirus B [HAdV-B]
gcaggcagcagc

SEQ ID NO: 1543998 - RNA, 21 nt, Human adenovirus B [HAdV-B]
ggcaucucgauccagcagacc

SEQ ID NO: 1543999 - RNA, 18 nt, Human adenovirus B [HAdV-B]
uggaacacgaggaagagu

SEQ ID NO: 1544000 - RNA, 15 nt, Human adenovirus B [HAdV-B]
guguugcucaggcau

SEQ ID NO: 1544001 - RNA, 21 nt, Human adenovirus B [HAdV-B]
uccuaccacucggaugugauc

SEQ ID NO: 1544002 - RNA, 13 nt, Human adenovirus B [HAdV-B]
uaaacaacagcac

SEQ ID NO: 1544003 - RNA, 18 nt, Human adenovirus B [HAdV-B]
uuugccauccuucucaac

SEQ ID NO: 1544004 - RNA, 18 nt, Human adenovirus B [HAdV-B]
agcagcagaggaaaaaag

SEQ ID NO: 1544005 - RNA, 18 nt, Human adenovirus B [HAdV-B]
ccagaacuuccaacaaaa

SEQ ID NO: 1544006 - RNA, 17 nt, Human adenovirus B [HAdV-B]
gacaguaaaggaagagc

SEQ ID NO: 1544007 - RNA, 17 nt, Human adenovirus B [HAdV-B]
ccuacggaagccagcac

SEQ ID NO: 1544008 - RNA, 14 nt, Human adenovirus B [HAdV-B]
aaccagcagcggca

SEQ ID NO: 1544009 - RNA, 15 nt, Human adenovirus B [HAdV-B]
cugcaaucugugcac

SEQ ID NO: 1544010 - RNA, 14 nt, Human adenovirus B [HAdV-B]
cugucucaacccca

SEQ ID NO: 1544011 - RNA, 17 nt, Human adenovirus B [HAdV-B]
aagucuacccguuucuu

SEQ ID NO: 1544012 - RNA, 22 nt, Human adenovirus B [HAdV-B]
gcagagucggggucaagagcag

SEQ ID NO: 1544013 - RNA, 19 nt, Human adenovirus B [HAdV-B]
gcauccaccggucaugcca

SEQ ID NO: 1544014 - RNA, 23 nt, Human adenovirus B [HAdV-B]
agagucaauugucucugaagaaa

SEQ ID NO: 1544015 - RNA, 20 nt, Human adenovirus B [HAdV-B]
aaauggcuucacacaaagcc

SEQ ID NO: 1544016 - RNA, 15 nt, Human adenovirus B [HAdV-B]
ucaggaucacagaga

SEQ ID NO: 1544017 - RNA, 18 nt, Human adenovirus B [HAdV-B]
cuuacuugaaaucagcaa

SEQ ID NO: 1544018 - RNA, 19 nt, Human adenovirus B [HAdV-B]
uaauggaauaguguuuaug

SEQ ID NO: 1544019 - RNA, 21 nt, Human adenovirus B [HAdV-B]
cagagcgugggauuguuucug

SEQ ID NO: 1544020 - RNA, 15 nt, Human adenovirus B [HAdV-B]
ugcaggugguaguuu

SEQ ID NO: 1544021 - RNA, 19 nt, Human adenovirus B [HAdV-B]
aagcaugauuuuaauagcc

SEQ ID NO: 1544022 - RNA, 19 nt, Human adenovirus B [HAdV-B]
uccagcuuuugcugugcca

SEQ ID NO: 1544023 - RNA, 17 nt, Human adenovirus B [HAdV-B]
uugaauucgggaaucac

SEQ ID NO: 1544024 - RNA, 15 nt, Human adenovirus B [HAdV-B]
ccugcugcgcacugc

SEQ ID NO: 1544025 - RNA, 18 nt, Human adenovirus B [HAdV-B]
cucacgcuugccagcacg

SEQ ID NO: 1544026 - RNA, 19 nt, Human adenovirus B [HAdV-B]
ccagaacuuccaacaaaaa

SEQ ID NO: 1544027 - RNA, 17 nt, Human adenovirus B [HAdV-B]
cagguuaucgcaccuga

SEQ ID NO: 1544028 - RNA, 22 nt, Human adenovirus B [HAdV-B]
accgaaaaguauggaggcaggg

SEQ ID NO: 1544029 - RNA, 17 nt, Human adenovirus B [HAdV-B]
uccacauuccaaacagu

SEQ ID NO: 1544030 - RNA, 22 nt, Human adenovirus B [HAdV-B]
cauccauggagguuugggccau

SEQ ID NO: 1544031 - RNA, 16 nt, Human adenovirus B [HAdV-B]
cucccccagccaugca

SEQ ID NO: 1544032 - RNA, 20 nt, Human adenovirus B [HAdV-B]
ucucugaccaugacuuugag

SEQ ID NO: 1544033 - RNA, 19 nt, Human adenovirus B [HAdV-B]
ucccgcugucaaccugccc

SEQ ID NO: 1544034 - RNA, 15 nt, Human adenovirus B [HAdV-B]
caggacagaaacaca

SEQ ID NO: 1544035 - RNA, 17 nt, Human adenovirus B [HAdV-B]
cccaauuggcuccagca

SEQ ID NO: 1544036 - RNA, 13 nt, Human adenovirus B [HAdV-B]
ccagaaaacaaaa

SEQ ID NO: 1544037 - RNA, 18 nt, Human adenovirus B [HAdV-B]
uucuucgcugucuugacu

SEQ ID NO: 1544038 - RNA, 16 nt, Human adenovirus B [HAdV-B]
cccaaugcaacaugac

SEQ ID NO: 1544039 - RNA, 20 nt, Human adenovirus B [HAdV-B]
caucuuuuuuaaaaaucaaa

SEQ ID NO: 1544040 - RNA, 15 nt, Human adenovirus B [HAdV-B]
gcgaaggugaagauu

SEQ ID NO: 1544041 - RNA, 20 nt, Human adenovirus B [HAdV-B]
cagcacuggacaugacagcg

SEQ ID NO: 1544042 - RNA, 13 nt, Human adenovirus B [HAdV-B]
agcggugguguau

SEQ ID NO: 1544043 - RNA, 12 nt, Human adenovirus B [HAdV-B]
ggagucacugcu

SEQ ID NO: 1544044 - RNA, 17 nt, Human adenovirus B [HAdV-B]
ucccgcaggaccugcuc

SEQ ID NO: 1544045 - RNA, 12 nt, Human adenovirus B [HAdV-B]
guccuuccaggg

SEQ ID NO: 1544046 - RNA, 18 nt, Human adenovirus B [HAdV-B]
gaauuuucucccagcggc

SEQ ID NO: 1544047 - RNA, 12 nt, Human adenovirus B [HAdV-B]
aggauuugcaug

SEQ ID NO: 1544048 - RNA, 13 nt, Human adenovirus B [HAdV-B]
uguucccagaguu

SEQ ID NO: 1544049 - RNA, 20 nt, Human adenovirus B [HAdV-B]
aauccacacauuacaaacag

SEQ ID NO: 1544050 - RNA, 13 nt, Human adenovirus B [HAdV-B]
gcaaaaacaagau

SEQ ID NO: 1544051 - RNA, 18 nt, Human adenovirus B [HAdV-B]
aggguugcauucacugcu

SEQ ID NO: 1544052 - RNA, 16 nt, Human adenovirus B [HAdV-B]
uguuuggucuuccuug

SEQ ID NO: 1544053 - RNA, 15 nt, Human adenovirus B [HAdV-B]
cguguugcucaggca

SEQ ID NO: 1544054 - RNA, 14 nt, Human adenovirus B [HAdV-B]
cucaaaaacacacu

SEQ ID NO: 1544055 - RNA, 15 nt, Human adenovirus B [HAdV-B]
cugcuccuucugaau

SEQ ID NO: 1544056 - RNA, 17 nt, Human adenovirus B [HAdV-B]
acauugcuucucugaac

SEQ ID NO: 1544057 - RNA, 15 nt, Human adenovirus B [HAdV-B]
auuuuuaacuccuca

SEQ ID NO: 1544058 - RNA, 23 nt, Human adenovirus B [HAdV-B]
gaucugcaaucaugcccacaucc

SEQ ID NO: 1544059 - RNA, 17 nt, Human adenovirus B [HAdV-B]
cuggcagaccucaucuu

SEQ ID NO: 1544060 - RNA, 17 nt, Human adenovirus B [HAdV-B]
ugcuacagcugcugcag

SEQ ID NO: 1544061 - RNA, 17 nt, Human adenovirus B [HAdV-B]
ugugauggcgcuagcag

SEQ ID NO: 1544062 - RNA, 15 nt, Human adenovirus B [HAdV-B]
gaguacuuggaagac

SEQ ID NO: 1544063 - RNA, 17 nt, Human adenovirus B [HAdV-B]
cauugcuuauugcuugu

SEQ ID NO: 1544064 - RNA, 13 nt, Human adenovirus B [HAdV-B]
aggaggacagucu

SEQ ID NO: 1544065 - RNA, 13 nt, Human adenovirus B [HAdV-B]
uaucauugagaac

SEQ ID NO: 1544066 - RNA, 22 nt, Human adenovirus B [HAdV-B]
cacaacgugguaacugggcucu

SEQ ID NO: 1544067 - RNA, 20 nt, Human adenovirus B [HAdV-B]
gccauucucgagcugccagu

SEQ ID NO: 1544068 - RNA, 14 nt, Human adenovirus B [HAdV-B]
uccugaaaccauuu

SEQ ID NO: 1544069 - RNA, 12 nt, Human adenovirus B [HAdV-B]
gaucaccugggc

SEQ ID NO: 1544070 - RNA, 22 nt, Human adenovirus B [HAdV-B]
aggaggaaaacgaggaggcaga

SEQ ID NO: 1544071 - RNA, 18 nt, Human adenovirus B [HAdV-B]
aaaauaaaaaaaaaaaca

SEQ ID NO: 1544072 - RNA, 13 nt, Human adenovirus B [HAdV-B]
uuaagagggagag

SEQ ID NO: 1544073 - RNA, 18 nt, Human adenovirus B [HAdV-B]
acugcccuccgacuuugu

SEQ ID NO: 1544074 - RNA, 22 nt, Human adenovirus B [HAdV-B]
gaaaccuugcgcaaacucgaag

SEQ ID NO: 1544075 - RNA, 18 nt, Human adenovirus B [HAdV-B]
gggcaacuccgacugcag

SEQ ID NO: 1544076 - RNA, 15 nt, Human adenovirus B [HAdV-B]
cucagguugucaguu

SEQ ID NO: 1544077 - RNA, 21 nt, Human adenovirus B [HAdV-B]
cccauggaugagcccacccug

SEQ ID NO: 1544078 - RNA, 18 nt, Human adenovirus B [HAdV-B]
gauuucauagccacagca

SEQ ID NO: 1544079 - RNA, 16 nt, Human adenovirus B [HAdV-B]
aagcauacaauccaga

SEQ ID NO: 1544080 - RNA, 15 nt, Human adenovirus B [HAdV-B]
gugacgcugccaccg

SEQ ID NO: 1544081 - RNA, 11 nt, Human adenovirus B [HAdV-B]
caccaaugcca

SEQ ID NO: 1544082 - RNA, 14 nt, Human adenovirus B [HAdV-B]
augauaacagaugu

SEQ ID NO: 1544083 - RNA, 17 nt, Human adenovirus B [HAdV-B]
ccauucuuaaacacacc

SEQ ID NO: 1544084 - RNA, 16 nt, Human adenovirus B [HAdV-B]
aggaccagugcuuuga

SEQ ID NO: 1544085 - RNA, 19 nt, Human adenovirus B [HAdV-B]
uaagugcuuugagacugau

SEQ ID NO: 1544086 - RNA, 19 nt, Human adenovirus B [HAdV-B]
uucuggcccaauugcaagc

SEQ ID NO: 1544087 - RNA, 17 nt, Human adenovirus B [HAdV-B]
caauguugccgcugccu

SEQ ID NO: 1544088 - RNA, 12 nt, Human adenovirus B [HAdV-B]
ggaauuggaagg

SEQ ID NO: 1544089 - RNA, 19 nt, Human adenovirus B [HAdV-B]
cuaucagaaugaccacagc

SEQ ID NO: 1544090 - RNA, 15 nt, Human adenovirus B [HAdV-B]
caguuuggaagccac

SEQ ID NO: 1544091 - RNA, 20 nt, Human adenovirus B [HAdV-B]
gaccucaucuucccagagcg

SEQ ID NO: 1544092 - RNA, 21 nt, Human adenovirus B [HAdV-B]
cagcggcggcgaccuccaaca

SEQ ID NO: 1544093 - RNA, 11 nt, Human adenovirus B [HAdV-B]
auaaaagaaaa

SEQ ID NO: 1544094 - RNA, 14 nt, Human adenovirus B [HAdV-B]
ccaguccugccacc

SEQ ID NO: 1544095 - RNA, 18 nt, Human adenovirus B [HAdV-B]
acaccgcucccccagcca

SEQ ID NO: 1544096 - RNA, 17 nt, Human adenovirus B [HAdV-B]
cuggagugucacugccg

SEQ ID NO: 1544097 - RNA, 15 nt, Human adenovirus B [HAdV-B]
cacguggcugcagcc

SEQ ID NO: 1544098 - RNA, 16 nt, Human adenovirus B [HAdV-B]
caguggauugcagaag

SEQ ID NO: 1544099 - RNA, 14 nt, Human adenovirus B [HAdV-B]
cgcucacaccucac

SEQ ID NO: 1544100 - RNA, 20 nt, Human adenovirus B [HAdV-B]
ucuccaaccucuccacaaua

SEQ ID NO: 1544101 - RNA, 17 nt, Human adenovirus B [HAdV-B]
uuaagcauuccaccgcc

SEQ ID NO: 1544102 - RNA, 23 nt, Human adenovirus B [HAdV-B]
ccagcuguuucugguggugcaac

SEQ ID NO: 1544103 - RNA, 13 nt, Human adenovirus B [HAdV-B]
auuaaaaaaugau

SEQ ID NO: 1544104 - RNA, 22 nt, Human adenovirus B [HAdV-B]
gcaggggacgcuacagugcagu

SEQ ID NO: 1544105 - RNA, 12 nt, Human adenovirus B [HAdV-B]
gacccaggccau

SEQ ID NO: 1544106 - RNA, 18 nt, Human adenovirus B [HAdV-B]
agagucucugacaaagug

SEQ ID NO: 1544107 - RNA, 18 nt, Human adenovirus B [HAdV-B]
ggccgagaagguggcugc

SEQ ID NO: 1544108 - RNA, 16 nt, Human adenovirus B [HAdV-B]
acaagagcgaagauca

SEQ ID NO: 1544109 - RNA, 14 nt, Human adenovirus B [HAdV-B]
cagcagcaccucac

SEQ ID NO: 1544110 - RNA, 15 nt, Human adenovirus B [HAdV-B]
uguacguagcagcga

SEQ ID NO: 1544111 - RNA, 23 nt, Human adenovirus B [HAdV-B]
augugagcggagacggcuugcug

SEQ ID NO: 1544112 - RNA, 18 nt, Human adenovirus B [HAdV-B]
ucuccaaccucuccacaa

SEQ ID NO: 1544113 - RNA, 12 nt, Human adenovirus B [HAdV-B]
acgaggaggcag

SEQ ID NO: 1544114 - RNA, 15 nt, Human adenovirus B [HAdV-B]
caaaggugucucuga

SEQ ID NO: 1544115 - RNA, 18 nt, Human adenovirus B [HAdV-B]
ggagccgaaaucuugaaa

SEQ ID NO: 1544116 - RNA, 21 nt, Human adenovirus B [HAdV-B]
gcaccgucgcuuccgaccugg

SEQ ID NO: 1544117 - RNA, 20 nt, Human adenovirus B [HAdV-B]
gguuaccguagaacuagagu

SEQ ID NO: 1544118 - RNA, 14 nt, Human adenovirus B [HAdV-B]
augacagaaugcau

SEQ ID NO: 1544119 - RNA, 21 nt, Human adenovirus B [HAdV-B]
auacaaagccucaucagccau

SEQ ID NO: 1544120 - RNA, 19 nt, Human adenovirus B [HAdV-B]
cauccaccggucaugccag

SEQ ID NO: 1544121 - RNA, 17 nt, Human adenovirus B [HAdV-B]
acagggaacugaugcac

SEQ ID NO: 1544122 - RNA, 13 nt, Human adenovirus B [HAdV-B]
ccaacuaucucuc

SEQ ID NO: 1544123 - RNA, 21 nt, Human adenovirus B [HAdV-B]
ccgcaaugcgggcggcgcugc

SEQ ID NO: 1544124 - RNA, 18 nt, Human adenovirus B [HAdV-B]
cacacuucugccccagcg

SEQ ID NO: 1544125 - RNA, 21 nt, Human adenovirus B [HAdV-B]
gucaccagggaaaaguacagu

SEQ ID NO: 1544126 - RNA, 15 nt, Human adenovirus B [HAdV-B]
cagcugcugcagaag

SEQ ID NO: 1544127 - RNA, 15 nt, Human adenovirus B [HAdV-B]
cucaaugcuucuuuu

SEQ ID NO: 1544128 - RNA, 18 nt, Human adenovirus B [HAdV-B]
gugccagguggucucugg

SEQ ID NO: 1544129 - RNA, 16 nt, Human adenovirus B [HAdV-B]
uggaagagcucagccg

SEQ ID NO: 1544130 - RNA, 17 nt, Human adenovirus B [HAdV-B]
auccucggcugcggaga

SEQ ID NO: 1544131 - RNA, 20 nt, Human adenovirus B [HAdV-B]
gaaucagaaugacccgcagg

SEQ ID NO: 1544132 - RNA, 18 nt, Human adenovirus B [HAdV-B]
cacugguuaccgaggaag

SEQ ID NO: 1544133 - RNA, 18 nt, Human adenovirus B [HAdV-B]
cuacuauagccagcaaau

SEQ ID NO: 1544134 - RNA, 21 nt, Human adenovirus B [HAdV-B]
gacaaugaggcuuucagagag

SEQ ID NO: 1544135 - RNA, 20 nt, Human adenovirus B [HAdV-B]
gccaucaucuccugcuugca

SEQ ID NO: 1544136 - RNA, 19 nt, Human adenovirus B [HAdV-B]
aucauauugcuugaaagcc

SEQ ID NO: 1544137 - RNA, 14 nt, Human adenovirus B [HAdV-B]
ggaggugaagauag

SEQ ID NO: 1544138 - RNA, 22 nt, Human adenovirus B [HAdV-B]
cguuuggacccgccgccagcaa

SEQ ID NO: 1544139 - RNA, 21 nt, Human adenovirus B [HAdV-B]
caccagguuguaucuggugga

SEQ ID NO: 1544140 - RNA, 15 nt, Human adenovirus B [HAdV-B]
auaccuguguagaug

SEQ ID NO: 1544141 - RNA, 22 nt, Human adenovirus B [HAdV-B]
gaagcuucuugcuucuugcaaa

SEQ ID NO: 1544142 - RNA, 16 nt, Human adenovirus B [HAdV-B]
ccgcaggcaagcagcc

SEQ ID NO: 1544143 - RNA, 14 nt, Human adenovirus B [HAdV-B]
uuucuaacuccuca

SEQ ID NO: 1544144 - RNA, 15 nt, Human adenovirus B [HAdV-B]
caccccgcacaacua

SEQ ID NO: 1544145 - RNA, 16 nt, Human adenovirus B [HAdV-B]
guccugccagggcaca

SEQ ID NO: 1544146 - RNA, 14 nt, Human adenovirus B [HAdV-B]
gacugaaaaccaaa

SEQ ID NO: 1544147 - RNA, 20 nt, Human adenovirus B [HAdV-B]
cucauauuugucagcauugu

SEQ ID NO: 1544148 - RNA, 15 nt, Human adenovirus B [HAdV-B]
guaucgcgaagccau

SEQ ID NO: 1544149 - RNA, 18 nt, Human adenovirus B [HAdV-B]
uuacacacaauaacaaaa

SEQ ID NO: 1544150 - RNA, 17 nt, Human adenovirus B [HAdV-B]
cauaguuauguuccuga

SEQ ID NO: 1544151 - RNA, 20 nt, Human adenovirus B [HAdV-B]
cacuguauuacuuccucgag

SEQ ID NO: 1544152 - RNA, 15 nt, Human adenovirus B [HAdV-B]
caaaacaacgagcag

SEQ ID NO: 1544153 - RNA, 15 nt, Human adenovirus B [HAdV-B]
gcgggacagcccgcc

SEQ ID NO: 1544154 - RNA, 14 nt, Human adenovirus B [HAdV-B]
ugggggugcuggcu

SEQ ID NO: 1544155 - RNA, 21 nt, Human adenovirus B [HAdV-B]
acagcuuucuggucagcugca

SEQ ID NO: 1544156 - RNA, 18 nt, Human adenovirus B [HAdV-B]
uuaccccuacggaagcca

SEQ ID NO: 1544157 - RNA, 21 nt, Human adenovirus B [HAdV-B]
uccuuaaacaucuagcaagac

SEQ ID NO: 1544158 - RNA, 14 nt, Human adenovirus B [HAdV-B]
uggcagaacacacu

SEQ ID NO: 1544159 - RNA, 18 nt, Human adenovirus B [HAdV-B]
cccagaagauauggagga

SEQ ID NO: 1544160 - RNA, 12 nt, Human adenovirus B [HAdV-B]
guagaggaaugu

SEQ ID NO: 1544161 - RNA, 18 nt, Human adenovirus B [HAdV-B]
auggcgaugaugggcugg

SEQ ID NO: 1544162 - RNA, 13 nt, Human adenovirus B [HAdV-B]
augaggcuuucag

SEQ ID NO: 1544163 - RNA, 17 nt, Human adenovirus B [HAdV-B]
auguguacugaguuuaa

SEQ ID NO: 1544164 - RNA, 20 nt, Human adenovirus B [HAdV-B]
acuuggaagacugauggcac

SEQ ID NO: 1544165 - RNA, 19 nt, Human adenovirus B [HAdV-B]
ggcagaccucaucuuccca

SEQ ID NO: 1544166 - RNA, 19 nt, Human adenovirus B [HAdV-B]
agcucuuaauuugggccau

SEQ ID NO: 1544167 - RNA, 17 nt, Human adenovirus B [HAdV-B]
uuucccaagcuuucagu

SEQ ID NO: 1544168 - RNA, 15 nt, Human adenovirus B [HAdV-B]
aaucuaaugauugca

SEQ ID NO: 1544169 - RNA, 15 nt, Human adenovirus B [HAdV-B]
acaaugucaacccau

SEQ ID NO: 1544170 - RNA, 13 nt, Human adenovirus B [HAdV-B]
gguaggagaaaga

SEQ ID NO: 1544171 - RNA, 19 nt, Human adenovirus B [HAdV-B]
ccugcgagccaaauccucg

SEQ ID NO: 1544172 - RNA, 18 nt, Human adenovirus B [HAdV-B]
ccacuagacaagucagua

SEQ ID NO: 1544173 - RNA, 19 nt, Human adenovirus B [HAdV-B]
cagccccccucgcagcagc

SEQ ID NO: 1544174 - RNA, 15 nt, Human adenovirus B [HAdV-B]
ccuuguguccuccaa

SEQ ID NO: 1544175 - RNA, 20 nt, Human adenovirus B [HAdV-B]
gaggccuuaucaaaugcuca

SEQ ID NO: 1544176 - RNA, 22 nt, Human adenovirus B [HAdV-B]
caacaaccguggucauuucuug

SEQ ID NO: 1544177 - RNA, 20 nt, Human adenovirus B [HAdV-B]
gauuacuuugauauaaucug

SEQ ID NO: 1544178 - RNA, 19 nt, Human adenovirus B [HAdV-B]
gaugcagcagcagcaggcg

SEQ ID NO: 1544179 - RNA, 21 nt, Human adenovirus B [HAdV-B]
aucaacgugacagcaaaugac

SEQ ID NO: 1544180 - RNA, 21 nt, Human adenovirus B [HAdV-B]
aacgagcagauaacuaucacc

SEQ ID NO: 1544181 - RNA, 16 nt, Human adenovirus B [HAdV-B]
cugccaccuccacuga

SEQ ID NO: 1544182 - RNA, 16 nt, Human adenovirus B [HAdV-B]
guuagcgccagcagga

SEQ ID NO: 1544183 - RNA, 19 nt, Human adenovirus B [HAdV-B]
ggacccuccaguggaggag

SEQ ID NO: 1544184 - RNA, 16 nt, Human adenovirus B [HAdV-B]
gacggcggugaugcaa

SEQ ID NO: 1544185 - RNA, 16 nt, Human adenovirus B [HAdV-B]
ccaugagcaggcaggu

SEQ ID NO: 1544186 - RNA, 16 nt, Human adenovirus B [HAdV-B]
gcaaucgcagugcagg

SEQ ID NO: 1544187 - RNA, 22 nt, Human adenovirus B [HAdV-B]
cugagcuaucucggcugcgaca

SEQ ID NO: 1544188 - RNA, 16 nt, Human adenovirus B [HAdV-B]
agucgaggaacccggc

SEQ ID NO: 1544189 - RNA, 19 nt, Human adenovirus B [HAdV-B]
aagccauagggcaaaguca

SEQ ID NO: 1544190 - RNA, 19 nt, Human adenovirus B [HAdV-B]
caccagggaaaaguacagu

SEQ ID NO: 1544191 - RNA, 18 nt, Human adenovirus B [HAdV-B]
uagauugcccaggacuuu

SEQ ID NO: 1544192 - RNA, 11 nt, Human adenovirus B [HAdV-B]
cagaggcuggu

SEQ ID NO: 1544193 - RNA, 19 nt, Human adenovirus B [HAdV-B]
cagcagcaggcgacggcgg

SEQ ID NO: 1544194 - RNA, 22 nt, Human adenovirus B [HAdV-B]
caguagaugggacgagaccgga

SEQ ID NO: 1544195 - RNA, 21 nt, Human adenovirus B [HAdV-B]
uguauaggagcauuugcuucc

SEQ ID NO: 1544196 - RNA, 20 nt, Human adenovirus B [HAdV-B]
auuaaaugacguucccucaa

SEQ ID NO: 1544197 - RNA, 14 nt, Human adenovirus B [HAdV-B]
cagaggaacacauu

SEQ ID NO: 1544198 - RNA, 13 nt, Human adenovirus B [HAdV-B]
gucucaaccccag

SEQ ID NO: 1544199 - RNA, 20 nt, Human adenovirus B [HAdV-B]
cacgagugccaucacaucuc

SEQ ID NO: 1544200 - RNA, 14 nt, Human adenovirus B [HAdV-B]
gagaaaaagaaaac

SEQ ID NO: 1544201 - RNA, 19 nt, Human adenovirus B [HAdV-B]
aaacuuuuauccagcuuuu

SEQ ID NO: 1544202 - RNA, 18 nt, Human adenovirus B [HAdV-B]
aagccaaaauagaagcug

SEQ ID NO: 1544203 - RNA, 23 nt, Human adenovirus B [HAdV-B]
ucauccauggagguuugggccau

SEQ ID NO: 1544204 - RNA, 17 nt, Human adenovirus B [HAdV-B]
ugauuauucuuugcuac

SEQ ID NO: 1544205 - RNA, 21 nt, Human adenovirus B [HAdV-B]
agacgcgcuccuuaaacaucu

SEQ ID NO: 1544206 - RNA, 20 nt, Human adenovirus B [HAdV-B]
gucggggucaagagcaggaa

SEQ ID NO: 1544207 - RNA, 23 nt, Human adenovirus B [HAdV-B]
cuugcgcaaguuugcuccggaag

SEQ ID NO: 1544208 - RNA, 20 nt, Human adenovirus B [HAdV-B]
caguggcagccuagucgcag

SEQ ID NO: 1544209 - RNA, 22 nt, Human adenovirus B [HAdV-B]
aaaaugccggccaauugccauu

SEQ ID NO: 1544210 - RNA, 20 nt, Human adenovirus B [HAdV-B]
aaacgaggaggcagaggagg

SEQ ID NO: 1544211 - RNA, 15 nt, Human adenovirus B [HAdV-B]
gcaguaucuggagcg

SEQ ID NO: 1544212 - RNA, 17 nt, Human adenovirus B [HAdV-B]
gauccauggaugcccau

SEQ ID NO: 1544213 - RNA, 17 nt, Human adenovirus B [HAdV-B]
caugccaaacgugaacg

SEQ ID NO: 1544214 - RNA, 14 nt, Human adenovirus B [HAdV-B]
aaauugucauguau

SEQ ID NO: 1544215 - RNA, 12 nt, Human adenovirus B [HAdV-B]
auaaaacaggac

SEQ ID NO: 1544216 - RNA, 21 nt, Human adenovirus B [HAdV-B]
accugcugcuucucccaggcu

SEQ ID NO: 1544217 - RNA, 23 nt, Human adenovirus B [HAdV-B]
auacugggugcgugacgcugcca

SEQ ID NO: 1544218 - RNA, 23 nt, Human adenovirus B [HAdV-B]
uuagacagcaaccccaggccaac

SEQ ID NO: 1544219 - RNA, 20 nt, Human adenovirus B [HAdV-B]
aguacuggcuaccuaucaca

SEQ ID NO: 1544220 - RNA, 14 nt, Human adenovirus B [HAdV-B]
gguagaacugcugc

SEQ ID NO: 1544221 - RNA, 12 nt, Human adenovirus B [HAdV-B]
ccgcaagagcuc

SEQ ID NO: 1544222 - RNA, 11 nt, Human adenovirus B [HAdV-B]
gccggacagga

SEQ ID NO: 1544223 - RNA, 13 nt, Human adenovirus B [HAdV-B]
auggcgcuagcag

SEQ ID NO: 1544224 - RNA, 14 nt, Human adenovirus B [HAdV-B]
gggauguaguuucu

SEQ ID NO: 1544225 - RNA, 21 nt, Human adenovirus B [HAdV-B]
aggaggauuaaagauuacagc

SEQ ID NO: 1544226 - RNA, 20 nt, Human adenovirus B [HAdV-B]
gcccccucccccugcugcua

SEQ ID NO: 1544227 - RNA, 16 nt, Human adenovirus B [HAdV-B]
ugcccgccaccugcug

SEQ ID NO: 1544228 - RNA, 16 nt, Human adenovirus B [HAdV-B]
ucuagcaagacagucg

SEQ ID NO: 1544229 - RNA, 19 nt, Human adenovirus B [HAdV-B]
cucuuucuucuucgcuguc

SEQ ID NO: 1544230 - RNA, 23 nt, Human adenovirus B [HAdV-B]
ccauaaccuacuacgccugcugc

SEQ ID NO: 1544231 - RNA, 22 nt, Human adenovirus B [HAdV-B]
gcacugggcauagucgcaccgc

SEQ ID NO: 1544232 - RNA, 20 nt, Human adenovirus B [HAdV-B]
agcugccuauaguacuccac

SEQ ID NO: 1544233 - RNA, 17 nt, Human adenovirus B [HAdV-B]
cauuaacuuugaugaac

SEQ ID NO: 1544234 - RNA, 17 nt, Human adenovirus B [HAdV-B]
cacugccaacaccgcuc

SEQ ID NO: 1544235 - RNA, 20 nt, Human adenovirus B [HAdV-B]
aaugagucgcagacguccug

SEQ ID NO: 1544236 - RNA, 15 nt, Human adenovirus B [HAdV-B]
ccucucaccuaccgc

SEQ ID NO: 1544237 - RNA, 23 nt, Human adenovirus B [HAdV-B]
acgaggaaaaggagcagagcuua

SEQ ID NO: 1544238 - RNA, 15 nt, Human adenovirus B [HAdV-B]
cuuaaucccagaaau

SEQ ID NO: 1544239 - RNA, 19 nt, Human adenovirus B [HAdV-B]
aggaugucacuccacagcu

SEQ ID NO: 1544240 - RNA, 18 nt, Human adenovirus B [HAdV-B]
aauaaaaaaaaaaacaag

SEQ ID NO: 1544241 - RNA, 18 nt, Human adenovirus B [HAdV-B]
cgaagcuaauuugggaca

SEQ ID NO: 1544242 - RNA, 23 nt, Human adenovirus B [HAdV-B]
uccaguggaggaggcggaguagc

SEQ ID NO: 1544243 - RNA, 12 nt, Human adenovirus B [HAdV-B]
gugcugcacagc

SEQ ID NO: 1544244 - RNA, 11 nt, Human adenovirus B [HAdV-B]
uuuccagaagc

SEQ ID NO: 1544245 - RNA, 21 nt, Human adenovirus B [HAdV-B]
ccacccuaugucgucacaggc

SEQ ID NO: 1544246 - RNA, 14 nt, Human adenovirus B [HAdV-B]
gaagacacuggcag

SEQ ID NO: 1544247 - RNA, 18 nt, Human adenovirus B [HAdV-B]
gagcccgagucugcaagu

SEQ ID NO: 1544248 - RNA, 23 nt, Human adenovirus B [HAdV-B]
uggcuuaccagacaaaguacagc

SEQ ID NO: 1544249 - RNA, 17 nt, Human adenovirus B [HAdV-B]
caaacugcuuagccaga

SEQ ID NO: 1544250 - RNA, 21 nt, Human adenovirus B [HAdV-B]
ccgacuuugugccucucaccu

SEQ ID NO: 1544251 - RNA, 23 nt, Human adenovirus B [HAdV-B]
aagucagucgcgcuuugggacag

SEQ ID NO: 1544252 - RNA, 18 nt, Human adenovirus B [HAdV-B]
agugccaucacaucucgu

SEQ ID NO: 1544253 - RNA, 24 nt, Human adenovirus B [HAdV-B]
aaugacggauuucugugggacgac

SEQ ID NO: 1544254 - RNA, 13 nt, Human adenovirus B [HAdV-B]
gaagggguucauu

SEQ ID NO: 1544255 - RNA, 22 nt, Human adenovirus B [HAdV-B]
cucugcguucgcucaccagaag

SEQ ID NO: 1544256 - RNA, 18 nt, Human adenovirus B [HAdV-B]
cgguacaccggauugcag

SEQ ID NO: 1544257 - RNA, 21 nt, Human adenovirus B [HAdV-B]
aacacaacaacucuggcuuug

SEQ ID NO: 1544258 - RNA, 23 nt, Human adenovirus B [HAdV-B]
cucaccauuaccaacugacuguc

SEQ ID NO: 1544259 - RNA, 17 nt, Human adenovirus B [HAdV-B]
cagcagcuccgccaguc

SEQ ID NO: 1544260 - RNA, 18 nt, Human adenovirus B [HAdV-B]
gcccaguccugccaccac

SEQ ID NO: 1544261 - RNA, 22 nt, Human adenovirus B [HAdV-B]
aaggacuuacauucaauucaaa

SEQ ID NO: 1544262 - RNA, 14 nt, Human adenovirus B [HAdV-B]
ccgcacuggcugcc

SEQ ID NO: 1544263 - RNA, 16 nt, Human adenovirus B [HAdV-B]
uuuuaggauaaaacag

SEQ ID NO: 1544264 - RNA, 15 nt, Human adenovirus B [HAdV-B]
gguccgaccuggaag

SEQ ID NO: 1544265 - RNA, 20 nt, Human adenovirus B [HAdV-B]
agaaguaggcugauugccac

SEQ ID NO: 1544266 - RNA, 15 nt, Human adenovirus B [HAdV-B]
cauggaaacucagcc

SEQ ID NO: 1544267 - RNA, 17 nt, Human adenovirus B [HAdV-B]
acuuuaaagaaaaaguu

SEQ ID NO: 1544268 - RNA, 17 nt, Human adenovirus B [HAdV-B]
uacuuucucuagcagca

SEQ ID NO: 1544269 - RNA, 18 nt, Human adenovirus B [HAdV-B]
cguagaggaauguuuaug

SEQ ID NO: 1544270 - RNA, 11 nt, Human adenovirus B [HAdV-B]
aaccugcugcu

SEQ ID NO: 1544271 - RNA, 18 nt, Human adenovirus B [HAdV-B]
guugaucaccugggcagc

SEQ ID NO: 1544272 - RNA, 19 nt, Human adenovirus B [HAdV-B]
uguuuggucuuccuuggcu

SEQ ID NO: 1544273 - RNA, 23 nt, Human adenovirus B [HAdV-B]
uuuugcugguuuccgaauggcag

SEQ ID NO: 1544274 - RNA, 12 nt, Human adenovirus B [HAdV-B]
ugcaacccccag

SEQ ID NO: 1544275 - RNA, 13 nt, Human adenovirus B [HAdV-B]
agaauacaccaau

SEQ ID NO: 1544276 - RNA, 19 nt, Human adenovirus B [HAdV-B]
aacuaucucuccuaccacu

SEQ ID NO: 1544277 - RNA, 21 nt, Human adenovirus B [HAdV-B]
caugagcaaacaguauucucu

SEQ ID NO: 1544278 - RNA, 20 nt, Human adenovirus B [HAdV-B]
guucagcggcauacuuucuc

SEQ ID NO: 1544279 - RNA, 19 nt, Human adenovirus B [HAdV-B]
caugcauacuaacaugcca

SEQ ID NO: 1544280 - RNA, 14 nt, Human adenovirus B [HAdV-B]
caagagcaggggac

SEQ ID NO: 1544281 - RNA, 16 nt, Human adenovirus B [HAdV-B]
gacccgccgccagcaa

SEQ ID NO: 1544282 - RNA, 16 nt, Human adenovirus B [HAdV-B]
agaagguccuggccau

SEQ ID NO: 1544283 - RNA, 17 nt, Human adenovirus B [HAdV-B]
guggauuuuuuccagga

SEQ ID NO: 1544284 - RNA, 13 nt, Human adenovirus B [HAdV-B]
cugcuugcaugag

SEQ ID NO: 1544285 - RNA, 19 nt, Human adenovirus B [HAdV-B]
cgaugggucuucuccuggg

SEQ ID NO: 1544286 - RNA, 19 nt, Human adenovirus B [HAdV-B]
gaucauggaaaucccaccc

SEQ ID NO: 1544287 - RNA, 22 nt, Human adenovirus B [HAdV-B]
auacuagucuugcuuguuuuac

SEQ ID NO: 1544288 - RNA, 20 nt, Human adenovirus B [HAdV-B]
uccaaugucacucuuccaga

SEQ ID NO: 1544289 - RNA, 14 nt, Human adenovirus B [HAdV-B]
gagagagaggauga

SEQ ID NO: 1544290 - RNA, 18 nt, Human adenovirus B [HAdV-B]
cuuucucccaagcagaca

SEQ ID NO: 1544291 - RNA, 13 nt, Human adenovirus B [HAdV-B]
ugaaggugcagcc

SEQ ID NO: 1544292 - RNA, 13 nt, Human adenovirus B [HAdV-B]
auucccggaagua

SEQ ID NO: 1544293 - RNA, 16 nt, Human adenovirus B [HAdV-B]
ugaagaaaugcauauu

SEQ ID NO: 1544294 - RNA, 22 nt, Human adenovirus B [HAdV-B]
uguucccagaguuggaagucua

SEQ ID NO: 1544295 - RNA, 23 nt, Human adenovirus B [HAdV-B]
acugcccuccgacuuugugccuc

SEQ ID NO: 1544296 - RNA, 23 nt, Human adenovirus B [HAdV-B]
gggcggcuuucagaggcugguca

SEQ ID NO: 1544297 - RNA, 15 nt, Human adenovirus B [HAdV-B]
agcaaaguuuacagc

SEQ ID NO: 1544298 - RNA, 23 nt, Human adenovirus B [HAdV-B]
gauuggcggcaggcgccucccag

SEQ ID NO: 1544299 - RNA, 17 nt, Human adenovirus B [HAdV-B]
cuagaucgugggccaug

SEQ ID NO: 1544300 - RNA, 20 nt, Human adenovirus B [HAdV-B]
ucugcacucagguugucagu

SEQ ID NO: 1544301 - RNA, 15 nt, Human adenovirus B [HAdV-B]
agcuguguacuccca

SEQ ID NO: 1544302 - RNA, 12 nt, Human adenovirus B [HAdV-B]
gugcgggggcaa

SEQ ID NO: 1544303 - RNA, 16 nt, Human adenovirus B [HAdV-B]
ugcaggagcggagccu

SEQ ID NO: 1544304 - RNA, 17 nt, Human adenovirus B [HAdV-B]
cagugcaggcagcagcu

SEQ ID NO: 1544305 - RNA, 13 nt, Human adenovirus B [HAdV-B]
agcagcagcaggc

SEQ ID NO: 1544306 - RNA, 21 nt, Human adenovirus B [HAdV-B]
gccagggcacacguggcugca

SEQ ID NO: 1544307 - RNA, 13 nt, Human adenovirus B [HAdV-B]
cacauacaagugc

SEQ ID NO: 1544308 - RNA, 14 nt, Human adenovirus B [HAdV-B]
cagucuggaggaag

SEQ ID NO: 1544309 - RNA, 18 nt, Human adenovirus B [HAdV-B]
guuuugagcuugggaaaa

SEQ ID NO: 1544310 - RNA, 14 nt, Human adenovirus B [HAdV-B]
uauucuuugcuacc

SEQ ID NO: 1544311 - RNA, 12 nt, Human adenovirus B [HAdV-B]
cccgcaggcagu

SEQ ID NO: 1544312 - RNA, 18 nt, Human adenovirus B [HAdV-B]
cuccaagauuuuccaugc

SEQ ID NO: 1544313 - RNA, 16 nt, Human adenovirus B [HAdV-B]
cugcuacgaagagcua

SEQ ID NO: 1544314 - RNA, 17 nt, Human adenovirus B [HAdV-B]
auauaaucugcaacaaa

SEQ ID NO: 1544315 - RNA, 16 nt, Human adenovirus B [HAdV-B]
gacggcggucauggac

SEQ ID NO: 1544316 - RNA, 21 nt, Human adenovirus B [HAdV-B]
gaucaguaucaucuuggccug

SEQ ID NO: 1544317 - RNA, 23 nt, Human adenovirus B [HAdV-B]
uggcacucccgucucgacccagc

SEQ ID NO: 1544318 - RNA, 21 nt, Human adenovirus B [HAdV-B]
aaacuccagacacucauguag

SEQ ID NO: 1544319 - RNA, 18 nt, Human adenovirus B [HAdV-B]
cguguuacccaguugaaa

SEQ ID NO: 1544320 - RNA, 15 nt, Human adenovirus B [HAdV-B]
auuaugugcauuuug

SEQ ID NO: 1544321 - RNA, 15 nt, Human adenovirus B [HAdV-B]
ugccaucaauuacuc

SEQ ID NO: 1544322 - RNA, 21 nt, Human adenovirus B [HAdV-B]
acaugcucuaccccauuccug

SEQ ID NO: 1544323 - RNA, 13 nt, Human adenovirus B [HAdV-B]
cuccuuuccuaga

SEQ ID NO: 1544324 - RNA, 21 nt, Human adenovirus B [HAdV-B]
auauuaucaccaaacugcuua

SEQ ID NO: 1544325 - RNA, 20 nt, Human adenovirus B [HAdV-B]
uccacacugguggccaccuc

SEQ ID NO: 1544326 - RNA, 14 nt, Human adenovirus B [HAdV-B]
ccaacgacgagaaa

SEQ ID NO: 1544327 - RNA, 20 nt, Human adenovirus B [HAdV-B]
agcauguggaaucaggcugu

SEQ ID NO: 1544328 - RNA, 14 nt, Human adenovirus B [HAdV-B]
cgagacgcccaggc

SEQ ID NO: 1544329 - RNA, 15 nt, Human adenovirus B [HAdV-B]
cacgguggugcaaaa

SEQ ID NO: 1544330 - RNA, 17 nt, Human adenovirus B [HAdV-B]
uggcaguuuggaagcca

SEQ ID NO: 1544331 - RNA, 18 nt, Human adenovirus B [HAdV-B]
cugagacagacaucgagc

SEQ ID NO: 1544332 - RNA, 12 nt, Human adenovirus B [HAdV-B]
agaguuucauga

SEQ ID NO: 1544333 - RNA, 18 nt, Human adenovirus B [HAdV-B]
gaggagaugcgagcuucc

SEQ ID NO: 1544334 - RNA, 22 nt, Human adenovirus B [HAdV-B]
cuguuucugguggugcaacaca

SEQ ID NO: 1544335 - RNA, 18 nt, Human adenovirus B [HAdV-B]
ccuucaauuggagcagua

SEQ ID NO: 1544336 - RNA, 18 nt, Human adenovirus B [HAdV-B]
uucuuagagauggaagac

SEQ ID NO: 1544337 - RNA, 12 nt, Human adenovirus B [HAdV-B]
aaagcuccaagc

SEQ ID NO: 1544338 - RNA, 20 nt, Human adenovirus B [HAdV-B]
ggugcaacacagcagagaca

SEQ ID NO: 1544339 - RNA, 21 nt, Human adenovirus B [HAdV-B]
gcccaaucgcgaagaggcaau

SEQ ID NO: 1544340 - RNA, 22 nt, Human adenovirus B [HAdV-B]
ccuccccaauuggcuccagcaa

SEQ ID NO: 1544341 - RNA, 15 nt, Human adenovirus B [HAdV-B]
cgacguggacagcga

SEQ ID NO: 1544342 - RNA, 18 nt, Human adenovirus B [HAdV-B]
acaugaccaaagacuggu

SEQ ID NO: 1544343 - RNA, 11 nt, Human adenovirus B [HAdV-B]
caacuggugag

SEQ ID NO: 1544344 - RNA, 14 nt, Human adenovirus B [HAdV-B]
auugccugacuuua

SEQ ID NO: 1544345 - RNA, 17 nt, Human adenovirus B [HAdV-B]
agucuguugaugcccaa

SEQ ID NO: 1544346 - RNA, 15 nt, Human adenovirus B [HAdV-B]
ccacugaagugcaaa

SEQ ID NO: 1544347 - RNA, 16 nt, Human adenovirus B [HAdV-B]
caaaguaaaaggcaca

SEQ ID NO: 1544348 - RNA, 17 nt, Human adenovirus B [HAdV-B]
cacgagccaacugaacg

SEQ ID NO: 1544349 - RNA, 17 nt, Human adenovirus B [HAdV-B]
cgccaccugcugcgcac

SEQ ID NO: 1544350 - RNA, 13 nt, Human adenovirus B [HAdV-B]
gagagcgugaugc

SEQ ID NO: 1544351 - RNA, 18 nt, Human adenovirus B [HAdV-B]
gcacaagcucuaaaguga

SEQ ID NO: 1544352 - RNA, 15 nt, Human adenovirus B [HAdV-B]
gagaauggcaacauc

SEQ ID NO: 1544353 - RNA, 16 nt, Human adenovirus B [HAdV-B]
ccccaucgaugcugcc

SEQ ID NO: 1544354 - RNA, 20 nt, Human adenovirus B [HAdV-B]
caucuagugguacugaugcu

SEQ ID NO: 1544355 - RNA, 19 nt, Human adenovirus B [HAdV-B]
ggaaguuucagaugaagaa

SEQ ID NO: 1544356 - RNA, 20 nt, Human adenovirus B [HAdV-B]
ccgagaagguggcugccauc

SEQ ID NO: 1544357 - RNA, 13 nt, Human adenovirus B [HAdV-B]
agacgcuggugac

SEQ ID NO: 1544358 - RNA, 16 nt, Human adenovirus B [HAdV-B]
cugucaacaucgccac

SEQ ID NO: 1544359 - RNA, 14 nt, Human adenovirus B [HAdV-B]
uagugauagaaguu

SEQ ID NO: 1544360 - RNA, 23 nt, Human adenovirus B [HAdV-B]
agacuguauaggagcauuugcuu

SEQ ID NO: 1544361 - RNA, 20 nt, Human adenovirus B [HAdV-B]
ugugacagugcaauguaaua

SEQ ID NO: 1544362 - RNA, 18 nt, Human adenovirus B [HAdV-B]
uauaaauuuuacugcaga

SEQ ID NO: 1544363 - RNA, 21 nt, Human adenovirus B [HAdV-B]
accccuacggaagccagcacc

SEQ ID NO: 1544364 - RNA, 14 nt, Human adenovirus B [HAdV-B]
cacauccaagaaca

SEQ ID NO: 1544365 - RNA, 14 nt, Human adenovirus B [HAdV-B]
cacucaccaccucc

SEQ ID NO: 1544366 - RNA, 12 nt, Human adenovirus B [HAdV-B]
uggaacucacca

SEQ ID NO: 1544367 - RNA, 15 nt, Human adenovirus B [HAdV-B]
uccagucuccugccg

SEQ ID NO: 1544368 - RNA, 20 nt, Human adenovirus B [HAdV-B]
accccacuaacaaccacagg

SEQ ID NO: 1544369 - RNA, 11 nt, Human adenovirus B [HAdV-B]
caacacuuuca

SEQ ID NO: 1544370 - RNA, 11 nt, Human adenovirus B [HAdV-B]
gaaaaagcaca

SEQ ID NO: 1544371 - RNA, 20 nt, Human adenovirus B [HAdV-B]
augagaaucgccuaggacaa

SEQ ID NO: 1544372 - RNA, 23 nt, Human adenovirus B [HAdV-B]
cagcugccuauaguacuccacca

SEQ ID NO: 1544373 - RNA, 15 nt, Human adenovirus B [HAdV-B]
cucugggaugcaaau

SEQ ID NO: 1544374 - RNA, 13 nt, Human adenovirus B [HAdV-B]
ccaucuaccacuc

SEQ ID NO: 1544375 - RNA, 16 nt, Human adenovirus B [HAdV-B]
ccaugcacucauccau

SEQ ID NO: 1544376 - RNA, 15 nt, Human adenovirus B [HAdV-B]
aggcugucccugcaa

SEQ ID NO: 1544377 - RNA, 16 nt, Human adenovirus B [HAdV-B]
gcauuaguaacaacac

SEQ ID NO: 1544378 - RNA, 18 nt, Human adenovirus B [HAdV-B]
ugaaaauaaacuuuguau

SEQ ID NO: 1544379 - RNA, 19 nt, Human adenovirus B [HAdV-B]
guauugguuuaaaaaaugg

SEQ ID NO: 1544380 - RNA, 18 nt, Human adenovirus B [HAdV-B]
gcuauuugcaccacacuu

SEQ ID NO: 1544381 - RNA, 19 nt, Human adenovirus B [HAdV-B]
aagaacaaaaagccaaaau

SEQ ID NO: 1544382 - RNA, 17 nt, Human adenovirus B [HAdV-B]
gacauuggaaaaaaacg

SEQ ID NO: 1544383 - RNA, 22 nt, Human adenovirus B [HAdV-B]
cggauucuuaacagugcaggca

SEQ ID NO: 1544384 - RNA, 22 nt, Human adenovirus B [HAdV-B]
gcaccgucgcuuccgaccuggc

SEQ ID NO: 1544385 - RNA, 15 nt, Human adenovirus B [HAdV-B]
gcauuauuggacaga

SEQ ID NO: 1544386 - RNA, 17 nt, Human adenovirus B [HAdV-B]
caucuagaccacugccg

SEQ ID NO: 1544387 - RNA, 18 nt, Human adenovirus B [HAdV-B]
uagaaaaugcaaauucca

SEQ ID NO: 1544388 - RNA, 13 nt, Human adenovirus B [HAdV-B]
cccacccugcuuu

SEQ ID NO: 1544389 - RNA, 14 nt, Human adenovirus B [HAdV-B]
gacagaaccagaua

SEQ ID NO: 1544390 - RNA, 20 nt, Human adenovirus B [HAdV-B]
ggcaaaauagacucucgccu

SEQ ID NO: 1544391 - RNA, 24 nt, Human adenovirus B [HAdV-B]
agaauuacuucgacaugggagcug

SEQ ID NO: 1544392 - RNA, 11 nt, Human adenovirus B [HAdV-B]
uuauuuacagu

SEQ ID NO: 1544393 - RNA, 16 nt, Human adenovirus B [HAdV-B]
gaggcgcugcugaaca

SEQ ID NO: 1544394 - RNA, 14 nt, Human adenovirus B [HAdV-B]
cauugcuucucuga

SEQ ID NO: 1544395 - RNA, 15 nt, Human adenovirus B [HAdV-B]
agggcgaaggacugg

SEQ ID NO: 1544396 - RNA, 14 nt, Human adenovirus B [HAdV-B]
agccggccuggacc

SEQ ID NO: 1544397 - RNA, 20 nt, Human adenovirus B [HAdV-B]
aggauauuuugaaauaugag

SEQ ID NO: 1544398 - RNA, 23 nt, Human adenovirus B [HAdV-B]
cuggaaggcggaugacuggcaga

SEQ ID NO: 1544399 - RNA, 23 nt, Human adenovirus B [HAdV-B]
aaaaugauuaauaaaaaaucacu

SEQ ID NO: 1544400 - RNA, 17 nt, Human adenovirus B [HAdV-B]
uccaaggaugagacagu

SEQ ID NO: 1544401 - RNA, 16 nt, Human adenovirus B [HAdV-B]
guauaauuaugcuuaa

SEQ ID NO: 1544402 - RNA, 19 nt, Human adenovirus B [HAdV-B]
cacuuagaagauacugagc

SEQ ID NO: 1544403 - RNA, 17 nt, Human adenovirus B [HAdV-B]
aacaauuuucgcucuuu

SEQ ID NO: 1544404 - RNA, 13 nt, Human adenovirus B [HAdV-B]
ucuaugaggacca

SEQ ID NO: 1544405 - RNA, 13 nt, Human adenovirus B [HAdV-B]
caacaaaacaaaa

SEQ ID NO: 1544406 - RNA, 16 nt, Human adenovirus B [HAdV-B]
ugcgaaaaggcugugg

SEQ ID NO: 1544407 - RNA, 15 nt, Human adenovirus B [HAdV-B]
ccagguggucucugg

SEQ ID NO: 1544408 - RNA, 14 nt, Human adenovirus B [HAdV-B]
cgagacgcucuucu

SEQ ID NO: 1544409 - RNA, 15 nt, Human adenovirus B [HAdV-B]
agauucccacugaaa

SEQ ID NO: 1544410 - RNA, 16 nt, Human adenovirus B [HAdV-B]
ccagacgugcagcuuc

SEQ ID NO: 1544411 - RNA, 15 nt, Human adenovirus B [HAdV-B]
acggugcugcaguug

SEQ ID NO: 1544412 - RNA, 21 nt, Human adenovirus B [HAdV-B]
ccauugaagggauucaugcuc

SEQ ID NO: 1544413 - RNA, 15 nt, Human adenovirus B [HAdV-B]
aggcauuaguuuaaa

SEQ ID NO: 1544414 - RNA, 14 nt, Human adenovirus B [HAdV-B]
guugagaccuggaa

SEQ ID NO: 1544415 - RNA, 21 nt, Human adenovirus B [HAdV-B]
cgcccagcuguuucugguggu

SEQ ID NO: 1544416 - RNA, 23 nt, Human adenovirus B [HAdV-B]
uaagcagguagcgccuggucugg

SEQ ID NO: 1544417 - RNA, 19 nt, Human adenovirus B [HAdV-B]
acgggaacaaagcuuggaa

SEQ ID NO: 1544418 - RNA, 11 nt, Human adenovirus B [HAdV-B]
ggacaggguuc

SEQ ID NO: 1544419 - RNA, 15 nt, Human adenovirus B [HAdV-B]
aucaugguguggaag

SEQ ID NO: 1544420 - RNA, 16 nt, Human adenovirus B [HAdV-B]
ccuccgcgauaccugg

SEQ ID NO: 1544421 - RNA, 15 nt, Human adenovirus B [HAdV-B]
uggcuucucuuacau

SEQ ID NO: 1544422 - RNA, 24 nt, Human adenovirus B [HAdV-B]
acugugcguaugcauacaccugcu

SEQ ID NO: 1544423 - RNA, 13 nt, Human adenovirus B [HAdV-B]
augaauguuccuu

SEQ ID NO: 1544424 - RNA, 16 nt, Human adenovirus B [HAdV-B]
auuuucuaacuccuca

SEQ ID NO: 1544425 - RNA, 13 nt, Human adenovirus B [HAdV-B]
ccauuguguucuc

SEQ ID NO: 1544426 - RNA, 19 nt, Human adenovirus B [HAdV-B]
agguuacuggccagugcag

SEQ ID NO: 1544427 - RNA, 12 nt, Human adenovirus B [HAdV-B]
cauugcuucucu

SEQ ID NO: 1544428 - RNA, 17 nt, Human adenovirus B [HAdV-B]
aaguucuaguuguaaaa

SEQ ID NO: 1544429 - RNA, 21 nt, Human adenovirus B [HAdV-B]
cugaacggggucaucuugcag

SEQ ID NO: 1544430 - RNA, 18 nt, Human adenovirus B [HAdV-B]
uuaccagacaaaguacag

SEQ ID NO: 1544431 - RNA, 23 nt, Human adenovirus B [HAdV-B]
uuaugcuuaaucguaaguauagc

SEQ ID NO: 1544432 - RNA, 15 nt, Human adenovirus B [HAdV-B]
cuggaggacagucug

SEQ ID NO: 1544433 - RNA, 13 nt, Human adenovirus B [HAdV-B]
ugcaugauggaua

SEQ ID NO: 1544434 - RNA, 14 nt, Human adenovirus B [HAdV-B]
aguuuggcaaugga

SEQ ID NO: 1544435 - RNA, 18 nt, Human adenovirus B [HAdV-B]
acagucaggcagaggagg

SEQ ID NO: 1544436 - RNA, 20 nt, Human adenovirus B [HAdV-B]
guucuggaggaggaacagca

SEQ ID NO: 1544437 - RNA, 14 nt, Human adenovirus B [HAdV-B]
cggcaggaugugag

SEQ ID NO: 1544438 - RNA, 22 nt, Human adenovirus B [HAdV-B]
ggucccuagcuugcaaccccca

SEQ ID NO: 1544439 - RNA, 23 nt, Human adenovirus B [HAdV-B]
gaacacaggagaugccccagagg

SEQ ID NO: 1544440 - RNA, 14 nt, Human adenovirus B [HAdV-B]
cacugaagugcaaa

SEQ ID NO: 1544441 - RNA, 17 nt, Human adenovirus B [HAdV-B]
uucuggcccaauugcaa

SEQ ID NO: 1544442 - RNA, 14 nt, Human adenovirus B [HAdV-B]
ugugucugaaggaa

SEQ ID NO: 1544443 - RNA, 20 nt, Human adenovirus B [HAdV-B]
caaugucacucuuccagaaa

SEQ ID NO: 1544444 - RNA, 22 nt, Human adenovirus B [HAdV-B]
cugacgccgccggucccacucg

SEQ ID NO: 1544445 - RNA, 19 nt, Human adenovirus B [HAdV-B]
cagugucgcuaacaauaca

SEQ ID NO: 1544446 - RNA, 22 nt, Human adenovirus B [HAdV-B]
auagggcuugacggggaagacg

SEQ ID NO: 1544447 - RNA, 21 nt, Human adenovirus B [HAdV-B]
caaguuugcuccggaagauua

SEQ ID NO: 1544448 - RNA, 20 nt, Human adenovirus B [HAdV-B]
guggacaggguucgacgagc

SEQ ID NO: 1544449 - RNA, 16 nt, Human adenovirus B [HAdV-B]
guucugacuuuggaaa

SEQ ID NO: 1544450 - RNA, 20 nt, Human adenovirus B [HAdV-B]
uucuuuugccauccuucuca

SEQ ID NO: 1544451 - RNA, 15 nt, Human adenovirus B [HAdV-B]
gcucaccauuaccaa

SEQ ID NO: 1544452 - RNA, 18 nt, Human adenovirus B [HAdV-B]
guggcgguucaggccucg

SEQ ID NO: 1544453 - RNA, 21 nt, Human adenovirus B [HAdV-B]
aagauagcuuugaggccugau

SEQ ID NO: 1544454 - RNA, 20 nt, Human adenovirus B [HAdV-B]
ggccugcgucaucacccagg

SEQ ID NO: 1544455 - RNA, 18 nt, Human adenovirus B [HAdV-B]
agagguuccaaagaucuu

SEQ ID NO: 1544456 - RNA, 22 nt, Human adenovirus B [HAdV-B]
ggaaccagaugccuuuuccaga

SEQ ID NO: 1544457 - RNA, 20 nt, Human adenovirus B [HAdV-B]
guuucauuuuccucacaacg

SEQ ID NO: 1544458 - RNA, 16 nt, Human adenovirus B [HAdV-B]
agcuagaucaaaagaa

SEQ ID NO: 1544459 - RNA, 14 nt, Human adenovirus B [HAdV-B]
gcagggcucugagc

SEQ ID NO: 1544460 - RNA, 21 nt, Human adenovirus B [HAdV-B]
cuauggagucacugcuaccug

SEQ ID NO: 1544461 - RNA, 17 nt, Human adenovirus B [HAdV-B]
ucuucaccauacucauu

SEQ ID NO: 1544462 - RNA, 15 nt, Human adenovirus B [HAdV-B]
uuagcgaucuucuca

SEQ ID NO: 1544463 - RNA, 14 nt, Human adenovirus B [HAdV-B]
cgcauugccagacg

SEQ ID NO: 1544464 - RNA, 17 nt, Human adenovirus B [HAdV-B]
gcgauaaugccagacuc

SEQ ID NO: 1544465 - RNA, 16 nt, Human adenovirus B [HAdV-B]
cuggaacacaggagau

SEQ ID NO: 1544466 - RNA, 15 nt, Human adenovirus B [HAdV-B]
guaucacaagagcga

SEQ ID NO: 1544467 - RNA, 13 nt, Human adenovirus B [HAdV-B]
aggauguccaagc

SEQ ID NO: 1544468 - RNA, 14 nt, Human adenovirus B [HAdV-B]
acggagggcagaaa

SEQ ID NO: 1544469 - RNA, 21 nt, Human adenovirus B [HAdV-B]
ccuuccagggucucaguguuc

SEQ ID NO: 1544470 - RNA, 15 nt, Human adenovirus B [HAdV-B]
aggcggagcgguggu

SEQ ID NO: 1544471 - RNA, 14 nt, Human adenovirus B [HAdV-B]
cgguccuuccaggg

SEQ ID NO: 1544472 - RNA, 17 nt, Human adenovirus B [HAdV-B]
ggccgcaaaugcucugc

SEQ ID NO: 1544473 - RNA, 22 nt, Human adenovirus B [HAdV-B]
ugcacagccggcaucauucaca

SEQ ID NO: 1544474 - RNA, 12 nt, Human adenovirus B [HAdV-B]
augcccagcacg

SEQ ID NO: 1544475 - RNA, 17 nt, Human adenovirus B [HAdV-B]
ccaucaucgugcucagu

SEQ ID NO: 1544476 - RNA, 18 nt, Human adenovirus B [HAdV-B]
caagaauuucuacugaaa

SEQ ID NO: 1544477 - RNA, 20 nt, Human adenovirus B [HAdV-B]
cugacacuccugguccugug

SEQ ID NO: 1544478 - RNA, 15 nt, Human adenovirus B [HAdV-B]
gaugaaaacugccca

SEQ ID NO: 1544479 - RNA, 20 nt, Human adenovirus B [HAdV-B]
caacccggauuuuacaacca

SEQ ID NO: 1544480 - RNA, 20 nt, Human adenovirus B [HAdV-B]
caggagaaauauucacugga

SEQ ID NO: 1544481 - RNA, 19 nt, Human adenovirus B [HAdV-B]
cagccgccgcccccagaag

SEQ ID NO: 1544482 - RNA, 13 nt, Human adenovirus B [HAdV-B]
aucaaaugcucac

SEQ ID NO: 1544483 - RNA, 16 nt, Human adenovirus B [HAdV-B]
aaggcgauaaugccag

SEQ ID NO: 1544484 - RNA, 17 nt, Human adenovirus B [HAdV-B]
ucgaaaccguugauguu

SEQ ID NO: 1544485 - RNA, 13 nt, Human adenovirus B [HAdV-B]
ucguucuucuuua

SEQ ID NO: 1544486 - RNA, 12 nt, Human adenovirus B [HAdV-B]
aggcaaaacaaa

SEQ ID NO: 1544487 - RNA, 14 nt, Human adenovirus B [HAdV-B]
uacaaaagaaggac

SEQ ID NO: 1544488 - RNA, 21 nt, Human adenovirus B [HAdV-B]
ucuuuagcgaucuucucaaug

SEQ ID NO: 1544489 - RNA, 22 nt, Human adenovirus B [HAdV-B]
ggcccaauugcaagccauccaa

SEQ ID NO: 1544490 - RNA, 21 nt, Human adenovirus B [HAdV-B]
augggcguccagcgcugccag

SEQ ID NO: 1544491 - RNA, 23 nt, Human adenovirus B [HAdV-B]
cccuguaugccaucuuccagcag

SEQ ID NO: 1544492 - RNA, 15 nt, Human adenovirus B [HAdV-B]
gcaucucaugacaug

SEQ ID NO: 1544493 - RNA, 20 nt, Human adenovirus B [HAdV-B]
gagaguuucaugaccagcau

SEQ ID NO: 1544494 - RNA, 19 nt, Human adenovirus B [HAdV-B]
auccauggaugcccaugcc

SEQ ID NO: 1544495 - RNA, 20 nt, Human adenovirus B [HAdV-B]
uguccguucucgcuggccac

SEQ ID NO: 1544496 - RNA, 18 nt, Human adenovirus B [HAdV-B]
gcggaugacuggcagaac

SEQ ID NO: 1544497 - RNA, 21 nt, Human adenovirus B [HAdV-B]
caccgguggaacacgaggaag

SEQ ID NO: 1544498 - RNA, 16 nt, Human adenovirus B [HAdV-B]
agcuguguacucccag

SEQ ID NO: 1544499 - RNA, 14 nt, Human adenovirus B [HAdV-B]
ucacagauuugcau

SEQ ID NO: 1544500 - RNA, 17 nt, Human adenovirus B [HAdV-B]
aaccccacuaacaacca

SEQ ID NO: 1544501 - RNA, 19 nt, Human adenovirus B [HAdV-B]
gcaaaguucgacauguguu

SEQ ID NO: 1544502 - RNA, 23 nt, Human adenovirus B [HAdV-B]
ccuggcagaccucaucuucccag

SEQ ID NO: 1544503 - RNA, 13 nt, Human adenovirus B [HAdV-B]
aguuauguuccug

SEQ ID NO: 1544504 - RNA, 15 nt, Human adenovirus B [HAdV-B]
caggcugugcagaaa

SEQ ID NO: 1544505 - RNA, 23 nt, Human adenovirus B [HAdV-B]
ugcagaggcauacaugccacaga

SEQ ID NO: 1544506 - RNA, 14 nt, Human adenovirus B [HAdV-B]
uucagcauuggcaa

SEQ ID NO: 1544507 - RNA, 19 nt, Human adenovirus B [HAdV-B]
auucuagagaaaaagaaaa

SEQ ID NO: 1544508 - RNA, 23 nt, Human adenovirus B [HAdV-B]
gggcaaaguuuaaaacugacccc

SEQ ID NO: 1544509 - RNA, 20 nt, Human adenovirus B [HAdV-B]
aacuuaaagaccagaacuuc

SEQ ID NO: 1544510 - RNA, 13 nt, Human adenovirus B [HAdV-B]
cacacaaagcaca

SEQ ID NO: 1544511 - RNA, 22 nt, Human adenovirus B [HAdV-B]
acagccccccucgcagcagcag

SEQ ID NO: 1544512 - RNA, 18 nt, Human adenovirus B [HAdV-B]
ugcagccgccgcccccag

SEQ ID NO: 1544513 - RNA, 20 nt, Human adenovirus B [HAdV-B]
agacgccaccgagcuaccac

SEQ ID NO: 1544514 - RNA, 22 nt, Human adenovirus B [HAdV-B]
uugcccucauaaucauugcagc

SEQ ID NO: 1544515 - RNA, 16 nt, Human adenovirus B [HAdV-B]
agaacucgguggauuu

SEQ ID NO: 1544516 - RNA, 14 nt, Human adenovirus B [HAdV-B]
cacaggagaauaaa

SEQ ID NO: 1544517 - RNA, 23 nt, Human adenovirus B [HAdV-B]
acaccaggaacuucaagcuggga

SEQ ID NO: 1544518 - RNA, 21 nt, Human adenovirus B [HAdV-B]
ccucaguacgauaccaccagg

SEQ ID NO: 1544519 - RNA, 20 nt, Human adenovirus B [HAdV-B]
gugaugcaauccccacugga

SEQ ID NO: 1544520 - RNA, 21 nt, Human adenovirus B [HAdV-B]
gacugcagcacuggacaugac

SEQ ID NO: 1544521 - RNA, 15 nt, Human adenovirus B [HAdV-B]
ccccagcagccaagg

SEQ ID NO: 1544522 - RNA, 17 nt, Human adenovirus B [HAdV-B]
aggucgacgcaucucau

SEQ ID NO: 1544523 - RNA, 20 nt, Human adenovirus B [HAdV-B]
aguuuacuuugccagaaggc

SEQ ID NO: 1544524 - RNA, 23 nt, Human adenovirus B [HAdV-B]
augggcguccagcgcugccaggg

SEQ ID NO: 1544525 - RNA, 17 nt, Human adenovirus B [HAdV-B]
gaucuaccgccagugcu

SEQ ID NO: 1544526 - RNA, 15 nt, Human adenovirus B [HAdV-B]
ugcugcgcacugccc

SEQ ID NO: 1544527 - RNA, 12 nt, Human adenovirus B [HAdV-B]
caccaaugcaaa

SEQ ID NO: 1544528 - RNA, 15 nt, Human adenovirus B [HAdV-B]
ugaucaccugggcag

SEQ ID NO: 1544529 - RNA, 17 nt, Human adenovirus B [HAdV-B]
cuaucucuccuaccacu

SEQ ID NO: 1544530 - RNA, 23 nt, Human adenovirus B [HAdV-B]
cuaacaaccacaggcggaucucu

SEQ ID NO: 1544531 - RNA, 22 nt, Human adenovirus B [HAdV-B]
augauauucuugagcaggcggc

SEQ ID NO: 1544532 - RNA, 17 nt, Human adenovirus B [HAdV-B]
aaaccaguggucaguga

SEQ ID NO: 1544533 - RNA, 18 nt, Human adenovirus B [HAdV-B]
uagaucaaaagaaaugcg

SEQ ID NO: 1544534 - RNA, 19 nt, Human adenovirus B [HAdV-B]
ugcagcuucgggcgccagc

SEQ ID NO: 1544535 - RNA, 20 nt, Human adenovirus B [HAdV-B]
cagaagguguaaaaaauaca

SEQ ID NO: 1544536 - RNA, 21 nt, Human adenovirus B [HAdV-B]
ggcuccagcaaaaacaagauu

SEQ ID NO: 1544537 - RNA, 12 nt, Human adenovirus B [HAdV-B]
uuucagaagaca

SEQ ID NO: 1544538 - RNA, 17 nt, Human adenovirus B [HAdV-B]
cacacugguggccaccu

SEQ ID NO: 1544539 - RNA, 15 nt, Human adenovirus B [HAdV-B]
cagcgcugccagggu

SEQ ID NO: 1544540 - RNA, 14 nt, Human adenovirus B [HAdV-B]
ggacuuggaagagg

SEQ ID NO: 1544541 - RNA, 14 nt, Human adenovirus B [HAdV-B]
uggauugccacagc

SEQ ID NO: 1544542 - RNA, 19 nt, Human adenovirus B [HAdV-B]
uacuugcuauuccaccaug

SEQ ID NO: 1544543 - RNA, 14 nt, Human adenovirus B [HAdV-B]
gcaaugacagaaug

SEQ ID NO: 1544544 - RNA, 21 nt, Human adenovirus B [HAdV-B]
agauuacagccaacgagccag

SEQ ID NO: 1544545 - RNA, 13 nt, Human adenovirus B [HAdV-B]
aacucaacacaag

SEQ ID NO: 1544546 - RNA, 19 nt, Human adenovirus B [HAdV-B]
uagucuacccuuuucucua

SEQ ID NO: 1544547 - RNA, 13 nt, Human adenovirus B [HAdV-B]
gcuuauggcaagc

SEQ ID NO: 1544548 - RNA, 20 nt, Human adenovirus B [HAdV-B]
ugccaccuccacugaagugc

SEQ ID NO: 1544549 - RNA, 17 nt, Human adenovirus B [HAdV-B]
cagaacaaggaagacca

SEQ ID NO: 1544550 - RNA, 21 nt, Human adenovirus B [HAdV-B]
cagaggagguggaagaaguaa

SEQ ID NO: 1544551 - RNA, 14 nt, Human adenovirus B [HAdV-B]
cuuacgagcagaca

SEQ ID NO: 1544552 - RNA, 14 nt, Human adenovirus B [HAdV-B]
caagauuggaauaa

SEQ ID NO: 1544553 - RNA, 20 nt, Human adenovirus B [HAdV-B]
acuuugauauaaucugcaac

SEQ ID NO: 1544554 - RNA, 14 nt, Human adenovirus B [HAdV-B]
cauugaugcucuau

SEQ ID NO: 1544555 - RNA, 23 nt, Human adenovirus B [HAdV-B]
cuaggacaaagcgugcugcacag

SEQ ID NO: 1544556 - RNA, 19 nt, Human adenovirus B [HAdV-B]
guauccugcccgccaccug

SEQ ID NO: 1544557 - RNA, 15 nt, Human adenovirus B [HAdV-B]
ggcucucaugaaagc

SEQ ID NO: 1544558 - RNA, 18 nt, Human adenovirus B [HAdV-B]
uaauggaauaguguuuau

SEQ ID NO: 1544559 - RNA, 14 nt, Human adenovirus B [HAdV-B]
ccauuaggaggcgc

SEQ ID NO: 1544560 - RNA, 16 nt, Human adenovirus B [HAdV-B]
gcguggggcgaagagc

SEQ ID NO: 1544561 - RNA, 20 nt, Human adenovirus B [HAdV-B]
aagaacaaaagaauaccaaa

SEQ ID NO: 1544562 - RNA, 14 nt, Human adenovirus B [HAdV-B]
aucucccaccacac

SEQ ID NO: 1544563 - RNA, 19 nt, Human adenovirus B [HAdV-B]
agugcgguacacccuggcc

SEQ ID NO: 1544564 - RNA, 13 nt, Human adenovirus B [HAdV-B]
uucccucuuccca

SEQ ID NO: 1544565 - RNA, 19 nt, Human adenovirus B [HAdV-B]
gaaaaugaaagcguucagc

SEQ ID NO: 1544566 - RNA, 17 nt, Human adenovirus B [HAdV-B]
gcauaugcaaaucccaa

SEQ ID NO: 1544567 - RNA, 18 nt, Human adenovirus B [HAdV-B]
ccuacauggguauucugc

SEQ ID NO: 1544568 - RNA, 11 nt, Human adenovirus B [HAdV-B]
aaccacaaccc

SEQ ID NO: 1544569 - RNA, 16 nt, Human adenovirus B [HAdV-B]
cauggaaaucccaccc

SEQ ID NO: 1544570 - RNA, 21 nt, Human adenovirus B [HAdV-B]
cugccuacccauggcgggcac

SEQ ID NO: 1544571 - RNA, 21 nt, Human adenovirus B [HAdV-B]
ucaugguaccuagaaauuucu

SEQ ID NO: 1544572 - RNA, 16 nt, Human adenovirus B [HAdV-B]
cgccaugacagacaga

SEQ ID NO: 1544573 - RNA, 17 nt, Human adenovirus B [HAdV-B]
cuugacaagcucuuaca

SEQ ID NO: 1544574 - RNA, 21 nt, Human adenovirus B [HAdV-B]
gucaucuuuagcgaucuucuc

SEQ ID NO: 1544575 - RNA, 19 nt, Human adenovirus B [HAdV-B]
ggcaggaugugagcuuccu

SEQ ID NO: 1544576 - RNA, 18 nt, Human adenovirus B [HAdV-B]
gcagaccucaucuuccca

SEQ ID NO: 1544577 - RNA, 13 nt, Human adenovirus B [HAdV-B]
aaaugcucugcaa

SEQ ID NO: 1544578 - RNA, 17 nt, Human adenovirus B [HAdV-B]
caccucuuucugaucau

SEQ ID NO: 1544579 - RNA, 22 nt, Human adenovirus B [HAdV-B]
gcagcagcuccuuuagccagag

SEQ ID NO: 1544580 - RNA, 22 nt, Human adenovirus B [HAdV-B]
gucaucuuuagcgaucuucuca

SEQ ID NO: 1544581 - RNA, 16 nt, Human adenovirus B [HAdV-B]
gaacugaagugcccau

SEQ ID NO: 1544582 - RNA, 18 nt, Human adenovirus B [HAdV-B]
uggcgcgauaccaggcau

SEQ ID NO: 1544583 - RNA, 19 nt, Human adenovirus B [HAdV-B]
cagcgcuuccaagaccggu

SEQ ID NO: 1544584 - RNA, 15 nt, Human adenovirus B [HAdV-B]
uuacuuugccagaag

SEQ ID NO: 1544585 - RNA, 14 nt, Human adenovirus B [HAdV-B]
augugccccaacag

SEQ ID NO: 1544586 - RNA, 18 nt, Human adenovirus B [HAdV-B]
cuccggaucuccugggca

SEQ ID NO: 1544587 - RNA, 18 nt, Human adenovirus B [HAdV-B]
cuuacuuuaaaauguuua

SEQ ID NO: 1544588 - RNA, 13 nt, Human adenovirus B [HAdV-B]
ccucgcagcagca

SEQ ID NO: 1544589 - RNA, 20 nt, Human adenovirus B [HAdV-B]
uacggagggcagaaacagca

SEQ ID NO: 1544590 - RNA, 10 nt, Human adenovirus B [HAdV-B]
gcggaggagg

SEQ ID NO: 1544591 - RNA, 11 nt, Human adenovirus B [HAdV-B]
agugucacugc

SEQ ID NO: 1544592 - RNA, 18 nt, Human adenovirus B [HAdV-B]
guaccgcaaugguagugc

SEQ ID NO: 1544593 - RNA, 22 nt, Human adenovirus B [HAdV-B]
cuucuccggaucuccugggcau

SEQ ID NO: 1544594 - RNA, 14 nt, Human adenovirus B [HAdV-B]
acacacagaaauau

SEQ ID NO: 1544595 - RNA, 16 nt, Human adenovirus B [HAdV-B]
ugccaugcaggcacuu

SEQ ID NO: 1544596 - RNA, 23 nt, Human adenovirus B [HAdV-B]
cucagcgacgaggaaaaggagca

SEQ ID NO: 1544597 - RNA, 19 nt, Human adenovirus B [HAdV-B]
cuccucaauaugcucuuac

SEQ ID NO: 1544598 - RNA, 12 nt, Human adenovirus B [HAdV-B]
uaaugacaaaau

SEQ ID NO: 1544599 - RNA, 15 nt, Human adenovirus B [HAdV-B]
gcuuuugcugugcca

SEQ ID NO: 1544600 - RNA, 14 nt, Human adenovirus B [HAdV-B]
aggucaggagccga

SEQ ID NO: 1544601 - RNA, 16 nt, Human adenovirus B [HAdV-B]
guaguguuguaaauca

SEQ ID NO: 1544602 - RNA, 13 nt, Human adenovirus B [HAdV-B]
caggaacugaaaa

SEQ ID NO: 1544603 - RNA, 22 nt, Human adenovirus B [HAdV-B]
gaacuugaaagagcuugacaag

SEQ ID NO: 1544604 - RNA, 21 nt, Human adenovirus B [HAdV-B]
gaagcucuuaauuugggccau

SEQ ID NO: 1544605 - RNA, 22 nt, Human adenovirus B [HAdV-B]
gcccccagaagauauggaggaa

SEQ ID NO: 1544606 - RNA, 15 nt, Human adenovirus B [HAdV-B]
gcugcgcacugcccu

SEQ ID NO: 1544607 - RNA, 22 nt, Human adenovirus B [HAdV-B]
uuucuuaccuuuggucuccaug

SEQ ID NO: 1544608 - RNA, 20 nt, Human adenovirus B [HAdV-B]
gcgaaauauggagcccagca

SEQ ID NO: 1544609 - RNA, 22 nt, Human adenovirus B [HAdV-B]
ccaguagguuuggaaguuucag

SEQ ID NO: 1544610 - RNA, 13 nt, Human adenovirus B [HAdV-B]
gauugcagcacug

SEQ ID NO: 1544611 - RNA, 21 nt, Human adenovirus B [HAdV-B]
uugagcgccucggcugcgugg

SEQ ID NO: 1544612 - RNA, 19 nt, Human adenovirus B [HAdV-B]
ugucgucacaggccucggc

SEQ ID NO: 1544613 - RNA, 17 nt, Human adenovirus B [HAdV-B]
aauugugaugauagcaa

SEQ ID NO: 1544614 - RNA, 17 nt, Human adenovirus B [HAdV-B]
gaagauauggaggaaga

SEQ ID NO: 1544615 - RNA, 15 nt, Human adenovirus B [HAdV-B]
ugucucacgcuugcc

SEQ ID NO: 1544616 - RNA, 22 nt, Human adenovirus B [HAdV-B]
auacacggcucucaugaaagca

SEQ ID NO: 1544617 - RNA, 16 nt, Human adenovirus B [HAdV-B]
acucaucuaaaaccau

SEQ ID NO: 1544618 - RNA, 20 nt, Human adenovirus B [HAdV-B]
gaagaccacgaacacaacuu

SEQ ID NO: 1544619 - RNA, 20 nt, Human adenovirus B [HAdV-B]
gcagcacuggacaugacagc

SEQ ID NO: 1544620 - RNA, 22 nt, Human adenovirus B [HAdV-B]
aucucuuaagguucuguggaca

SEQ ID NO: 1544621 - RNA, 12 nt, Human adenovirus B [HAdV-B]
aaaaaacagcca

SEQ ID NO: 1544622 - RNA, 18 nt, Human adenovirus B [HAdV-B]
cugcccaaaacaacgagc

SEQ ID NO: 1544623 - RNA, 16 nt, Human adenovirus B [HAdV-B]
caauccacacauuaca

SEQ ID NO: 1544624 - RNA, 20 nt, Human adenovirus B [HAdV-B]
caguaagaaagaacaaaaag

SEQ ID NO: 1544625 - RNA, 18 nt, Human adenovirus B [HAdV-B]
cauguggaaucaggcugu

SEQ ID NO: 1544626 - RNA, 14 nt, Human adenovirus B [HAdV-B]
agcgcuuucacagu

SEQ ID NO: 1544627 - RNA, 23 nt, Human adenovirus B [HAdV-B]
uugcagacgguaaaucugagcca

SEQ ID NO: 1544628 - RNA, 17 nt, Human adenovirus B [HAdV-B]
acugcagcacuggacau

SEQ ID NO: 1544629 - RNA, 16 nt, Human adenovirus B [HAdV-B]
gcagaaaucuucccau

SEQ ID NO: 1544630 - RNA, 16 nt, Human adenovirus B [HAdV-B]
gaagcuauaauguguu

SEQ ID NO: 1544631 - RNA, 23 nt, Human adenovirus B [HAdV-B]
agaacaaaagaauaccaaaagaa

SEQ ID NO: 1544632 - RNA, 20 nt, Human adenovirus B [HAdV-B]
ggaagagucuuucugugcga

SEQ ID NO: 1544633 - RNA, 14 nt, Human adenovirus B [HAdV-B]
ucacuucccucuuc

SEQ ID NO: 1544634 - RNA, 16 nt, Human adenovirus B [HAdV-B]
ggauuuccugccacca

SEQ ID NO: 1544635 - RNA, 12 nt, Human adenovirus B [HAdV-B]
caauuguugcag

SEQ ID NO: 1544636 - RNA, 17 nt, Human adenovirus B [HAdV-B]
aacagaaaaccagcagc

SEQ ID NO: 1544637 - RNA, 18 nt, Human adenovirus B [HAdV-B]
gaaaccauuugguggcau

SEQ ID NO: 1544638 - RNA, 13 nt, Human adenovirus B [HAdV-B]
ucgggggcagagg

SEQ ID NO: 1544639 - RNA, 15 nt, Human adenovirus B [HAdV-B]
cgucaucacccaggg

SEQ ID NO: 1544640 - RNA, 12 nt, Human adenovirus B [HAdV-B]
caggccagcaca

SEQ ID NO: 1544641 - RNA, 20 nt, Human adenovirus B [HAdV-B]
guuugcgcuacuuucacagc

SEQ ID NO: 1544642 - RNA, 12 nt, Human adenovirus B [HAdV-B]
uggcugcagcca

SEQ ID NO: 1544643 - RNA, 13 nt, Human adenovirus B [HAdV-B]
cacaacccccacu

SEQ ID NO: 1544644 - RNA, 22 nt, Human adenovirus B [HAdV-B]
ugaagcucuuaauuugggccau

SEQ ID NO: 1544645 - RNA, 15 nt, Human adenovirus B [HAdV-B]
agcuuaagcauucca

SEQ ID NO: 1544646 - RNA, 19 nt, Human adenovirus B [HAdV-B]
cuuucagaagacaugcaug

SEQ ID NO: 1544647 - RNA, 12 nt, Human adenovirus B [HAdV-B]
auggcugggcac

SEQ ID NO: 1544648 - RNA, 19 nt, Human adenovirus B [HAdV-B]
agugaaccacaacccccac

SEQ ID NO: 1544649 - RNA, 18 nt, Human adenovirus B [HAdV-B]
ccacgguagcauaugcaa

SEQ ID NO: 1544650 - RNA, 14 nt, Human adenovirus B [HAdV-B]
cuucaauuggagca

SEQ ID NO: 1544651 - RNA, 23 nt, Human adenovirus B [HAdV-B]
agcaggaacgcgcggccaaagag

SEQ ID NO: 1544652 - RNA, 18 nt, Human adenovirus B [HAdV-B]
ugaaggaugaaaaaaaac

SEQ ID NO: 1544653 - RNA, 18 nt, Human adenovirus B [HAdV-B]
uguuccacaguucaguga

SEQ ID NO: 1544654 - RNA, 21 nt, Human adenovirus B [HAdV-B]
ugucauaauggaguugcuucc

SEQ ID NO: 1544655 - RNA, 17 nt, Human adenovirus B [HAdV-B]
ugguuuuagauuccaca

SEQ ID NO: 1544656 - RNA, 20 nt, Human adenovirus B [HAdV-B]
ccgcguucgggggugugcuc

SEQ ID NO: 1544657 - RNA, 17 nt, Human adenovirus B [HAdV-B]
auuuucucccagcggcc

SEQ ID NO: 1544658 - RNA, 13 nt, Human adenovirus B [HAdV-B]
ccagggucucagu

SEQ ID NO: 1544659 - RNA, 22 nt, Human adenovirus B [HAdV-B]
ucgcauguauucauuuuucaga

SEQ ID NO: 1544660 - RNA, 13 nt, Human adenovirus B [HAdV-B]
cccgccaccugcu

SEQ ID NO: 1544661 - RNA, 19 nt, Human adenovirus B [HAdV-B]
cagggcacacguggcugca

SEQ ID NO: 1544662 - RNA, 16 nt, Human adenovirus B [HAdV-B]
accuacuaaugugaaa

SEQ ID NO: 1544663 - RNA, 16 nt, Human adenovirus B [HAdV-B]
cagaggaacacauucc

SEQ ID NO: 1544664 - RNA, 14 nt, Human adenovirus B [HAdV-B]
caacaagugcagca

SEQ ID NO: 1544665 - RNA, 21 nt, Human adenovirus B [HAdV-B]
ugacauucucguauuuuguau

SEQ ID NO: 1544666 - RNA, 18 nt, Human adenovirus B [HAdV-B]
uggggcgaagagccaugc

SEQ ID NO: 1544667 - RNA, 13 nt, Human adenovirus B [HAdV-B]
gaagguucugggg

SEQ ID NO: 1544668 - RNA, 19 nt, Human adenovirus B [HAdV-B]
gaacacgaggaagaguuga

SEQ ID NO: 1544669 - RNA, 18 nt, Human adenovirus B [HAdV-B]
cauaucauaguagccuga

SEQ ID NO: 1544670 - RNA, 23 nt, Human adenovirus B [HAdV-B]
aggauccuauagaggugggauug

SEQ ID NO: 1544671 - RNA, 20 nt, Human adenovirus B [HAdV-B]
gccaccugcugcgcacugcc

SEQ ID NO: 1544672 - RNA, 22 nt, Human adenovirus B [HAdV-B]
cuagugaaaguuaacuggaugc

SEQ ID NO: 1544673 - RNA, 22 nt, Human adenovirus B [HAdV-B]
caccaaggccauggcgacgagc

SEQ ID NO: 1544674 - RNA, 23 nt, Human adenovirus B [HAdV-B]
uacucgcgugccaggcacuucca

SEQ ID NO: 1544675 - RNA, 22 nt, Human adenovirus B [HAdV-B]
acaaugaagaacccaauucucu

SEQ ID NO: 1544676 - RNA, 18 nt, Human adenovirus B [HAdV-B]
uccaacagagccuaccuc

SEQ ID NO: 1544677 - RNA, 21 nt, Human adenovirus B [HAdV-B]
uauguuccugaguuaaaucau

SEQ ID NO: 1544678 - RNA, 11 nt, Human adenovirus B [HAdV-B]
ugaacucugau

SEQ ID NO: 1544679 - RNA, 19 nt, Human adenovirus B [HAdV-B]
ggugcaacacagcagagac

SEQ ID NO: 1544680 - RNA, 23 nt, Human adenovirus B [HAdV-B]
agaggauccuuagauaugugcag

SEQ ID NO: 1544681 - RNA, 18 nt, Human adenovirus B [HAdV-B]
gccauugcugucaacauc

SEQ ID NO: 1544682 - RNA, 23 nt, Human adenovirus B [HAdV-B]
auguugacgagacgcucuucucc

SEQ ID NO: 1544683 - RNA, 17 nt, Human adenovirus B [HAdV-B]
aguucguuauccagccu

SEQ ID NO: 1544684 - RNA, 14 nt, Human adenovirus B [HAdV-B]
cgcuugccagcacg

SEQ ID NO: 1544685 - RNA, 17 nt, Human adenovirus B [HAdV-B]
ccucccgacggugcugc

SEQ ID NO: 1544686 - RNA, 17 nt, Human adenovirus B [HAdV-B]
cugaccccgggacugug

SEQ ID NO: 1544687 - RNA, 18 nt, Human adenovirus B [HAdV-B]
ugugccucucaccuaccg

SEQ ID NO: 1544688 - RNA, 22 nt, Human adenovirus B [HAdV-B]
uccaucagcagacacaucacuu

SEQ ID NO: 1544689 - RNA, 14 nt, Human adenovirus B [HAdV-B]
gcgggucgugagcu

SEQ ID NO: 1544690 - RNA, 14 nt, Human adenovirus B [HAdV-B]
gauggcgccagcau

SEQ ID NO: 1544691 - RNA, 16 nt, Human adenovirus B [HAdV-B]
gccuucaauuggagca

SEQ ID NO: 1544692 - RNA, 12 nt, Human adenovirus B [HAdV-B]
uacuaauacuac

SEQ ID NO: 1544693 - RNA, 16 nt, Human adenovirus B [HAdV-B]
agcucaugcucuggac

SEQ ID NO: 1544694 - RNA, 18 nt, Human adenovirus B [HAdV-B]
accaauauuuuugcuucu

SEQ ID NO: 1544695 - RNA, 21 nt, Human adenovirus B [HAdV-B]
uccaccgcccaguccugccac

SEQ ID NO: 1544696 - RNA, 18 nt, Human adenovirus B [HAdV-B]
ugaguuuaauggcuagau

SEQ ID NO: 1544697 - RNA, 23 nt, Human adenovirus B [HAdV-B]
agugcggaaccuuugacacugcc

SEQ ID NO: 1544698 - RNA, 20 nt, Human adenovirus B [HAdV-B]
acaugggagccaggaguucc

SEQ ID NO: 1544699 - RNA, 17 nt, Human adenovirus B [HAdV-B]
acuucuccaucagcaga

SEQ ID NO: 1544700 - RNA, 14 nt, Human adenovirus B [HAdV-B]
guacgagagcguga

SEQ ID NO: 1544701 - RNA, 17 nt, Human adenovirus B [HAdV-B]
cagaccucaucuuccca

SEQ ID NO: 1544702 - RNA, 18 nt, Human adenovirus B [HAdV-B]
ugacugucgguagaagaa

SEQ ID NO: 1544703 - RNA, 13 nt, Human adenovirus B [HAdV-B]
caguuacuaugac

SEQ ID NO: 1544704 - RNA, 15 nt, Human adenovirus B [HAdV-B]
uacuggauguuuuau

SEQ ID NO: 1544705 - RNA, 22 nt, Human adenovirus B [HAdV-B]
gcacuuagaagauacugagcag

SEQ ID NO: 1544706 - RNA, 20 nt, Human adenovirus B [HAdV-B]
caaagcgcgugugauggugu

SEQ ID NO: 1544707 - RNA, 23 nt, Human adenovirus B [HAdV-B]
cucgagcaacuucaugucuaugg

SEQ ID NO: 1544708 - RNA, 12 nt, Human adenovirus B [HAdV-B]
acuaucgcagcc

SEQ ID NO: 1544709 - RNA, 16 nt, Human adenovirus B [HAdV-B]
uacguucguucuucuu

SEQ ID NO: 1544710 - RNA, 18 nt, Human adenovirus B [HAdV-B]
acaugcagaauaaaaaag

SEQ ID NO: 1544711 - RNA, 17 nt, Human adenovirus B [HAdV-B]
ccuacaaaacaugcaac

SEQ ID NO: 1544712 - RNA, 21 nt, Human adenovirus B [HAdV-B]
aucaagcggguuaaaaaggac

SEQ ID NO: 1544713 - RNA, 19 nt, Human adenovirus B [HAdV-B]
caagaauuucuacugaaaa

SEQ ID NO: 1544714 - RNA, 11 nt, Human adenovirus B [HAdV-B]
gaagaaaugca

SEQ ID NO: 1544715 - RNA, 11 nt, Human adenovirus B [HAdV-B]
gagcgaagugu

SEQ ID NO: 1544716 - RNA, 14 nt, Human adenovirus B [HAdV-B]
gacuagcagacagg

SEQ ID NO: 1544717 - RNA, 18 nt, Human adenovirus B [HAdV-B]
agccuggaggaacgugaa

SEQ ID NO: 1544718 - RNA, 13 nt, Human adenovirus B [HAdV-B]
ucuuaaagaguag

SEQ ID NO: 1544719 - RNA, 16 nt, Human adenovirus B [HAdV-B]
cacaagacaagccaca

SEQ ID NO: 1544720 - RNA, 11 nt, Human adenovirus B [HAdV-B]
uucuggggagu

SEQ ID NO: 1544721 - RNA, 20 nt, Human adenovirus B [HAdV-B]
cagcuuuugcugugccagaa

SEQ ID NO: 1544722 - RNA, 22 nt, Human adenovirus B [HAdV-B]
gcucuuacugcggaggaggaga

SEQ ID NO: 1544723 - RNA, 20 nt, Human adenovirus B [HAdV-B]
cuaguuguuugccaaaggau

SEQ ID NO: 1544724 - RNA, 17 nt, Human adenovirus B [HAdV-B]
ucugcaaucaugcccac

SEQ ID NO: 1544725 - RNA, 15 nt, Human adenovirus B [HAdV-B]
ucauccuuggcuccg

SEQ ID NO: 1544726 - RNA, 16 nt, Human adenovirus B [HAdV-B]
gcaugcgaaugcggag

SEQ ID NO: 1544727 - RNA, 12 nt, Human adenovirus B [HAdV-B]
gagggcgaagga

SEQ ID NO: 1544728 - RNA, 19 nt, Human adenovirus B [HAdV-B]
cugccuuguaagggcagca

SEQ ID NO: 1544729 - RNA, 17 nt, Human adenovirus B [HAdV-B]
agaguaucauagugcag

SEQ ID NO: 1544730 - RNA, 22 nt, Human adenovirus B [HAdV-B]
ccgggacuguggaccuccgccu

SEQ ID NO: 1544731 - RNA, 19 nt, Human adenovirus B [HAdV-B]
uguaccgcaaugguagugc

SEQ ID NO: 1544732 - RNA, 18 nt, Human adenovirus B [HAdV-B]
aacaucaauugacaugcc

SEQ ID NO: 1544733 - RNA, 15 nt, Human adenovirus B [HAdV-B]
gcuggcggcuccacc

SEQ ID NO: 1544734 - RNA, 16 nt, Human adenovirus B [HAdV-B]
guacgauaccaccagg

SEQ ID NO: 1544735 - RNA, 20 nt, Human adenovirus B [HAdV-B]
aacaccuuagaaaaugcaaa

SEQ ID NO: 1544736 - RNA, 14 nt, Human adenovirus B [HAdV-B]
ugucaaccaggggg

SEQ ID NO: 1544737 - RNA, 16 nt, Human adenovirus B [HAdV-B]
ucgagggucugggcaa

SEQ ID NO: 1544738 - RNA, 16 nt, Human adenovirus B [HAdV-B]
gauuuuggcuggaaug

SEQ ID NO: 1544739 - RNA, 20 nt, Human adenovirus B [HAdV-B]
acuguugguagcuccuuuca

SEQ ID NO: 1544740 - RNA, 14 nt, Human adenovirus B [HAdV-B]
ccgacggugcugca

SEQ ID NO: 1544741 - RNA, 13 nt, Human adenovirus B [HAdV-B]
ccuaugcacuuuu

SEQ ID NO: 1544742 - RNA, 20 nt, Human adenovirus B [HAdV-B]
cacuggcugcccccaccugg

SEQ ID NO: 1544743 - RNA, 20 nt, Human adenovirus B [HAdV-B]
acaugggggugcuggcuggu

SEQ ID NO: 1544744 - RNA, 12 nt, Human adenovirus B [HAdV-B]
cauguccaccug

SEQ ID NO: 1544745 - RNA, 12 nt, Human adenovirus B [HAdV-B]
ugaccacagcaa

SEQ ID NO: 1544746 - RNA, 14 nt, Human adenovirus B [HAdV-B]
uuguucguguugcu

SEQ ID NO: 1544747 - RNA, 21 nt, Human adenovirus B [HAdV-B]
cagcgccaugacagacagagg

SEQ ID NO: 1544748 - RNA, 22 nt, Human adenovirus B [HAdV-B]
ccaaaacaacgagcagauaacu

SEQ ID NO: 1544749 - RNA, 16 nt, Human adenovirus B [HAdV-B]
gcagaacacacucuuc

SEQ ID NO: 1544750 - RNA, 20 nt, Human adenovirus B [HAdV-B]
aaugccuuaaccucuuucug

SEQ ID NO: 1544751 - RNA, 18 nt, Human adenovirus B [HAdV-B]
agccguuaaccccacagc

SEQ ID NO: 1544752 - RNA, 12 nt, Human adenovirus B [HAdV-B]
aaaacaggacua

SEQ ID NO: 1544753 - RNA, 12 nt, Human adenovirus B [HAdV-B]
auucacugcucc

SEQ ID NO: 1544754 - RNA, 18 nt, Human adenovirus B [HAdV-B]
gccaugcuuagggcggcc

SEQ ID NO: 1544755 - RNA, 17 nt, Human adenovirus B [HAdV-B]
gccaaccguugaaggau

SEQ ID NO: 1544756 - RNA, 16 nt, Human adenovirus B [HAdV-B]
auggaagugcaaacug

SEQ ID NO: 1544757 - RNA, 18 nt, Human adenovirus B [HAdV-B]
cuucuccaucagcagaca

SEQ ID NO: 1544758 - RNA, 17 nt, Human adenovirus B [HAdV-B]
gugagcuggccuggaaa

SEQ ID NO: 1544759 - RNA, 17 nt, Human adenovirus B [HAdV-B]
auuccaccagccagguu

SEQ ID NO: 1544760 - RNA, 13 nt, Human adenovirus B [HAdV-B]
aaaccugcugcuu

SEQ ID NO: 1544761 - RNA, 15 nt, Human adenovirus B [HAdV-B]
gugagaauuggaaga

SEQ ID NO: 1544762 - RNA, 17 nt, Human adenovirus B [HAdV-B]
cuguauaggagcauuug

SEQ ID NO: 1544763 - RNA, 15 nt, Human adenovirus B [HAdV-B]
ggaacacgaggaaga

SEQ ID NO: 1544764 - RNA, 16 nt, Human adenovirus B [HAdV-B]
agaagcagaccugugu

SEQ ID NO: 1544765 - RNA, 18 nt, Human adenovirus B [HAdV-B]
cuugggugggagaggaag

SEQ ID NO: 1544766 - RNA, 16 nt, Human adenovirus B [HAdV-B]
auuguguuucaagcag

SEQ ID NO: 1544767 - RNA, 13 nt, Human adenovirus B [HAdV-B]
acguuuuggauuu

SEQ ID NO: 1544768 - RNA, 22 nt, Human adenovirus B [HAdV-B]
cagccagaaccucagcugggag

SEQ ID NO: 1544769 - RNA, 22 nt, Human adenovirus B [HAdV-B]
gcaagguaauuaaauccacacu

SEQ ID NO: 1544770 - RNA, 20 nt, Human adenovirus B [HAdV-B]
cauggaugagcaucacagcg

SEQ ID NO: 1544771 - RNA, 17 nt, Human adenovirus B [HAdV-B]
cucaaccccagcugccu

SEQ ID NO: 1544772 - RNA, 22 nt, Human adenovirus B [HAdV-B]
ucuacuggucgcuuccagacau

SEQ ID NO: 1544773 - RNA, 12 nt, Human adenovirus B [HAdV-B]
cacacagcagcg

SEQ ID NO: 1544774 - RNA, 19 nt, Human adenovirus B [HAdV-B]
agcugacuugucuccugaa

SEQ ID NO: 1544775 - RNA, 21 nt, Human adenovirus B [HAdV-B]
ugcuuaacaauuuucgcucuu

SEQ ID NO: 1544776 - RNA, 23 nt, Human adenovirus B [HAdV-B]
agugcccaucaguguggaagagc

SEQ ID NO: 1544777 - RNA, 22 nt, Human adenovirus B [HAdV-B]
ucgguccuuccagggucucagu

SEQ ID NO: 1544778 - RNA, 12 nt, Human adenovirus B [HAdV-B]
gacagauaaaga

SEQ ID NO: 1544779 - RNA, 19 nt, Human adenovirus B [HAdV-B]
agagcgugaugcagcagca

SEQ ID NO: 1544780 - RNA, 22 nt, Human adenovirus B [HAdV-B]
acagcggcggcgaccuccaaca

SEQ ID NO: 1544781 - RNA, 14 nt, Human adenovirus B [HAdV-B]
gaaacgcuuucuag

SEQ ID NO: 1544782 - RNA, 23 nt, Human adenovirus B [HAdV-B]
uaacaggaauuuuugacaugaac

SEQ ID NO: 1544783 - RNA, 21 nt, Human adenovirus B [HAdV-B]
uccgaccuggaaggcggauga

SEQ ID NO: 1544784 - RNA, 13 nt, Human adenovirus B [HAdV-B]
auggugggucuuu

SEQ ID NO: 1544785 - RNA, 19 nt, Human adenovirus B [HAdV-B]
gugaaaguguuguuggaac

SEQ ID NO: 1544786 - RNA, 16 nt, Human adenovirus B [HAdV-B]
cuugcaacauacaaaa

SEQ ID NO: 1544787 - RNA, 12 nt, Human adenovirus B [HAdV-B]
accccaggccaa

SEQ ID NO: 1544788 - RNA, 15 nt, Human adenovirus B [HAdV-B]
caaguugaucaugcc

SEQ ID NO: 1544789 - RNA, 15 nt, Human adenovirus B [HAdV-B]
uugaguacucagccu

SEQ ID NO: 1544790 - RNA, 12 nt, Human adenovirus B [HAdV-B]
cgccagcagcag

SEQ ID NO: 1544791 - RNA, 18 nt, Human adenovirus B [HAdV-B]
ugucacccucuucaacau

SEQ ID NO: 1544792 - RNA, 14 nt, Human adenovirus B [HAdV-B]
agugcaaacugaac

SEQ ID NO: 1544793 - RNA, 20 nt, Human adenovirus B [HAdV-B]
gguggaacacgaggaagagu

SEQ ID NO: 1544794 - RNA, 22 nt, Human adenovirus B [HAdV-B]
aagaaaucggaucuuuccaacc

SEQ ID NO: 1544795 - RNA, 14 nt, Human adenovirus B [HAdV-B]
ucuccuaggcagag

SEQ ID NO: 1544796 - RNA, 22 nt, Human adenovirus B [HAdV-B]
gggugcuaccgcggcugagccc

SEQ ID NO: 1544797 - RNA, 21 nt, Human adenovirus B [HAdV-B]
aauugacaugcccuuggcucu

SEQ ID NO: 1544798 - RNA, 22 nt, Human adenovirus B [HAdV-B]
cuggaggacagucuggaggaag

SEQ ID NO: 1544799 - RNA, 15 nt, Human adenovirus B [HAdV-B]
gccuacugccaccuc

SEQ ID NO: 1544800 - RNA, 15 nt, Human adenovirus B [HAdV-B]
gucaaguguuucuug

SEQ ID NO: 1544801 - RNA, 14 nt, Human adenovirus B [HAdV-B]
uuagcuauuugcac

SEQ ID NO: 1544802 - RNA, 18 nt, Human adenovirus B [HAdV-B]
ccuacggaagccagcacc

SEQ ID NO: 1544803 - RNA, 16 nt, Human adenovirus B [HAdV-B]
ccaccugcugcgcacu

SEQ ID NO: 1544804 - RNA, 16 nt, Human adenovirus B [HAdV-B]
cagcagcccuucucua

SEQ ID NO: 1544805 - RNA, 19 nt, Human adenovirus B [HAdV-B]
uaucuaacguggaacucac

SEQ ID NO: 1544806 - RNA, 14 nt, Human adenovirus B [HAdV-B]
ugcauucacugcuc

SEQ ID NO: 1544807 - RNA, 20 nt, Human adenovirus B [HAdV-B]
aggcagaguuucuuguaaaa

SEQ ID NO: 1544808 - RNA, 17 nt, Human adenovirus B [HAdV-B]
aaccuuugacacugccg

SEQ ID NO: 1544809 - RNA, 16 nt, Human adenovirus B [HAdV-B]
acagauggauaaauca

SEQ ID NO: 1544810 - RNA, 15 nt, Human adenovirus B [HAdV-B]
gcuucgugcccguug

SEQ ID NO: 1544811 - RNA, 20 nt, Human adenovirus B [HAdV-B]
ugucagcauugucacugccg

SEQ ID NO: 1544812 - RNA, 17 nt, Human adenovirus B [HAdV-B]
agucggcggacauugcu

SEQ ID NO: 1544813 - RNA, 22 nt, Human adenovirus B [HAdV-B]
gacaauggaugguuuacaaaac

SEQ ID NO: 1544814 - RNA, 17 nt, Human adenovirus B [HAdV-B]
gacaaugaggcuuucag

SEQ ID NO: 1544815 - RNA, 14 nt, Human adenovirus B [HAdV-B]
gugacgcugccacc

SEQ ID NO: 1544816 - RNA, 14 nt, Human adenovirus B [HAdV-B]
gucuuguugccauc

SEQ ID NO: 1544817 - RNA, 17 nt, Human adenovirus B [HAdV-B]
gcaggaugugagcuucc

SEQ ID NO: 1544818 - RNA, 21 nt, Human adenovirus B [HAdV-B]
acaaagcccaaacggaguucu

SEQ ID NO: 1544819 - RNA, 19 nt, Human adenovirus B [HAdV-B]
gaggguaaaccagugguca

SEQ ID NO: 1544820 - RNA, 15 nt, Human adenovirus B [HAdV-B]
gccgccggucccacu

SEQ ID NO: 1544821 - RNA, 11 nt, Human adenovirus B [HAdV-B]
agaaaaaaaca

SEQ ID NO: 1544822 - RNA, 19 nt, Human adenovirus B [HAdV-B]
ccuguagaaaaagauagua

SEQ ID NO: 1544823 - RNA, 18 nt, Human adenovirus B [HAdV-B]
gcuucacacaaagcccaa

SEQ ID NO: 1544824 - RNA, 15 nt, Human adenovirus B [HAdV-B]
cagccuccaaaggcc

SEQ ID NO: 1544825 - RNA, 14 nt, Human adenovirus B [HAdV-B]
cggagggcagaaac

SEQ ID NO: 1544826 - RNA, 15 nt, Human adenovirus B [HAdV-B]
ucccucuaaauacac

SEQ ID NO: 1544827 - RNA, 22 nt, Human adenovirus B [HAdV-B]
acucucccagggauuuggaaga

SEQ ID NO: 1544828 - RNA, 13 nt, Human adenovirus B [HAdV-B]
ggcggcuccaccc

SEQ ID NO: 1544829 - RNA, 20 nt, Human adenovirus B [HAdV-B]
uuuuaauagcccuuaacauc

SEQ ID NO: 1544830 - RNA, 20 nt, Human adenovirus B [HAdV-B]
auucauuuuucagaaacuuc

SEQ ID NO: 1544831 - RNA, 21 nt, Human adenovirus B [HAdV-B]
agcucaugcucuggacaugac

SEQ ID NO: 1544832 - RNA, 14 nt, Human adenovirus B [HAdV-B]
gaacaacugccgua

SEQ ID NO: 1544833 - RNA, 17 nt, Human adenovirus B [HAdV-B]
gcgccgcgacggcagga

SEQ ID NO: 1544834 - RNA, 20 nt, Human adenovirus B [HAdV-B]
ugcagcacuggacaugacag

SEQ ID NO: 1544835 - RNA, 14 nt, Human adenovirus B [HAdV-B]
gcggcgcugcagag

SEQ ID NO: 1544836 - RNA, 14 nt, Human adenovirus B [HAdV-B]
aaaacaugcaacau

SEQ ID NO: 1544837 - RNA, 17 nt, Human adenovirus B [HAdV-B]
ucgcaaugacagaaugc

SEQ ID NO: 1544838 - RNA, 18 nt, Human adenovirus B [HAdV-B]
cuugagcagcuuuucgua

SEQ ID NO: 1544839 - RNA, 22 nt, Human adenovirus B [HAdV-B]
cgguacaccggauugcagcacu

SEQ ID NO: 1544840 - RNA, 23 nt, Human adenovirus B [HAdV-B]
ucagaugcaucccgugcugcgac

SEQ ID NO: 1544841 - RNA, 18 nt, Human adenovirus B [HAdV-B]
ggcgcuccucguccaaau

SEQ ID NO: 1544842 - RNA, 22 nt, Human adenovirus B [HAdV-B]
cagcagugucgcuaacaauaca

SEQ ID NO: 1544843 - RNA, 18 nt, Human adenovirus B [HAdV-B]
auaccgcaaccaaaauau

SEQ ID NO: 1544844 - RNA, 17 nt, Human adenovirus B [HAdV-B]
gaaugagccuaacagga

SEQ ID NO: 1544845 - RNA, 22 nt, Human adenovirus B [HAdV-B]
cagucuuuccaucacaagacaa

SEQ ID NO: 1544846 - RNA, 16 nt, Human adenovirus B [HAdV-B]
ccaaacggcaccugcg

SEQ ID NO: 1544847 - RNA, 14 nt, Human adenovirus B [HAdV-B]
ugcacuuuuugcuu

SEQ ID NO: 1544848 - RNA, 11 nt, Human adenovirus B [HAdV-B]
cgauuuggaag

SEQ ID NO: 1544849 - RNA, 13 nt, Human adenovirus B [HAdV-B]
gguggcuuccagc

SEQ ID NO: 1544850 - RNA, 16 nt, Human adenovirus B [HAdV-B]
cuuucucuagcagcag

SEQ ID NO: 1544851 - RNA, 13 nt, Human adenovirus B [HAdV-B]
ugcaaaacaauga

SEQ ID NO: 1544852 - RNA, 16 nt, Human adenovirus B [HAdV-B]
cuucaacauccaggaa

SEQ ID NO: 1544853 - RNA, 15 nt, Human adenovirus B [HAdV-B]
cagcgacggaugucu

SEQ ID NO: 1544854 - RNA, 12 nt, Human adenovirus B [HAdV-B]
gucaccugcgga

SEQ ID NO: 1544855 - RNA, 15 nt, Human adenovirus B [HAdV-B]
cagacuagcagacag

SEQ ID NO: 1544856 - RNA, 14 nt, Human adenovirus B [HAdV-B]
uggaaacucagcca

SEQ ID NO: 1544857 - RNA, 18 nt, Human adenovirus B [HAdV-B]
agccaacgagccagcgca

SEQ ID NO: 1544858 - RNA, 17 nt, Human adenovirus B [HAdV-B]
accggauugcagcacug

SEQ ID NO: 1544859 - RNA, 22 nt, Human adenovirus B [HAdV-B]
gaaucagaaugacccgcaggca

SEQ ID NO: 1544860 - RNA, 16 nt, Human adenovirus B [HAdV-B]
guuccuggacauugcu

SEQ ID NO: 1544861 - RNA, 20 nt, Human adenovirus B [HAdV-B]
cgccuucaauuggagcagua

SEQ ID NO: 1544862 - RNA, 22 nt, Human adenovirus B [HAdV-B]
aacucugaccacucugauacaa

SEQ ID NO: 1544863 - RNA, 18 nt, Human adenovirus B [HAdV-B]
uccggaucuccugggcau

SEQ ID NO: 1544864 - RNA, 17 nt, Human adenovirus B [HAdV-B]
agugccaucacaucucg

SEQ ID NO: 1544865 - RNA, 22 nt, Human adenovirus B [HAdV-B]
uugagcugggaugggugcauuc

SEQ ID NO: 1544866 - RNA, 19 nt, Human adenovirus B [HAdV-B]
ccacgccuuacauguggag

SEQ ID NO: 1544867 - RNA, 15 nt, Human adenovirus B [HAdV-B]
cuggagugucacugc

SEQ ID NO: 1544868 - RNA, 23 nt, Human adenovirus B [HAdV-B]
uguguccuccaagauuuuccaug

SEQ ID NO: 1544869 - RNA, 17 nt, Human adenovirus B [HAdV-B]
gccguagacgccagcgc

SEQ ID NO: 1544870 - RNA, 20 nt, Human adenovirus B [HAdV-B]
gcugacuugucuccugaacu

SEQ ID NO: 1544871 - RNA, 18 nt, Human adenovirus B [HAdV-B]
cggaucgcuguccaggaa

SEQ ID NO: 1544872 - RNA, 14 nt, Human adenovirus B [HAdV-B]
cagugcaggcagca

SEQ ID NO: 1544873 - RNA, 13 nt, Human adenovirus B [HAdV-B]
gccauuugccauu

SEQ ID NO: 1544874 - RNA, 15 nt, Human adenovirus B [HAdV-B]
gcugcagagccagcc

SEQ ID NO: 1544875 - RNA, 16 nt, Human adenovirus B [HAdV-B]
aucauagugcaggagc

SEQ ID NO: 1544876 - RNA, 14 nt, Human adenovirus B [HAdV-B]
gguagacagaaugg

SEQ ID NO: 1544877 - RNA, 21 nt, Human adenovirus B [HAdV-B]
gcucuuaccaccacgccccgc

SEQ ID NO: 1544878 - RNA, 20 nt, Human adenovirus B [HAdV-B]
ucaacaauaccuguguagau

SEQ ID NO: 1544879 - RNA, 21 nt, Human adenovirus B [HAdV-B]
ugcaaguccuuuuccuagucu

SEQ ID NO: 1544880 - RNA, 14 nt, Human adenovirus B [HAdV-B]
cuggcuaccuauca

SEQ ID NO: 1544881 - RNA, 14 nt, Human adenovirus B [HAdV-B]
ugaugaaaugacag

SEQ ID NO: 1544882 - RNA, 18 nt, Human adenovirus B [HAdV-B]
cccugccguugcgcagca

SEQ ID NO: 1544883 - RNA, 12 nt, Human adenovirus B [HAdV-B]
acgcccaggccg

SEQ ID NO: 1544884 - RNA, 22 nt, Human adenovirus B [HAdV-B]
ccagaacaccuuagaaaaugca

SEQ ID NO: 1544885 - RNA, 17 nt, Human adenovirus B [HAdV-B]
gcuugggcgcuugccag

SEQ ID NO: 1544886 - RNA, 23 nt, Human adenovirus B [HAdV-B]
aacagugcaggcagcagcuccuu

SEQ ID NO: 1544887 - RNA, 17 nt, Human adenovirus B [HAdV-B]
ugcccaggacuuuuuga

SEQ ID NO: 1544888 - RNA, 18 nt, Human adenovirus B [HAdV-B]
ggugacgcggcugagcua

SEQ ID NO: 1544889 - RNA, 18 nt, Human adenovirus B [HAdV-B]
cuuucagacuagcagaca

SEQ ID NO: 1544890 - RNA, 23 nt, Human adenovirus B [HAdV-B]
ccauucucgagcugccagugcgc

SEQ ID NO: 1544891 - RNA, 22 nt, Human adenovirus B [HAdV-B]
aacugcccaaaacaacgagcag

SEQ ID NO: 1544892 - RNA, 14 nt, Human adenovirus B [HAdV-B]
aggucgcagugcau

SEQ ID NO: 1544893 - RNA, 14 nt, Human adenovirus B [HAdV-B]
uuacaaccagaaga

SEQ ID NO: 1544894 - RNA, 14 nt, Human adenovirus B [HAdV-B]
uggggcgaagagcc

SEQ ID NO: 1544895 - RNA, 21 nt, Human adenovirus B [HAdV-B]
accugaagucuacggccaacc

SEQ ID NO: 1544896 - RNA, 23 nt, Human adenovirus B [HAdV-B]
aucccgacgaaaguacgguccag

SEQ ID NO: 1544897 - RNA, 16 nt, Human adenovirus B [HAdV-B]
aguaguuauuuugccu

SEQ ID NO: 1544898 - RNA, 19 nt, Human adenovirus B [HAdV-B]
cccaguccugccaccaccu

SEQ ID NO: 1544899 - RNA, 23 nt, Human adenovirus B [HAdV-B]
ggcggaugaaggcgaggaggaag

SEQ ID NO: 1544900 - RNA, 22 nt, Human adenovirus B [HAdV-B]
ccggccggagccgcggcuaacg

SEQ ID NO: 1544901 - RNA, 15 nt, Human adenovirus B [HAdV-B]
agguggacgagcaga

SEQ ID NO: 1544902 - RNA, 23 nt, Human adenovirus B [HAdV-B]
ccaucuauuauuccuacuccugg

SEQ ID NO: 1544903 - RNA, 15 nt, Human adenovirus B [HAdV-B]
ucggcugcggagaca

SEQ ID NO: 1544904 - RNA, 18 nt, Human adenovirus B [HAdV-B]
cacagccaaucaccacac

SEQ ID NO: 1544905 - RNA, 13 nt, Human adenovirus B [HAdV-B]
gcaaggacaacau

SEQ ID NO: 1544906 - RNA, 23 nt, Human adenovirus B [HAdV-B]
aaaucaaguguuuuuauuucauu

SEQ ID NO: 1544907 - RNA, 14 nt, Human adenovirus B [HAdV-B]
ccuuugacacugcc

SEQ ID NO: 1544908 - RNA, 21 nt, Human adenovirus B [HAdV-B]
uagacacggcuuugugcggca

SEQ ID NO: 1544909 - RNA, 19 nt, Human adenovirus B [HAdV-B]
auuaacaaacugcuggacu

SEQ ID NO: 1544910 - RNA, 21 nt, Human adenovirus B [HAdV-B]
cuccccaaggaucacccucaa

SEQ ID NO: 1544911 - RNA, 19 nt, Human adenovirus B [HAdV-B]
agaaacauaucccagggaa

SEQ ID NO: 1544912 - RNA, 19 nt, Human adenovirus B [HAdV-B]
cgcgcagauggcaucucuc

SEQ ID NO: 1544913 - RNA, 15 nt, Human adenovirus B [HAdV-B]
ggcaauucuggccca

SEQ ID NO: 1544914 - RNA, 16 nt, Human adenovirus B [HAdV-B]
caggacuacuccaccc

SEQ ID NO: 1544915 - RNA, 19 nt, Human adenovirus B [HAdV-B]
gcuagugaucgcacugcuu

SEQ ID NO: 1544916 - RNA, 14 nt, Human adenovirus B [HAdV-B]
uggacccaggccau

SEQ ID NO: 1544917 - RNA, 23 nt, Human adenovirus B [HAdV-B]
cuggccaacuaucucuccuacca

SEQ ID NO: 1544918 - RNA, 13 nt, Human adenovirus B [HAdV-B]
aagaaaugcauau

SEQ ID NO: 1544919 - RNA, 14 nt, Human adenovirus B [HAdV-B]
ccaggggguccacc

SEQ ID NO: 1544920 - RNA, 16 nt, Human adenovirus B [HAdV-B]
ugagcugggaugggug

SEQ ID NO: 1544921 - RNA, 18 nt, Human adenovirus B [HAdV-B]
acuucaacaaucagcauu

SEQ ID NO: 1544922 - RNA, 17 nt, Human adenovirus B [HAdV-B]
aucugcaacaaaacaaa

SEQ ID NO: 1544923 - RNA, 18 nt, Human adenovirus B [HAdV-B]
ugauuuaaaaucaagugu

SEQ ID NO: 1544924 - RNA, 16 nt, Human adenovirus B [HAdV-B]
gucuacccguuucuug

SEQ ID NO: 1544925 - RNA, 14 nt, Human adenovirus B [HAdV-B]
agacauaaaugcau

SEQ ID NO: 1544926 - RNA, 13 nt, Human adenovirus B [HAdV-B]
cgccaccugcugc

SEQ ID NO: 1544927 - RNA, 20 nt, Human adenovirus B [HAdV-B]
aggagaaauauucacuggaa

SEQ ID NO: 1544928 - RNA, 20 nt, Human adenovirus B [HAdV-B]
gauuugauauugacagugcc

SEQ ID NO: 1544929 - RNA, 22 nt, Human adenovirus B [HAdV-B]
cagaguaucauagugcaggagc

SEQ ID NO: 1544930 - RNA, 22 nt, Human adenovirus B [HAdV-B]
gagcuucuacaacgaacaagcu

SEQ ID NO: 1544931 - RNA, 13 nt, Human adenovirus B [HAdV-B]
auaagaaugccau

SEQ ID NO: 1544932 - RNA, 15 nt, Human adenovirus B [HAdV-B]
guccggcccacggag

SEQ ID NO: 1544933 - RNA, 17 nt, Human adenovirus B [HAdV-B]
agccacagcaaccccag

SEQ ID NO: 1544934 - RNA, 18 nt, Human adenovirus B [HAdV-B]
uaccagacaaaguacagc

SEQ ID NO: 1544935 - RNA, 23 nt, Human adenovirus B [HAdV-B]
ugguuagcucauaggagcuggcu

SEQ ID NO: 1544936 - RNA, 14 nt, Human adenovirus B [HAdV-B]
agggaaaaguacag

SEQ ID NO: 1544937 - RNA, 16 nt, Human adenovirus B [HAdV-B]
ugcagcaacaggagga

SEQ ID NO: 1544938 - RNA, 12 nt, Human adenovirus B [HAdV-B]
auugccacagcu

SEQ ID NO: 1544939 - RNA, 15 nt, Human adenovirus B [HAdV-B]
gaaauuuucucccag

SEQ ID NO: 1544940 - RNA, 23 nt, Human adenovirus B [HAdV-B]
uauuuugauuaagggaaaugcca

SEQ ID NO: 1544941 - RNA, 17 nt, Human adenovirus B [HAdV-B]
acccaauauaaccuucc

SEQ ID NO: 1544942 - RNA, 18 nt, Human adenovirus B [HAdV-B]
auuugugugacagugcaa

SEQ ID NO: 1544943 - RNA, 21 nt, Human adenovirus B [HAdV-B]
gcaaugcgggcggcgcugcag

SEQ ID NO: 1544944 - RNA, 17 nt, Human adenovirus B [HAdV-B]
ggcucucuucaacaagu

SEQ ID NO: 1544945 - RNA, 19 nt, Human adenovirus B [HAdV-B]
uuuccaucauguuugacuc

SEQ ID NO: 1544946 - RNA, 17 nt, Human adenovirus B [HAdV-B]
cgaugggucuucuccug

SEQ ID NO: 1544947 - RNA, 17 nt, Human adenovirus B [HAdV-B]
aaagcacaagcucuaaa

SEQ ID NO: 1544948 - RNA, 21 nt, Human adenovirus B [HAdV-B]
cgugcagcuucgggcgccagc

SEQ ID NO: 1544949 - RNA, 19 nt, Human adenovirus B [HAdV-B]
uugaugaacaaugccauca

SEQ ID NO: 1544950 - RNA, 17 nt, Human adenovirus B [HAdV-B]
auuaucaccaaacugcu

SEQ ID NO: 1544951 - RNA, 16 nt, Human adenovirus B [HAdV-B]
cgcugcaaucugugca

SEQ ID NO: 1544952 - RNA, 20 nt, Human adenovirus B [HAdV-B]
ugaggccacaacgcacagcc

SEQ ID NO: 1544953 - RNA, 17 nt, Human adenovirus B [HAdV-B]
ucuguauugcaggagaa

SEQ ID NO: 1544954 - RNA, 17 nt, Human adenovirus B [HAdV-B]
augaacaaugccaucau

SEQ ID NO: 1544955 - RNA, 14 nt, Human adenovirus B [HAdV-B]
agugcaauguaaua

SEQ ID NO: 1544956 - RNA, 18 nt, Human adenovirus B [HAdV-B]
uacaacucccuggcuccu

SEQ ID NO: 1544957 - RNA, 14 nt, Human adenovirus B [HAdV-B]
cagcgcugccaggg

SEQ ID NO: 1544958 - RNA, 23 nt, Human adenovirus B [HAdV-B]
ucacaaaaggcugucccugcaac

SEQ ID NO: 1544959 - RNA, 23 nt, Human adenovirus B [HAdV-B]
cuaauaauaauaugcaugcuuuu

SEQ ID NO: 1544960 - RNA, 23 nt, Human adenovirus B [HAdV-B]
caggaugucccaacgacgagaaa

SEQ ID NO: 1544961 - RNA, 16 nt, Human adenovirus B [HAdV-B]
gcaauccccacuggag

SEQ ID NO: 1544962 - RNA, 13 nt, Human adenovirus B [HAdV-B]
accguuucugggg

SEQ ID NO: 1544963 - RNA, 12 nt, Human adenovirus B [HAdV-B]
ucacuccacagc

SEQ ID NO: 1544964 - RNA, 16 nt, Human adenovirus B [HAdV-B]
ggcgcuugccagggug

SEQ ID NO: 1544965 - RNA, 18 nt, Human adenovirus B [HAdV-B]
agauugggacagucaggc

SEQ ID NO: 1544966 - RNA, 13 nt, Human adenovirus B [HAdV-B]
gauugcuggaaua

SEQ ID NO: 1544967 - RNA, 18 nt, Human adenovirus B [HAdV-B]
cccuacggaagccagcac

SEQ ID NO: 1544968 - RNA, 23 nt, Human adenovirus B [HAdV-B]
ucuacggccaaccguugaaggau

SEQ ID NO: 1544969 - RNA, 19 nt, Human adenovirus B [HAdV-B]
cuacggaagccagcaccca

SEQ ID NO: 1544970 - RNA, 14 nt, Human adenovirus B [HAdV-B]
cuucccucuuccca

SEQ ID NO: 1544971 - RNA, 17 nt, Human adenovirus B [HAdV-B]
ccaaggaugagacagug

SEQ ID NO: 1544972 - RNA, 21 nt, Human adenovirus B [HAdV-B]
guaucagaaaaaaacagccau

SEQ ID NO: 1544973 - RNA, 13 nt, Human adenovirus B [HAdV-B]
cuggaggaggaac

SEQ ID NO: 1544974 - RNA, 19 nt, Human adenovirus B [HAdV-B]
cggcgaggagccggaggag

SEQ ID NO: 1544975 - RNA, 20 nt, Human adenovirus B [HAdV-B]
gugaugcagcagcagcaggc

SEQ ID NO: 1544976 - RNA, 15 nt, Human adenovirus B [HAdV-B]
cgggcggcgcugcag

SEQ ID NO: 1544977 - RNA, 15 nt, Human adenovirus B [HAdV-B]
cgcccaguccugcca

SEQ ID NO: 1544978 - RNA, 16 nt, Human adenovirus B [HAdV-B]
ugcaaagagcucugac

SEQ ID NO: 1544979 - RNA, 13 nt, Human adenovirus B [HAdV-B]
caugaacaugcaa

SEQ ID NO: 1544980 - RNA, 18 nt, Human adenovirus B [HAdV-B]
uuccuggauacacggcuc

SEQ ID NO: 1544981 - RNA, 20 nt, Human adenovirus B [HAdV-B]
ugacagugccgguugagaug

SEQ ID NO: 1544982 - RNA, 15 nt, Human adenovirus B [HAdV-B]
aaccccacagccaau

SEQ ID NO: 1544983 - RNA, 21 nt, Human adenovirus B [HAdV-B]
aguucuugugguaaauccaau

SEQ ID NO: 1544984 - RNA, 17 nt, Human adenovirus B [HAdV-B]
ugaaacucacuauucaa

SEQ ID NO: 1544985 - RNA, 21 nt, Human adenovirus B [HAdV-B]
ccucagagcgaaguguaucag

SEQ ID NO: 1544986 - RNA, 14 nt, Human adenovirus B [HAdV-B]
ucaguccugccagg

SEQ ID NO: 1544987 - RNA, 15 nt, Human adenovirus B [HAdV-B]
ccacuaccacauucc

SEQ ID NO: 1544988 - RNA, 15 nt, Human adenovirus B [HAdV-B]
gcgaccuccaacaga

SEQ ID NO: 1544989 - RNA, 23 nt, Human adenovirus B [HAdV-B]
cagcauuguggagaacauggaag

SEQ ID NO: 1544990 - RNA, 17 nt, Human adenovirus B [HAdV-B]
acaugaaucaugugaaa

SEQ ID NO: 1544991 - RNA, 23 nt, Human adenovirus B [HAdV-B]
guuucacauuccaccagccaggu

SEQ ID NO: 1544992 - RNA, 19 nt, Human adenovirus B [HAdV-B]
aacagugcaggcagcagcu

SEQ ID NO: 1544993 - RNA, 13 nt, Human adenovirus B [HAdV-B]
uggaucccaugga

SEQ ID NO: 1544994 - RNA, 18 nt, Human adenovirus B [HAdV-B]
ccuaguguaccaggaaag

SEQ ID NO: 1544995 - RNA, 23 nt, Human adenovirus B [HAdV-B]
cgacgaggaaaaggagcagagcu

SEQ ID NO: 1544996 - RNA, 20 nt, Human adenovirus B [HAdV-B]
acuuccgcaaucccaacagg

SEQ ID NO: 1544997 - RNA, 23 nt, Human adenovirus B [HAdV-B]
ccgccuaugaucuggacuuggaa

SEQ ID NO: 1544998 - RNA, 14 nt, Human adenovirus B [HAdV-B]
cgcagggcucugag

SEQ ID NO: 1544999 - RNA, 14 nt, Human adenovirus B [HAdV-B]
ccucggcugcggag

SEQ ID NO: 1545000 - RNA, 15 nt, Human adenovirus B [HAdV-B]
gcgcugcagagccag

SEQ ID NO: 1545001 - RNA, 16 nt, Human adenovirus B [HAdV-B]
uuaagauucccacuga

SEQ ID NO: 1545002 - RNA, 15 nt, Human adenovirus B [HAdV-B]
caguacaagcgcaga

SEQ ID NO: 1545003 - RNA, 22 nt, Human adenovirus B [HAdV-B]
uuacuugaaaguggguagacag

SEQ ID NO: 1545004 - RNA, 22 nt, Human adenovirus B [HAdV-B]
cuucuuucagacuagcagacag

SEQ ID NO: 1545005 - RNA, 22 nt, Human adenovirus B [HAdV-B]
gucuugacugaugucuugcaug

SEQ ID NO: 1545006 - RNA, 14 nt, Human adenovirus B [HAdV-B]
cuguaccugugcca

SEQ ID NO: 1545007 - RNA, 12 nt, Human adenovirus B [HAdV-B]
accuaugugaac

SEQ ID NO: 1545008 - RNA, 12 nt, Human adenovirus B [HAdV-B]
gaucggacaggg

SEQ ID NO: 1545009 - RNA, 15 nt, Human adenovirus B [HAdV-B]
uuuuccgccauauuu

SEQ ID NO: 1545010 - RNA, 21 nt, Human adenovirus B [HAdV-B]
caucaaccucuaugcuacuuu

SEQ ID NO: 1545011 - RNA, 19 nt, Human adenovirus B [HAdV-B]
ucgaguuuacuuugccaga

SEQ ID NO: 1545012 - RNA, 20 nt, Human adenovirus B [HAdV-B]
acuuacuugaaaucagcaau

SEQ ID NO: 1545013 - RNA, 15 nt, Human adenovirus B [HAdV-B]
ucucacuugccaccc

SEQ ID NO: 1545014 - RNA, 22 nt, Human adenovirus B [HAdV-B]
aacauguugguuggagccugag

SEQ ID NO: 1545015 - RNA, 17 nt, Human adenovirus B [HAdV-B]
gacaauuggaauaucua

SEQ ID NO: 1545016 - RNA, 17 nt, Human adenovirus B [HAdV-B]
ucagccagaaccucagc

SEQ ID NO: 1545017 - RNA, 17 nt, Human adenovirus B [HAdV-B]
uuacuaccgucaccucc

SEQ ID NO: 1545018 - RNA, 19 nt, Human adenovirus B [HAdV-B]
ugcggcaucgcagaaaaca

SEQ ID NO: 1545019 - RNA, 18 nt, Human adenovirus B [HAdV-B]
ugcuauuaguuacuucaa

SEQ ID NO: 1545020 - RNA, 20 nt, Human adenovirus B [HAdV-B]
gcgacagggaacugaugcac

SEQ ID NO: 1545021 - RNA, 16 nt, Human adenovirus B [HAdV-B]
cccagagcgucucagg

SEQ ID NO: 1545022 - RNA, 11 nt, Human adenovirus B [HAdV-B]
uaugaaaucaa

SEQ ID NO: 1545023 - RNA, 19 nt, Human adenovirus B [HAdV-B]
ucggcuuacgagcagacag

SEQ ID NO: 1545024 - RNA, 22 nt, Human adenovirus B [HAdV-B]
accuauacacaccuugcuucac

SEQ ID NO: 1545025 - RNA, 12 nt, Human adenovirus B [HAdV-B]
uacuuucucuag

SEQ ID NO: 1545026 - RNA, 22 nt, Human adenovirus B [HAdV-B]
gaagacaguuuggaggaggaaa

SEQ ID NO: 1545027 - RNA, 22 nt, Human adenovirus B [HAdV-B]
cucgaaaacugguuagcugcac

SEQ ID NO: 1545028 - RNA, 22 nt, Human adenovirus B [HAdV-B]
augcguguuggauugccacagc

SEQ ID NO: 1545029 - RNA, 19 nt, Human adenovirus B [HAdV-B]
gguguaucgcaaugacaga

SEQ ID NO: 1545030 - RNA, 19 nt, Human adenovirus B [HAdV-B]
ccagaucuucagcauuggc

SEQ ID NO: 1545031 - RNA, 18 nt, Human adenovirus B [HAdV-B]
acgaggaaaaggagcaga

SEQ ID NO: 1545032 - RNA, 14 nt, Human adenovirus B [HAdV-B]
ucuccuccuaguga

SEQ ID NO: 1545033 - RNA, 15 nt, Human adenovirus B [HAdV-B]
agauugcccaggacu

SEQ ID NO: 1545034 - RNA, 15 nt, Human adenovirus B [HAdV-B]
cauacaauccagaca

SEQ ID NO: 1545035 - RNA, 13 nt, Human adenovirus B [HAdV-B]
gcuucuugcaaau

SEQ ID NO: 1545036 - RNA, 13 nt, Human adenovirus B [HAdV-B]
aacgagccagcgc

SEQ ID NO: 1545037 - RNA, 15 nt, Human adenovirus B [HAdV-B]
aggcgcugcugaaca

SEQ ID NO: 1545038 - RNA, 16 nt, Human adenovirus B [HAdV-B]
gccuacugccaccucc

SEQ ID NO: 1545039 - RNA, 21 nt, Human adenovirus B [HAdV-B]
cgcuaacaauacaauuuccaa

SEQ ID NO: 1545040 - RNA, 13 nt, Human adenovirus B [HAdV-B]
gagcccagcaugu

SEQ ID NO: 1545041 - RNA, 16 nt, Human adenovirus B [HAdV-B]
ccaccagguuguaucu

SEQ ID NO: 1545042 - RNA, 16 nt, Human adenovirus B [HAdV-B]
ggcacuucagcuugcc

SEQ ID NO: 1545043 - RNA, 17 nt, Human adenovirus B [HAdV-B]
ugauuugcggugcuucc

SEQ ID NO: 1545044 - RNA, 18 nt, Human adenovirus B [HAdV-B]
agacaaggcaguuauuag

SEQ ID NO: 1545045 - RNA, 21 nt, Human adenovirus B [HAdV-B]
agugguugacuugcaggacag

SEQ ID NO: 1545046 - RNA, 14 nt, Human adenovirus B [HAdV-B]
auuccaccagccag

SEQ ID NO: 1545047 - RNA, 14 nt, Human adenovirus B [HAdV-B]
cccgccgccagcaa

SEQ ID NO: 1545048 - RNA, 20 nt, Human adenovirus B [HAdV-B]
aaagcuauucguccagauga

SEQ ID NO: 1545049 - RNA, 17 nt, Human adenovirus B [HAdV-B]
uuagaagauacugagca

SEQ ID NO: 1545050 - RNA, 18 nt, Human adenovirus B [HAdV-B]
cagcuccuuuagccagag

SEQ ID NO: 1545051 - RNA, 20 nt, Human adenovirus B [HAdV-B]
gcauuaucgcugcagugaca

SEQ ID NO: 1545052 - RNA, 11 nt, Human adenovirus B [HAdV-B]
cuagcuugcaa

SEQ ID NO: 1545053 - RNA, 19 nt, Human adenovirus B [HAdV-B]
cugccguugcgcagcagua

SEQ ID NO: 1545054 - RNA, 17 nt, Human adenovirus B [HAdV-B]
aauuuuagcuccucucc

SEQ ID NO: 1545055 - RNA, 21 nt, Human adenovirus B [HAdV-B]
gauacuuaugaucacaagcag

SEQ ID NO: 1545056 - RNA, 20 nt, Human adenovirus B [HAdV-B]
uuuugaucacaaugugauga

SEQ ID NO: 1545057 - RNA, 19 nt, Human adenovirus B [HAdV-B]
cagauauggcccucacuug

SEQ ID NO: 1545058 - RNA, 14 nt, Human adenovirus B [HAdV-B]
gaguagauggaaga

SEQ ID NO: 1545059 - RNA, 14 nt, Human adenovirus B [HAdV-B]
caaagagcucugac

SEQ ID NO: 1545060 - RNA, 21 nt, Human adenovirus B [HAdV-B]
uuugcaguagguacaacacau

SEQ ID NO: 1545061 - RNA, 14 nt, Human adenovirus B [HAdV-B]
caugaaagccuuug

SEQ ID NO: 1545062 - RNA, 14 nt, Human adenovirus B [HAdV-B]
cgacauguguugag

SEQ ID NO: 1545063 - RNA, 21 nt, Human adenovirus B [HAdV-B]
ucucccagacucguacaaaua

SEQ ID NO: 1545064 - RNA, 14 nt, Human adenovirus B [HAdV-B]
uacuugaaaucagc

SEQ ID NO: 1545065 - RNA, 17 nt, Human adenovirus B [HAdV-B]
gcuccagcaaaaacaag

SEQ ID NO: 1545066 - RNA, 22 nt, Human adenovirus B [HAdV-B]
aaccgguauaucgggcaggaug

SEQ ID NO: 1545067 - RNA, 14 nt, Human adenovirus B [HAdV-B]
uaguggcacaacau

SEQ ID NO: 1545068 - RNA, 16 nt, Human adenovirus B [HAdV-B]
cgaggaggaagagggc

SEQ ID NO: 1545069 - RNA, 16 nt, Human adenovirus B [HAdV-B]
cuccaagcaagaugua

SEQ ID NO: 1545070 - RNA, 14 nt, Human adenovirus B [HAdV-B]
cccagcuguuucug

SEQ ID NO: 1545071 - RNA, 12 nt, Human adenovirus B [HAdV-B]
ugcaagauaucu

SEQ ID NO: 1545072 - RNA, 14 nt, Human adenovirus B [HAdV-B]
uccuaugcacuuuu

SEQ ID NO: 1545073 - RNA, 14 nt, Human adenovirus B [HAdV-B]
acucccagcagcuc

SEQ ID NO: 1545074 - RNA, 21 nt, Human adenovirus B [HAdV-B]
gccacagggucuccagcucga

SEQ ID NO: 1545075 - RNA, 20 nt, Human adenovirus B [HAdV-B]
augcuuagggcggccagacg

SEQ ID NO: 1545076 - RNA, 20 nt, Human adenovirus B [HAdV-B]
agcuguguacucccagcagc

SEQ ID NO: 1545077 - RNA, 18 nt, Human adenovirus B [HAdV-B]
ccacagcauuguggagaa

SEQ ID NO: 1545078 - RNA, 18 nt, Human adenovirus B [HAdV-B]
acaagaauuugaaaaguu

SEQ ID NO: 1545079 - RNA, 12 nt, Human adenovirus B [HAdV-B]
ucuucuccuggg

SEQ ID NO: 1545080 - RNA, 12 nt, Human adenovirus B [HAdV-B]
cagucaggcaga

SEQ ID NO: 1545081 - RNA, 18 nt, Human adenovirus B [HAdV-B]
cucuucgggggcagaggu

SEQ ID NO: 1545082 - RNA, 17 nt, Human adenovirus B [HAdV-B]
cacauccagaucuucag

SEQ ID NO: 1545083 - RNA, 18 nt, Human adenovirus B [HAdV-B]
aggcuguucugacuuugg

SEQ ID NO: 1545084 - RNA, 19 nt, Human adenovirus B [HAdV-B]
acuauaaaaguaguuuaga

SEQ ID NO: 1545085 - RNA, 17 nt, Human adenovirus B [HAdV-B]
gguugcauucacugcuc

SEQ ID NO: 1545086 - RNA, 12 nt, Human adenovirus B [HAdV-B]
auucccugcaga

SEQ ID NO: 1545087 - RNA, 13 nt, Human adenovirus B [HAdV-B]
uuacagaaaucuc

SEQ ID NO: 1545088 - RNA, 13 nt, Human adenovirus B [HAdV-B]
gucaauugucucu

SEQ ID NO: 1545089 - RNA, 23 nt, Human adenovirus B [HAdV-B]
cuggagcuggaaccgagggugag

SEQ ID NO: 1545090 - RNA, 12 nt, Human adenovirus B [HAdV-B]
uauaaauuaaau

SEQ ID NO: 1545091 - RNA, 19 nt, Human adenovirus B [HAdV-B]
gaaucauaauauugccaug

SEQ ID NO: 1545092 - RNA, 14 nt, Human adenovirus B [HAdV-B]
augaacaaugccau

SEQ ID NO: 1545093 - RNA, 15 nt, Human adenovirus B [HAdV-B]
uggucuccaugaguu

SEQ ID NO: 1545094 - RNA, 19 nt, Human adenovirus B [HAdV-B]
ugccagguggucucuggau

SEQ ID NO: 1545095 - RNA, 18 nt, Human adenovirus B [HAdV-B]
caacaccuuaaucccaga

SEQ ID NO: 1545096 - RNA, 18 nt, Human adenovirus B [HAdV-B]
agucaaguguuucuugaa

SEQ ID NO: 1545097 - RNA, 14 nt, Human adenovirus B [HAdV-B]
caagguucccucag

SEQ ID NO: 1545098 - RNA, 15 nt, Human adenovirus B [HAdV-B]
gcaguacucaagcga

SEQ ID NO: 1545099 - RNA, 20 nt, Human adenovirus B [HAdV-B]
cacuauucaaccuguagaaa

SEQ ID NO: 1545100 - RNA, 14 nt, Human adenovirus B [HAdV-B]
ugaucgcacugcuu

SEQ ID NO: 1545101 - RNA, 14 nt, Human adenovirus B [HAdV-B]
guuaacuguucacu

SEQ ID NO: 1545102 - RNA, 23 nt, Human adenovirus B [HAdV-B]
cuuuuccaaaguaugcaaacaca

SEQ ID NO: 1545103 - RNA, 24 nt, Human adenovirus B [HAdV-B]
acuauguuuucuuagagauggaag

SEQ ID NO: 1545104 - RNA, 18 nt, Human adenovirus B [HAdV-B]
uaaaaaauauaauuauuu

SEQ ID NO: 1545105 - RNA, 16 nt, Human adenovirus B [HAdV-B]
ucaauaguuccaaaug

SEQ ID NO: 1545106 - RNA, 13 nt, Human adenovirus B [HAdV-B]
gaggccggacugg

SEQ ID NO: 1545107 - RNA, 11 nt, Human adenovirus B [HAdV-B]
cccagcagcuc

SEQ ID NO: 1545108 - RNA, 21 nt, Human adenovirus B [HAdV-B]
caaacggcaccugcgagccaa

SEQ ID NO: 1545109 - RNA, 15 nt, Human adenovirus B [HAdV-B]
gccagcgccaugaca

SEQ ID NO: 1545110 - RNA, 15 nt, Human adenovirus B [HAdV-B]
acaugggcaccugga

SEQ ID NO: 1545111 - RNA, 20 nt, Human adenovirus B [HAdV-B]
agcucuuacagaaaucucuu

SEQ ID NO: 1545112 - RNA, 20 nt, Human adenovirus B [HAdV-B]
guggucagugaugagcagcu

SEQ ID NO: 1545113 - RNA, 13 nt, Human adenovirus B [HAdV-B]
cugcaaaaauaaa

SEQ ID NO: 1545114 - RNA, 19 nt, Human adenovirus B [HAdV-B]
uuugaggccugauaaacag

SEQ ID NO: 1545115 - RNA, 17 nt, Human adenovirus B [HAdV-B]
accacguaagaagcuuc

SEQ ID NO: 1545116 - RNA, 21 nt, Human adenovirus B [HAdV-B]
cugauuauuucaccaaugcca

SEQ ID NO: 1545117 - RNA, 17 nt, Human adenovirus B [HAdV-B]
ccccucccccugcugcu

SEQ ID NO: 1545118 - RNA, 14 nt, Human adenovirus B [HAdV-B]
ccagaaaacaaaaa

SEQ ID NO: 1545119 - RNA, 15 nt, Human adenovirus B [HAdV-B]
acaaugaggcuuuca

SEQ ID NO: 1545120 - RNA, 14 nt, Human adenovirus B [HAdV-B]
guuagcugcacagc

SEQ ID NO: 1545121 - RNA, 12 nt, Human adenovirus B [HAdV-B]
augagacagugu

SEQ ID NO: 1545122 - RNA, 21 nt, Human adenovirus B [HAdV-B]
ggaaucaccaacuugggaacc

SEQ ID NO: 1545123 - RNA, 16 nt, Human adenovirus B [HAdV-B]
auagcuuugaggccug

SEQ ID NO: 1545124 - RNA, 18 nt, Human adenovirus B [HAdV-B]
cuggccaacuaucucucc

SEQ ID NO: 1545125 - RNA, 20 nt, Human adenovirus B [HAdV-B]
aggggacugccccauggcau

SEQ ID NO: 1545126 - RNA, 20 nt, Human adenovirus B [HAdV-B]
caccauucuuaaacacaccc

SEQ ID NO: 1545127 - RNA, 13 nt, Human adenovirus B [HAdV-B]
caccuccacugaa

SEQ ID NO: 1545128 - RNA, 15 nt, Human adenovirus B [HAdV-B]
aaucugcacuacacu

SEQ ID NO: 1545129 - RNA, 12 nt, Human adenovirus B [HAdV-B]
ggaaauggggcu

SEQ ID NO: 1545130 - RNA, 22 nt, Human adenovirus B [HAdV-B]
augcccaugccuauuacaacug

SEQ ID NO: 1545131 - RNA, 12 nt, Human adenovirus B [HAdV-B]
acaauccagaca

SEQ ID NO: 1545132 - RNA, 23 nt, Human adenovirus B [HAdV-B]
aagagggcgaguacuuggaagac

SEQ ID NO: 1545133 - RNA, 20 nt, Human adenovirus B [HAdV-B]
accgucgcuuccgaccuggc

SEQ ID NO: 1545134 - RNA, 13 nt, Human adenovirus B [HAdV-B]
cuccuaggcagag

SEQ ID NO: 1545135 - RNA, 13 nt, Human adenovirus B [HAdV-B]
uguuuagaagaac

SEQ ID NO: 1545136 - RNA, 19 nt, Human adenovirus B [HAdV-B]
auagcuuccuuggaagagg

SEQ ID NO: 1545137 - RNA, 16 nt, Human adenovirus B [HAdV-B]
gacgcuacagugcagu

SEQ ID NO: 1545138 - RNA, 23 nt, Human adenovirus B [HAdV-B]
agcucauaggagcuggcuuucau

SEQ ID NO: 1545139 - RNA, 23 nt, Human adenovirus B [HAdV-B]
agagucguuugagcaaccuucuu

SEQ ID NO: 1545140 - RNA, 22 nt, Human adenovirus B [HAdV-B]
gucuuccggaucgcuguccagg

SEQ ID NO: 1545141 - RNA, 14 nt, Human adenovirus B [HAdV-B]
gguguccagaaaac

SEQ ID NO: 1545142 - RNA, 17 nt, Human adenovirus B [HAdV-B]
ccaauuaucgcugcugc

SEQ ID NO: 1545143 - RNA, 12 nt, Human adenovirus B [HAdV-B]
uuuaacuccuca

SEQ ID NO: 1545144 - RNA, 20 nt, Human adenovirus B [HAdV-B]
gaggaagauggcgaugaugg

SEQ ID NO: 1545145 - RNA, 16 nt, Human adenovirus B [HAdV-B]
aacaaagaaaaaaugc

SEQ ID NO: 1545146 - RNA, 15 nt, Human adenovirus B [HAdV-B]
cucauuugugcauuu

SEQ ID NO: 1545147 - RNA, 20 nt, Human adenovirus B [HAdV-B]
gcggacauugcuucucugaa

SEQ ID NO: 1545148 - RNA, 13 nt, Human adenovirus B [HAdV-B]
cugccgcugcaau

SEQ ID NO: 1545149 - RNA, 17 nt, Human adenovirus B [HAdV-B]
aacgcgggucgugagcu

SEQ ID NO: 1545150 - RNA, 18 nt, Human adenovirus B [HAdV-B]
acucuuccagaaaacaaa

SEQ ID NO: 1545151 - RNA, 13 nt, Human adenovirus B [HAdV-B]
gugcggcaggcau

SEQ ID NO: 1545152 - RNA, 21 nt, Human adenovirus B [HAdV-B]
gcagcagcaaucacaaaaggc

SEQ ID NO: 1545153 - RNA, 15 nt, Human adenovirus B [HAdV-B]
gauauguggccuggg

SEQ ID NO: 1545154 - RNA, 14 nt, Human adenovirus B [HAdV-B]
caaagcgugcugca

SEQ ID NO: 1545155 - RNA, 22 nt, Human adenovirus B [HAdV-B]
agucuguuccacaguucaguga

SEQ ID NO: 1545156 - RNA, 13 nt, Human adenovirus B [HAdV-B]
uauugcuuuuugg

SEQ ID NO: 1545157 - RNA, 17 nt, Human adenovirus B [HAdV-B]
ucuaaggccauuugcca

SEQ ID NO: 1545158 - RNA, 15 nt, Human adenovirus B [HAdV-B]
gagugcguuccugga

SEQ ID NO: 1545159 - RNA, 13 nt, Human adenovirus B [HAdV-B]
aaguuuucuugca

SEQ ID NO: 1545160 - RNA, 18 nt, Human adenovirus B [HAdV-B]
acugccuauccuuucaau

SEQ ID NO: 1545161 - RNA, 17 nt, Human adenovirus B [HAdV-B]
auaguaacuugcaacau

SEQ ID NO: 1545162 - RNA, 16 nt, Human adenovirus B [HAdV-B]
uugacaugaacaugca

SEQ ID NO: 1545163 - RNA, 16 nt, Human adenovirus B [HAdV-B]
cucgcggugaccagca

SEQ ID NO: 1545164 - RNA, 21 nt, Human adenovirus B [HAdV-B]
ugcagcacuggacaugacagc

SEQ ID NO: 1545165 - RNA, 22 nt, Human adenovirus B [HAdV-B]
cacaaagcccaaacggaguucu

SEQ ID NO: 1545166 - RNA, 14 nt, Human adenovirus B [HAdV-B]
acauccaauagcgc

SEQ ID NO: 1545167 - RNA, 15 nt, Human adenovirus B [HAdV-B]
cuggucagcugcaaa

SEQ ID NO: 1545168 - RNA, 16 nt, Human adenovirus B [HAdV-B]
gaccggacgcuucccg

SEQ ID NO: 1545169 - RNA, 22 nt, Human adenovirus B [HAdV-B]
agauuacagccaacgagccagc

SEQ ID NO: 1545170 - RNA, 18 nt, Human adenovirus B [HAdV-B]
guaaugggaguaaagugu

SEQ ID NO: 1545171 - RNA, 16 nt, Human adenovirus B [HAdV-B]
augcuggcuacugugc

SEQ ID NO: 1545172 - RNA, 14 nt, Human adenovirus B [HAdV-B]
agagcgagccguag

SEQ ID NO: 1545173 - RNA, 16 nt, Human adenovirus B [HAdV-B]
aacauucuacagagua

SEQ ID NO: 1545174 - RNA, 20 nt, Human adenovirus B [HAdV-B]
ccauggaugagcccacccug

SEQ ID NO: 1545175 - RNA, 23 nt, Human adenovirus B [HAdV-B]
ggcccuuacagacuugggacaga

SEQ ID NO: 1545176 - RNA, 15 nt, Human adenovirus B [HAdV-B]
uaagcauuccaccgc

SEQ ID NO: 1545177 - RNA, 21 nt, Human adenovirus B [HAdV-B]
cugagcuaucucggcugcgac

SEQ ID NO: 1545178 - RNA, 18 nt, Human adenovirus B [HAdV-B]
ugggcaccgacucuccca

SEQ ID NO: 1545179 - RNA, 16 nt, Human adenovirus B [HAdV-B]
gacguaagagccggcg

SEQ ID NO: 1545180 - RNA, 18 nt, Human adenovirus B [HAdV-B]
ccgucgccauacccuacc

SEQ ID NO: 1545181 - RNA, 12 nt, Human adenovirus B [HAdV-B]
cacagacaccua

SEQ ID NO: 1545182 - RNA, 20 nt, Human adenovirus B [HAdV-B]
uggucuggggguacaaacug

SEQ ID NO: 1545183 - RNA, 21 nt, Human adenovirus B [HAdV-B]
ggacagaggucccaguuucaa

SEQ ID NO: 1545184 - RNA, 23 nt, Human adenovirus B [HAdV-B]
cggaagccagcacccagaccauu

SEQ ID NO: 1545185 - RNA, 16 nt, Human adenovirus B [HAdV-B]
cguagcccaaugcaac

SEQ ID NO: 1545186 - RNA, 23 nt, Human adenovirus B [HAdV-B]
aaugcuuguuacauaucuggaaa

SEQ ID NO: 1545187 - RNA, 18 nt, Human adenovirus B [HAdV-B]
uaugcccgucuucucaaa

SEQ ID NO: 1545188 - RNA, 20 nt, Human adenovirus B [HAdV-B]
gcagagaaacaacagacaug

SEQ ID NO: 1545189 - RNA, 20 nt, Human adenovirus B [HAdV-B]
augccauggacaaugucaac

SEQ ID NO: 1545190 - RNA, 13 nt, Human adenovirus B [HAdV-B]
caaacgccagaag

SEQ ID NO: 1545191 - RNA, 12 nt, Human adenovirus B [HAdV-B]
caggaacugaaa

SEQ ID NO: 1545192 - RNA, 12 nt, Human adenovirus B [HAdV-B]
ggagggcagaaa

SEQ ID NO: 1545193 - RNA, 13 nt, Human adenovirus B [HAdV-B]
agcugggaugggu

SEQ ID NO: 1545194 - RNA, 17 nt, Human adenovirus B [HAdV-B]
ugacguuucgcucacca

SEQ ID NO: 1545195 - RNA, 15 nt, Human adenovirus B [HAdV-B]
auccauggaugccca

SEQ ID NO: 1545196 - RNA, 16 nt, Human adenovirus B [HAdV-B]
uugcugugccagaagu

SEQ ID NO: 1545197 - RNA, 20 nt, Human adenovirus B [HAdV-B]
cuggacauugcucaccaccu

SEQ ID NO: 1545198 - RNA, 22 nt, Human adenovirus B [HAdV-B]
ggucaaaagaaugcuggcuuca

SEQ ID NO: 1545199 - RNA, 15 nt, Human adenovirus B [HAdV-B]
ggcaggaugugagcu

SEQ ID NO: 1545200 - RNA, 18 nt, Human adenovirus B [HAdV-B]
gcguuccuggacauugcu

SEQ ID NO: 1545201 - RNA, 22 nt, Human adenovirus B [HAdV-B]
cuggcagaccucaucuucccag

SEQ ID NO: 1545202 - RNA, 14 nt, Human adenovirus B [HAdV-B]
guagguuuggaagu

SEQ ID NO: 1545203 - RNA, 14 nt, Human adenovirus B [HAdV-B]
ccccucgcagcagc

SEQ ID NO: 1545204 - RNA, 15 nt, Human adenovirus B [HAdV-B]
gacggcggugaugca

SEQ ID NO: 1545205 - RNA, 23 nt, Human adenovirus B [HAdV-B]
cuaugacuauugauuugaugaac

SEQ ID NO: 1545206 - RNA, 16 nt, Human adenovirus B [HAdV-B]
uauuccaauguggcuc

SEQ ID NO: 1545207 - RNA, 22 nt, Human adenovirus B [HAdV-B]
gcgccucccaggacuacuccac

SEQ ID NO: 1545208 - RNA, 21 nt, Human adenovirus B [HAdV-B]
cugagguuaaagugagaccca

SEQ ID NO: 1545209 - RNA, 22 nt, Human adenovirus B [HAdV-B]
uuccacaguucagugauguguu

SEQ ID NO: 1545210 - RNA, 16 nt, Human adenovirus B [HAdV-B]
ccuccaguggaggagg

SEQ ID NO: 1545211 - RNA, 17 nt, Human adenovirus B [HAdV-B]
cgguucuuugcucuucc

SEQ ID NO: 1545212 - RNA, 22 nt, Human adenovirus B [HAdV-B]
cacugguuuuuauugcuuuuug

SEQ ID NO: 1545213 - RNA, 16 nt, Human adenovirus B [HAdV-B]
caaucaucauauuaca

SEQ ID NO: 1545214 - RNA, 15 nt, Human adenovirus B [HAdV-B]
cucuagcagcagugu

SEQ ID NO: 1545215 - RNA, 18 nt, Human adenovirus B [HAdV-B]
uugcaaggccccagcagc

SEQ ID NO: 1545216 - RNA, 21 nt, Human adenovirus B [HAdV-B]
cagccccccucgcagcagcag

SEQ ID NO: 1545217 - RNA, 21 nt, Human adenovirus B [HAdV-B]
caguagucaaguguuucuuga

SEQ ID NO: 1545218 - RNA, 16 nt, Human adenovirus B [HAdV-B]
caggcaaaacaaaaaa

SEQ ID NO: 1545219 - RNA, 18 nt, Human adenovirus B [HAdV-B]
ccacaucguaggucagga

SEQ ID NO: 1545220 - RNA, 13 nt, Human adenovirus B [HAdV-B]
uuuugcugugcca

SEQ ID NO: 1545221 - RNA, 15 nt, Human adenovirus B [HAdV-B]
cauuccuuaugcuua

SEQ ID NO: 1545222 - RNA, 15 nt, Human adenovirus B [HAdV-B]
ggaucacccucaagg

SEQ ID NO: 1545223 - RNA, 18 nt, Human adenovirus B [HAdV-B]
aagauuuuguaugaagau

SEQ ID NO: 1545224 - RNA, 16 nt, Human adenovirus B [HAdV-B]
gcaaacucgaagagaa

SEQ ID NO: 1545225 - RNA, 17 nt, Human adenovirus B [HAdV-B]
cagccgccgcccccaga

SEQ ID NO: 1545226 - RNA, 15 nt, Human adenovirus B [HAdV-B]
gggugggagaggaag

SEQ ID NO: 1545227 - RNA, 14 nt, Human adenovirus B [HAdV-B]
agagcgugaugcag

SEQ ID NO: 1545228 - RNA, 13 nt, Human adenovirus B [HAdV-B]
cucgaagcaaggg

SEQ ID NO: 1545229 - RNA, 14 nt, Human adenovirus B [HAdV-B]
aaauccgguucauu

SEQ ID NO: 1545230 - RNA, 14 nt, Human adenovirus B [HAdV-B]
gcaacauacaaaau

SEQ ID NO: 1545231 - RNA, 13 nt, Human adenovirus B [HAdV-B]
uucggaacuggca

SEQ ID NO: 1545232 - RNA, 19 nt, Human adenovirus B [HAdV-B]
cuucgcauaucccgcuguc

SEQ ID NO: 1545233 - RNA, 23 nt, Human adenovirus B [HAdV-B]
ugaggccugauaaacaguauaag

SEQ ID NO: 1545234 - RNA, 21 nt, Human adenovirus B [HAdV-B]
ccaugcuuagggcggccagac

SEQ ID NO: 1545235 - RNA, 19 nt, Human adenovirus B [HAdV-B]
ccgagucgaggaacccggc

SEQ ID NO: 1545236 - RNA, 21 nt, Human adenovirus B [HAdV-B]
cagcacugaaacaccaucagc

SEQ ID NO: 1545237 - RNA, 20 nt, Human adenovirus B [HAdV-B]
gccccuacuauagccagcaa

SEQ ID NO: 1545238 - RNA, 16 nt, Human adenovirus B [HAdV-B]
acuucagcgcacucuc

SEQ ID NO: 1545239 - RNA, 18 nt, Human adenovirus B [HAdV-B]
gcuugggcgcuugccagg

SEQ ID NO: 1545240 - RNA, 16 nt, Human adenovirus B [HAdV-B]
acaacugacgccgccg

SEQ ID NO: 1545241 - RNA, 20 nt, Human adenovirus B [HAdV-B]
ccaucuauuauuccuacucc

SEQ ID NO: 1545242 - RNA, 15 nt, Human adenovirus B [HAdV-B]
guugaaggugcagcc

SEQ ID NO: 1545243 - RNA, 20 nt, Human adenovirus B [HAdV-B]
uggacccuccaguggaggag

SEQ ID NO: 1545244 - RNA, 14 nt, Human adenovirus B [HAdV-B]
agagcuucuacaac

SEQ ID NO: 1545245 - RNA, 21 nt, Human adenovirus B [HAdV-B]
uacccucgguauaaaacaucc

SEQ ID NO: 1545246 - RNA, 17 nt, Human adenovirus B [HAdV-B]
gagcgccgcgacggcag

SEQ ID NO: 1545247 - RNA, 20 nt, Human adenovirus B [HAdV-B]
gaaucauguccaccuggggg

SEQ ID NO: 1545248 - RNA, 19 nt, Human adenovirus B [HAdV-B]
uccgagucgaggaacccgg

SEQ ID NO: 1545249 - RNA, 14 nt, Human adenovirus B [HAdV-B]
uccuaaaaaacaag

SEQ ID NO: 1545250 - RNA, 17 nt, Human adenovirus B [HAdV-B]
gggggcaauucuggccc

SEQ ID NO: 1545251 - RNA, 22 nt, Human adenovirus B [HAdV-B]
ucuuagacucaucuaaaaccau

SEQ ID NO: 1545252 - RNA, 18 nt, Human adenovirus B [HAdV-B]
accugaaguaaauggaac

SEQ ID NO: 1545253 - RNA, 23 nt, Human adenovirus B [HAdV-B]
agcaagcaccggaucccgcaaug

SEQ ID NO: 1545254 - RNA, 22 nt, Human adenovirus B [HAdV-B]
aaucucuuaagguucuguggac

SEQ ID NO: 1545255 - RNA, 15 nt, Human adenovirus B [HAdV-B]
gguacuuccgcucga

SEQ ID NO: 1545256 - RNA, 17 nt, Human adenovirus B [HAdV-B]
augucaccugcggagca

SEQ ID NO: 1545257 - RNA, 16 nt, Human adenovirus B [HAdV-B]
ugcaaggccccagcag

SEQ ID NO: 1545258 - RNA, 14 nt, Human adenovirus B [HAdV-B]
gucaggcuguucug

SEQ ID NO: 1545259 - RNA, 12 nt, Human adenovirus B [HAdV-B]
cacagagcugcc

SEQ ID NO: 1545260 - RNA, 18 nt, Human adenovirus B [HAdV-B]
ccgccaaacccaacacac

SEQ ID NO: 1545261 - RNA, 18 nt, Human adenovirus B [HAdV-B]
ccuggagcgacaucggca

SEQ ID NO: 1545262 - RNA, 16 nt, Human adenovirus B [HAdV-B]
ugcucacuugugcugg

SEQ ID NO: 1545263 - RNA, 15 nt, Human adenovirus B [HAdV-B]
auguaaauuuggaaa

SEQ ID NO: 1545264 - RNA, 10 nt, Human adenovirus B [HAdV-B]
ugaauuauuc

SEQ ID NO: 1545265 - RNA, 23 nt, Human adenovirus B [HAdV-B]
agccagguuaaauccgguucauu

SEQ ID NO: 1545266 - RNA, 14 nt, Human adenovirus B [HAdV-B]
cacaacgcacagcc

SEQ ID NO: 1545267 - RNA, 18 nt, Human adenovirus B [HAdV-B]
ggcgacggcggugaugca

SEQ ID NO: 1545268 - RNA, 19 nt, Human adenovirus B [HAdV-B]
gcuggacuacuugcacaga

SEQ ID NO: 1545269 - RNA, 16 nt, Human adenovirus B [HAdV-B]
gccaaggcgauggguc

SEQ ID NO: 1545270 - RNA, 14 nt, Human adenovirus B [HAdV-B]
aacccaaccagcgc

SEQ ID NO: 1545271 - RNA, 22 nt, Human adenovirus B [HAdV-B]
gcaaagauucgauccgaugaca

SEQ ID NO: 1545272 - RNA, 14 nt, Human adenovirus B [HAdV-B]
caucuucccagagc

SEQ ID NO: 1545273 - RNA, 19 nt, Human adenovirus B [HAdV-B]
aguagacaccuaugugaac

SEQ ID NO: 1545274 - RNA, 20 nt, Human adenovirus B [HAdV-B]
acaacugacgccgccggucc

SEQ ID NO: 1545275 - RNA, 17 nt, Human adenovirus B [HAdV-B]
uguuuccgucacaguga

SEQ ID NO: 1545276 - RNA, 16 nt, Human adenovirus B [HAdV-B]
ucgacgcaucucauga

SEQ ID NO: 1545277 - RNA, 22 nt, Human adenovirus B [HAdV-B]
agauguacgcgaagccgugucu

SEQ ID NO: 1545278 - RNA, 21 nt, Human adenovirus B [HAdV-B]
ccauguucaugagcaaacagu

SEQ ID NO: 1545279 - RNA, 20 nt, Human adenovirus B [HAdV-B]
auggaagacuuaugcucagg

SEQ ID NO: 1545280 - RNA, 12 nt, Human adenovirus B [HAdV-B]
ugcaaacugaac

SEQ ID NO: 1545281 - RNA, 20 nt, Human adenovirus B [HAdV-B]
gcuccaaauacaucucagug

SEQ ID NO: 1545282 - RNA, 17 nt, Human adenovirus B [HAdV-B]
ccaggacuacuccaccc

SEQ ID NO: 1545283 - RNA, 21 nt, Human adenovirus B [HAdV-B]
cgauucucacuugccacccuc

SEQ ID NO: 1545284 - RNA, 12 nt, Human adenovirus B [HAdV-B]
aaucaugugaaa

SEQ ID NO: 1545285 - RNA, 13 nt, Human adenovirus B [HAdV-B]
ggcagcagcuccu

SEQ ID NO: 1545286 - RNA, 13 nt, Human adenovirus B [HAdV-B]
aaguauggaggca

SEQ ID NO: 1545287 - RNA, 22 nt, Human adenovirus B [HAdV-B]
aguuucuaugcguguuggauug

SEQ ID NO: 1545288 - RNA, 19 nt, Human adenovirus B [HAdV-B]
cugugccagaaguacuggc

SEQ ID NO: 1545289 - RNA, 22 nt, Human adenovirus B [HAdV-B]
uucugaucaucgcacguggaaa

SEQ ID NO: 1545290 - RNA, 23 nt, Human adenovirus B [HAdV-B]
aacucuugcuugacucucugggc

SEQ ID NO: 1545291 - RNA, 13 nt, Human adenovirus B [HAdV-B]
gcgggucgugagc

SEQ ID NO: 1545292 - RNA, 16 nt, Human adenovirus B [HAdV-B]
acgggugcuuacugga

SEQ ID NO: 1545293 - RNA, 21 nt, Human adenovirus B [HAdV-B]
ccugucacuuuccgcuccacu

SEQ ID NO: 1545294 - RNA, 22 nt, Human adenovirus B [HAdV-B]
gcgcgguuagcgccagcaggag

SEQ ID NO: 1545295 - RNA, 14 nt, Human adenovirus B [HAdV-B]
caacucugacuucu

SEQ ID NO: 1545296 - RNA, 20 nt, Human adenovirus B [HAdV-B]
gaaagguuccagcgugaugc

SEQ ID NO: 1545297 - RNA, 20 nt, Human adenovirus B [HAdV-B]
cagaugcaucccgugcugcg

SEQ ID NO: 1545298 - RNA, 22 nt, Human adenovirus B [HAdV-B]
auugaugacaauauuaacaccu

SEQ ID NO: 1545299 - RNA, 14 nt, Human adenovirus B [HAdV-B]
acaccuaugugaac

SEQ ID NO: 1545300 - RNA, 14 nt, Human adenovirus B [HAdV-B]
cauuuccauuccuu

SEQ ID NO: 1545301 - RNA, 21 nt, Human adenovirus B [HAdV-B]
aguugaaaaccacgaaaaugc

SEQ ID NO: 1545302 - RNA, 15 nt, Human adenovirus B [HAdV-B]
uccgguauccugccc

SEQ ID NO: 1545303 - RNA, 22 nt, Human adenovirus B [HAdV-B]
cucccgacggugcugcaguugg

SEQ ID NO: 1545304 - RNA, 18 nt, Human adenovirus B [HAdV-B]
ugcucuaccccauuccug

SEQ ID NO: 1545305 - RNA, 17 nt, Human adenovirus B [HAdV-B]
gugaacgcguuggugga

SEQ ID NO: 1545306 - RNA, 15 nt, Human adenovirus B [HAdV-B]
uaaucauaaaucagg

SEQ ID NO: 1545307 - RNA, 21 nt, Human adenovirus B [HAdV-B]
gugaugaggguaaaccagugg

SEQ ID NO: 1545308 - RNA, 17 nt, Human adenovirus B [HAdV-B]
acgcauccgccagcagc

SEQ ID NO: 1545309 - RNA, 16 nt, Human adenovirus B [HAdV-B]
uacuuagauuugauau

SEQ ID NO: 1545310 - RNA, 12 nt, Human adenovirus B [HAdV-B]
gauugcuggaau

SEQ ID NO: 1545311 - RNA, 12 nt, Human adenovirus B [HAdV-B]
agagcucagccg

SEQ ID NO: 1545312 - RNA, 20 nt, Human adenovirus B [HAdV-B]
cccgaagccuuuagacagca

SEQ ID NO: 1545313 - RNA, 18 nt, Human adenovirus B [HAdV-B]
aaaauguugaaaugggca

SEQ ID NO: 1545314 - RNA, 18 nt, Human adenovirus B [HAdV-B]
ucuggcacgauucucacu

SEQ ID NO: 1545315 - RNA, 14 nt, Human adenovirus B [HAdV-B]
guccaaaugcgcac

SEQ ID NO: 1545316 - RNA, 19 nt, Human adenovirus B [HAdV-B]
gccuggacccuccagugga

SEQ ID NO: 1545317 - RNA, 21 nt, Human adenovirus B [HAdV-B]
ccugcagaaaucuucccauca

SEQ ID NO: 1545318 - RNA, 19 nt, Human adenovirus B [HAdV-B]
ccagcgccaugacagacag

SEQ ID NO: 1545319 - RNA, 15 nt, Human adenovirus B [HAdV-B]
cuaaugauugcaaau

SEQ ID NO: 1545320 - RNA, 16 nt, Human adenovirus B [HAdV-B]
caugcaugacccagau

SEQ ID NO: 1545321 - RNA, 19 nt, Human adenovirus B [HAdV-B]
uuaaauccacacugguggc

SEQ ID NO: 1545322 - RNA, 13 nt, Human adenovirus B [HAdV-B]
gcagcacugaaac

SEQ ID NO: 1545323 - RNA, 14 nt, Human adenovirus B [HAdV-B]
aaaucaacacagcc

SEQ ID NO: 1545324 - RNA, 19 nt, Human adenovirus B [HAdV-B]
gaauaauuaauauaaucug

SEQ ID NO: 1545325 - RNA, 17 nt, Human adenovirus B [HAdV-B]
gccagcacccagaccau

SEQ ID NO: 1545326 - RNA, 17 nt, Human adenovirus B [HAdV-B]
gcaguaacuuuuguaaa

SEQ ID NO: 1545327 - RNA, 23 nt, Human adenovirus B [HAdV-B]
auagugcaggagcggagccuggg

SEQ ID NO: 1545328 - RNA, 23 nt, Human adenovirus B [HAdV-B]
cacagccccuacuauagccagca

SEQ ID NO: 1545329 - RNA, 20 nt, Human adenovirus B [HAdV-B]
agacaauuuugcgccaacac

SEQ ID NO: 1545330 - RNA, 22 nt, Human adenovirus B [HAdV-B]
ugcagccgccgcccccagaaga

SEQ ID NO: 1545331 - RNA, 14 nt, Human adenovirus B [HAdV-B]
caguguggaagagc

SEQ ID NO: 1545332 - RNA, 13 nt, Human adenovirus B [HAdV-B]
ugaaagaaaacau

SEQ ID NO: 1545333 - RNA, 21 nt, Human adenovirus B [HAdV-B]
uauucuucgcgauccuuccag

SEQ ID NO: 1545334 - RNA, 14 nt, Human adenovirus B [HAdV-B]
caauaaacaucacu

SEQ ID NO: 1545335 - RNA, 14 nt, Human adenovirus B [HAdV-B]
ucucaaccccagcu

SEQ ID NO: 1545336 - RNA, 16 nt, Human adenovirus B [HAdV-B]
gugggauuguuucuga

SEQ ID NO: 1545337 - RNA, 14 nt, Human adenovirus B [HAdV-B]
guaccaugcaugca

SEQ ID NO: 1545338 - RNA, 19 nt, Human adenovirus B [HAdV-B]
gcggccuaagagaccugcu

SEQ ID NO: 1545339 - RNA, 19 nt, Human adenovirus B [HAdV-B]
gccagcgcaaacccgagag

SEQ ID NO: 1545340 - RNA, 17 nt, Human adenovirus B [HAdV-B]
ggcggagcgguggugua

SEQ ID NO: 1545341 - RNA, 23 nt, Human adenovirus B [HAdV-B]
cagccaaggcgaugggucuucuc

SEQ ID NO: 1545342 - RNA, 18 nt, Human adenovirus B [HAdV-B]
aaaacggauucuggggag

SEQ ID NO: 1545343 - RNA, 13 nt, Human adenovirus B [HAdV-B]
gaggaauguuuau

SEQ ID NO: 1545344 - RNA, 13 nt, Human adenovirus B [HAdV-B]
auggagucacugc

SEQ ID NO: 1545345 - RNA, 22 nt, Human adenovirus B [HAdV-B]
acaugaacaugcaaaucuggaa

SEQ ID NO: 1545346 - RNA, 23 nt, Human adenovirus B [HAdV-B]
agauuuguaucccacuaugcaac

SEQ ID NO: 1545347 - RNA, 12 nt, Human adenovirus B [HAdV-B]
gcgccagcagga

SEQ ID NO: 1545348 - RNA, 16 nt, Human adenovirus B [HAdV-B]
aacuuuuacaucuccc

SEQ ID NO: 1545349 - RNA, 16 nt, Human adenovirus B [HAdV-B]
uuuucucccagcagca

SEQ ID NO: 1545350 - RNA, 14 nt, Human adenovirus B [HAdV-B]
uggguauaauuaug

SEQ ID NO: 1545351 - RNA, 15 nt, Human adenovirus B [HAdV-B]
caccccgaaacugcg

SEQ ID NO: 1545352 - RNA, 15 nt, Human adenovirus B [HAdV-B]
acgaggaaaaggagc

SEQ ID NO: 1545353 - RNA, 18 nt, Human adenovirus B [HAdV-B]
augaggaccaaucacagc

SEQ ID NO: 1545354 - RNA, 14 nt, Human adenovirus B [HAdV-B]
cucuuucuucuucg

SEQ ID NO: 1545355 - RNA, 16 nt, Human adenovirus B [HAdV-B]
acuggaacaggugaaa

SEQ ID NO: 1545356 - RNA, 16 nt, Human adenovirus B [HAdV-B]
cgggucgugagcugcg

SEQ ID NO: 1545357 - RNA, 13 nt, Human adenovirus B [HAdV-B]
guguuggacagag

SEQ ID NO: 1545358 - RNA, 18 nt, Human adenovirus B [HAdV-B]
ccauuagauauagacaug

SEQ ID NO: 1545359 - RNA, 15 nt, Human adenovirus B [HAdV-B]
gcaugaauuggcuca

SEQ ID NO: 1545360 - RNA, 17 nt, Human adenovirus B [HAdV-B]
acccaguugaaaaccac

SEQ ID NO: 1545361 - RNA, 20 nt, Human adenovirus B [HAdV-B]
ggaggacagucuggaggaca

SEQ ID NO: 1545362 - RNA, 22 nt, Human adenovirus B [HAdV-B]
cuggaacagaagacacaaguuc

SEQ ID NO: 1545363 - RNA, 16 nt, Human adenovirus B [HAdV-B]
ugaauuaagacucucc

SEQ ID NO: 1545364 - RNA, 21 nt, Human adenovirus B [HAdV-B]
auaaacaagcuuguuguugau

SEQ ID NO: 1545365 - RNA, 13 nt, Human adenovirus B [HAdV-B]
uugggccauuuug

SEQ ID NO: 1545366 - RNA, 22 nt, Human adenovirus B [HAdV-B]
agauaauuacuugaaagugggu

SEQ ID NO: 1545367 - RNA, 15 nt, Human adenovirus B [HAdV-B]
ugccaugcgagccgc

SEQ ID NO: 1545368 - RNA, 17 nt, Human adenovirus B [HAdV-B]
ccgucuuugucugcacg

SEQ ID NO: 1545369 - RNA, 14 nt, Human adenovirus B [HAdV-B]
caguuucacauucc

SEQ ID NO: 1545370 - RNA, 23 nt, Human adenovirus B [HAdV-B]
gaaguaggcugauugccacagau

SEQ ID NO: 1545371 - RNA, 23 nt, Human adenovirus B [HAdV-B]
cucgguauaaaacaucccgcagg

SEQ ID NO: 1545372 - RNA, 18 nt, Human adenovirus B [HAdV-B]
caguguccugaagcauga

SEQ ID NO: 1545373 - RNA, 16 nt, Human adenovirus B [HAdV-B]
uggcaugggaugggug

SEQ ID NO: 1545374 - RNA, 20 nt, Human adenovirus B [HAdV-B]
aucuaaggccauuugccauu

SEQ ID NO: 1545375 - RNA, 14 nt, Human adenovirus B [HAdV-B]
cagacaugaugaag

SEQ ID NO: 1545376 - RNA, 12 nt, Human adenovirus B [HAdV-B]
aacacgaggaag

SEQ ID NO: 1545377 - RNA, 19 nt, Human adenovirus B [HAdV-B]
cgagcuaccacugccaugc

SEQ ID NO: 1545378 - RNA, 18 nt, Human adenovirus B [HAdV-B]
ggucagugaugagcagcu

SEQ ID NO: 1545379 - RNA, 21 nt, Human adenovirus B [HAdV-B]
ccaaaauaucgcggcacuucu

SEQ ID NO: 1545380 - RNA, 15 nt, Human adenovirus B [HAdV-B]
ucugauuccuggaua

SEQ ID NO: 1545381 - RNA, 14 nt, Human adenovirus B [HAdV-B]
cgcgaagaggcaau

SEQ ID NO: 1545382 - RNA, 15 nt, Human adenovirus B [HAdV-B]
uaaacgcgaagguga

SEQ ID NO: 1545383 - RNA, 21 nt, Human adenovirus B [HAdV-B]
agcucagagaugucauccaaa

SEQ ID NO: 1545384 - RNA, 22 nt, Human adenovirus B [HAdV-B]
gcaacucugacuucugcucgcu

SEQ ID NO: 1545385 - RNA, 21 nt, Human adenovirus B [HAdV-B]
gauauugacagugccgguuga

SEQ ID NO: 1545386 - RNA, 18 nt, Human adenovirus B [HAdV-B]
accugcugcgcacugccc

SEQ ID NO: 1545387 - RNA, 19 nt, Human adenovirus B [HAdV-B]
cuuccgaccuggcagaccu

SEQ ID NO: 1545388 - RNA, 19 nt, Human adenovirus B [HAdV-B]
auaauauugccaugcaggc

SEQ ID NO: 1545389 - RNA, 14 nt, Human adenovirus B [HAdV-B]
uggaacagaagaca

SEQ ID NO: 1545390 - RNA, 15 nt, Human adenovirus B [HAdV-B]
gacagaauggagugc

SEQ ID NO: 1545391 - RNA, 17 nt, Human adenovirus B [HAdV-B]
cuuacgagcagacagua

SEQ ID NO: 1545392 - RNA, 14 nt, Human adenovirus B [HAdV-B]
gcuacagcugcugc

SEQ ID NO: 1545393 - RNA, 15 nt, Human adenovirus B [HAdV-B]
gggguguguuggaca

SEQ ID NO: 1545394 - RNA, 18 nt, Human adenovirus B [HAdV-B]
cuguucugacuuuggaaa

SEQ ID NO: 1545395 - RNA, 13 nt, Human adenovirus B [HAdV-B]
cccuacgcugucu

SEQ ID NO: 1545396 - RNA, 18 nt, Human adenovirus B [HAdV-B]
cugcgcacugcccuccga

SEQ ID NO: 1545397 - RNA, 16 nt, Human adenovirus B [HAdV-B]
augugacaccggugga

SEQ ID NO: 1545398 - RNA, 16 nt, Human adenovirus B [HAdV-B]
ccagacaaaguacagc

SEQ ID NO: 1545399 - RNA, 19 nt, Human adenovirus B [HAdV-B]
cguguacaaggcacugggc

SEQ ID NO: 1545400 - RNA, 11 nt, Human adenovirus B [HAdV-B]
caaaacaaaaa

SEQ ID NO: 1545401 - RNA, 21 nt, Human adenovirus B [HAdV-B]
ugcgauuuucaaggugcucaa

SEQ ID NO: 1545402 - RNA, 24 nt, Human adenovirus B [HAdV-B]
gcgacucgacuccguagccuggag

SEQ ID NO: 1545403 - RNA, 18 nt, Human adenovirus B [HAdV-B]
caaaguacagcgggcaca

SEQ ID NO: 1545404 - RNA, 14 nt, Human adenovirus B [HAdV-B]
gcagacacaucacu

SEQ ID NO: 1545405 - RNA, 13 nt, Human adenovirus B [HAdV-B]
cagcacugaaaca

SEQ ID NO: 1545406 - RNA, 17 nt, Human adenovirus B [HAdV-B]
uggguagacagaaugga

SEQ ID NO: 1545407 - RNA, 16 nt, Human adenovirus B [HAdV-B]
uaugaagaugaaagca

SEQ ID NO: 1545408 - RNA, 18 nt, Human adenovirus B [HAdV-B]
aucccgcugucaaccugc

SEQ ID NO: 1545409 - RNA, 22 nt, Human adenovirus B [HAdV-B]
cugguuagcugcacagccggca

SEQ ID NO: 1545410 - RNA, 19 nt, Human adenovirus B [HAdV-B]
ugcagacgguaaaucugag

SEQ ID NO: 1545411 - RNA, 12 nt, Human adenovirus B [HAdV-B]
aaacucgcgccg

SEQ ID NO: 1545412 - RNA, 17 nt, Human adenovirus B [HAdV-B]
cugggaugcaaaugcaa

SEQ ID NO: 1545413 - RNA, 12 nt, Human adenovirus B [HAdV-B]
caucuacugugg

SEQ ID NO: 1545414 - RNA, 12 nt, Human adenovirus B [HAdV-B]
aaacccacugcu

SEQ ID NO: 1545415 - RNA, 20 nt, Human adenovirus B [HAdV-B]
gcaugaauuggcucagcgcc

SEQ ID NO: 1545416 - RNA, 14 nt, Human adenovirus B [HAdV-B]
gacaaagcgugcug

SEQ ID NO: 1545417 - RNA, 13 nt, Human adenovirus B [HAdV-B]
cggaucuccuggg

SEQ ID NO: 1545418 - RNA, 19 nt, Human adenovirus B [HAdV-B]
caucuagugguacugaugc

SEQ ID NO: 1545419 - RNA, 20 nt, Human adenovirus B [HAdV-B]
ucacaucucguccucagcga

SEQ ID NO: 1545420 - RNA, 13 nt, Human adenovirus B [HAdV-B]
auuacaacugacg

SEQ ID NO: 1545421 - RNA, 19 nt, Human adenovirus B [HAdV-B]
auguaguuucuaugcgugu

SEQ ID NO: 1545422 - RNA, 20 nt, Human adenovirus B [HAdV-B]
auauucacuggaacagguga

SEQ ID NO: 1545423 - RNA, 14 nt, Human adenovirus B [HAdV-B]
cgcuaccaucuccg

SEQ ID NO: 1545424 - RNA, 18 nt, Human adenovirus B [HAdV-B]
uacacaacaagugcagca

SEQ ID NO: 1545425 - RNA, 20 nt, Human adenovirus B [HAdV-B]
uguagaugccuaugagaaca

SEQ ID NO: 1545426 - RNA, 13 nt, Human adenovirus B [HAdV-B]
cugggcauucuga

SEQ ID NO: 1545427 - RNA, 22 nt, Human adenovirus B [HAdV-B]
ucgcccccggucccucuaaaua

SEQ ID NO: 1545428 - RNA, 18 nt, Human adenovirus B [HAdV-B]
augacagaaugcaucgcg

SEQ ID NO: 1545429 - RNA, 14 nt, Human adenovirus B [HAdV-B]
guguauggcagcaa

SEQ ID NO: 1545430 - RNA, 15 nt, Human adenovirus B [HAdV-B]
cgcaagagcucugcu

SEQ ID NO: 1545431 - RNA, 18 nt, Human adenovirus B [HAdV-B]
guuaaaaaccugcugcuu

SEQ ID NO: 1545432 - RNA, 14 nt, Human adenovirus B [HAdV-B]
cucccccugcugcu

SEQ ID NO: 1545433 - RNA, 19 nt, Human adenovirus B [HAdV-B]
aguccugccagggcacacg

SEQ ID NO: 1545434 - RNA, 20 nt, Human adenovirus B [HAdV-B]
caauggaugguuuacaaaac

SEQ ID NO: 1545435 - RNA, 14 nt, Human adenovirus B [HAdV-B]
cacagcagagacaa

SEQ ID NO: 1545436 - RNA, 21 nt, Human adenovirus B [HAdV-B]
ugcagccgccgcccccagaag

SEQ ID NO: 1545437 - RNA, 13 nt, Human adenovirus B [HAdV-B]
uccccuacaaaac

SEQ ID NO: 1545438 - RNA, 18 nt, Human adenovirus B [HAdV-B]
cacaacaagugcagcaac

SEQ ID NO: 1545439 - RNA, 20 nt, Human adenovirus B [HAdV-B]
ucauaggagcuggcuuucau

SEQ ID NO: 1545440 - RNA, 15 nt, Human adenovirus B [HAdV-B]
cuggcagaacacacu

SEQ ID NO: 1545441 - RNA, 23 nt, Human adenovirus B [HAdV-B]
ugccaccuccacugaagugcaaa

SEQ ID NO: 1545442 - RNA, 19 nt, Human adenovirus B [HAdV-B]
guuuaugccuuaccagugu

SEQ ID NO: 1545443 - RNA, 18 nt, Human adenovirus B [HAdV-B]
cuuucagagaggcgcugc

SEQ ID NO: 1545444 - RNA, 19 nt, Human adenovirus B [HAdV-B]
ugagaagguccuggccauc

SEQ ID NO: 1545445 - RNA, 22 nt, Human adenovirus B [HAdV-B]
cgaagccguacaugggcaccug

SEQ ID NO: 1545446 - RNA, 15 nt, Human adenovirus B [HAdV-B]
gugaaaguguuguug

SEQ ID NO: 1545447 - RNA, 15 nt, Human adenovirus B [HAdV-B]
cccgggacuguggac

SEQ ID NO: 1545448 - RNA, 22 nt, Human adenovirus B [HAdV-B]
cgagagcgugaugcagcagcag

SEQ ID NO: 1545449 - RNA, 20 nt, Human adenovirus B [HAdV-B]
uguuugccaaaggaucccau

SEQ ID NO: 1545450 - RNA, 19 nt, Human adenovirus B [HAdV-B]
gcuugggcgcuugccaggg

SEQ ID NO: 1545451 - RNA, 12 nt, Human adenovirus B [HAdV-B]
cagccaacgagc

SEQ ID NO: 1545452 - RNA, 18 nt, Human adenovirus B [HAdV-B]
cuaacgaauuugaaauaa

SEQ ID NO: 1545453 - RNA, 16 nt, Human adenovirus B [HAdV-B]
agaagauacugagcag

SEQ ID NO: 1545454 - RNA, 17 nt, Human adenovirus B [HAdV-B]
ggcacacguggcugcag

SEQ ID NO: 1545455 - RNA, 13 nt, Human adenovirus B [HAdV-B]
aaugacaaaauau

SEQ ID NO: 1545456 - RNA, 15 nt, Human adenovirus B [HAdV-B]
cggccagacgugcag

SEQ ID NO: 1545457 - RNA, 14 nt, Human adenovirus B [HAdV-B]
ggcaguuuggaagc

SEQ ID NO: 1545458 - RNA, 19 nt, Human adenovirus B [HAdV-B]
gagggcgaaggacuggcac

SEQ ID NO: 1545459 - RNA, 21 nt, Human adenovirus B [HAdV-B]
gggacaacaaucuaugcccaa

SEQ ID NO: 1545460 - RNA, 14 nt, Human adenovirus B [HAdV-B]
gcggcucauguugc

SEQ ID NO: 1545461 - RNA, 15 nt, Human adenovirus B [HAdV-B]
ucgcucaccagaagu

SEQ ID NO: 1545462 - RNA, 20 nt, Human adenovirus B [HAdV-B]
cagccauggcuuaccagaca

SEQ ID NO: 1545463 - RNA, 21 nt, Human adenovirus B [HAdV-B]
auuacuaaugcuaaagguuuc

SEQ ID NO: 1545464 - RNA, 14 nt, Human adenovirus B [HAdV-B]
acgcacagccugua

SEQ ID NO: 1545465 - RNA, 22 nt, Human adenovirus B [HAdV-B]
aacccggcggcgucccagcagu

SEQ ID NO: 1545466 - RNA, 15 nt, Human adenovirus B [HAdV-B]
uugauuugaugaaca

SEQ ID NO: 1545467 - RNA, 14 nt, Human adenovirus B [HAdV-B]
cuuuccagccuuga

SEQ ID NO: 1545468 - RNA, 13 nt, Human adenovirus B [HAdV-B]
auacuuuuggaac

SEQ ID NO: 1545469 - RNA, 16 nt, Human adenovirus B [HAdV-B]
agucuguugaugccca

SEQ ID NO: 1545470 - RNA, 17 nt, Human adenovirus B [HAdV-B]
gaacagaacuugaaaga

SEQ ID NO: 1545471 - RNA, 14 nt, Human adenovirus B [HAdV-B]
aguuccaaauggag

SEQ ID NO: 1545472 - RNA, 16 nt, Human adenovirus B [HAdV-B]
accucuuucuguuuac

SEQ ID NO: 1545473 - RNA, 21 nt, Human adenovirus B [HAdV-B]
caguggucagugaugagcagc

SEQ ID NO: 1545474 - RNA, 21 nt, Human adenovirus B [HAdV-B]
gcaaucaugcccacauccaga

SEQ ID NO: 1545475 - RNA, 15 nt, Human adenovirus B [HAdV-B]
agauuuuucugcaac

SEQ ID NO: 1545476 - RNA, 21 nt, Human adenovirus B [HAdV-B]
uugcaugguuguagcuuuuuu

SEQ ID NO: 1545477 - RNA, 16 nt, Human adenovirus B [HAdV-B]
uacugagcucaucaaa

SEQ ID NO: 1545478 - RNA, 12 nt, Human adenovirus B [HAdV-B]
uguuaacuguuc

SEQ ID NO: 1545479 - RNA, 13 nt, Human adenovirus B [HAdV-B]
gccccgccaacac

SEQ ID NO: 1545480 - RNA, 19 nt, Human adenovirus B [HAdV-B]
cauaaucauugcagccaug

SEQ ID NO: 1545481 - RNA, 15 nt, Human adenovirus B [HAdV-B]
ggagcugacuugcag

SEQ ID NO: 1545482 - RNA, 19 nt, Human adenovirus B [HAdV-B]
cauuuggucagaaaacaca

SEQ ID NO: 1545483 - RNA, 17 nt, Human adenovirus B [HAdV-B]
gacucucgccugcaacg

SEQ ID NO: 1545484 - RNA, 16 nt, Human adenovirus B [HAdV-B]
uauggagucacugcua

SEQ ID NO: 1545485 - RNA, 15 nt, Human adenovirus B [HAdV-B]
gauuuuggcuggaau

SEQ ID NO: 1545486 - RNA, 15 nt, Human adenovirus B [HAdV-B]
caacauauccuucac

SEQ ID NO: 1545487 - RNA, 18 nt, Human adenovirus B [HAdV-B]
cauugguccaacagagcc

SEQ ID NO: 1545488 - RNA, 19 nt, Human adenovirus B [HAdV-B]
uucuaacuccucaaucauc

SEQ ID NO: 1545489 - RNA, 20 nt, Human adenovirus B [HAdV-B]
ccuagucgcagggcucugag

SEQ ID NO: 1545490 - RNA, 16 nt, Human adenovirus B [HAdV-B]
uaucaacgugacagca

SEQ ID NO: 1545491 - RNA, 16 nt, Human adenovirus B [HAdV-B]
cgagcaagacccgggc

SEQ ID NO: 1545492 - RNA, 22 nt, Human adenovirus B [HAdV-B]
ccggcgaaggcgcauugccaga

SEQ ID NO: 1545493 - RNA, 13 nt, Human adenovirus B [HAdV-B]
acagugcaggcag

SEQ ID NO: 1545494 - RNA, 18 nt, Human adenovirus B [HAdV-B]
cuacacaguguacguagc

SEQ ID NO: 1545495 - RNA, 17 nt, Human adenovirus B [HAdV-B]
ggagcagccaaaucaga

SEQ ID NO: 1545496 - RNA, 14 nt, Human adenovirus B [HAdV-B]
ccucaaaaacacac

SEQ ID NO: 1545497 - RNA, 23 nt, Human adenovirus B [HAdV-B]
acuagugaaaguuaacuggaugc

SEQ ID NO: 1545498 - RNA, 17 nt, Human adenovirus B [HAdV-B]
agacgacugacaaauaa

SEQ ID NO: 1545499 - RNA, 21 nt, Human adenovirus B [HAdV-B]
cucaggaucacagagacgagc

SEQ ID NO: 1545500 - RNA, 17 nt, Human adenovirus B [HAdV-B]
gcacgucuucaaccgcu

SEQ ID NO: 1545501 - RNA, 17 nt, Human adenovirus B [HAdV-B]
cgcguggggcgaagagc

SEQ ID NO: 1545502 - RNA, 15 nt, Human adenovirus B [HAdV-B]
cuggauuuccugcca

SEQ ID NO: 1545503 - RNA, 12 nt, Human adenovirus B [HAdV-B]
acugcuggacua

SEQ ID NO: 1545504 - RNA, 21 nt, Human adenovirus B [HAdV-B]
cugcucucacagaucacggga

SEQ ID NO: 1545505 - RNA, 18 nt, Human adenovirus B [HAdV-B]
cuuuuaaaacgcacugug

SEQ ID NO: 1545506 - RNA, 17 nt, Human adenovirus B [HAdV-B]
ugggucugacacaucau

SEQ ID NO: 1545507 - RNA, 22 nt, Human adenovirus B [HAdV-B]
gugaaaacauguugguuggagc

SEQ ID NO: 1545508 - RNA, 19 nt, Human adenovirus B [HAdV-B]
ucgcgcgguuagcgccagc

SEQ ID NO: 1545509 - RNA, 14 nt, Human adenovirus B [HAdV-B]
ccuaccaacacaac

SEQ ID NO: 1545510 - RNA, 18 nt, Human adenovirus B [HAdV-B]
caccggauugcagcacug

SEQ ID NO: 1545511 - RNA, 17 nt, Human adenovirus B [HAdV-B]
ccacagggucuccagcu

SEQ ID NO: 1545512 - RNA, 20 nt, Human adenovirus B [HAdV-B]
agaugccuggggacagguua

SEQ ID NO: 1545513 - RNA, 16 nt, Human adenovirus B [HAdV-B]
ggcaccgacucuccca

SEQ ID NO: 1545514 - RNA, 21 nt, Human adenovirus B [HAdV-B]
cuuucagaagacaugcaugac

SEQ ID NO: 1545515 - RNA, 19 nt, Human adenovirus B [HAdV-B]
acuggaucuacguccacug

SEQ ID NO: 1545516 - RNA, 13 nt, Human adenovirus B [HAdV-B]
ucaauucacaaaa

SEQ ID NO: 1545517 - RNA, 20 nt, Human adenovirus B [HAdV-B]
agcugaaauuacaaaagaag

SEQ ID NO: 1545518 - RNA, 22 nt, Human adenovirus B [HAdV-B]
gugucuaucuguaccugugcca

SEQ ID NO: 1545519 - RNA, 21 nt, Human adenovirus B [HAdV-B]
gcuaggcggagcgguggugua

SEQ ID NO: 1545520 - RNA, 14 nt, Human adenovirus B [HAdV-B]
uucucgagcugcca

SEQ ID NO: 1545521 - RNA, 19 nt, Human adenovirus B [HAdV-B]
gacaggguucgacgagcgc

SEQ ID NO: 1545522 - RNA, 23 nt, Human adenovirus B [HAdV-B]
gccuggacccuccaguggaggag

SEQ ID NO: 1545523 - RNA, 18 nt, Human adenovirus B [HAdV-B]
gcuuaacugauuuccuuc

SEQ ID NO: 1545524 - RNA, 20 nt, Human adenovirus B [HAdV-B]
augggucuucuccugggcaa

SEQ ID NO: 1545525 - RNA, 21 nt, Human adenovirus B [HAdV-B]
ggauucuuaacagugcaggca

SEQ ID NO: 1545526 - RNA, 15 nt, Human adenovirus B [HAdV-B]
cuuccuaugcacuuu

SEQ ID NO: 1545527 - RNA, 13 nt, Human adenovirus B [HAdV-B]
gacaaaguacagc

SEQ ID NO: 1545528 - RNA, 13 nt, Human adenovirus B [HAdV-B]
ucuacauuccaga

SEQ ID NO: 1545529 - RNA, 22 nt, Human adenovirus B [HAdV-B]
gccuaggacaaagcgugcugca

SEQ ID NO: 1545530 - RNA, 13 nt, Human adenovirus B [HAdV-B]
gagaggaugaaaa

SEQ ID NO: 1545531 - RNA, 16 nt, Human adenovirus B [HAdV-B]
auggcuuaccagacaa

SEQ ID NO: 1545532 - RNA, 15 nt, Human adenovirus B [HAdV-B]
agccccaauggccac

SEQ ID NO: 1545533 - RNA, 15 nt, Human adenovirus B [HAdV-B]
guacggggaugauga

SEQ ID NO: 1545534 - RNA, 21 nt, Human adenovirus B [HAdV-B]
guuaaguucgacaccaggaac

SEQ ID NO: 1545535 - RNA, 16 nt, Human adenovirus B [HAdV-B]
agcugcuacagcugcu

SEQ ID NO: 1545536 - RNA, 14 nt, Human adenovirus B [HAdV-B]
cuauuuagagacag

SEQ ID NO: 1545537 - RNA, 13 nt, Human adenovirus B [HAdV-B]
aucaccugggcag

SEQ ID NO: 1545538 - RNA, 22 nt, Human adenovirus B [HAdV-B]
agaggcaauguauacugggugc

SEQ ID NO: 1545539 - RNA, 14 nt, Human adenovirus B [HAdV-B]
caccugcggagcag

SEQ ID NO: 1545540 - RNA, 17 nt, Human adenovirus B [HAdV-B]
gcgcaguagucaagugu

SEQ ID NO: 1545541 - RNA, 13 nt, Human adenovirus B [HAdV-B]
acugacgccagac

SEQ ID NO: 1545542 - RNA, 15 nt, Human adenovirus B [HAdV-B]
ugaaacccacugcua

SEQ ID NO: 1545543 - RNA, 15 nt, Human adenovirus B [HAdV-B]
gaucacaaugugaug

SEQ ID NO: 1545544 - RNA, 15 nt, Human adenovirus B [HAdV-B]
cuacggaagccagca

SEQ ID NO: 1545545 - RNA, 23 nt, Human adenovirus B [HAdV-B]
gaugucccaacgacgagaaaaca

SEQ ID NO: 1545546 - RNA, 16 nt, Human adenovirus B [HAdV-B]
agggauuuggaagagc

SEQ ID NO: 1545547 - RNA, 20 nt, Human adenovirus B [HAdV-B]
aauuuuucauccuuggcucc

SEQ ID NO: 1545548 - RNA, 21 nt, Human adenovirus B [HAdV-B]
gucggcggacauugcuucucu

SEQ ID NO: 1545549 - RNA, 18 nt, Human adenovirus B [HAdV-B]
acaucuagaccacugccg

SEQ ID NO: 1545550 - RNA, 14 nt, Human adenovirus B [HAdV-B]
auuccuugcucaga

SEQ ID NO: 1545551 - RNA, 18 nt, Human adenovirus B [HAdV-B]
ucuucccagagcgucuca

SEQ ID NO: 1545552 - RNA, 11 nt, Human adenovirus B [HAdV-B]
gcuagcagccc

SEQ ID NO: 1545553 - RNA, 16 nt, Human adenovirus B [HAdV-B]
gcccucaagggccgca

SEQ ID NO: 1545554 - RNA, 15 nt, Human adenovirus B [HAdV-B]
caugaaucaugugaa

SEQ ID NO: 1545555 - RNA, 17 nt, Human adenovirus B [HAdV-B]
ccaauauuuuugcuucu

SEQ ID NO: 1545556 - RNA, 17 nt, Human adenovirus B [HAdV-B]
cauaggagcuggcuuuc

SEQ ID NO: 1545557 - RNA, 11 nt, Human adenovirus B [HAdV-B]
ggcagaggugg

SEQ ID NO: 1545558 - RNA, 18 nt, Human adenovirus B [HAdV-B]
aucaaaaaauuccagucu

SEQ ID NO: 1545559 - RNA, 23 nt, Human adenovirus B [HAdV-B]
gaagagcguaacuuccaaaaguc

SEQ ID NO: 1545560 - RNA, 15 nt, Human adenovirus B [HAdV-B]
cagaaugacccgcag

SEQ ID NO: 1545561 - RNA, 12 nt, Human adenovirus B [HAdV-B]
gcaggagcggag

SEQ ID NO: 1545562 - RNA, 15 nt, Human adenovirus B [HAdV-B]
cagagaggcgcugcu

SEQ ID NO: 1545563 - RNA, 16 nt, Human adenovirus B [HAdV-B]
cauagauaauuacuug

SEQ ID NO: 1545564 - RNA, 13 nt, Human adenovirus B [HAdV-B]
agugaugagcagc

SEQ ID NO: 1545565 - RNA, 17 nt, Human adenovirus B [HAdV-B]
cgcgaguuaagcgacag

SEQ ID NO: 1545566 - RNA, 19 nt, Human adenovirus B [HAdV-B]
auuuggcuaaccaggcugu

SEQ ID NO: 1545567 - RNA, 18 nt, Human adenovirus B [HAdV-B]
ccuuguaagggcagcagc

SEQ ID NO: 1545568 - RNA, 11 nt, Human adenovirus B [HAdV-B]
cgcuuucacag

SEQ ID NO: 1545569 - RNA, 22 nt, Human adenovirus B [HAdV-B]
ucuugaccacgguggugcaaaa

SEQ ID NO: 1545570 - RNA, 12 nt, Human adenovirus B [HAdV-B]
ccugggccuggc

SEQ ID NO: 1545571 - RNA, 15 nt, Human adenovirus B [HAdV-B]
cauugucuuacugcc

SEQ ID NO: 1545572 - RNA, 21 nt, Human adenovirus B [HAdV-B]
caagccacagggucuccagcu

SEQ ID NO: 1545573 - RNA, 14 nt, Human adenovirus B [HAdV-B]
ucuuccagaaaaca

SEQ ID NO: 1545574 - RNA, 22 nt, Human adenovirus B [HAdV-B]
ucuuuugccauccuucucaacg

SEQ ID NO: 1545575 - RNA, 14 nt, Human adenovirus B [HAdV-B]
gcaagaugaggaca

SEQ ID NO: 1545576 - RNA, 20 nt, Human adenovirus B [HAdV-B]
cacacaaagcacaagcucua

SEQ ID NO: 1545577 - RNA, 15 nt, Human adenovirus B [HAdV-B]
cggaggaggacaguc

SEQ ID NO: 1545578 - RNA, 21 nt, Human adenovirus B [HAdV-B]
gugucuaucuguaccugugcc

SEQ ID NO: 1545579 - RNA, 20 nt, Human adenovirus B [HAdV-B]
cucgaagggguucauugguc

SEQ ID NO: 1545580 - RNA, 15 nt, Human adenovirus B [HAdV-B]
aggucaucugggcca

SEQ ID NO: 1545581 - RNA, 14 nt, Human adenovirus B [HAdV-B]
cucgaagagaaucu

SEQ ID NO: 1545582 - RNA, 13 nt, Human adenovirus B [HAdV-B]
cucccagcagcac

SEQ ID NO: 1545583 - RNA, 19 nt, Human adenovirus B [HAdV-B]
acggaguucuuacuuuaaa

SEQ ID NO: 1545584 - RNA, 14 nt, Human adenovirus B [HAdV-B]
gccucuucucuuuc

SEQ ID NO: 1545585 - RNA, 21 nt, Human adenovirus B [HAdV-B]
ccagcgccaugacagacagag

SEQ ID NO: 1545586 - RNA, 22 nt, Human adenovirus B [HAdV-B]
uauggaagcaguaacuuuugua

SEQ ID NO: 1545587 - RNA, 16 nt, Human adenovirus B [HAdV-B]
cagauguacgcgaagc

SEQ ID NO: 1545588 - RNA, 17 nt, Human adenovirus B [HAdV-B]
gaguuaagcgacaggga

SEQ ID NO: 1545589 - RNA, 21 nt, Human adenovirus B [HAdV-B]
ucaccaaacugcuuagccaga

SEQ ID NO: 1545590 - RNA, 23 nt, Human adenovirus B [HAdV-B]
uguaucggcuuacgagcagacag

SEQ ID NO: 1545591 - RNA, 14 nt, Human adenovirus B [HAdV-B]
gcacccgucccccu

SEQ ID NO: 1545592 - RNA, 15 nt, Human adenovirus B [HAdV-B]
auugcccaggacuuu

SEQ ID NO: 1545593 - RNA, 15 nt, Human adenovirus B [HAdV-B]
guguggaagagcuca

SEQ ID NO: 1545594 - RNA, 18 nt, Human adenovirus B [HAdV-B]
gagaaaaaucagaaauuc

SEQ ID NO: 1545595 - RNA, 22 nt, Human adenovirus B [HAdV-B]
gggacgaggauuucgaaguuga

SEQ ID NO: 1545596 - RNA, 16 nt, Human adenovirus B [HAdV-B]
acccaacauccugucc

SEQ ID NO: 1545597 - RNA, 23 nt, Human adenovirus B [HAdV-B]
auuuuggagagaguuugcugcaa

SEQ ID NO: 1545598 - RNA, 16 nt, Human adenovirus B [HAdV-B]
auccagaucuucagca

SEQ ID NO: 1545599 - RNA, 21 nt, Human adenovirus B [HAdV-B]
acuauaaacaagaauuugaaa

SEQ ID NO: 1545600 - RNA, 17 nt, Human adenovirus B [HAdV-B]
cucuuccagaaaacaaa

SEQ ID NO: 1545601 - RNA, 12 nt, Human adenovirus B [HAdV-B]
uuacaaaaccau

SEQ ID NO: 1545602 - RNA, 22 nt, Human adenovirus B [HAdV-B]
cgcccguaauuauacuccuacu

SEQ ID NO: 1545603 - RNA, 10 nt, Human adenovirus B [HAdV-B]
cgcgaacagg

SEQ ID NO: 1545604 - RNA, 16 nt, Human adenovirus B [HAdV-B]
guucgagucaggguug

SEQ ID NO: 1545605 - RNA, 12 nt, Human adenovirus B [HAdV-B]
acgcacagccug

SEQ ID NO: 1545606 - RNA, 21 nt, Human adenovirus B [HAdV-B]
gaggccacaacgcacagccug

SEQ ID NO: 1545607 - RNA, 19 nt, Human adenovirus B [HAdV-B]
gaugcauuauuggacagaa

SEQ ID NO: 1545608 - RNA, 21 nt, Human adenovirus B [HAdV-B]
gcaccuuugaauugcaaggcc

SEQ ID NO: 1545609 - RNA, 19 nt, Human adenovirus B [HAdV-B]
agcaauugagauuugccac

SEQ ID NO: 1545610 - RNA, 14 nt, Human adenovirus B [HAdV-B]
caggaucacagaga

SEQ ID NO: 1545611 - RNA, 22 nt, Human adenovirus B [HAdV-B]
gcacacuaaaaggaccucaagg

SEQ ID NO: 1545612 - RNA, 20 nt, Human adenovirus B [HAdV-B]
agacggauuaauauccggaa

SEQ ID NO: 1545613 - RNA, 12 nt, Human adenovirus B [HAdV-B]
ucccaguuucaa

SEQ ID NO: 1545614 - RNA, 18 nt, Human adenovirus B [HAdV-B]
ggacauugcuucucugaa

SEQ ID NO: 1545615 - RNA, 18 nt, Human adenovirus B [HAdV-B]
ccauacucauuugugcau

SEQ ID NO: 1545616 - RNA, 18 nt, Human adenovirus B [HAdV-B]
accagggaaaaguacagu

SEQ ID NO: 1545617 - RNA, 18 nt, Human adenovirus B [HAdV-B]
aagucagguggacgagca

SEQ ID NO: 1545618 - RNA, 20 nt, Human adenovirus B [HAdV-B]
caccuuagaaaaugcaaauu

SEQ ID NO: 1545619 - RNA, 22 nt, Human adenovirus B [HAdV-B]
agcgccggcaggucccgcaggc

SEQ ID NO: 1545620 - RNA, 14 nt, Human adenovirus B [HAdV-B]
gaugugaacauggu

SEQ ID NO: 1545621 - RNA, 21 nt, Human adenovirus B [HAdV-B]
cacagcagcgggcgucauugu

SEQ ID NO: 1545622 - RNA, 18 nt, Human adenovirus B [HAdV-B]
cgaaggcgcauugccaga

SEQ ID NO: 1545623 - RNA, 14 nt, Human adenovirus B [HAdV-B]
caguccugccacca

SEQ ID NO: 1545624 - RNA, 22 nt, Human adenovirus B [HAdV-B]
acuccccccaaacgucagccaa

SEQ ID NO: 1545625 - RNA, 21 nt, Human adenovirus B [HAdV-B]
ccacccucgauuaugcaaggu

SEQ ID NO: 1545626 - RNA, 22 nt, Human adenovirus B [HAdV-B]
ggcgcuacuugcuauuccacca

SEQ ID NO: 1545627 - RNA, 16 nt, Human adenovirus B [HAdV-B]
ggaacaaagcuuggaa

SEQ ID NO: 1545628 - RNA, 18 nt, Human adenovirus B [HAdV-B]
acgauuggacccaggcca

SEQ ID NO: 1545629 - RNA, 18 nt, Human adenovirus B [HAdV-B]
uuuauuugaaaaucaauu

SEQ ID NO: 1545630 - RNA, 13 nt, Human adenovirus B [HAdV-B]
cggggucaagagc

SEQ ID NO: 1545631 - RNA, 20 nt, Human adenovirus B [HAdV-B]
gaucccauggaugagcccac

SEQ ID NO: 1545632 - RNA, 23 nt, Human adenovirus B [HAdV-B]
uguugcacaauaucuuuuagaag

SEQ ID NO: 1545633 - RNA, 20 nt, Human adenovirus B [HAdV-B]
caucccgaauaccgcaacca

SEQ ID NO: 1545634 - RNA, 21 nt, Human adenovirus B [HAdV-B]
ugggcauucugaaugaaggcg

SEQ ID NO: 1545635 - RNA, 21 nt, Human adenovirus B [HAdV-B]
ugaacggggucaucuugcagg

SEQ ID NO: 1545636 - RNA, 18 nt, Human adenovirus B [HAdV-B]
gcaggacagaaacacaga

SEQ ID NO: 1545637 - RNA, 13 nt, Human adenovirus B [HAdV-B]
cauaguugccagc

SEQ ID NO: 1545638 - RNA, 14 nt, Human adenovirus B [HAdV-B]
caagaugaggacaa

SEQ ID NO: 1545639 - RNA, 11 nt, Human adenovirus B [HAdV-B]
aaaugcuuucu

SEQ ID NO: 1545640 - RNA, 15 nt, Human adenovirus B [HAdV-B]
ucaugcauacuaaca

SEQ ID NO: 1545641 - RNA, 20 nt, Human adenovirus B [HAdV-B]
acgaaguguaccaugcaugc

SEQ ID NO: 1545642 - RNA, 20 nt, Human adenovirus B [HAdV-B]
ggucaucuugcaggucugcc

SEQ ID NO: 1545643 - RNA, 17 nt, Human adenovirus B [HAdV-B]
ugaggaccaaucacagc

SEQ ID NO: 1545644 - RNA, 23 nt, Human adenovirus B [HAdV-B]
auacaccccguccaaugucacuc

SEQ ID NO: 1545645 - RNA, 20 nt, Human adenovirus B [HAdV-B]
agacauggaaacucagccau

SEQ ID NO: 1545646 - RNA, 20 nt, Human adenovirus B [HAdV-B]
gaucucgucgaaaccguuga

SEQ ID NO: 1545647 - RNA, 20 nt, Human adenovirus B [HAdV-B]
aaaaugaguagauggaagac

SEQ ID NO: 1545648 - RNA, 19 nt, Human adenovirus B [HAdV-B]
ugggagcugacuugcagug

SEQ ID NO: 1545649 - RNA, 21 nt, Human adenovirus B [HAdV-B]
aggcagagaaacaacagacau

SEQ ID NO: 1545650 - RNA, 12 nt, Human adenovirus B [HAdV-B]
aauuuuggcuca

SEQ ID NO: 1545651 - RNA, 19 nt, Human adenovirus B [HAdV-B]
aagcaaggguccgccacug

SEQ ID NO: 1545652 - RNA, 20 nt, Human adenovirus B [HAdV-B]
gugcaggagcggagccuggg

SEQ ID NO: 1545653 - RNA, 16 nt, Human adenovirus B [HAdV-B]
gacuugcaggacagaa

SEQ ID NO: 1545654 - RNA, 16 nt, Human adenovirus B [HAdV-B]
agcgugaugcagcagc

SEQ ID NO: 1545655 - RNA, 16 nt, Human adenovirus B [HAdV-B]
cuggccaucgugaacg

SEQ ID NO: 1545656 - RNA, 13 nt, Human adenovirus B [HAdV-B]
gcugauugccaca

SEQ ID NO: 1545657 - RNA, 14 nt, Human adenovirus B [HAdV-B]
agagcgugggauug

SEQ ID NO: 1545658 - RNA, 17 nt, Human adenovirus B [HAdV-B]
cucagcucaugcucugg

SEQ ID NO: 1545659 - RNA, 13 nt, Human adenovirus B [HAdV-B]
ucuucccagagcg

SEQ ID NO: 1545660 - RNA, 17 nt, Human adenovirus B [HAdV-B]
gcaggaggcgcaaacag

SEQ ID NO: 1545661 - RNA, 20 nt, Human adenovirus B [HAdV-B]
uccgcgauaccuggcaccua

SEQ ID NO: 1545662 - RNA, 17 nt, Human adenovirus B [HAdV-B]
ugcagcaacaggaggau

SEQ ID NO: 1545663 - RNA, 14 nt, Human adenovirus B [HAdV-B]
gaacugaugcacag

SEQ ID NO: 1545664 - RNA, 21 nt, Human adenovirus B [HAdV-B]
aaaaugccaaauauggcaaag

SEQ ID NO: 1545665 - RNA, 12 nt, Human adenovirus B [HAdV-B]
caauaacaaaac

SEQ ID NO: 1545666 - RNA, 17 nt, Human adenovirus B [HAdV-B]
aguacuccaccagaaca

SEQ ID NO: 1545667 - RNA, 20 nt, Human adenovirus B [HAdV-B]
gaaacuuuuacaucucccac

SEQ ID NO: 1545668 - RNA, 20 nt, Human adenovirus B [HAdV-B]
gcuccgguauccugcccgcc

SEQ ID NO: 1545669 - RNA, 17 nt, Human adenovirus B [HAdV-B]
ugcaggcagcagcuccu

SEQ ID NO: 1545670 - RNA, 13 nt, Human adenovirus B [HAdV-B]
uagcugcacagcc

SEQ ID NO: 1545671 - RNA, 23 nt, Human adenovirus B [HAdV-B]
auagcaauggggccgugggcagc

SEQ ID NO: 1545672 - RNA, 16 nt, Human adenovirus B [HAdV-B]
ggccgagaagguggcu

SEQ ID NO: 1545673 - RNA, 17 nt, Human adenovirus B [HAdV-B]
uguaucccacuaugcaa

SEQ ID NO: 1545674 - RNA, 14 nt, Human adenovirus B [HAdV-B]
cucgcucacaccuc

SEQ ID NO: 1545675 - RNA, 15 nt, Human adenovirus B [HAdV-B]
ggcagucucgacaga

SEQ ID NO: 1545676 - RNA, 21 nt, Human adenovirus B [HAdV-B]
gagaaacaacagacauggaaa

SEQ ID NO: 1545677 - RNA, 18 nt, Human adenovirus B [HAdV-B]
uguucaauaaacaucacu

SEQ ID NO: 1545678 - RNA, 20 nt, Human adenovirus B [HAdV-B]
aucugggaccugguucacgc

SEQ ID NO: 1545679 - RNA, 22 nt, Human adenovirus B [HAdV-B]
cgucagugaaaacguuccugcu

SEQ ID NO: 1545680 - RNA, 23 nt, Human adenovirus B [HAdV-B]
uuuugcacccgacacaagccgca

SEQ ID NO: 1545681 - RNA, 15 nt, Human adenovirus B [HAdV-B]
aguguuucuugaaug

SEQ ID NO: 1545682 - RNA, 18 nt, Human adenovirus B [HAdV-B]
gcuccgggguaguguugu

SEQ ID NO: 1545683 - RNA, 22 nt, Human adenovirus B [HAdV-B]
ucccgccaagaauuucuacuga

SEQ ID NO: 1545684 - RNA, 14 nt, Human adenovirus B [HAdV-B]
ccugccaaugcaac

SEQ ID NO: 1545685 - RNA, 20 nt, Human adenovirus B [HAdV-B]
caccuguuccgacugcagaa

SEQ ID NO: 1545686 - RNA, 19 nt, Human adenovirus B [HAdV-B]
gcgccgcgacggcaggaug

SEQ ID NO: 1545687 - RNA, 18 nt, Human adenovirus B [HAdV-B]
ugaucuggacuuggaaga

SEQ ID NO: 1545688 - RNA, 18 nt, Human adenovirus B [HAdV-B]
aaauacacauacaaagcc

SEQ ID NO: 1545689 - RNA, 22 nt, Human adenovirus B [HAdV-B]
acgaccagacggaaucuuucag

SEQ ID NO: 1545690 - RNA, 13 nt, Human adenovirus B [HAdV-B]
ccuggaaggcgga

SEQ ID NO: 1545691 - RNA, 13 nt, Human adenovirus B [HAdV-B]
caauccccacugg

SEQ ID NO: 1545692 - RNA, 24 nt, Human adenovirus B [HAdV-B]
gaccccacacggcgacagguguuu

SEQ ID NO: 1545693 - RNA, 22 nt, Human adenovirus B [HAdV-B]
augccaucauagauaauuacuu

SEQ ID NO: 1545694 - RNA, 14 nt, Human adenovirus B [HAdV-B]
uguuucugaugcaa

SEQ ID NO: 1545695 - RNA, 14 nt, Human adenovirus B [HAdV-B]
gcucuuccucacug

SEQ ID NO: 1545696 - RNA, 15 nt, Human adenovirus B [HAdV-B]
ugaaaccuucucagu

SEQ ID NO: 1545697 - RNA, 18 nt, Human adenovirus B [HAdV-B]
acggcgacgcgugcaaug

SEQ ID NO: 1545698 - RNA, 15 nt, Human adenovirus B [HAdV-B]
gacagggaacugaug

SEQ ID NO: 1545699 - RNA, 16 nt, Human adenovirus B [HAdV-B]
ccccggacccaaguug

SEQ ID NO: 1545700 - RNA, 20 nt, Human adenovirus B [HAdV-B]
aacaggaggauuaaagauua

SEQ ID NO: 1545701 - RNA, 22 nt, Human adenovirus B [HAdV-B]
uggggggguauaaaagggggcg

SEQ ID NO: 1545702 - RNA, 15 nt, Human adenovirus B [HAdV-B]
aaugugaaaggcggu

SEQ ID NO: 1545703 - RNA, 18 nt, Human adenovirus B [HAdV-B]
ccagcuuuugcugugcca

SEQ ID NO: 1545704 - RNA, 14 nt, Human adenovirus B [HAdV-B]
cauucacacagcag

SEQ ID NO: 1545705 - RNA, 16 nt, Human adenovirus B [HAdV-B]
ccaaagacugguucuu

SEQ ID NO: 1545706 - RNA, 21 nt, Human adenovirus B [HAdV-B]
cccgccaaacccaacacacac

SEQ ID NO: 1545707 - RNA, 22 nt, Human adenovirus B [HAdV-B]
cuucucgcaacugggcggcuuu

SEQ ID NO: 1545708 - RNA, 14 nt, Human adenovirus B [HAdV-B]
cuuccaacaaaaag

SEQ ID NO: 1545709 - RNA, 14 nt, Human adenovirus B [HAdV-B]
cuaggcaacuguua

SEQ ID NO: 1545710 - RNA, 11 nt, Human adenovirus B [HAdV-B]
gaguuggaagu

SEQ ID NO: 1545711 - RNA, 16 nt, Human adenovirus B [HAdV-B]
guacaaccacacucuu

SEQ ID NO: 1545712 - RNA, 22 nt, Human adenovirus B [HAdV-B]
aaucagaaugacccgcaggcag

SEQ ID NO: 1545713 - RNA, 17 nt, Human adenovirus B [HAdV-B]
cugcuacagcugcugca

SEQ ID NO: 1545714 - RNA, 13 nt, Human adenovirus B [HAdV-B]
uccagucuccugc

SEQ ID NO: 1545715 - RNA, 19 nt, Human adenovirus B [HAdV-B]
ugaaacgcuuucuagagag

SEQ ID NO: 1545716 - RNA, 17 nt, Human adenovirus B [HAdV-B]
aauaguuccaaauggag

SEQ ID NO: 1545717 - RNA, 19 nt, Human adenovirus B [HAdV-B]
gucggggucaagagcagga

SEQ ID NO: 1545718 - RNA, 15 nt, Human adenovirus B [HAdV-B]
cagaaugaccacagc

SEQ ID NO: 1545719 - RNA, 14 nt, Human adenovirus B [HAdV-B]
gauuccuugcucag

SEQ ID NO: 1545720 - RNA, 16 nt, Human adenovirus B [HAdV-B]
caacgaacaagcugug

SEQ ID NO: 1545721 - RNA, 21 nt, Human adenovirus B [HAdV-B]
caguuguaaucaaaacuccau

SEQ ID NO: 1545722 - RNA, 20 nt, Human adenovirus B [HAdV-B]
guuugggccauuuuggaaga

SEQ ID NO: 1545723 - RNA, 14 nt, Human adenovirus B [HAdV-B]
gcuacgaagagcua

SEQ ID NO: 1545724 - RNA, 15 nt, Human adenovirus B [HAdV-B]
ccucuuuucaccucg

SEQ ID NO: 1545725 - RNA, 15 nt, Human adenovirus B [HAdV-B]
ggaggcuauguggga

SEQ ID NO: 1545726 - RNA, 19 nt, Human adenovirus B [HAdV-B]
ucuucgcgauccuuccagu

SEQ ID NO: 1545727 - RNA, 15 nt, Human adenovirus B [HAdV-B]
caaaaaauuccaguc

SEQ ID NO: 1545728 - RNA, 21 nt, Human adenovirus B [HAdV-B]
ccaugccuuucucccaagcag

SEQ ID NO: 1545729 - RNA, 17 nt, Human adenovirus B [HAdV-B]
acuacuugcacagagcu

SEQ ID NO: 1545730 - RNA, 12 nt, Human adenovirus B [HAdV-B]
ggauuuggaaga

SEQ ID NO: 1545731 - RNA, 17 nt, Human adenovirus B [HAdV-B]
accaaucggucucaaaa

SEQ ID NO: 1545732 - RNA, 15 nt, Human adenovirus B [HAdV-B]
uucugaggaaaucau

SEQ ID NO: 1545733 - RNA, 23 nt, Human adenovirus B [HAdV-B]
cagauuugcauuucccaagcuuu

SEQ ID NO: 1545734 - RNA, 17 nt, Human adenovirus B [HAdV-B]
gaggcuuucagagaggc

SEQ ID NO: 1545735 - RNA, 16 nt, Human adenovirus B [HAdV-B]
cccagcagcaccucac

SEQ ID NO: 1545736 - RNA, 12 nt, Human adenovirus B [HAdV-B]
gacggcuugcug

SEQ ID NO: 1545737 - RNA, 23 nt, Human adenovirus B [HAdV-B]
cagaugcgcccccaacaacagcc

SEQ ID NO: 1545738 - RNA, 20 nt, Human adenovirus B [HAdV-B]
ugcaugaaagccuuugcugu

SEQ ID NO: 1545739 - RNA, 13 nt, Human adenovirus B [HAdV-B]
ggcaaaguuuaaa

SEQ ID NO: 1545740 - RNA, 16 nt, Human adenovirus B [HAdV-B]
agucugagacagacau

SEQ ID NO: 1545741 - RNA, 12 nt, Human adenovirus B [HAdV-B]
guugaugcccaa

SEQ ID NO: 1545742 - RNA, 14 nt, Human adenovirus B [HAdV-B]
acagucaggcagag

SEQ ID NO: 1545743 - RNA, 14 nt, Human adenovirus B [HAdV-B]
aaguaaauggaaca

SEQ ID NO: 1545744 - RNA, 13 nt, Human adenovirus B [HAdV-B]
gagcggagccugg

SEQ ID NO: 1545745 - RNA, 18 nt, Human adenovirus B [HAdV-B]
aucuacuucgaacucccc

SEQ ID NO: 1545746 - RNA, 23 nt, Human adenovirus B [HAdV-B]
cacaacaccgcuuccacccuuga

SEQ ID NO: 1545747 - RNA, 12 nt, Human adenovirus B [HAdV-B]
agccuacugcca

SEQ ID NO: 1545748 - RNA, 17 nt, Human adenovirus B [HAdV-B]
cugcguggccuuuggcg

SEQ ID NO: 1545749 - RNA, 16 nt, Human adenovirus B [HAdV-B]
ugcagaaaucuuccca

SEQ ID NO: 1545750 - RNA, 20 nt, Human adenovirus B [HAdV-B]
ucgcauaucccgcugucaac

SEQ ID NO: 1545751 - RNA, 17 nt, Human adenovirus B [HAdV-B]
ucaugauuaaacaacag

SEQ ID NO: 1545752 - RNA, 18 nt, Human adenovirus B [HAdV-B]
gacauacucgcgugccag

SEQ ID NO: 1545753 - RNA, 17 nt, Human adenovirus B [HAdV-B]
ucaucgggagggucugc

SEQ ID NO: 1545754 - RNA, 20 nt, Human adenovirus B [HAdV-B]
cccagagcgucucaggguua

SEQ ID NO: 1545755 - RNA, 21 nt, Human adenovirus B [HAdV-B]
uuggauaaaaguuuggcaaug

SEQ ID NO: 1545756 - RNA, 23 nt, Human adenovirus B [HAdV-B]
ggaagcaacgaagcuuggaaugc

SEQ ID NO: 1545757 - RNA, 17 nt, Human adenovirus B [HAdV-B]
cucagguugucaguuuc

SEQ ID NO: 1545758 - RNA, 11 nt, Human adenovirus B [HAdV-B]
augaacaaugc

SEQ ID NO: 1545759 - RNA, 13 nt, Human adenovirus B [HAdV-B]
cuucuccugggca

SEQ ID NO: 1545760 - RNA, 15 nt, Human adenovirus B [HAdV-B]
agauguaaccugggc

SEQ ID NO: 1545761 - RNA, 12 nt, Human adenovirus B [HAdV-B]
aaagccaaaaua

SEQ ID NO: 1545762 - RNA, 12 nt, Human adenovirus B [HAdV-B]
ucgauuguugau

SEQ ID NO: 1545763 - RNA, 14 nt, Human adenovirus B [HAdV-B]
ugaacaugguucua

SEQ ID NO: 1545764 - RNA, 16 nt, Human adenovirus B [HAdV-B]
auuguuucugaugcaa

SEQ ID NO: 1545765 - RNA, 16 nt, Human adenovirus B [HAdV-B]
cuuaaccgaagagcaa

SEQ ID NO: 1545766 - RNA, 23 nt, Human adenovirus B [HAdV-B]
ggaggcagggcucucaaacccga

SEQ ID NO: 1545767 - RNA, 16 nt, Human adenovirus B [HAdV-B]
ucccgcagacucauuu

SEQ ID NO: 1545768 - RNA, 19 nt, Human adenovirus B [HAdV-B]
uucagacucauccugcugg

SEQ ID NO: 1545769 - RNA, 18 nt, Human adenovirus B [HAdV-B]
uugucuccugaacugcaa

SEQ ID NO: 1545770 - RNA, 23 nt, Human adenovirus B [HAdV-B]
ggcguccagcgcugccaggguuc

SEQ ID NO: 1545771 - RNA, 15 nt, Human adenovirus B [HAdV-B]
gccaccugcugcgca

SEQ ID NO: 1545772 - RNA, 23 nt, Human adenovirus B [HAdV-B]
cguacgagagcgugaugcagcag

SEQ ID NO: 1545773 - RNA, 18 nt, Human adenovirus B [HAdV-B]
guguggaagagcucagcc

SEQ ID NO: 1545774 - RNA, 11 nt, Human adenovirus B [HAdV-B]
cucuuucugau

SEQ ID NO: 1545775 - RNA, 21 nt, Human adenovirus B [HAdV-B]
caugugauggcgcuagcagcc

SEQ ID NO: 1545776 - RNA, 14 nt, Human adenovirus B [HAdV-B]
aaacggcaccugcg

SEQ ID NO: 1545777 - RNA, 19 nt, Human adenovirus B [HAdV-B]
aacguugguuaaucaugca

SEQ ID NO: 1545778 - RNA, 17 nt, Human adenovirus B [HAdV-B]
ggggaguccaacgugug

SEQ ID NO: 1545779 - RNA, 18 nt, Human adenovirus B [HAdV-B]
uguagcgggaauccugag

SEQ ID NO: 1545780 - RNA, 13 nt, Human adenovirus B [HAdV-B]
gcaaguggaggaa

SEQ ID NO: 1545781 - RNA, 12 nt, Human adenovirus B [HAdV-B]
caaccacacucu

SEQ ID NO: 1545782 - RNA, 12 nt, Human adenovirus B [HAdV-B]
accacacucuua

SEQ ID NO: 1545783 - RNA, 21 nt, Human adenovirus B [HAdV-B]
auccugucugauuccuggaua

SEQ ID NO: 1545784 - RNA, 23 nt, Human adenovirus B [HAdV-B]
augaaaacugcccaaaacaacga

SEQ ID NO: 1545785 - RNA, 22 nt, Human adenovirus B [HAdV-B]
acucgguggauuuuuuccagga

SEQ ID NO: 1545786 - RNA, 14 nt, Human adenovirus B [HAdV-B]
acccacaagcagcc

SEQ ID NO: 1545787 - RNA, 13 nt, Human adenovirus B [HAdV-B]
ggcuguggacagu

SEQ ID NO: 1545788 - RNA, 21 nt, Human adenovirus B [HAdV-B]
ucaaaacuccacuuaaucaua

SEQ ID NO: 1545789 - RNA, 22 nt, Human adenovirus B [HAdV-B]
cugagcagucuccgauguugug

SEQ ID NO: 1545790 - RNA, 14 nt, Human adenovirus B [HAdV-B]
ugaugcguuucuua

SEQ ID NO: 1545791 - RNA, 21 nt, Human adenovirus B [HAdV-B]
agcccauucgugcaggugagg

SEQ ID NO: 1545792 - RNA, 23 nt, Human adenovirus B [HAdV-B]
caaaaauaaaaaaaaaaacaagc

SEQ ID NO: 1545793 - RNA, 18 nt, Human adenovirus B [HAdV-B]
acuucgaacuccccaagg

SEQ ID NO: 1545794 - RNA, 20 nt, Human adenovirus B [HAdV-B]
gacgccagcgccaugacaga

SEQ ID NO: 1545795 - RNA, 23 nt, Human adenovirus B [HAdV-B]
augccaucaucuccugcuugcau

SEQ ID NO: 1545796 - RNA, 22 nt, Human adenovirus B [HAdV-B]
ggaugggugagugcagaggcau

SEQ ID NO: 1545797 - RNA, 17 nt, Human adenovirus B [HAdV-B]
guugacuugcaggacag

SEQ ID NO: 1545798 - RNA, 21 nt, Human adenovirus B [HAdV-B]
accuuccggaaccacacugcc

SEQ ID NO: 1545799 - RNA, 16 nt, Human adenovirus B [HAdV-B]
gcguggcucgcuacaa

SEQ ID NO: 1545800 - RNA, 18 nt, Human adenovirus B [HAdV-B]
aacgaugggaaucauaau

SEQ ID NO: 1545801 - RNA, 20 nt, Human adenovirus B [HAdV-B]
uggaagacugauggcacaac

SEQ ID NO: 1545802 - RNA, 16 nt, Human adenovirus B [HAdV-B]
aaugauugcuggaaua

SEQ ID NO: 1545803 - RNA, 14 nt, Human adenovirus B [HAdV-B]
ggcaauucuggccc

SEQ ID NO: 1545804 - RNA, 16 nt, Human adenovirus B [HAdV-B]
guucgcgguugagaag

SEQ ID NO: 1545805 - RNA, 23 nt, Human adenovirus B [HAdV-B]
uugauuaauguuagcaaaguuua

SEQ ID NO: 1545806 - RNA, 23 nt, Human adenovirus B [HAdV-B]
cauauucuguuugguaaaacaag

SEQ ID NO: 1545807 - RNA, 16 nt, Human adenovirus B [HAdV-B]
guucaugagcaaacag

SEQ ID NO: 1545808 - RNA, 18 nt, Human adenovirus B [HAdV-B]
aaccccagguagaacugc

SEQ ID NO: 1545809 - RNA, 22 nt, Human adenovirus B [HAdV-B]
gcuauaauguguuggaagacaa

SEQ ID NO: 1545810 - RNA, 19 nt, Human adenovirus B [HAdV-B]
agaagguuuccaucauguu

SEQ ID NO: 1545811 - RNA, 14 nt, Human adenovirus B [HAdV-B]
gagaaaaugaaagc

SEQ ID NO: 1545812 - RNA, 10 nt, Human adenovirus B [HAdV-B]
aauuggcucc

SEQ ID NO: 1545813 - RNA, 14 nt, Human adenovirus B [HAdV-B]
cucugaacuucuug

SEQ ID NO: 1545814 - RNA, 21 nt, Human adenovirus B [HAdV-B]
agcagauaacuaucaccaaga

SEQ ID NO: 1545815 - RNA, 17 nt, Human adenovirus B [HAdV-B]
ccagacucgcaguacuc

SEQ ID NO: 1545816 - RNA, 18 nt, Human adenovirus B [HAdV-B]
caugaauuggcucagcgc

SEQ ID NO: 1545817 - RNA, 15 nt, Human adenovirus B [HAdV-B]
gaagauacugagcag

SEQ ID NO: 1545818 - RNA, 22 nt, Human adenovirus B [HAdV-B]
gccaugcgagccgcaagagcuc

SEQ ID NO: 1545819 - RNA, 20 nt, Human adenovirus B [HAdV-B]
acucgacuccguagccugga

SEQ ID NO: 1545820 - RNA, 19 nt, Human adenovirus B [HAdV-B]
ucagcaauaaggucucugu

SEQ ID NO: 1545821 - RNA, 19 nt, Human adenovirus B [HAdV-B]
uagucauauaguucaugug

SEQ ID NO: 1545822 - RNA, 15 nt, Human adenovirus B [HAdV-B]
aggcacuucagcuug

SEQ ID NO: 1545823 - RNA, 19 nt, Human adenovirus B [HAdV-B]
cagaccucaucuucccaga

SEQ ID NO: 1545824 - RNA, 23 nt, Human adenovirus B [HAdV-B]
gagcaucaaccucuaugcuacuu

SEQ ID NO: 1545825 - RNA, 22 nt, Human adenovirus B [HAdV-B]
cuccucguuuacguacugguga

SEQ ID NO: 1545826 - RNA, 17 nt, Human adenovirus B [HAdV-B]
acggcaggaugugagcu

SEQ ID NO: 1545827 - RNA, 22 nt, Human adenovirus B [HAdV-B]
ggguccaccuuuuccaaaguau

SEQ ID NO: 1545828 - RNA, 18 nt, Human adenovirus B [HAdV-B]
guugaucaugccuggagu

SEQ ID NO: 1545829 - RNA, 23 nt, Human adenovirus B [HAdV-B]
agcaggggacgcuacagugcagu

SEQ ID NO: 1545830 - RNA, 18 nt, Human adenovirus B [HAdV-B]
gaaagagucugagacaga

SEQ ID NO: 1545831 - RNA, 16 nt, Human adenovirus B [HAdV-B]
gaacucaccaaccugg

SEQ ID NO: 1545832 - RNA, 23 nt, Human adenovirus B [HAdV-B]
ucuuaacagugcaggcagcagcu

SEQ ID NO: 1545833 - RNA, 13 nt, Human adenovirus B [HAdV-B]
ucuuaugaggaag

SEQ ID NO: 1545834 - RNA, 19 nt, Human adenovirus B [HAdV-B]
ugaccaugacuuugagaaa

SEQ ID NO: 1545835 - RNA, 16 nt, Human adenovirus B [HAdV-B]
gggacagucaggcaga

SEQ ID NO: 1545836 - RNA, 16 nt, Human adenovirus B [HAdV-B]
ugacugaaacacucac

SEQ ID NO: 1545837 - RNA, 16 nt, Human adenovirus B [HAdV-B]
aggaaaaggagcagag

SEQ ID NO: 1545838 - RNA, 22 nt, Human adenovirus B [HAdV-B]
gguggugcaacacagcagagac

SEQ ID NO: 1545839 - RNA, 13 nt, Human adenovirus B [HAdV-B]
ccuagaaauuucu

SEQ ID NO: 1545840 - RNA, 16 nt, Human adenovirus B [HAdV-B]
acccacaaucuucaug

SEQ ID NO: 1545841 - RNA, 17 nt, Human adenovirus B [HAdV-B]
aauugcgagugaugcga

SEQ ID NO: 1545842 - RNA, 16 nt, Human adenovirus B [HAdV-B]
uggacauugcucacca

SEQ ID NO: 1545843 - RNA, 15 nt, Human adenovirus B [HAdV-B]
agccauugcugucaa

SEQ ID NO: 1545844 - RNA, 15 nt, Human adenovirus B [HAdV-B]
aggcgacggcgguga

SEQ ID NO: 1545845 - RNA, 13 nt, Human adenovirus B [HAdV-B]
gcacuuuuugcuu

SEQ ID NO: 1545846 - RNA, 19 nt, Human adenovirus B [HAdV-B]
ggcaggaugucacuccaca

SEQ ID NO: 1545847 - RNA, 22 nt, Human adenovirus B [HAdV-B]
ugaugcaauccccacuggaggc

SEQ ID NO: 1545848 - RNA, 23 nt, Human adenovirus B [HAdV-B]
uguuuucuuagagauggaagaca

SEQ ID NO: 1545849 - RNA, 14 nt, Human adenovirus B [HAdV-B]
acuucgaacucccc

SEQ ID NO: 1545850 - RNA, 14 nt, Human adenovirus B [HAdV-B]
cuccaguggaggag

SEQ ID NO: 1545851 - RNA, 22 nt, Human adenovirus B [HAdV-B]
uguucuccuaggcagagaaaca

SEQ ID NO: 1545852 - RNA, 21 nt, Human adenovirus B [HAdV-B]
aguuucauccuaaaaaacaag

SEQ ID NO: 1545853 - RNA, 18 nt, Human adenovirus B [HAdV-B]
caucgccggacaggaugc

SEQ ID NO: 1545854 - RNA, 15 nt, Human adenovirus B [HAdV-B]
gugaggcgcgcgcag

SEQ ID NO: 1545855 - RNA, 18 nt, Human adenovirus B [HAdV-B]
cccagaugccugugauga

SEQ ID NO: 1545856 - RNA, 16 nt, Human adenovirus B [HAdV-B]
uggaacaggugaaaac

SEQ ID NO: 1545857 - RNA, 16 nt, Human adenovirus B [HAdV-B]
ggcgaagagccaugcu

SEQ ID NO: 1545858 - RNA, 18 nt, Human adenovirus B [HAdV-B]
cagccccccucgcagcag

SEQ ID NO: 1545859 - RNA, 18 nt, Human adenovirus B [HAdV-B]
cugguucuauucccuacc

SEQ ID NO: 1545860 - RNA, 23 nt, Human adenovirus B [HAdV-B]
gcaugacccagaugccugugaug

SEQ ID NO: 1545861 - RNA, 22 nt, Human adenovirus B [HAdV-B]
caguuagcuggcggcuccaccc

SEQ ID NO: 1545862 - RNA, 21 nt, Human adenovirus B [HAdV-B]
gcaucaaaaacgccaauaaca

SEQ ID NO: 1545863 - RNA, 17 nt, Human adenovirus B [HAdV-B]
cgccagacgccgcaccu

SEQ ID NO: 1545864 - RNA, 22 nt, Human adenovirus B [HAdV-B]
aggcgaugggucuucuccuggg

SEQ ID NO: 1545865 - RNA, 20 nt, Human adenovirus B [HAdV-B]
uuuggagagaguuugcugca

SEQ ID NO: 1545866 - RNA, 21 nt, Human adenovirus B [HAdV-B]
aggugaagauuuguaucccac

SEQ ID NO: 1545867 - RNA, 21 nt, Human adenovirus B [HAdV-B]
ugaauaauucuacaacuucac

SEQ ID NO: 1545868 - RNA, 23 nt, Human adenovirus B [HAdV-B]
cgggccccggagcauaguucccc

SEQ ID NO: 1545869 - RNA, 23 nt, Human adenovirus B [HAdV-B]
accccguucagcggcauacuuuc

SEQ ID NO: 1545870 - RNA, 14 nt, Human adenovirus B [HAdV-B]
aacuggugaggaac

SEQ ID NO: 1545871 - RNA, 20 nt, Human adenovirus B [HAdV-B]
ggccaucauggaagcuguag

SEQ ID NO: 1545872 - RNA, 16 nt, Human adenovirus B [HAdV-B]
cugauuucacucaaau

SEQ ID NO: 1545873 - RNA, 18 nt, Human adenovirus B [HAdV-B]
gaagcuuggaaugcccac

SEQ ID NO: 1545874 - RNA, 12 nt, Human adenovirus B [HAdV-B]
cucccagcagca

SEQ ID NO: 1545875 - RNA, 18 nt, Human adenovirus B [HAdV-B]
augcgggcggcgcugcag

SEQ ID NO: 1545876 - RNA, 17 nt, Human adenovirus B [HAdV-B]
uugcaaucgcagugcag

SEQ ID NO: 1545877 - RNA, 14 nt, Human adenovirus B [HAdV-B]
gccuggcugcggag

SEQ ID NO: 1545878 - RNA, 16 nt, Human adenovirus B [HAdV-B]
cucuuucauccuggaa

SEQ ID NO: 1545879 - RNA, 17 nt, Human adenovirus B [HAdV-B]
guaucauagugcaggag

SEQ ID NO: 1545880 - RNA, 22 nt, Human adenovirus B [HAdV-B]
cauuagggguguguuggacaga

SEQ ID NO: 1545881 - RNA, 19 nt, Human adenovirus B [HAdV-B]
gacuacuugcacagagcug

SEQ ID NO: 1545882 - RNA, 14 nt, Human adenovirus B [HAdV-B]
uguuaauucaucug

SEQ ID NO: 1545883 - RNA, 12 nt, Human adenovirus B [HAdV-B]
auauaauuauuu

SEQ ID NO: 1545884 - RNA, 21 nt, Human adenovirus B [HAdV-B]
gcccgucuucucaaagagcuu

SEQ ID NO: 1545885 - RNA, 15 nt, Human adenovirus B [HAdV-B]
cugcugcagaagcua

SEQ ID NO: 1545886 - RNA, 15 nt, Human adenovirus B [HAdV-B]
gauacuggauguuuu

SEQ ID NO: 1545887 - RNA, 18 nt, Human adenovirus B [HAdV-B]
ggcgcaguagucaagugu

SEQ ID NO: 1545888 - RNA, 17 nt, Human adenovirus B [HAdV-B]
ccauuugccauucucga

SEQ ID NO: 1545889 - RNA, 13 nt, Human adenovirus B [HAdV-B]
cucucaccuaccg

SEQ ID NO: 1545890 - RNA, 13 nt, Human adenovirus B [HAdV-B]
uagagacagaagc

SEQ ID NO: 1545891 - RNA, 21 nt, Human adenovirus B [HAdV-B]
auccugcccgccaccugcugc

SEQ ID NO: 1545892 - RNA, 22 nt, Human adenovirus B [HAdV-B]
gcuuccagacaugaugaaggau

SEQ ID NO: 1545893 - RNA, 11 nt, Human adenovirus B [HAdV-B]
agaguuucaug

SEQ ID NO: 1545894 - RNA, 15 nt, Human adenovirus B [HAdV-B]
acucugaacuucuug

SEQ ID NO: 1545895 - RNA, 20 nt, Human adenovirus B [HAdV-B]
cagcccaugagcaggcaggu

SEQ ID NO: 1545896 - RNA, 11 nt, Human adenovirus B [HAdV-B]
cgaggaggaag

SEQ ID NO: 1545897 - RNA, 19 nt, Human adenovirus B [HAdV-B]
auuuccccaaauggcuuca

SEQ ID NO: 1545898 - RNA, 22 nt, Human adenovirus B [HAdV-B]
uguuggauugccacagcuggca

SEQ ID NO: 1545899 - RNA, 16 nt, Human adenovirus B [HAdV-B]
ugggcgcuugccaggg

SEQ ID NO: 1545900 - RNA, 20 nt, Human adenovirus B [HAdV-B]
uauccugcccgccaccugcu

SEQ ID NO: 1545901 - RNA, 16 nt, Human adenovirus B [HAdV-B]
uggggccgugggcagc

SEQ ID NO: 1545902 - RNA, 15 nt, Human adenovirus B [HAdV-B]
cuuggaagacugaug

SEQ ID NO: 1545903 - RNA, 21 nt, Human adenovirus B [HAdV-B]
agugcccaucaguguggaaga

SEQ ID NO: 1545904 - RNA, 20 nt, Human adenovirus B [HAdV-B]
aacacacaccccgaaacugc

SEQ ID NO: 1545905 - RNA, 15 nt, Human adenovirus B [HAdV-B]
caccauaauuucauu

SEQ ID NO: 1545906 - RNA, 20 nt, Human adenovirus B [HAdV-B]
gcaguacaagcgcagaccuc

SEQ ID NO: 1545907 - RNA, 14 nt, Human adenovirus B [HAdV-B]
gccgcaggaggcgc

SEQ ID NO: 1545908 - RNA, 16 nt, Human adenovirus B [HAdV-B]
cuacagagucucugac

SEQ ID NO: 1545909 - RNA, 21 nt, Human adenovirus B [HAdV-B]
agcagcuaacccgauggcugg

SEQ ID NO: 1545910 - RNA, 18 nt, Human adenovirus B [HAdV-B]
cauuuucgcgcuccaugg

SEQ ID NO: 1545911 - RNA, 12 nt, Human adenovirus B [HAdV-B]
agaaagagggaa

SEQ ID NO: 1545912 - RNA, 12 nt, Human adenovirus B [HAdV-B]
aucaaaagaaau

SEQ ID NO: 1545913 - RNA, 13 nt, Human adenovirus B [HAdV-B]
accugcggagcag

SEQ ID NO: 1545914 - RNA, 12 nt, Human adenovirus B [HAdV-B]
gcagccaaggcg

SEQ ID NO: 1545915 - RNA, 22 nt, Human adenovirus B [HAdV-B]
ucgcaacugggcggcuuucaga

SEQ ID NO: 1545916 - RNA, 20 nt, Human adenovirus B [HAdV-B]
acaagucggcggacauugcu

SEQ ID NO: 1545917 - RNA, 16 nt, Human adenovirus B [HAdV-B]
gacagucaggcagagg

SEQ ID NO: 1545918 - RNA, 23 nt, Human adenovirus B [HAdV-B]
cagcgccaugacagacagagggg

SEQ ID NO: 1545919 - RNA, 14 nt, Human adenovirus B [HAdV-B]
uaguuauguuccug

SEQ ID NO: 1545920 - RNA, 13 nt, Human adenovirus B [HAdV-B]
gacccgcaggcag

SEQ ID NO: 1545921 - RNA, 17 nt, Human adenovirus B [HAdV-B]
uguuagcaucaguuaac

SEQ ID NO: 1545922 - RNA, 20 nt, Human adenovirus B [HAdV-B]
ggaaucaggcuguggacagu

SEQ ID NO: 1545923 - RNA, 22 nt, Human adenovirus B [HAdV-B]
guuucacauuccaccagccagg

SEQ ID NO: 1545924 - RNA, 13 nt, Human adenovirus B [HAdV-B]
cccaguccugcca

SEQ ID NO: 1545925 - RNA, 12 nt, Human adenovirus B [HAdV-B]
ucuaccuugacc

SEQ ID NO: 1545926 - RNA, 22 nt, Human adenovirus B [HAdV-B]
caagagcucugcuacgaagagc

SEQ ID NO: 1545927 - RNA, 21 nt, Human adenovirus B [HAdV-B]
ccggcgaaggcgcauugccag

SEQ ID NO: 1545928 - RNA, 14 nt, Human adenovirus B [HAdV-B]
agauguacggaggc

SEQ ID NO: 1545929 - RNA, 12 nt, Human adenovirus B [HAdV-B]
cuugaauuauuc

SEQ ID NO: 1545930 - RNA, 17 nt, Human adenovirus B [HAdV-B]
ggaucaguccugccagg

SEQ ID NO: 1545931 - RNA, 22 nt, Human adenovirus B [HAdV-B]
ugccaggguucgguccuuccag

SEQ ID NO: 1545932 - RNA, 21 nt, Human adenovirus B [HAdV-B]
cggcccuggcagaacacacuc

SEQ ID NO: 1545933 - RNA, 20 nt, Human adenovirus B [HAdV-B]
acugcuacaaguugcgccuc

SEQ ID NO: 1545934 - RNA, 19 nt, Human adenovirus B [HAdV-B]
cguccagcgcugccagggu

SEQ ID NO: 1545935 - RNA, 20 nt, Human adenovirus B [HAdV-B]
cuuaacagugcaggcagcag

SEQ ID NO: 1545936 - RNA, 11 nt, Human adenovirus B [HAdV-B]
cagucuccugc

SEQ ID NO: 1545937 - RNA, 13 nt, Human adenovirus B [HAdV-B]
auggcgugggcgc

SEQ ID NO: 1545938 - RNA, 17 nt, Human adenovirus B [HAdV-B]
gccuguacuucuccauc

SEQ ID NO: 1545939 - RNA, 11 nt, Human adenovirus B [HAdV-B]
ggaacuggcac

SEQ ID NO: 1545940 - RNA, 19 nt, Human adenovirus B [HAdV-B]
ucgaugcugccccaauggg

SEQ ID NO: 1545941 - RNA, 18 nt, Human adenovirus B [HAdV-B]
auguuagcaaaguuuaca

SEQ ID NO: 1545942 - RNA, 17 nt, Human adenovirus B [HAdV-B]
ucagaccggcaagagaa

SEQ ID NO: 1545943 - RNA, 17 nt, Human adenovirus B [HAdV-B]
cugcagaaaucuuccca

SEQ ID NO: 1545944 - RNA, 18 nt, Human adenovirus B [HAdV-B]
acauuggugccagguggu

SEQ ID NO: 1545945 - RNA, 15 nt, Human adenovirus B [HAdV-B]
gauccugagguauga

SEQ ID NO: 1545946 - RNA, 19 nt, Human adenovirus B [HAdV-B]
agccccccgggaacaagag

SEQ ID NO: 1545947 - RNA, 12 nt, Human adenovirus B [HAdV-B]
ccagaugccuuu

SEQ ID NO: 1545948 - RNA, 16 nt, Human adenovirus B [HAdV-B]
ucuagaccacugccgc

SEQ ID NO: 1545949 - RNA, 17 nt, Human adenovirus B [HAdV-B]
cuagaagauaaggaggu

SEQ ID NO: 1545950 - RNA, 14 nt, Human adenovirus B [HAdV-B]
aaugaaagcguuca

SEQ ID NO: 1545951 - RNA, 17 nt, Human adenovirus B [HAdV-B]
ggcgcugcagagccagc

SEQ ID NO: 1545952 - RNA, 13 nt, Human adenovirus B [HAdV-B]
agguucuguggac

SEQ ID NO: 1545953 - RNA, 19 nt, Human adenovirus B [HAdV-B]
cuguguacucccagcagcu

SEQ ID NO: 1545954 - RNA, 19 nt, Human adenovirus B [HAdV-B]
ggcaguuauuagaugcugc

SEQ ID NO: 1545955 - RNA, 16 nt, Human adenovirus B [HAdV-B]
gccaaugcaaccaaua

SEQ ID NO: 1545956 - RNA, 22 nt, Human adenovirus B [HAdV-B]
agagcccauucgugcaggugag

SEQ ID NO: 1545957 - RNA, 12 nt, Human adenovirus B [HAdV-B]
caugaacuccag

SEQ ID NO: 1545958 - RNA, 20 nt, Human adenovirus B [HAdV-B]
ucaugcuccgggguaguguu

SEQ ID NO: 1545959 - RNA, 20 nt, Human adenovirus B [HAdV-B]
cguggucauuucuugcuugc

SEQ ID NO: 1545960 - RNA, 19 nt, Human adenovirus B [HAdV-B]
cugaagggggaagcccgcc

SEQ ID NO: 1545961 - RNA, 19 nt, Human adenovirus B [HAdV-B]
gcgccagcaucaguuucac

SEQ ID NO: 1545962 - RNA, 17 nt, Human adenovirus B [HAdV-B]
augaucuugggguguau

SEQ ID NO: 1545963 - RNA, 13 nt, Human adenovirus B [HAdV-B]
uggcaugggaugg

SEQ ID NO: 1545964 - RNA, 18 nt, Human adenovirus B [HAdV-B]
acacaagguucccucagg

SEQ ID NO: 1545965 - RNA, 22 nt, Human adenovirus B [HAdV-B]
aacauagacauaaaugcaugca

SEQ ID NO: 1545966 - RNA, 20 nt, Human adenovirus B [HAdV-B]
uagcaucgccccccucugau

SEQ ID NO: 1545967 - RNA, 21 nt, Human adenovirus B [HAdV-B]
uguauccggaggguccuccuc

SEQ ID NO: 1545968 - RNA, 20 nt, Human adenovirus B [HAdV-B]
uuaggccgucuuuggggugg

SEQ ID NO: 1545969 - RNA, 16 nt, Human adenovirus B [HAdV-B]
aagcuaaggcaaacau

SEQ ID NO: 1545970 - RNA, 12 nt, Human adenovirus B [HAdV-B]
cuacuuucacag

SEQ ID NO: 1545971 - RNA, 15 nt, Human adenovirus B [HAdV-B]
cuucgggggcagagg

SEQ ID NO: 1545972 - RNA, 22 nt, Human adenovirus B [HAdV-B]
acuaacuuuuuaagugcuuuga

SEQ ID NO: 1545973 - RNA, 20 nt, Human adenovirus B [HAdV-B]
cuaacccgauggcugggcac

SEQ ID NO: 1545974 - RNA, 14 nt, Human adenovirus B [HAdV-B]
gcgugaugcagcag

SEQ ID NO: 1545975 - RNA, 16 nt, Human adenovirus B [HAdV-B]
ggugggcauuguaaua

SEQ ID NO: 1545976 - RNA, 22 nt, Human adenovirus B [HAdV-B]
cgucgccguagacgcacaagca

SEQ ID NO: 1545977 - RNA, 14 nt, Human adenovirus B [HAdV-B]
agacuagcagacag

SEQ ID NO: 1545978 - RNA, 16 nt, Human adenovirus B [HAdV-B]
cuuucuccauacuuua

SEQ ID NO: 1545979 - RNA, 16 nt, Human adenovirus B [HAdV-B]
acaugaaucaugugaa

SEQ ID NO: 1545980 - RNA, 15 nt, Human adenovirus B [HAdV-B]
gcacuggacaugaca

SEQ ID NO: 1545981 - RNA, 15 nt, Human adenovirus B [HAdV-B]
guuuacuuaagguga

SEQ ID NO: 1545982 - RNA, 16 nt, Human adenovirus B [HAdV-B]
uugacaagcucuuaca

SEQ ID NO: 1545983 - RNA, 16 nt, Human adenovirus B [HAdV-B]
aggaugaaaaaaaacc

SEQ ID NO: 1545984 - RNA, 17 nt, Human adenovirus B [HAdV-B]
uugccauccuucucaac

SEQ ID NO: 1545985 - RNA, 19 nt, Human adenovirus B [HAdV-B]
uuugcugugccagaaguac

SEQ ID NO: 1545986 - RNA, 21 nt, Human adenovirus B [HAdV-B]
ucuuuugccauccuucucaac

SEQ ID NO: 1545987 - RNA, 15 nt, Human adenovirus B [HAdV-B]
uucgcugucuugacu

SEQ ID NO: 1545988 - RNA, 17 nt, Human adenovirus B [HAdV-B]
uaucggaggaggaggac

SEQ ID NO: 1545989 - RNA, 21 nt, Human adenovirus B [HAdV-B]
aggaaccugaaguaaauggaa

SEQ ID NO: 1545990 - RNA, 16 nt, Human adenovirus B [HAdV-B]
cgaagagaaucugcac

SEQ ID NO: 1545991 - RNA, 22 nt, Human adenovirus B [HAdV-B]
caccauucuuaaacacacccuc

SEQ ID NO: 1545992 - RNA, 15 nt, Human adenovirus B [HAdV-B]
ugcaccacacuucug

SEQ ID NO: 1545993 - RNA, 17 nt, Human adenovirus B [HAdV-B]
ggaaggcggaugacugg

SEQ ID NO: 1545994 - RNA, 16 nt, Human adenovirus B [HAdV-B]
ccaacgacgagaaaac

SEQ ID NO: 1545995 - RNA, 20 nt, Human adenovirus B [HAdV-B]
cucucccagggauuuggaag

SEQ ID NO: 1545996 - RNA, 15 nt, Human adenovirus B [HAdV-B]
ccagggcacacgugg

SEQ ID NO: 1545997 - RNA, 18 nt, Human adenovirus B [HAdV-B]
ucuaaucccacucaugag

SEQ ID NO: 1545998 - RNA, 22 nt, Human adenovirus B [HAdV-B]
acuccagugaaucuaaugauug

SEQ ID NO: 1545999 - RNA, 20 nt, Human adenovirus B [HAdV-B]
ugccagcacggugggaucug

SEQ ID NO: 1546000 - RNA, 18 nt, Human adenovirus B [HAdV-B]
caggaugugagcuuccuu

SEQ ID NO: 1546001 - RNA, 23 nt, Human adenovirus B [HAdV-B]
agaacgcuucggacggagucucc

SEQ ID NO: 1546002 - RNA, 21 nt, Human adenovirus B [HAdV-B]
aacauuauuguacugccaucu

SEQ ID NO: 1546003 - RNA, 15 nt, Human adenovirus B [HAdV-B]
gguccgccacugcgc

SEQ ID NO: 1546004 - RNA, 22 nt, Human adenovirus B [HAdV-B]
gcugcuacagcugcugcagaag

SEQ ID NO: 1546005 - RNA, 15 nt, Human adenovirus B [HAdV-B]
aagauuuuccaugca

SEQ ID NO: 1546006 - RNA, 19 nt, Human adenovirus B [HAdV-B]
gcauuguggagaacaugga

SEQ ID NO: 1546007 - RNA, 23 nt, Human adenovirus B [HAdV-B]
gagcuuaagcauuccaccgccca

SEQ ID NO: 1546008 - RNA, 19 nt, Human adenovirus B [HAdV-B]
ccagaccauuaacuuugau

SEQ ID NO: 1546009 - RNA, 11 nt, Human adenovirus B [HAdV-B]
ggaaguuucag

SEQ ID NO: 1546010 - RNA, 20 nt, Human adenovirus B [HAdV-B]
ccucccgacggugcugcagu

SEQ ID NO: 1546011 - RNA, 15 nt, Human adenovirus B [HAdV-B]
ccagcacgacugccu

SEQ ID NO: 1546012 - RNA, 15 nt, Human adenovirus B [HAdV-B]
cugggcagcuaggac

SEQ ID NO: 1546013 - RNA, 16 nt, Human adenovirus B [HAdV-B]
uuacugacgccagacg

SEQ ID NO: 1546014 - RNA, 15 nt, Human adenovirus B [HAdV-B]
acuggcuaccuauca

SEQ ID NO: 1546015 - RNA, 22 nt, Human adenovirus B [HAdV-B]
ccuucuccggaucuccugggca

SEQ ID NO: 1546016 - RNA, 19 nt, Human adenovirus B [HAdV-B]
gacagcaaccccaggccaa

SEQ ID NO: 1546017 - RNA, 16 nt, Human adenovirus B [HAdV-B]
cccaaucgcgaagagg

SEQ ID NO: 1546018 - RNA, 20 nt, Human adenovirus B [HAdV-B]
agaacuggauuuccugccac

SEQ ID NO: 1546019 - RNA, 17 nt, Human adenovirus B [HAdV-B]
cucucauaggaccccca

SEQ ID NO: 1546020 - RNA, 19 nt, Human adenovirus B [HAdV-B]
ugcucagugucuugugacu

SEQ ID NO: 1546021 - RNA, 14 nt, Human adenovirus B [HAdV-B]
uugcuaacgcugga

SEQ ID NO: 1546022 - RNA, 14 nt, Human adenovirus B [HAdV-B]
gugcuuugagacug

SEQ ID NO: 1546023 - RNA, 19 nt, Human adenovirus B [HAdV-B]
ggagcuuaccuuuggaagu

SEQ ID NO: 1546024 - RNA, 15 nt, Human adenovirus B [HAdV-B]
agaugccuuucauga

SEQ ID NO: 1546025 - RNA, 21 nt, Human adenovirus B [HAdV-B]
ggaucacagagacgagccugg

SEQ ID NO: 1546026 - RNA, 19 nt, Human adenovirus B [HAdV-B]
cugcggagcagagcagguc

SEQ ID NO: 1546027 - RNA, 14 nt, Human adenovirus B [HAdV-B]
auggcagggaagug

SEQ ID NO: 1546028 - RNA, 18 nt, Human adenovirus B [HAdV-B]
gacuuuaugagccagagc

SEQ ID NO: 1546029 - RNA, 12 nt, Human adenovirus B [HAdV-B]
aagggaaaugcc

SEQ ID NO: 1546030 - RNA, 13 nt, Human adenovirus B [HAdV-B]
gagucgaggaacc

SEQ ID NO: 1546031 - RNA, 15 nt, Human adenovirus B [HAdV-B]
acuggaggcucccuu

SEQ ID NO: 1546032 - RNA, 20 nt, Human adenovirus B [HAdV-B]
gucaaauuuuagcuccucuc

SEQ ID NO: 1546033 - RNA, 17 nt, Human adenovirus B [HAdV-B]
aaagcgugcugcacagc

SEQ ID NO: 1546034 - RNA, 22 nt, Human adenovirus B [HAdV-B]
ucaguguggaagagcucagccg

SEQ ID NO: 1546035 - RNA, 14 nt, Human adenovirus B [HAdV-B]
ugagcugcgucacg

SEQ ID NO: 1546036 - RNA, 21 nt, Human adenovirus B [HAdV-B]
aaggucgcagugcaugguguu

SEQ ID NO: 1546037 - RNA, 14 nt, Human adenovirus B [HAdV-B]
aaucauaauccgaa

SEQ ID NO: 1546038 - RNA, 19 nt, Human adenovirus B [HAdV-B]
cucagccauugcugucaac

SEQ ID NO: 1546039 - RNA, 14 nt, Human adenovirus B [HAdV-B]
ggcugcagccaacc

SEQ ID NO: 1546040 - RNA, 14 nt, Human adenovirus B [HAdV-B]
gacagaaacacaga

SEQ ID NO: 1546041 - RNA, 15 nt, Human adenovirus B [HAdV-B]
cgaggaaaaggagca

SEQ ID NO: 1546042 - RNA, 21 nt, Human adenovirus B [HAdV-B]
augcuggcuacugugcauauu

SEQ ID NO: 1546043 - RNA, 17 nt, Human adenovirus B [HAdV-B]
uagaaugcauucuucug

SEQ ID NO: 1546044 - RNA, 11 nt, Human adenovirus B [HAdV-B]
agaagaggaag

SEQ ID NO: 1546045 - RNA, 23 nt, Human adenovirus B [HAdV-B]
uacgaccagacggaaucuuucag

SEQ ID NO: 1546046 - RNA, 15 nt, Human adenovirus B [HAdV-B]
cuuucuguuuacaga

SEQ ID NO: 1546047 - RNA, 21 nt, Human adenovirus B [HAdV-B]
aucggcacgagccaacugaac

SEQ ID NO: 1546048 - RNA, 14 nt, Human adenovirus B [HAdV-B]
gaguacuuggaaga

SEQ ID NO: 1546049 - RNA, 13 nt, Human adenovirus B [HAdV-B]
ucacagagacgag

SEQ ID NO: 1546050 - RNA, 14 nt, Human adenovirus B [HAdV-B]
gcucuaugccaacu

SEQ ID NO: 1546051 - RNA, 13 nt, Human adenovirus B [HAdV-B]
cgaguacuuggaa

SEQ ID NO: 1546052 - RNA, 20 nt, Human adenovirus B [HAdV-B]
ccuuggaagagguuccaaag

SEQ ID NO: 1546053 - RNA, 19 nt, Human adenovirus B [HAdV-B]
gaaaguauggaagugcaaa

SEQ ID NO: 1546054 - RNA, 15 nt, Human adenovirus B [HAdV-B]
gauuaugcaagguaa

SEQ ID NO: 1546055 - RNA, 14 nt, Human adenovirus B [HAdV-B]
ccuccaguggagga

SEQ ID NO: 1546056 - RNA, 16 nt, Human adenovirus B [HAdV-B]
cugcguucgcucacca

SEQ ID NO: 1546057 - RNA, 14 nt, Human adenovirus B [HAdV-B]
guuucugguggugc

SEQ ID NO: 1546058 - RNA, 12 nt, Human adenovirus B [HAdV-B]
gaacaguaagaa

SEQ ID NO: 1546059 - RNA, 20 nt, Human adenovirus B [HAdV-B]
uacuaaggguugcauucacu

SEQ ID NO: 1546060 - RNA, 14 nt, Human adenovirus B [HAdV-B]
aacagugcaggcag

SEQ ID NO: 1546061 - RNA, 14 nt, Human adenovirus B [HAdV-B]
cuuugagacugaug

SEQ ID NO: 1546062 - RNA, 21 nt, Human adenovirus B [HAdV-B]
cagcuuuugcugugccagaag

SEQ ID NO: 1546063 - RNA, 14 nt, Human adenovirus B [HAdV-B]
cugauugccacaga

SEQ ID NO: 1546064 - RNA, 20 nt, Human adenovirus B [HAdV-B]
accaggaacuucaagcuggg

SEQ ID NO: 1546065 - RNA, 14 nt, Human adenovirus B [HAdV-B]
gcgcgggcaaacac

SEQ ID NO: 1546066 - RNA, 13 nt, Human adenovirus B [HAdV-B]
ccgacugcagcac

SEQ ID NO: 1546067 - RNA, 18 nt, Human adenovirus B [HAdV-B]
uauggaagugcaaacuga

SEQ ID NO: 1546068 - RNA, 17 nt, Human adenovirus B [HAdV-B]
acagcaaccccaggcca

SEQ ID NO: 1546069 - RNA, 14 nt, Human adenovirus B [HAdV-B]
gcuuaccuuuggaa

SEQ ID NO: 1546070 - RNA, 13 nt, Human adenovirus B [HAdV-B]
guccucagcgacg

SEQ ID NO: 1546071 - RNA, 16 nt, Human adenovirus B [HAdV-B]
auacaacaauuuccac

SEQ ID NO: 1546072 - RNA, 20 nt, Human adenovirus B [HAdV-B]
cuugcuggagugucacugcc

SEQ ID NO: 1546073 - RNA, 18 nt, Human adenovirus B [HAdV-B]
accaaugccaucuuaaac

SEQ ID NO: 1546074 - RNA, 14 nt, Human adenovirus B [HAdV-B]
guaucgcaaugaca

SEQ ID NO: 1546075 - RNA, 23 nt, Human adenovirus B [HAdV-B]
uagagcgagccguagacgccagc

SEQ ID NO: 1546076 - RNA, 16 nt, Human adenovirus B [HAdV-B]
cuuucaagauggccac

SEQ ID NO: 1546077 - RNA, 12 nt, Human adenovirus B [HAdV-B]
gaguuaaaucau

SEQ ID NO: 1546078 - RNA, 14 nt, Human adenovirus B [HAdV-B]
gaacgaaacuuuuc

SEQ ID NO: 1546079 - RNA, 17 nt, Human adenovirus B [HAdV-B]
aagcuaaggcaaacaua

SEQ ID NO: 1546080 - RNA, 21 nt, Human adenovirus B [HAdV-B]
uggaggaagauugggacaguc

SEQ ID NO: 1546081 - RNA, 15 nt, Human adenovirus B [HAdV-B]
gccagcgguucugga

SEQ ID NO: 1546082 - RNA, 19 nt, Human adenovirus B [HAdV-B]
ucagauaaggcguaguguu

SEQ ID NO: 1546083 - RNA, 16 nt, Human adenovirus B [HAdV-B]
agcagcaggcgacggc

SEQ ID NO: 1546084 - RNA, 13 nt, Human adenovirus B [HAdV-B]
caugggcaccugg

SEQ ID NO: 1546085 - RNA, 19 nt, Human adenovirus B [HAdV-B]
gaugcaauccccacuggag

SEQ ID NO: 1546086 - RNA, 20 nt, Human adenovirus B [HAdV-B]
cgcgcgguuagcgccagcag

SEQ ID NO: 1546087 - RNA, 12 nt, Human adenovirus B [HAdV-B]
ccuuugcugucu

SEQ ID NO: 1546088 - RNA, 17 nt, Human adenovirus B [HAdV-B]
aguugcgccucuucucu

SEQ ID NO: 1546089 - RNA, 19 nt, Human adenovirus B [HAdV-B]
uacaugggcaccuggagcg

SEQ ID NO: 1546090 - RNA, 17 nt, Human adenovirus B [HAdV-B]
augacccagaugccugu

SEQ ID NO: 1546091 - RNA, 18 nt, Human adenovirus B [HAdV-B]
agguggacgagcagaccu

SEQ ID NO: 1546092 - RNA, 12 nt, Human adenovirus B [HAdV-B]
caagcaggagag

SEQ ID NO: 1546093 - RNA, 16 nt, Human adenovirus B [HAdV-B]
ccugccaccaccucua

SEQ ID NO: 1546094 - RNA, 11 nt, Human adenovirus B [HAdV-B]
cccugcugcua

SEQ ID NO: 1546095 - RNA, 14 nt, Human adenovirus B [HAdV-B]
uguacucccagcag

SEQ ID NO: 1546096 - RNA, 13 nt, Human adenovirus B [HAdV-B]
ucgcaaccccgcu

SEQ ID NO: 1546097 - RNA, 18 nt, Human adenovirus B [HAdV-B]
ugucucugaagaaaugca

SEQ ID NO: 1546098 - RNA, 13 nt, Human adenovirus B [HAdV-B]
uugcaugaaagcc

SEQ ID NO: 1546099 - RNA, 21 nt, Human adenovirus B [HAdV-B]
augaaggcgaggaggaagagg

SEQ ID NO: 1546100 - RNA, 15 nt, Human adenovirus B [HAdV-B]
uauaauucuaugaaa

SEQ ID NO: 1546101 - RNA, 19 nt, Human adenovirus B [HAdV-B]
agugcaccuacacccugcu

SEQ ID NO: 1546102 - RNA, 13 nt, Human adenovirus B [HAdV-B]
uggugaacaccaa

SEQ ID NO: 1546103 - RNA, 23 nt, Human adenovirus B [HAdV-B]
gcccaaugcaacaugaccaaaga

SEQ ID NO: 1546104 - RNA, 19 nt, Human adenovirus B [HAdV-B]
ucgagccggccggagccgc

SEQ ID NO: 1546105 - RNA, 13 nt, Human adenovirus B [HAdV-B]
guuaaaucaucau

SEQ ID NO: 1546106 - RNA, 14 nt, Human adenovirus B [HAdV-B]
cgagcugccagugc

SEQ ID NO: 1546107 - RNA, 14 nt, Human adenovirus B [HAdV-B]
ccucaaaacuccac

SEQ ID NO: 1546108 - RNA, 22 nt, Human adenovirus B [HAdV-B]
ucagucgcgcuuugggacagga

SEQ ID NO: 1546109 - RNA, 19 nt, Human adenovirus B [HAdV-B]
cagguuaucgcaccugaag

SEQ ID NO: 1546110 - RNA, 17 nt, Human adenovirus B [HAdV-B]
uuugacaugaacaugca

SEQ ID NO: 1546111 - RNA, 15 nt, Human adenovirus B [HAdV-B]
cagcaccucacuucc

SEQ ID NO: 1546112 - RNA, 19 nt, Human adenovirus B [HAdV-B]
cugacuuuaugagccagag

SEQ ID NO: 1546113 - RNA, 17 nt, Human adenovirus B [HAdV-B]
cugccuccuugcagaua

SEQ ID NO: 1546114 - RNA, 19 nt, Human adenovirus B [HAdV-B]
uucuggggucuuguugcca

SEQ ID NO: 1546115 - RNA, 15 nt, Human adenovirus B [HAdV-B]
auacaauccagacau

SEQ ID NO: 1546116 - RNA, 23 nt, Human adenovirus B [HAdV-B]
caccgagcuaccacugccaugcg

SEQ ID NO: 1546117 - RNA, 13 nt, Human adenovirus B [HAdV-B]
ugcaggucugccu

SEQ ID NO: 1546118 - RNA, 18 nt, Human adenovirus B [HAdV-B]
auccacaagacccagagg

SEQ ID NO: 1546119 - RNA, 21 nt, Human adenovirus B [HAdV-B]
cucgcacuuagaagauacuga

SEQ ID NO: 1546120 - RNA, 20 nt, Human adenovirus B [HAdV-B]
gaaauauggagcccagcaug

SEQ ID NO: 1546121 - RNA, 21 nt, Human adenovirus B [HAdV-B]
cugaaucauaauauugccaug

SEQ ID NO: 1546122 - RNA, 17 nt, Human adenovirus B [HAdV-B]
ccgcuuucgcagcggcg

SEQ ID NO: 1546123 - RNA, 14 nt, Human adenovirus B [HAdV-B]
ucaaacugcacacu

SEQ ID NO: 1546124 - RNA, 20 nt, Human adenovirus B [HAdV-B]
agagcgugaugcagcagcag

SEQ ID NO: 1546125 - RNA, 14 nt, Human adenovirus B [HAdV-B]
uuguaucuggugga

SEQ ID NO: 1546126 - RNA, 18 nt, Human adenovirus B [HAdV-B]
gcaguuauugacagugua

SEQ ID NO: 1546127 - RNA, 17 nt, Human adenovirus B [HAdV-B]
ccuguuccgucuggcca

SEQ ID NO: 1546128 - RNA, 17 nt, Human adenovirus B [HAdV-B]
gcaugaccucugcacuc

SEQ ID NO: 1546129 - RNA, 15 nt, Human adenovirus B [HAdV-B]
cuacagagucucuga

SEQ ID NO: 1546130 - RNA, 11 nt, Human adenovirus B [HAdV-B]
ggagcagagcu

SEQ ID NO: 1546131 - RNA, 20 nt, Human adenovirus B [HAdV-B]
ugccauucucgagcugccag

SEQ ID NO: 1546132 - RNA, 20 nt, Human adenovirus B [HAdV-B]
auaacaaaaccuggaacaau

SEQ ID NO: 1546133 - RNA, 12 nt, Human adenovirus B [HAdV-B]
ugaauguuccuu

SEQ ID NO: 1546134 - RNA, 22 nt, Human adenovirus B [HAdV-B]
cagaacugaagugcccaucagu

SEQ ID NO: 1546135 - RNA, 18 nt, Human adenovirus B [HAdV-B]
gcccaucaguguggaaga

SEQ ID NO: 1546136 - RNA, 21 nt, Human adenovirus B [HAdV-B]
aacgaauuuucucccagcggc

SEQ ID NO: 1546137 - RNA, 16 nt, Human adenovirus B [HAdV-B]
aauuggcgcgauacca

SEQ ID NO: 1546138 - RNA, 18 nt, Human adenovirus B [HAdV-B]
cgaugggucuucuccugg

SEQ ID NO: 1546139 - RNA, 17 nt, Human adenovirus B [HAdV-B]
ugaaauuaugugcauuu

SEQ ID NO: 1546140 - RNA, 19 nt, Human adenovirus B [HAdV-B]
ggcugcgguccgaccugga

SEQ ID NO: 1546141 - RNA, 20 nt, Human adenovirus B [HAdV-B]
aucccgccaaacccaacaca

SEQ ID NO: 1546142 - RNA, 13 nt, Human adenovirus B [HAdV-B]
agauuacagccaa

SEQ ID NO: 1546143 - RNA, 23 nt, Human adenovirus B [HAdV-B]
ccucgcggugaccagcaugaaua

SEQ ID NO: 1546144 - RNA, 17 nt, Human adenovirus B [HAdV-B]
ggccgaacuuucggccu

SEQ ID NO: 1546145 - RNA, 12 nt, Human adenovirus B [HAdV-B]
ucagaaauuccc

SEQ ID NO: 1546146 - RNA, 16 nt, Human adenovirus B [HAdV-B]
agcgcuaccaucuccg

SEQ ID NO: 1546147 - RNA, 17 nt, Human adenovirus B [HAdV-B]
cggaggguccuccuccu

SEQ ID NO: 1546148 - RNA, 20 nt, Human adenovirus B [HAdV-B]
gcuauggagucacugcuacc

SEQ ID NO: 1546149 - RNA, 21 nt, Human adenovirus B [HAdV-B]
gccuuguaagggcagcagccc

SEQ ID NO: 1546150 - RNA, 19 nt, Human adenovirus B [HAdV-B]
cuccguagccuggaggaac

SEQ ID NO: 1546151 - RNA, 22 nt, Human adenovirus B [HAdV-B]
auuuccacuucaacaaucagca

SEQ ID NO: 1546152 - RNA, 18 nt, Human adenovirus B [HAdV-B]
gcuccuucugaaucauaa

SEQ ID NO: 1546153 - RNA, 21 nt, Human adenovirus B [HAdV-B]
auuggagcaguaucuggagcg

SEQ ID NO: 1546154 - RNA, 19 nt, Human adenovirus B [HAdV-B]
uacccuugguuugaugcau

SEQ ID NO: 1546155 - RNA, 15 nt, Human adenovirus B [HAdV-B]
guaacagaagaggaa

SEQ ID NO: 1546156 - RNA, 15 nt, Human adenovirus B [HAdV-B]
cgaugacaauucucu

SEQ ID NO: 1546157 - RNA, 20 nt, Human adenovirus B [HAdV-B]
auuugauuuuggcuggaaug

SEQ ID NO: 1546158 - RNA, 14 nt, Human adenovirus B [HAdV-B]
guccguugaaauua

SEQ ID NO: 1546159 - RNA, 19 nt, Human adenovirus B [HAdV-B]
caccugcugcgcacugccc

SEQ ID NO: 1546160 - RNA, 13 nt, Human adenovirus B [HAdV-B]
auucagaaaccuu

SEQ ID NO: 1546161 - RNA, 17 nt, Human adenovirus B [HAdV-B]
ugaauuagucugcaaaa

SEQ ID NO: 1546162 - RNA, 12 nt, Human adenovirus B [HAdV-B]
gcagcgaagugg

SEQ ID NO: 1546163 - RNA, 15 nt, Human adenovirus B [HAdV-B]
gucagcauugucacu

SEQ ID NO: 1546164 - RNA, 20 nt, Human adenovirus B [HAdV-B]
gccauacccuaccaacacaa

SEQ ID NO: 1546165 - RNA, 14 nt, Human adenovirus B [HAdV-B]
gcaguacaggacag

SEQ ID NO: 1546166 - RNA, 22 nt, Human adenovirus B [HAdV-B]
cuguagugccuucccgcucuaa

SEQ ID NO: 1546167 - RNA, 13 nt, Human adenovirus B [HAdV-B]
gacagucaggcag

SEQ ID NO: 1546168 - RNA, 15 nt, Human adenovirus B [HAdV-B]
cagcuaaagaccauc

SEQ ID NO: 1546169 - RNA, 20 nt, Human adenovirus B [HAdV-B]
agacgagccugggaucaugg

SEQ ID NO: 1546170 - RNA, 16 nt, Human adenovirus B [HAdV-B]
gcccaguccugccacc

SEQ ID NO: 1546171 - RNA, 14 nt, Human adenovirus B [HAdV-B]
gcuugacucucugg

SEQ ID NO: 1546172 - RNA, 23 nt, Human adenovirus B [HAdV-B]
gacuuuaccccuacggaagccag

SEQ ID NO: 1546173 - RNA, 15 nt, Human adenovirus B [HAdV-B]
gaucccauggaugag

SEQ ID NO: 1546174 - RNA, 19 nt, Human adenovirus B [HAdV-B]
gccaucuuccagcagaguc

SEQ ID NO: 1546175 - RNA, 19 nt, Human adenovirus B [HAdV-B]
aaauuuuggcucaaccaua

SEQ ID NO: 1546176 - RNA, 14 nt, Human adenovirus B [HAdV-B]
gggucuucuccugg

SEQ ID NO: 1546177 - RNA, 14 nt, Human adenovirus B [HAdV-B]
cagaacuugaaaga

SEQ ID NO: 1546178 - RNA, 13 nt, Human adenovirus B [HAdV-B]
agcugacuugcag

SEQ ID NO: 1546179 - RNA, 20 nt, Human adenovirus B [HAdV-B]
gccugacuuuaugagccaga

SEQ ID NO: 1546180 - RNA, 12 nt, Human adenovirus B [HAdV-B]
guaccugugcca

SEQ ID NO: 1546181 - RNA, 18 nt, Human adenovirus B [HAdV-B]
cauuguggagaacaugga

SEQ ID NO: 1546182 - RNA, 21 nt, Human adenovirus B [HAdV-B]
aggauccuuagauaugugcag

SEQ ID NO: 1546183 - RNA, 14 nt, Human adenovirus B [HAdV-B]
caacuucacauaca

SEQ ID NO: 1546184 - RNA, 23 nt, Human adenovirus B [HAdV-B]
acaacaauuuccacuucaacaau

SEQ ID NO: 1546185 - RNA, 20 nt, Human adenovirus B [HAdV-B]
gaggcggaugaaggcgagga

SEQ ID NO: 1546186 - RNA, 18 nt, Human adenovirus B [HAdV-B]
gcuggauauggccagcac

SEQ ID NO: 1546187 - RNA, 15 nt, Human adenovirus B [HAdV-B]
cagcuccgccagucc

SEQ ID NO: 1546188 - RNA, 20 nt, Human adenovirus B [HAdV-B]
cagacauggaaacucagcca

SEQ ID NO: 1546189 - RNA, 12 nt, Human adenovirus B [HAdV-B]
ucccaucacugg

SEQ ID NO: 1546190 - RNA, 18 nt, Human adenovirus B [HAdV-B]
gucuaucuguaccugugc

SEQ ID NO: 1546191 - RNA, 17 nt, Human adenovirus B [HAdV-B]
ccuuccaguacucuucu

SEQ ID NO: 1546192 - RNA, 15 nt, Human adenovirus B [HAdV-B]
acaauacaauuucca

SEQ ID NO: 1546193 - RNA, 13 nt, Human adenovirus B [HAdV-B]
ugcaacccccagu

SEQ ID NO: 1546194 - RNA, 18 nt, Human adenovirus B [HAdV-B]
gauaugugcagcagagcg

SEQ ID NO: 1546195 - RNA, 20 nt, Human adenovirus B [HAdV-B]
uccaacagaaaaccagcagc

SEQ ID NO: 1546196 - RNA, 22 nt, Human adenovirus B [HAdV-B]
ugcaaaucuggaagauccugag

SEQ ID NO: 1546197 - RNA, 22 nt, Human adenovirus B [HAdV-B]
uacacaccuugcuucacuuucu

SEQ ID NO: 1546198 - RNA, 18 nt, Human adenovirus B [HAdV-B]
cauacucgcgugccaggc

SEQ ID NO: 1546199 - RNA, 23 nt, Human adenovirus B [HAdV-B]
cggugaugcaauccccacuggag

SEQ ID NO: 1546200 - RNA, 18 nt, Human adenovirus B [HAdV-B]
cuccuccuucguacgaga

SEQ ID NO: 1546201 - RNA, 23 nt, Human adenovirus B [HAdV-B]
ugcgacaucuagaccacugccgc

SEQ ID NO: 1546202 - RNA, 22 nt, Human adenovirus B [HAdV-B]
ccaacaccuuaaucccagaaau

SEQ ID NO: 1546203 - RNA, 18 nt, Human adenovirus B [HAdV-B]
cguuaaccccacagccaa

SEQ ID NO: 1546204 - RNA, 16 nt, Human adenovirus B [HAdV-B]
agcuuuugcugugcca

SEQ ID NO: 1546205 - RNA, 17 nt, Human adenovirus B [HAdV-B]
uguuggauugccacagc

SEQ ID NO: 1546206 - RNA, 21 nt, Human adenovirus B [HAdV-B]
uccaucagcagacacaucacu

SEQ ID NO: 1546207 - RNA, 21 nt, Human adenovirus B [HAdV-B]
ucguacgagagcgugaugcag

SEQ ID NO: 1546208 - RNA, 16 nt, Human adenovirus B [HAdV-B]
ccuuuauuccaaugug

SEQ ID NO: 1546209 - RNA, 19 nt, Human adenovirus B [HAdV-B]
gugcccaucaguguggaag

SEQ ID NO: 1546210 - RNA, 19 nt, Human adenovirus B [HAdV-B]
cugcuacaaguugcgccuc

SEQ ID NO: 1546211 - RNA, 12 nt, Human adenovirus B [HAdV-B]
acaauucucuag

SEQ ID NO: 1546212 - RNA, 15 nt, Human adenovirus B [HAdV-B]
acuugggugggagag

SEQ ID NO: 1546213 - RNA, 17 nt, Human adenovirus B [HAdV-B]
uagucuguuccacaguu

SEQ ID NO: 1546214 - RNA, 21 nt, Human adenovirus B [HAdV-B]
aucacaauuaggaccagugcu

SEQ ID NO: 1546215 - RNA, 23 nt, Human adenovirus B [HAdV-B]
ugccugacuuuaugagccagagc

SEQ ID NO: 1546216 - RNA, 16 nt, Human adenovirus B [HAdV-B]
ggcgaggaggaagagg

SEQ ID NO: 1546217 - RNA, 20 nt, Human adenovirus B [HAdV-B]
ccugcauggugggaaucaac

SEQ ID NO: 1546218 - RNA, 19 nt, Human adenovirus B [HAdV-B]
aaugggaguaaaguguaaa

SEQ ID NO: 1546219 - RNA, 13 nt, Human adenovirus B [HAdV-B]
gggcggguggugc

SEQ ID NO: 1546220 - RNA, 20 nt, Human adenovirus B [HAdV-B]
cuggacuacuugcacagagc

SEQ ID NO: 1546221 - RNA, 21 nt, Human adenovirus B [HAdV-B]
ccauccgaguaucaucacuua

SEQ ID NO: 1546222 - RNA, 15 nt, Human adenovirus B [HAdV-B]
uccgacugcagaauc

SEQ ID NO: 1546223 - RNA, 16 nt, Human adenovirus B [HAdV-B]
cuccuaggcagagaaa

SEQ ID NO: 1546224 - RNA, 18 nt, Human adenovirus B [HAdV-B]
ugccaucuuccagcagag

SEQ ID NO: 1546225 - RNA, 15 nt, Human adenovirus B [HAdV-B]
gguucuguggacagg

SEQ ID NO: 1546226 - RNA, 16 nt, Human adenovirus B [HAdV-B]
gucuuuccaucacaag

SEQ ID NO: 1546227 - RNA, 14 nt, Human adenovirus B [HAdV-B]
cauaagauucuuga

SEQ ID NO: 1546228 - RNA, 21 nt, Human adenovirus B [HAdV-B]
ccuggaaggcggaugacuggc

SEQ ID NO: 1546229 - RNA, 13 nt, Human adenovirus B [HAdV-B]
ugaaaugggcaug

SEQ ID NO: 1546230 - RNA, 15 nt, Human adenovirus B [HAdV-B]
cagccuguacuucuc

SEQ ID NO: 1546231 - RNA, 18 nt, Human adenovirus B [HAdV-B]
gugccaggcacuuccauu

SEQ ID NO: 1546232 - RNA, 16 nt, Human adenovirus B [HAdV-B]
aagauugggacaguca

SEQ ID NO: 1546233 - RNA, 18 nt, Human adenovirus B [HAdV-B]
ugucucugaccaugacuu

SEQ ID NO: 1546234 - RNA, 18 nt, Human adenovirus B [HAdV-B]
ucaucugggccaaacugg

SEQ ID NO: 1546235 - RNA, 21 nt, Human adenovirus B [HAdV-B]
guggcagccuagucgcagggc

SEQ ID NO: 1546236 - RNA, 15 nt, Human adenovirus B [HAdV-B]
gaucaaaagaaaugc

SEQ ID NO: 1546237 - RNA, 16 nt, Human adenovirus B [HAdV-B]
gaggaaaaggagcaga

SEQ ID NO: 1546238 - RNA, 12 nt, Human adenovirus B [HAdV-B]
cuucuugcuuac

SEQ ID NO: 1546239 - RNA, 16 nt, Human adenovirus B [HAdV-B]
ugaucacaaugugaug

SEQ ID NO: 1546240 - RNA, 18 nt, Human adenovirus B [HAdV-B]
cuucagcuugcccucaua

SEQ ID NO: 1546241 - RNA, 18 nt, Human adenovirus B [HAdV-B]
ggccuaagagaccugcua

SEQ ID NO: 1546242 - RNA, 13 nt, Human adenovirus B [HAdV-B]
agacgagccuggg

SEQ ID NO: 1546243 - RNA, 22 nt, Human adenovirus B [HAdV-B]
aggucccgcaggcaagcagccg

SEQ ID NO: 1546244 - RNA, 18 nt, Human adenovirus B [HAdV-B]
gcuguuucugguggugca

SEQ ID NO: 1546245 - RNA, 18 nt, Human adenovirus B [HAdV-B]
agaaguaccucagagcga

SEQ ID NO: 1546246 - RNA, 11 nt, Human adenovirus B [HAdV-B]
accaaugccau

SEQ ID NO: 1546247 - RNA, 12 nt, Human adenovirus B [HAdV-B]
caucagccaugg

SEQ ID NO: 1546248 - RNA, 15 nt, Human adenovirus B [HAdV-B]
cuauuuagagacaga

SEQ ID NO: 1546249 - RNA, 14 nt, Human adenovirus B [HAdV-B]
agcagagcguggga

SEQ ID NO: 1546250 - RNA, 22 nt, Human adenovirus B [HAdV-B]
cagcauuaucgcugcagugaca

SEQ ID NO: 1546251 - RNA, 16 nt, Human adenovirus B [HAdV-B]
gcaaggccccagcagc

SEQ ID NO: 1546252 - RNA, 23 nt, Human adenovirus B [HAdV-B]
uucggacggagucuccgguuuuu

SEQ ID NO: 1546253 - RNA, 15 nt, Human adenovirus B [HAdV-B]
uguccuccaagauuu

SEQ ID NO: 1546254 - RNA, 20 nt, Human adenovirus B [HAdV-B]
cagaauaaaaaagcgaaaga

SEQ ID NO: 1546255 - RNA, 19 nt, Human adenovirus B [HAdV-B]
ucagacucauccugcuggu

SEQ ID NO: 1546256 - RNA, 14 nt, Human adenovirus B [HAdV-B]
ucaggaugucccaa

SEQ ID NO: 1546257 - RNA, 18 nt, Human adenovirus B [HAdV-B]
aaauuuaccugcauggug

SEQ ID NO: 1546258 - RNA, 21 nt, Human adenovirus B [HAdV-B]
uaacuguucacugguuuuuau

SEQ ID NO: 1546259 - RNA, 15 nt, Human adenovirus B [HAdV-B]
ccuggcagaacacac

SEQ ID NO: 1546260 - RNA, 17 nt, Human adenovirus B [HAdV-B]
agguguauuucacguga

SEQ ID NO: 1546261 - RNA, 18 nt, Human adenovirus B [HAdV-B]
guuucuguauugcaggag

SEQ ID NO: 1546262 - RNA, 22 nt, Human adenovirus B [HAdV-B]
cacucuuccagaaaacaaaaac

SEQ ID NO: 1546263 - RNA, 21 nt, Human adenovirus B [HAdV-B]
ccgguauccugcccgccaccu

SEQ ID NO: 1546264 - RNA, 23 nt, Human adenovirus B [HAdV-B]
caaugaauaaauaaacaagcuug

SEQ ID NO: 1546265 - RNA, 12 nt, Human adenovirus B [HAdV-B]
uccgacugcagc

SEQ ID NO: 1546266 - RNA, 15 nt, Human adenovirus B [HAdV-B]
auucacacagcagcg

SEQ ID NO: 1546267 - RNA, 20 nt, Human adenovirus B [HAdV-B]
cucggcugcggagacaagca

SEQ ID NO: 1546268 - RNA, 22 nt, Human adenovirus B [HAdV-B]
cuggcagaacaaggaagaccac

SEQ ID NO: 1546269 - RNA, 16 nt, Human adenovirus B [HAdV-B]
ccggauugcagcacug

SEQ ID NO: 1546270 - RNA, 18 nt, Human adenovirus B [HAdV-B]
ucacagagacgagccugg

SEQ ID NO: 1546271 - RNA, 20 nt, Human adenovirus B [HAdV-B]
auugcucaccaccucagaug

SEQ ID NO: 1546272 - RNA, 15 nt, Human adenovirus B [HAdV-B]
gucuuacugccuggc

SEQ ID NO: 1546273 - RNA, 16 nt, Human adenovirus B [HAdV-B]
uuugaaaaauguugaa

SEQ ID NO: 1546274 - RNA, 16 nt, Human adenovirus B [HAdV-B]
cuccuuuagccagagg

SEQ ID NO: 1546275 - RNA, 17 nt, Human adenovirus B [HAdV-B]
ggcuugacggggaagac

SEQ ID NO: 1546276 - RNA, 17 nt, Human adenovirus B [HAdV-B]
gcagcacuggacaugac

SEQ ID NO: 1546277 - RNA, 16 nt, Human adenovirus B [HAdV-B]
auuucaccaaugccau

SEQ ID NO: 1546278 - RNA, 12 nt, Human adenovirus B [HAdV-B]
cacuccacagcu

SEQ ID NO: 1546279 - RNA, 14 nt, Human adenovirus B [HAdV-B]
caaggccccagcag

SEQ ID NO: 1546280 - RNA, 22 nt, Human adenovirus B [HAdV-B]
cacgguuuggaccgaagacgag

SEQ ID NO: 1546281 - RNA, 22 nt, Human adenovirus B [HAdV-B]
uacguccacuggacgggauagg

SEQ ID NO: 1546282 - RNA, 15 nt, Human adenovirus B [HAdV-B]
gagagccggccugga

SEQ ID NO: 1546283 - RNA, 14 nt, Human adenovirus B [HAdV-B]
ccaucaucgugcuc

SEQ ID NO: 1546284 - RNA, 19 nt, Human adenovirus B [HAdV-B]
cucaagguccggcccacgg

SEQ ID NO: 1546285 - RNA, 16 nt, Human adenovirus B [HAdV-B]
uugcgccaacaccugu

SEQ ID NO: 1546286 - RNA, 23 nt, Human adenovirus B [HAdV-B]
ugacguucccucaaaaacacacu

SEQ ID NO: 1546287 - RNA, 16 nt, Human adenovirus B [HAdV-B]
aggagcggagccuggg

SEQ ID NO: 1546288 - RNA, 23 nt, Human adenovirus B [HAdV-B]
gcacgucuucaaccgcuuuccug

SEQ ID NO: 1546289 - RNA, 21 nt, Human adenovirus B [HAdV-B]
ucgaagcaagggggccaccuc

SEQ ID NO: 1546290 - RNA, 14 nt, Human adenovirus B [HAdV-B]
uacgagcagacagu

SEQ ID NO: 1546291 - RNA, 22 nt, Human adenovirus B [HAdV-B]
caaaaauaaaaaaaaaaacaag

SEQ ID NO: 1546292 - RNA, 13 nt, Human adenovirus B [HAdV-B]
ugcgggggcaaca

SEQ ID NO: 1546293 - RNA, 18 nt, Human adenovirus B [HAdV-B]
uccagguguaaguuucca

SEQ ID NO: 1546294 - RNA, 23 nt, Human adenovirus B [HAdV-B]
aucuugcaggucugccuacccau

SEQ ID NO: 1546295 - RNA, 23 nt, Human adenovirus B [HAdV-B]
uacggaagccagcacccagacca

SEQ ID NO: 1546296 - RNA, 22 nt, Human adenovirus B [HAdV-B]
gccagcgccaugacagacagag

SEQ ID NO: 1546297 - RNA, 16 nt, Human adenovirus B [HAdV-B]
gcgcaaguuugcuccg

SEQ ID NO: 1546298 - RNA, 19 nt, Human adenovirus B [HAdV-B]
cagcccaugagcaggcagg

SEQ ID NO: 1546299 - RNA, 16 nt, Human adenovirus B [HAdV-B]
gguguguuggacagag

SEQ ID NO: 1546300 - RNA, 19 nt, Human adenovirus B [HAdV-B]
cauggguauucugcaugag

SEQ ID NO: 1546301 - RNA, 18 nt, Human adenovirus B [HAdV-B]
augaacgaucgcgguggg

SEQ ID NO: 1546302 - RNA, 21 nt, Human adenovirus B [HAdV-B]
cauuaagcagguagcgccugg

SEQ ID NO: 1546303 - RNA, 16 nt, Human adenovirus B [HAdV-B]
gacgauuggacccagg

SEQ ID NO: 1546304 - RNA, 22 nt, Human adenovirus B [HAdV-B]
acuugucgccuucgcguuccca

SEQ ID NO: 1546305 - RNA, 16 nt, Human adenovirus B [HAdV-B]
cucugacuggagcugg

SEQ ID NO: 1546306 - RNA, 17 nt, Human adenovirus B [HAdV-B]
ccuggcagaacacacuc

SEQ ID NO: 1546307 - RNA, 21 nt, Human adenovirus B [HAdV-B]
cagcacggugggaucugcaau

SEQ ID NO: 1546308 - RNA, 16 nt, Human adenovirus B [HAdV-B]
cucagccauugcuguc

SEQ ID NO: 1546309 - RNA, 20 nt, Human adenovirus B [HAdV-B]
cugcaacgggugcuuacugg

SEQ ID NO: 1546310 - RNA, 14 nt, Human adenovirus B [HAdV-B]
ccaucaucuccugc

SEQ ID NO: 1546311 - RNA, 18 nt, Human adenovirus B [HAdV-B]
cacugguggccaccucgc

SEQ ID NO: 1546312 - RNA, 16 nt, Human adenovirus B [HAdV-B]
guaucaaggcucugca

SEQ ID NO: 1546313 - RNA, 14 nt, Human adenovirus B [HAdV-B]
uuuucuuacuuuua

SEQ ID NO: 1546314 - RNA, 22 nt, Human adenovirus B [HAdV-B]
cccaggccaugcaacguaucau

SEQ ID NO: 1546315 - RNA, 21 nt, Human adenovirus B [HAdV-B]
cugaaaguauggaagugcaaa

SEQ ID NO: 1546316 - RNA, 23 nt, Human adenovirus B [HAdV-B]
cuccguuccggagacagggagga

SEQ ID NO: 1546317 - RNA, 18 nt, Human adenovirus B [HAdV-B]
cuaucuguaccugugcca

SEQ ID NO: 1546318 - RNA, 15 nt, Human adenovirus B [HAdV-B]
aucacuuccaugccu

SEQ ID NO: 1546319 - RNA, 19 nt, Human adenovirus B [HAdV-B]
ccaugauaauagcaauggg

SEQ ID NO: 1546320 - RNA, 17 nt, Human adenovirus B [HAdV-B]
uuuauuugaaaaucaau

SEQ ID NO: 1546321 - RNA, 23 nt, Human adenovirus B [HAdV-B]
gaugcggcaucgcagaaaacaaa

SEQ ID NO: 1546322 - RNA, 22 nt, Human adenovirus B [HAdV-B]
uauggccaauaccaaacuuaua

SEQ ID NO: 1546323 - RNA, 19 nt, Human adenovirus B [HAdV-B]
caacucagcucaugcucug

SEQ ID NO: 1546324 - RNA, 20 nt, Human adenovirus B [HAdV-B]
uccugcccgccaccugcugc

SEQ ID NO: 1546325 - RNA, 22 nt, Human adenovirus B [HAdV-B]
cauaauuaaaagcgcuccagcc

SEQ ID NO: 1546326 - RNA, 15 nt, Human adenovirus B [HAdV-B]
guuaggucugugggg

SEQ ID NO: 1546327 - RNA, 14 nt, Human adenovirus B [HAdV-B]
uccgaccuggcaga

SEQ ID NO: 1546328 - RNA, 18 nt, Human adenovirus B [HAdV-B]
cagaaguaccucagagcg

SEQ ID NO: 1546329 - RNA, 17 nt, Human adenovirus B [HAdV-B]
ccuugaagccaugcugc

SEQ ID NO: 1546330 - RNA, 13 nt, Human adenovirus B [HAdV-B]
ccgacugcagaau

SEQ ID NO: 1546331 - RNA, 18 nt, Human adenovirus B [HAdV-B]
aguaaauggaacaaguga

SEQ ID NO: 1546332 - RNA, 19 nt, Human adenovirus B [HAdV-B]
gauuugauggaagcuauca

SEQ ID NO: 1546333 - RNA, 15 nt, Human adenovirus B [HAdV-B]
cuacccuagaagaua

SEQ ID NO: 1546334 - RNA, 16 nt, Human adenovirus B [HAdV-B]
ccauuguguucuccua

SEQ ID NO: 1546335 - RNA, 16 nt, Human adenovirus B [HAdV-B]
uacuuggaagacugau

SEQ ID NO: 1546336 - RNA, 14 nt, Human adenovirus B [HAdV-B]
guugguuaaucaug

SEQ ID NO: 1546337 - RNA, 15 nt, Human adenovirus B [HAdV-B]
gaugguuauaaugga

SEQ ID NO: 1546338 - RNA, 15 nt, Human adenovirus B [HAdV-B]
cucccgacggugcug

SEQ ID NO: 1546339 - RNA, 22 nt, Human adenovirus B [HAdV-B]
ccacaauauauauauacacaag

SEQ ID NO: 1546340 - RNA, 22 nt, Human adenovirus B [HAdV-B]
cucccagcagcaccucacuucc

SEQ ID NO: 1546341 - RNA, 21 nt, Human adenovirus B [HAdV-B]
uuugagaaauugguauuugaa

SEQ ID NO: 1546342 - RNA, 17 nt, Human adenovirus B [HAdV-B]
ucuucgggggcagaggu

SEQ ID NO: 1546343 - RNA, 22 nt, Human adenovirus B [HAdV-B]
ugucauagacguagaugggauc

SEQ ID NO: 1546344 - RNA, 20 nt, Human adenovirus B [HAdV-B]
ucagagaggcgcugcugaac

SEQ ID NO: 1546345 - RNA, 19 nt, Human adenovirus B [HAdV-B]
uugacugaugucuugcaug

SEQ ID NO: 1546346 - RNA, 22 nt, Human adenovirus B [HAdV-B]
ccuuguagugcuaggaauucuu

SEQ ID NO: 1546347 - RNA, 10 nt, Human adenovirus B [HAdV-B]
uuugccaaaa

SEQ ID NO: 1546348 - RNA, 15 nt, Human adenovirus B [HAdV-B]
ugauuacuuugauau

SEQ ID NO: 1546349 - RNA, 16 nt, Human adenovirus B [HAdV-B]
aucuguaccugugcca

SEQ ID NO: 1546350 - RNA, 18 nt, Human adenovirus B [HAdV-B]
cuuaugcccgucuucuca

SEQ ID NO: 1546351 - RNA, 18 nt, Human adenovirus B [HAdV-B]
accuguaucgcgaagcca

SEQ ID NO: 1546352 - RNA, 15 nt, Human adenovirus B [HAdV-B]
aauuuccaauccaac

SEQ ID NO: 1546353 - RNA, 18 nt, Human adenovirus B [HAdV-B]
ggcgcugcagagccagcc

SEQ ID NO: 1546354 - RNA, 20 nt, Human adenovirus B [HAdV-B]
accugaagucuacggccaac

SEQ ID NO: 1546355 - RNA, 20 nt, Human adenovirus B [HAdV-B]
augaugaaggauccugucac

SEQ ID NO: 1546356 - RNA, 20 nt, Human adenovirus B [HAdV-B]
cagaccgucagccaugggca

SEQ ID NO: 1546357 - RNA, 21 nt, Human adenovirus B [HAdV-B]
gccagacucgcaguacucaag

SEQ ID NO: 1546358 - RNA, 20 nt, Human adenovirus B [HAdV-B]
cauggaagcuguagugccuu

SEQ ID NO: 1546359 - RNA, 15 nt, Human adenovirus B [HAdV-B]
agguggucucuggau

SEQ ID NO: 1546360 - RNA, 22 nt, Human adenovirus B [HAdV-B]
caaaguaaaaggcacaggagaa

SEQ ID NO: 1546361 - RNA, 14 nt, Human adenovirus B [HAdV-B]
acagcaacuucuug

SEQ ID NO: 1546362 - RNA, 16 nt, Human adenovirus B [HAdV-B]
ccacacgauccacacu

SEQ ID NO: 1546363 - RNA, 16 nt, Human adenovirus B [HAdV-B]
agggugagaauuacuu

SEQ ID NO: 1546364 - RNA, 14 nt, Human adenovirus B [HAdV-B]
cacauacaaagccu

SEQ ID NO: 1546365 - RNA, 20 nt, Human adenovirus B [HAdV-B]
uuaauauaaauuaaaugacg

SEQ ID NO: 1546366 - RNA, 21 nt, Human adenovirus B [HAdV-B]
cagauucaaugauugcaauug

SEQ ID NO: 1546367 - RNA, 17 nt, Human adenovirus B [HAdV-B]
ccaaccaagcaaugcaa

SEQ ID NO: 1546368 - RNA, 13 nt, Human adenovirus B [HAdV-B]
uaaagcuggcaga

SEQ ID NO: 1546369 - RNA, 18 nt, Human adenovirus B [HAdV-B]
gcuuccgaccuggcagac

SEQ ID NO: 1546370 - RNA, 12 nt, Human adenovirus B [HAdV-B]
cagcaguacagg

SEQ ID NO: 1546371 - RNA, 15 nt, Human adenovirus B [HAdV-B]
acguggaacucacca

SEQ ID NO: 1546372 - RNA, 22 nt, Human adenovirus B [HAdV-B]
acugccgcugcaaucugugcac

SEQ ID NO: 1546373 - RNA, 20 nt, Human adenovirus B [HAdV-B]
cuaaaggcgcuccaaauaca

SEQ ID NO: 1546374 - RNA, 17 nt, Human adenovirus B [HAdV-B]
cuuuggguauaauuaug

SEQ ID NO: 1546375 - RNA, 17 nt, Human adenovirus B [HAdV-B]
agaauuucuacugaaaa

SEQ ID NO: 1546376 - RNA, 18 nt, Human adenovirus B [HAdV-B]
ucccaguagguuuggaag

SEQ ID NO: 1546377 - RNA, 22 nt, Human adenovirus B [HAdV-B]
cugauuauuucaccaaugccau

SEQ ID NO: 1546378 - RNA, 13 nt, Human adenovirus B [HAdV-B]
ucaaaugcucacu

SEQ ID NO: 1546379 - RNA, 18 nt, Human adenovirus B [HAdV-B]
acugcacacuaaaaggac

SEQ ID NO: 1546380 - RNA, 18 nt, Human adenovirus B [HAdV-B]
cuucgacaugggagcuga

SEQ ID NO: 1546381 - RNA, 19 nt, Human adenovirus B [HAdV-B]
auuaguuuaaaagagguuc

SEQ ID NO: 1546382 - RNA, 22 nt, Human adenovirus B [HAdV-B]
uaugcaucugcgccgcaggagg

SEQ ID NO: 1546383 - RNA, 15 nt, Human adenovirus B [HAdV-B]
ccaguugaaaaccac

SEQ ID NO: 1546384 - RNA, 16 nt, Human adenovirus B [HAdV-B]
cugcccgccaccugcu

SEQ ID NO: 1546385 - RNA, 20 nt, Human adenovirus B [HAdV-B]
gaccuuucauuaacaaacug

SEQ ID NO: 1546386 - RNA, 17 nt, Human adenovirus B [HAdV-B]
agaggucaucugggcca

SEQ ID NO: 1546387 - RNA, 21 nt, Human adenovirus B [HAdV-B]
augcaaacacaugucacccuc

SEQ ID NO: 1546388 - RNA, 13 nt, Human adenovirus B [HAdV-B]
cagucaggcagag

SEQ ID NO: 1546389 - RNA, 15 nt, Human adenovirus B [HAdV-B]
uccagguguaaguuu

SEQ ID NO: 1546390 - RNA, 13 nt, Human adenovirus B [HAdV-B]
gaccucaucuucc

SEQ ID NO: 1546391 - RNA, 17 nt, Human adenovirus B [HAdV-B]
ggcauggaugagcauca

SEQ ID NO: 1546392 - RNA, 17 nt, Human adenovirus B [HAdV-B]
ucagacuagcagacagg

SEQ ID NO: 1546393 - RNA, 14 nt, Human adenovirus B [HAdV-B]
ucaccugggcagcu

SEQ ID NO: 1546394 - RNA, 19 nt, Human adenovirus B [HAdV-B]
gccagcgguucuggaggag

SEQ ID NO: 1546395 - RNA, 13 nt, Human adenovirus B [HAdV-B]
uguagaaaaagau

SEQ ID NO: 1546396 - RNA, 16 nt, Human adenovirus B [HAdV-B]
ccaaguagcaguuuac

SEQ ID NO: 1546397 - RNA, 21 nt, Human adenovirus B [HAdV-B]
gccaggguucgguccuuccag

SEQ ID NO: 1546398 - RNA, 17 nt, Human adenovirus B [HAdV-B]
cccucaaaaacacacua

SEQ ID NO: 1546399 - RNA, 13 nt, Human adenovirus B [HAdV-B]
gcugguuuccgaa

SEQ ID NO: 1546400 - RNA, 16 nt, Human adenovirus B [HAdV-B]
caaagccuacugccac

SEQ ID NO: 1546401 - RNA, 17 nt, Human adenovirus B [HAdV-B]
caccauucuuaaacaca

SEQ ID NO: 1546402 - RNA, 12 nt, Human adenovirus B [HAdV-B]
augaaaaacacc

SEQ ID NO: 1546403 - RNA, 20 nt, Human adenovirus B [HAdV-B]
gcuuaacuugccuaucugug

SEQ ID NO: 1546404 - RNA, 22 nt, Human adenovirus B [HAdV-B]
uacuggaucuacguccacugga

SEQ ID NO: 1546405 - RNA, 23 nt, Human adenovirus B [HAdV-B]
cugcacagccggcaucauucaca

SEQ ID NO: 1546406 - RNA, 15 nt, Human adenovirus B [HAdV-B]
cgauccaugcuucug

SEQ ID NO: 1546407 - RNA, 19 nt, Human adenovirus B [HAdV-B]
aagcggcgaggagccggag

SEQ ID NO: 1546408 - RNA, 21 nt, Human adenovirus B [HAdV-B]
ugcaacuggauuguguuucaa

SEQ ID NO: 1546409 - RNA, 11 nt, Human adenovirus B [HAdV-B]
ccaacaccugu

SEQ ID NO: 1546410 - RNA, 21 nt, Human adenovirus B [HAdV-B]
gguagcugaaacccacugcua

SEQ ID NO: 1546411 - RNA, 14 nt, Human adenovirus B [HAdV-B]
guuccgucuggcca

SEQ ID NO: 1546412 - RNA, 21 nt, Human adenovirus B [HAdV-B]
gucuuacugccuggcugcgga

SEQ ID NO: 1546413 - RNA, 18 nt, Human adenovirus B [HAdV-B]
gccagcgguucuggagga

SEQ ID NO: 1546414 - RNA, 15 nt, Human adenovirus B [HAdV-B]
gcucuuacugcggag

SEQ ID NO: 1546415 - RNA, 21 nt, Human adenovirus B [HAdV-B]
auuugugggauuugauggaag

SEQ ID NO: 1546416 - RNA, 21 nt, Human adenovirus B [HAdV-B]
gaaauaugagugguucgaguu

SEQ ID NO: 1546417 - RNA, 14 nt, Human adenovirus B [HAdV-B]
cgaagccauagggc

SEQ ID NO: 1546418 - RNA, 20 nt, Human adenovirus B [HAdV-B]
auuuacuaacuagacucuca

SEQ ID NO: 1546419 - RNA, 23 nt, Human adenovirus B [HAdV-B]
ucagcagacacaucacuuccaug

SEQ ID NO: 1546420 - RNA, 21 nt, Human adenovirus B [HAdV-B]
aucauucccugcagaaaucuu

SEQ ID NO: 1546421 - RNA, 17 nt, Human adenovirus B [HAdV-B]
aagggagaaaauggcau

SEQ ID NO: 1546422 - RNA, 21 nt, Human adenovirus B [HAdV-B]
ccuacuugcgcaaguuugcuc

SEQ ID NO: 1546423 - RNA, 15 nt, Human adenovirus B [HAdV-B]
acuccguagccugga

SEQ ID NO: 1546424 - RNA, 15 nt, Human adenovirus B [HAdV-B]
gcuuggaaugcccac

SEQ ID NO: 1546425 - RNA, 15 nt, Human adenovirus B [HAdV-B]
uggacuuggaagagg

SEQ ID NO: 1546426 - RNA, 18 nt, Human adenovirus B [HAdV-B]
gugcgccugcuugggcgc

SEQ ID NO: 1546427 - RNA, 23 nt, Human adenovirus B [HAdV-B]
acaccaaucucuccccacgcaca

SEQ ID NO: 1546428 - RNA, 22 nt, Human adenovirus B [HAdV-B]
cgaggguggaaucauguccacc

SEQ ID NO: 1546429 - RNA, 22 nt, Human adenovirus B [HAdV-B]
cucggacgauuggacccaggcc

SEQ ID NO: 1546430 - RNA, 20 nt, Human adenovirus B [HAdV-B]
ucggcuuacgagcagacagu

SEQ ID NO: 1546431 - RNA, 22 nt, Human adenovirus B [HAdV-B]
caagguaauuaaauccacacug

SEQ ID NO: 1546432 - RNA, 16 nt, Human adenovirus B [HAdV-B]
ccaccgagcuaccacu

SEQ ID NO: 1546433 - RNA, 20 nt, Human adenovirus B [HAdV-B]
ugagcgccgcgacggcagga

SEQ ID NO: 1546434 - RNA, 18 nt, Human adenovirus B [HAdV-B]
gggaacucauugaguuca

SEQ ID NO: 1546435 - RNA, 15 nt, Human adenovirus B [HAdV-B]
uuucauagccacagc

SEQ ID NO: 1546436 - RNA, 22 nt, Human adenovirus B [HAdV-B]
agcuguagugccuucccgcucu

SEQ ID NO: 1546437 - RNA, 20 nt, Human adenovirus B [HAdV-B]
accuugacccccagaccggc

SEQ ID NO: 1546438 - RNA, 12 nt, Human adenovirus B [HAdV-B]
caaggaggugaa

SEQ ID NO: 1546439 - RNA, 18 nt, Human adenovirus B [HAdV-B]
caaaucaugaacuccagu

SEQ ID NO: 1546440 - RNA, 11 nt, Human adenovirus B [HAdV-B]
gggggcagagg

SEQ ID NO: 1546441 - RNA, 13 nt, Human adenovirus B [HAdV-B]
acacggcacgaag

SEQ ID NO: 1546442 - RNA, 21 nt, Human adenovirus B [HAdV-B]
ugacgaaaaugccggccaauu

SEQ ID NO: 1546443 - RNA, 21 nt, Human adenovirus B [HAdV-B]
caguguggaagagcucagccg

SEQ ID NO: 1546444 - RNA, 13 nt, Human adenovirus B [HAdV-B]
gcucaccaccuca

SEQ ID NO: 1546445 - RNA, 21 nt, Human adenovirus B [HAdV-B]
uccgcgauugugucuaucugu

SEQ ID NO: 1546446 - RNA, 14 nt, Human adenovirus B [HAdV-B]
aguucaucgggagg

SEQ ID NO: 1546447 - RNA, 20 nt, Human adenovirus B [HAdV-B]
cccggcggcgucccagcagu

SEQ ID NO: 1546448 - RNA, 18 nt, Human adenovirus B [HAdV-B]
gaugguuauaauggaaua

SEQ ID NO: 1546449 - RNA, 20 nt, Human adenovirus B [HAdV-B]
aaucaugcaacccaauauaa

SEQ ID NO: 1546450 - RNA, 20 nt, Human adenovirus B [HAdV-B]
aggaggcggaguagcugacu

SEQ ID NO: 1546451 - RNA, 15 nt, Human adenovirus B [HAdV-B]
gaagauuaccacccc

SEQ ID NO: 1546452 - RNA, 19 nt, Human adenovirus B [HAdV-B]
gaaaauguaaauuuggaaa

SEQ ID NO: 1546453 - RNA, 18 nt, Human adenovirus B [HAdV-B]
cagaaugacccgcaggca

SEQ ID NO: 1546454 - RNA, 19 nt, Human adenovirus B [HAdV-B]
gugcucaacgguggcuucc

SEQ ID NO: 1546455 - RNA, 14 nt, Human adenovirus B [HAdV-B]
caaaacaaaaccaa

SEQ ID NO: 1546456 - RNA, 22 nt, Human adenovirus B [HAdV-B]
uccauggagguuugggccauuu

SEQ ID NO: 1546457 - RNA, 14 nt, Human adenovirus B [HAdV-B]
cauguaugcagaaa

SEQ ID NO: 1546458 - RNA, 12 nt, Human adenovirus B [HAdV-B]
gcugccagugcg

SEQ ID NO: 1546459 - RNA, 16 nt, Human adenovirus B [HAdV-B]
agcaguaucuggagcg

SEQ ID NO: 1546460 - RNA, 14 nt, Human adenovirus B [HAdV-B]
gcacacaaagcaca

SEQ ID NO: 1546461 - RNA, 21 nt, Human adenovirus B [HAdV-B]
gcgugcaauggcgugggcgca

SEQ ID NO: 1546462 - RNA, 16 nt, Human adenovirus B [HAdV-B]
cuccagcaaaaacaag

SEQ ID NO: 1546463 - RNA, 19 nt, Human adenovirus B [HAdV-B]
uccagacaugaugaaggau

SEQ ID NO: 1546464 - RNA, 14 nt, Human adenovirus B [HAdV-B]
cuaggcagagaaac

SEQ ID NO: 1546465 - RNA, 15 nt, Human adenovirus B [HAdV-B]
gacauggaaacucag

SEQ ID NO: 1546466 - RNA, 20 nt, Human adenovirus B [HAdV-B]
auugcaaggccccagcagcc

SEQ ID NO: 1546467 - RNA, 11 nt, Human adenovirus B [HAdV-B]
gccggaggaga

SEQ ID NO: 1546468 - RNA, 18 nt, Human adenovirus B [HAdV-B]
uauagcuuccuuggaaga

SEQ ID NO: 1546469 - RNA, 15 nt, Human adenovirus B [HAdV-B]
cuuuccugagaacca

SEQ ID NO: 1546470 - RNA, 18 nt, Human adenovirus B [HAdV-B]
aauacaauggacucugac

SEQ ID NO: 1546471 - RNA, 18 nt, Human adenovirus B [HAdV-B]
guuguuggaaccagaugc

SEQ ID NO: 1546472 - RNA, 22 nt, Human adenovirus B [HAdV-B]
ggaauguuuaugccuuaccagu

SEQ ID NO: 1546473 - RNA, 15 nt, Human adenovirus B [HAdV-B]
gagucggugagcucu

SEQ ID NO: 1546474 - RNA, 17 nt, Human adenovirus B [HAdV-B]
ucugaacuaucagaaug

SEQ ID NO: 1546475 - RNA, 14 nt, Human adenovirus B [HAdV-B]
agcagagcaggucu

SEQ ID NO: 1546476 - RNA, 15 nt, Human adenovirus B [HAdV-B]
aauuaagacucuccu

SEQ ID NO: 1546477 - RNA, 19 nt, Human adenovirus B [HAdV-B]
aguucuuguagugaggaaa

SEQ ID NO: 1546478 - RNA, 15 nt, Human adenovirus B [HAdV-B]
cgugacgcugccacc

SEQ ID NO: 1546479 - RNA, 16 nt, Human adenovirus B [HAdV-B]
caagcagacaccaggg

SEQ ID NO: 1546480 - RNA, 15 nt, Human adenovirus B [HAdV-B]
ggaauccugaggcau

SEQ ID NO: 1546481 - RNA, 22 nt, Human adenovirus B [HAdV-B]
acgcacagccuguacauuccca

SEQ ID NO: 1546482 - RNA, 15 nt, Human adenovirus B [HAdV-B]
gcaagucuguugaug

SEQ ID NO: 1546483 - RNA, 19 nt, Human adenovirus B [HAdV-B]
cuuccgcaaucccaacagg

SEQ ID NO: 1546484 - RNA, 15 nt, Human adenovirus B [HAdV-B]
agcgugcugcacagc

SEQ ID NO: 1546485 - RNA, 23 nt, Human adenovirus B [HAdV-B]
ucccacucaugagaagguccugg

SEQ ID NO: 1546486 - RNA, 22 nt, Human adenovirus B [HAdV-B]
gcucuaccccauuccugccaau

SEQ ID NO: 1546487 - RNA, 21 nt, Human adenovirus B [HAdV-B]
gaaucauaauauugccaugca

SEQ ID NO: 1546488 - RNA, 23 nt, Human adenovirus B [HAdV-B]
gauccuuagauaugugcagcaga

SEQ ID NO: 1546489 - RNA, 17 nt, Human adenovirus B [HAdV-B]
cgauuggacccaggcca

SEQ ID NO: 1546490 - RNA, 15 nt, Human adenovirus B [HAdV-B]
gauggccguggugcu

SEQ ID NO: 1546491 - RNA, 19 nt, Human adenovirus B [HAdV-B]
gcucccuuugugccuccgc

SEQ ID NO: 1546492 - RNA, 20 nt, Human adenovirus B [HAdV-B]
cgagucggugagcucuccgc

SEQ ID NO: 1546493 - RNA, 17 nt, Human adenovirus B [HAdV-B]
caaccauaaaaacauac

SEQ ID NO: 1546494 - RNA, 21 nt, Human adenovirus B [HAdV-B]
ggccaacuaucucuccuacca

SEQ ID NO: 1546495 - RNA, 12 nt, Human adenovirus B [HAdV-B]
ccagcagcggca

SEQ ID NO: 1546496 - RNA, 16 nt, Human adenovirus B [HAdV-B]
agcgccagcaggaggc

SEQ ID NO: 1546497 - RNA, 14 nt, Human adenovirus B [HAdV-B]
gaccacgguggugc

SEQ ID NO: 1546498 - RNA, 12 nt, Human adenovirus B [HAdV-B]
cuucacacaaag

SEQ ID NO: 1546499 - RNA, 13 nt, Human adenovirus B [HAdV-B]
ucaagauggccac

SEQ ID NO: 1546500 - RNA, 18 nt, Human adenovirus B [HAdV-B]
ggcggaugaaggcgagga

SEQ ID NO: 1546501 - RNA, 18 nt, Human adenovirus B [HAdV-B]
aggcaauguauacugggu

SEQ ID NO: 1546502 - RNA, 15 nt, Human adenovirus B [HAdV-B]
gagcaauaaaugacg

SEQ ID NO: 1546503 - RNA, 18 nt, Human adenovirus B [HAdV-B]
uguucccagaguuggaag

SEQ ID NO: 1546504 - RNA, 18 nt, Human adenovirus B [HAdV-B]
caauuaggaccagugcuu

SEQ ID NO: 1546505 - RNA, 21 nt, Human adenovirus B [HAdV-B]
ucagcauuggcaaugcugaac

SEQ ID NO: 1546506 - RNA, 23 nt, Human adenovirus B [HAdV-B]
uggcuacugugcauauuguuucc

SEQ ID NO: 1546507 - RNA, 16 nt, Human adenovirus B [HAdV-B]
aacccccacuacuccc

SEQ ID NO: 1546508 - RNA, 16 nt, Human adenovirus B [HAdV-B]
gguggggcggucagcu

SEQ ID NO: 1546509 - RNA, 18 nt, Human adenovirus B [HAdV-B]
cuggauguuuuauuuuga

SEQ ID NO: 1546510 - RNA, 19 nt, Human adenovirus B [HAdV-B]
gacaucuagaccacugccg

SEQ ID NO: 1546511 - RNA, 21 nt, Human adenovirus B [HAdV-B]
accccagguagaacugcugcu

SEQ ID NO: 1546512 - RNA, 18 nt, Human adenovirus B [HAdV-B]
gcuuacaacucccuggcu

SEQ ID NO: 1546513 - RNA, 18 nt, Human adenovirus B [HAdV-B]
gaacccuacuagcaaacc

SEQ ID NO: 1546514 - RNA, 21 nt, Human adenovirus B [HAdV-B]
uagaauaagucgcccgaguuu

SEQ ID NO: 1546515 - RNA, 12 nt, Human adenovirus B [HAdV-B]
ugcucugcaaaa

SEQ ID NO: 1546516 - RNA, 19 nt, Human adenovirus B [HAdV-B]
aggcagaggaggcggagga

SEQ ID NO: 1546517 - RNA, 20 nt, Human adenovirus B [HAdV-B]
cgauuagcgagucaguggac

SEQ ID NO: 1546518 - RNA, 20 nt, Human adenovirus B [HAdV-B]
auggcgaucccgaaaaagga

SEQ ID NO: 1546519 - RNA, 17 nt, Human adenovirus B [HAdV-B]
guccuggcgggggcaua

SEQ ID NO: 1546520 - RNA, 18 nt, Human adenovirus B [HAdV-B]
agcauaugcaaaucccaa

SEQ ID NO: 1546521 - RNA, 14 nt, Human adenovirus B [HAdV-B]
cgaaguugaugaaa

SEQ ID NO: 1546522 - RNA, 17 nt, Human adenovirus B [HAdV-B]
acagcaguagccacagc

SEQ ID NO: 1546523 - RNA, 11 nt, Human adenovirus B [HAdV-B]
aucuguugcac

SEQ ID NO: 1546524 - RNA, 21 nt, Human adenovirus B [HAdV-B]
aaaugccggccaauugccauu

SEQ ID NO: 1546525 - RNA, 18 nt, Human adenovirus B [HAdV-B]
gccuacaucuacugugga

SEQ ID NO: 1546526 - RNA, 16 nt, Human adenovirus B [HAdV-B]
uuaccaguguaacaug

SEQ ID NO: 1546527 - RNA, 17 nt, Human adenovirus B [HAdV-B]
caguccugccaccaccu

SEQ ID NO: 1546528 - RNA, 16 nt, Human adenovirus B [HAdV-B]
cagccaaacggcaccu

SEQ ID NO: 1546529 - RNA, 16 nt, Human adenovirus B [HAdV-B]
cagcgcugccaggguu

SEQ ID NO: 1546530 - RNA, 20 nt, Human adenovirus B [HAdV-B]
ugcgcacgggcggguagcug

SEQ ID NO: 1546531 - RNA, 16 nt, Human adenovirus B [HAdV-B]
uguuaauucaucuggc

SEQ ID NO: 1546532 - RNA, 13 nt, Human adenovirus B [HAdV-B]
agauacaugggca

SEQ ID NO: 1546533 - RNA, 13 nt, Human adenovirus B [HAdV-B]
gacagaacugaag

SEQ ID NO: 1546534 - RNA, 15 nt, Human adenovirus B [HAdV-B]
gcgauaaugccagac

SEQ ID NO: 1546535 - RNA, 19 nt, Human adenovirus B [HAdV-B]
uccccccaaacgucagcca

SEQ ID NO: 1546536 - RNA, 20 nt, Human adenovirus B [HAdV-B]
cagcaguacaggacaggcgc

SEQ ID NO: 1546537 - RNA, 21 nt, Human adenovirus B [HAdV-B]
acacacucuucuucgccuucu

SEQ ID NO: 1546538 - RNA, 20 nt, Human adenovirus B [HAdV-B]
cugacuuuaugagccagagc

SEQ ID NO: 1546539 - RNA, 22 nt, Human adenovirus B [HAdV-B]
gcucaucaaagguuaggucugu

SEQ ID NO: 1546540 - RNA, 14 nt, Human adenovirus B [HAdV-B]
auguuuaaccccac

SEQ ID NO: 1546541 - RNA, 20 nt, Human adenovirus B [HAdV-B]
ugcgaucuggccauguucau

SEQ ID NO: 1546542 - RNA, 20 nt, Human adenovirus B [HAdV-B]
cagaaccuauuuagagacag

SEQ ID NO: 1546543 - RNA, 22 nt, Human adenovirus B [HAdV-B]
guuucucuucgggggcagaggu

SEQ ID NO: 1546544 - RNA, 12 nt, Human adenovirus B [HAdV-B]
gccgaugugucu

SEQ ID NO: 1546545 - RNA, 15 nt, Human adenovirus B [HAdV-B]
ggcaggcaugcaaga

SEQ ID NO: 1546546 - RNA, 14 nt, Human adenovirus B [HAdV-B]
cagcugcugcagaa

SEQ ID NO: 1546547 - RNA, 21 nt, Human adenovirus B [HAdV-B]
gagcaguaucuggagcgggcu

SEQ ID NO: 1546548 - RNA, 11 nt, Human adenovirus B [HAdV-B]
augaauuaaaa

SEQ ID NO: 1546549 - RNA, 16 nt, Human adenovirus B [HAdV-B]
caucgcagaaaacaaa

SEQ ID NO: 1546550 - RNA, 12 nt, Human adenovirus B [HAdV-B]
uacauggcuccg

SEQ ID NO: 1546551 - RNA, 16 nt, Human adenovirus B [HAdV-B]
ucccagggauuuggaa

SEQ ID NO: 1546552 - RNA, 20 nt, Human adenovirus B [HAdV-B]
gaugagcccacccugcuuua

SEQ ID NO: 1546553 - RNA, 14 nt, Human adenovirus B [HAdV-B]
gcgaggagccggag

SEQ ID NO: 1546554 - RNA, 21 nt, Human adenovirus B [HAdV-B]
augguuguagcuuuuuugguu

SEQ ID NO: 1546555 - RNA, 16 nt, Human adenovirus B [HAdV-B]
ccugcggagcagagca

SEQ ID NO: 1546556 - RNA, 20 nt, Human adenovirus B [HAdV-B]
ucuuuagcgaucuucucaau

SEQ ID NO: 1546557 - RNA, 17 nt, Human adenovirus B [HAdV-B]
uggauccagauauucaa

SEQ ID NO: 1546558 - RNA, 20 nt, Human adenovirus B [HAdV-B]
uacuucuccaucagcagaca

SEQ ID NO: 1546559 - RNA, 18 nt, Human adenovirus B [HAdV-B]
cgguucaggccucgcaac

SEQ ID NO: 1546560 - RNA, 23 nt, Human adenovirus B [HAdV-B]
aggaugauugggagguggccauu

SEQ ID NO: 1546561 - RNA, 17 nt, Human adenovirus B [HAdV-B]
aguaacuuuuguaaaug

SEQ ID NO: 1546562 - RNA, 15 nt, Human adenovirus B [HAdV-B]
gcuacagcugcugca

SEQ ID NO: 1546563 - RNA, 14 nt, Human adenovirus B [HAdV-B]
ugaagccaugcugc

SEQ ID NO: 1546564 - RNA, 13 nt, Human adenovirus B [HAdV-B]
gcaugggaugggu

SEQ ID NO: 1546565 - RNA, 16 nt, Human adenovirus B [HAdV-B]
aagacuaggcaacugu

SEQ ID NO: 1546566 - RNA, 12 nt, Human adenovirus B [HAdV-B]
aaaaauggccug

SEQ ID NO: 1546567 - RNA, 20 nt, Human adenovirus B [HAdV-B]
gccaccaucccgaauaccgc

SEQ ID NO: 1546568 - RNA, 14 nt, Human adenovirus B [HAdV-B]
ccaugacagacaga

SEQ ID NO: 1546569 - RNA, 14 nt, Human adenovirus B [HAdV-B]
gccaugacagacag

SEQ ID NO: 1546570 - RNA, 11 nt, Human adenovirus B [HAdV-B]
cacuggcugcc

SEQ ID NO: 1546571 - RNA, 17 nt, Human adenovirus B [HAdV-B]
uauuguucguguugcuc

SEQ ID NO: 1546572 - RNA, 21 nt, Human adenovirus B [HAdV-B]
gaauugcaaggccccagcagc

SEQ ID NO: 1546573 - RNA, 19 nt, Human adenovirus B [HAdV-B]
aggacaaaaaagaagagga

SEQ ID NO: 1546574 - RNA, 13 nt, Human adenovirus B [HAdV-B]
cucucgaggacgc

SEQ ID NO: 1546575 - RNA, 19 nt, Human adenovirus B [HAdV-B]
gcuccgccaguccaccucg

SEQ ID NO: 1546576 - RNA, 23 nt, Human adenovirus B [HAdV-B]
auuugccauucucgagcugccag

SEQ ID NO: 1546577 - RNA, 13 nt, Human adenovirus B [HAdV-B]
cguguugcucagg

SEQ ID NO: 1546578 - RNA, 24 nt, Human adenovirus B [HAdV-B]
aacuuggacugaccuugauggaaa

SEQ ID NO: 1546579 - RNA, 18 nt, Human adenovirus B [HAdV-B]
cuuaccggcucugggcau

SEQ ID NO: 1546580 - RNA, 19 nt, Human adenovirus B [HAdV-B]
ccaucaucgugcucagugu

SEQ ID NO: 1546581 - RNA, 13 nt, Human adenovirus B [HAdV-B]
auuuccauuccuu

SEQ ID NO: 1546582 - RNA, 20 nt, Human adenovirus B [HAdV-B]
auuuacauauuggcaccauu

SEQ ID NO: 1546583 - RNA, 17 nt, Human adenovirus B [HAdV-B]
cucgauaaucugcuccu

SEQ ID NO: 1546584 - RNA, 18 nt, Human adenovirus B [HAdV-B]
gugcugcacagcacccug

SEQ ID NO: 1546585 - RNA, 20 nt, Human adenovirus B [HAdV-B]
gaguuuaaugggcgaagagg

SEQ ID NO: 1546586 - RNA, 14 nt, Human adenovirus B [HAdV-B]
gacuugggacagaa

SEQ ID NO: 1546587 - RNA, 20 nt, Human adenovirus B [HAdV-B]
ggaagagcucagccgcgccu

SEQ ID NO: 1546588 - RNA, 14 nt, Human adenovirus B [HAdV-B]
agcaggaacugaaa

SEQ ID NO: 1546589 - RNA, 17 nt, Human adenovirus B [HAdV-B]
uauaauggaauaguguu

SEQ ID NO: 1546590 - RNA, 14 nt, Human adenovirus B [HAdV-B]
uaccaggaaagucc

SEQ ID NO: 1546591 - RNA, 13 nt, Human adenovirus B [HAdV-B]
cgaggaggcagag

SEQ ID NO: 1546592 - RNA, 22 nt, Human adenovirus B [HAdV-B]
ccugcuugggcgcuugccaggg

SEQ ID NO: 1546593 - RNA, 20 nt, Human adenovirus B [HAdV-B]
acauaucuggaaauggggcu

SEQ ID NO: 1546594 - RNA, 19 nt, Human adenovirus B [HAdV-B]
cuccaacagaaaaccagca

SEQ ID NO: 1546595 - RNA, 18 nt, Human adenovirus B [HAdV-B]
gagucugagacagacauc

SEQ ID NO: 1546596 - RNA, 23 nt, Human adenovirus B [HAdV-B]
gacggaugucucacgcuugccag

SEQ ID NO: 1546597 - RNA, 15 nt, Human adenovirus B [HAdV-B]
uuggacggcuccugg

SEQ ID NO: 1546598 - RNA, 18 nt, Human adenovirus B [HAdV-B]
guacagcgggcacacaaa

SEQ ID NO: 1546599 - RNA, 15 nt, Human adenovirus B [HAdV-B]
ugcaaggccccagca

SEQ ID NO: 1546600 - RNA, 15 nt, Human adenovirus B [HAdV-B]
ucuauucugguucua

SEQ ID NO: 1546601 - RNA, 20 nt, Human adenovirus B [HAdV-B]
gucuaucuguaccugugcca

SEQ ID NO: 1546602 - RNA, 17 nt, Human adenovirus B [HAdV-B]
cgagaaaaaacagccaa

SEQ ID NO: 1546603 - RNA, 21 nt, Human adenovirus B [HAdV-B]
gagucugagacagacaucgag

SEQ ID NO: 1546604 - RNA, 17 nt, Human adenovirus B [HAdV-B]
ugucacuccacagcuuu

SEQ ID NO: 1546605 - RNA, 18 nt, Human adenovirus B [HAdV-B]
gcguccagcgcugccagg

SEQ ID NO: 1546606 - RNA, 13 nt, Human adenovirus B [HAdV-B]
uucuuaacagugc

SEQ ID NO: 1546607 - RNA, 23 nt, Human adenovirus B [HAdV-B]
ucuacuucaaccccuucuccgga

SEQ ID NO: 1546608 - RNA, 14 nt, Human adenovirus B [HAdV-B]
uggagucacugcua

SEQ ID NO: 1546609 - RNA, 22 nt, Human adenovirus B [HAdV-B]
ccgggccuucuaugauuucucg

SEQ ID NO: 1546610 - RNA, 20 nt, Human adenovirus B [HAdV-B]
ggugcucaacgguggcuucc

SEQ ID NO: 1546611 - RNA, 13 nt, Human adenovirus B [HAdV-B]
auacaauggacuc

SEQ ID NO: 1546612 - RNA, 20 nt, Human adenovirus B [HAdV-B]
uggcagaccucaucuuccca

SEQ ID NO: 1546613 - RNA, 20 nt, Human adenovirus B [HAdV-B]
cacuuacuugaaaucagcaa

SEQ ID NO: 1546614 - RNA, 14 nt, Human adenovirus B [HAdV-B]
agaggucagaggag

SEQ ID NO: 1546615 - RNA, 16 nt, Human adenovirus B [HAdV-B]
ugcagcuaacaugcuc

SEQ ID NO: 1546616 - RNA, 22 nt, Human adenovirus B [HAdV-B]
uggcuuccagcaaagccuccac

SEQ ID NO: 1546617 - RNA, 14 nt, Human adenovirus B [HAdV-B]
aaaguuugguggau

SEQ ID NO: 1546618 - RNA, 16 nt, Human adenovirus B [HAdV-B]
gcccuacucaaucugg

SEQ ID NO: 1546619 - RNA, 14 nt, Human adenovirus B [HAdV-B]
agcuccgccagucc

SEQ ID NO: 1546620 - RNA, 15 nt, Human adenovirus B [HAdV-B]
gucuuccuuggcuuc

SEQ ID NO: 1546621 - RNA, 16 nt, Human adenovirus B [HAdV-B]
aggcagaggaggugga

SEQ ID NO: 1546622 - RNA, 17 nt, Human adenovirus B [HAdV-B]
caagcuuucaguuccga

SEQ ID NO: 1546623 - RNA, 15 nt, Human adenovirus B [HAdV-B]
uagguuggauagcau

SEQ ID NO: 1546624 - RNA, 13 nt, Human adenovirus B [HAdV-B]
ccaaauggagaca

SEQ ID NO: 1546625 - RNA, 12 nt, Human adenovirus B [HAdV-B]
ucccaucaucgu

SEQ ID NO: 1546626 - RNA, 23 nt, Human adenovirus B [HAdV-B]
aauugcaaggccccagcagccaa

SEQ ID NO: 1546627 - RNA, 20 nt, Human adenovirus B [HAdV-B]
ccaacaccgcucccccagcc

SEQ ID NO: 1546628 - RNA, 16 nt, Human adenovirus B [HAdV-B]
aacgaggaggcagagg

SEQ ID NO: 1546629 - RNA, 14 nt, Human adenovirus B [HAdV-B]
aggaguaucuaaac

SEQ ID NO: 1546630 - RNA, 19 nt, Human adenovirus B [HAdV-B]
guucaauuuguggaggagu

SEQ ID NO: 1546631 - RNA, 19 nt, Human adenovirus B [HAdV-B]
aucuggacuuggaagaggg

SEQ ID NO: 1546632 - RNA, 16 nt, Human adenovirus B [HAdV-B]
ggucuugugugggacg

SEQ ID NO: 1546633 - RNA, 22 nt, Human adenovirus B [HAdV-B]
gggucuugugugggacgaugag

SEQ ID NO: 1546634 - RNA, 21 nt, Human adenovirus B [HAdV-B]
caggguuguuuccgucacagu

SEQ ID NO: 1546635 - RNA, 22 nt, Human adenovirus B [HAdV-B]
ggcuccuaaaggcgcuccaaau

SEQ ID NO: 1546636 - RNA, 13 nt, Human adenovirus B [HAdV-B]
guuugguggauaa

SEQ ID NO: 1546637 - RNA, 15 nt, Human adenovirus B [HAdV-B]
caguagguuuggaag

SEQ ID NO: 1546638 - RNA, 18 nt, Human adenovirus B [HAdV-B]
cugccaugcgagccgcaa

SEQ ID NO: 1546639 - RNA, 18 nt, Human adenovirus B [HAdV-B]
cucacuauucaaccugua

SEQ ID NO: 1546640 - RNA, 18 nt, Human adenovirus B [HAdV-B]
cgcuauggagucacugcu

SEQ ID NO: 1546641 - RNA, 19 nt, Human adenovirus B [HAdV-B]
uggaagccacucugaacuu

SEQ ID NO: 1546642 - RNA, 14 nt, Human adenovirus B [HAdV-B]
caggucuacugguc

SEQ ID NO: 1546643 - RNA, 14 nt, Human adenovirus B [HAdV-B]
ggcaggaugugagc

SEQ ID NO: 1546644 - RNA, 18 nt, Human adenovirus B [HAdV-B]
gcaacgaauuuucuccca

SEQ ID NO: 1546645 - RNA, 18 nt, Human adenovirus B [HAdV-B]
uuguaucccacuaugcaa

SEQ ID NO: 1546646 - RNA, 16 nt, Human adenovirus B [HAdV-B]
ccaagaugcuggaaau

SEQ ID NO: 1546647 - RNA, 18 nt, Human adenovirus B [HAdV-B]
gaccccgggacuguggac

SEQ ID NO: 1546648 - RNA, 15 nt, Human adenovirus B [HAdV-B]
gacaguuuggaggag

SEQ ID NO: 1546649 - RNA, 19 nt, Human adenovirus B [HAdV-B]
uagacagcaaccccaggcc

SEQ ID NO: 1546650 - RNA, 18 nt, Human adenovirus B [HAdV-B]
ucggggaagauaguuguu

SEQ ID NO: 1546651 - RNA, 15 nt, Human adenovirus B [HAdV-B]
aaauuacccaaguca

SEQ ID NO: 1546652 - RNA, 14 nt, Human adenovirus B [HAdV-B]
ccgcugucaaccug

SEQ ID NO: 1546653 - RNA, 16 nt, Human adenovirus B [HAdV-B]
guuaagacuggucacu

SEQ ID NO: 1546654 - RNA, 22 nt, Human adenovirus B [HAdV-B]
aaggaccaccaagacgguguau

SEQ ID NO: 1546655 - RNA, 12 nt, Human adenovirus B [HAdV-B]
acuaaugugaaa

SEQ ID NO: 1546656 - RNA, 14 nt, Human adenovirus B [HAdV-B]
agccuacugccacc

SEQ ID NO: 1546657 - RNA, 19 nt, Human adenovirus B [HAdV-B]
ccugcagaaaucuucccau

SEQ ID NO: 1546658 - RNA, 17 nt, Human adenovirus B [HAdV-B]
aggacccccaaucacuu

SEQ ID NO: 1546659 - RNA, 12 nt, Human adenovirus B [HAdV-B]
cugacaaauaaa

SEQ ID NO: 1546660 - RNA, 14 nt, Human adenovirus B [HAdV-B]
cagacuagcagaca

SEQ ID NO: 1546661 - RNA, 21 nt, Human adenovirus B [HAdV-B]
cugcaacgaauuuucucccag

SEQ ID NO: 1546662 - RNA, 16 nt, Human adenovirus B [HAdV-B]
guccagcgcugccagg

SEQ ID NO: 1546663 - RNA, 20 nt, Human adenovirus B [HAdV-B]
auccagcuuuugcugugcca

SEQ ID NO: 1546664 - RNA, 16 nt, Human adenovirus B [HAdV-B]
ccugauuacuucuuuc

SEQ ID NO: 1546665 - RNA, 15 nt, Human adenovirus B [HAdV-B]
agauaguuguuaauu

SEQ ID NO: 1546666 - RNA, 17 nt, Human adenovirus B [HAdV-B]
uaacgcuggagagguca

SEQ ID NO: 1546667 - RNA, 17 nt, Human adenovirus B [HAdV-B]
cauucucgagcugccag

SEQ ID NO: 1546668 - RNA, 19 nt, Human adenovirus B [HAdV-B]
uaucagaaaaaaacagcca

SEQ ID NO: 1546669 - RNA, 21 nt, Human adenovirus B [HAdV-B]
uggccgaugugucugaaggaa

SEQ ID NO: 1546670 - RNA, 15 nt, Human adenovirus B [HAdV-B]
uaagguauauuauug

SEQ ID NO: 1546671 - RNA, 15 nt, Human adenovirus B [HAdV-B]
cggaagccagcaccc

SEQ ID NO: 1546672 - RNA, 13 nt, Human adenovirus B [HAdV-B]
cagugcaggcagc

SEQ ID NO: 1546673 - RNA, 14 nt, Human adenovirus B [HAdV-B]
caggcggcugaccg

SEQ ID NO: 1546674 - RNA, 18 nt, Human adenovirus B [HAdV-B]
ggacucuguuaacuucac

SEQ ID NO: 1546675 - RNA, 11 nt, Human adenovirus B [HAdV-B]
aggagcuggcu

SEQ ID NO: 1546676 - RNA, 21 nt, Human adenovirus B [HAdV-B]
uugccaugcaggcacuucagc

SEQ ID NO: 1546677 - RNA, 15 nt, Human adenovirus B [HAdV-B]
ccagucgccguagcc

SEQ ID NO: 1546678 - RNA, 22 nt, Human adenovirus B [HAdV-B]
acgccagacgccgcaccugucc

SEQ ID NO: 1546679 - RNA, 17 nt, Human adenovirus B [HAdV-B]
ggcaguuuggaagccac

SEQ ID NO: 1546680 - RNA, 21 nt, Human adenovirus B [HAdV-B]
ccgcaggcaagcagccgcuuu

SEQ ID NO: 1546681 - RNA, 18 nt, Human adenovirus B [HAdV-B]
gauucuuaacagugcagg

SEQ ID NO: 1546682 - RNA, 15 nt, Human adenovirus B [HAdV-B]
cgaggaggcagagga

SEQ ID NO: 1546683 - RNA, 18 nt, Human adenovirus B [HAdV-B]
guucgcaagaugaggaca

SEQ ID NO: 1546684 - RNA, 16 nt, Human adenovirus B [HAdV-B]
aucaccugggcagcua

SEQ ID NO: 1546685 - RNA, 17 nt, Human adenovirus B [HAdV-B]
cccgcaggaccugcucg

SEQ ID NO: 1546686 - RNA, 18 nt, Human adenovirus B [HAdV-B]
ucagugaaaacguuccug

SEQ ID NO: 1546687 - RNA, 15 nt, Human adenovirus B [HAdV-B]
ccucaagggccgcac

SEQ ID NO: 1546688 - RNA, 12 nt, Human adenovirus B [HAdV-B]
ucagcugcaaag

SEQ ID NO: 1546689 - RNA, 16 nt, Human adenovirus B [HAdV-B]
uaguuauuuugccucc

SEQ ID NO: 1546690 - RNA, 22 nt, Human adenovirus B [HAdV-B]
cugcaaagcuccaagcagguca

SEQ ID NO: 1546691 - RNA, 15 nt, Human adenovirus B [HAdV-B]
agcuugguuaccagu

SEQ ID NO: 1546692 - RNA, 17 nt, Human adenovirus B [HAdV-B]
caaggucaacccuaucc

SEQ ID NO: 1546693 - RNA, 12 nt, Human adenovirus B [HAdV-B]
caucaguuucac

SEQ ID NO: 1546694 - RNA, 13 nt, Human adenovirus B [HAdV-B]
gaugagaggccuu

SEQ ID NO: 1546695 - RNA, 11 nt, Human adenovirus B [HAdV-B]
ggagucacugc

SEQ ID NO: 1546696 - RNA, 12 nt, Human adenovirus B [HAdV-B]
guagaagaggga

SEQ ID NO: 1546697 - RNA, 16 nt, Human adenovirus B [HAdV-B]
aacacacccucauaau

SEQ ID NO: 1546698 - RNA, 17 nt, Human adenovirus B [HAdV-B]
guagauggcgccagcau

SEQ ID NO: 1546699 - RNA, 21 nt, Human adenovirus B [HAdV-B]
cuugcuggagugucacugccg

SEQ ID NO: 1546700 - RNA, 21 nt, Human adenovirus B [HAdV-B]
gagcuuaagcauuccaccgcc

SEQ ID NO: 1546701 - RNA, 15 nt, Human adenovirus B [HAdV-B]
gccacagcuggcaga

SEQ ID NO: 1546702 - RNA, 14 nt, Human adenovirus B [HAdV-B]
aucuguggaguucu

SEQ ID NO: 1546703 - RNA, 23 nt, Human adenovirus B [HAdV-B]
guagacgccagcgccaugacaga

SEQ ID NO: 1546704 - RNA, 14 nt, Human adenovirus B [HAdV-B]
acuugcaguggcag

SEQ ID NO: 1546705 - RNA, 19 nt, Human adenovirus B [HAdV-B]
cugacgccagacgccgcac

SEQ ID NO: 1546706 - RNA, 13 nt, Human adenovirus B [HAdV-B]
cuuucuaaaaaaa

SEQ ID NO: 1546707 - RNA, 16 nt, Human adenovirus B [HAdV-B]
acgagccaacugaacg

SEQ ID NO: 1546708 - RNA, 23 nt, Human adenovirus B [HAdV-B]
cggcgcuacuugcuauuccacca

SEQ ID NO: 1546709 - RNA, 17 nt, Human adenovirus B [HAdV-B]
ggcgacggcggugaugc

SEQ ID NO: 1546710 - RNA, 14 nt, Human adenovirus B [HAdV-B]
gaauuaaaaaauga

SEQ ID NO: 1546711 - RNA, 15 nt, Human adenovirus B [HAdV-B]
cgccgucacagcagc

SEQ ID NO: 1546712 - RNA, 21 nt, Human adenovirus B [HAdV-B]
ugccgccaucucuaguagaca

SEQ ID NO: 1546713 - RNA, 15 nt, Human adenovirus B [HAdV-B]
acaaaacaaaaccaa

SEQ ID NO: 1546714 - RNA, 13 nt, Human adenovirus B [HAdV-B]
cuuggcuucuuuu

SEQ ID NO: 1546715 - RNA, 18 nt, Human adenovirus B [HAdV-B]
gcaaacucgaagagaauc

SEQ ID NO: 1546716 - RNA, 19 nt, Human adenovirus B [HAdV-B]
caaguugaucaugccugga

SEQ ID NO: 1546717 - RNA, 13 nt, Human adenovirus B [HAdV-B]
ggcaccuggagcg

SEQ ID NO: 1546718 - RNA, 22 nt, Human adenovirus B [HAdV-B]
gauuuccuucgcggcuggccau

SEQ ID NO: 1546719 - RNA, 19 nt, Human adenovirus B [HAdV-B]
aggaggcggaggaggacag

SEQ ID NO: 1546720 - RNA, 20 nt, Human adenovirus B [HAdV-B]
ugcuaucgagaaaaaucaga

SEQ ID NO: 1546721 - RNA, 23 nt, Human adenovirus B [HAdV-B]
aggcuacaacguagcccaaugca

SEQ ID NO: 1546722 - RNA, 16 nt, Human adenovirus B [HAdV-B]
aacugcccaaaacaac

SEQ ID NO: 1546723 - RNA, 11 nt, Human adenovirus B [HAdV-B]
cuguggcuuuu

SEQ ID NO: 1546724 - RNA, 21 nt, Human adenovirus B [HAdV-B]
caaucaugcccacauccagau

SEQ ID NO: 1546725 - RNA, 17 nt, Human adenovirus B [HAdV-B]
guucugaggaaaucauc

SEQ ID NO: 1546726 - RNA, 22 nt, Human adenovirus B [HAdV-B]
augaccagcaugaaaggaacua

SEQ ID NO: 1546727 - RNA, 12 nt, Human adenovirus B [HAdV-B]
gcgccaacaccu

SEQ ID NO: 1546728 - RNA, 18 nt, Human adenovirus B [HAdV-B]
cagugucgcuaacaauac

SEQ ID NO: 1546729 - RNA, 21 nt, Human adenovirus B [HAdV-B]
ggauguagaugccuaugagaa

SEQ ID NO: 1546730 - RNA, 16 nt, Human adenovirus B [HAdV-B]
cgggcggaaucgggac

SEQ ID NO: 1546731 - RNA, 19 nt, Human adenovirus B [HAdV-B]
cccuaguguaccaggaaag

SEQ ID NO: 1546732 - RNA, 11 nt, Human adenovirus B [HAdV-B]
cugcacagcac

SEQ ID NO: 1546733 - RNA, 17 nt, Human adenovirus B [HAdV-B]
gaaugaugaccaaagau

SEQ ID NO: 1546734 - RNA, 19 nt, Human adenovirus B [HAdV-B]
accugcgagccaaauccuc

SEQ ID NO: 1546735 - RNA, 16 nt, Human adenovirus B [HAdV-B]
agaccggcgaggaacu

SEQ ID NO: 1546736 - RNA, 14 nt, Human adenovirus B [HAdV-B]
ucaucuaaaaccau

SEQ ID NO: 1546737 - RNA, 16 nt, Human adenovirus B [HAdV-B]
ucggaacuggcaccuc

SEQ ID NO: 1546738 - RNA, 23 nt, Human adenovirus B [HAdV-B]
cacugaaaguauggaagugcaaa

SEQ ID NO: 1546739 - RNA, 17 nt, Human adenovirus B [HAdV-B]
agugaaucuaaugauug

SEQ ID NO: 1546740 - RNA, 20 nt, Human adenovirus B [HAdV-B]
caaaacgcggcccuggcaga

SEQ ID NO: 1546741 - RNA, 20 nt, Human adenovirus B [HAdV-B]
ggaggcagaggagguggaag

SEQ ID NO: 1546742 - RNA, 17 nt, Human adenovirus B [HAdV-B]
ccuacauggguauucug

SEQ ID NO: 1546743 - RNA, 15 nt, Human adenovirus B [HAdV-B]
agucugcaaaaauaa

SEQ ID NO: 1546744 - RNA, 18 nt, Human adenovirus B [HAdV-B]
caaaucccaaccaagcaa

SEQ ID NO: 1546745 - RNA, 17 nt, Human adenovirus B [HAdV-B]
aguuucagaugaagaaa

SEQ ID NO: 1546746 - RNA, 16 nt, Human adenovirus B [HAdV-B]
acagcugcugcagaag

SEQ ID NO: 1546747 - RNA, 18 nt, Human adenovirus B [HAdV-B]
gcaggcgccucccaggac

SEQ ID NO: 1546748 - RNA, 16 nt, Human adenovirus B [HAdV-B]
caggugaaaacauguu

SEQ ID NO: 1546749 - RNA, 16 nt, Human adenovirus B [HAdV-B]
agaacagaacuugaaa

SEQ ID NO: 1546750 - RNA, 21 nt, Human adenovirus B [HAdV-B]
aauaguaacuugcaacauaca

SEQ ID NO: 1546751 - RNA, 23 nt, Human adenovirus B [HAdV-B]
aauaucaucgaaguugcuggaaa

SEQ ID NO: 1546752 - RNA, 13 nt, Human adenovirus B [HAdV-B]
caauguggcucua

SEQ ID NO: 1546753 - RNA, 18 nt, Human adenovirus B [HAdV-B]
gcuccgguauccugcccg

SEQ ID NO: 1546754 - RNA, 21 nt, Human adenovirus B [HAdV-B]
auggacaggagucaaccccac

SEQ ID NO: 1546755 - RNA, 20 nt, Human adenovirus B [HAdV-B]
ugcuggagugucacugccgc

SEQ ID NO: 1546756 - RNA, 16 nt, Human adenovirus B [HAdV-B]
cagacgccgcaccugu

SEQ ID NO: 1546757 - RNA, 17 nt, Human adenovirus B [HAdV-B]
cggagacaagcaacagc

SEQ ID NO: 1546758 - RNA, 14 nt, Human adenovirus B [HAdV-B]
cuuuugcugugcca

SEQ ID NO: 1546759 - RNA, 19 nt, Human adenovirus B [HAdV-B]
agcaauggggccgugggca

SEQ ID NO: 1546760 - RNA, 16 nt, Human adenovirus B [HAdV-B]
gucucugacaaagugg

SEQ ID NO: 1546761 - RNA, 14 nt, Human adenovirus B [HAdV-B]
ggucugcauccaug

SEQ ID NO: 1546762 - RNA, 20 nt, Human adenovirus B [HAdV-B]
gucuucucaaagagcuucua

SEQ ID NO: 1546763 - RNA, 17 nt, Human adenovirus B [HAdV-B]
agccguuaaccccacag

SEQ ID NO: 1546764 - RNA, 15 nt, Human adenovirus B [HAdV-B]
gagucugagacagac

SEQ ID NO: 1546765 - RNA, 18 nt, Human adenovirus B [HAdV-B]
acaagauuggaauaagca

SEQ ID NO: 1546766 - RNA, 22 nt, Human adenovirus B [HAdV-B]
cacagcuagugaucgcacugcu

SEQ ID NO: 1546767 - RNA, 16 nt, Human adenovirus B [HAdV-B]
ugugccuuuccacaua

SEQ ID NO: 1546768 - RNA, 16 nt, Human adenovirus B [HAdV-B]
agcaagggggccaccu

SEQ ID NO: 1546769 - RNA, 19 nt, Human adenovirus B [HAdV-B]
uuaccagacaaaguacagc

SEQ ID NO: 1546770 - RNA, 16 nt, Human adenovirus B [HAdV-B]
gauucucacuugccac

SEQ ID NO: 1546771 - RNA, 22 nt, Human adenovirus B [HAdV-B]
caaauuaggacaaggacuuaca

SEQ ID NO: 1546772 - RNA, 18 nt, Human adenovirus B [HAdV-B]
gucuacuggucgcuucca

SEQ ID NO: 1546773 - RNA, 15 nt, Human adenovirus B [HAdV-B]
cagguuaucgcaccu

SEQ ID NO: 1546774 - RNA, 18 nt, Human adenovirus B [HAdV-B]
ggaaugcgacgcuacagg

SEQ ID NO: 1546775 - RNA, 15 nt, Human adenovirus B [HAdV-B]
gaagaugaaagcacc

SEQ ID NO: 1546776 - RNA, 18 nt, Human adenovirus B [HAdV-B]
uggaagagaugguggguc

SEQ ID NO: 1546777 - RNA, 19 nt, Human adenovirus B [HAdV-B]
gcgcgguuagcgccagcag

SEQ ID NO: 1546778 - RNA, 13 nt, Human adenovirus B [HAdV-B]
cgacugcagcacu

SEQ ID NO: 1546779 - RNA, 14 nt, Human adenovirus B [HAdV-B]
gcggcgauagaaug

SEQ ID NO: 1546780 - RNA, 13 nt, Human adenovirus B [HAdV-B]
uuaggaccagugc

SEQ ID NO: 1546781 - RNA, 19 nt, Human adenovirus B [HAdV-B]
ccucccgacggugcugcag

SEQ ID NO: 1546782 - RNA, 21 nt, Human adenovirus B [HAdV-B]
gcuaacccgauggcugggcac

SEQ ID NO: 1546783 - RNA, 12 nt, Human adenovirus B [HAdV-B]
uuaugugcauuu

SEQ ID NO: 1546784 - RNA, 17 nt, Human adenovirus B [HAdV-B]
agaagaggcggaugaag

SEQ ID NO: 1546785 - RNA, 13 nt, Human adenovirus B [HAdV-B]
caagauagcuuug

SEQ ID NO: 1546786 - RNA, 13 nt, Human adenovirus B [HAdV-B]
ucgcgugccaggc

SEQ ID NO: 1546787 - RNA, 17 nt, Human adenovirus B [HAdV-B]
aauucgggaaucaccaa

SEQ ID NO: 1546788 - RNA, 22 nt, Human adenovirus B [HAdV-B]
cuggucuggggguacaaacugu

SEQ ID NO: 1546789 - RNA, 18 nt, Human adenovirus B [HAdV-B]
cacgccccgccaacaccu

SEQ ID NO: 1546790 - RNA, 20 nt, Human adenovirus B [HAdV-B]
aauugcaaggccccagcagc

SEQ ID NO: 1546791 - RNA, 22 nt, Human adenovirus B [HAdV-B]
ccggcauggguguauggcagca

SEQ ID NO: 1546792 - RNA, 23 nt, Human adenovirus B [HAdV-B]
cagugaugagcagcuaacccgau

SEQ ID NO: 1546793 - RNA, 15 nt, Human adenovirus B [HAdV-B]
ucauccaaauucacc

SEQ ID NO: 1546794 - RNA, 18 nt, Human adenovirus B [HAdV-B]
agacaugcaugacccaga

SEQ ID NO: 1546795 - RNA, 21 nt, Human adenovirus B [HAdV-B]
aaccggucacuuugcagcaag

SEQ ID NO: 1546796 - RNA, 15 nt, Human adenovirus B [HAdV-B]
guggugggugcagag

SEQ ID NO: 1546797 - RNA, 13 nt, Human adenovirus B [HAdV-B]
cgcugcagagcca

SEQ ID NO: 1546798 - RNA, 13 nt, Human adenovirus B [HAdV-B]
uggaugccaugga

SEQ ID NO: 1546799 - RNA, 23 nt, Human adenovirus B [HAdV-B]
uugcaacauacaaaaucuuacau

SEQ ID NO: 1546800 - RNA, 14 nt, Human adenovirus B [HAdV-B]
ggcaccugcgagcc

SEQ ID NO: 1546801 - RNA, 14 nt, Human adenovirus B [HAdV-B]
uccccgcugggggg

SEQ ID NO: 1546802 - RNA, 17 nt, Human adenovirus B [HAdV-B]
aaguagcaguuuaccau

SEQ ID NO: 1546803 - RNA, 16 nt, Human adenovirus B [HAdV-B]
ugaacuaucagaauga

SEQ ID NO: 1546804 - RNA, 15 nt, Human adenovirus B [HAdV-B]
cugacuugcaguggc

SEQ ID NO: 1546805 - RNA, 17 nt, Human adenovirus B [HAdV-B]
cugaagcugaaauuaca

SEQ ID NO: 1546806 - RNA, 22 nt, Human adenovirus B [HAdV-B]
cgcggcgugccucugacgugag

SEQ ID NO: 1546807 - RNA, 15 nt, Human adenovirus B [HAdV-B]
ggaagacgcgcuccu

SEQ ID NO: 1546808 - RNA, 12 nt, Human adenovirus B [HAdV-B]
caccgacagcgg

SEQ ID NO: 1546809 - RNA, 22 nt, Human adenovirus B [HAdV-B]
ggucaagagcaggaacugaaaa

SEQ ID NO: 1546810 - RNA, 17 nt, Human adenovirus B [HAdV-B]
cauauuucaaagaugua

SEQ ID NO: 1546811 - RNA, 17 nt, Human adenovirus B [HAdV-B]
gcccaguccugccacca

SEQ ID NO: 1546812 - RNA, 13 nt, Human adenovirus B [HAdV-B]
cucccaggacuac

SEQ ID NO: 1546813 - RNA, 16 nt, Human adenovirus B [HAdV-B]
cuguuccgucuggcca

SEQ ID NO: 1546814 - RNA, 21 nt, Human adenovirus B [HAdV-B]
cuaugaggaccaaucacagcc

SEQ ID NO: 1546815 - RNA, 22 nt, Human adenovirus B [HAdV-B]
ggcagcaauguuuagaagaaca

SEQ ID NO: 1546816 - RNA, 18 nt, Human adenovirus B [HAdV-B]
ccgaagagcaauaaauga

SEQ ID NO: 1546817 - RNA, 13 nt, Human adenovirus B [HAdV-B]
gccauugcuguca

SEQ ID NO: 1546818 - RNA, 22 nt, Human adenovirus B [HAdV-B]
cgguucauuggggucaaaaaca

SEQ ID NO: 1546819 - RNA, 21 nt, Human adenovirus B [HAdV-B]
augauuaauaaaaaaucacuu

SEQ ID NO: 1546820 - RNA, 23 nt, Human adenovirus B [HAdV-B]
guaaaacaagccaagauauccua

SEQ ID NO: 1546821 - RNA, 23 nt, Human adenovirus B [HAdV-B]
acuaucuccuaacgaauuugaaa

SEQ ID NO: 1546822 - RNA, 16 nt, Human adenovirus B [HAdV-B]
uccgaccuggcagacc

SEQ ID NO: 1546823 - RNA, 12 nt, Human adenovirus B [HAdV-B]
ugccuggagugu

SEQ ID NO: 1546824 - RNA, 14 nt, Human adenovirus B [HAdV-B]
aaccuugucauaau

SEQ ID NO: 1546825 - RNA, 21 nt, Human adenovirus B [HAdV-B]
cccugcaacuacugcaacugc

SEQ ID NO: 1546826 - RNA, 24 nt, Human adenovirus B [HAdV-B]
ggaagauccugagguaugaugaua

SEQ ID NO: 1546827 - RNA, 14 nt, Human adenovirus B [HAdV-B]
ggaagacugauggc

SEQ ID NO: 1546828 - RNA, 13 nt, Human adenovirus B [HAdV-B]
aaguuuggcaaug

SEQ ID NO: 1546829 - RNA, 16 nt, Human adenovirus B [HAdV-B]
cagucaggcagaggag

SEQ ID NO: 1546830 - RNA, 17 nt, Human adenovirus B [HAdV-B]
cagccgaaacaguaccu

SEQ ID NO: 1546831 - RNA, 14 nt, Human adenovirus B [HAdV-B]
gcuuacaacucccu

SEQ ID NO: 1546832 - RNA, 15 nt, Human adenovirus B [HAdV-B]
ccuguggugggugca

SEQ ID NO: 1546833 - RNA, 18 nt, Human adenovirus B [HAdV-B]
acuuacuugaaaucagca

SEQ ID NO: 1546834 - RNA, 15 nt, Human adenovirus B [HAdV-B]
gggauuuggaagagc

SEQ ID NO: 1546835 - RNA, 12 nt, Human adenovirus B [HAdV-B]
cucccaagcaga

SEQ ID NO: 1546836 - RNA, 23 nt, Human adenovirus B [HAdV-B]
guaugccaucuuccagcagaguc

SEQ ID NO: 1546837 - RNA, 19 nt, Human adenovirus B [HAdV-B]
aaacaccguuucuggggcg

SEQ ID NO: 1546838 - RNA, 13 nt, Human adenovirus B [HAdV-B]
cccgcaggcagug

SEQ ID NO: 1546839 - RNA, 22 nt, Human adenovirus B [HAdV-B]
aaaacugguuagcugcacagcc

SEQ ID NO: 1546840 - RNA, 12 nt, Human adenovirus B [HAdV-B]
ugaucuggacuu

SEQ ID NO: 1546841 - RNA, 13 nt, Human adenovirus B [HAdV-B]
cuaccgccagugc

SEQ ID NO: 1546842 - RNA, 16 nt, Human adenovirus B [HAdV-B]
gaagaaaguaaaccga

SEQ ID NO: 1546843 - RNA, 17 nt, Human adenovirus B [HAdV-B]
gcguccagcgcugccag

SEQ ID NO: 1546844 - RNA, 22 nt, Human adenovirus B [HAdV-B]
aggguaauuuguuugccaugga

SEQ ID NO: 1546845 - RNA, 16 nt, Human adenovirus B [HAdV-B]
uacacggcucucauga

SEQ ID NO: 1546846 - RNA, 14 nt, Human adenovirus B [HAdV-B]
cgugcugcacagca

SEQ ID NO: 1546847 - RNA, 19 nt, Human adenovirus B [HAdV-B]
gcuuccagacaugaugaag

SEQ ID NO: 1546848 - RNA, 21 nt, Human adenovirus B [HAdV-B]
cuaggacaaagcgugcugcac

SEQ ID NO: 1546849 - RNA, 20 nt, Human adenovirus B [HAdV-B]
ucccgagugguacacugucu

SEQ ID NO: 1546850 - RNA, 22 nt, Human adenovirus B [HAdV-B]
gaucgaggguacgcgcaugcga

SEQ ID NO: 1546851 - RNA, 16 nt, Human adenovirus B [HAdV-B]
gcaccgacucucccag

SEQ ID NO: 1546852 - RNA, 23 nt, Human adenovirus B [HAdV-B]
aaauguaaauuuggaaacuccag

SEQ ID NO: 1546853 - RNA, 13 nt, Human adenovirus B [HAdV-B]
acuacacuuuuag

SEQ ID NO: 1546854 - RNA, 19 nt, Human adenovirus B [HAdV-B]
uaaccuacuacgccugcug

SEQ ID NO: 1546855 - RNA, 18 nt, Human adenovirus B [HAdV-B]
uuaaaaaccugcugcuuc

SEQ ID NO: 1546856 - RNA, 14 nt, Human adenovirus B [HAdV-B]
cgggcaggauguca

SEQ ID NO: 1546857 - RNA, 22 nt, Human adenovirus B [HAdV-B]
gagcuuccuuacauagaagagg

SEQ ID NO: 1546858 - RNA, 17 nt, Human adenovirus B [HAdV-B]
cucagccauugcuguca

SEQ ID NO: 1546859 - RNA, 20 nt, Human adenovirus B [HAdV-B]
aagagcuugacaagcucuua

SEQ ID NO: 1546860 - RNA, 18 nt, Human adenovirus B [HAdV-B]
ccugucugauuccuggau

SEQ ID NO: 1546861 - RNA, 22 nt, Human adenovirus B [HAdV-B]
guuagcuggcggcuccacccua

SEQ ID NO: 1546862 - RNA, 13 nt, Human adenovirus B [HAdV-B]
cucacgcuugcca

SEQ ID NO: 1546863 - RNA, 21 nt, Human adenovirus B [HAdV-B]
ccccacggcgacgcgugcaau

SEQ ID NO: 1546864 - RNA, 15 nt, Human adenovirus B [HAdV-B]
ccagggucucagugu

SEQ ID NO: 1546865 - RNA, 14 nt, Human adenovirus B [HAdV-B]
cugaccgcccagcu

SEQ ID NO: 1546866 - RNA, 12 nt, Human adenovirus B [HAdV-B]
acacagaacuuu

SEQ ID NO: 1546867 - RNA, 17 nt, Human adenovirus B [HAdV-B]
ccacagcaacuucuuga

SEQ ID NO: 1546868 - RNA, 13 nt, Human adenovirus B [HAdV-B]
auacaauuuccaa

SEQ ID NO: 1546869 - RNA, 11 nt, Human adenovirus B [HAdV-B]
aauaugagugg

SEQ ID NO: 1546870 - RNA, 19 nt, Human adenovirus B [HAdV-B]
guuccggagacagggagga

SEQ ID NO: 1546871 - RNA, 23 nt, Human adenovirus B [HAdV-B]
ccaugccuauuacaacugacgcc

SEQ ID NO: 1546872 - RNA, 19 nt, Human adenovirus B [HAdV-B]
acgguuuuuugaaagaaaa

SEQ ID NO: 1546873 - RNA, 21 nt, Human adenovirus B [HAdV-B]
cucacuauucaaccuguagaa

SEQ ID NO: 1546874 - RNA, 11 nt, Human adenovirus B [HAdV-B]
ugaagugcaaa

SEQ ID NO: 1546875 - RNA, 20 nt, Human adenovirus B [HAdV-B]
accagcgcuuccaagaccgg

SEQ ID NO: 1546876 - RNA, 17 nt, Human adenovirus B [HAdV-B]
uugcaaggccccagcag

SEQ ID NO: 1546877 - RNA, 18 nt, Human adenovirus B [HAdV-B]
caucccucaaaacuccac

SEQ ID NO: 1546878 - RNA, 16 nt, Human adenovirus B [HAdV-B]
augggcaccuggagcg

SEQ ID NO: 1546879 - RNA, 21 nt, Human adenovirus B [HAdV-B]
gccaugcuuagggcggccaga

SEQ ID NO: 1546880 - RNA, 14 nt, Human adenovirus B [HAdV-B]
cucuuccucacugu

SEQ ID NO: 1546881 - RNA, 17 nt, Human adenovirus B [HAdV-B]
acagggcguuggauaaa

SEQ ID NO: 1546882 - RNA, 16 nt, Human adenovirus B [HAdV-B]
auagcuuccuuggaag

SEQ ID NO: 1546883 - RNA, 21 nt, Human adenovirus B [HAdV-B]
gaugauauucuugagcaggcg

SEQ ID NO: 1546884 - RNA, 22 nt, Human adenovirus B [HAdV-B]
caaagcuauucguccagaugag

SEQ ID NO: 1546885 - RNA, 16 nt, Human adenovirus B [HAdV-B]
gaauguuuaugccuua

SEQ ID NO: 1546886 - RNA, 16 nt, Human adenovirus B [HAdV-B]
gaugaaaacugcccaa

SEQ ID NO: 1546887 - RNA, 15 nt, Human adenovirus B [HAdV-B]
aaucugcaacaaaac

SEQ ID NO: 1546888 - RNA, 20 nt, Human adenovirus B [HAdV-B]
cacagcacccugaaggggga

SEQ ID NO: 1546889 - RNA, 14 nt, Human adenovirus B [HAdV-B]
gacagcaaaugaca

SEQ ID NO: 1546890 - RNA, 14 nt, Human adenovirus B [HAdV-B]
ggaaucaaccccau

SEQ ID NO: 1546891 - RNA, 19 nt, Human adenovirus B [HAdV-B]
gaugccuuuuccagaauga

SEQ ID NO: 1546892 - RNA, 16 nt, Human adenovirus B [HAdV-B]
acagugcaggcagcag

SEQ ID NO: 1546893 - RNA, 14 nt, Human adenovirus B [HAdV-B]
gcaagggggccacc

SEQ ID NO: 1546894 - RNA, 16 nt, Human adenovirus B [HAdV-B]
cuaccacugccaugcg

SEQ ID NO: 1546895 - RNA, 11 nt, Human adenovirus B [HAdV-B]
uuugcugugcc

SEQ ID NO: 1546896 - RNA, 13 nt, Human adenovirus B [HAdV-B]
cagucuggaggac

SEQ ID NO: 1546897 - RNA, 15 nt, Human adenovirus B [HAdV-B]
gaaaguggguagaca

SEQ ID NO: 1546898 - RNA, 17 nt, Human adenovirus B [HAdV-B]
cagcuuuugcugugcca

SEQ ID NO: 1546899 - RNA, 17 nt, Human adenovirus B [HAdV-B]
gccaaacccaacacaca

SEQ ID NO: 1546900 - RNA, 13 nt, Human adenovirus B [HAdV-B]
augggucuucucc

SEQ ID NO: 1546901 - RNA, 14 nt, Human adenovirus B [HAdV-B]
ccaagcaaugcaac

SEQ ID NO: 1546902 - RNA, 21 nt, Human adenovirus B [HAdV-B]
cuggccgagaagguggcugcc

SEQ ID NO: 1546903 - RNA, 15 nt, Human adenovirus B [HAdV-B]
gcaggcgccucccag

SEQ ID NO: 1546904 - RNA, 17 nt, Human adenovirus B [HAdV-B]
gucccgauuuggaagag

SEQ ID NO: 1546905 - RNA, 17 nt, Human adenovirus B [HAdV-B]
gcgccaugacagacaga

SEQ ID NO: 1546906 - RNA, 21 nt, Human adenovirus B [HAdV-B]
cgauguugugucccagcggcg

SEQ ID NO: 1546907 - RNA, 19 nt, Human adenovirus B [HAdV-B]
cuguuaaaaaccugcugcu

SEQ ID NO: 1546908 - RNA, 16 nt, Human adenovirus B [HAdV-B]
agagcucugacuggag

SEQ ID NO: 1546909 - RNA, 14 nt, Human adenovirus B [HAdV-B]
gggacagucaggca

SEQ ID NO: 1546910 - RNA, 21 nt, Human adenovirus B [HAdV-B]
ucuuaccuuuggucuccauga

SEQ ID NO: 1546911 - RNA, 13 nt, Human adenovirus B [HAdV-B]
uccaccuuuucca

SEQ ID NO: 1546912 - RNA, 14 nt, Human adenovirus B [HAdV-B]
agagaggaugaaaa

SEQ ID NO: 1546913 - RNA, 15 nt, Human adenovirus B [HAdV-B]
agccggccggagccg

SEQ ID NO: 1546914 - RNA, 12 nt, Human adenovirus B [HAdV-B]
cuccauacuuua

SEQ ID NO: 1546915 - RNA, 16 nt, Human adenovirus B [HAdV-B]
uggaagccacucugaa

SEQ ID NO: 1546916 - RNA, 17 nt, Human adenovirus B [HAdV-B]
acauacaacaauuucca

SEQ ID NO: 1546917 - RNA, 18 nt, Human adenovirus B [HAdV-B]
gcauacaauccagacaug

SEQ ID NO: 1546918 - RNA, 22 nt, Human adenovirus B [HAdV-B]
aggagaaagagcaaccgugucu

SEQ ID NO: 1546919 - RNA, 23 nt, Human adenovirus B [HAdV-B]
aacacguuccgugggucugacac

SEQ ID NO: 1546920 - RNA, 15 nt, Human adenovirus B [HAdV-B]
ggccuccuagcaagg

SEQ ID NO: 1546921 - RNA, 22 nt, Human adenovirus B [HAdV-B]
gguggauaaaaugaguagaugg

SEQ ID NO: 1546922 - RNA, 19 nt, Human adenovirus B [HAdV-B]
cacauacaacaauuuccac

SEQ ID NO: 1546923 - RNA, 21 nt, Human adenovirus B [HAdV-B]
augguacccaaacgccagaag

SEQ ID NO: 1546924 - RNA, 17 nt, Human adenovirus B [HAdV-B]
caacaaucuaugcccaa

SEQ ID NO: 1546925 - RNA, 15 nt, Human adenovirus B [HAdV-B]
gacagcaaccccagg

SEQ ID NO: 1546926 - RNA, 12 nt, Human adenovirus B [HAdV-B]
aaagccugcugg

SEQ ID NO: 1546927 - RNA, 16 nt, Human adenovirus B [HAdV-B]
ucucaacgaugcgcac

SEQ ID NO: 1546928 - RNA, 18 nt, Human adenovirus B [HAdV-B]
ugcaccuacacccugcug

SEQ ID NO: 1546929 - RNA, 13 nt, Human adenovirus B [HAdV-B]
gcuucacuuucuu

SEQ ID NO: 1546930 - RNA, 18 nt, Human adenovirus B [HAdV-B]
ccuccacugaagugcaaa

SEQ ID NO: 1546931 - RNA, 14 nt, Human adenovirus B [HAdV-B]
gucucacgcuugcc

SEQ ID NO: 1546932 - RNA, 14 nt, Human adenovirus B [HAdV-B]
uuaucaaaugcuca

SEQ ID NO: 1546933 - RNA, 21 nt, Human adenovirus B [HAdV-B]
ugacauaucugucaugcuuaa

SEQ ID NO: 1546934 - RNA, 12 nt, Human adenovirus B [HAdV-B]
auauuuuugcuu

SEQ ID NO: 1546935 - RNA, 14 nt, Human adenovirus B [HAdV-B]
ugaaggggugugcg

SEQ ID NO: 1546936 - RNA, 18 nt, Human adenovirus B [HAdV-B]
uagcagcgugcuggacuu

SEQ ID NO: 1546937 - RNA, 19 nt, Human adenovirus B [HAdV-B]
uagcugaaacccacugcua

SEQ ID NO: 1546938 - RNA, 22 nt, Human adenovirus B [HAdV-B]
aagcuguguacucccagcagcu

SEQ ID NO: 1546939 - RNA, 22 nt, Human adenovirus B [HAdV-B]
auggaauagaaaguuuggugga

SEQ ID NO: 1546940 - RNA, 20 nt, Human adenovirus B [HAdV-B]
gacuuuaugagccagagcau

SEQ ID NO: 1546941 - RNA, 14 nt, Human adenovirus B [HAdV-B]
uaucggaggaggag

SEQ ID NO: 1546942 - RNA, 12 nt, Human adenovirus B [HAdV-B]
accacacugcca

SEQ ID NO: 1546943 - RNA, 20 nt, Human adenovirus B [HAdV-B]
uacuaccaauauuuuugcuu

SEQ ID NO: 1546944 - RNA, 17 nt, Human adenovirus B [HAdV-B]
ucagcuguugggguagg

SEQ ID NO: 1546945 - RNA, 14 nt, Human adenovirus B [HAdV-B]
acuuccagcccaug

SEQ ID NO: 1546946 - RNA, 13 nt, Human adenovirus B [HAdV-B]
uuuggaggaggaa

SEQ ID NO: 1546947 - RNA, 14 nt, Human adenovirus B [HAdV-B]
cgcucgggauucuc

SEQ ID NO: 1546948 - RNA, 19 nt, Human adenovirus B [HAdV-B]
caaugaggcuuucagagag

SEQ ID NO: 1546949 - RNA, 17 nt, Human adenovirus B [HAdV-B]
aaucuggggucagugau

SEQ ID NO: 1546950 - RNA, 18 nt, Human adenovirus B [HAdV-B]
ccagcgccaugacagaca

SEQ ID NO: 1546951 - RNA, 14 nt, Human adenovirus B [HAdV-B]
gcggagacaagcaa

SEQ ID NO: 1546952 - RNA, 20 nt, Human adenovirus B [HAdV-B]
cuaggacaaagcgugcugca

SEQ ID NO: 1546953 - RNA, 21 nt, Human adenovirus B [HAdV-B]
caguccugccagggcacacgu

SEQ ID NO: 1546954 - RNA, 13 nt, Human adenovirus B [HAdV-B]
uggauuuccugcc

SEQ ID NO: 1546955 - RNA, 19 nt, Human adenovirus B [HAdV-B]
cuccacuagacaagucagu

SEQ ID NO: 1546956 - RNA, 17 nt, Human adenovirus B [HAdV-B]
cauuccugcaccauucc

SEQ ID NO: 1546957 - RNA, 14 nt, Human adenovirus B [HAdV-B]
aaagauaguaagaa

SEQ ID NO: 1546958 - RNA, 14 nt, Human adenovirus B [HAdV-B]
gauggaaaaaccga

SEQ ID NO: 1546959 - RNA, 14 nt, Human adenovirus B [HAdV-B]
cuucuccugggcaa

SEQ ID NO: 1546960 - RNA, 12 nt, Human adenovirus B [HAdV-B]
accucacuuccc

SEQ ID NO: 1546961 - RNA, 14 nt, Human adenovirus B [HAdV-B]
uacuuugccagaag

SEQ ID NO: 1546962 - RNA, 13 nt, Human adenovirus B [HAdV-B]
auauuuucccgca

SEQ ID NO: 1546963 - RNA, 19 nt, Human adenovirus B [HAdV-B]
aagagcucugacuggagcu

SEQ ID NO: 1546964 - RNA, 14 nt, Human adenovirus B [HAdV-B]
cuaguagacaccua

SEQ ID NO: 1546965 - RNA, 14 nt, Human adenovirus B [HAdV-B]
cauugcagccauga

SEQ ID NO: 1546966 - RNA, 19 nt, Human adenovirus B [HAdV-B]
caggauccuauagaggugg

SEQ ID NO: 1546967 - RNA, 15 nt, Human adenovirus B [HAdV-B]
cgaggcucucuucaa

SEQ ID NO: 1546968 - RNA, 18 nt, Human adenovirus B [HAdV-B]
uaguuauguuccugaguu

SEQ ID NO: 1546969 - RNA, 23 nt, Human adenovirus B [HAdV-B]
acacucaccaccuccaauuccgc

SEQ ID NO: 1546970 - RNA, 13 nt, Human adenovirus B [HAdV-B]
cagaacacacucu

SEQ ID NO: 1546971 - RNA, 14 nt, Human adenovirus B [HAdV-B]
ggcgaccuccaaca

SEQ ID NO: 1546972 - RNA, 23 nt, Human adenovirus B [HAdV-B]
cccguaacuccgcgaacaggugu

SEQ ID NO: 1546973 - RNA, 14 nt, Human adenovirus B [HAdV-B]
aacagucagcucuu

SEQ ID NO: 1546974 - RNA, 21 nt, Human adenovirus B [HAdV-B]
acagauaagcccuugguguag

SEQ ID NO: 1546975 - RNA, 20 nt, Human adenovirus B [HAdV-B]
gaagccuuuagacagcaacc

SEQ ID NO: 1546976 - RNA, 14 nt, Human adenovirus B [HAdV-B]
acugcuuuucccau

SEQ ID NO: 1546977 - RNA, 13 nt, Human adenovirus B [HAdV-B]
cugacuugucucc

SEQ ID NO: 1546978 - RNA, 16 nt, Human adenovirus B [HAdV-B]
aagcgcgugugauggu

SEQ ID NO: 1546979 - RNA, 16 nt, Human adenovirus B [HAdV-B]
gacaggcgcuuagaaa

SEQ ID NO: 1546980 - RNA, 21 nt, Human adenovirus B [HAdV-B]
gucucaguguucgagucaggg

SEQ ID NO: 1546981 - RNA, 15 nt, Human adenovirus B [HAdV-B]
ugcuagauggaacag

SEQ ID NO: 1546982 - RNA, 19 nt, Human adenovirus B [HAdV-B]
gaaucauguccaccugggg

SEQ ID NO: 1546983 - RNA, 19 nt, Human adenovirus B [HAdV-B]
gaggcagucuaccugcgua

SEQ ID NO: 1546984 - RNA, 19 nt, Human adenovirus B [HAdV-B]
guucugacgagaaucagaa

SEQ ID NO: 1546985 - RNA, 13 nt, Human adenovirus B [HAdV-B]
ccuuccaguacuc

SEQ ID NO: 1546986 - RNA, 19 nt, Human adenovirus B [HAdV-B]
uucagaagacaugcaugac

SEQ ID NO: 1546987 - RNA, 20 nt, Human adenovirus B [HAdV-B]
ugaaaguauggaagugcaaa

SEQ ID NO: 1546988 - RNA, 18 nt, Human adenovirus B [HAdV-B]
uggacucugacacuccug

SEQ ID NO: 1546989 - RNA, 12 nt, Human adenovirus B [HAdV-B]
augaggccacaa

SEQ ID NO: 1546990 - RNA, 14 nt, Human adenovirus B [HAdV-B]
ucuguugaaauuuu

SEQ ID NO: 1546991 - RNA, 15 nt, Human adenovirus B [HAdV-B]
augggcgaagaggag

SEQ ID NO: 1546992 - RNA, 19 nt, Human adenovirus B [HAdV-B]
aggaugcauuauuggacag

SEQ ID NO: 1546993 - RNA, 13 nt, Human adenovirus B [HAdV-B]
aauguuagcaaag

SEQ ID NO: 1546994 - RNA, 14 nt, Human adenovirus B [HAdV-B]
ucacaagacaagcc

SEQ ID NO: 1546995 - RNA, 11 nt, Human adenovirus B [HAdV-B]
ucuuccuucac

SEQ ID NO: 1546996 - RNA, 19 nt, Human adenovirus B [HAdV-B]
accguucaauuuguggagg

SEQ ID NO: 1546997 - RNA, 14 nt, Human adenovirus B [HAdV-B]
cacuugccacccuc

SEQ ID NO: 1546998 - RNA, 18 nt, Human adenovirus B [HAdV-B]
cucaaacugcacacuaaa

SEQ ID NO: 1546999 - RNA, 20 nt, Human adenovirus B [HAdV-B]
cucgcgugccaggcacuucc

SEQ ID NO: 1547000 - RNA, 15 nt, Human adenovirus B [HAdV-B]
guauggaagugcaaa

SEQ ID NO: 1547001 - RNA, 14 nt, Human adenovirus B [HAdV-B]
cccgcaggcaagca

SEQ ID NO: 1547002 - RNA, 13 nt, Human adenovirus B [HAdV-B]
cagacacaucacu

SEQ ID NO: 1547003 - RNA, 18 nt, Human adenovirus B [HAdV-B]
guuguaucugguggacaa

SEQ ID NO: 1547004 - RNA, 18 nt, Human adenovirus B [HAdV-B]
cacugaaacaccaucagc

SEQ ID NO: 1547005 - RNA, 18 nt, Human adenovirus B [HAdV-B]
ucggcuuacgagcagaca

SEQ ID NO: 1547006 - RNA, 19 nt, Human adenovirus B [HAdV-B]
cggucacuuugcagcaagu

SEQ ID NO: 1547007 - RNA, 22 nt, Human adenovirus B [HAdV-B]
cagccuguacuucuccaucagc

SEQ ID NO: 1547008 - RNA, 16 nt, Human adenovirus B [HAdV-B]
gcaacgggugcuuacu

SEQ ID NO: 1547009 - RNA, 20 nt, Human adenovirus B [HAdV-B]
gcgcuuugggacaggaagac

SEQ ID NO: 1547010 - RNA, 16 nt, Human adenovirus B [HAdV-B]
cgaguaucaucacuua

SEQ ID NO: 1547011 - RNA, 13 nt, Human adenovirus B [HAdV-B]
aggaucacagaga

SEQ ID NO: 1547012 - RNA, 18 nt, Human adenovirus B [HAdV-B]
uucuccggaucuccuggg

SEQ ID NO: 1547013 - RNA, 18 nt, Human adenovirus B [HAdV-B]
cgagagccggccuggacc

SEQ ID NO: 1547014 - RNA, 22 nt, Human adenovirus B [HAdV-B]
aauggagugguagauuuggcua

SEQ ID NO: 1547015 - RNA, 20 nt, Human adenovirus B [HAdV-B]
cacaggcucccuguucccag

SEQ ID NO: 1547016 - RNA, 23 nt, Human adenovirus B [HAdV-B]
cagaccauuaacuuugaugaacg

SEQ ID NO: 1547017 - RNA, 13 nt, Human adenovirus B [HAdV-B]
caucgugcucagu

SEQ ID NO: 1547018 - RNA, 17 nt, Human adenovirus B [HAdV-B]
acagauuugcauuuccc

SEQ ID NO: 1547019 - RNA, 21 nt, Human adenovirus B [HAdV-B]
aucccgugcugcgacagaugc

SEQ ID NO: 1547020 - RNA, 14 nt, Human adenovirus B [HAdV-B]
gauucucacuugcc

SEQ ID NO: 1547021 - RNA, 17 nt, Human adenovirus B [HAdV-B]
acagaaaaccagcagcg

SEQ ID NO: 1547022 - RNA, 13 nt, Human adenovirus B [HAdV-B]
guaauuaaaucca

SEQ ID NO: 1547023 - RNA, 12 nt, Human adenovirus B [HAdV-B]
gcuacugcugua

SEQ ID NO: 1547024 - RNA, 23 nt, Human adenovirus B [HAdV-B]
accaagagucaauugucucugaa

SEQ ID NO: 1547025 - RNA, 13 nt, Human adenovirus B [HAdV-B]
cgaucuucucaau

SEQ ID NO: 1547026 - RNA, 19 nt, Human adenovirus B [HAdV-B]
ugccuuguaagggcagcag

SEQ ID NO: 1547027 - RNA, 23 nt, Human adenovirus B [HAdV-B]
aagcuguguacucccagcagcuc

SEQ ID NO: 1547028 - RNA, 21 nt, Human adenovirus B [HAdV-B]
caaccuggguucgcugguggc

SEQ ID NO: 1547029 - RNA, 21 nt, Human adenovirus B [HAdV-B]
aggaccagugcuuugagcgcg

SEQ ID NO: 1547030 - RNA, 18 nt, Human adenovirus B [HAdV-B]
ugcccacauccagaucuu

SEQ ID NO: 1547031 - RNA, 13 nt, Human adenovirus B [HAdV-B]
guaucggaggagg

SEQ ID NO: 1547032 - RNA, 22 nt, Human adenovirus B [HAdV-B]
ggcacgauucucacuugccacc

SEQ ID NO: 1547033 - RNA, 17 nt, Human adenovirus B [HAdV-B]
agaggugggauugaaug

SEQ ID NO: 1547034 - RNA, 17 nt, Human adenovirus B [HAdV-B]
gcucgggauucuccuuu

SEQ ID NO: 1547035 - RNA, 23 nt, Human adenovirus B [HAdV-B]
gaacaauaccuuauccaccacau

SEQ ID NO: 1547036 - RNA, 19 nt, Human adenovirus B [HAdV-B]
cgcaaaguucgacaugugu

SEQ ID NO: 1547037 - RNA, 13 nt, Human adenovirus B [HAdV-B]
guucucgcuggcc

SEQ ID NO: 1547038 - RNA, 14 nt, Human adenovirus B [HAdV-B]
cugcagagccagcc

SEQ ID NO: 1547039 - RNA, 18 nt, Human adenovirus B [HAdV-B]
uaacuuuuguaaauguua

SEQ ID NO: 1547040 - RNA, 20 nt, Human adenovirus B [HAdV-B]
acauugucuuacugccuggc

SEQ ID NO: 1547041 - RNA, 21 nt, Human adenovirus B [HAdV-B]
guuucacuuccgcaaucccaa

SEQ ID NO: 1547042 - RNA, 19 nt, Human adenovirus B [HAdV-B]
augaggcuuucagagaggc

SEQ ID NO: 1547043 - RNA, 13 nt, Human adenovirus B [HAdV-B]
uguccaagcgcaa

SEQ ID NO: 1547044 - RNA, 15 nt, Human adenovirus B [HAdV-B]
uuugauuaagggaaa

SEQ ID NO: 1547045 - RNA, 16 nt, Human adenovirus B [HAdV-B]
cagcagcagcagcagc

SEQ ID NO: 1547046 - RNA, 23 nt, Human adenovirus B [HAdV-B]
cuuuaaaauguuuaaccccacua

SEQ ID NO: 1547047 - RNA, 11 nt, Human adenovirus B [HAdV-B]
cuaggcagaga

SEQ ID NO: 1547048 - RNA, 19 nt, Human adenovirus B [HAdV-B]
auuguguucuccuaggcag

SEQ ID NO: 1547049 - RNA, 16 nt, Human adenovirus B [HAdV-B]
cuacuggucgcuucca

SEQ ID NO: 1547050 - RNA, 17 nt, Human adenovirus B [HAdV-B]
auuucauagccacagca

SEQ ID NO: 1547051 - RNA, 20 nt, Human adenovirus B [HAdV-B]
auucuguuugguaaaacaag

SEQ ID NO: 1547052 - RNA, 16 nt, Human adenovirus B [HAdV-B]
ccaguguaacaugaau

SEQ ID NO: 1547053 - RNA, 22 nt, Human adenovirus B [HAdV-B]
agaaucuuaccggcucugggca

SEQ ID NO: 1547054 - RNA, 24 nt, Human adenovirus B [HAdV-B]
cagugagcuggccuggaaaugaca

SEQ ID NO: 1547055 - RNA, 14 nt, Human adenovirus B [HAdV-B]
acaagaauuugaaa

SEQ ID NO: 1547056 - RNA, 16 nt, Human adenovirus B [HAdV-B]
uaaaccauaauuaaaa

SEQ ID NO: 1547057 - RNA, 18 nt, Human adenovirus B [HAdV-B]
auuccagucuccugccgc

SEQ ID NO: 1547058 - RNA, 14 nt, Human adenovirus B [HAdV-B]
ccaaacgccagaag

SEQ ID NO: 1547059 - RNA, 18 nt, Human adenovirus B [HAdV-B]
gucuccgguuuuuggaga

SEQ ID NO: 1547060 - RNA, 20 nt, Human adenovirus B [HAdV-B]
ugucgguagaagaaccugac

SEQ ID NO: 1547061 - RNA, 20 nt, Human adenovirus B [HAdV-B]
caccuuggauuugcccccuc

SEQ ID NO: 1547062 - RNA, 15 nt, Human adenovirus B [HAdV-B]
caccgucgaugaugu

SEQ ID NO: 1547063 - RNA, 19 nt, Human adenovirus B [HAdV-B]
ucaccugcggagcagagca

SEQ ID NO: 1547064 - RNA, 19 nt, Human adenovirus B [HAdV-B]
cucugacuggagcuggaac

SEQ ID NO: 1547065 - RNA, 23 nt, Human adenovirus B [HAdV-B]
uagcugaugggaguggggucauc

SEQ ID NO: 1547066 - RNA, 17 nt, Human adenovirus B [HAdV-B]
ggggugcuggcugguca

SEQ ID NO: 1547067 - RNA, 21 nt, Human adenovirus B [HAdV-B]
agaauguaucauucccugcag

SEQ ID NO: 1547068 - RNA, 14 nt, Human adenovirus B [HAdV-B]
ggcggguggugccg

SEQ ID NO: 1547069 - RNA, 12 nt, Human adenovirus B [HAdV-B]
guuuggaggagg

SEQ ID NO: 1547070 - RNA, 14 nt, Human adenovirus B [HAdV-B]
acgaggaggcagag

SEQ ID NO: 1547071 - RNA, 17 nt, Human adenovirus B [HAdV-B]
cggcaggcgccucccag

SEQ ID NO: 1547072 - RNA, 22 nt, Human adenovirus B [HAdV-B]
caggacaggcgcuuagaaauaa

SEQ ID NO: 1547073 - RNA, 16 nt, Human adenovirus B [HAdV-B]
ccuuagaaaaugcaaa

SEQ ID NO: 1547074 - RNA, 16 nt, Human adenovirus B [HAdV-B]
ccggucccacucgaag

SEQ ID NO: 1547075 - RNA, 21 nt, Human adenovirus B [HAdV-B]
gcggcgaggagccggaggaga

SEQ ID NO: 1547076 - RNA, 15 nt, Human adenovirus B [HAdV-B]
gucccgauuuggaag

SEQ ID NO: 1547077 - RNA, 19 nt, Human adenovirus B [HAdV-B]
caugaaagccuuugcuguc

SEQ ID NO: 1547078 - RNA, 19 nt, Human adenovirus B [HAdV-B]
augagaacaguaagaaaga

SEQ ID NO: 1547079 - RNA, 13 nt, Human adenovirus B [HAdV-B]
ggcgggcacccaa

SEQ ID NO: 1547080 - RNA, 24 nt, Human adenovirus B [HAdV-B]
ccgacugcagcacuggacaugaca

SEQ ID NO: 1547081 - RNA, 15 nt, Human adenovirus B [HAdV-B]
gcagcagcaaucaca

SEQ ID NO: 1547082 - RNA, 16 nt, Human adenovirus B [HAdV-B]
cucguucaucauuucc

SEQ ID NO: 1547083 - RNA, 14 nt, Human adenovirus B [HAdV-B]
uacacugucucugu

SEQ ID NO: 1547084 - RNA, 16 nt, Human adenovirus B [HAdV-B]
acaugggagcugacuu

SEQ ID NO: 1547085 - RNA, 16 nt, Human adenovirus B [HAdV-B]
cauucaauucaaacaa

SEQ ID NO: 1547086 - RNA, 19 nt, Human adenovirus B [HAdV-B]
gggacagucaggcagagga

SEQ ID NO: 1547087 - RNA, 18 nt, Human adenovirus B [HAdV-B]
caggaaagucccgcuccc

SEQ ID NO: 1547088 - RNA, 20 nt, Human adenovirus B [HAdV-B]
cgaguuuacuuugccagaag

SEQ ID NO: 1547089 - RNA, 16 nt, Human adenovirus B [HAdV-B]
ugugggagggguagcg

SEQ ID NO: 1547090 - RNA, 18 nt, Human adenovirus B [HAdV-B]
acgccuuacauguggagu

SEQ ID NO: 1547091 - RNA, 19 nt, Human adenovirus B [HAdV-B]
ucuaaauacacauacaaag

SEQ ID NO: 1547092 - RNA, 13 nt, Human adenovirus B [HAdV-B]
caccacaccacuc

SEQ ID NO: 1547093 - RNA, 19 nt, Human adenovirus B [HAdV-B]
ucuaccuugacccccagac

SEQ ID NO: 1547094 - RNA, 21 nt, Human adenovirus B [HAdV-B]
uccaucacaagacaagccaca

SEQ ID NO: 1547095 - RNA, 17 nt, Human adenovirus B [HAdV-B]
gcugccccgaaaccagu

SEQ ID NO: 1547096 - RNA, 22 nt, Human adenovirus B [HAdV-B]
augacccagaugccugugauga

SEQ ID NO: 1547097 - RNA, 22 nt, Human adenovirus B [HAdV-B]
ugcgucaucacccagggggcaa

SEQ ID NO: 1547098 - RNA, 16 nt, Human adenovirus B [HAdV-B]
gcacaacuacuuucuc

SEQ ID NO: 1547099 - RNA, 21 nt, Human adenovirus B [HAdV-B]
auuacagccaacgagccagcg

SEQ ID NO: 1547100 - RNA, 18 nt, Human adenovirus B [HAdV-B]
aaccacgaaaaugccaaa

SEQ ID NO: 1547101 - RNA, 18 nt, Human adenovirus B [HAdV-B]
caacagacccaacuacau

SEQ ID NO: 1547102 - RNA, 11 nt, Human adenovirus B [HAdV-B]
cuacuccuggu

SEQ ID NO: 1547103 - RNA, 18 nt, Human adenovirus B [HAdV-B]
cugcguauguagcauagu

SEQ ID NO: 1547104 - RNA, 22 nt, Human adenovirus B [HAdV-B]
cccgcaaugcgggcggcgcugc

SEQ ID NO: 1547105 - RNA, 15 nt, Human adenovirus B [HAdV-B]
cauacaugccacaga

SEQ ID NO: 1547106 - RNA, 14 nt, Human adenovirus B [HAdV-B]
ucuuacugcuuuac

SEQ ID NO: 1547107 - RNA, 14 nt, Human adenovirus B [HAdV-B]
gaacauuggugcca

SEQ ID NO: 1547108 - RNA, 15 nt, Human adenovirus B [HAdV-B]
cagguggacgagcag

SEQ ID NO: 1547109 - RNA, 23 nt, Human adenovirus B [HAdV-B]
cgcaggaggcgcaaacaguuuca

SEQ ID NO: 1547110 - RNA, 20 nt, Human adenovirus B [HAdV-B]
aucccacuaugcaacugaug

SEQ ID NO: 1547111 - RNA, 19 nt, Human adenovirus B [HAdV-B]
aaaauuugccaaaaaaaca

SEQ ID NO: 1547112 - RNA, 20 nt, Human adenovirus B [HAdV-B]
agcucaacgacuacaccgcu

SEQ ID NO: 1547113 - RNA, 16 nt, Human adenovirus B [HAdV-B]
aauuccagucuccugc

SEQ ID NO: 1547114 - RNA, 19 nt, Human adenovirus B [HAdV-B]
ugaaccacaacccccacua

SEQ ID NO: 1547115 - RNA, 11 nt, Human adenovirus B [HAdV-B]
ggaucuccugg

SEQ ID NO: 1547116 - RNA, 11 nt, Human adenovirus B [HAdV-B]
gcugcuacagc

SEQ ID NO: 1547117 - RNA, 15 nt, Human adenovirus B [HAdV-B]
ggccauuuuggaaga

SEQ ID NO: 1547118 - RNA, 15 nt, Human adenovirus B [HAdV-B]
gauagccccaauggc

SEQ ID NO: 1547119 - RNA, 11 nt, Human adenovirus B [HAdV-B]
gauuuggaaga

SEQ ID NO: 1547120 - RNA, 17 nt, Human adenovirus B [HAdV-B]
cuacccaacauccuguc

SEQ ID NO: 1547121 - RNA, 23 nt, Human adenovirus B [HAdV-B]
cgaugcccuacucaaucugggac

SEQ ID NO: 1547122 - RNA, 22 nt, Human adenovirus B [HAdV-B]
cugggaugggaucccgaaacca

SEQ ID NO: 1547123 - RNA, 18 nt, Human adenovirus B [HAdV-B]
gcaccacacuucugcccc

SEQ ID NO: 1547124 - RNA, 13 nt, Human adenovirus B [HAdV-B]
caguguaacauga

SEQ ID NO: 1547125 - RNA, 13 nt, Human adenovirus B [HAdV-B]
ggagggcagaaac

SEQ ID NO: 1547126 - RNA, 21 nt, Human adenovirus B [HAdV-B]
aauuugccaaaaaaacauuca

SEQ ID NO: 1547127 - RNA, 19 nt, Human adenovirus B [HAdV-B]
guagucaauauagaaauua

SEQ ID NO: 1547128 - RNA, 14 nt, Human adenovirus B [HAdV-B]
cacgcgcacaucca

SEQ ID NO: 1547129 - RNA, 16 nt, Human adenovirus B [HAdV-B]
gcuuccuuggaagagg

SEQ ID NO: 1547130 - RNA, 20 nt, Human adenovirus B [HAdV-B]
ccagcgugaugccaaccugg

SEQ ID NO: 1547131 - RNA, 14 nt, Human adenovirus B [HAdV-B]
gcgcugcagagcca

SEQ ID NO: 1547132 - RNA, 22 nt, Human adenovirus B [HAdV-B]
gaaagcaucauauugcuugaaa

SEQ ID NO: 1547133 - RNA, 21 nt, Human adenovirus B [HAdV-B]
cuggaugguaccuucuaccug

SEQ ID NO: 1547134 - RNA, 23 nt, Human adenovirus B [HAdV-B]
guugagcgccucggcugcguggc

SEQ ID NO: 1547135 - RNA, 18 nt, Human adenovirus B [HAdV-B]
uacccaguugaaaaccac

SEQ ID NO: 1547136 - RNA, 22 nt, Human adenovirus B [HAdV-B]
gagaccugcuaccaaugaauua

SEQ ID NO: 1547137 - RNA, 22 nt, Human adenovirus B [HAdV-B]
aguuacccuugguuugaugcau

SEQ ID NO: 1547138 - RNA, 22 nt, Human adenovirus B [HAdV-B]
gaugaaaccuucucaguugcau

SEQ ID NO: 1547139 - RNA, 17 nt, Human adenovirus B [HAdV-B]
aaaacaacggagcagcc

SEQ ID NO: 1547140 - RNA, 19 nt, Human adenovirus B [HAdV-B]
gcaccuuugaauugcaagg

SEQ ID NO: 1547141 - RNA, 19 nt, Human adenovirus B [HAdV-B]
acauaucagccagaaccuc

SEQ ID NO: 1547142 - RNA, 13 nt, Human adenovirus B [HAdV-B]
augaacaaugcca

SEQ ID NO: 1547143 - RNA, 23 nt, Human adenovirus B [HAdV-B]
cgcguggggcgaagagccaugcu

SEQ ID NO: 1547144 - RNA, 18 nt, Human adenovirus B [HAdV-B]
agauaugugcagcagagc

SEQ ID NO: 1547145 - RNA, 19 nt, Human adenovirus B [HAdV-B]
ugcaguagguacaacacau

SEQ ID NO: 1547146 - RNA, 22 nt, Human adenovirus B [HAdV-B]
ggaacagcaguacaggacaggc

SEQ ID NO: 1547147 - RNA, 21 nt, Human adenovirus B [HAdV-B]
cggguuaaaaaggacaaaaaa

SEQ ID NO: 1547148 - RNA, 22 nt, Human adenovirus B [HAdV-B]
aucagccauggcuuaccagaca

SEQ ID NO: 1547149 - RNA, 18 nt, Human adenovirus B [HAdV-B]
ggcggcgcugcagagcca

SEQ ID NO: 1547150 - RNA, 18 nt, Human adenovirus B [HAdV-B]
gacgguaaaucugagcca

SEQ ID NO: 1547151 - RNA, 17 nt, Human adenovirus B [HAdV-B]
ucaggagccgaaaucuu

SEQ ID NO: 1547152 - RNA, 19 nt, Human adenovirus B [HAdV-B]
cuucuccggaucuccuggg

SEQ ID NO: 1547153 - RNA, 22 nt, Human adenovirus B [HAdV-B]
ucuuaaaccggucacuuugcag

SEQ ID NO: 1547154 - RNA, 20 nt, Human adenovirus B [HAdV-B]
aacugacgccgccgguccca

SEQ ID NO: 1547155 - RNA, 18 nt, Human adenovirus B [HAdV-B]
caaacccaacacacaccc

SEQ ID NO: 1547156 - RNA, 14 nt, Human adenovirus B [HAdV-B]
aaaagaagaggaag

SEQ ID NO: 1547157 - RNA, 11 nt, Human adenovirus B [HAdV-B]
uacaaaaccau

SEQ ID NO: 1547158 - RNA, 21 nt, Human adenovirus B [HAdV-B]
aaaacugguuagcugcacagc

SEQ ID NO: 1547159 - RNA, 19 nt, Human adenovirus B [HAdV-B]
gucucacgcuugccagcac

SEQ ID NO: 1547160 - RNA, 12 nt, Human adenovirus B [HAdV-B]
cgaucugagaaa

SEQ ID NO: 1547161 - RNA, 14 nt, Human adenovirus B [HAdV-B]
gggaugaaguuucu

SEQ ID NO: 1547162 - RNA, 17 nt, Human adenovirus B [HAdV-B]
gcuccgccaguccaccu

SEQ ID NO: 1547163 - RNA, 23 nt, Human adenovirus B [HAdV-B]
gaugcuggaaauagggaucagaa

SEQ ID NO: 1547164 - RNA, 22 nt, Human adenovirus B [HAdV-B]
uccaacaaccguggucauuucu

SEQ ID NO: 1547165 - RNA, 20 nt, Human adenovirus B [HAdV-B]
aguaagaaagaacaaaaagc

SEQ ID NO: 1547166 - RNA, 22 nt, Human adenovirus B [HAdV-B]
gccaccucguucaucauuuccc

SEQ ID NO: 1547167 - RNA, 11 nt, Human adenovirus B [HAdV-B]
ugcagcagcag

SEQ ID NO: 1547168 - RNA, 12 nt, Human adenovirus B [HAdV-B]
cugggaccuggu

SEQ ID NO: 1547169 - RNA, 17 nt, Human adenovirus B [HAdV-B]
cucgaagggguucauug

SEQ ID NO: 1547170 - RNA, 16 nt, Human adenovirus B [HAdV-B]
uagccccaauggccac

SEQ ID NO: 1547171 - RNA, 22 nt, Human adenovirus B [HAdV-B]
acugcccaaaacaacgagcaga

SEQ ID NO: 1547172 - RNA, 21 nt, Human adenovirus B [HAdV-B]
gcaguuggggauacuuaugau

SEQ ID NO: 1547173 - RNA, 20 nt, Human adenovirus B [HAdV-B]
ccgucgcuuccgaccuggca

SEQ ID NO: 1547174 - RNA, 14 nt, Human adenovirus B [HAdV-B]
gcgugccaggcacu

SEQ ID NO: 1547175 - RNA, 15 nt, Human adenovirus B [HAdV-B]
gaccacgguggugca

SEQ ID NO: 1547176 - RNA, 18 nt, Human adenovirus B [HAdV-B]
cggcaacugccgucuucu

SEQ ID NO: 1547177 - RNA, 20 nt, Human adenovirus B [HAdV-B]
agccguagacgccagcgcca

SEQ ID NO: 1547178 - RNA, 17 nt, Human adenovirus B [HAdV-B]
cuagcauaaguucaucg

SEQ ID NO: 1547179 - RNA, 16 nt, Human adenovirus B [HAdV-B]
auucuuaacagugcag

SEQ ID NO: 1547180 - RNA, 18 nt, Human adenovirus B [HAdV-B]
acugaagugcccaucagu

SEQ ID NO: 1547181 - RNA, 17 nt, Human adenovirus B [HAdV-B]
uguugggacgcggaaug

SEQ ID NO: 1547182 - RNA, 15 nt, Human adenovirus B [HAdV-B]
cuggcggcuccaccc

SEQ ID NO: 1547183 - RNA, 22 nt, Human adenovirus B [HAdV-B]
gacuauaaacaagaauuugaaa

SEQ ID NO: 1547184 - RNA, 21 nt, Human adenovirus B [HAdV-B]
ccugcugcuucucccaggcuc

SEQ ID NO: 1547185 - RNA, 17 nt, Human adenovirus B [HAdV-B]
cuaccuugacccccaga

SEQ ID NO: 1547186 - RNA, 19 nt, Human adenovirus B [HAdV-B]
ucgccacgagugccaucac

SEQ ID NO: 1547187 - RNA, 19 nt, Human adenovirus B [HAdV-B]
ugaugcagcagcagcaggc

SEQ ID NO: 1547188 - RNA, 22 nt, Human adenovirus B [HAdV-B]
accuuccggaaccacacugcca

SEQ ID NO: 1547189 - RNA, 15 nt, Human adenovirus B [HAdV-B]
ccucaaaacuccacu

SEQ ID NO: 1547190 - RNA, 20 nt, Human adenovirus B [HAdV-B]
cuagagagagaggaugaaaa

SEQ ID NO: 1547191 - RNA, 21 nt, Human adenovirus B [HAdV-B]
auggugggucuuugaaaaaug

SEQ ID NO: 1547192 - RNA, 17 nt, Human adenovirus B [HAdV-B]
uccgguauccugcccgc

SEQ ID NO: 1547193 - RNA, 17 nt, Human adenovirus B [HAdV-B]
ugagcugggaugggugc

SEQ ID NO: 1547194 - RNA, 20 nt, Human adenovirus B [HAdV-B]
gauugggacagucaggcaga

SEQ ID NO: 1547195 - RNA, 16 nt, Human adenovirus B [HAdV-B]
caccccggauugcaug

SEQ ID NO: 1547196 - RNA, 15 nt, Human adenovirus B [HAdV-B]
caagacaagccacag

SEQ ID NO: 1547197 - RNA, 20 nt, Human adenovirus B [HAdV-B]
gcugcaaagcuccaagcagg

SEQ ID NO: 1547198 - RNA, 17 nt, Human adenovirus B [HAdV-B]
accugaaguaaauggaa

SEQ ID NO: 1547199 - RNA, 15 nt, Human adenovirus B [HAdV-B]
ccaccuccacugaag

SEQ ID NO: 1547200 - RNA, 15 nt, Human adenovirus B [HAdV-B]
cggcgugccucugac

SEQ ID NO: 1547201 - RNA, 19 nt, Human adenovirus B [HAdV-B]
ucuaaggccauuugccauu

SEQ ID NO: 1547202 - RNA, 23 nt, Human adenovirus B [HAdV-B]
guucgaaccaccgucgaugaugu

SEQ ID NO: 1547203 - RNA, 16 nt, Human adenovirus B [HAdV-B]
caagcaaaccgacucc

SEQ ID NO: 1547204 - RNA, 19 nt, Human adenovirus B [HAdV-B]
acuuagaagauacugagca

SEQ ID NO: 1547205 - RNA, 16 nt, Human adenovirus B [HAdV-B]
gcagaagcuaaggcaa

SEQ ID NO: 1547206 - RNA, 23 nt, Human adenovirus B [HAdV-B]
cccacugaaaguauggaagugca

SEQ ID NO: 1547207 - RNA, 13 nt, Human adenovirus B [HAdV-B]
aaccaagcaaugc

SEQ ID NO: 1547208 - RNA, 18 nt, Human adenovirus B [HAdV-B]
cuuaagguucuguggaca

SEQ ID NO: 1547209 - RNA, 21 nt, Human adenovirus B [HAdV-B]
uggaaaucccaccccuagucu

SEQ ID NO: 1547210 - RNA, 13 nt, Human adenovirus B [HAdV-B]
aaugaggcuuuca

SEQ ID NO: 1547211 - RNA, 17 nt, Human adenovirus B [HAdV-B]
ggcggaugacuggcaga

SEQ ID NO: 1547212 - RNA, 15 nt, Human adenovirus B [HAdV-B]
gaggaugugagcgga

SEQ ID NO: 1547213 - RNA, 18 nt, Human adenovirus B [HAdV-B]
ugggacagucaggcagag

SEQ ID NO: 1547214 - RNA, 17 nt, Human adenovirus B [HAdV-B]
cgcaaguccccuuucag

SEQ ID NO: 1547215 - RNA, 20 nt, Human adenovirus B [HAdV-B]
ggcgccuucaauuggagcag

SEQ ID NO: 1547216 - RNA, 23 nt, Human adenovirus B [HAdV-B]
cuguacuucuccaucagcagaca

SEQ ID NO: 1547217 - RNA, 16 nt, Human adenovirus B [HAdV-B]
cuguagacgaucuggc

SEQ ID NO: 1547218 - RNA, 13 nt, Human adenovirus B [HAdV-B]
ugauugccacaga

SEQ ID NO: 1547219 - RNA, 14 nt, Human adenovirus B [HAdV-B]
uguuucaagcagga

SEQ ID NO: 1547220 - RNA, 20 nt, Human adenovirus B [HAdV-B]
aucacugguuaccgaggaag

SEQ ID NO: 1547221 - RNA, 15 nt, Human adenovirus B [HAdV-B]
cacaacgcacagccu

SEQ ID NO: 1547222 - RNA, 13 nt, Human adenovirus B [HAdV-B]
aagccaugcugcg

SEQ ID NO: 1547223 - RNA, 13 nt, Human adenovirus B [HAdV-B]
uaaacaagaauuu

SEQ ID NO: 1547224 - RNA, 14 nt, Human adenovirus B [HAdV-B]
ugcuacgaagagcu

SEQ ID NO: 1547225 - RNA, 13 nt, Human adenovirus B [HAdV-B]
gacuuaugcucag

SEQ ID NO: 1547226 - RNA, 17 nt, Human adenovirus B [HAdV-B]
uggggccgugggcagcg

SEQ ID NO: 1547227 - RNA, 19 nt, Human adenovirus B [HAdV-B]
uagaagcugcuacagcugc

SEQ ID NO: 1547228 - RNA, 17 nt, Human adenovirus B [HAdV-B]
ucaugaccagcaugaaa

SEQ ID NO: 1547229 - RNA, 15 nt, Human adenovirus B [HAdV-B]
ugccgcugccuccuu

SEQ ID NO: 1547230 - RNA, 17 nt, Human adenovirus B [HAdV-B]
aggguugcauucacugc

SEQ ID NO: 1547231 - RNA, 19 nt, Human adenovirus B [HAdV-B]
gcaacgaauuuucucccag

SEQ ID NO: 1547232 - RNA, 12 nt, Human adenovirus B [HAdV-B]
agcauguggaau

SEQ ID NO: 1547233 - RNA, 12 nt, Human adenovirus B [HAdV-B]
aauuccagucuc

SEQ ID NO: 1547234 - RNA, 17 nt, Human adenovirus B [HAdV-B]
guccugccaccaccucu

SEQ ID NO: 1547235 - RNA, 20 nt, Human adenovirus B [HAdV-B]
gcagcuccuuuagccagagg

SEQ ID NO: 1547236 - RNA, 15 nt, Human adenovirus B [HAdV-B]
caugacagacagagg

SEQ ID NO: 1547237 - RNA, 18 nt, Human adenovirus B [HAdV-B]
ucuugcuucuugcaaaua

SEQ ID NO: 1547238 - RNA, 20 nt, Human adenovirus B [HAdV-B]
gcccaaucgcgaagaggcaa

SEQ ID NO: 1547239 - RNA, 23 nt, Human adenovirus B [HAdV-B]
uagaugggauccucaaagaugcc

SEQ ID NO: 1547240 - RNA, 12 nt, Human adenovirus B [HAdV-B]
gcauacuuucuc

SEQ ID NO: 1547241 - RNA, 22 nt, Human adenovirus B [HAdV-B]
gaaaacugcacacuuacuuuug

SEQ ID NO: 1547242 - RNA, 16 nt, Human adenovirus B [HAdV-B]
gcucauggacaaacag

SEQ ID NO: 1547243 - RNA, 15 nt, Human adenovirus B [HAdV-B]
cuccggaucuccugg

SEQ ID NO: 1547244 - RNA, 15 nt, Human adenovirus B [HAdV-B]
cuucgcggcuggcca

SEQ ID NO: 1547245 - RNA, 20 nt, Human adenovirus B [HAdV-B]
cguacgagagcgugaugcag

SEQ ID NO: 1547246 - RNA, 22 nt, Human adenovirus B [HAdV-B]
gccccccgggaacaagagcagg

SEQ ID NO: 1547247 - RNA, 14 nt, Human adenovirus B [HAdV-B]
gacucuuaaagagu

SEQ ID NO: 1547248 - RNA, 14 nt, Human adenovirus B [HAdV-B]
caggagcggagccu

SEQ ID NO: 1547249 - RNA, 17 nt, Human adenovirus B [HAdV-B]
ucaaccccagcugccua

SEQ ID NO: 1547250 - RNA, 20 nt, Human adenovirus B [HAdV-B]
ugccagcgguucuggaggag

SEQ ID NO: 1547251 - RNA, 23 nt, Human adenovirus B [HAdV-B]
ccaacgguuuuuugaaagaaaac

SEQ ID NO: 1547252 - RNA, 19 nt, Human adenovirus B [HAdV-B]
gggucuaccuugaccccca

SEQ ID NO: 1547253 - RNA, 13 nt, Human adenovirus B [HAdV-B]
gcugcacagcacc

SEQ ID NO: 1547254 - RNA, 18 nt, Human adenovirus B [HAdV-B]
ggccugcgucaucaccca

SEQ ID NO: 1547255 - RNA, 14 nt, Human adenovirus B [HAdV-B]
guccuuugccaaac

SEQ ID NO: 1547256 - RNA, 14 nt, Human adenovirus B [HAdV-B]
cuaacgcuggagag

SEQ ID NO: 1547257 - RNA, 18 nt, Human adenovirus B [HAdV-B]
agcagacagggcuugcag

SEQ ID NO: 1547258 - RNA, 22 nt, Human adenovirus B [HAdV-B]
guuugugcgcgaguuugcccca

SEQ ID NO: 1547259 - RNA, 21 nt, Human adenovirus B [HAdV-B]
cuucccauuuaacagaauaca

SEQ ID NO: 1547260 - RNA, 19 nt, Human adenovirus B [HAdV-B]
gaucuaccgccagugcugu

SEQ ID NO: 1547261 - RNA, 13 nt, Human adenovirus B [HAdV-B]
guuccugcucuca

SEQ ID NO: 1547262 - RNA, 15 nt, Human adenovirus B [HAdV-B]
cccuccaguggagga

SEQ ID NO: 1547263 - RNA, 16 nt, Human adenovirus B [HAdV-B]
gcugucaaccugcccc

SEQ ID NO: 1547264 - RNA, 18 nt, Human adenovirus B [HAdV-B]
caggucccgcaggcaagc

SEQ ID NO: 1547265 - RNA, 17 nt, Human adenovirus B [HAdV-B]
uucucuagaaacuuuua

SEQ ID NO: 1547266 - RNA, 15 nt, Human adenovirus B [HAdV-B]
agaccugcuaccaau

SEQ ID NO: 1547267 - RNA, 18 nt, Human adenovirus B [HAdV-B]
cuacaucuacuguggaug

SEQ ID NO: 1547268 - RNA, 13 nt, Human adenovirus B [HAdV-B]
ccuuuagacagca

SEQ ID NO: 1547269 - RNA, 20 nt, Human adenovirus B [HAdV-B]
aguuauuagaugcugcauga

SEQ ID NO: 1547270 - RNA, 17 nt, Human adenovirus B [HAdV-B]
acuaucagaaugaccac

SEQ ID NO: 1547271 - RNA, 13 nt, Human adenovirus B [HAdV-B]
cgcuugccagggu

SEQ ID NO: 1547272 - RNA, 22 nt, Human adenovirus B [HAdV-B]
acguggaacucaccaaccuggu

SEQ ID NO: 1547273 - RNA, 22 nt, Human adenovirus B [HAdV-B]
aggauucggccgaugauagcag

SEQ ID NO: 1547274 - RNA, 14 nt, Human adenovirus B [HAdV-B]
caaacccacaagca

SEQ ID NO: 1547275 - RNA, 17 nt, Human adenovirus B [HAdV-B]
ccgacugcagcacugga

SEQ ID NO: 1547276 - RNA, 16 nt, Human adenovirus B [HAdV-B]
acagucaggcagagga

SEQ ID NO: 1547277 - RNA, 13 nt, Human adenovirus B [HAdV-B]
ugagcugggaugg

SEQ ID NO: 1547278 - RNA, 17 nt, Human adenovirus B [HAdV-B]
cccuacggaagccagca

SEQ ID NO: 1547279 - RNA, 11 nt, Human adenovirus B [HAdV-B]
uaauuggaagg

SEQ ID NO: 1547280 - RNA, 17 nt, Human adenovirus B [HAdV-B]
ucacaagacaagccaca

SEQ ID NO: 1547281 - RNA, 23 nt, Human adenovirus B [HAdV-B]
gccuacaucuacuguggaugcag

SEQ ID NO: 1547282 - RNA, 22 nt, Human adenovirus B [HAdV-B]
ggcccuggcagaacacacucuu

SEQ ID NO: 1547283 - RNA, 15 nt, Human adenovirus B [HAdV-B]
cgaugucgucacagg

SEQ ID NO: 1547284 - RNA, 18 nt, Human adenovirus B [HAdV-B]
uggucauuucuugcuugc

SEQ ID NO: 1547285 - RNA, 20 nt, Human adenovirus B [HAdV-B]
cuagaucugaguuggcuuua

SEQ ID NO: 1547286 - RNA, 14 nt, Human adenovirus B [HAdV-B]
gaugagacaguguc

SEQ ID NO: 1547287 - RNA, 16 nt, Human adenovirus B [HAdV-B]
caaggccccagcagcc

SEQ ID NO: 1547288 - RNA, 14 nt, Human adenovirus B [HAdV-B]
ugaccccgggacug

SEQ ID NO: 1547289 - RNA, 14 nt, Human adenovirus B [HAdV-B]
cgcucuaaucccac

SEQ ID NO: 1547290 - RNA, 18 nt, Human adenovirus B [HAdV-B]
ucccgacgaaaguacggu

SEQ ID NO: 1547291 - RNA, 18 nt, Human adenovirus B [HAdV-B]
aagaucaacuucagcgca

SEQ ID NO: 1547292 - RNA, 17 nt, Human adenovirus B [HAdV-B]
gccaugcauugaaguga

SEQ ID NO: 1547293 - RNA, 13 nt, Human adenovirus B [HAdV-B]
guacugaugcuag

SEQ ID NO: 1547294 - RNA, 16 nt, Human adenovirus B [HAdV-B]
cauccuaaaaaacaag

SEQ ID NO: 1547295 - RNA, 17 nt, Human adenovirus B [HAdV-B]
caagcucuuacagaaau

SEQ ID NO: 1547296 - RNA, 12 nt, Human adenovirus B [HAdV-B]
cgcuugccuucu

SEQ ID NO: 1547297 - RNA, 20 nt, Human adenovirus B [HAdV-B]
gccaccuccacugaagugca

SEQ ID NO: 1547298 - RNA, 21 nt, Human adenovirus B [HAdV-B]
gucaugggugcuaccgcggcu

SEQ ID NO: 1547299 - RNA, 17 nt, Human adenovirus B [HAdV-B]
cggcaggucccgcaggc

SEQ ID NO: 1547300 - RNA, 18 nt, Human adenovirus B [HAdV-B]
ccuacuacgccugcugcu

SEQ ID NO: 1547301 - RNA, 16 nt, Human adenovirus B [HAdV-B]
ucgaaggcgggcauga

SEQ ID NO: 1547302 - RNA, 16 nt, Human adenovirus B [HAdV-B]
ucaauucaaacaacau

SEQ ID NO: 1547303 - RNA, 21 nt, Human adenovirus B [HAdV-B]
ccuuggcuccgcgacacggca

SEQ ID NO: 1547304 - RNA, 14 nt, Human adenovirus B [HAdV-B]
gcuauacuaccaau

SEQ ID NO: 1547305 - RNA, 14 nt, Human adenovirus B [HAdV-B]
aaugcacaugauca

SEQ ID NO: 1547306 - RNA, 16 nt, Human adenovirus B [HAdV-B]
agaaugacccgcaggc

SEQ ID NO: 1547307 - RNA, 13 nt, Human adenovirus B [HAdV-B]
guuuggaggagga

SEQ ID NO: 1547308 - RNA, 21 nt, Human adenovirus B [HAdV-B]
ccuagucuacccuuuucucua

SEQ ID NO: 1547309 - RNA, 20 nt, Human adenovirus B [HAdV-B]
cagacgguaaaucugagcca

SEQ ID NO: 1547310 - RNA, 14 nt, Human adenovirus B [HAdV-B]
uuuuccaacuuaua

SEQ ID NO: 1547311 - RNA, 13 nt, Human adenovirus B [HAdV-B]
gauugccacagcu

SEQ ID NO: 1547312 - RNA, 12 nt, Human adenovirus B [HAdV-B]
ggaggaggaaca

SEQ ID NO: 1547313 - RNA, 15 nt, Human adenovirus B [HAdV-B]
ccacaacgcacagcc

SEQ ID NO: 1547314 - RNA, 22 nt, Human adenovirus B [HAdV-B]
gcguugguggagaacaaagcua

SEQ ID NO: 1547315 - RNA, 15 nt, Human adenovirus B [HAdV-B]
gggcggcgcugcaga

SEQ ID NO: 1547316 - RNA, 15 nt, Human adenovirus B [HAdV-B]
acagucaggcagagg

SEQ ID NO: 1547317 - RNA, 14 nt, Human adenovirus B [HAdV-B]
gagacgagccuggg

SEQ ID NO: 1547318 - RNA, 17 nt, Human adenovirus B [HAdV-B]
acugaccaucgccucuc

SEQ ID NO: 1547319 - RNA, 19 nt, Human adenovirus B [HAdV-B]
uggauguagaugccuauga

SEQ ID NO: 1547320 - RNA, 17 nt, Human adenovirus B [HAdV-B]
gccacgagugccaucac

SEQ ID NO: 1547321 - RNA, 15 nt, Human adenovirus B [HAdV-B]
cugucgguagaagaa

SEQ ID NO: 1547322 - RNA, 22 nt, Human adenovirus B [HAdV-B]
agcaacgcauucugauuucacu

SEQ ID NO: 1547323 - RNA, 22 nt, Human adenovirus B [HAdV-B]
gcaaauacaaggaagaaaugcu

SEQ ID NO: 1547324 - RNA, 17 nt, Human adenovirus B [HAdV-B]
gauuucugugggacgac

SEQ ID NO: 1547325 - RNA, 16 nt, Human adenovirus B [HAdV-B]
cuguauaggagcauuu

SEQ ID NO: 1547326 - RNA, 12 nt, Human adenovirus B [HAdV-B]
aucacccagcaa

SEQ ID NO: 1547327 - RNA, 16 nt, Human adenovirus B [HAdV-B]
guugauuuaaaaucaa

SEQ ID NO: 1547328 - RNA, 18 nt, Human adenovirus B [HAdV-B]
aaguccccuuucagaaga

SEQ ID NO: 1547329 - RNA, 14 nt, Human adenovirus B [HAdV-B]
aaaaucaauucaca

SEQ ID NO: 1547330 - RNA, 18 nt, Human adenovirus B [HAdV-B]
ccgagcuaccacugccau

SEQ ID NO: 1547331 - RNA, 16 nt, Human adenovirus B [HAdV-B]
gaaaucuugaaaucac

SEQ ID NO: 1547332 - RNA, 19 nt, Human adenovirus B [HAdV-B]
cauuaagauucccacugaa

SEQ ID NO: 1547333 - RNA, 13 nt, Human adenovirus B [HAdV-B]
ugugcagcagagc

SEQ ID NO: 1547334 - RNA, 20 nt, Human adenovirus B [HAdV-B]
caaggccccagcagccaagg

SEQ ID NO: 1547335 - RNA, 11 nt, Human adenovirus B [HAdV-B]
acacagcagcg

SEQ ID NO: 1547336 - RNA, 21 nt, Human adenovirus B [HAdV-B]
cuuaagcauuccaccgcccag

SEQ ID NO: 1547337 - RNA, 13 nt, Human adenovirus B [HAdV-B]
cugcacagcaccc

SEQ ID NO: 1547338 - RNA, 16 nt, Human adenovirus B [HAdV-B]
gucucuguugaaauuu

SEQ ID NO: 1547339 - RNA, 15 nt, Human adenovirus B [HAdV-B]
agcucagagccauug

SEQ ID NO: 1547340 - RNA, 16 nt, Human adenovirus B [HAdV-B]
uacauuccagaaggau

SEQ ID NO: 1547341 - RNA, 16 nt, Human adenovirus B [HAdV-B]
cuucaacaaguacugc

SEQ ID NO: 1547342 - RNA, 21 nt, Human adenovirus B [HAdV-B]
agcgcuccagccaaaacucau

SEQ ID NO: 1547343 - RNA, 23 nt, Human adenovirus B [HAdV-B]
ugccccacggcgacgcgugcaau

SEQ ID NO: 1547344 - RNA, 21 nt, Human adenovirus B [HAdV-B]
caucaccgaacccgaggggag

SEQ ID NO: 1547345 - RNA, 20 nt, Human adenovirus B [HAdV-B]
ugucggccaaguagcaguuu

SEQ ID NO: 1547346 - RNA, 17 nt, Human adenovirus B [HAdV-B]
guucuggaggaggaaca

SEQ ID NO: 1547347 - RNA, 23 nt, Human adenovirus B [HAdV-B]
acagcauuguggagaacauggaa

SEQ ID NO: 1547348 - RNA, 12 nt, Human adenovirus B [HAdV-B]
ucuggggucuug

SEQ ID NO: 1547349 - RNA, 22 nt, Human adenovirus B [HAdV-B]
cugccaccaccucuacccuaga

SEQ ID NO: 1547350 - RNA, 21 nt, Human
agggacaggaccccagcucug

SEQ ID NO: 1547351 - RNA, 13 nt, Human
agcaucuaucaga

SEQ ID NO: 1547352 - RNA, 19 nt, Human
accacgggcccggguuggg

SEQ ID NO: 1547353 - RNA, 15 nt, Human
aagagucgcugugcc

SEQ ID NO: 1547354 - RNA, 22 nt, Human
aagagucgcugugccacaggcu

SEQ ID NO: 1547355 - RNA, 17 nt, Human
gccggccaguggccuuc

SEQ ID NO: 1547356 - RNA, 16 nt, Human
gccaccccgagggcug

SEQ ID NO: 1547357 - RNA, 23 nt, Human
gccaccccgagggcugagccugg

SEQ ID NO: 1547358 - RNA, 17 nt, Human
gccaccccgagggcuga

SEQ ID NO: 1547359 - RNA, 12 nt, Human
ggaccccagcuc

SEQ ID NO: 1547360 - RNA, 15 nt, Human
ggaccccagcucugc

SEQ ID NO: 1547361 - RNA, 13 nt, Human
ggaccccagcucu

SEQ ID NO: 1547362 - RNA, 17 nt, Human
aaaagcuggauuuucuu

SEQ ID NO: 1547363 - RNA, 18 nt, Human
gaccucgugccaccccga

SEQ ID NO: 1547364 - RNA, 20 nt, Human
gagggcugagccugguccca

SEQ ID NO: 1547365 - RNA, 20 nt, Human
cuuauuagaaaaauauuaua

SEQ ID NO: 1547366 - RNA, 14 nt, Human
cuggaugauauuuu

SEQ ID NO: 1547367 - RNA, 16 nt, Human
cuggaugcccaggaau

SEQ ID NO: 1547368 - RNA, 13 nt, Human
cuggaugcccagg

SEQ ID NO: 1547369 - RNA, 14 nt, Human
cuggaugcccagga

SEQ ID NO: 1547370 - RNA, 15 nt, Human
cuggaugcccaggaa

SEQ ID NO: 1547371 - RNA, 11 nt, Human
cuggugcccug

SEQ ID NO: 1547372 - RNA, 12 nt, Human
cugcagccugca

SEQ ID NO: 1547373 - RNA, 14 nt, Human
cugcagccugcagg

SEQ ID NO: 1547374 - RNA, 19 nt, Human
cugcagccugcaggaccuc

SEQ ID NO: 1547375 - RNA, 15 nt, Human
cugcagccugcagga

SEQ ID NO: 1547376 - RNA, 14 nt, Human
cauuuguuguuuga

SEQ ID NO: 1547377 - RNA, 17 nt, Human
caggaccucgugccacc

SEQ ID NO: 1547378 - RNA, 12 nt, Human
caggaccccagc

SEQ ID NO: 1547379 - RNA, 13 nt, Human
caggaccccagcu

SEQ ID NO: 1547380 - RNA, 14 nt, Human
caggaccccagcuc

SEQ ID NO: 1547381 - RNA, 15 nt, Human
caggaccccagcucu

SEQ ID NO: 1547382 - RNA, 18 nt, Human
ccagacuugggaggaugu

SEQ ID NO: 1547383 - RNA, 15 nt, Human
ccagaucaaggaugu

SEQ ID NO: 1547384 - RNA, 15 nt, Human
ccagacggggcugga

SEQ ID NO: 1547385 - RNA, 23 nt, Human
cccagcaugcaccacgggcccgg

SEQ ID NO: 1547386 - RNA, 19 nt, Human
cccagcaugcaccacgggc

SEQ ID NO: 1547387 - RNA, 15 nt, Human
cccuggaugcccagg

SEQ ID NO: 1547388 - RNA, 16 nt, Human
cccuggaugcccagga

SEQ ID NO: 1547389 - RNA, 13 nt, Human
cccugacagggcc

SEQ ID NO: 1547390 - RNA, 16 nt, Human
cccugacagggccagu

SEQ ID NO: 1547391 - RNA, 14 nt, Human
cuaagucauucaua

SEQ ID NO: 1547392 - RNA, 12 nt, Human
ccuuccccagca

SEQ ID NO: 1547393 - RNA, 13 nt, Human
ccuuccccagcau

SEQ ID NO: 1547394 - RNA, 21 nt, Human
cucgugccaccccgagggcug

SEQ ID NO: 1547395 - RNA, 18 nt, Human
uuuuccaaucauuugacu

SEQ ID NO: 1547396 - RNA, 21 nt, Human
uuugacacuuauagauugaaa

SEQ ID NO: 1547397 - RNA, 16 nt, Human
auuauaacucauuugu

SEQ ID NO: 1547398 - RNA, 13 nt, Human
auuauaaaguuuu

SEQ ID NO: 1547399 - RNA, 16 nt, Human
auuauaaaguuuucua

SEQ ID NO: 1547400 - RNA, 12 nt, Human
uuuuugauauau

SEQ ID NO: 1547401 - RNA, 23 nt, Human
uuuaggauguguauuucauuuau

SEQ ID NO: 1547402 - RNA, 20 nt, Human
uuuacuucuaagucauucau

SEQ ID NO: 1547403 - RNA, 12 nt, Human
ugugccacaggc

SEQ ID NO: 1547404 - RNA, 16 nt, Human
ugugccacaggcuuag

SEQ ID NO: 1547405 - RNA, 19 nt, Human
agucucaugccuugagauc

SEQ ID NO: 1547406 - RNA, 21 nt, Human
agucucaugccuugagaucug

SEQ ID NO: 1547407 - RNA, 14 nt, Human
uguaguaucucaua

SEQ ID NO: 1547408 - RNA, 19 nt, Human
uggugcccuggaugcccag

SEQ ID NO: 1547409 - RNA, 18 nt, Human
aggugauauuuuucuuau

SEQ ID NO: 1547410 - RNA, 22 nt, Human
aggggugcggcggucccagcuc

SEQ ID NO: 1547411 - RNA, 20 nt, Human
aggggugcggcggucccagc

SEQ ID NO: 1547412 - RNA, 21 nt, Human
aggggugcggcggucccagcu

SEQ ID NO: 1547413 - RNA, 23 nt, Human
aggggugcggcggucccagcucc

SEQ ID NO: 1547414 - RNA, 14 nt, Human
uggggccaugccuc

SEQ ID NO: 1547415 - RNA, 19 nt, Human
uggggccaugccuccucag

SEQ ID NO: 1547416 - RNA, 21 nt, Human
uggggccaugccuccucagga

SEQ ID NO: 1547417 - RNA, 20 nt, Human
uggggccaugccuccucagg

SEQ ID NO: 1547418 - RNA, 13 nt, Human
agggaggcagggg

SEQ ID NO: 1547419 - RNA, 21 nt, Human
uggagugugaggguccugcag

SEQ ID NO: 1547420 - RNA, 16 nt, Human
aggagccgaagcccag

SEQ ID NO: 1547421 - RNA, 18 nt, Human
aggagccgaagcccaggg

SEQ ID NO: 1547422 - RNA, 15 nt, Human
agagucuccauuuaa

SEQ ID NO: 1547423 - RNA, 20 nt, Human
acuugaauaaccaucugaaa

SEQ ID NO: 1547424 - RNA, 19 nt, Human
acuugaauaaccaucugaa

SEQ ID NO: 1547425 - RNA, 15 nt, Human
acuuauagauugaaa

SEQ ID NO: 1547426 - RNA, 13 nt, Human
ucgguccuggugc

SEQ ID NO: 1547427 - RNA, 16 nt, Human
ucgguccuggugcccu

SEQ ID NO: 1547428 - RNA, 20 nt, Human
acgggcccggguugggucac

SEQ ID NO: 1547429 - RNA, 21 nt, Human
acgggcccggguugggucacc

SEQ ID NO: 1547430 - RNA, 16 nt, Human
acgggcccggguuggg

SEQ ID NO: 1547431 - RNA, 17 nt, Human
acgggcccggguugggu

SEQ ID NO: 1547432 - RNA, 19 nt, Human
accucgugccaccccgagg

SEQ ID NO: 1547433 - RNA, 23 nt, Human
accucgugccaccccgagggcug

SEQ ID NO: 1547434 - RNA, 18 nt, Human
acaguugcuguuguguga

SEQ ID NO: 1547435 - RNA, 14 nt, Human
accagacggggcug

SEQ ID NO: 1547436 - RNA, 15 nt, Human
accagacggggcugg

SEQ ID NO: 1547437 - RNA, 21 nt, Human
accagacggggcuggagugug

SEQ ID NO: 1547438 - RNA, 16 nt, Human
accagacggggcugga

SEQ ID NO: 1547439 - RNA, 12 nt, Human
accauuauuuuu

SEQ ID NO: 1547440 - RNA, 18 nt, Human
uaguuuugugaaggugau

SEQ ID NO: 1547441 - RNA, 22 nt, Human
gugccguguccccugacagggc

SEQ ID NO: 1547442 - RNA, 23 nt, Human
gugccguguccccugacagggcc

SEQ ID NO: 1547443 - RNA, 16 nt, Human
aacauuugcugucagc

SEQ ID NO: 1547444 - RNA, 17 nt, Human
caccagacggggcugga

SEQ ID NO: 1547445 - RNA, 16 nt, Human
caccagacggggcugg

SEQ ID NO: 1547446 - RNA, 14 nt, Human
uuugauauaugaaa

SEQ ID NO: 1547447 - RNA, 22 nt, Human
uuccccagcaugcaccacgggc

SEQ ID NO: 1547448 - RNA, 17 nt, Human
ugugaggguccugcagc

SEQ ID NO: 1547449 - RNA, 23 nt, Human
uguggggccaugccuccucagga

SEQ ID NO: 1547450 - RNA, 15 nt, Human
uguuguuuuuggaug

SEQ ID NO: 1547451 - RNA, 14 nt, Human
uguguaguuccagc

SEQ ID NO: 1547452 - RNA, 19 nt, Human
uggaugauauuuuuuauca

SEQ ID NO: 1547453 - RNA, 14 nt, Human
uggaugcccaggaa

SEQ ID NO: 1547454 - RNA, 13 nt, Human
uggaugcccagga

SEQ ID NO: 1547455 - RNA, 17 nt, Human
ugccaccccgagggcug

SEQ ID NO: 1547456 - RNA, 18 nt, Human
ugccaccccgagggcuga

SEQ ID NO: 1547457 - RNA, 12 nt, Human
uccuggugcccu

SEQ ID NO: 1547458 - RNA, 13 nt, Human
uccuggugcccug

SEQ ID NO: 1547459 - RNA, 22 nt, Human
uccuggugcccuggaugcccag

SEQ ID NO: 1547460 - RNA, 14 nt, Human
guuuucuaaauuua

SEQ ID NO: 1547461 - RNA, 16 nt, Human
uaagagguugauuaua

SEQ ID NO: 1547462 - RNA, 16 nt, Human
uacagaaauauccaug

SEQ ID NO: 1547463 - RNA, 18 nt, Human
uacuugaauaaccaucug

SEQ ID NO: 1547464 - RNA, 20 nt, Human
uacuugaauaaccaucugaa

SEQ ID NO: 1547465 - RNA, 22 nt, Human
ggggugcggcggucccagcucc

SEQ ID NO: 1547466 - RNA, 20 nt, Human
ggggugcggcggucccagcu

SEQ ID NO: 1547467 - RNA, 21 nt, Human
gggugcggcggucccagcucc

SEQ ID NO: 1547468 - RNA, 19 nt, Human
ggucaccagacggggcugg

SEQ ID NO: 1547469 - RNA, 11 nt, Human
ggcugagccug

SEQ ID NO: 1547470 - RNA, 22 nt, Human
ggagccgaagcccaggggccgg

SEQ ID NO: 1547471 - RNA, 15 nt, Human
ggagccgaagcccag

SEQ ID NO: 1547472 - RNA, 17 nt, Human
ggagccgaagcccaggg

SEQ ID NO: 1547473 - RNA, 19 nt, Human
ggagccgaagcccaggggc

SEQ ID NO: 1547474 - RNA, 17 nt, Human
gccgggcaggguguggg

SEQ ID NO: 1547475 - RNA, 13 nt, Human
gccugcaggaccu

SEQ ID NO: 1547476 - RNA, 17 nt, Human
gccugcaggaccucgug

SEQ ID NO: 1547477 - RNA, 18 nt, Human
gccugcaggaccucgugc

SEQ ID NO: 1547478 - RNA, 23 nt, Human
gccugcaggaccucgugccaccc

SEQ ID NO: 1547479 - RNA, 13 nt, Human
gcggucccagcuc

SEQ ID NO: 1547480 - RNA, 14 nt, Human
gcggucccagcucc

SEQ ID NO: 1547481 - RNA, 18 nt, Human
gcggucccagcucccugg

SEQ ID NO: 1547482 - RNA, 22 nt, Human
gcggucccagcucccuggcucc

SEQ ID NO: 1547483 - RNA, 15 nt, Human
gcaggaccucgugcc

SEQ ID NO: 1547484 - RNA, 16 nt, Human
gcagccugcaggaccu

SEQ ID NO: 1547485 - RNA, 13 nt, Human
gcagccugcagga

SEQ ID NO: 1547486 - RNA, 15 nt, Human
gcaccacgggcccgg

SEQ ID NO: 1547487 - RNA, 14 nt, Human
gcaugcaccacggg

SEQ ID NO: 1547488 - RNA, 15 nt, Human
gcaugcaccacgggc

SEQ ID NO: 1547489 - RNA, 19 nt, Human
gcaagcucuuuuauaugcu

SEQ ID NO: 1547490 - RNA, 16 nt, Human
gaagcccaggggccgg

SEQ ID NO: 1547491 - RNA, 19 nt, Human
gaauaaucaaauacauuuu

SEQ ID NO: 1547492 - RNA, 16 nt, Human
gaaggugauuuauucu

SEQ ID NO: 1547493 - RNA, 18 nt, Human
gacagggccagugcaguu

SEQ ID NO: 1547494 - RNA, 24 nt, Human
cuuacuugcauaccaaguugauac

SEQ ID NO: 1547495 - RNA, 15 nt, Human
cgucgguccuggugc

SEQ ID NO: 1547496 - RNA, 21 nt, Human
cgggcaggguguggggccaug

SEQ ID NO: 1547497 - RNA, 16 nt, Human
ccugaagaacuauuuu

SEQ ID NO: 1547498 - RNA, 13 nt, Human
ccgagggcugagc

SEQ ID NO: 1547499 - RNA, 16 nt, Human
ccgagggcugagccug

SEQ ID NO: 1547500 - RNA, 22 nt, Human
ccgagggcugagccugguccca

SEQ ID NO: 1547501 - RNA, 18 nt, Human
ccccaggagggaggcagg

SEQ ID NO: 1547502 - RNA, 19 nt, Human
ccccaggagggaggcaggg

SEQ ID NO: 1547503 - RNA, 9 nt, Human
cccagcucc

SEQ ID NO: 1547504 - RNA, 16 nt, Human
cccaggugauauuuuu

SEQ ID NO: 1547505 - RNA, 12 nt, Human
cccaggggccgg

SEQ ID NO: 1547506 - RNA, 15 nt, Human
ccacaggcuuaggga

SEQ ID NO: 1547507 - RNA, 18 nt, Human
ccacaggcuuagggacag

SEQ ID NO: 1547508 - RNA, 19 nt, Human
ccacaggcuuagggacagg

SEQ ID NO: 1547509 - RNA, 21 nt, Human
ccacaggcuuagggacaggac

SEQ ID NO: 1547510 - RNA, 19 nt, Human
ggccaguggccuuccccag

SEQ ID NO: 1547511 - RNA, 22 nt, Human
ggccaguggccuuccccagcau

SEQ ID NO: 1547512 - RNA, 17 nt, Human
ggccaugccuccucagg

SEQ ID NO: 1547513 - RNA, 18 nt, Human
ggccaugccuccucagga

SEQ ID NO: 1547514 - RNA, 21 nt, Human
ggccaugccuccucaggagcc

SEQ ID NO: 1547515 - RNA, 14 nt, Human
gguccuggugcccu

SEQ ID NO: 1547516 - RNA, 24 nt, Human
gguccuggugcccuggaugcccag

SEQ ID NO: 1547517 - RNA, 12 nt, Human
gguccuggugcc

SEQ ID NO: 1547518 - RNA, 13 nt, Human
gguccuggugccc

SEQ ID NO: 1547519 - RNA, 13 nt, Human
gggccaugccucc

SEQ ID NO: 1547520 - RNA, 23 nt, Human
gggccaugccuccucaggagccg

SEQ ID NO: 1547521 - RNA, 22 nt, Human
gggccaugccuccucaggagcc

SEQ ID NO: 1547522 - RNA, 15 nt, Human
gggacaggaccccag

SEQ ID NO: 1547523 - RNA, 17 nt, Human
gggacaggaccccagcu

SEQ ID NO: 1547524 - RNA, 19 nt, Human
gggacaggaccccagcucu

SEQ ID NO: 1547525 - RNA, 21 nt, Human
gggacaggaccccagcucugc

SEQ ID NO: 1547526 - RNA, 22 nt, Human
gggacaggaccccagcucugcg

SEQ ID NO: 1547527 - RNA, 15 nt, Human
gcuggagugugaggg

SEQ ID NO: 1547528 - RNA, 21 nt, Human
gcuggagugugaggguccugc

SEQ ID NO: 1547529 - RNA, 13 nt, Human
gcugugccacagg

SEQ ID NO: 1547530 - RNA, 14 nt, Human
gcugugccacaggc

SEQ ID NO: 1547531 - RNA, 15 nt, Human
gcugugccacaggcu

SEQ ID NO: 1547532 - RNA, 20 nt, Human
gcugugccacaggcuuaggg

SEQ ID NO: 1547533 - RNA, 19 nt, Human
gcugugccacaggcuuagg

SEQ ID NO: 1547534 - RNA, 21 nt, Human
gccaguggccuuccccagcau

SEQ ID NO: 1547535 - RNA, 17 nt, Human
cuucuaagucauucaua

SEQ ID NO: 1547536 - RNA, 12 nt, Human
cagccugcagga

SEQ ID NO: 1547537 - RNA, 21 nt, Human
cagccugcaggaccucgugcc

SEQ ID NO: 1547538 - RNA, 22 nt, Human
ccaugucaagagucgcugugcc

SEQ ID NO: 1547539 - RNA, 19 nt, Human
ccugcagccugcaggaccu

SEQ ID NO: 1547540 - RNA, 17 nt, Human
ccugcaggaccucgugc

SEQ ID NO: 1547541 - RNA, 18 nt, Human
ccugcaggaccucgugcc

SEQ ID NO: 1547542 - RNA, 15 nt, Human
cggcggucccagcuc

SEQ ID NO: 1547543 - RNA, 16 nt, Human
cggcggucccagcucc

SEQ ID NO: 1547544 - RNA, 19 nt, Human
cggcggucccagcucccug

SEQ ID NO: 1547545 - RNA, 19 nt, Human
cucugcgucgguccuggug

SEQ ID NO: 1547546 - RNA, 20 nt, Human
cucugcgucgguccuggugc

SEQ ID NO: 1547547 - RNA, 21 nt, Human
cucugcgucgguccuggugcc

SEQ ID NO: 1547548 - RNA, 22 nt, Human
cucugcgucgguccuggugccc

SEQ ID NO: 1547549 - RNA, 17 nt, Human
cuccgccuuaccaggag

SEQ ID NO: 1547550 - RNA, 22 nt, Human
uuggaugguguuacauauuaua

SEQ ID NO: 1547551 - RNA, 14 nt, Human
auggccgggcaggg

SEQ ID NO: 1547552 - RNA, 16 nt, Human
uuuaagcaaguuaagu

SEQ ID NO: 1547553 - RNA, 17 nt, Human
uuuaagcaaguuaagug

SEQ ID NO: 1547554 - RNA, 14 nt, Human
uuccuuuuuuugau

SEQ ID NO: 1547555 - RNA, 13 nt, Human
uugaaauuuccua

SEQ ID NO: 1547556 - RNA, 18 nt, Human
uuaguuuugugaagguga

SEQ ID NO: 1547557 - RNA, 20 nt, Human
auaguucccaggugauauuu

SEQ ID NO: 1547558 - RNA, 21 nt, Human
uuagggacaggaccccagcuc

SEQ ID NO: 1547559 - RNA, 22 nt, Human
uuagggacaggaccccagcucu

SEQ ID NO: 1547560 - RNA, 20 nt, Human
auaaucccuggaugauauuu

SEQ ID NO: 1547561 - RNA, 21 nt, Human
auaaucccuggaugauauuuu

SEQ ID NO: 1547562 - RNA, 16 nt, Human
auaaccaucugaaagu

SEQ ID NO: 1547563 - RNA, 16 nt, Human
uuacaggcacuaaagu

SEQ ID NO: 1547564 - RNA, 15 nt, Human
aguuagaacauuugc

SEQ ID NO: 1547565 - RNA, 17 nt, Human
ugucaagagucgcugug

SEQ ID NO: 1547566 - RNA, 19 nt, Human
ugucaagagucgcugugcc

SEQ ID NO: 1547567 - RNA, 22 nt, Human
aggguguggggccaugccuccu

SEQ ID NO: 1547568 - RNA, 23 nt, Human
aggguguggggccaugccuccuc

SEQ ID NO: 1547569 - RNA, 13 nt, Human
uggccuuccccag

SEQ ID NO: 1547570 - RNA, 23 nt, Human
uggccuuccccagcaugcaccac

SEQ ID NO: 1547571 - RNA, 15 nt, Human
uggccuuccccagca

SEQ ID NO: 1547572 - RNA, 18 nt, Human
ugcggcggucccagcucc

SEQ ID NO: 1547573 - RNA, 13 nt, Human
ugcggcgguccca

SEQ ID NO: 1547574 - RNA, 14 nt, Human
ugcggcggucccag

SEQ ID NO: 1547575 - RNA, 17 nt, Human
ugcggcggucccagcuc

SEQ ID NO: 1547576 - RNA, 22 nt, Human
agccuggucccacgagggugcc

SEQ ID NO: 1547577 - RNA, 18 nt, Human
ugcagccugcaggaccuc

SEQ ID NO: 1547578 - RNA, 17 nt, Human
ugcagccugcaggaccu

SEQ ID NO: 1547579 - RNA, 14 nt, Human
ugaguagucucaug

SEQ ID NO: 1547580 - RNA, 17 nt, Human
ugauauuuuuuaucaua

SEQ ID NO: 1547581 - RNA, 19 nt, Human
ugauauuuuuuaucauaaa

SEQ ID NO: 1547582 - RNA, 17 nt, Human
ugaucaaacaugucucu

SEQ ID NO: 1547583 - RNA, 17 nt, Human
agccacauauugagaug

SEQ ID NO: 1547584 - RNA, 20 nt, Human
ugaccccaggagggaggcag

SEQ ID NO: 1547585 - RNA, 22 nt, Human
ugaccccaggagggaggcaggg

SEQ ID NO: 1547586 - RNA, 12 nt, Human
agauuuuguugg

SEQ ID NO: 1547587 - RNA, 20 nt, Human
ugaaaaagcuggauuuucuu

SEQ ID NO: 1547588 - RNA, 17 nt, Human
agaauaaucaaauacau

SEQ ID NO: 1547589 - RNA, 20 nt, Human
agaaauuacuaauuuuacuu

SEQ ID NO: 1547590 - RNA, 20 nt, Human
acuugaucauuuuuaccauu

SEQ ID NO: 1547591 - RNA, 16 nt, Human
ucgcugugccacaggc

SEQ ID NO: 1547592 - RNA, 11 nt, Human
accccagcucu

SEQ ID NO: 1547593 - RNA, 12 nt, Human
uccccugacagg

SEQ ID NO: 1547594 - RNA, 15 nt, Human
uccccugacagggcc

SEQ ID NO: 1547595 - RNA, 14 nt, Human
acgagggugccgug

SEQ ID NO: 1547596 - RNA, 17 nt, Human
uagaaacauguaauccu

SEQ ID NO: 1547597 - RNA, 15 nt, Human
uauaacucauuuguu

SEQ ID NO: 1547598 - RNA, 20 nt, Human
aauuacuuacguauguuugu

SEQ ID NO: 1547599 - RNA, 18 nt, Human
uaccauuauuuuuaggau

SEQ ID NO: 1547600 - RNA, 15 nt, Human
aagcccaggggccgg

SEQ ID NO: 1547601 - RNA, 22 nt, Human
guggggccaugccuccucagga

SEQ ID NO: 1547602 - RNA, 21 nt, Human
guggggccaugccuccucagg

SEQ ID NO: 1547603 - RNA, 17 nt, Human
guggccuuccccagcau

SEQ ID NO: 1547604 - RNA, 18 nt, Human
guggccuuccccagcaug

SEQ ID NO: 1547605 - RNA, 21 nt, Human
guggccuuccccagcaugcac

SEQ ID NO: 1547606 - RNA, 19 nt, Human
guggccuuccccagcaugc

SEQ ID NO: 1547607 - RNA, 14 nt, Human
guguauuucauuua

SEQ ID NO: 1547608 - RNA, 23 nt, Human
guguggggccaugccuccucagg

SEQ ID NO: 1547609 - RNA, 11 nt, Human
aaauuguguua

SEQ ID NO: 1547610 - RNA, 24 nt, Human
gugaggguccugcagccugcagga

SEQ ID NO: 1547611 - RNA, 23 nt, Human
gugaggguccugcagccugcagg

SEQ ID NO: 1547612 - RNA, 14 nt, Human
gugaggguccugca

SEQ ID NO: 1547613 - RNA, 15 nt, Human
gugaggguccugcag

SEQ ID NO: 1547614 - RNA, 18 nt, Human
gugccaccccgagggcug

SEQ ID NO: 1547615 - RNA, 22 nt, Human
accaucugaaagugguacuuga

SEQ ID NO: 1547616 - RNA, 17 nt, Human
acagggccagugcaguu

SEQ ID NO: 1547617 - RNA, 21 nt, Human
aacuuacuugcauaccaaguu

SEQ ID NO: 1547618 - RNA, 23 nt, Human
aggcuuagggacaggaccccagc

SEQ ID NO: 1547619 - RNA, 16 nt, Human
aggguccugcagccug

SEQ ID NO: 1547620 - RNA, 17 nt, Human
aggguccugcagccugc

SEQ ID NO: 1547621 - RNA, 19 nt, Human
aggguccugcagccugcag

SEQ ID NO: 1547622 - RNA, 21 nt, Human
aggguccugcagccugcagga

SEQ ID NO: 1547623 - RNA, 13 nt, Human
agggacuuagcaa

SEQ ID NO: 1547624 - RNA, 18 nt, Human
aguggccuuccccagcau

SEQ ID NO: 1547625 - RNA, 17 nt, Human
aguggccuuccccagca

SEQ ID NO: 1547626 - RNA, 23 nt, Human
aguugauacuugaauaaccaucu

SEQ ID NO: 1547627 - RNA, 19 nt, Human
caagagucgcugugccaca

SEQ ID NO: 1547628 - RNA, 22 nt, Human
caagagucgcugugccacaggc

SEQ ID NO: 1547629 - RNA, 15 nt, Human
uuaagcaaguuaagu

SEQ ID NO: 1547630 - RNA, 21 nt, Human
uuaagagguugauuauaaagu

SEQ ID NO: 1547631 - RNA, 13 nt, Human
uuaaauauuuagu

SEQ ID NO: 1547632 - RNA, 21 nt, Human
uguccuccgccuuaccaggag

SEQ ID NO: 1547633 - RNA, 17 nt, Human
ugcuaaaggagcaucua

SEQ ID NO: 1547634 - RNA, 16 nt, Human
ugcgucgguccuggug

SEQ ID NO: 1547635 - RNA, 18 nt, Human
uccuccgccuuaccagga

SEQ ID NO: 1547636 - RNA, 18 nt, Human
ucccacgagggugccgug

SEQ ID NO: 1547637 - RNA, 18 nt, Human
uccagcaaaucaagcuga

SEQ ID NO: 1547638 - RNA, 20 nt, Human
uacagcuccuuugaaaacuc

SEQ ID NO: 1547639 - RNA, 14 nt, Human
uacagcuccuuuga

SEQ ID NO: 1547640 - RNA, 18 nt, Human
uaagucauucauaaaccu

SEQ ID NO: 1547641 - RNA, 22 nt, Human
uaagugguucuuugguuccagu

SEQ ID NO: 1547642 - RNA, 15 nt, Human
uaaaguuaguaaaga

SEQ ID NO: 1547643 - RNA, 21 nt, Human
uaaagaaaaguuuaccaucug

SEQ ID NO: 1547644 - RNA, 20 nt, Human
guuacauauuauauguucua

SEQ ID NO: 1547645 - RNA, 21 nt, Human
guguggggccaugccuccuca

SEQ ID NO: 1547646 - RNA, 18 nt, Human
guguccccugacagggcc

SEQ ID NO: 1547647 - RNA, 23 nt, Human
guguuacuagccucaaaauacau

SEQ ID NO: 1547648 - RNA, 18 nt, Human
guggugaccccaggaggg

SEQ ID NO: 1547649 - RNA, 16 nt, Human
guggugaccccaggag

SEQ ID NO: 1547650 - RNA, 14 nt, Human
gugguacuugauca

SEQ ID NO: 1547651 - RNA, 21 nt, Human
gugcaguuugguguguccucc

SEQ ID NO: 1547652 - RNA, 18 nt, Human
gugcggcggucccagcuc

SEQ ID NO: 1547653 - RNA, 19 nt, Human
gugcggcggucccagcucc

SEQ ID NO: 1547654 - RNA, 22 nt, Human
gugcggcggucccagcucccug

SEQ ID NO: 1547655 - RNA, 14 nt, Human
gugauauuuuucuu

SEQ ID NO: 1547656 - RNA, 15 nt, Human
gucgguccuggugcc

SEQ ID NO: 1547657 - RNA, 17 nt, Human
gucgguccuggugcccu

SEQ ID NO: 1547658 - RNA, 18 nt, Human
gucgguccuggugcccug

SEQ ID NO: 1547659 - RNA, 17 nt, Human
gucgcugugccacaggc

SEQ ID NO: 1547660 - RNA, 17 nt, Human
gucaccagacggggcug

SEQ ID NO: 1547661 - RNA, 16 nt, Human
gucaccagacggggcu

SEQ ID NO: 1547662 - RNA, 15 nt, Human
guauguuuguacuug

SEQ ID NO: 1547663 - RNA, 13 nt, Human
uuugaauaugaaa

SEQ ID NO: 1547664 - RNA, 13 nt, Human
uuuuuugauauau

SEQ ID NO: 1547665 - RNA, 15 nt, Human
uuuucuaaauuuauc

SEQ ID NO: 1547666 - RNA, 18 nt, Human
uuuuggaugguguuacau

SEQ ID NO: 1547667 - RNA, 15 nt, Human
gcgucgguccuggug

SEQ ID NO: 1547668 - RNA, 15 nt, Human
gccuccucaggagcc

SEQ ID NO: 1547669 - RNA, 12 nt, Human
gccuccucagga

SEQ ID NO: 1547670 - RNA, 13 nt, Human
gccgaagcccagg

SEQ ID NO: 1547671 - RNA, 18 nt, Human
gccguguccccugacagg

SEQ ID NO: 1547672 - RNA, 15 nt, Human
gccaugccuccucag

SEQ ID NO: 1547673 - RNA, 14 nt, Human
gagccgaagcccag

SEQ ID NO: 1547674 - RNA, 15 nt, Human
gagccgaagcccagg

SEQ ID NO: 1547675 - RNA, 12 nt, Human
gaccccagcucu

SEQ ID NO: 1547676 - RNA, 14 nt, Human
gaccccagcucugc

SEQ ID NO: 1547677 - RNA, 20 nt, Human
gacaugggugaacuuacuug

SEQ ID NO: 1547678 - RNA, 20 nt, Human
gaaauuacuaauuuuacuuc

SEQ ID NO: 1547679 - RNA, 20 nt, Human
gaaauuuccuaauuuauucu

SEQ ID NO: 1547680 - RNA, 19 nt, Human
gaaauuacuaauuuuacuu

SEQ ID NO: 1547681 - RNA, 14 nt, Human
cuggucccacgagg

SEQ ID NO: 1547682 - RNA, 17 nt, Human
cuggucccacgagggug

SEQ ID NO: 1547683 - RNA, 19 nt, Human
cuggucccacgagggugcc

SEQ ID NO: 1547684 - RNA, 12 nt, Human
cugagccugguc

SEQ ID NO: 1547685 - RNA, 17 nt, Human
cugacagggccagugca

SEQ ID NO: 1547686 - RNA, 12 nt, Human
cugacagggcca

SEQ ID NO: 1547687 - RNA, 15 nt, Human
cgugccaccccgagg

SEQ ID NO: 1547688 - RNA, 22 nt, Human
cgugccaccccgagggcugagc

SEQ ID NO: 1547689 - RNA, 19 nt, Human
cgugccaccccgagggcug

SEQ ID NO: 1547690 - RNA, 13 nt, Human
cgguccuggugcc

SEQ ID NO: 1547691 - RNA, 13 nt, Human
cggucccagcucc

SEQ ID NO: 1547692 - RNA, 12 nt, Human
cggucccagcuc

SEQ ID NO: 1547693 - RNA, 22 nt, Human
cggccaguggccuuccccagca

SEQ ID NO: 1547694 - RNA, 18 nt, Human
caguggccuuccccagca

SEQ ID NO: 1547695 - RNA, 17 nt, Human
caguggccuuccccagc

SEQ ID NO: 1547696 - RNA, 19 nt, Human
caguggccuuccccagcau

SEQ ID NO: 1547697 - RNA, 19 nt, Human
cauagaaaacacuacagug

SEQ ID NO: 1547698 - RNA, 15 nt, Human
caugccuccucagga

SEQ ID NO: 1547699 - RNA, 17 nt, Human
ccagugcuuuauguugu

SEQ ID NO: 1547700 - RNA, 22 nt, Human
ccagcucugcgucgguccuggu

SEQ ID NO: 1547701 - RNA, 11 nt, Human
cccagcucugc

SEQ ID NO: 1547702 - RNA, 12 nt, Human
cccagcucugcg

SEQ ID NO: 1547703 - RNA, 17 nt, Human
cccacgagggugccgug

SEQ ID NO: 1547704 - RNA, 16 nt, Human
ccaugccuccucagga

SEQ ID NO: 1547705 - RNA, 15 nt, Human
ccaugccuccucagg

SEQ ID NO: 1547706 - RNA, 22 nt, Human
ggccagugcaguuugguguguc

SEQ ID NO: 1547707 - RNA, 15 nt, Human
aaauauuauaacuca

SEQ ID NO: 1547708 - RNA, 15 nt, Human
gguccugcagccugc

SEQ ID NO: 1547709 - RNA, 16 nt, Human
gguccugcagccugca

SEQ ID NO: 1547710 - RNA, 16 nt, Human
ggggccggccaguggc

SEQ ID NO: 1547711 - RNA, 14 nt, Human
ggacaggaccccag

SEQ ID NO: 1547712 - RNA, 15 nt, Human
ggacaggaccccagc

SEQ ID NO: 1547713 - RNA, 16 nt, Human
ggacaggaccccagcu

SEQ ID NO: 1547714 - RNA, 17 nt, Human
ggacaggaccccagcuc

SEQ ID NO: 1547715 - RNA, 21 nt, Human
ggacaggaccccagcucugcg

SEQ ID NO: 1547716 - RNA, 18 nt, Human
ggacaggaccccagcucu

SEQ ID NO: 1547717 - RNA, 20 nt, Human
ggacaggaccccagcucugc

SEQ ID NO: 1547718 - RNA, 23 nt, Human
cuuagggacaggaccccagcucu

SEQ ID NO: 1547719 - RNA, 21 nt, Human
cuuagggacaggaccccagcu

SEQ ID NO: 1547720 - RNA, 22 nt, Human
cuuagggacaggaccccagcuc

SEQ ID NO: 1547721 - RNA, 18 nt, Human
cuuagggacaggacccca

SEQ ID NO: 1547722 - RNA, 20 nt, Human
cuuagggacaggaccccagc

SEQ ID NO: 1547723 - RNA, 19 nt, Human
cacaggcuuagggacagga

SEQ ID NO: 1547724 - RNA, 22 nt, Human
cacaggcuuagggacaggaccc

SEQ ID NO: 1547725 - RNA, 18 nt, Human
cacaggcuuagggacagg

SEQ ID NO: 1547726 - RNA, 14 nt, Human
caugcaccacgggc

SEQ ID NO: 1547727 - RNA, 19 nt, Human
caugucaagagucgcugug

SEQ ID NO: 1547728 - RNA, 21 nt, Human
caugucaagagucgcugugcc

SEQ ID NO: 1547729 - RNA, 16 nt, Human
ccacgagggugccgug

SEQ ID NO: 1547730 - RNA, 22 nt, Human
cagugcaguuugguguguccuc

SEQ ID NO: 1547731 - RNA, 16 nt, Human
caggguguggggccau

SEQ ID NO: 1547732 - RNA, 17 nt, Human
caggguguggggccaug

SEQ ID NO: 1547733 - RNA, 22 nt, Human
caggguguggggccaugccucc

SEQ ID NO: 1547734 - RNA, 15 nt, Human
caggagggaggcagg

SEQ ID NO: 1547735 - RNA, 21 nt, Human
caggagggaggcaggggaggg

SEQ ID NO: 1547736 - RNA, 18 nt, Human
caggaccccagcucugcg

SEQ ID NO: 1547737 - RNA, 16 nt, Human
caggaccccagcucug

SEQ ID NO: 1547738 - RNA, 17 nt, Human
caggaccccagcucugc

SEQ ID NO: 1547739 - RNA, 14 nt, Human
ccuggaugcccagg

SEQ ID NO: 1547740 - RNA, 15 nt, Human
ccgaagcccaggggc

SEQ ID NO: 1547741 - RNA, 16 nt, Human
ccgaagcccaggggcc

SEQ ID NO: 1547742 - RNA, 17 nt, Human
ccgaagcccaggggccg

SEQ ID NO: 1547743 - RNA, 16 nt, Human
ccccugacagggccag

SEQ ID NO: 1547744 - RNA, 19 nt, Human
ccccgagggcugagccugg

SEQ ID NO: 1547745 - RNA, 21 nt, Human
ccccgagggcugagccugguc

SEQ ID NO: 1547746 - RNA, 14 nt, Human
ccccgagggcugag

SEQ ID NO: 1547747 - RNA, 19 nt, Human
cguguccccugacagggcc

SEQ ID NO: 1547748 - RNA, 16 nt, Human
cguguccccugacagg

SEQ ID NO: 1547749 - RNA, 18 nt, Human
cguguccccugacagggc

SEQ ID NO: 1547750 - RNA, 22 nt, Human
auugguuuuccaaucauuugac

SEQ ID NO: 1547751 - RNA, 14 nt, Human
augguguuacauau

SEQ ID NO: 1547752 - RNA, 18 nt, Human
uuugugaaggugauuuau

SEQ ID NO: 1547753 - RNA, 19 nt, Human
auguagcgcuuugaauaug

SEQ ID NO: 1547754 - RNA, 21 nt, Human
auguagcgcuuugaauaugaa

SEQ ID NO: 1547755 - RNA, 13 nt, Human
augccuccucagg

SEQ ID NO: 1547756 - RNA, 15 nt, Human
augccuccucaggag

SEQ ID NO: 1547757 - RNA, 14 nt, Human
augccuccucagga

SEQ ID NO: 1547758 - RNA, 18 nt, Human
augccuccucaggagccg

SEQ ID NO: 1547759 - RNA, 16 nt, Human
auauuuuuuaucauaa

SEQ ID NO: 1547760 - RNA, 18 nt, Human
auccuaaauuuacccucu

SEQ ID NO: 1547761 - RNA, 13 nt, Human
uugauuauaaagu

SEQ ID NO: 1547762 - RNA, 22 nt, Human
uugacacuuauagauugaaauu

SEQ ID NO: 1547763 - RNA, 17 nt, Human
auaaucaaauacauuuu

SEQ ID NO: 1547764 - RNA, 19 nt, Human
auaacucauuuguuguuug

SEQ ID NO: 1547765 - RNA, 21 nt, Human
aguuuugugaaggugauuuau

SEQ ID NO: 1547766 - RNA, 12 nt, Human
aguuuaccaucu

SEQ ID NO: 1547767 - RNA, 16 nt, Human
aguuuaccaucugaaa

SEQ ID NO: 1547768 - RNA, 19 nt, Human
agugugaggguccugcagc

SEQ ID NO: 1547769 - RNA, 15 nt, Human
uguccccugacaggg

SEQ ID NO: 1547770 - RNA, 16 nt, Human
uguccccugacagggc

SEQ ID NO: 1547771 - RNA, 18 nt, Human
uguccccugacagggcca

SEQ ID NO: 1547772 - RNA, 18 nt, Human
agucgcugugccacaggc

SEQ ID NO: 1547773 - RNA, 16 nt, Human
agggcugagccugguc

SEQ ID NO: 1547774 - RNA, 17 nt, Human
agggcugagccuggucc

SEQ ID NO: 1547775 - RNA, 23 nt, Human
agcucugcgucgguccuggugcc

SEQ ID NO: 1547776 - RNA, 22 nt, Human
agcucugcgucgguccuggugc

SEQ ID NO: 1547777 - RNA, 21 nt, Human
ugcaguuugguguguccuccg

SEQ ID NO: 1547778 - RNA, 20 nt, Human
agccugcaggaccucgugcc

SEQ ID NO: 1547779 - RNA, 21 nt, Human
agccugcaggaccucgugcca

SEQ ID NO: 1547780 - RNA, 22 nt, Human
ucuggucuaaauuguguuacua

SEQ ID NO: 1547781 - RNA, 14 nt, Human
ugaauauaaucccu

SEQ ID NO: 1547782 - RNA, 15 nt, Human
agagucgcugugcca

SEQ ID NO: 1547783 - RNA, 19 nt, Human
agagucgcugugccacagg

SEQ ID NO: 1547784 - RNA, 14 nt, Human
agagucgcugugcc

SEQ ID NO: 1547785 - RNA, 23 nt, Human
ugaggguccugcagccugcagga

SEQ ID NO: 1547786 - RNA, 21 nt, Human
ugaggguccugcagccugcag

SEQ ID NO: 1547787 - RNA, 22 nt, Human
ugaggguccugcagccugcagg

SEQ ID NO: 1547788 - RNA, 14 nt, Human
ugaggguccugcag

SEQ ID NO: 1547789 - RNA, 15 nt, Human
ugaggguccugcagc

SEQ ID NO: 1547790 - RNA, 18 nt, Human
ugaggguccugcagccug

SEQ ID NO: 1547791 - RNA, 19 nt, Human
ugaggguccugcagccugc

SEQ ID NO: 1547792 - RNA, 11 nt, Human
ugagccugguc

SEQ ID NO: 1547793 - RNA, 13 nt, Human
uccugcagccugc

SEQ ID NO: 1547794 - RNA, 18 nt, Human
accgacguugccaucaaa

SEQ ID NO: 1547795 - RNA, 18 nt, Human
ucauuugacuaagagucu

SEQ ID NO: 1547796 - RNA, 13 nt, Human
uauuucauuuauu

SEQ ID NO: 1547797 - RNA, 16 nt, Human
uauggccgggcagggu

SEQ ID NO: 1547798 - RNA, 19 nt, Human
uauagauugaaauuuccua

SEQ ID NO: 1547799 - RNA, 17 nt, Human
aauuuaucaguaccuaa

SEQ ID NO: 1547800 - RNA, 19 nt, Human
aauuuacccucuugaauau

SEQ ID NO: 1547801 - RNA, 22 nt, Human
aauuuacccucuugaauauaau

SEQ ID NO: 1547802 - RNA, 14 nt, Human
guugggucaccaga

SEQ ID NO: 1547803 - RNA, 21 nt, Human
guugggucaccagacggggcu

SEQ ID NO: 1547804 - RNA, 12 nt, Human
aaggagcaucua

SEQ ID NO: 1547805 - RNA, 24 nt, Human
guuuuuggaugguguuacauauua

SEQ ID NO: 1547806 - RNA, 19 nt, Human
aaguuagaacauuugcugu

SEQ ID NO: 1547807 - RNA, 14 nt, Human
aaguuuaccaucug

SEQ ID NO: 1547808 - RNA, 17 nt, Human
gugugaggguccugcag

SEQ ID NO: 1547809 - RNA, 21 nt, Human
aagauguagcgcuuugaauau

SEQ ID NO: 1547810 - RNA, 16 nt, Human
aagaaaaguuuaccau

SEQ ID NO: 1547811 - RNA, 10 nt, Human
guccugcagc

SEQ ID NO: 1547812 - RNA, 18 nt, Human
guccugcagccugcagga

SEQ ID NO: 1547813 - RNA, 14 nt, Human
guccugcagccugc

SEQ ID NO: 1547814 - RNA, 19 nt, Human
aguggccuuccccagcaug

SEQ ID NO: 1547815 - RNA, 20 nt, Human
agggacaggaccccagcucu

SEQ ID NO: 1547816 - RNA, 17 nt, Human
agggacaggaccccagc

SEQ ID NO: 1547817 - RNA, 18 nt, Human
agggacaggaccccagcu

SEQ ID NO: 1547818 - RNA, 13 nt, Human
agggacaggaccc

SEQ ID NO: 1547819 - RNA, 16 nt, Human
agggacaggaccccag

SEQ ID NO: 1547820 - RNA, 22 nt, Human
aauauuauaacucauuuguugu

SEQ ID NO: 1547821 - RNA, 15 nt, Human
caccccgagggcuga

SEQ ID NO: 1547822 - RNA, 13 nt, Human
caaauacauuuua

SEQ ID NO: 1547823 - RNA, 18 nt, Human
uucuaagucauucauaaa

SEQ ID NO: 1547824 - RNA, 13 nt, Human
uuguuugguuaua

SEQ ID NO: 1547825 - RNA, 14 nt, Human
uuuaccaucugaaa

SEQ ID NO: 1547826 - RNA, 13 nt, Human
uuuaccaucugaa

SEQ ID NO: 1547827 - RNA, 21 nt, Human
uuuacccucuugaauauaauc

SEQ ID NO: 1547828 - RNA, 13 nt, Human
uuuccuaauuuau

SEQ ID NO: 1547829 - RNA, 16 nt, Human
uuauggccgggcaggg

SEQ ID NO: 1547830 - RNA, 20 nt, Human
uuauugguuuuccaaucauu

SEQ ID NO: 1547831 - RNA, 20 nt, Human
ugggucaccagacggggcug

SEQ ID NO: 1547832 - RNA, 21 nt, Human
ugggucaccagacggggcugg

SEQ ID NO: 1547833 - RNA, 19 nt, Human
ugggucaccagacggggcu

SEQ ID NO: 1547834 - RNA, 16 nt, Human
ugccuccucaggagcc

SEQ ID NO: 1547835 - RNA, 12 nt, Human
ugccuccucagg

SEQ ID NO: 1547836 - RNA, 13 nt, Human
ugccuccucagga

SEQ ID NO: 1547837 - RNA, 16 nt, Human
ucuaucagauuaaguu

SEQ ID NO: 1547838 - RNA, 19 nt, Human
uccgccuuaccaggagaag

SEQ ID NO: 1547839 - RNA, 21 nt, Human
uccccagcaugcaccacgggc

SEQ ID NO: 1547840 - RNA, 19 nt, Human
uccccagcaugcaccacgg

SEQ ID NO: 1547841 - RNA, 20 nt, Human
uccccagcaugcaccacggg

SEQ ID NO: 1547842 - RNA, 14 nt, Human
uauuauauguucua

SEQ ID NO: 1547843 - RNA, 17 nt, Human
uauuauauguucuagaa

SEQ ID NO: 1547844 - RNA, 15 nt, Human
ucaccagacggggcu

SEQ ID NO: 1547845 - RNA, 19 nt, Human
ucaccagacggggcuggag

SEQ ID NO: 1547846 - RNA, 19 nt, Human
gugcccuggaugcccagga

SEQ ID NO: 1547847 - RNA, 18 nt, Human
gugcccuggaugcccagg

SEQ ID NO: 1547848 - RNA, 15 nt, Human
gucccagcucccugg

SEQ ID NO: 1547849 - RNA, 11 nt, Human
guccuggugcc

SEQ ID NO: 1547850 - RNA, 12 nt, Human
guccuggugccc

SEQ ID NO: 1547851 - RNA, 20 nt, Human
guccuggugcccuggaugcc

SEQ ID NO: 1547852 - RNA, 23 nt, Human
guccuggugcccuggaugcccag

SEQ ID NO: 1547853 - RNA, 18 nt, Human
guccuccgccuuaccagg

SEQ ID NO: 1547854 - RNA, 11 nt, Human
gucccagcucc

SEQ ID NO: 1547855 - RNA, 19 nt, Human
ggggugcggcggucccagc

SEQ ID NO: 1547856 - RNA, 21 nt, Human
gggcccggguugggucaccag

SEQ ID NO: 1547857 - RNA, 22 nt, Human
gggcccggguugggucaccaga

SEQ ID NO: 1547858 - RNA, 15 nt, Human
gggcugagccugguc

SEQ ID NO: 1547859 - RNA, 23 nt, Human
gggcugagccuggucccacgagg

SEQ ID NO: 1547860 - RNA, 13 nt, Human
gggcugagccugg

SEQ ID NO: 1547861 - RNA, 20 nt, Human
ggucccagcucccuggcucc

SEQ ID NO: 1547862 - RNA, 12 nt, Human
ggucccagcucc

SEQ ID NO: 1547863 - RNA, 14 nt, Human
ggucccagcucccu

SEQ ID NO: 1547864 - RNA, 15 nt, Human
ggucccagcucccug

SEQ ID NO: 1547865 - RNA, 15 nt, Human
ggugcccuggaugcc

SEQ ID NO: 1547866 - RNA, 18 nt, Human
ggugcccuggaugcccag

SEQ ID NO: 1547867 - RNA, 19 nt, Human
ggugcccuggaugcccagg

SEQ ID NO: 1547868 - RNA, 20 nt, Human
ggugcccuggaugcccagga

SEQ ID NO: 1547869 - RNA, 19 nt, Human
ggugcggcggucccagcuc

SEQ ID NO: 1547870 - RNA, 21 nt, Human
gguuuuccaaucauuugacua

SEQ ID NO: 1547871 - RNA, 23 nt, Human
guacaguugcuguugugugauca

SEQ ID NO: 1547872 - RNA, 13 nt, Human
ggaccucgugcca

SEQ ID NO: 1547873 - RNA, 22 nt, Human
gcuuagggacaggaccccagcu

SEQ ID NO: 1547874 - RNA, 23 nt, Human
gcuuagggacaggaccccagcuc

SEQ ID NO: 1547875 - RNA, 21 nt, Human
gcucugcgucgguccuggugc

SEQ ID NO: 1547876 - RNA, 20 nt, Human
gcucugcgucgguccuggug

SEQ ID NO: 1547877 - RNA, 20 nt, Human
gcccuggaugcccaggaauc

SEQ ID NO: 1547878 - RNA, 13 nt, Human
gaggguccugcag

SEQ ID NO: 1547879 - RNA, 17 nt, Human
gaggguccugcagccug

SEQ ID NO: 1547880 - RNA, 21 nt, Human
gaggguccugcagccugcagg

SEQ ID NO: 1547881 - RNA, 18 nt, Human
gaggguccugcagccugc

SEQ ID NO: 1547882 - RNA, 23 nt, Human
gagggugccguguccccugacag

SEQ ID NO: 1547883 - RNA, 19 nt, Human
gaggggugcggcgguccca

SEQ ID NO: 1547884 - RNA, 22 nt, Human
gaggggugcggcggucccagcu

SEQ ID NO: 1547885 - RNA, 19 nt, Human
gacaggaccccagcucugc

SEQ ID NO: 1547886 - RNA, 14 nt, Human
gacaggaccccagc

SEQ ID NO: 1547887 - RNA, 15 nt, Human
gacaggaccccagcu

SEQ ID NO: 1547888 - RNA, 16 nt, Human
gacaggaccccagcuc

SEQ ID NO: 1547889 - RNA, 17 nt, Human
gacaggaccccagcucu

SEQ ID NO: 1547890 - RNA, 18 nt, Human
gacaggaccccagcucug

SEQ ID NO: 1547891 - RNA, 20 nt, Human
gacaggaccccagcucugcg

SEQ ID NO: 1547892 - RNA, 13 nt, Human
cugugccacaggc

SEQ ID NO: 1547893 - RNA, 22 nt, Human
cuguauauauuuauggccgggc

SEQ ID NO: 1547894 - RNA, 23 nt, Human
cucaggagccgaagcccaggggc

SEQ ID NO: 1547895 - RNA, 21 nt, Human
cucaggagccgaagcccaggg

SEQ ID NO: 1547896 - RNA, 14 nt, Human
cuaaauuuuaagug

SEQ ID NO: 1547897 - RNA, 11 nt, Human
cuaaaaacaua

SEQ ID NO: 1547898 - RNA, 15 nt, Human
cgcugugccacaggc

SEQ ID NO: 1547899 - RNA, 13 nt, Human
cggaauauauuuu

SEQ ID NO: 1547900 - RNA, 16 nt, Human
cgaagcccaggggccg

SEQ ID NO: 1547901 - RNA, 15 nt, Human
ccgggcagggugugg

SEQ ID NO: 1547902 - RNA, 23 nt, Human
ccagugcaguuugguguguccuc

SEQ ID NO: 1547903 - RNA, 17 nt, Human
ccaguggccuuccccag

SEQ ID NO: 1547904 - RNA, 19 nt, Human
ccaguggccuuccccagca

SEQ ID NO: 1547905 - RNA, 20 nt, Human
ggagugugaggguccugcag

SEQ ID NO: 1547906 - RNA, 11 nt, Human
aaaaaguuugu

SEQ ID NO: 1547907 - RNA, 18 nt, Human
aaaaaguuugucuuaguu

SEQ ID NO: 1547908 - RNA, 14 nt, Human
ggccuuccccagca

SEQ ID NO: 1547909 - RNA, 13 nt, Human
ggccuuccccagc

SEQ ID NO: 1547910 - RNA, 14 nt, Human
aaagugguacuuga

SEQ ID NO: 1547911 - RNA, 20 nt, Human
aaagugguacuugaucauuu

SEQ ID NO: 1547912 - RNA, 23 nt, Human
aaagugguacuugaucauuuuua

SEQ ID NO: 1547913 - RNA, 13 nt, Human
guaauccuaaauu

SEQ ID NO: 1547914 - RNA, 18 nt, Human
ggguccugcagccugcag

SEQ ID NO: 1547915 - RNA, 23 nt, Human
ggguccugcagccugcaggaccu

SEQ ID NO: 1547916 - RNA, 19 nt, Human
ggguccugcagccugcagg

SEQ ID NO: 1547917 - RNA, 14 nt, Human
ggggccaugccucc

SEQ ID NO: 1547918 - RNA, 17 nt, Human
ggggccaugccuccuca

SEQ ID NO: 1547919 - RNA, 19 nt, Human
ggggccaugccuccucagg

SEQ ID NO: 1547920 - RNA, 23 nt, Human
ggggccaugccuccucaggagcc

SEQ ID NO: 1547921 - RNA, 17 nt, Human
gggccggccaguggccu

SEQ ID NO: 1547922 - RNA, 14 nt, Human
gcggcggucccagc

SEQ ID NO: 1547923 - RNA, 16 nt, Human
gcggcggucccagcuc

SEQ ID NO: 1547924 - RNA, 17 nt, Human
gcggcggucccagcucc

SEQ ID NO: 1547925 - RNA, 16 nt, Human
gauacuugaauaacca

SEQ ID NO: 1547926 - RNA, 17 nt, Human
cuggugcccuggaugcc

SEQ ID NO: 1547927 - RNA, 20 nt, Human
cuggugcccuggaugcccag

SEQ ID NO: 1547928 - RNA, 21 nt, Human
cuggugcccuggaugcccagg

SEQ ID NO: 1547929 - RNA, 23 nt, Human
cuggagugugaggguccugcagc

SEQ ID NO: 1547930 - RNA, 20 nt, Human
cagaauaaucaaauacauuu

SEQ ID NO: 1547931 - RNA, 21 nt, Human
ccaggagggaggcaggggagg

SEQ ID NO: 1547932 - RNA, 19 nt, Human
ccaggggccggccaguggc

SEQ ID NO: 1547933 - RNA, 15 nt, Human
ccaggagggaggcag

SEQ ID NO: 1547934 - RNA, 22 nt, Human
ccaggagggaggcaggggaggg

SEQ ID NO: 1547935 - RNA, 21 nt, Human
ccucaggagccgaagcccagg

SEQ ID NO: 1547936 - RNA, 12 nt, Human
ccucaggagccg

SEQ ID NO: 1547937 - RNA, 19 nt, Human
ccucaggagccgaagccca

SEQ ID NO: 1547938 - RNA, 22 nt, Human
ccucaggagccgaagcccaggg

SEQ ID NO: 1547939 - RNA, 16 nt, Human
ccugcagccugcagga

SEQ ID NO: 1547940 - RNA, 17 nt, Human
cuaauuuauucuaaauu

SEQ ID NO: 1547941 - RNA, 21 nt, Human
uuuuguuugguuauaucgaaa

SEQ ID NO: 1547942 - RNA, 13 nt, Human
uuuuguuugguua

SEQ ID NO: 1547943 - RNA, 16 nt, Human
uuuuguuugguuauau

SEQ ID NO: 1547944 - RNA, 15 nt, Human
uuuugauauaugaaa

SEQ ID NO: 1547945 - RNA, 24 nt, Human
auuacuuacguauguuuguacuug

SEQ ID NO: 1547946 - RNA, 14 nt, Human
augaaaugacuucu

SEQ ID NO: 1547947 - RNA, 22 nt, Human
uuugaaaacucuguguuuggaa

SEQ ID NO: 1547948 - RNA, 23 nt, Human
auauauuuauggccgggcagggu

SEQ ID NO: 1547949 - RNA, 19 nt, Human
aucaauucuguauuccaga

SEQ ID NO: 1547950 - RNA, 13 nt, Human
agugguuuagaaa

SEQ ID NO: 1547951 - RNA, 16 nt, Human
aguuugguguguccuc

SEQ ID NO: 1547952 - RNA, 19 nt, Human
auaccaaguugauacuuga

SEQ ID NO: 1547953 - RNA, 22 nt, Human
auaaaccuugucuaugaaauga

SEQ ID NO: 1547954 - RNA, 24 nt, Human
agggugccguguccccugacaggg

SEQ ID NO: 1547955 - RNA, 15 nt, Human
agggugccguguccc

SEQ ID NO: 1547956 - RNA, 14 nt, Human
agccgaagcccagg

SEQ ID NO: 1547957 - RNA, 13 nt, Human
agcccaggggccg

SEQ ID NO: 1547958 - RNA, 12 nt, Human
uggccgggcagg

SEQ ID NO: 1547959 - RNA, 13 nt, Human
uggccgggcaggg

SEQ ID NO: 1547960 - RNA, 22 nt, Human
aggagggaggcaggggaggggu

SEQ ID NO: 1547961 - RNA, 16 nt, Human
ugacagggccagugca

SEQ ID NO: 1547962 - RNA, 19 nt, Human
ugacagggccagugcaguu

SEQ ID NO: 1547963 - RNA, 19 nt, Human
ugaaauuuccuaauuuauu

SEQ ID NO: 1547964 - RNA, 20 nt, Human
ucugcgucgguccuggugcc

SEQ ID NO: 1547965 - RNA, 17 nt, Human
uccugcagccugcagga

SEQ ID NO: 1547966 - RNA, 21 nt, Human
uccucaggagccgaagcccag

SEQ ID NO: 1547967 - RNA, 22 nt, Human
uccucaggagccgaagcccagg

SEQ ID NO: 1547968 - RNA, 15 nt, Human
acuaauuuuacuucu

SEQ ID NO: 1547969 - RNA, 10 nt, Human
ucccagcucc

SEQ ID NO: 1547970 - RNA, 21 nt, Human
uaagcaaguuaaguguccucc

SEQ ID NO: 1547971 - RNA, 21 nt, Human
aauuaguacagaaauauccau

SEQ ID NO: 1547972 - RNA, 12 nt, Human
acaggaccccag

SEQ ID NO: 1547973 - RNA, 13 nt, Human
acaggaccccagc

SEQ ID NO: 1547974 - RNA, 14 nt, Human
acaggaccccagcu

SEQ ID NO: 1547975 - RNA, 15 nt, Human
acaggaccccagcuc

SEQ ID NO: 1547976 - RNA, 16 nt, Human
acaggaccccagcucu

SEQ ID NO: 1547977 - RNA, 17 nt, Human
acaggaccccagcucug

SEQ ID NO: 1547978 - RNA, 19 nt, Human
acaggaccccagcucugcg

SEQ ID NO: 1547979 - RNA, 18 nt, Human
acaggaccccagcucugc

SEQ ID NO: 1547980 - RNA, 16 nt, Human
acaggcuuagggacag

SEQ ID NO: 1547981 - RNA, 15 nt, Human
uaguucccaggugau

SEQ ID NO: 1547982 - RNA, 19 nt, Human
uagggacaggaccccagcu

SEQ ID NO: 1547983 - RNA, 20 nt, Human
uagggacaggaccccagcuc

SEQ ID NO: 1547984 - RNA, 22 nt, Human
uagggacaggaccccagcucug

SEQ ID NO: 1547985 - RNA, 21 nt, Human
uagggacaggaccccagcucu

SEQ ID NO: 1547986 - RNA, 14 nt, Human
aagaaacaacagaa

SEQ ID NO: 1547987 - RNA, 14 nt, Human
guccccugacaggg

SEQ ID NO: 1547988 - RNA, 16 nt, Human
gucgcugugccacagg

SEQ ID NO: 1547989 - RNA, 13 nt, Human
aaaaauuuuuguu

SEQ ID NO: 1547990 - RNA, 14 nt, Human
aaaaauuuuuguuu

SEQ ID NO: 1547991 - RNA, 14 nt, Human
aggaccucgugcca

SEQ ID NO: 1547992 - RNA, 13 nt, Human
aggaccccagcuc

SEQ ID NO: 1547993 - RNA, 14 nt, Human
aggaccccagcucu

SEQ ID NO: 1547994 - RNA, 16 nt, Human
aggaccccagcucugc

SEQ ID NO: 1547995 - RNA, 17 nt, Human
aggaccccagcucugcg

SEQ ID NO: 1547996 - RNA, 15 nt, Human
agcaugcaccacggg

SEQ ID NO: 1547997 - RNA, 13 nt, Human
agacggggcugga

SEQ ID NO: 1547998 - RNA, 15 nt, Human
accccgagggcugag

SEQ ID NO: 1547999 - RNA, 21 nt, Human
uuauaucgaaauaguuacagg

SEQ ID NO: 1548000 - RNA, 23 nt, Human
uuauguuguuguuguuuuuggau

SEQ ID NO: 1548001 - RNA, 19 nt, Human
uuauuagaaaaauauuaua

SEQ ID NO: 1548002 - RNA, 17 nt, Human
ugccacaggcuuaggga

SEQ ID NO: 1548003 - RNA, 21 nt, Human
ugccacaggcuuagggacagg

SEQ ID NO: 1548004 - RNA, 20 nt, Human
ugccacaggcuuagggacag

SEQ ID NO: 1548005 - RNA, 21 nt, Human
ugccguguccccugacagggc

SEQ ID NO: 1548006 - RNA, 16 nt, Human
ugcccuggaugcccag

SEQ ID NO: 1548007 - RNA, 18 nt, Human
ugcccuggaugcccagga

SEQ ID NO: 1548008 - RNA, 22 nt, Human
ucgugccaccccgagggcugag

SEQ ID NO: 1548009 - RNA, 22 nt, Human
uauuccagacuugggaggaugu

SEQ ID NO: 1548010 - RNA, 23 nt, Human
ucaggagccgaagcccaggggcc

SEQ ID NO: 1548011 - RNA, 22 nt, Human
ggcuuagggacaggaccccagc

SEQ ID NO: 1548012 - RNA, 17 nt, Human
ggcucccaugucaagag

SEQ ID NO: 1548013 - RNA, 14 nt, Human
ggcggucccagcuc

SEQ ID NO: 1548014 - RNA, 15 nt, Human
ggcggucccagcucc

SEQ ID NO: 1548015 - RNA, 21 nt, Human
gccuggucccacgagggugcc

SEQ ID NO: 1548016 - RNA, 12 nt, Human
gcaggggagggg

SEQ ID NO: 1548017 - RNA, 17 nt, Human
gcacuaaaguuaguaaa

SEQ ID NO: 1548018 - RNA, 13 nt, Human
gagucgcugugcc

SEQ ID NO: 1548019 - RNA, 14 nt, Human
gauagacugcuaca

SEQ ID NO: 1548020 - RNA, 19 nt, Human
gagccuggucccacgaggg

SEQ ID NO: 1548021 - RNA, 23 nt, Human
gagccuggucccacgagggugcc

SEQ ID NO: 1548022 - RNA, 18 nt, Human
gaaccugaagaacuauuu

SEQ ID NO: 1548023 - RNA, 18 nt, Human
gaacuuacuugcauacca

SEQ ID NO: 1548024 - RNA, 16 nt, Human
gaaucuguauauauuu

SEQ ID NO: 1548025 - RNA, 18 nt, Human
cugcgucgguccuggugc

SEQ ID NO: 1548026 - RNA, 17 nt, Human
cugcgucgguccuggug

SEQ ID NO: 1548027 - RNA, 14 nt, Human
cugaagaacuauuu

SEQ ID NO: 1548028 - RNA, 12 nt, Human
cuccucaggagc

SEQ ID NO: 1548029 - RNA, 13 nt, Human
cuccucaggagcc

SEQ ID NO: 1548030 - RNA, 22 nt, Human
ccuggugcccuggaugcccagg

SEQ ID NO: 1548031 - RNA, 21 nt, Human
ccuggugcccuggaugcccag

SEQ ID NO: 1548032 - RNA, 12 nt, Human
ccuggugcccug

SEQ ID NO: 1548033 - RNA, 18 nt, Human
ccuggugcccuggaugcc

SEQ ID NO: 1548034 - RNA, 20 nt, Human
ccuggugcccuggaugccca

SEQ ID NO: 1548035 - RNA, 20 nt, Human
ccuggucccacgagggugcc

SEQ ID NO: 1548036 - RNA, 13 nt, Human
ccgccuuaccagg

SEQ ID NO: 1548037 - RNA, 17 nt, Human
ccguguccccugacagg

SEQ ID NO: 1548038 - RNA, 19 nt, Human
ccguguccccugacagggc

SEQ ID NO: 1548039 - RNA, 23 nt, Human
cccgagggcugagccugguccca

SEQ ID NO: 1548040 - RNA, 18 nt, Human
cccggguugggucaccag

SEQ ID NO: 1548041 - RNA, 17 nt, Human
ccaucugaaagugguac

SEQ ID NO: 1548042 - RNA, 18 nt, Human
ccauuauuuuuaggaugu

SEQ ID NO: 1548043 - RNA, 18 nt, Human
ccagcaugcaccacgggc

SEQ ID NO: 1548044 - RNA, 20 nt, Human
ccagcaugcaccacgggccc

SEQ ID NO: 1548045 - RNA, 23 nt, Human
ccaccccgagggcugagccuggu

SEQ ID NO: 1548046 - RNA, 19 nt, Human
cauucauaaaccuugucua

SEQ ID NO: 1548047 - RNA, 14 nt, Human
cauuuuuaccauua

SEQ ID NO: 1548048 - RNA, 17 nt, Human
caggggccggccagugg

SEQ ID NO: 1548049 - RNA, 22 nt, Human
caggggccggccaguggccuuc

SEQ ID NO: 1548050 - RNA, 13 nt, Human
caggggaggggug

SEQ ID NO: 1548051 - RNA, 16 nt, Human
cagggccagugcaguu

SEQ ID NO: 1548052 - RNA, 16 nt, Human
caggcuuagggacagg

SEQ ID NO: 1548053 - RNA, 17 nt, Human
caggcuuagggacagga

SEQ ID NO: 1548054 - RNA, 17 nt, Human
caggagccgaagcccag

SEQ ID NO: 1548055 - RNA, 18 nt, Human
caggagccgaagcccagg

SEQ ID NO: 1548056 - RNA, 21 nt, Human
caggagccgaagcccaggggc

SEQ ID NO: 1548057 - RNA, 19 nt, Human
caggagaagaaccugaaga

SEQ ID NO: 1548058 - RNA, 19 nt, Human
caggaaucuguauauauuu

SEQ ID NO: 1548059 - RNA, 18 nt, Human
caggaccucgugccaccc

SEQ ID NO: 1548060 - RNA, 17 nt, Human
cagcaugcaccacgggc

SEQ ID NO: 1548061 - RNA, 19 nt, Human
cagacggggcuggagugug

SEQ ID NO: 1548062 - RNA, 13 nt, Human
cagacggggcugg

SEQ ID NO: 1548063 - RNA, 14 nt, Human
auuucauguugggu

SEQ ID NO: 1548064 - RNA, 23 nt, Human
ggucaccagacggggcuggagug

SEQ ID NO: 1548065 - RNA, 13 nt, Human
ggugcccuggaug

SEQ ID NO: 1548066 - RNA, 14 nt, Human adenovirus C
cugaagcagggcca

SEQ ID NO: 1548067 - RNA, 20 nt, Human adenovirus C
gcaacccuuccaggagggcu

SEQ ID NO: 1548068 - RNA, 15 nt, Human adenovirus C
cccgagggccgcugg

SEQ ID NO: 1548069 - RNA, 16 nt, Human adenovirus C
ggaauuugagccccuc

SEQ ID NO: 1548070 - RNA, 17 nt, Human adenovirus C
uggccgcguccaucugg

SEQ ID NO: 1548071 - RNA, 14 nt, Human adenovirus C
ucuuugugguucuu

SEQ ID NO: 1548072 - RNA, 21 nt, Human adenovirus C
augguuaaccuacaccagugu

SEQ ID NO: 1548073 - RNA, 16 nt, Human adenovirus C
ccuacuccggcacugc

SEQ ID NO: 1548074 - RNA, 13 nt, Human adenovirus C
ucaaacccagcuu

SEQ ID NO: 1548075 - RNA, 21 nt, Human adenovirus C
gaguggcuguugaugugguga

SEQ ID NO: 1548076 - RNA, 13 nt, Human adenovirus C
acugccgccgcca

SEQ ID NO: 1548077 - RNA, 15 nt, Human adenovirus C
agggcaaccugggcu

SEQ ID NO: 1548078 - RNA, 16 nt, Human adenovirus C
accguagaugggacac

SEQ ID NO: 1548079 - RNA, 14 nt, Human adenovirus C
agcaaggccuggaa

SEQ ID NO: 1548080 - RNA, 13 nt, Human adenovirus C
cccucuuccuccc

SEQ ID NO: 1548081 - RNA, 18 nt, Human adenovirus C
gcuggagcugcccaagac

SEQ ID NO: 1548082 - RNA, 22 nt, Human adenovirus C
accacccgcccgcgccugcugg

SEQ ID NO: 1548083 - RNA, 15 nt, Human adenovirus C
aagacagaaacacag

SEQ ID NO: 1548084 - RNA, 19 nt, Human adenovirus C
cggaaacagggacgagccc

SEQ ID NO: 1548085 - RNA, 18 nt, Human adenovirus C
accaacgugcccaucucc

SEQ ID NO: 1548086 - RNA, 16 nt, Human adenovirus C
uggcaaugggcccacg

SEQ ID NO: 1548087 - RNA, 19 nt, Human adenovirus C
gaacuugcaggggcugugg

SEQ ID NO: 1548088 - RNA, 14 nt, Human adenovirus C
ccgcguccgcgcuc

SEQ ID NO: 1548089 - RNA, 14 nt, Human adenovirus C
ggugguuuuccaua

SEQ ID NO: 1548090 - RNA, 18 nt, Human adenovirus C
caaccgcgcccaggcggc

SEQ ID NO: 1548091 - RNA, 14 nt, Human adenovirus C
gcugccagggccgu

SEQ ID NO: 1548092 - RNA, 17 nt, Human adenovirus C
gugacuuggcacccacc

SEQ ID NO: 1548093 - RNA, 21 nt, Human adenovirus C
uggcgaucguaaacgcgcugg

SEQ ID NO: 1548094 - RNA, 13 nt, Human adenovirus C
acugggaguugcg

SEQ ID NO: 1548095 - RNA, 21 nt, Human adenovirus C
agcugccgucaucccugagca

SEQ ID NO: 1548096 - RNA, 19 nt, Human adenovirus C
caagcuacccacccagcgc

SEQ ID NO: 1548097 - RNA, 13 nt, Human adenovirus C
agcauuugaccau

SEQ ID NO: 1548098 - RNA, 14 nt, Human adenovirus C
agccggccuggacc

SEQ ID NO: 1548099 - RNA, 14 nt, Human adenovirus C
agcgcccccugcua

SEQ ID NO: 1548100 - RNA, 18 nt, Human adenovirus C
uugaucaaacccagcuuc

SEQ ID NO: 1548101 - RNA, 14 nt, Human adenovirus C
guaaacgcgcuggc

SEQ ID NO: 1548102 - RNA, 18 nt, Human adenovirus C
uauaccuuuuuaaugcau

SEQ ID NO: 1548103 - RNA, 14 nt, Human adenovirus C
guggcaacuggcaa

SEQ ID NO: 1548104 - RNA, 20 nt, Human adenovirus C
caggcuacuaagaaaacaca

SEQ ID NO: 1548105 - RNA, 23 nt, Human adenovirus C
agcaaugacagcaccuucaccca

SEQ ID NO: 1548106 - RNA, 19 nt, Human adenovirus C
cgcggcgugcuggacaggg

SEQ ID NO: 1548107 - RNA, 17 nt, Human adenovirus C
cgcuggccagcacgcuc

SEQ ID NO: 1548108 - RNA, 18 nt, Human adenovirus C
gcgaaggaggcaggaccc

SEQ ID NO: 1548109 - RNA, 18 nt, Human adenovirus C
ggacacgggcagccugga

SEQ ID NO: 1548110 - RNA, 17 nt, Human adenovirus C
agaacuauggcagcaag

SEQ ID NO: 1548111 - RNA, 23 nt, Human adenovirus C
guuucuggcggaggugcugcuga

SEQ ID NO: 1548112 - RNA, 18 nt, Human adenovirus C
gcccagcgauagcaguuc

SEQ ID NO: 1548113 - RNA, 20 nt, Human adenovirus C
ggaaagcuuccgcaggccaa

SEQ ID NO: 1548114 - RNA, 22 nt, Human adenovirus C
uaccuugagcgacgaccugggc

SEQ ID NO: 1548115 - RNA, 12 nt, Human adenovirus C
gcaggcagaacg

SEQ ID NO: 1548116 - RNA, 11 nt, Human adenovirus C
cggccccaccg

SEQ ID NO: 1548117 - RNA, 15 nt, Human adenovirus C
cugguguaccaggaa

SEQ ID NO: 1548118 - RNA, 13 nt, Human adenovirus C
ggcagcucgguga

SEQ ID NO: 1548119 - RNA, 18 nt, Human adenovirus C
ugcgcuuuuuggaacgcg

SEQ ID NO: 1548120 - RNA, 19 nt, Human adenovirus C
auggccggccacggccuga

SEQ ID NO: 1548121 - RNA, 11 nt, Human adenovirus C
ccucagcagcg

SEQ ID NO: 1548122 - RNA, 15 nt, Human adenovirus C
cgccgccgacccggc

SEQ ID NO: 1548123 - RNA, 19 nt, Human adenovirus C
ccgcucauggcgcagcugu

SEQ ID NO: 1548124 - RNA, 16 nt, Human adenovirus C
gagguccgcgugcggc

SEQ ID NO: 1548125 - RNA, 15 nt, Human adenovirus C
uucagagaagaacau

SEQ ID NO: 1548126 - RNA, 20 nt, Human adenovirus C
gcagucugcagcgcugccaa

SEQ ID NO: 1548127 - RNA, 13 nt, Human adenovirus C
aagucacugugga

SEQ ID NO: 1548128 - RNA, 15 nt, Human adenovirus C
gcggggugcugggau

SEQ ID NO: 1548129 - RNA, 20 nt, Human adenovirus C
uaccuaggucacuugcugac

SEQ ID NO: 1548130 - RNA, 19 nt, Human adenovirus C
ugaaugaccaguggagagg

SEQ ID NO: 1548131 - RNA, 18 nt, Human adenovirus C
ugacagguggagaugacu

SEQ ID NO: 1548132 - RNA, 13 nt, Human adenovirus C
aagccgacgcgcc

SEQ ID NO: 1548133 - RNA, 24 nt, Human adenovirus C
gacggcguaguuucgcaggcgcug

SEQ ID NO: 1548134 - RNA, 16 nt, Human adenovirus C
uaugcuaaaaugaaga

SEQ ID NO: 1548135 - RNA, 20 nt, Human adenovirus C
ggcaguggucuccucagcga

SEQ ID NO: 1548136 - RNA, 16 nt, Human adenovirus C
augccaaccuauggag

SEQ ID NO: 1548137 - RNA, 16 nt, Human adenovirus C
cuuccucccaacucug

SEQ ID NO: 1548138 - RNA, 13 nt, Human adenovirus C
acuauaacagagg

SEQ ID NO: 1548139 - RNA, 19 nt, Human adenovirus C
cuacaccuuucgccagggc

SEQ ID NO: 1548140 - RNA, 19 nt, Human adenovirus C
aacacaugucuaugcccag

SEQ ID NO: 1548141 - RNA, 22 nt, Human adenovirus C
gugggccgcggggguguccuug

SEQ ID NO: 1548142 - RNA, 19 nt, Human adenovirus C
cucuuccuuuuccucuugc

SEQ ID NO: 1548143 - RNA, 14 nt, Human adenovirus C
cugggucgucuuca

SEQ ID NO: 1548144 - RNA, 18 nt, Human adenovirus C
ggccaagaacaagagcug

SEQ ID NO: 1548145 - RNA, 21 nt, Human adenovirus C
acuggcaccuuuuguuccacc

SEQ ID NO: 1548146 - RNA, 18 nt, Human adenovirus C
cagcaucgcuacaaccuc

SEQ ID NO: 1548147 - RNA, 18 nt, Human adenovirus C
auuugucacccuuauccu

SEQ ID NO: 1548148 - RNA, 19 nt, Human adenovirus C
accacuaccggcaaccgcc

SEQ ID NO: 1548149 - RNA, 13 nt, Human adenovirus C
ccggcgccagcac

SEQ ID NO: 1548150 - RNA, 20 nt, Human adenovirus C
ggccauauuuuuugggcacc

SEQ ID NO: 1548151 - RNA, 22 nt, Human adenovirus C
gaugccgccaacgcgccuacca

SEQ ID NO: 1548152 - RNA, 20 nt, Human adenovirus C
cugugccuuuuacugcugcu

SEQ ID NO: 1548153 - RNA, 23 nt, Human adenovirus C
ugagcuccacaggucacgggcca

SEQ ID NO: 1548154 - RNA, 19 nt, Human adenovirus C
gaagaucuggaaggugcug

SEQ ID NO: 1548155 - RNA, 13 nt, Human adenovirus C
uccuccuggagau

SEQ ID NO: 1548156 - RNA, 17 nt, Human adenovirus C
caucaucgucacaaagg

SEQ ID NO: 1548157 - RNA, 14 nt, Human adenovirus C
guccguguccccgu

SEQ ID NO: 1548158 - RNA, 13 nt, Human adenovirus C
ucagcgccuccca

SEQ ID NO: 1548159 - RNA, 24 nt, Human adenovirus C
cgacuacaugaacaagcgaguggu

SEQ ID NO: 1548160 - RNA, 15 nt, Human adenovirus C
ggugcaggagcgcag

SEQ ID NO: 1548161 - RNA, 13 nt, Human adenovirus C
cgcagcagcaggg

SEQ ID NO: 1548162 - RNA, 16 nt, Human adenovirus C
cgcuaacuacugccac

SEQ ID NO: 1548163 - RNA, 12 nt, Human adenovirus C
aagaucagcuuc

SEQ ID NO: 1548164 - RNA, 13 nt, Human adenovirus C
gcagccgcaggcc

SEQ ID NO: 1548165 - RNA, 17 nt, Human adenovirus C
cucgaucucuuccuccu

SEQ ID NO: 1548166 - RNA, 16 nt, Human adenovirus C
accgcgcgcccugggg

SEQ ID NO: 1548167 - RNA, 10 nt, Human adenovirus C
aacaggaggg

SEQ ID NO: 1548168 - RNA, 12 nt, Human adenovirus C
cucaccucccaa

SEQ ID NO: 1548169 - RNA, 16 nt, Human adenovirus C
ccaagcaguuccaggc

SEQ ID NO: 1548170 - RNA, 18 nt, Human adenovirus C
cuucagcuugccugcucc

SEQ ID NO: 1548171 - RNA, 15 nt, Human adenovirus C
caggcuuaccccgcc

SEQ ID NO: 1548172 - RNA, 17 nt, Human adenovirus C
caacuuugguagcugcc

SEQ ID NO: 1548173 - RNA, 21 nt, Human adenovirus C
cagcaacuuuccggugguggg

SEQ ID NO: 1548174 - RNA, 15 nt, Human adenovirus C
acacagaagcaaagg

SEQ ID NO: 1548175 - RNA, 15 nt, Human adenovirus C
acccgcgcgcgcugg

SEQ ID NO: 1548176 - RNA, 15 nt, Human adenovirus C
guucggggcugugcc

SEQ ID NO: 1548177 - RNA, 17 nt, Human adenovirus C
acgcggaggcucucuuc

SEQ ID NO: 1548178 - RNA, 15 nt, Human adenovirus C
gacgagcggccgccg

SEQ ID NO: 1548179 - RNA, 16 nt, Human adenovirus C
ggccugguaggcgcag

SEQ ID NO: 1548180 - RNA, 19 nt, Human adenovirus C
ugcaccacagaacaugaaa

SEQ ID NO: 1548181 - RNA, 23 nt, Human adenovirus C
acgccaccuucuuccccauggcc

SEQ ID NO: 1548182 - RNA, 13 nt, Human adenovirus C
acccuggcugugg

SEQ ID NO: 1548183 - RNA, 13 nt, Human adenovirus C
gcgcccuggaggc

SEQ ID NO: 1548184 - RNA, 13 nt, Human adenovirus C
acucgcugcugca

SEQ ID NO: 1548185 - RNA, 14 nt, Human adenovirus C
gucccgcucccacc

SEQ ID NO: 1548186 - RNA, 18 nt, Human adenovirus C
acgucgcaccggccgacg

SEQ ID NO: 1548187 - RNA, 19 nt, Human adenovirus C
aggucccuucgcagggcca

SEQ ID NO: 1548188 - RNA, 20 nt, Human adenovirus C
cuuuaacggcucuucauuug

SEQ ID NO: 1548189 - RNA, 21 nt, Human adenovirus C
agcgguuaagcugggaugggu

SEQ ID NO: 1548190 - RNA, 16 nt, Human adenovirus C
ucacugucgcugcaac

SEQ ID NO: 1548191 - RNA, 17 nt, Human adenovirus C
ccaccggcggcggcgcg

SEQ ID NO: 1548192 - RNA, 13 nt, Human adenovirus C
acgucgcgccgca

SEQ ID NO: 1548193 - RNA, 18 nt, Human adenovirus C
ucgcgcaacugggcagca

SEQ ID NO: 1548194 - RNA, 20 nt, Human adenovirus C
cuuuccgccgccaacaugcu

SEQ ID NO: 1548195 - RNA, 22 nt, Human adenovirus C
cugcugcuaauagcgcccuuca

SEQ ID NO: 1548196 - RNA, 20 nt, Human adenovirus C
ucagcuggggcucgcugugg

SEQ ID NO: 1548197 - RNA, 22 nt, Human adenovirus C
cccggaauugcauccguggccu

SEQ ID NO: 1548198 - RNA, 17 nt, Human adenovirus C
ccuaugacaagcgcuuu

SEQ ID NO: 1548199 - RNA, 18 nt, Human adenovirus C
aaguuugccacacaaccu

SEQ ID NO: 1548200 - RNA, 13 nt, Human adenovirus C
guuuuccuggcca

SEQ ID NO: 1548201 - RNA, 21 nt, Human adenovirus C
cuucuucaaucuccucuucca

SEQ ID NO: 1548202 - RNA, 17 nt, Human adenovirus C
ggccagcuguuggggug

SEQ ID NO: 1548203 - RNA, 13 nt, Human adenovirus C
gccuacccgcagu

SEQ ID NO: 1548204 - RNA, 17 nt, Human adenovirus C
gaggaagguccuccucc

SEQ ID NO: 1548205 - RNA, 14 nt, Human adenovirus C
ccaacuccaugcuu

SEQ ID NO: 1548206 - RNA, 13 nt, Human adenovirus C
caucugcagcgcc

SEQ ID NO: 1548207 - RNA, 23 nt, Human adenovirus C
ugcgcuuaaaaugggcagcgguc

SEQ ID NO: 1548208 - RNA, 17 nt, Human adenovirus C
uaggaucagacaaugca

SEQ ID NO: 1548209 - RNA, 16 nt, Human adenovirus C
ccggccuuaacuccac

SEQ ID NO: 1548210 - RNA, 22 nt, Human adenovirus C
acagaagcaccauguccuuggg

SEQ ID NO: 1548211 - RNA, 19 nt, Human adenovirus C
ccacgcccuacauguggag

SEQ ID NO: 1548212 - RNA, 20 nt, Human adenovirus C
guaacuuuauguccaugggc

SEQ ID NO: 1548213 - RNA, 17 nt, Human adenovirus C
cuauaggacugaugcau

SEQ ID NO: 1548214 - RNA, 16 nt, Human adenovirus C
cgauguuuagcugcac

SEQ ID NO: 1548215 - RNA, 19 nt, Human adenovirus C
cucguccagacgggccagg

SEQ ID NO: 1548216 - RNA, 19 nt, Human adenovirus C
ugccauuaaaaaccuccuc

SEQ ID NO: 1548217 - RNA, 18 nt, Human adenovirus C
ggcggccaugcgggccgc

SEQ ID NO: 1548218 - RNA, 16 nt, Human adenovirus C
cgcagcggugcagcca

SEQ ID NO: 1548219 - RNA, 15 nt, Human adenovirus C
caggugcagacccug

SEQ ID NO: 1548220 - RNA, 18 nt, Human adenovirus C
ugcagaccaaccuggacc

SEQ ID NO: 1548221 - RNA, 17 nt, Human adenovirus C
gccccccuucucccacc

SEQ ID NO: 1548222 - RNA, 17 nt, Human adenovirus C
gauagcggccgggcagu

SEQ ID NO: 1548223 - RNA, 14 nt, Human adenovirus C
ggucucgcauucca

SEQ ID NO: 1548224 - RNA, 13 nt, Human adenovirus C
ucagccacuuaaa

SEQ ID NO: 1548225 - RNA, 21 nt, Human adenovirus C
aaaggugguagauggccuggc

SEQ ID NO: 1548226 - RNA, 21 nt, Human adenovirus C
gcagaaguauuccauagagca

SEQ ID NO: 1548227 - RNA, 16 nt, Human adenovirus C
uguaccugccagacaa

SEQ ID NO: 1548228 - RNA, 21 nt, Human adenovirus C
gauguaauuaaaguaggcggu

SEQ ID NO: 1548229 - RNA, 15 nt, Human adenovirus C
cucaaauauggaaca

SEQ ID NO: 1548230 - RNA, 15 nt, Human adenovirus C
cagccggugggcccg

SEQ ID NO: 1548231 - RNA, 17 nt, Human adenovirus C
ggcgcugcagagccagc

SEQ ID NO: 1548232 - RNA, 23 nt, Human adenovirus C
cgggucaaaaagaaaaagaaaga

SEQ ID NO: 1548233 - RNA, 20 nt, Human adenovirus C
caagcggcaacccuuccagg

SEQ ID NO: 1548234 - RNA, 15 nt, Human adenovirus C
ccgcggcgugcugga

SEQ ID NO: 1548235 - RNA, 15 nt, Human adenovirus C
gaccaaccggcggca

SEQ ID NO: 1548236 - RNA, 14 nt, Human adenovirus C
gaaacacagagcug

SEQ ID NO: 1548237 - RNA, 19 nt, Human adenovirus C
acgccucggaguaccugag

SEQ ID NO: 1548238 - RNA, 23 nt, Human adenovirus C
cgaggucguuggagaugcgggcc

SEQ ID NO: 1548239 - RNA, 18 nt, Human adenovirus C
cgcgcggagguugcuggc

SEQ ID NO: 1548240 - RNA, 12 nt, Human adenovirus C
cauuaacaaaaa

SEQ ID NO: 1548241 - RNA, 19 nt, Human adenovirus C
cgcggcuguagaccacgcc

SEQ ID NO: 1548242 - RNA, 23 nt, Human adenovirus C
ccauuaacgaggaugggcagggg

SEQ ID NO: 1548243 - RNA, 19 nt, Human adenovirus C
ccuauaccuuuuuaaugca

SEQ ID NO: 1548244 - RNA, 22 nt, Human adenovirus C
ggcguccggcucaccacccagg

SEQ ID NO: 1548245 - RNA, 19 nt, Human adenovirus C
aggcgcauguggacgagca

SEQ ID NO: 1548246 - RNA, 19 nt, Human adenovirus C
caaauacaaaagcagacgc

SEQ ID NO: 1548247 - RNA, 20 nt, Human adenovirus C
cauggguguucuugcugguc

SEQ ID NO: 1548248 - RNA, 16 nt, Human adenovirus C
ugcauguuuucccuga

SEQ ID NO: 1548249 - RNA, 17 nt, Human adenovirus C
cuccucuauaaacauuc

SEQ ID NO: 1548250 - RNA, 13 nt, Human adenovirus C
ggcgaugagcagc

SEQ ID NO: 1548251 - RNA, 19 nt, Human adenovirus C
agaugcgggccaugagcug

SEQ ID NO: 1548252 - RNA, 19 nt, Human adenovirus C
ccuguguggaagccuggac

SEQ ID NO: 1548253 - RNA, 15 nt, Human adenovirus C
ccgcgagcuuagaaa

SEQ ID NO: 1548254 - RNA, 14 nt, Human adenovirus C
cuggaacagagcuc

SEQ ID NO: 1548255 - RNA, 20 nt, Human adenovirus C
cacaagaaucgccugcuacu

SEQ ID NO: 1548256 - RNA, 15 nt, Human adenovirus C
acagcgccugcauga

SEQ ID NO: 1548257 - RNA, 21 nt, Human adenovirus C
ccuucuccuaccgcgucagga

SEQ ID NO: 1548258 - RNA, 13 nt, Human adenovirus C
cgggcacuaccgc

SEQ ID NO: 1548259 - RNA, 20 nt, Human adenovirus C
ccaaaccucagcgccuccca

SEQ ID NO: 1548260 - RNA, 20 nt, Human adenovirus C
ccugcaggaaucgccccauc

SEQ ID NO: 1548261 - RNA, 20 nt, Human adenovirus C
cgcgcggcggcggcccugcu

SEQ ID NO: 1548262 - RNA, 19 nt, Human adenovirus C
gccaguggcaacuggcaaa

SEQ ID NO: 1548263 - RNA, 17 nt, Human adenovirus C
aaaugaugacaaacuua

SEQ ID NO: 1548264 - RNA, 19 nt, Human adenovirus C
gcagcgugagcgcgcgcag

SEQ ID NO: 1548265 - RNA, 15 nt, Human adenovirus C
aucugcuggcgcaga

SEQ ID NO: 1548266 - RNA, 16 nt, Human adenovirus C
gcgcagcuugcccuug

SEQ ID NO: 1548267 - RNA, 12 nt, Human adenovirus C
ccugggcuggcg

SEQ ID NO: 1548268 - RNA, 21 nt, Human adenovirus C
cggcagucugcagcgcugcca

SEQ ID NO: 1548269 - RNA, 13 nt, Human adenovirus C
caccaccacccuc

SEQ ID NO: 1548270 - RNA, 20 nt, Human adenovirus C
ggcaccaggugcacgcgcca

SEQ ID NO: 1548271 - RNA, 16 nt, Human adenovirus C
caucuccagcggccac

SEQ ID NO: 1548272 - RNA, 21 nt, Human adenovirus C
ccaugucgccgccagaggagc

SEQ ID NO: 1548273 - RNA, 17 nt, Human adenovirus C
uaaacucaggcacaacc

SEQ ID NO: 1548274 - RNA, 13 nt, Human adenovirus C
cuggcgcgcuggc

SEQ ID NO: 1548275 - RNA, 15 nt, Human adenovirus C
gcucuacagcuuccu

SEQ ID NO: 1548276 - RNA, 14 nt, Human adenovirus C
gcuguccagcugcu

SEQ ID NO: 1548277 - RNA, 20 nt, Human adenovirus C
gucucgcauuccacgagcca

SEQ ID NO: 1548278 - RNA, 23 nt, Human adenovirus C
ucgcccuugcggcagucugcagc

SEQ ID NO: 1548279 - RNA, 14 nt, Human adenovirus C
cugcaacaagaaaa

SEQ ID NO: 1548280 - RNA, 13 nt, Human adenovirus C
ccuugauuuuccg

SEQ ID NO: 1548281 - RNA, 13 nt, Human adenovirus C
ggacgacgcagag

SEQ ID NO: 1548282 - RNA, 22 nt, Human adenovirus C
cgacuggcgccaggucauggac

SEQ ID NO: 1548283 - RNA, 13 nt, Human adenovirus C
gcaguuccaggcg

SEQ ID NO: 1548284 - RNA, 19 nt, Human adenovirus C
caucaaacaauacuaaaaa

SEQ ID NO: 1548285 - RNA, 13 nt, Human adenovirus C
ccacgugccgggc

SEQ ID NO: 1548286 - RNA, 22 nt, Human adenovirus C
cccggcuaucguggcuacaccu

SEQ ID NO: 1548287 - RNA, 20 nt, Human adenovirus C
auuuuuccaaaacaggaggu

SEQ ID NO: 1548288 - RNA, 16 nt, Human adenovirus C
cgagcccaaaguccag

SEQ ID NO: 1548289 - RNA, 11 nt, Human adenovirus C
agcgaggagga

SEQ ID NO: 1548290 - RNA, 16 nt, Human adenovirus C
acacuuaagcucgccu

SEQ ID NO: 1548291 - RNA, 19 nt, Human adenovirus C
ggaagaugaagaugaagaa

SEQ ID NO: 1548292 - RNA, 15 nt, Human adenovirus C
uuucugccagcgccu

SEQ ID NO: 1548293 - RNA, 22 nt, Human adenovirus C
acugacuuugcuuuccugagcc

SEQ ID NO: 1548294 - RNA, 17 nt, Human adenovirus C
cuugaaagugggcaggc

SEQ ID NO: 1548295 - RNA, 16 nt, Human adenovirus C
ccagaggagcugcuga

SEQ ID NO: 1548296 - RNA, 23 nt, Human adenovirus C
cucauguucuugucccuccgcac

SEQ ID NO: 1548297 - RNA, 13 nt, Human adenovirus C
cuggguucccccu

SEQ ID NO: 1548298 - RNA, 11 nt, Human adenovirus C
cgcgccgcacc

SEQ ID NO: 1548299 - RNA, 15 nt, Human adenovirus C
ugcaaauuccuccgg

SEQ ID NO: 1548300 - RNA, 12 nt, Human adenovirus C
cccaccacugug

SEQ ID NO: 1548301 - RNA, 16 nt, Human adenovirus C
uggugcgcggagcccg

SEQ ID NO: 1548302 - RNA, 23 nt, Human adenovirus C
aggagcgcagcuugagccuggcu

SEQ ID NO: 1548303 - RNA, 13 nt, Human adenovirus C
ugauccuccagua

SEQ ID NO: 1548304 - RNA, 19 nt, Human adenovirus C
ucguaggugagcuccucag

SEQ ID NO: 1548305 - RNA, 18 nt, Human adenovirus C
ccauuuuuccaaaacagg

SEQ ID NO: 1548306 - RNA, 14 nt, Human adenovirus C
gucaucccugagca

SEQ ID NO: 1548307 - RNA, 14 nt, Human adenovirus C
agguacugaaaugu

SEQ ID NO: 1548308 - RNA, 13 nt, Human adenovirus C
gcaacaagaaaac

SEQ ID NO: 1548309 - RNA, 21 nt, Human adenovirus C
ugacgcguuccggcagcagcc

SEQ ID NO: 1548310 - RNA, 17 nt, Human adenovirus C
ugaggcugguccugcug

SEQ ID NO: 1548311 - RNA, 21 nt, Human adenovirus C
gaggagccuccaccggccgug

SEQ ID NO: 1548312 - RNA, 16 nt, Human adenovirus C
gcaagagcgcagcgau

SEQ ID NO: 1548313 - RNA, 15 nt, Human adenovirus C
uaccaacucuuacac

SEQ ID NO: 1548314 - RNA, 15 nt, Human adenovirus C
ggcggcggcgcgcaa

SEQ ID NO: 1548315 - RNA, 16 nt, Human adenovirus C
uauguauaaauuucca

SEQ ID NO: 1548316 - RNA, 17 nt, Human adenovirus C
ccggcggcgguggugga

SEQ ID NO: 1548317 - RNA, 22 nt, Human adenovirus C
uacagcccgggggaggcaagca

SEQ ID NO: 1548318 - RNA, 22 nt, Human adenovirus C
cugaguauaauaaauacagaaa

SEQ ID NO: 1548319 - RNA, 19 nt, Human adenovirus C
cugcgacuuaccgcagccg

SEQ ID NO: 1548320 - RNA, 17 nt, Human adenovirus C
aggguaucauggcggac

SEQ ID NO: 1548321 - RNA, 14 nt, Human adenovirus C
cgucacccagcacu

SEQ ID NO: 1548322 - RNA, 14 nt, Human adenovirus C
caaagcaggggcca

SEQ ID NO: 1548323 - RNA, 12 nt, Human adenovirus C
ucaggcgccgcc

SEQ ID NO: 1548324 - RNA, 14 nt, Human adenovirus C
cagugagcaggaac

SEQ ID NO: 1548325 - RNA, 18 nt, Human adenovirus C
cuggugcugaagcgcugc

SEQ ID NO: 1548326 - RNA, 16 nt, Human adenovirus C
cgcacccgccccccgc

SEQ ID NO: 1548327 - RNA, 15 nt, Human adenovirus C
aguuucgcaggcgcu

SEQ ID NO: 1548328 - RNA, 12 nt, Human adenovirus C
ugaccaugaaga

SEQ ID NO: 1548329 - RNA, 15 nt, Human adenovirus C
cuacaacaaacagag

SEQ ID NO: 1548330 - RNA, 20 nt, Human adenovirus C
cuggaagacgcggaggcucu

SEQ ID NO: 1548331 - RNA, 20 nt, Human adenovirus C
gcaaccuaaaggagcugcag

SEQ ID NO: 1548332 - RNA, 19 nt, Human adenovirus C
caacauccgcggcugacgc

SEQ ID NO: 1548333 - RNA, 16 nt, Human adenovirus C
uggaggaggcgccgca

SEQ ID NO: 1548334 - RNA, 14 nt, Human adenovirus C
cugcagaauuaagg

SEQ ID NO: 1548335 - RNA, 12 nt, Human adenovirus C
auccgcccugcu

SEQ ID NO: 1548336 - RNA, 13 nt, Human adenovirus C
agcgcggggugcc

SEQ ID NO: 1548337 - RNA, 22 nt, Human adenovirus C
cagcgugagcgcgcgcagcagc

SEQ ID NO: 1548338 - RNA, 21 nt, Human adenovirus C
caugcgcgagggacaggcuua

SEQ ID NO: 1548339 - RNA, 13 nt, Human adenovirus C
ccccagguccagg

SEQ ID NO: 1548340 - RNA, 16 nt, Human adenovirus C
gaggaggaauacuggg

SEQ ID NO: 1548341 - RNA, 20 nt, Human adenovirus C
ccaugggcgcacucacagac

SEQ ID NO: 1548342 - RNA, 21 nt, Human adenovirus C
uagcauuaaguuugacagcau

SEQ ID NO: 1548343 - RNA, 15 nt, Human adenovirus C
accuaaaugccaacc

SEQ ID NO: 1548344 - RNA, 16 nt, Human adenovirus C
agcgccaaaaacuggu

SEQ ID NO: 1548345 - RNA, 14 nt, Human adenovirus C
gcggguuggggcgg

SEQ ID NO: 1548346 - RNA, 18 nt, Human adenovirus C
cgcaccgcguccgcgcuc

SEQ ID NO: 1548347 - RNA, 16 nt, Human adenovirus C
gcagcggguggcgguc

SEQ ID NO: 1548348 - RNA, 17 nt, Human adenovirus C
guggacgucgcgccgca

SEQ ID NO: 1548349 - RNA, 22 nt, Human adenovirus C
cagcaauaugagcgguggcgcc

SEQ ID NO: 1548350 - RNA, 16 nt, Human adenovirus C
ggcagaaacagagggc

SEQ ID NO: 1548351 - RNA, 15 nt, Human adenovirus C
agggugccagacugc

SEQ ID NO: 1548352 - RNA, 16 nt, Human adenovirus C
gcuauaaaugcaggaa

SEQ ID NO: 1548353 - RNA, 18 nt, Human adenovirus C
ugguacuuguccaucaac

SEQ ID NO: 1548354 - RNA, 14 nt, Human adenovirus C
ggcggcggcggagu

SEQ ID NO: 1548355 - RNA, 18 nt, Human adenovirus C
gaaaaugccuugauuuuc

SEQ ID NO: 1548356 - RNA, 15 nt, Human adenovirus C
uggcaaugggcccac

SEQ ID NO: 1548357 - RNA, 16 nt, Human adenovirus C
gauuaaaaacaaguug

SEQ ID NO: 1548358 - RNA, 14 nt, Human adenovirus C
acuaaagcaaggcc

SEQ ID NO: 1548359 - RNA, 18 nt, Human adenovirus C
guuccucguaggugagcu

SEQ ID NO: 1548360 - RNA, 17 nt, Human adenovirus C
ugagacaugauuccucg

SEQ ID NO: 1548361 - RNA, 14 nt, Human adenovirus C
uccuccugccaggc

SEQ ID NO: 1548362 - RNA, 14 nt, Human adenovirus C
cggucggccaugcc

SEQ ID NO: 1548363 - RNA, 18 nt, Human adenovirus C
cacaggguugcagcacug

SEQ ID NO: 1548364 - RNA, 13 nt, Human adenovirus C
gugagcgcacugc

SEQ ID NO: 1548365 - RNA, 15 nt, Human adenovirus C
aggaccucugcacuc

SEQ ID NO: 1548366 - RNA, 18 nt, Human adenovirus C
gacagcaccuucacccag

SEQ ID NO: 1548367 - RNA, 15 nt, Human adenovirus C
aaguccacaaaaaac

SEQ ID NO: 1548368 - RNA, 20 nt, Human adenovirus C
ggcgaaaagcguccgcggcc

SEQ ID NO: 1548369 - RNA, 22 nt, Human adenovirus C
cccgccaccugcugugcgcuuc

SEQ ID NO: 1548370 - RNA, 16 nt, Human adenovirus C
gggcgcaguaguccag

SEQ ID NO: 1548371 - RNA, 20 nt, Human adenovirus C
cauccguggccuugcaggcg

SEQ ID NO: 1548372 - RNA, 21 nt, Human adenovirus C
ccauccuuauaucgcccagca

SEQ ID NO: 1548373 - RNA, 13 nt, Human adenovirus C
accuucaaaucaa

SEQ ID NO: 1548374 - RNA, 18 nt, Human adenovirus C
cagagaugaccggcucaa

SEQ ID NO: 1548375 - RNA, 22 nt, Human adenovirus C
cggcgcggaagagaacuccaac

SEQ ID NO: 1548376 - RNA, 22 nt, Human adenovirus C
guccaggcgacgagcggccgcc

SEQ ID NO: 1548377 - RNA, 15 nt, Human adenovirus C
cugggcuggagcccg

SEQ ID NO: 1548378 - RNA, 14 nt, Human adenovirus C
ggacagcaagaaac

SEQ ID NO: 1548379 - RNA, 17 nt, Human adenovirus C
agagggagcggggggcu

SEQ ID NO: 1548380 - RNA, 22 nt, Human adenovirus C
ccaccugcgcgagauugagcuc

SEQ ID NO: 1548381 - RNA, 23 nt, Human adenovirus C
gcucgcccuugcggcagucugca

SEQ ID NO: 1548382 - RNA, 21 nt, Human adenovirus C
ccaaaagauuauccaaaaccu

SEQ ID NO: 1548383 - RNA, 21 nt, Human adenovirus C
ccggggcgcgcugcggcugcu

SEQ ID NO: 1548384 - RNA, 22 nt, Human adenovirus C
acuggucuugucaugccugggg

SEQ ID NO: 1548385 - RNA, 22 nt, Human adenovirus C
uggacaaccccagacccaucuc

SEQ ID NO: 1548386 - RNA, 18 nt, Human adenovirus C
ggcugccgugcggcaggg

SEQ ID NO: 1548387 - RNA, 13 nt, Human adenovirus C
cauccgcgccgca

SEQ ID NO: 1548388 - RNA, 13 nt, Human adenovirus C
ccaugcuuuuuga

SEQ ID NO: 1548389 - RNA, 19 nt, Human adenovirus C
gcuccuuuuggcuuccuuc

SEQ ID NO: 1548390 - RNA, 23 nt, Human adenovirus C
cugcagagcauaguggugcagga

SEQ ID NO: 1548391 - RNA, 14 nt, Human adenovirus C
gaaaagcuuauuau

SEQ ID NO: 1548392 - RNA, 18 nt, Human adenovirus C
gaggagcaacagcaggag

SEQ ID NO: 1548393 - RNA, 17 nt, Human adenovirus C
gguggcucccgggcuug

SEQ ID NO: 1548394 - RNA, 20 nt, Human adenovirus C
cgcccuggaggcagcugggg

SEQ ID NO: 1548395 - RNA, 20 nt, Human adenovirus C
acuacaugaacaagcgagug

SEQ ID NO: 1548396 - RNA, 18 nt, Human adenovirus C
aaccuaucaccgucaccc

SEQ ID NO: 1548397 - RNA, 21 nt, Human adenovirus C
aaaaugugggagucaaguacu

SEQ ID NO: 1548398 - RNA, 15 nt, Human adenovirus C
agcaaaccucaccuc

SEQ ID NO: 1548399 - RNA, 14 nt, Human adenovirus C
ccaaaccucagcgc

SEQ ID NO: 1548400 - RNA, 20 nt, Human adenovirus C
gcaugauaaauauguggccg

SEQ ID NO: 1548401 - RNA, 20 nt, Human adenovirus C
gagacguacuucagccugaa

SEQ ID NO: 1548402 - RNA, 22 nt, Human adenovirus C
uuggcguugccgcuggacgagg

SEQ ID NO: 1548403 - RNA, 20 nt, Human adenovirus C
cugcacgcaaccgcgcccag

SEQ ID NO: 1548404 - RNA, 12 nt, Human adenovirus C
cauucugcagag

SEQ ID NO: 1548405 - RNA, 14 nt, Human adenovirus C
ugcgugcucuacau

SEQ ID NO: 1548406 - RNA, 15 nt, Human adenovirus C
cgggcggcgcugcag

SEQ ID NO: 1548407 - RNA, 18 nt, Human adenovirus C
cauugcuuucagggacaa

SEQ ID NO: 1548408 - RNA, 14 nt, Human adenovirus C
gcaccgccagcgca

SEQ ID NO: 1548409 - RNA, 20 nt, Human adenovirus C
ucugcgacgcguugcaagag

SEQ ID NO: 1548410 - RNA, 20 nt, Human adenovirus C
cuucucggccggcaacgcca

SEQ ID NO: 1548411 - RNA, 18 nt, Human adenovirus C
gcuccuuuuggcuuccuu

SEQ ID NO: 1548412 - RNA, 17 nt, Human adenovirus C
cugaccugcgcugggcc

SEQ ID NO: 1548413 - RNA, 14 nt, Human adenovirus C
cuacucccagcuca

SEQ ID NO: 1548414 - RNA, 16 nt, Human adenovirus C
uggggcggcgaccuga

SEQ ID NO: 1548415 - RNA, 16 nt, Human adenovirus C
gcaagcuagaggaaac

SEQ ID NO: 1548416 - RNA, 15 nt, Human adenovirus C
gacaaaagaacccac

SEQ ID NO: 1548417 - RNA, 23 nt, Human adenovirus C
gaaacagagggcugccugcacuu

SEQ ID NO: 1548418 - RNA, 18 nt, Human adenovirus C
ucacggugaaggggugcg

SEQ ID NO: 1548419 - RNA, 20 nt, Human adenovirus C
ccgugggcucguggugcuug

SEQ ID NO: 1548420 - RNA, 16 nt, Human adenovirus C
cucagcagcggcaaga

SEQ ID NO: 1548421 - RNA, 13 nt, Human adenovirus C
gcuuucagggaca

SEQ ID NO: 1548422 - RNA, 11 nt, Human adenovirus C
agucacugugg

SEQ ID NO: 1548423 - RNA, 17 nt, Human adenovirus C
cgcaguuggggccuccg

SEQ ID NO: 1548424 - RNA, 16 nt, Human adenovirus C
cagcaauaacacaggc

SEQ ID NO: 1548425 - RNA, 19 nt, Human adenovirus C
cgugacacugcagcaggug

SEQ ID NO: 1548426 - RNA, 22 nt, Human adenovirus C
cuuuuaagggcguagagcuugg

SEQ ID NO: 1548427 - RNA, 13 nt, Human adenovirus C
aaucaaacucaca

SEQ ID NO: 1548428 - RNA, 14 nt, Human adenovirus C
uggcaaccaccgcu

SEQ ID NO: 1548429 - RNA, 18 nt, Human adenovirus C
gcagcccuaucagcagcc

SEQ ID NO: 1548430 - RNA, 20 nt, Human adenovirus C
gcacuaguauugccacugcc

SEQ ID NO: 1548431 - RNA, 15 nt, Human adenovirus C
gcauacggccgccag

SEQ ID NO: 1548432 - RNA, 14 nt, Human adenovirus C
uguccuuggaugau

SEQ ID NO: 1548433 - RNA, 23 nt, Human adenovirus C
acgcuggaccugccuccccccgc

SEQ ID NO: 1548434 - RNA, 18 nt, Human adenovirus C
cagaggagcugcugagcc

SEQ ID NO: 1548435 - RNA, 21 nt, Human adenovirus C
caggggcgcagcuugcgggcg

SEQ ID NO: 1548436 - RNA, 12 nt, Human adenovirus C
ugaaaccaugcu

SEQ ID NO: 1548437 - RNA, 13 nt, Human adenovirus C
cgcaaccgcagac

SEQ ID NO: 1548438 - RNA, 16 nt, Human adenovirus C
gagccaggugagcucu

SEQ ID NO: 1548439 - RNA, 18 nt, Human adenovirus C
uacauucgggcagcagcg

SEQ ID NO: 1548440 - RNA, 20 nt, Human adenovirus C
guccagcagaggcggccgcc

SEQ ID NO: 1548441 - RNA, 22 nt, Human adenovirus C
cagcagcagggcaaccugggcu

SEQ ID NO: 1548442 - RNA, 14 nt, Human adenovirus C
gcgcgcuggagcaa

SEQ ID NO: 1548443 - RNA, 22 nt, Human adenovirus C
ccagauuuuggcgcgcccgcca

SEQ ID NO: 1548444 - RNA, 20 nt, Human adenovirus C
ucagcgcagcggugcagcca

SEQ ID NO: 1548445 - RNA, 14 nt, Human adenovirus C
ccuuuccgccgcca

SEQ ID NO: 1548446 - RNA, 20 nt, Human adenovirus C
ccgauuuccgugcgcagggu

SEQ ID NO: 1548447 - RNA, 22 nt, Human adenovirus C
agcggggugguggaccuggcca

SEQ ID NO: 1548448 - RNA, 18 nt, Human adenovirus C
ccugcgccguagcgccau

SEQ ID NO: 1548449 - RNA, 19 nt, Human adenovirus C
cggaggcguacaugccgca

SEQ ID NO: 1548450 - RNA, 14 nt, Human adenovirus C
guggagccugggcu

SEQ ID NO: 1548451 - RNA, 23 nt, Human adenovirus C
aacuccagggugcgccacaaugu

SEQ ID NO: 1548452 - RNA, 19 nt, Human adenovirus C
ucugacaaccccaacaccu

SEQ ID NO: 1548453 - RNA, 13 nt, Human adenovirus C
cugcccaccaccc

SEQ ID NO: 1548454 - RNA, 21 nt, Human adenovirus C
ccugcacgucuagggcgcagu

SEQ ID NO: 1548455 - RNA, 13 nt, Human adenovirus C
ccggccugcugaa

SEQ ID NO: 1548456 - RNA, 20 nt, Human adenovirus C
uccgaucuaggcgcugcggc

SEQ ID NO: 1548457 - RNA, 16 nt, Human adenovirus C
ccacagaaacuagcga

SEQ ID NO: 1548458 - RNA, 14 nt, Human adenovirus C
agcuuguugaccag

SEQ ID NO: 1548459 - RNA, 20 nt, Human adenovirus C
agacugggguuugacccagu

SEQ ID NO: 1548460 - RNA, 10 nt, Human adenovirus C
aaaaaacaac

SEQ ID NO: 1548461 - RNA, 18 nt, Human adenovirus C
accccgccaacgugcccu

SEQ ID NO: 1548462 - RNA, 20 nt, Human adenovirus C
aggacaaacagguggagcug

SEQ ID NO: 1548463 - RNA, 17 nt, Human adenovirus C
caaagggcccuggcugg

SEQ ID NO: 1548464 - RNA, 12 nt, Human adenovirus C
uccucaccugcc

SEQ ID NO: 1548465 - RNA, 19 nt, Human adenovirus C
cggccaugcgggccgcucg

SEQ ID NO: 1548466 - RNA, 17 nt, Human adenovirus C
gaagacguaugcgcagg

SEQ ID NO: 1548467 - RNA, 15 nt, Human adenovirus C
gcggucggccaugcc

SEQ ID NO: 1548468 - RNA, 21 nt, Human adenovirus C
acuuugcgucucuggccccgc

SEQ ID NO: 1548469 - RNA, 20 nt, Human adenovirus C
caaagcaaaccucaccuccg

SEQ ID NO: 1548470 - RNA, 15 nt, Human adenovirus C
gccuccgcccugcgc

SEQ ID NO: 1548471 - RNA, 22 nt, Human adenovirus C
acuacccgacgccgaaccacca

SEQ ID NO: 1548472 - RNA, 16 nt, Human adenovirus C
gcggcagcggcagcaa

SEQ ID NO: 1548473 - RNA, 19 nt, Human adenovirus C
cuugcgcuaugugcagcag

SEQ ID NO: 1548474 - RNA, 10 nt, Human adenovirus C
uaacuccugu

SEQ ID NO: 1548475 - RNA, 20 nt, Human adenovirus C
ugaugccuuugaggguggcc

SEQ ID NO: 1548476 - RNA, 15 nt, Human adenovirus C
caacaaucuaugcca

SEQ ID NO: 1548477 - RNA, 22 nt, Human adenovirus C
ccgauguaaggguucggggcug

SEQ ID NO: 1548478 - RNA, 17 nt, Human adenovirus C
gugcuggacagggggcc

SEQ ID NO: 1548479 - RNA, 21 nt, Human adenovirus C
aagcccgugacacugcagcag

SEQ ID NO: 1548480 - RNA, 15 nt, Human adenovirus C
acacguggcggccgc

SEQ ID NO: 1548481 - RNA, 13 nt, Human adenovirus C
cugccgccgccac

SEQ ID NO: 1548482 - RNA, 17 nt, Human adenovirus C
cccaugaaaccaugcua

SEQ ID NO: 1548483 - RNA, 16 nt, Human adenovirus C
gugaccgaggagcuga

SEQ ID NO: 1548484 - RNA, 14 nt, Human adenovirus C
ccugacgggcggca

SEQ ID NO: 1548485 - RNA, 15 nt, Human adenovirus C
accguagaugggaca

SEQ ID NO: 1548486 - RNA, 23 nt, Human adenovirus C
gcaagucuagcgccugcugccau

SEQ ID NO: 1548487 - RNA, 22 nt, Human adenovirus C
ccacauccuuggccaauugcaa

SEQ ID NO: 1548488 - RNA, 16 nt, Human adenovirus C
uucaauugcagaaaau

SEQ ID NO: 1548489 - RNA, 19 nt, Human adenovirus C
gcgcacaaacgcggccgca

SEQ ID NO: 1548490 - RNA, 22 nt, Human adenovirus C
ccauaagggccuccccuucuuc

SEQ ID NO: 1548491 - RNA, 22 nt, Human adenovirus C
agucagucgagaaggaggacag

SEQ ID NO: 1548492 - RNA, 14 nt, Human adenovirus C
gcaggcggccgcug

SEQ ID NO: 1548493 - RNA, 19 nt, Human adenovirus C
gcaagccgcucauggcgca

SEQ ID NO: 1548494 - RNA, 21 nt, Human adenovirus C
agcagguuccugagcagcugc

SEQ ID NO: 1548495 - RNA, 17 nt, Human adenovirus C
acugucacuugcugaag

SEQ ID NO: 1548496 - RNA, 19 nt, Human adenovirus C
cuaccuuaccaaugcaauu

SEQ ID NO: 1548497 - RNA, 14 nt, Human adenovirus C
ugcccuccgccgcu

SEQ ID NO: 1548498 - RNA, 21 nt, Human adenovirus C
gugauuauuuaccccccaccc

SEQ ID NO: 1548499 - RNA, 19 nt, Human adenovirus C
agaagacggaugagcucgg

SEQ ID NO: 1548500 - RNA, 13 nt, Human adenovirus C
auccacaaggccg

SEQ ID NO: 1548501 - RNA, 14 nt, Human adenovirus C
guaccugcgcacgc

SEQ ID NO: 1548502 - RNA, 14 nt, Human adenovirus C
acccccgcggcgcc

SEQ ID NO: 1548503 - RNA, 17 nt, Human adenovirus C
cggcguccggcucacca

SEQ ID NO: 1548504 - RNA, 16 nt, Human adenovirus C
caaccccaccaaugug

SEQ ID NO: 1548505 - RNA, 18 nt, Human adenovirus C
cuacuccgagaccaugac

SEQ ID NO: 1548506 - RNA, 14 nt, Human adenovirus C
cugcaaccuggucu

SEQ ID NO: 1548507 - RNA, 22 nt, Human adenovirus C
uggccauuaccuuugacucuuc

SEQ ID NO: 1548508 - RNA, 18 nt, Human adenovirus C
gcacacugaacagcaucg

SEQ ID NO: 1548509 - RNA, 21 nt, Human adenovirus C
guccggacgggacauuucaga

SEQ ID NO: 1548510 - RNA, 19 nt, Human adenovirus C
uucgcgaccgcgagggaga

SEQ ID NO: 1548511 - RNA, 21 nt, Human adenovirus C
ugagcacagucaugagcgagc

SEQ ID NO: 1548512 - RNA, 23 nt, Human adenovirus C
acucccauuuuuccaaaacagga

SEQ ID NO: 1548513 - RNA, 15 nt, Human adenovirus C
gcugccgccgccgcc

SEQ ID NO: 1548514 - RNA, 20 nt, Human adenovirus C
cccuggaggcagcuggggcc

SEQ ID NO: 1548515 - RNA, 14 nt, Human adenovirus C
gcccaugagccggc

SEQ ID NO: 1548516 - RNA, 15 nt, Human adenovirus C
gcuacccacccagcg

SEQ ID NO: 1548517 - RNA, 19 nt, Human adenovirus C
cgacgccgaaccaccacug

SEQ ID NO: 1548518 - RNA, 19 nt, Human adenovirus C
gaggaggacuuugagcccg

SEQ ID NO: 1548519 - RNA, 13 nt, Human adenovirus C
gcaccggcggcag

SEQ ID NO: 1548520 - RNA, 14 nt, Human adenovirus C
ggccgccagagcuu

SEQ ID NO: 1548521 - RNA, 20 nt, Human adenovirus C
ggacgaugaguacgagccag

SEQ ID NO: 1548522 - RNA, 24 nt, Human adenovirus C
gcaugugaguuggaugauaugguu

SEQ ID NO: 1548523 - RNA, 15 nt, Human adenovirus C
gcauguuuucccuga

SEQ ID NO: 1548524 - RNA, 17 nt, Human adenovirus C
ucacagaccugggccaa

SEQ ID NO: 1548525 - RNA, 22 nt, Human adenovirus C
uggaaucaggcuguagacagcu

SEQ ID NO: 1548526 - RNA, 23 nt, Human adenovirus C
gccccuccgcggcguggcccuug

SEQ ID NO: 1548527 - RNA, 15 nt, Human adenovirus C
aaaaucugcuccaga

SEQ ID NO: 1548528 - RNA, 14 nt, Human adenovirus C
aaagaugacaccga

SEQ ID NO: 1548529 - RNA, 12 nt, Human adenovirus C
cagacgggccag

SEQ ID NO: 1548530 - RNA, 16 nt, Human adenovirus C
gcgcggcggcugcugc

SEQ ID NO: 1548531 - RNA, 23 nt, Human adenovirus C
cgcgaggcguacgugccgcggca

SEQ ID NO: 1548532 - RNA, 22 nt, Human adenovirus C
agcagcugcgacuuaccgcagc

SEQ ID NO: 1548533 - RNA, 20 nt, Human adenovirus C
agucugcagcgcugccaaaa

SEQ ID NO: 1548534 - RNA, 18 nt, Human adenovirus C
auccagucguagcaggag

SEQ ID NO: 1548535 - RNA, 13 nt, Human adenovirus C
ccauccaccacca

SEQ ID NO: 1548536 - RNA, 13 nt, Human adenovirus C
cgcaauucuggaa

SEQ ID NO: 1548537 - RNA, 14 nt, Human adenovirus C
gcuccagugagcag

SEQ ID NO: 1548538 - RNA, 15 nt, Human adenovirus C
cggcugcuguugcuu

SEQ ID NO: 1548539 - RNA, 17 nt, Human adenovirus C
cgagcgguugcugcgcg

SEQ ID NO: 1548540 - RNA, 21 nt, Human adenovirus C
caagucgggcggggggaccaa

SEQ ID NO: 1548541 - RNA, 22 nt, Human adenovirus C
acuugcauggcguguuaaaugg

SEQ ID NO: 1548542 - RNA, 13 nt, Human adenovirus C
caggcgggagcuc

SEQ ID NO: 1548543 - RNA, 15 nt, Human adenovirus C
ggccgccgaccuggu

SEQ ID NO: 1548544 - RNA, 19 nt, Human adenovirus C
gcuagugaaaagcguggcu

SEQ ID NO: 1548545 - RNA, 22 nt, Human adenovirus C
cuugacgaccguucgcacuggg

SEQ ID NO: 1548546 - RNA, 23 nt, Human adenovirus C
cucagcgaccgcgagcugaugca

SEQ ID NO: 1548547 - RNA, 14 nt, Human adenovirus C
ugggccggggugcg

SEQ ID NO: 1548548 - RNA, 20 nt, Human adenovirus C
cggccgacgggcggccaugc

SEQ ID NO: 1548549 - RNA, 17 nt, Human adenovirus C
aggaugggcaggggcua

SEQ ID NO: 1548550 - RNA, 18 nt, Human adenovirus C
ccucguccucggagccgc

SEQ ID NO: 1548551 - RNA, 15 nt, Human adenovirus C
cacuggcaacauggg

SEQ ID NO: 1548552 - RNA, 17 nt, Human adenovirus C
cgugcuggacagggggc

SEQ ID NO: 1548553 - RNA, 22 nt, Human adenovirus C
ggcgauccuaacucugcagacc

SEQ ID NO: 1548554 - RNA, 14 nt, Human adenovirus C
gcgggagcuccugc

SEQ ID NO: 1548555 - RNA, 15 nt, Human adenovirus C
ucuagcgccugcugc

SEQ ID NO: 1548556 - RNA, 21 nt, Human adenovirus C
accaguggagaggcagagcga

SEQ ID NO: 1548557 - RNA, 22 nt, Human adenovirus C
cuuugaguucgccaccaccgcc

SEQ ID NO: 1548558 - RNA, 14 nt, Human adenovirus C
acaccuacagccug

SEQ ID NO: 1548559 - RNA, 16 nt, Human adenovirus C
cugcaagaugaggguu

SEQ ID NO: 1548560 - RNA, 17 nt, Human adenovirus C
cagugucuccagagggg

SEQ ID NO: 1548561 - RNA, 15 nt, Human adenovirus C
agcagccgcggccau

SEQ ID NO: 1548562 - RNA, 15 nt, Human adenovirus C
uacaacguagcucag

SEQ ID NO: 1548563 - RNA, 14 nt, Human adenovirus C
cauccacaaggccg

SEQ ID NO: 1548564 - RNA, 13 nt, Human adenovirus C
aggcgcggcggcu

SEQ ID NO: 1548565 - RNA, 17 nt, Human adenovirus C
cggcaacugucacuugc

SEQ ID NO: 1548566 - RNA, 23 nt, Human adenovirus C
gcagcuagccaacuaccuugccu

SEQ ID NO: 1548567 - RNA, 16 nt, Human adenovirus C
agacucggcggacggc

SEQ ID NO: 1548568 - RNA, 12 nt, Human adenovirus C
gggcucgggacc

SEQ ID NO: 1548569 - RNA, 16 nt, Human adenovirus C
cccaccgugcagcuga

SEQ ID NO: 1548570 - RNA, 17 nt, Human adenovirus C
gugagcuguuugauucu

SEQ ID NO: 1548571 - RNA, 16 nt, Human adenovirus C
cggaggugcugcugau

SEQ ID NO: 1548572 - RNA, 19 nt, Human adenovirus C
ccacuuacaauuaccucag

SEQ ID NO: 1548573 - RNA, 15 nt, Human adenovirus C
cgccgccgcagcccu

SEQ ID NO: 1548574 - RNA, 16 nt, Human adenovirus C
gcggggaccacagaac

SEQ ID NO: 1548575 - RNA, 23 nt, Human adenovirus C
ccagacuauuuuuuccagaccag

SEQ ID NO: 1548576 - RNA, 15 nt, Human adenovirus C
aaucaaagaagagau

SEQ ID NO: 1548577 - RNA, 18 nt, Human adenovirus C
aggacccuggugcugcca

SEQ ID NO: 1548578 - RNA, 11 nt, Human adenovirus C
gaaucaggcug

SEQ ID NO: 1548579 - RNA, 13 nt, Human adenovirus C
gcacgggcagcgg

SEQ ID NO: 1548580 - RNA, 21 nt, Human adenovirus C
gcagcuuguugaccagcucgg

SEQ ID NO: 1548581 - RNA, 16 nt, Human adenovirus C
guggagccugggcugg

SEQ ID NO: 1548582 - RNA, 14 nt, Human adenovirus C
ggcaccaggugcac

SEQ ID NO: 1548583 - RNA, 15 nt, Human adenovirus C
cgcggcgccgggccc

SEQ ID NO: 1548584 - RNA, 14 nt, Human adenovirus C
cgcacccgcccccc

SEQ ID NO: 1548585 - RNA, 13 nt, Human adenovirus C
gacagcaagaaac

SEQ ID NO: 1548586 - RNA, 15 nt, Human adenovirus C
ucacccacagccgcc

SEQ ID NO: 1548587 - RNA, 14 nt, Human adenovirus C
gcaggcgcagagac

SEQ ID NO: 1548588 - RNA, 14 nt, Human adenovirus C
ugcgcaggagcaca

SEQ ID NO: 1548589 - RNA, 24 nt, Human adenovirus C
cggccguggagacagugucuccag

SEQ ID NO: 1548590 - RNA, 13 nt, Human adenovirus C
auuaccauguaca

SEQ ID NO: 1548591 - RNA, 21 nt, Human adenovirus C
acgcugguggcuaccucuccg

SEQ ID NO: 1548592 - RNA, 15 nt, Human adenovirus C
cgccagaggagcugc

SEQ ID NO: 1548593 - RNA, 12 nt, Human adenovirus C
cggcggcggugg

SEQ ID NO: 1548594 - RNA, 19 nt, Human adenovirus C
cucccggaacucaggucaa

SEQ ID NO: 1548595 - RNA, 21 nt, Human adenovirus C
uagcgccauugcuucuucccc

SEQ ID NO: 1548596 - RNA, 14 nt, Human adenovirus C
agaguuucugcuac

SEQ ID NO: 1548597 - RNA, 16 nt, Human adenovirus C
gaugaagaagaggaag

SEQ ID NO: 1548598 - RNA, 17 nt, Human adenovirus C
cagcacaguaacugcag

SEQ ID NO: 1548599 - RNA, 21 nt, Human adenovirus C
cgcgggcgcugaccugcgcug

SEQ ID NO: 1548600 - RNA, 22 nt, Human adenovirus C
cuacaacguagcucagugcaac

SEQ ID NO: 1548601 - RNA, 18 nt, Human adenovirus C
ccgcgucaugcacgcagc

SEQ ID NO: 1548602 - RNA, 19 nt, Human adenovirus C
ugcaaacuugcaagaacaa

SEQ ID NO: 1548603 - RNA, 16 nt, Human adenovirus C
accgugcagcugaugg

SEQ ID NO: 1548604 - RNA, 23 nt, Human adenovirus C
cuuccauaagggccuccccuucu

SEQ ID NO: 1548605 - RNA, 16 nt, Human adenovirus C
ggcgcggcggcugcug

SEQ ID NO: 1548606 - RNA, 13 nt, Human adenovirus C
gguaacaggaggg

SEQ ID NO: 1548607 - RNA, 20 nt, Human adenovirus C
cgacugaaugaccaguggag

SEQ ID NO: 1548608 - RNA, 17 nt, Human adenovirus C
cuguauaacgcuggaaa

SEQ ID NO: 1548609 - RNA, 23 nt, Human adenovirus C
guaguuuuuacgcccggugagcg

SEQ ID NO: 1548610 - RNA, 24 nt, Human adenovirus C
gccccucgccauagcggaugucag

SEQ ID NO: 1548611 - RNA, 17 nt, Human adenovirus C
accugagccccgggcug

SEQ ID NO: 1548612 - RNA, 13 nt, Human adenovirus C
uagcacaaaacuc

SEQ ID NO: 1548613 - RNA, 14 nt, Human adenovirus C
cuuugcgucucugg

SEQ ID NO: 1548614 - RNA, 16 nt, Human adenovirus C
caggggaugauuuuga

SEQ ID NO: 1548615 - RNA, 22 nt, Human adenovirus C
ccaaaugcggagcuuaccgccu

SEQ ID NO: 1548616 - RNA, 17 nt, Human adenovirus C
cgcgcgucccugcgccg

SEQ ID NO: 1548617 - RNA, 15 nt, Human adenovirus C
caaguauaggucucu

SEQ ID NO: 1548618 - RNA, 14 nt, Human adenovirus C
cacuaaagcaaggc

SEQ ID NO: 1548619 - RNA, 21 nt, Human adenovirus C
agccuaaagcccgugacacug

SEQ ID NO: 1548620 - RNA, 18 nt, Human adenovirus C
cgggcccuugcuucccag

SEQ ID NO: 1548621 - RNA, 21 nt, Human adenovirus C
gucagacaacgggggagcgcu

SEQ ID NO: 1548622 - RNA, 17 nt, Human adenovirus C
augcgccccccuccuca

SEQ ID NO: 1548623 - RNA, 23 nt, Human adenovirus C
gccugcgucauuacccagggcca

SEQ ID NO: 1548624 - RNA, 14 nt, Human adenovirus C
ccaaccaggcagug

SEQ ID NO: 1548625 - RNA, 17 nt, Human adenovirus C
agcaagacucugacaaa

SEQ ID NO: 1548626 - RNA, 18 nt, Human adenovirus C
ggcccgaugaggccggcc

SEQ ID NO: 1548627 - RNA, 15 nt, Human adenovirus C
augagcuugaucugc

SEQ ID NO: 1548628 - RNA, 18 nt, Human adenovirus C
cagcggcagcggcagcaa

SEQ ID NO: 1548629 - RNA, 24 nt, Human adenovirus C
cccacaacacggccuccacgcugg

SEQ ID NO: 1548630 - RNA, 17 nt, Human adenovirus C
agcuaaaauacaacccc

SEQ ID NO: 1548631 - RNA, 13 nt, Human adenovirus C
acggcggccuggc

SEQ ID NO: 1548632 - RNA, 17 nt, Human adenovirus C
cagaaaccugugcugcc

SEQ ID NO: 1548633 - RNA, 21 nt, Human adenovirus C
cgcgcugcggcugcuguugcu

SEQ ID NO: 1548634 - RNA, 23 nt, Human adenovirus C
gcagcugccgccgccgccaccca

SEQ ID NO: 1548635 - RNA, 22 nt, Human adenovirus C
agagcuuccacuuggucaggca

SEQ ID NO: 1548636 - RNA, 16 nt, Human adenovirus C
gcgcagcggugcagcc

SEQ ID NO: 1548637 - RNA, 15 nt, Human adenovirus C
gagccagaggacggc

SEQ ID NO: 1548638 - RNA, 13 nt, Human adenovirus C
gccgcggugcagg

SEQ ID NO: 1548639 - RNA, 23 nt, Human adenovirus C
cggcccguagccaguggcaacug

SEQ ID NO: 1548640 - RNA, 23 nt, Human adenovirus C
cgaggaggcacuaaagcaaggcc

SEQ ID NO: 1548641 - RNA, 22 nt, Human adenovirus C
ccuacugcaccggcggcagcgg

SEQ ID NO: 1548642 - RNA, 15 nt, Human adenovirus C
cccggugccgggauu

SEQ ID NO: 1548643 - RNA, 19 nt, Human adenovirus C
gugccaaccgcagccgagc

SEQ ID NO: 1548644 - RNA, 19 nt, Human adenovirus C
aucuccagcggccacaccc

SEQ ID NO: 1548645 - RNA, 19 nt, Human adenovirus C
cagaugccgcggugcaggc

SEQ ID NO: 1548646 - RNA, 17 nt, Human adenovirus C
uugagccuggcugacaa

SEQ ID NO: 1548647 - RNA, 17 nt, Human adenovirus C
cuccuaacuccugugag

SEQ ID NO: 1548648 - RNA, 17 nt, Human adenovirus C
cagcgccugcacugcaa

SEQ ID NO: 1548649 - RNA, 23 nt, Human adenovirus C
ccuacuuucccagugcccgcugu

SEQ ID NO: 1548650 - RNA, 14 nt, Human adenovirus C
ggccgccuguggac

SEQ ID NO: 1548651 - RNA, 17 nt, Human adenovirus C
cuuuuacugcugcugga

SEQ ID NO: 1548652 - RNA, 16 nt, Human adenovirus C
ccuugcggcagucugc

SEQ ID NO: 1548653 - RNA, 13 nt, Human adenovirus C
caggagcuggugc

SEQ ID NO: 1548654 - RNA, 22 nt, Human adenovirus C
uguccacaguggacgcggccau

SEQ ID NO: 1548655 - RNA, 14 nt, Human adenovirus C
caguuuauucccaa

SEQ ID NO: 1548656 - RNA, 17 nt, Human adenovirus C
cacccagcgccaaaaac

SEQ ID NO: 1548657 - RNA, 19 nt, Human adenovirus C
guuguacagguggcugaac

SEQ ID NO: 1548658 - RNA, 16 nt, Human adenovirus C
ggagcugcccaagacu

SEQ ID NO: 1548659 - RNA, 19 nt, Human adenovirus C
gccgcgcgcgggcaggagc

SEQ ID NO: 1548660 - RNA, 17 nt, Human adenovirus C
caaacaucagccccccu

SEQ ID NO: 1548661 - RNA, 22 nt, Human adenovirus C
agcgguacgguuuuccuggcca

SEQ ID NO: 1548662 - RNA, 12 nt, Human adenovirus C
ggccgccagagc

SEQ ID NO: 1548663 - RNA, 17 nt, Human adenovirus C
augcgcgggcggcaagc

SEQ ID NO: 1548664 - RNA, 11 nt, Human adenovirus C
cucgcugcugc

SEQ ID NO: 1548665 - RNA, 15 nt, Human adenovirus C
ugaccugcgcugggc

SEQ ID NO: 1548666 - RNA, 19 nt, Human adenovirus C
ggcugacgcggcggcagau

SEQ ID NO: 1548667 - RNA, 21 nt, Human adenovirus C
cagacaucauuuugcugccag

SEQ ID NO: 1548668 - RNA, 23 nt, Human adenovirus C
uuugccuccccgucaugcaagac

SEQ ID NO: 1548669 - RNA, 12 nt, Human adenovirus C
ccacccuugccg

SEQ ID NO: 1548670 - RNA, 21 nt, Human adenovirus C
caugaaccacccuacuuuccc

SEQ ID NO: 1548671 - RNA, 17 nt, Human adenovirus C
caaacucuacagccaaa

SEQ ID NO: 1548672 - RNA, 18 nt, Human adenovirus C
gacgcgcccuggaggcag

SEQ ID NO: 1548673 - RNA, 16 nt, Human adenovirus C
gugcugcggcagaugc

SEQ ID NO: 1548674 - RNA, 14 nt, Human adenovirus C
cggcgugcuggaca

SEQ ID NO: 1548675 - RNA, 17 nt, Human adenovirus C
caccuauuaccggcugc

SEQ ID NO: 1548676 - RNA, 23 nt, Human adenovirus C
gcaaggccuggaacagcagcaca

SEQ ID NO: 1548677 - RNA, 23 nt, Human adenovirus C
agcaggcagaggcggcgcugcga

SEQ ID NO: 1548678 - RNA, 14 nt, Human adenovirus C
gaagccuggaccga

SEQ ID NO: 1548679 - RNA, 22 nt, Human adenovirus C
agccugcaaagggcccuggcug

SEQ ID NO: 1548680 - RNA, 21 nt, Human adenovirus C
accgaagauagcggccgggca

SEQ ID NO: 1548681 - RNA, 15 nt, Human adenovirus C
ggcgcggcuaggagc

SEQ ID NO: 1548682 - RNA, 15 nt, Human adenovirus C
aucuaugccaaacag

SEQ ID NO: 1548683 - RNA, 22 nt, Human adenovirus C
gguuuacuucaaccccuuuucu

SEQ ID NO: 1548684 - RNA, 18 nt, Human adenovirus C
gaggcuaagugggagggg

SEQ ID NO: 1548685 - RNA, 15 nt, Human adenovirus C
ccgagaccaugacca

SEQ ID NO: 1548686 - RNA, 13 nt, Human adenovirus C
uggaccuggccaa

SEQ ID NO: 1548687 - RNA, 16 nt, Human adenovirus C
aaacgacugcagguac

SEQ ID NO: 1548688 - RNA, 15 nt, Human adenovirus C
agucuuccaagguga

SEQ ID NO: 1548689 - RNA, 17 nt, Human adenovirus C
ugucgcgaucggcgcgc

SEQ ID NO: 1548690 - RNA, 23 nt, Human adenovirus C
cacuccugacguaaccugcggcu

SEQ ID NO: 1548691 - RNA, 16 nt, Human adenovirus C
aaggccuggccagugu

SEQ ID NO: 1548692 - RNA, 22 nt, Human adenovirus C
ccggaccaguuuauucccaacu

SEQ ID NO: 1548693 - RNA, 18 nt, Human adenovirus C
cuggauuuucuggccaug

SEQ ID NO: 1548694 - RNA, 17 nt, Human adenovirus C
ucagccgcgcgcugggg

SEQ ID NO: 1548695 - RNA, 13 nt, Human adenovirus C
ccaacuggcccca

SEQ ID NO: 1548696 - RNA, 16 nt, Human adenovirus C
cggcggccuggcgcaa

SEQ ID NO: 1548697 - RNA, 18 nt, Human adenovirus C
ucgccugcuacuguuguc

SEQ ID NO: 1548698 - RNA, 14 nt, Human adenovirus C
guccuccgggcaca

SEQ ID NO: 1548699 - RNA, 18 nt, Human adenovirus C
gcagcgccagugcgccau

SEQ ID NO: 1548700 - RNA, 16 nt, Human adenovirus C
gcgcgcaacgcaccgc

SEQ ID NO: 1548701 - RNA, 16 nt, Human adenovirus C
cgaggcagcggcagaa

SEQ ID NO: 1548702 - RNA, 22 nt, Human adenovirus C
uugagccuggcugacaaggugg

SEQ ID NO: 1548703 - RNA, 21 nt, Human adenovirus C
uagaaaccccacgguggcacc

SEQ ID NO: 1548704 - RNA, 17 nt, Human adenovirus C
aaugugagguuuacugg

SEQ ID NO: 1548705 - RNA, 16 nt, Human adenovirus C
cgugcgcaccaccggc

SEQ ID NO: 1548706 - RNA, 13 nt, Human adenovirus C
cucccacgcagac

SEQ ID NO: 1548707 - RNA, 21 nt, Human adenovirus C
cagcugaccacuuacuggcug

SEQ ID NO: 1548708 - RNA, 13 nt, Human adenovirus C
cuucagcuggggc

SEQ ID NO: 1548709 - RNA, 20 nt, Human adenovirus C
cucccaaaagacauauuucc

SEQ ID NO: 1548710 - RNA, 17 nt, Human adenovirus C
acaggccagaugcugag

SEQ ID NO: 1548711 - RNA, 17 nt, Human adenovirus C
guggugagcgcggcgcc

SEQ ID NO: 1548712 - RNA, 24 nt, Human adenovirus C
ugggggugcaaucccugaagcgcc

SEQ ID NO: 1548713 - RNA, 16 nt, Human adenovirus C
gcccugcucccagagc

SEQ ID NO: 1548714 - RNA, 15 nt, Human adenovirus C
cuuuuuugaguuuua

SEQ ID NO: 1548715 - RNA, 13 nt, Human adenovirus C
gcgcccaggcggc

SEQ ID NO: 1548716 - RNA, 20 nt, Human adenovirus C
agcaugaagggcacgagcug

SEQ ID NO: 1548717 - RNA, 17 nt, Human adenovirus C
ggccugacgggcggcau

SEQ ID NO: 1548718 - RNA, 16 nt, Human adenovirus C
acuucaggaaggaugu

SEQ ID NO: 1548719 - RNA, 17 nt, Human adenovirus C
agcgcgcuaccacccca

SEQ ID NO: 1548720 - RNA, 13 nt, Human adenovirus C
gcuuaaggguggg

SEQ ID NO: 1548721 - RNA, 23 nt, Human adenovirus C
aaaaccuaucaccgucacccagc

SEQ ID NO: 1548722 - RNA, 20 nt, Human adenovirus C
ggauagagagccuaguggac

SEQ ID NO: 1548723 - RNA, 17 nt, Human adenovirus C
auggaagacugggacag

SEQ ID NO: 1548724 - RNA, 20 nt, Human adenovirus C
uaaagcaaaacuugaaggac

SEQ ID NO: 1548725 - RNA, 20 nt, Human adenovirus C
ucaacgcgcgcgcagccucc

SEQ ID NO: 1548726 - RNA, 19 nt, Human adenovirus C
auguccaaggugaaccuga

SEQ ID NO: 1548727 - RNA, 16 nt, Human adenovirus C
cuaacucaggggcgca

SEQ ID NO: 1548728 - RNA, 20 nt, Human adenovirus C
uuuuuggccacuggccgcgc

SEQ ID NO: 1548729 - RNA, 14 nt, Human adenovirus C
ggcgcagcgugagc

SEQ ID NO: 1548730 - RNA, 15 nt, Human adenovirus C
cucaaagcauccagg

SEQ ID NO: 1548731 - RNA, 17 nt, Human adenovirus C
gaaagugggcaggcaga

SEQ ID NO: 1548732 - RNA, 16 nt, Human adenovirus C
uguauuauaacagcac

SEQ ID NO: 1548733 - RNA, 17 nt, Human adenovirus C
agauuuuucugcugugc

SEQ ID NO: 1548734 - RNA, 15 nt, Human adenovirus C
cgaucucuuccuccu

SEQ ID NO: 1548735 - RNA, 18 nt, Human adenovirus C
aggggcaacauccgcggc

SEQ ID NO: 1548736 - RNA, 18 nt, Human adenovirus C
caggacccuggugcugcc

SEQ ID NO: 1548737 - RNA, 20 nt, Human adenovirus C
cguugauguuguggcccacg

SEQ ID NO: 1548738 - RNA, 20 nt, Human adenovirus C
cgcgggcuagguccagguga

SEQ ID NO: 1548739 - RNA, 17 nt, Human adenovirus C
aaccuaaaugccaaccu

SEQ ID NO: 1548740 - RNA, 16 nt, Human adenovirus C
cguccagacgggccag

SEQ ID NO: 1548741 - RNA, 16 nt, Human adenovirus C
uauggcagcaaggccu

SEQ ID NO: 1548742 - RNA, 13 nt, Human adenovirus C
gccggguggugca

SEQ ID NO: 1548743 - RNA, 14 nt, Human adenovirus C
accgcggaugcugg

SEQ ID NO: 1548744 - RNA, 22 nt, Human adenovirus C
cucacucucuuccgcaucgcug

SEQ ID NO: 1548745 - RNA, 15 nt, Human adenovirus C
gccugcuuaaaaccc

SEQ ID NO: 1548746 - RNA, 14 nt, Human adenovirus C
aggcuguagacagc

SEQ ID NO: 1548747 - RNA, 17 nt, Human adenovirus C
cugugcuuugcucccaa

SEQ ID NO: 1548748 - RNA, 16 nt, Human adenovirus C
cauugaaaaccaugga

SEQ ID NO: 1548749 - RNA, 14 nt, Human adenovirus C
gguagauggccugg

SEQ ID NO: 1548750 - RNA, 14 nt, Human adenovirus C
aggcagcuggggcc

SEQ ID NO: 1548751 - RNA, 14 nt, Human adenovirus C
gcagcagccgcagg

SEQ ID NO: 1548752 - RNA, 12 nt, Human adenovirus C
guggagcucugc

SEQ ID NO: 1548753 - RNA, 12 nt, Human adenovirus C
ucgggcagcagc

SEQ ID NO: 1548754 - RNA, 15 nt, Human adenovirus C
ugcacgcuggccagc

SEQ ID NO: 1548755 - RNA, 16 nt, Human adenovirus C
ugccuuugaggguggc

SEQ ID NO: 1548756 - RNA, 16 nt, Human adenovirus C
guagguacuccgccac

SEQ ID NO: 1548757 - RNA, 15 nt, Human adenovirus C
cagggaugcgcugcu

SEQ ID NO: 1548758 - RNA, 12 nt, Human adenovirus C
gcugcugagccg

SEQ ID NO: 1548759 - RNA, 16 nt, Human adenovirus C
cccauggcccacaaca

SEQ ID NO: 1548760 - RNA, 21 nt, Human adenovirus C
cagaaaccugugcugccaggg

SEQ ID NO: 1548761 - RNA, 19 nt, Human adenovirus C
gacuugagaggccuguccu

SEQ ID NO: 1548762 - RNA, 20 nt, Human adenovirus C
ucugcagaauuaaggaggau

SEQ ID NO: 1548763 - RNA, 12 nt, Human adenovirus C
ccuaaaugccaa

SEQ ID NO: 1548764 - RNA, 16 nt, Human adenovirus C
uggaaaauacaccacu

SEQ ID NO: 1548765 - RNA, 17 nt, Human adenovirus C
acccaagggugcagcug

SEQ ID NO: 1548766 - RNA, 23 nt, Human adenovirus C
ggccuaucauugugcucaaccca

SEQ ID NO: 1548767 - RNA, 14 nt, Human adenovirus C
gcggcagggcgcug

SEQ ID NO: 1548768 - RNA, 13 nt, Human adenovirus C
cacuccugcgccg

SEQ ID NO: 1548769 - RNA, 18 nt, Human adenovirus C
acucggaccacucugaga

SEQ ID NO: 1548770 - RNA, 15 nt, Human adenovirus C
gucgcgccgcaccgc

SEQ ID NO: 1548771 - RNA, 19 nt, Human adenovirus C
gaucuugguugugggccau

SEQ ID NO: 1548772 - RNA, 20 nt, Human adenovirus C
cucgcgcucaaaggcuacag

SEQ ID NO: 1548773 - RNA, 16 nt, Human adenovirus C
gggauagagagccuag

SEQ ID NO: 1548774 - RNA, 15 nt, Human adenovirus C
ccgcggcguggcccu

SEQ ID NO: 1548775 - RNA, 14 nt, Human adenovirus C
accucauggaggcu

SEQ ID NO: 1548776 - RNA, 14 nt, Human adenovirus C
gcgaugagcagcug

SEQ ID NO: 1548777 - RNA, 13 nt, Human adenovirus C
cugaggacuacca

SEQ ID NO: 1548778 - RNA, 19 nt, Human adenovirus C
guaaagaccccgggcagca

SEQ ID NO: 1548779 - RNA, 19 nt, Human adenovirus C
gugcuguugaagcaucugc

SEQ ID NO: 1548780 - RNA, 19 nt, Human adenovirus C
ccggacuaacaucugcccu

SEQ ID NO: 1548781 - RNA, 16 nt, Human adenovirus C
cgccugcugggcgagg

SEQ ID NO: 1548782 - RNA, 19 nt, Human adenovirus C
cacccaaaaagaagcugca

SEQ ID NO: 1548783 - RNA, 18 nt, Human adenovirus C
gccgccaugggcuccagu

SEQ ID NO: 1548784 - RNA, 13 nt, Human adenovirus C
aagagacgcucgg

SEQ ID NO: 1548785 - RNA, 13 nt, Human adenovirus C
ccacucgcuccag

SEQ ID NO: 1548786 - RNA, 17 nt, Human adenovirus C
cacaucucgggccagga

SEQ ID NO: 1548787 - RNA, 22 nt, Human adenovirus C
acuuuugcuaccaacucuuaca

SEQ ID NO: 1548788 - RNA, 18 nt, Human adenovirus C
caucuccuaacugcagaa

SEQ ID NO: 1548789 - RNA, 15 nt, Human adenovirus C
caguagacaaggccu

SEQ ID NO: 1548790 - RNA, 18 nt, Human adenovirus C
uacucccauuuuuccaaa

SEQ ID NO: 1548791 - RNA, 20 nt, Human adenovirus C
cccgcggcgacaggucaggc

SEQ ID NO: 1548792 - RNA, 17 nt, Human adenovirus C
gcaggagcgcugggcgu

SEQ ID NO: 1548793 - RNA, 21 nt, Human adenovirus C
agcccguguucugacagggcc

SEQ ID NO: 1548794 - RNA, 12 nt, Human adenovirus C
gacgcucggugc

SEQ ID NO: 1548795 - RNA, 17 nt, Human adenovirus C
acggccgcuacgugccc

SEQ ID NO: 1548796 - RNA, 18 nt, Human adenovirus C
augcggcaggagggagag

SEQ ID NO: 1548797 - RNA, 18 nt, Human adenovirus C
agcuacccacccagcgcc

SEQ ID NO: 1548798 - RNA, 15 nt, Human adenovirus C
aaccuccgcuccuca

SEQ ID NO: 1548799 - RNA, 12 nt, Human adenovirus C
augagacaugau

SEQ ID NO: 1548800 - RNA, 18 nt, Human adenovirus C
aggccuggccaguguuug

SEQ ID NO: 1548801 - RNA, 18 nt, Human adenovirus C
cacgcuugaagacaaagg

SEQ ID NO: 1548802 - RNA, 19 nt, Human adenovirus C
gagcgacgcaagcuaauga

SEQ ID NO: 1548803 - RNA, 16 nt, Human adenovirus C
ggcagagcgacugcgc

SEQ ID NO: 1548804 - RNA, 17 nt, Human adenovirus C
caaggccggaaaccuca

SEQ ID NO: 1548805 - RNA, 12 nt, Human adenovirus C
agcuugguggca

SEQ ID NO: 1548806 - RNA, 15 nt, Human adenovirus C
agggggguguuccua

SEQ ID NO: 1548807 - RNA, 16 nt, Human adenovirus C
ccugagccccgggcug

SEQ ID NO: 1548808 - RNA, 15 nt, Human adenovirus C
acacgggcagccugg

SEQ ID NO: 1548809 - RNA, 21 nt, Human adenovirus C
gaugcaaacuugcaagaacaa

SEQ ID NO: 1548810 - RNA, 19 nt, Human adenovirus C
cccucguuccagacgcggc

SEQ ID NO: 1548811 - RNA, 16 nt, Human adenovirus C
cugaucagaugaugca

SEQ ID NO: 1548812 - RNA, 13 nt, Human adenovirus C
uggaacucuacaa

SEQ ID NO: 1548813 - RNA, 18 nt, Human adenovirus C
ugaccgugcccggucugg

SEQ ID NO: 1548814 - RNA, 14 nt, Human adenovirus C
cagccuccgccgcc

SEQ ID NO: 1548815 - RNA, 15 nt, Human adenovirus C
aaaaccuccuccucc

SEQ ID NO: 1548816 - RNA, 12 nt, Human adenovirus C
ccgccaccugcu

SEQ ID NO: 1548817 - RNA, 15 nt, Human adenovirus C
cuccucagcagcggc

SEQ ID NO: 1548818 - RNA, 15 nt, Human adenovirus C
gaagaaacucuggug

SEQ ID NO: 1548819 - RNA, 12 nt, Human adenovirus C
cugccaccuccc

SEQ ID NO: 1548820 - RNA, 11 nt, Human adenovirus C
cuuccucccaa

SEQ ID NO: 1548821 - RNA, 21 nt, Human adenovirus C
ugcauggugauaaaacuaaac

SEQ ID NO: 1548822 - RNA, 20 nt, Human adenovirus C
uuguaagcgcgcuggagcaa

SEQ ID NO: 1548823 - RNA, 22 nt, Human adenovirus C
aauuaaaacgggcgguggcaug

SEQ ID NO: 1548824 - RNA, 13 nt, Human adenovirus C
ucuuauacuagca

SEQ ID NO: 1548825 - RNA, 14 nt, Human adenovirus C
acccgcuguuccuu

SEQ ID NO: 1548826 - RNA, 14 nt, Human adenovirus C
acggccgccagagc

SEQ ID NO: 1548827 - RNA, 19 nt, Human adenovirus C
ucauggcggggaccacaga

SEQ ID NO: 1548828 - RNA, 23 nt, Human adenovirus C
uguaguagucuugcaugagccuu

SEQ ID NO: 1548829 - RNA, 15 nt, Human adenovirus C
ucacaaccccaccau

SEQ ID NO: 1548830 - RNA, 12 nt, Human adenovirus C
cacccgcccgcg

SEQ ID NO: 1548831 - RNA, 19 nt, Human adenovirus C
gagcaggcagaggcggcgc

SEQ ID NO: 1548832 - RNA, 22 nt, Human adenovirus C
acgcugguggcuaccucuccgc

SEQ ID NO: 1548833 - RNA, 16 nt, Human adenovirus C
cucguggcgcgggcac

SEQ ID NO: 1548834 - RNA, 13 nt, Human adenovirus C
cgcgcccuggggc

SEQ ID NO: 1548835 - RNA, 13 nt, Human adenovirus C
guguggcagcaau

SEQ ID NO: 1548836 - RNA, 20 nt, Human adenovirus C
gccugccgacuuggaggagc

SEQ ID NO: 1548837 - RNA, 19 nt, Human adenovirus C
cgccagagcuuccacuugg

SEQ ID NO: 1548838 - RNA, 19 nt, Human adenovirus C
aucaccgucacccagcacu

SEQ ID NO: 1548839 - RNA, 22 nt, Human adenovirus C
gcauaccccgcgccacuggguc

SEQ ID NO: 1548840 - RNA, 12 nt, Human adenovirus C
gacagaaacaca

SEQ ID NO: 1548841 - RNA, 14 nt, Human adenovirus C
uacaaaaagcgggc

SEQ ID NO: 1548842 - RNA, 19 nt, Human adenovirus C
cauuccacgagccagguga

SEQ ID NO: 1548843 - RNA, 17 nt, Human adenovirus C
acguggagcucugcaac

SEQ ID NO: 1548844 - RNA, 18 nt, Human adenovirus C
caggcggccgcugcggcc

SEQ ID NO: 1548845 - RNA, 11 nt, Human adenovirus C
aagggccuccc

SEQ ID NO: 1548846 - RNA, 14 nt, Human adenovirus C
aauucaccaccucc

SEQ ID NO: 1548847 - RNA, 13 nt, Human adenovirus C
caagagcagcggc

SEQ ID NO: 1548848 - RNA, 12 nt, Human adenovirus C
agucggugcucg

SEQ ID NO: 1548849 - RNA, 18 nt, Human adenovirus C
cauucgcggcgacaccuu

SEQ ID NO: 1548850 - RNA, 15 nt, Human adenovirus C
uccaggaaguacggc

SEQ ID NO: 1548851 - RNA, 13 nt, Human adenovirus C
ccuaacccuggau

SEQ ID NO: 1548852 - RNA, 13 nt, Human adenovirus C
gcugccugcacuu

SEQ ID NO: 1548853 - RNA, 18 nt, Human adenovirus C
gacgacauagacgacagc

SEQ ID NO: 1548854 - RNA, 22 nt, Human adenovirus C
gguggaccuggccaaccaggca

SEQ ID NO: 1548855 - RNA, 19 nt, Human adenovirus C
gcugcgguucaucccugug

SEQ ID NO: 1548856 - RNA, 15 nt, Human adenovirus C
cagcacagcaccaca

SEQ ID NO: 1548857 - RNA, 16 nt, Human adenovirus C
gagggcccggcgcacg

SEQ ID NO: 1548858 - RNA, 15 nt, Human adenovirus C
uacgugccgcggcag

SEQ ID NO: 1548859 - RNA, 19 nt, Human adenovirus C
ccuacgaugaccuggaggg

SEQ ID NO: 1548860 - RNA, 13 nt, Human adenovirus C
gcgcgcuggcaac

SEQ ID NO: 1548861 - RNA, 23 nt, Human adenovirus C
gcgggcacucuuccguggucugg

SEQ ID NO: 1548862 - RNA, 18 nt, Human adenovirus C
cccgguuauggguuggcg

SEQ ID NO: 1548863 - RNA, 14 nt, Human adenovirus C
gacagcauuugucu

SEQ ID NO: 1548864 - RNA, 17 nt, Human adenovirus C
ggcacgucggcgccgcg

SEQ ID NO: 1548865 - RNA, 17 nt, Human adenovirus C
gcgccgcacgaggggca

SEQ ID NO: 1548866 - RNA, 21 nt, Human adenovirus C
cccagcaauaacacaggcugg

SEQ ID NO: 1548867 - RNA, 16 nt, Human adenovirus C
uguuucuccacgccuu

SEQ ID NO: 1548868 - RNA, 21 nt, Human adenovirus C
ccagacuauuuuuuccagacc

SEQ ID NO: 1548869 - RNA, 22 nt, Human adenovirus C
ggcuuucgcuguacggcaguag

SEQ ID NO: 1548870 - RNA, 21 nt, Human adenovirus C
ggugagcuccucaggggagcu

SEQ ID NO: 1548871 - RNA, 19 nt, Human adenovirus C
gguuucugcccugaaggcu

SEQ ID NO: 1548872 - RNA, 17 nt, Human adenovirus C
aguacaagauuagcaaa

SEQ ID NO: 1548873 - RNA, 22 nt, Human adenovirus C
ucgcgcaccucgcgcucaaagg

SEQ ID NO: 1548874 - RNA, 19 nt, Human adenovirus C
uggcacccaccgugcagcu

SEQ ID NO: 1548875 - RNA, 20 nt, Human adenovirus C
gacccgccgggagagggggc

SEQ ID NO: 1548876 - RNA, 23 nt, Human adenovirus C
ugucccuuuuuuuuccacagcuc

SEQ ID NO: 1548877 - RNA, 16 nt, Human adenovirus C
auccacagcggcggca

SEQ ID NO: 1548878 - RNA, 22 nt, Human adenovirus C
gacauuggcuggaaugccauag

SEQ ID NO: 1548879 - RNA, 15 nt, Human adenovirus C
ccaggauggcaccca

SEQ ID NO: 1548880 - RNA, 15 nt, Human adenovirus C
ccauuuuaaaaaaac

SEQ ID NO: 1548881 - RNA, 14 nt, Human adenovirus C
ggcauuaacaugga

SEQ ID NO: 1548882 - RNA, 15 nt, Human adenovirus C
agaagcugcagcugc

SEQ ID NO: 1548883 - RNA, 20 nt, Human adenovirus C
gcaacuggcaaagcacacug

SEQ ID NO: 1548884 - RNA, 14 nt, Human adenovirus C
cgcgcuccuuggcc

SEQ ID NO: 1548885 - RNA, 20 nt, Human adenovirus C
caaagcgugcaggggcccaa

SEQ ID NO: 1548886 - RNA, 19 nt, Human adenovirus C
gggccccaagccgacgcgc

SEQ ID NO: 1548887 - RNA, 18 nt, Human adenovirus C
uagcaccacugcagagcu

SEQ ID NO: 1548888 - RNA, 14 nt, Human adenovirus C
gcgggcugcucugc

SEQ ID NO: 1548889 - RNA, 19 nt, Human adenovirus C
gcuacaccuaccgccccag

SEQ ID NO: 1548890 - RNA, 19 nt, Human adenovirus C
aacauuccagcaccuucaa

SEQ ID NO: 1548891 - RNA, 18 nt, Human adenovirus C
uacugcccgaauaugccc

SEQ ID NO: 1548892 - RNA, 18 nt, Human adenovirus C
uauauccacucucucaaa

SEQ ID NO: 1548893 - RNA, 16 nt, Human adenovirus C
agcaggggggccacuu

SEQ ID NO: 1548894 - RNA, 14 nt, Human adenovirus C
uccaggcgacgagc

SEQ ID NO: 1548895 - RNA, 14 nt, Human adenovirus C
guugcauguggaaa

SEQ ID NO: 1548896 - RNA, 13 nt, Human adenovirus C
cauccaugacagg

SEQ ID NO: 1548897 - RNA, 14 nt, Human adenovirus C
agccucgccccccu

SEQ ID NO: 1548898 - RNA, 20 nt, Human adenovirus C
caacaugaccaaggacuggu

SEQ ID NO: 1548899 - RNA, 13 nt, Human adenovirus C
gcuggucucugga

SEQ ID NO: 1548900 - RNA, 17 nt, Human adenovirus C
ccagauugcaaguacaa

SEQ ID NO: 1548901 - RNA, 23 nt, Human adenovirus C
cucggcuaauauggccugcugca

SEQ ID NO: 1548902 - RNA, 13 nt, Human adenovirus C
ccaaccggcggca

SEQ ID NO: 1548903 - RNA, 14 nt, Human adenovirus C
gacgcgguggugga

SEQ ID NO: 1548904 - RNA, 15 nt, Human adenovirus C
ccucaggcgccgccg

SEQ ID NO: 1548905 - RNA, 16 nt, Human adenovirus C
cgcgguucacccuggc

SEQ ID NO: 1548906 - RNA, 15 nt, Human adenovirus C
cccauuacaguguca

SEQ ID NO: 1548907 - RNA, 21 nt, Human adenovirus C
guccacgguaaagaccccggg

SEQ ID NO: 1548908 - RNA, 19 nt, Human adenovirus C
aggcgcuccauggccucgu

SEQ ID NO: 1548909 - RNA, 13 nt, Human adenovirus C
agcuuuugaaauc

SEQ ID NO: 1548910 - RNA, 15 nt, Human adenovirus C
uggggcaggaggaca

SEQ ID NO: 1548911 - RNA, 15 nt, Human adenovirus C
ucuccaucccaucgc

SEQ ID NO: 1548912 - RNA, 18 nt, Human adenovirus C
auagcggaugucagccuu

SEQ ID NO: 1548913 - RNA, 19 nt, Human adenovirus C
gcggaggcucucuucagca

SEQ ID NO: 1548914 - RNA, 18 nt, Human adenovirus C
cgccggagaucuauggcc

SEQ ID NO: 1548915 - RNA, 20 nt, Human adenovirus C
cgggacgcucuggccgguga

SEQ ID NO: 1548916 - RNA, 17 nt, Human adenovirus C
cacccacagccgccuga

SEQ ID NO: 1548917 - RNA, 23 nt, Human adenovirus C
ccugacgcguuccggcagcagcc

SEQ ID NO: 1548918 - RNA, 20 nt, Human adenovirus C
uacaaagcgcgguucacccu

SEQ ID NO: 1548919 - RNA, 21 nt, Human adenovirus C
gagcgcauccacaaggccgug

SEQ ID NO: 1548920 - RNA, 21 nt, Human adenovirus C
cgcauuccacgagccagguga

SEQ ID NO: 1548921 - RNA, 15 nt, Human adenovirus C
cagcgccagugcgcc

SEQ ID NO: 1548922 - RNA, 21 nt, Human adenovirus C
aaacgcggccgcacugggcgc

SEQ ID NO: 1548923 - RNA, 20 nt, Human adenovirus C
agugcagcacagcagggaca

SEQ ID NO: 1548924 - RNA, 17 nt, Human adenovirus C
gagaaggaggacagccu

SEQ ID NO: 1548925 - RNA, 14 nt, Human adenovirus C
gcgagggagcgagg

SEQ ID NO: 1548926 - RNA, 14 nt, Human adenovirus C
caaacucacagaac

SEQ ID NO: 1548927 - RNA, 14 nt, Human adenovirus C
augcggcaggaggg

SEQ ID NO: 1548928 - RNA, 13 nt, Human adenovirus C
cugcucccagagc

SEQ ID NO: 1548929 - RNA, 16 nt, Human adenovirus C
agaugaagaagaggaa

SEQ ID NO: 1548930 - RNA, 17 nt, Human adenovirus C
augugggauaugcucca

SEQ ID NO: 1548931 - RNA, 20 nt, Human adenovirus C
gcccgaucacuuggugcugg

SEQ ID NO: 1548932 - RNA, 15 nt, Human adenovirus C
agccggugggcccgu

SEQ ID NO: 1548933 - RNA, 18 nt, Human adenovirus C
gcgggcccuugcuuccca

SEQ ID NO: 1548934 - RNA, 15 nt, Human adenovirus C
ccgcaguggucuuac

SEQ ID NO: 1548935 - RNA, 16 nt, Human adenovirus C
aaccuuuggacaccuc

SEQ ID NO: 1548936 - RNA, 12 nt, Human adenovirus C
gcgcgcuggcca

SEQ ID NO: 1548937 - RNA, 20 nt, Human adenovirus C
aguacggcaccgccagcgca

SEQ ID NO: 1548938 - RNA, 22 nt, Human adenovirus C
augacugcaaauuuacuuuggu

SEQ ID NO: 1548939 - RNA, 19 nt, Human adenovirus C
caccaacgugcccaucucc

SEQ ID NO: 1548940 - RNA, 19 nt, Human adenovirus C
acuuccccgccaggaacca

SEQ ID NO: 1548941 - RNA, 13 nt, Human adenovirus C
auuuauguaaaua

SEQ ID NO: 1548942 - RNA, 13 nt, Human adenovirus C
gcccgugcacucc

SEQ ID NO: 1548943 - RNA, 12 nt, Human adenovirus C
gcugaaagaggu

SEQ ID NO: 1548944 - RNA, 14 nt, Human adenovirus C
cccugcuaguggag

SEQ ID NO: 1548945 - RNA, 16 nt, Human adenovirus C
uuaaugcaucucauaa

SEQ ID NO: 1548946 - RNA, 16 nt, Human adenovirus C
cuccacgugccgggcg

SEQ ID NO: 1548947 - RNA, 18 nt, Human adenovirus C
ugcuaccuucugcagcua

SEQ ID NO: 1548948 - RNA, 21 nt, Human adenovirus C
agaacugguugacggccuggu

SEQ ID NO: 1548949 - RNA, 17 nt, Human adenovirus C
gcggcaggagcagagcc

SEQ ID NO: 1548950 - RNA, 16 nt, Human adenovirus C
cgcuggaccugccucc

SEQ ID NO: 1548951 - RNA, 19 nt, Human adenovirus C
guacaaguuguggccccca

SEQ ID NO: 1548952 - RNA, 19 nt, Human adenovirus C
gacuuugcuuuccugagcc

SEQ ID NO: 1548953 - RNA, 17 nt, Human adenovirus C
cgagguggaacugcugc

SEQ ID NO: 1548954 - RNA, 14 nt, Human adenovirus C
cgggccaugagcug

SEQ ID NO: 1548955 - RNA, 16 nt, Human adenovirus C
cacauuucggccccac

SEQ ID NO: 1548956 - RNA, 15 nt, Human adenovirus C
gcaggaaucgcccca

SEQ ID NO: 1548957 - RNA, 20 nt, Human adenovirus C
cggggcuccgggggcgaggu

SEQ ID NO: 1548958 - RNA, 21 nt, Human adenovirus C
caaaauuuccaacaaaaggug

SEQ ID NO: 1548959 - RNA, 13 nt, Human adenovirus C
ucaucugcagccu

SEQ ID NO: 1548960 - RNA, 17 nt, Human adenovirus C
gacaaagcccaagaaau

SEQ ID NO: 1548961 - RNA, 16 nt, Human adenovirus C
aggcagugcaaaauaa

SEQ ID NO: 1548962 - RNA, 19 nt, Human adenovirus C
agguuccugagcagcugcg

SEQ ID NO: 1548963 - RNA, 21 nt, Human adenovirus C
ccucgcauagccgggucaggg

SEQ ID NO: 1548964 - RNA, 18 nt, Human adenovirus C
agacguaugcgcaggagc

SEQ ID NO: 1548965 - RNA, 21 nt, Human adenovirus C
cuacggcaucucgauccagca

SEQ ID NO: 1548966 - RNA, 21 nt, Human adenovirus C
gcccguguucugacagggccc

SEQ ID NO: 1548967 - RNA, 16 nt, Human adenovirus C
agacagugucuccaga

SEQ ID NO: 1548968 - RNA, 17 nt, Human adenovirus C
caaaaucaaagaagaga

SEQ ID NO: 1548969 - RNA, 19 nt, Human adenovirus C
cgugagcgcgcgcagcagc

SEQ ID NO: 1548970 - RNA, 14 nt, Human adenovirus C
cacgcaaccgcgcc

SEQ ID NO: 1548971 - RNA, 13 nt, Human adenovirus C
cugauaacaucca

SEQ ID NO: 1548972 - RNA, 20 nt, Human adenovirus C
gucaggcgggagcuccugca

SEQ ID NO: 1548973 - RNA, 23 nt, Human adenovirus C
auuuguagcgccacaucuucucu

SEQ ID NO: 1548974 - RNA, 12 nt, Human adenovirus C
aggaagccaggc

SEQ ID NO: 1548975 - RNA, 17 nt, Human adenovirus C
cacucacagaccugggc

SEQ ID NO: 1548976 - RNA, 16 nt, Human adenovirus C
cccagugcccgcuguc

SEQ ID NO: 1548977 - RNA, 15 nt, Human adenovirus C
agaugccaugaacca

SEQ ID NO: 1548978 - RNA, 15 nt, Human adenovirus C
aaugcaucaaacaau

SEQ ID NO: 1548979 - RNA, 23 nt, Human adenovirus C
cagccuagacgaagcuuccgagg

SEQ ID NO: 1548980 - RNA, 16 nt, Human adenovirus C
ggagcaacagcaggag

SEQ ID NO: 1548981 - RNA, 14 nt, Human adenovirus C
ccaacagaggauaa

SEQ ID NO: 1548982 - RNA, 16 nt, Human adenovirus C
cuuaccucccuugccg

SEQ ID NO: 1548983 - RNA, 17 nt, Human adenovirus C
cuagcccugcaaacauc

SEQ ID NO: 1548984 - RNA, 21 nt, Human adenovirus C
cacaugucuaugcccaggcuc

SEQ ID NO: 1548985 - RNA, 13 nt, Human adenovirus C
uggaagccaugcu

SEQ ID NO: 1548986 - RNA, 22 nt, Human adenovirus C
cagccugcaaagggcccuggcu

SEQ ID NO: 1548987 - RNA, 20 nt, Human adenovirus C
ugaccaacgacucaagcagg

SEQ ID NO: 1548988 - RNA, 20 nt, Human adenovirus C
cagcggcagacaugcagggc

SEQ ID NO: 1548989 - RNA, 20 nt, Human adenovirus C
ucagcacaguaacugcagca

SEQ ID NO: 1548990 - RNA, 16 nt, Human adenovirus C
aaccauaucccaggga

SEQ ID NO: 1548991 - RNA, 16 nt, Human adenovirus C
acaacucgcugcugca

SEQ ID NO: 1548992 - RNA, 23 nt, Human adenovirus C
ccauggaucacaaccccaccaug

SEQ ID NO: 1548993 - RNA, 20 nt, Human adenovirus C
cgcuccacgguggcggcgag

SEQ ID NO: 1548994 - RNA, 16 nt, Human adenovirus C
guuucgcgcugcuccu

SEQ ID NO: 1548995 - RNA, 23 nt, Human adenovirus C
cgcaccuucgccccaggcugggg

SEQ ID NO: 1548996 - RNA, 21 nt, Human adenovirus C
cacgagccaggugagcucugg

SEQ ID NO: 1548997 - RNA, 12 nt, Human adenovirus C
gacacggcggcg

SEQ ID NO: 1548998 - RNA, 12 nt, Human adenovirus C
gacgcggcggca

SEQ ID NO: 1548999 - RNA, 13 nt, Human adenovirus C
ccacgcucgguga

SEQ ID NO: 1549000 - RNA, 12 nt, Human adenovirus C
ugcccaggcucc

SEQ ID NO: 1549001 - RNA, 20 nt, Human adenovirus C
gcacugggcgcaccaccguc

SEQ ID NO: 1549002 - RNA, 20 nt, Human adenovirus C
cggacuaucgcaacaccacu

SEQ ID NO: 1549003 - RNA, 17 nt, Human adenovirus C
gccgccuuuuagcugca

SEQ ID NO: 1549004 - RNA, 13 nt, Human adenovirus C
cccacccccacug

SEQ ID NO: 1549005 - RNA, 13 nt, Human adenovirus C
cggaggugcugcu

SEQ ID NO: 1549006 - RNA, 16 nt, Human adenovirus C
agacgccgcaccugcc

SEQ ID NO: 1549007 - RNA, 12 nt, Human adenovirus C
cugcgagggcca

SEQ ID NO: 1549008 - RNA, 15 nt, Human adenovirus C
cgucacccagcacuc

SEQ ID NO: 1549009 - RNA, 11 nt, Human adenovirus C
uguagguacuc

SEQ ID NO: 1549010 - RNA, 18 nt, Human adenovirus C
guggccgggggugcuugg

SEQ ID NO: 1549011 - RNA, 18 nt, Human adenovirus C
ugacuacagcccggggga

SEQ ID NO: 1549012 - RNA, 14 nt, Human adenovirus C
gcggcgcugcagag

SEQ ID NO: 1549013 - RNA, 22 nt, Human adenovirus C
gcgucccugcgccgugccgcca

SEQ ID NO: 1549014 - RNA, 21 nt, Human adenovirus C
agccaaacgcucaucagugau

SEQ ID NO: 1549015 - RNA, 12 nt, Human adenovirus C
agccggccugga

SEQ ID NO: 1549016 - RNA, 15 nt, Human adenovirus C
gcucgaucucuuccu

SEQ ID NO: 1549017 - RNA, 14 nt, Human adenovirus C
agguugaguuuaag

SEQ ID NO: 1549018 - RNA, 22 nt, Human adenovirus C
ucagcgccauuaugagcaagga

SEQ ID NO: 1549019 - RNA, 23 nt, Human adenovirus C
cccagcacucggcagaaacagag

SEQ ID NO: 1549020 - RNA, 18 nt, Human adenovirus C
acccacccaaagcagacc

SEQ ID NO: 1549021 - RNA, 18 nt, Human adenovirus C
uuccaaaaacgaggagga

SEQ ID NO: 1549022 - RNA, 17 nt, Human adenovirus C
ucgcaaggccuggccag

SEQ ID NO: 1549023 - RNA, 18 nt, Human adenovirus C
cgaugccgccaacgcgcc

SEQ ID NO: 1549024 - RNA, 21 nt, Human adenovirus C
agcaacagcagcggucacaca

SEQ ID NO: 1549025 - RNA, 15 nt, Human adenovirus C
uaagcccgucucugg

SEQ ID NO: 1549026 - RNA, 20 nt, Human adenovirus C
uaugcaccccgcaccgcucc

SEQ ID NO: 1549027 - RNA, 13 nt, Human adenovirus C
cagcucuacagcu

SEQ ID NO: 1549028 - RNA, 14 nt, Human adenovirus C
acuggcagggacac

SEQ ID NO: 1549029 - RNA, 16 nt, Human adenovirus C
ccuaccggggggagaa

SEQ ID NO: 1549030 - RNA, 15 nt, Human adenovirus C
acccaccgugcagcu

SEQ ID NO: 1549031 - RNA, 21 nt, Human adenovirus C
auauggcccucaccugccgcc

SEQ ID NO: 1549032 - RNA, 16 nt, Human adenovirus C
ugcaucuaaaagcggu

SEQ ID NO: 1549033 - RNA, 22 nt, Human adenovirus C
ugcucguccagacgggccaggg

SEQ ID NO: 1549034 - RNA, 13 nt, Human adenovirus C
gucuccagagggg

SEQ ID NO: 1549035 - RNA, 13 nt, Human adenovirus C
cccuggugcugcc

SEQ ID NO: 1549036 - RNA, 21 nt, Human adenovirus C
ggcaccauccgcaauacagag

SEQ ID NO: 1549037 - RNA, 19 nt, Human adenovirus C
gaggcguaggagucgcgca

SEQ ID NO: 1549038 - RNA, 19 nt, Human adenovirus C
cccaauccccccgccgccg

SEQ ID NO: 1549039 - RNA, 16 nt, Human adenovirus C
uugaucaaacccagcu

SEQ ID NO: 1549040 - RNA, 13 nt, Human adenovirus C
ucaccuccuuucc

SEQ ID NO: 1549041 - RNA, 11 nt, Human adenovirus C
ugcuaccucuu

SEQ ID NO: 1549042 - RNA, 20 nt, Human adenovirus C
gccccuacguuuacaaggcc

SEQ ID NO: 1549043 - RNA, 19 nt, Human adenovirus C
cacgccgccaccagugucc

SEQ ID NO: 1549044 - RNA, 15 nt, Human adenovirus C
aguuaccagccacaa

SEQ ID NO: 1549045 - RNA, 17 nt, Human adenovirus C
ccgcaacuucagacugg

SEQ ID NO: 1549046 - RNA, 15 nt, Human adenovirus C
gcuggaccugccucc

SEQ ID NO: 1549047 - RNA, 16 nt, Human adenovirus C
augcucagucugggca

SEQ ID NO: 1549048 - RNA, 14 nt, Human adenovirus C
cagcugccgccgcc

SEQ ID NO: 1549049 - RNA, 22 nt, Human adenovirus C
uaaauauggaaaccccagacac

SEQ ID NO: 1549050 - RNA, 22 nt, Human adenovirus C
ccaaguggacguaaaggcuaaa

SEQ ID NO: 1549051 - RNA, 14 nt, Human adenovirus C
caggcgcagagaca

SEQ ID NO: 1549052 - RNA, 17 nt, Human adenovirus C
gcagccgcaggccaacc

SEQ ID NO: 1549053 - RNA, 22 nt, Human adenovirus C
gcagcggcagacaugcagggca

SEQ ID NO: 1549054 - RNA, 22 nt, Human adenovirus C
ccguagaggagccuccaccggc

SEQ ID NO: 1549055 - RNA, 17 nt, Human adenovirus C
cccacggacgaggagga

SEQ ID NO: 1549056 - RNA, 13 nt, Human adenovirus C
ccgcaccgcuccc

SEQ ID NO: 1549057 - RNA, 14 nt, Human adenovirus C
gaccuggccaacca

SEQ ID NO: 1549058 - RNA, 17 nt, Human adenovirus C
cauggcauggggugggu

SEQ ID NO: 1549059 - RNA, 15 nt, Human adenovirus C
accacuuacuggcug

SEQ ID NO: 1549060 - RNA, 22 nt, Human adenovirus C
cgcgcacaaacgcggccgcacu

SEQ ID NO: 1549061 - RNA, 15 nt, Human adenovirus C
ggccguagguggcgc

SEQ ID NO: 1549062 - RNA, 14 nt, Human adenovirus C
gccuguccucgagc

SEQ ID NO: 1549063 - RNA, 15 nt, Human adenovirus C
ugcuggacagggggc

SEQ ID NO: 1549064 - RNA, 23 nt, Human adenovirus C
aguucaugucgcuguccagcugc

SEQ ID NO: 1549065 - RNA, 17 nt, Human adenovirus C
aguaaguuugccacaca

SEQ ID NO: 1549066 - RNA, 23 nt, Human adenovirus C
gcugcggggugguguuguagaug

SEQ ID NO: 1549067 - RNA, 14 nt, Human adenovirus C
aucuauaggccuau

SEQ ID NO: 1549068 - RNA, 22 nt, Human adenovirus C
accccacgguggcaccuacgca

SEQ ID NO: 1549069 - RNA, 20 nt, Human adenovirus C
gugacacugcagcaggugcu

SEQ ID NO: 1549070 - RNA, 12 nt, Human adenovirus C
aggacugaugca

SEQ ID NO: 1549071 - RNA, 15 nt, Human adenovirus C
ggcgauuggcgccgu

SEQ ID NO: 1549072 - RNA, 19 nt, Human adenovirus C
gagcgugagccggcggcgc

SEQ ID NO: 1549073 - RNA, 21 nt, Human adenovirus C
cccggaauugcauccguggcc

SEQ ID NO: 1549074 - RNA, 15 nt, Human adenovirus C
uccccuaucaggguc

SEQ ID NO: 1549075 - RNA, 13 nt, Human adenovirus C
aaccucaccuccc

SEQ ID NO: 1549076 - RNA, 20 nt, Human adenovirus C
caggcgcuuuuccaagagaa

SEQ ID NO: 1549077 - RNA, 18 nt, Human adenovirus C
uggcgcagcgugagcgcg

SEQ ID NO: 1549078 - RNA, 18 nt, Human adenovirus C
gcaaaaucuccugcacgu

SEQ ID NO: 1549079 - RNA, 13 nt, Human adenovirus C
cucaaaagcgggc

SEQ ID NO: 1549080 - RNA, 12 nt, Human adenovirus C
cacuacccggac

SEQ ID NO: 1549081 - RNA, 20 nt, Human adenovirus C
gguuccugagcagcugcgac

SEQ ID NO: 1549082 - RNA, 16 nt, Human adenovirus C
gcgcaaaaucuccugc

SEQ ID NO: 1549083 - RNA, 20 nt, Human adenovirus C
cgguucgagucucgggccgg

SEQ ID NO: 1549084 - RNA, 21 nt, Human adenovirus C
cucgccccccuucucccaccc

SEQ ID NO: 1549085 - RNA, 13 nt, Human adenovirus C
guaccgcagcugg

SEQ ID NO: 1549086 - RNA, 13 nt, Human adenovirus C
agcaacagcagcg

SEQ ID NO: 1549087 - RNA, 14 nt, Human adenovirus C
caggagcgcugggc

SEQ ID NO: 1549088 - RNA, 13 nt, Human adenovirus C
cgcgcgcagcagc

SEQ ID NO: 1549089 - RNA, 22 nt, Human adenovirus C
aggggcaacguguacugggugc

SEQ ID NO: 1549090 - RNA, 11 nt, Human adenovirus C
aaucuugguua

SEQ ID NO: 1549091 - RNA, 13 nt, Human adenovirus C
aagcaagaccagg

SEQ ID NO: 1549092 - RNA, 13 nt, Human adenovirus C
gggcuagguccag

SEQ ID NO: 1549093 - RNA, 16 nt, Human adenovirus C
ccggcggcagcggcag

SEQ ID NO: 1549094 - RNA, 20 nt, Human adenovirus C
caccuguaacgcuggaccug

SEQ ID NO: 1549095 - RNA, 23 nt, Human adenovirus C
gcagcggcagacaugcagggcac

SEQ ID NO: 1549096 - RNA, 13 nt, Human adenovirus C
ugaccugcacguc

SEQ ID NO: 1549097 - RNA, 12 nt, Human adenovirus C
agcaugaagggc

SEQ ID NO: 1549098 - RNA, 23 nt, Human adenovirus C
cagcauuugucuuuacgccaccu

SEQ ID NO: 1549099 - RNA, 15 nt, Human adenovirus C
aggagggcgagggcc

SEQ ID NO: 1549100 - RNA, 16 nt, Human adenovirus C
cacucgcuccagggug

SEQ ID NO: 1549101 - RNA, 19 nt, Human adenovirus C
cacggugaaggggugcgcu

SEQ ID NO: 1549102 - RNA, 15 nt, Human adenovirus C
gcagggcacccuccc

SEQ ID NO: 1549103 - RNA, 13 nt, Human adenovirus C
cgcuccagggugu

SEQ ID NO: 1549104 - RNA, 14 nt, Human adenovirus C
cuugaucugcuggc

SEQ ID NO: 1549105 - RNA, 21 nt, Human adenovirus C
gaggaagugauuaucgagcag

SEQ ID NO: 1549106 - RNA, 19 nt, Human adenovirus C
gcaaguuuuacgcccgcaa

SEQ ID NO: 1549107 - RNA, 13 nt, Human adenovirus C
ccagguacagccc

SEQ ID NO: 1549108 - RNA, 20 nt, Human adenovirus C
cguagccaguggcaacuggc

SEQ ID NO: 1549109 - RNA, 20 nt, Human adenovirus C
uuuacgccaccuucuucccc

SEQ ID NO: 1549110 - RNA, 13 nt, Human adenovirus C
cugaaacccacca

SEQ ID NO: 1549111 - RNA, 14 nt, Human adenovirus C
cgucccugcgccgu

SEQ ID NO: 1549112 - RNA, 15 nt, Human adenovirus C
gcagcacaggccaga

SEQ ID NO: 1549113 - RNA, 18 nt, Human adenovirus C
gccgcacugggcgcacca

SEQ ID NO: 1549114 - RNA, 14 nt, Human adenovirus C
uccugccaggcuca

SEQ ID NO: 1549115 - RNA, 22 nt, Human adenovirus C
gcuacaacaaacagagcgauuu

SEQ ID NO: 1549116 - RNA, 19 nt, Human adenovirus C
cuucagcuugccugcucca

SEQ ID NO: 1549117 - RNA, 15 nt, Human adenovirus C
gcguggucaaacucu

SEQ ID NO: 1549118 - RNA, 11 nt, Human adenovirus C
cccagacacac

SEQ ID NO: 1549119 - RNA, 13 nt, Human adenovirus C
ccgccaacgugcc

SEQ ID NO: 1549120 - RNA, 14 nt, Human adenovirus C
auccagcggcggcg

SEQ ID NO: 1549121 - RNA, 19 nt, Human adenovirus C
cuaccgcgcgcccuggggc

SEQ ID NO: 1549122 - RNA, 18 nt, Human adenovirus C
cgcagcuugagccuggcu

SEQ ID NO: 1549123 - RNA, 22 nt, Human adenovirus C
cccaccaugcgcgagggacagg

SEQ ID NO: 1549124 - RNA, 17 nt, Human adenovirus C
uauagguguaggccacg

SEQ ID NO: 1549125 - RNA, 22 nt, Human adenovirus C
ccgcgucagaaccauaucccag

SEQ ID NO: 1549126 - RNA, 23 nt, Human adenovirus C
cucccaaaauguaaccacuguua

SEQ ID NO: 1549127 - RNA, 21 nt, Human adenovirus C
gcccuggaggcagcuggggcc

SEQ ID NO: 1549128 - RNA, 19 nt, Human adenovirus C
cgggccgaacacucgugcu

SEQ ID NO: 1549129 - RNA, 13 nt, Human adenovirus C
agcugaucuucuc

SEQ ID NO: 1549130 - RNA, 17 nt, Human adenovirus C
cgcuggggcaggaggac

SEQ ID NO: 1549131 - RNA, 12 nt, Human adenovirus C
caccacugcaga

SEQ ID NO: 1549132 - RNA, 20 nt, Human adenovirus C
guaguggcaucagaagguga

SEQ ID NO: 1549133 - RNA, 13 nt, Human adenovirus C
ccuggaggagcgc

SEQ ID NO: 1549134 - RNA, 20 nt, Human adenovirus C
ccgagcggacaagcagcugg

SEQ ID NO: 1549135 - RNA, 17 nt, Human adenovirus C
uauuauucgccacaaag

SEQ ID NO: 1549136 - RNA, 20 nt, Human adenovirus C
aggaggcaggacccuggugc

SEQ ID NO: 1549137 - RNA, 12 nt, Human adenovirus C
accucagcgccu

SEQ ID NO: 1549138 - RNA, 17 nt, Human adenovirus C
cuguaacgcuggaccug

SEQ ID NO: 1549139 - RNA, 21 nt, Human adenovirus C
cuugaugacaacaucgcgcag

SEQ ID NO: 1549140 - RNA, 13 nt, Human adenovirus C
ggcgugcagaccg

SEQ ID NO: 1549141 - RNA, 23 nt, Human adenovirus C
ccugcgcgagauugagcuccacg

SEQ ID NO: 1549142 - RNA, 14 nt, Human adenovirus C
aguaccgcagcugg

SEQ ID NO: 1549143 - RNA, 22 nt, Human adenovirus C
cccugcgucgcaaccaggaaca

SEQ ID NO: 1549144 - RNA, 21 nt, Human adenovirus C
cagggcuacgugcgccaggcc

SEQ ID NO: 1549145 - RNA, 18 nt, Human adenovirus C
uccacagcggcggcagca

SEQ ID NO: 1549146 - RNA, 12 nt, Human adenovirus C
ccgcugcagcca

SEQ ID NO: 1549147 - RNA, 13 nt, Human adenovirus C
agaagaagagcaa

SEQ ID NO: 1549148 - RNA, 18 nt, Human adenovirus C
gccagaaggcgcucgccg

SEQ ID NO: 1549149 - RNA, 19 nt, Human adenovirus C
cguucucgcgggggcgcag

SEQ ID NO: 1549150 - RNA, 22 nt, Human adenovirus C
auaagggccuccccuucuucuu

SEQ ID NO: 1549151 - RNA, 22 nt, Human adenovirus C
gucgaagccguugauguugugg

SEQ ID NO: 1549152 - RNA, 15 nt, Human adenovirus C
gcagguuccugagca

SEQ ID NO: 1549153 - RNA, 13 nt, Human adenovirus C
acacccuuacugu

SEQ ID NO: 1549154 - RNA, 17 nt, Human adenovirus C
acuauucugcugcaugu

SEQ ID NO: 1549155 - RNA, 15 nt, Human adenovirus C
ccagcgccugcacug

SEQ ID NO: 1549156 - RNA, 15 nt, Human adenovirus C
uguauauuaaugcau

SEQ ID NO: 1549157 - RNA, 18 nt, Human adenovirus C
ggacaaccccagacccau

SEQ ID NO: 1549158 - RNA, 11 nt, Human adenovirus C
aacuacugcca

SEQ ID NO: 1549159 - RNA, 13 nt, Human adenovirus C
ggccgaggcagcg

SEQ ID NO: 1549160 - RNA, 16 nt, Human adenovirus C
ggcgaggcgcgccgcg

SEQ ID NO: 1549161 - RNA, 19 nt, Human adenovirus C
acgguaaagaccccgggca

SEQ ID NO: 1549162 - RNA, 21 nt, Human adenovirus C
cgccaccgagacguacuucag

SEQ ID NO: 1549163 - RNA, 13 nt, Human adenovirus C
ucgaugcuccccu

SEQ ID NO: 1549164 - RNA, 21 nt, Human adenovirus C
uucgggaaagacgguggugcg

SEQ ID NO: 1549165 - RNA, 13 nt, Human adenovirus C
ugcagaccgugga

SEQ ID NO: 1549166 - RNA, 13 nt, Human adenovirus C
cacccgcagcugc

SEQ ID NO: 1549167 - RNA, 22 nt, Human adenovirus C
cgucaccgguugcugcgcccac

SEQ ID NO: 1549168 - RNA, 16 nt, Human adenovirus C
agguacgaugagaccc

SEQ ID NO: 1549169 - RNA, 17 nt, Human adenovirus C
agguuccugagcagcug

SEQ ID NO: 1549170 - RNA, 22 nt, Human adenovirus C
aguaaguuugccacacaaccuu

SEQ ID NO: 1549171 - RNA, 15 nt, Human adenovirus C
ugaggcuacagagga

SEQ ID NO: 1549172 - RNA, 16 nt, Human adenovirus C
cugguggaacuugagg

SEQ ID NO: 1549173 - RNA, 23 nt, Human adenovirus C
agcgccugauuucugccagcgcc

SEQ ID NO: 1549174 - RNA, 13 nt, Human adenovirus C
cacggacgaggag

SEQ ID NO: 1549175 - RNA, 21 nt, Human adenovirus C
cgcgaccgugucuagcuugcu

SEQ ID NO: 1549176 - RNA, 16 nt, Human adenovirus C
cuauucugcugcaugu

SEQ ID NO: 1549177 - RNA, 23 nt, Human adenovirus C
gcacgaccgucagcggggucugg

SEQ ID NO: 1549178 - RNA, 22 nt, Human adenovirus C
uaacccugacgcguuccggcag

SEQ ID NO: 1549179 - RNA, 15 nt, Human adenovirus C
uggaaggggguggug

SEQ ID NO: 1549180 - RNA, 16 nt, Human adenovirus C
ugguuaugauucauca

SEQ ID NO: 1549181 - RNA, 17 nt, Human adenovirus C
cugucgagccaaacgcu

SEQ ID NO: 1549182 - RNA, 18 nt, Human adenovirus C
cagcggucacacagaagc

SEQ ID NO: 1549183 - RNA, 12 nt, Human adenovirus C
acugcugcugga

SEQ ID NO: 1549184 - RNA, 14 nt, Human adenovirus C
gccugugaugcugg

SEQ ID NO: 1549185 - RNA, 17 nt, Human adenovirus C
cgagggccgcuggcugc

SEQ ID NO: 1549186 - RNA, 12 nt, Human adenovirus C
accugggcggcg

SEQ ID NO: 1549187 - RNA, 18 nt, Human adenovirus C
ccaccaguuggaggagug

SEQ ID NO: 1549188 - RNA, 13 nt, Human adenovirus C
cagcgccaaggcu

SEQ ID NO: 1549189 - RNA, 17 nt, Human adenovirus C
gcgccgggcccggcacu

SEQ ID NO: 1549190 - RNA, 20 nt, Human adenovirus C
agaggagcugcugagccgcc

SEQ ID NO: 1549191 - RNA, 20 nt, Human adenovirus C
aaaccuucucuacgccaacu

SEQ ID NO: 1549192 - RNA, 14 nt, Human adenovirus C
cugggggcguacac

SEQ ID NO: 1549193 - RNA, 13 nt, Human adenovirus C
acagcacuggcaa

SEQ ID NO: 1549194 - RNA, 19 nt, Human adenovirus C
cucccgguaccauauaaac

SEQ ID NO: 1549195 - RNA, 21 nt, Human adenovirus C
ugccgcggugcaggcggccgc

SEQ ID NO: 1549196 - RNA, 17 nt, Human adenovirus C
ccccgucgaggcacccc

SEQ ID NO: 1549197 - RNA, 13 nt, Human adenovirus C
gcaccagccgcac

SEQ ID NO: 1549198 - RNA, 20 nt, Human adenovirus C
cucggcuaauauggccugcu

SEQ ID NO: 1549199 - RNA, 16 nt, Human adenovirus C
aucucgucgaagccgu

SEQ ID NO: 1549200 - RNA, 14 nt, Human adenovirus C
cgcagcagcagggc

SEQ ID NO: 1549201 - RNA, 13 nt, Human adenovirus C
ugcuugcuugcaa

SEQ ID NO: 1549202 - RNA, 22 nt, Human adenovirus C
gcucauggcgcagcuguuccuu

SEQ ID NO: 1549203 - RNA, 22 nt, Human adenovirus C
cuauuuauguaaauaauggaaa

SEQ ID NO: 1549204 - RNA, 20 nt, Human adenovirus C
cggugacgcgggcgggcccc

SEQ ID NO: 1549205 - RNA, 17 nt, Human adenovirus C
aacucaacuaaugcaaa

SEQ ID NO: 1549206 - RNA, 16 nt, Human adenovirus C
cuucagcgcgcgcugc

SEQ ID NO: 1549207 - RNA, 17 nt, Human adenovirus C
gcuacaacaaacagagc

SEQ ID NO: 1549208 - RNA, 23 nt, Human adenovirus C
gccaacuacaauauuggcuacca

SEQ ID NO: 1549209 - RNA, 14 nt, Human adenovirus C
agcaggagcgcugg

SEQ ID NO: 1549210 - RNA, 20 nt, Human adenovirus C
ggacguaaaggcuaaacccu

SEQ ID NO: 1549211 - RNA, 20 nt, Human adenovirus C
cauacccgccaacgccacca

SEQ ID NO: 1549212 - RNA, 16 nt, Human adenovirus C
cgggagagggggcagg

SEQ ID NO: 1549213 - RNA, 22 nt, Human adenovirus C
ugcuauggaucuuaugccaggc

SEQ ID NO: 1549214 - RNA, 14 nt, Human adenovirus C
gaagaucuggaagg

SEQ ID NO: 1549215 - RNA, 14 nt, Human adenovirus C
ggcaacgaccgccu

SEQ ID NO: 1549216 - RNA, 22 nt, Human adenovirus C
ugaaguuuucacuccacaggcu

SEQ ID NO: 1549217 - RNA, 16 nt, Human adenovirus C
gugcgcggcaccagcg

SEQ ID NO: 1549218 - RNA, 18 nt, Human adenovirus C
aaccuuuggacaccuccc

SEQ ID NO: 1549219 - RNA, 17 nt, Human adenovirus C
cuucagaaacuuccagc

SEQ ID NO: 1549220 - RNA, 23 nt, Human adenovirus C
augggacuugcggcuggagcugc

SEQ ID NO: 1549221 - RNA, 15 nt, Human adenovirus C
uccagacgggccagg

SEQ ID NO: 1549222 - RNA, 20 nt, Human adenovirus C
augaaugugagguuuacugg

SEQ ID NO: 1549223 - RNA, 20 nt, Human adenovirus C
cugaggccgaggcagcggca

SEQ ID NO: 1549224 - RNA, 17 nt, Human adenovirus C
uggcuaccccuucgaug

SEQ ID NO: 1549225 - RNA, 16 nt, Human adenovirus C
uugcgucucuggcccc

SEQ ID NO: 1549226 - RNA, 22 nt, Human adenovirus C
gcuagcuuuuuuggccacuggc

SEQ ID NO: 1549227 - RNA, 11 nt, Human adenovirus C
cgcggagcccg

SEQ ID NO: 1549228 - RNA, 13 nt, Human adenovirus C
gggaacaacccau

SEQ ID NO: 1549229 - RNA, 15 nt, Human adenovirus C
uacggauuugucacc

SEQ ID NO: 1549230 - RNA, 18 nt, Human adenovirus C
ugaggcugguccugcugg

SEQ ID NO: 1549231 - RNA, 15 nt, Human adenovirus C
gaugaagaugaagaa

SEQ ID NO: 1549232 - RNA, 20 nt, Human adenovirus C
cuauggccccccgaagaagg

SEQ ID NO: 1549233 - RNA, 20 nt, Human adenovirus C
uggaguuaccagccacaaau

SEQ ID NO: 1549234 - RNA, 22 nt, Human adenovirus C
cacucucgcaaggccuggccag

SEQ ID NO: 1549235 - RNA, 15 nt, Human adenovirus C
uggcugcucgagggg

SEQ ID NO: 1549236 - RNA, 18 nt, Human adenovirus C
gcccugcgcgucggccag

SEQ ID NO: 1549237 - RNA, 19 nt, Human adenovirus C
acauugcuuucagggacaa

SEQ ID NO: 1549238 - RNA, 23 nt, Human adenovirus C
agcugccgucaucccugagcagg

SEQ ID NO: 1549239 - RNA, 17 nt, Human adenovirus C
agaaaccgggccuccaa

SEQ ID NO: 1549240 - RNA, 11 nt, Human adenovirus C
ccauccagaca

SEQ ID NO: 1549241 - RNA, 17 nt, Human adenovirus C
gcggcuggcgguagagg

SEQ ID NO: 1549242 - RNA, 20 nt, Human adenovirus C
gaguuuaaggaaccagcuug

SEQ ID NO: 1549243 - RNA, 15 nt, Human adenovirus C
gaaaagcgcggccua

SEQ ID NO: 1549244 - RNA, 18 nt, Human adenovirus C
ccauuaugagcaaggaaa

SEQ ID NO: 1549245 - RNA, 19 nt, Human adenovirus C
auacugggacagucaggca

SEQ ID NO: 1549246 - RNA, 17 nt, Human adenovirus C
cgcgucggccagguagc

SEQ ID NO: 1549247 - RNA, 14 nt, Human adenovirus C
cgcuccuaacuccu

SEQ ID NO: 1549248 - RNA, 23 nt, Human adenovirus C
gaaggggguggugugucgcccca

SEQ ID NO: 1549249 - RNA, 21 nt, Human adenovirus C
gcccuggcuggcacgggcagc

SEQ ID NO: 1549250 - RNA, 12 nt, Human adenovirus C
gggccggggugc

SEQ ID NO: 1549251 - RNA, 13 nt, Human adenovirus C
agugggcaggcag

SEQ ID NO: 1549252 - RNA, 19 nt, Human adenovirus C
acgaagccuuccauccaga

SEQ ID NO: 1549253 - RNA, 20 nt, Human adenovirus C
caacgcgcgccuagccgugc

SEQ ID NO: 1549254 - RNA, 16 nt, Human adenovirus C
aaucaaaauaaaaagu

SEQ ID NO: 1549255 - RNA, 14 nt, Human adenovirus C
auugcuucuucccc

SEQ ID NO: 1549256 - RNA, 18 nt, Human adenovirus C
cagggucaugucuuucca

SEQ ID NO: 1549257 - RNA, 18 nt, Human adenovirus C
ccgcgguugugcagggug

SEQ ID NO: 1549258 - RNA, 17 nt, Human adenovirus C
aagucuaagcagccgcc

SEQ ID NO: 1549259 - RNA, 19 nt, Human adenovirus C
gggauuugaggugcccgag

SEQ ID NO: 1549260 - RNA, 15 nt, Human adenovirus C
gcagcagggcaaccu

SEQ ID NO: 1549261 - RNA, 17 nt, Human adenovirus C
aacccagcuucagcuug

SEQ ID NO: 1549262 - RNA, 16 nt, Human adenovirus C
guaccugccagacaag

SEQ ID NO: 1549263 - RNA, 17 nt, Human adenovirus C
gucgccgccagaggagc

SEQ ID NO: 1549264 - RNA, 21 nt, Human adenovirus C
augagcagcuggcgcgcuggc

SEQ ID NO: 1549265 - RNA, 13 nt, Human adenovirus C
auaacaacucagg

SEQ ID NO: 1549266 - RNA, 12 nt, Human adenovirus C
gcuaccucuccg

SEQ ID NO: 1549267 - RNA, 17 nt, Human adenovirus C
cccgcggcgccgggccc

SEQ ID NO: 1549268 - RNA, 17 nt, Human adenovirus C
gccaaccaggcagugca

SEQ ID NO: 1549269 - RNA, 17 nt, Human adenovirus C
acgagcggccgccgcag

SEQ ID NO: 1549270 - RNA, 20 nt, Human adenovirus C
acuuuuagcuuaaugaccag

SEQ ID NO: 1549271 - RNA, 21 nt, Human adenovirus C
ugccgccaacgcgccuaccac

SEQ ID NO: 1549272 - RNA, 13 nt, Human adenovirus C
gcgagauugagcu

SEQ ID NO: 1549273 - RNA, 16 nt, Human adenovirus C
ugucguuucucagcag

SEQ ID NO: 1549274 - RNA, 16 nt, Human adenovirus C
cgagcggccgccgcag

SEQ ID NO: 1549275 - RNA, 20 nt, Human adenovirus C
acgcgcgcgcagccuccaug

SEQ ID NO: 1549276 - RNA, 12 nt, Human adenovirus C
ccaggcgccccc

SEQ ID NO: 1549277 - RNA, 14 nt, Human adenovirus C
cgcggcugacgcgg

SEQ ID NO: 1549278 - RNA, 20 nt, Human adenovirus C
gacuauuuuuuccagaccag

SEQ ID NO: 1549279 - RNA, 18 nt, Human adenovirus C
ccagcccaugagccggca

SEQ ID NO: 1549280 - RNA, 16 nt, Human adenovirus C
gcagagcgacugcgcc

SEQ ID NO: 1549281 - RNA, 16 nt, Human adenovirus C
gcucagucugggcaag

SEQ ID NO: 1549282 - RNA, 16 nt, Human adenovirus C
ccugggcggcgagcac

SEQ ID NO: 1549283 - RNA, 17 nt, Human adenovirus C
cggcacuuaaccuaccc

SEQ ID NO: 1549284 - RNA, 14 nt, Human adenovirus C
cgccccaggcuggg

SEQ ID NO: 1549285 - RNA, 20 nt, Human adenovirus C
gcccgcuugcaagcagugca

SEQ ID NO: 1549286 - RNA, 20 nt, Human adenovirus C
ggccaagaacaagagcugaa

SEQ ID NO: 1549287 - RNA, 13 nt, Human adenovirus C
ccuccuccagaag

SEQ ID NO: 1549288 - RNA, 24 nt, Human adenovirus C
cgcagacacgaucggcaggcucag

SEQ ID NO: 1549289 - RNA, 14 nt, Human adenovirus C
uaugauucaucaaa

SEQ ID NO: 1549290 - RNA, 12 nt, Human adenovirus C
gucggcgccgcg

SEQ ID NO: 1549291 - RNA, 14 nt, Human adenovirus C
gcguguggcagcaa

SEQ ID NO: 1549292 - RNA, 18 nt, Human adenovirus C
uccucggagccgcgcucc

SEQ ID NO: 1549293 - RNA, 23 nt, Human adenovirus C
guggugaaaguagaagucccugc

SEQ ID NO: 1549294 - RNA, 21 nt, Human adenovirus C
cagagcgauuugucagaagcc

SEQ ID NO: 1549295 - RNA, 21 nt, Human adenovirus C
cuccugcgccguagcgccauu

SEQ ID NO: 1549296 - RNA, 17 nt, Human adenovirus C
gcugucauaccacugca

SEQ ID NO: 1549297 - RNA, 22 nt, Human adenovirus C
acgcccagcguggcgcuggaca

SEQ ID NO: 1549298 - RNA, 16 nt, Human adenovirus C
gacacgggcagccugg

SEQ ID NO: 1549299 - RNA, 17 nt, Human adenovirus C
cgucgcgccgcaccgcg

SEQ ID NO: 1549300 - RNA, 23 nt, Human adenovirus C
uccucauguucuugucccuccgc

SEQ ID NO: 1549301 - RNA, 15 nt, Human adenovirus C
ggcgcagcgugagcg

SEQ ID NO: 1549302 - RNA, 14 nt, Human adenovirus C
cucucugacccacg

SEQ ID NO: 1549303 - RNA, 12 nt, Human adenovirus C
cgaucgcacccu

SEQ ID NO: 1549304 - RNA, 24 nt, Human adenovirus C
acaguaugauuaaaugagacauga

SEQ ID NO: 1549305 - RNA, 22 nt, Human adenovirus C
caccaugcgcgagggacaggcu

SEQ ID NO: 1549306 - RNA, 22 nt, Human adenovirus C
gaugcgggccaugagcugcgag

SEQ ID NO: 1549307 - RNA, 16 nt, Human adenovirus C
aucgcucaguaccaac

SEQ ID NO: 1549308 - RNA, 17 nt, Human adenovirus C
uguccagcuuauucagc

SEQ ID NO: 1549309 - RNA, 18 nt, Human adenovirus C
augcgagcccaacccgcg

SEQ ID NO: 1549310 - RNA, 17 nt, Human adenovirus C
ccccuuugaguucgcca

SEQ ID NO: 1549311 - RNA, 12 nt, Human adenovirus C
aucauugaaaac

SEQ ID NO: 1549312 - RNA, 16 nt, Human adenovirus C
ggugggugagcgcgga

SEQ ID NO: 1549313 - RNA, 17 nt, Human adenovirus C
agagcauaguggugcag

SEQ ID NO: 1549314 - RNA, 20 nt, Human adenovirus C
acagggcccagucugcaaga

SEQ ID NO: 1549315 - RNA, 12 nt, Human adenovirus C
uccugccaggcu

SEQ ID NO: 1549316 - RNA, 20 nt, Human adenovirus C
cuuugccacacgggcggagg

SEQ ID NO: 1549317 - RNA, 22 nt, Human adenovirus C
cgcccucccguagaggagccuc

SEQ ID NO: 1549318 - RNA, 20 nt, Human adenovirus C
acgccucggaguaccugagc

SEQ ID NO: 1549319 - RNA, 15 nt, Human adenovirus C
gugcgcaguacuggc

SEQ ID NO: 1549320 - RNA, 13 nt, Human adenovirus C
ucaacaacagcug

SEQ ID NO: 1549321 - RNA, 22 nt, Human adenovirus C
cuuggcgcgcagcuugcccuug

SEQ ID NO: 1549322 - RNA, 20 nt, Human adenovirus C
gcuacaggggccucuucuuc

SEQ ID NO: 1549323 - RNA, 16 nt, Human adenovirus C
cgugcgcaguacuggc

SEQ ID NO: 1549324 - RNA, 13 nt, Human adenovirus C
cugacagggccca

SEQ ID NO: 1549325 - RNA, 19 nt, Human adenovirus C
cgggcccuugcuucccagg

SEQ ID NO: 1549326 - RNA, 13 nt, Human adenovirus C
ucucgauccagca

SEQ ID NO: 1549327 - RNA, 20 nt, Human adenovirus C
acugcuaccuucugcagcua

SEQ ID NO: 1549328 - RNA, 19 nt, Human adenovirus C
gacuuuguaagcgcgcugg

SEQ ID NO: 1549329 - RNA, 19 nt, Human adenovirus C
uggcgggcgcucgggcuug

SEQ ID NO: 1549330 - RNA, 16 nt, Human adenovirus C
cuacgaaaaaaccacu

SEQ ID NO: 1549331 - RNA, 20 nt, Human adenovirus C
cuccguggccgcgcaccugg

SEQ ID NO: 1549332 - RNA, 13 nt, Human adenovirus C
gcccgagggcaac

SEQ ID NO: 1549333 - RNA, 12 nt, Human adenovirus C
gaacccccgcgg

SEQ ID NO: 1549334 - RNA, 15 nt, Human adenovirus C
cgcggcccgacaggg

SEQ ID NO: 1549335 - RNA, 19 nt, Human adenovirus C
aaacccaaagucaaacugc

SEQ ID NO: 1549336 - RNA, 17 nt, Human adenovirus C
auugcauccguggccuu

SEQ ID NO: 1549337 - RNA, 17 nt, Human adenovirus C
cugggggcguacacugg

SEQ ID NO: 1549338 - RNA, 12 nt, Human adenovirus C
aggcgccgccgg

SEQ ID NO: 1549339 - RNA, 20 nt, Human adenovirus C
ucccgcggcgacaggucagg

SEQ ID NO: 1549340 - RNA, 17 nt, Human adenovirus C
aguuaagagagcugcag

SEQ ID NO: 1549341 - RNA, 21 nt, Human adenovirus C
uaacgugucguaugugucaug

SEQ ID NO: 1549342 - RNA, 14 nt, Human adenovirus C
aacaaguuuagaaa

SEQ ID NO: 1549343 - RNA, 16 nt, Human adenovirus C
cuucgcggucuuucca

SEQ ID NO: 1549344 - RNA, 22 nt, Human adenovirus C
gacaugcagggcacccuccccu

SEQ ID NO: 1549345 - RNA, 14 nt, Human adenovirus C
gcaauaacacaggc

SEQ ID NO: 1549346 - RNA, 15 nt, Human adenovirus C
agguacgccugcagg

SEQ ID NO: 1549347 - RNA, 15 nt, Human adenovirus C
gcgcgagggacaggc

SEQ ID NO: 1549348 - RNA, 22 nt, Human adenovirus C
gccauuagcauuugcagguggu

SEQ ID NO: 1549349 - RNA, 14 nt, Human adenovirus C
gaggaagaugaaga

SEQ ID NO: 1549350 - RNA, 21 nt, Human adenovirus C
gcugcaaacuuucuccaaagu

SEQ ID NO: 1549351 - RNA, 23 nt, Human adenovirus C
cugaaaauaaaaaacaggucucu

SEQ ID NO: 1549352 - RNA, 16 nt, Human adenovirus C
ggugacaaccgugugc

SEQ ID NO: 1549353 - RNA, 13 nt, Human adenovirus C
ugggcaggcagaa

SEQ ID NO: 1549354 - RNA, 17 nt, Human adenovirus C
acuagauugcaagaaaa

SEQ ID NO: 1549355 - RNA, 10 nt, Human adenovirus C
ccagcggcgg

SEQ ID NO: 1549356 - RNA, 19 nt, Human adenovirus C
guuuguaccuauugucagc

SEQ ID NO: 1549357 - RNA, 20 nt, Human adenovirus C
gccuggcggguuuggcuggu

SEQ ID NO: 1549358 - RNA, 20 nt, Human adenovirus C
aucuucucagaauucuuuaa

SEQ ID NO: 1549359 - RNA, 17 nt, Human adenovirus C
agggcaacccaacaccu

SEQ ID NO: 1549360 - RNA, 22 nt, Human adenovirus C
uuccuaucaaccagaaccucaa

SEQ ID NO: 1549361 - RNA, 14 nt, Human adenovirus C
acacagaagcaaag

SEQ ID NO: 1549362 - RNA, 14 nt, Human adenovirus C
aagcuacaaggacc

SEQ ID NO: 1549363 - RNA, 22 nt, Human adenovirus C
gacacugcagcaggugcugccc

SEQ ID NO: 1549364 - RNA, 22 nt, Human adenovirus C
cuaacauaaacacacaauaaau

SEQ ID NO: 1549365 - RNA, 20 nt, Human adenovirus C
acgugcauacacuuccucag

SEQ ID NO: 1549366 - RNA, 21 nt, Human adenovirus C
cauccguggccuugcaggcgc

SEQ ID NO: 1549367 - RNA, 13 nt, Human adenovirus C
cuaucagcagccg

SEQ ID NO: 1549368 - RNA, 16 nt, Human adenovirus C
augauuuugaggaggc

SEQ ID NO: 1549369 - RNA, 17 nt, Human adenovirus C
aaagugguuuuguacag

SEQ ID NO: 1549370 - RNA, 17 nt, Human adenovirus C
agcuuguugaccagcuc

SEQ ID NO: 1549371 - RNA, 17 nt, Human adenovirus C
cgagcugcuucccaaag

SEQ ID NO: 1549372 - RNA, 15 nt, Human adenovirus C
ccgccgcagcagccg

SEQ ID NO: 1549373 - RNA, 16 nt, Human adenovirus C
uggcacaacacaggca

SEQ ID NO: 1549374 - RNA, 21 nt, Human adenovirus C
cucgcuccagggugugaagac

SEQ ID NO: 1549375 - RNA, 17 nt, Human adenovirus C
gccaccaguuggaggag

SEQ ID NO: 1549376 - RNA, 14 nt, Human adenovirus C
ggaccucugcacuc

SEQ ID NO: 1549377 - RNA, 17 nt, Human adenovirus C
uauggcccucaccugcc

SEQ ID NO: 1549378 - RNA, 19 nt, Human adenovirus C
gacuacuugcaucgcgcgg

SEQ ID NO: 1549379 - RNA, 15 nt, Human adenovirus C
ccgggaggcggucga

SEQ ID NO: 1549380 - RNA, 13 nt, Human adenovirus C
ugcuuacucccaa

SEQ ID NO: 1549381 - RNA, 21 nt, Human adenovirus C
ugcugcacgcaaccgcgccca

SEQ ID NO: 1549382 - RNA, 23 nt, Human adenovirus C
ggccaaucaagcagguggcaccg

SEQ ID NO: 1549383 - RNA, 22 nt, Human adenovirus C
gacgcggcgguugaucuccuga

SEQ ID NO: 1549384 - RNA, 13 nt, Human adenovirus C
gggggcugccgug

SEQ ID NO: 1549385 - RNA, 15 nt, Human adenovirus C
cgcagcagcagggca

SEQ ID NO: 1549386 - RNA, 14 nt, Human adenovirus C
cuacauuccagaaa

SEQ ID NO: 1549387 - RNA, 14 nt, Human adenovirus C
cuaccaccuucccc

SEQ ID NO: 1549388 - RNA, 15 nt, Human adenovirus C
augaagaagaggaag

SEQ ID NO: 1549389 - RNA, 14 nt, Human adenovirus C
augcgccacuggca

SEQ ID NO: 1549390 - RNA, 18 nt, Human adenovirus C
agccaguggcaacuggca

SEQ ID NO: 1549391 - RNA, 17 nt, Human adenovirus C
auaaacauuccagcacc

SEQ ID NO: 1549392 - RNA, 14 nt, Human adenovirus C
ggagcugcugagcc

SEQ ID NO: 1549393 - RNA, 17 nt, Human adenovirus C
ggcgggcgcucgggcuu

SEQ ID NO: 1549394 - RNA, 14 nt, Human adenovirus C
cuccuuugcacucc

SEQ ID NO: 1549395 - RNA, 12 nt, Human adenovirus C
ggaggggggaca

SEQ ID NO: 1549396 - RNA, 14 nt, Human adenovirus C
aggccugcagaccg

SEQ ID NO: 1549397 - RNA, 21 nt, Human adenovirus C
auuuccgugcgcaggguggcu

SEQ ID NO: 1549398 - RNA, 14 nt, Human adenovirus C
cagcgccugcauga

SEQ ID NO: 1549399 - RNA, 23 nt, Human adenovirus C
cacuggucuugucaugccugggg

SEQ ID NO: 1549400 - RNA, 15 nt, Human adenovirus C
acaauaccugugugg

SEQ ID NO: 1549401 - RNA, 13 nt, Human adenovirus C
gaugcgaguagcc

SEQ ID NO: 1549402 - RNA, 16 nt, Human adenovirus C
gaaaauucuaaagcua

SEQ ID NO: 1549403 - RNA, 17 nt, Human adenovirus C
cuacgaacgccaccugu

SEQ ID NO: 1549404 - RNA, 14 nt, Human adenovirus C
gccagguagcauuu

SEQ ID NO: 1549405 - RNA, 17 nt, Human adenovirus C
acccggcgccagcaccu

SEQ ID NO: 1549406 - RNA, 22 nt, Human adenovirus C
ugcugacccggagaugcagcgc

SEQ ID NO: 1549407 - RNA, 20 nt, Human adenovirus C
auuucugccagcgccugcac

SEQ ID NO: 1549408 - RNA, 21 nt, Human adenovirus C
ugaagacaugguuaaccuaca

SEQ ID NO: 1549409 - RNA, 11 nt, Human adenovirus C
gcccuggggcg

SEQ ID NO: 1549410 - RNA, 12 nt, Human adenovirus C
agauggccuggc

SEQ ID NO: 1549411 - RNA, 12 nt, Human adenovirus C
acaaagcagggg

SEQ ID NO: 1549412 - RNA, 15 nt, Human adenovirus C
cauccaccaccaucc

SEQ ID NO: 1549413 - RNA, 18 nt, Human adenovirus C
ggcgcugcagagccagcc

SEQ ID NO: 1549414 - RNA, 21 nt, Human adenovirus C
gcaggucugcacggaccagcg

SEQ ID NO: 1549415 - RNA, 17 nt, Human adenovirus C
accuuggggcgcgcugg

SEQ ID NO: 1549416 - RNA, 17 nt, Human adenovirus C
auggaaaccccagacac

SEQ ID NO: 1549417 - RNA, 21 nt, Human adenovirus C
gagcggggggcuucugaggcu

SEQ ID NO: 1549418 - RNA, 23 nt, Human adenovirus C
caggcuccuuugucuggagaaac

SEQ ID NO: 1549419 - RNA, 15 nt, Human adenovirus C
gcagcaaggccugga

SEQ ID NO: 1549420 - RNA, 21 nt, Human adenovirus C
ccaacuacaauauuggcuacc

SEQ ID NO: 1549421 - RNA, 13 nt, Human adenovirus C
gcgagugguggcu

SEQ ID NO: 1549422 - RNA, 13 nt, Human adenovirus C
auggaaauuaaaa

SEQ ID NO: 1549423 - RNA, 16 nt, Human adenovirus C
ccccgggcagcaggcg

SEQ ID NO: 1549424 - RNA, 21 nt, Human adenovirus C
ccucguaggugagcuccucag

SEQ ID NO: 1549425 - RNA, 19 nt, Human adenovirus C
ggauuacaagcuccucccg

SEQ ID NO: 1549426 - RNA, 15 nt, Human adenovirus C
agcauaguggugcag

SEQ ID NO: 1549427 - RNA, 12 nt, Human adenovirus C
gacggcggccug

SEQ ID NO: 1549428 - RNA, 21 nt, Human adenovirus C
uuagugcuccacuuaaacuca

SEQ ID NO: 1549429 - RNA, 19 nt, Human adenovirus C
gcacgcuggccagcacgcu

SEQ ID NO: 1549430 - RNA, 14 nt, Human adenovirus C
aucaggguccagag

SEQ ID NO: 1549431 - RNA, 14 nt, Human adenovirus C
ccuacugcaccggc

SEQ ID NO: 1549432 - RNA, 21 nt, Human adenovirus C
caacggacuaucgcaacacca

SEQ ID NO: 1549433 - RNA, 13 nt, Human adenovirus C
cagcagcacaggc

SEQ ID NO: 1549434 - RNA, 19 nt, Human adenovirus C
acucgcuccagggugugaa

SEQ ID NO: 1549435 - RNA, 24 nt, Human adenovirus C
cacugcuaccuucugcagcuagcc

SEQ ID NO: 1549436 - RNA, 22 nt, Human adenovirus C
ggaugaagaagaggaagaugaa

SEQ ID NO: 1549437 - RNA, 15 nt, Human adenovirus C
accgcucccuggucu

SEQ ID NO: 1549438 - RNA, 13 nt, Human adenovirus C
cugcgaggacagg

SEQ ID NO: 1549439 - RNA, 17 nt, Human adenovirus C
gcuuauuacagcgcuug

SEQ ID NO: 1549440 - RNA, 12 nt, Human adenovirus C
gccagcgacugg

SEQ ID NO: 1549441 - RNA, 21 nt, Human adenovirus C
cagcaggaggaagccaggcgg

SEQ ID NO: 1549442 - RNA, 22 nt, Human adenovirus C
ucgcccugcgcgucggccaggu

SEQ ID NO: 1549443 - RNA, 19 nt, Human adenovirus C
gcgcucgucgggcaccagg

SEQ ID NO: 1549444 - RNA, 15 nt, Human adenovirus C
auuggccggacaggc

SEQ ID NO: 1549445 - RNA, 15 nt, Human adenovirus C
gacaccuucaacccc

SEQ ID NO: 1549446 - RNA, 22 nt, Human adenovirus C
ccgccaacgccaccaacgugcc

SEQ ID NO: 1549447 - RNA, 17 nt, Human adenovirus C
gcugguccugcuggugc

SEQ ID NO: 1549448 - RNA, 10 nt, Human adenovirus C
caucgcgccu

SEQ ID NO: 1549449 - RNA, 18 nt, Human adenovirus C
cuauguggaaucaggcug

SEQ ID NO: 1549450 - RNA, 20 nt, Human adenovirus C
ccgggcugcgcgcuggccag

SEQ ID NO: 1549451 - RNA, 22 nt, Human adenovirus C
cuucauucaguucauugacugg

SEQ ID NO: 1549452 - RNA, 13 nt, Human adenovirus C
augcgggccuccg

SEQ ID NO: 1549453 - RNA, 13 nt, Human adenovirus C
agcgccugcacug

SEQ ID NO: 1549454 - RNA, 22 nt, Human adenovirus C
gcaagcugauugccaggggcag

SEQ ID NO: 1549455 - RNA, 22 nt, Human adenovirus C
uuccaggcgcggcggcugcugc

SEQ ID NO: 1549456 - RNA, 15 nt, Human adenovirus C
cggucgcauuccccu

SEQ ID NO: 1549457 - RNA, 16 nt, Human adenovirus C
caggcggcuauuacca

SEQ ID NO: 1549458 - RNA, 20 nt, Human adenovirus C
ucacuugcugaagaccauuc

SEQ ID NO: 1549459 - RNA, 15 nt, Human adenovirus C
gcaugcuuuugagcg

SEQ ID NO: 1549460 - RNA, 16 nt, Human adenovirus C
gccuuccggagcgagg

SEQ ID NO: 1549461 - RNA, 15 nt, Human adenovirus C
cgccguuagcccaag

SEQ ID NO: 1549462 - RNA, 22 nt, Human adenovirus C
guccuuggguccggccugcuga

SEQ ID NO: 1549463 - RNA, 14 nt, Human adenovirus C
acuggacucuuccu

SEQ ID NO: 1549464 - RNA, 17 nt, Human adenovirus C
cuaggucacuugcugac

SEQ ID NO: 1549465 - RNA, 18 nt, Human adenovirus C
agaugccgcggugcaggc

SEQ ID NO: 1549466 - RNA, 20 nt, Human adenovirus C
agcagcagggcaaccugggc

SEQ ID NO: 1549467 - RNA, 17 nt, Human adenovirus C
gcguuucagccccccgg

SEQ ID NO: 1549468 - RNA, 17 nt, Human adenovirus C
ggucgcccgggcagggu

SEQ ID NO: 1549469 - RNA, 13 nt, Human adenovirus C
guaguccaggguu

SEQ ID NO: 1549470 - RNA, 14 nt, Human adenovirus C
uugagccuggcuga

SEQ ID NO: 1549471 - RNA, 14 nt, Human adenovirus C
uuccaccgcucugc

SEQ ID NO: 1549472 - RNA, 17 nt, Human adenovirus C
gaucaggcuacuaagaa

SEQ ID NO: 1549473 - RNA, 15 nt, Human adenovirus C
cagcugguaccuugc

SEQ ID NO: 1549474 - RNA, 19 nt, Human adenovirus C
ccccggcuaucguggcuac

SEQ ID NO: 1549475 - RNA, 13 nt, Human adenovirus C
cgcggcggcugcu

SEQ ID NO: 1549476 - RNA, 19 nt, Human adenovirus C
augcaucuaaaagcgguga

SEQ ID NO: 1549477 - RNA, 22 nt, Human adenovirus C
agacagcuaugauccagauguu

SEQ ID NO: 1549478 - RNA, 22 nt, Human adenovirus C
acucgcgccuguugcugcugcu

SEQ ID NO: 1549479 - RNA, 13 nt, Human adenovirus C
ccucacucucuuc

SEQ ID NO: 1549480 - RNA, 16 nt, Human adenovirus C
aagcaggggccaagaa

SEQ ID NO: 1549481 - RNA, 14 nt, Human adenovirus C
gucuggagcucccg

SEQ ID NO: 1549482 - RNA, 16 nt, Human adenovirus C
gaccugcucggacggc

SEQ ID NO: 1549483 - RNA, 17 nt, Human adenovirus C
uugacaacucaggggcc

SEQ ID NO: 1549484 - RNA, 19 nt, Human adenovirus C
cuguccacgaucaccucug

SEQ ID NO: 1549485 - RNA, 23 nt, Human adenovirus C
ugcaaguagcacaaaacuccgau

SEQ ID NO: 1549486 - RNA, 19 nt, Human adenovirus C
ccaucaacaaagcccgcca

SEQ ID NO: 1549487 - RNA, 20 nt, Human adenovirus C
gccugaagauggcaugugag

SEQ ID NO: 1549488 - RNA, 15 nt, Human adenovirus C
cgcggcggcugcugc

SEQ ID NO: 1549489 - RNA, 15 nt, Human adenovirus C
aaaaucguaaaacuu

SEQ ID NO: 1549490 - RNA, 22 nt, Human adenovirus C
cgggcggcaugcgucgugcgca

SEQ ID NO: 1549491 - RNA, 15 nt, Human adenovirus C
cagccgcaggccaac

SEQ ID NO: 1549492 - RNA, 15 nt, Human adenovirus C
cuuacuguaacugca

SEQ ID NO: 1549493 - RNA, 21 nt, Human adenovirus C
ccgacacgguuaacuccuccu

SEQ ID NO: 1549494 - RNA, 14 nt, Human adenovirus C
uaucagcagccgcg

SEQ ID NO: 1549495 - RNA, 22 nt, Human adenovirus C
agaccaguagacaaggccugca

SEQ ID NO: 1549496 - RNA, 12 nt, Human adenovirus C
cgaagaaaagcg

SEQ ID NO: 1549497 - RNA, 13 nt, Human adenovirus C
ucgagaaggagga

SEQ ID NO: 1549498 - RNA, 17 nt, Human adenovirus C
gagcgcaggguuugguu

SEQ ID NO: 1549499 - RNA, 15 nt, Human adenovirus C
caugcagggcacccu

SEQ ID NO: 1549500 - RNA, 18 nt, Human adenovirus C
agcugcagcugccgccgc

SEQ ID NO: 1549501 - RNA, 15 nt, Human adenovirus C
gcccuugcuucccag

SEQ ID NO: 1549502 - RNA, 20 nt, Human adenovirus C
gggucugccagacuucacca

SEQ ID NO: 1549503 - RNA, 18 nt, Human adenovirus C
cgcucgagaucaggcuac

SEQ ID NO: 1549504 - RNA, 19 nt, Human adenovirus C
gguccgugugcaccagccg

SEQ ID NO: 1549505 - RNA, 22 nt, Human adenovirus C
gcccagcaauaacacaggcugg

SEQ ID NO: 1549506 - RNA, 23 nt, Human adenovirus C
accgugugcuugauauggcuucc

SEQ ID NO: 1549507 - RNA, 16 nt, Human adenovirus C
gggacacauaccuagg

SEQ ID NO: 1549508 - RNA, 16 nt, Human adenovirus C
ccugucgucagcgcca

SEQ ID NO: 1549509 - RNA, 16 nt, Human adenovirus C
agacaccuucaacccc

SEQ ID NO: 1549510 - RNA, 14 nt, Human adenovirus C
cucccacgcagaca

SEQ ID NO: 1549511 - RNA, 15 nt, Human adenovirus C
aaccuaaaugccaac

SEQ ID NO: 1549512 - RNA, 16 nt, Human adenovirus C
gcaguaguccaggguu

SEQ ID NO: 1549513 - RNA, 14 nt, Human adenovirus C
cagcagcgcacccu

SEQ ID NO: 1549514 - RNA, 16 nt, Human adenovirus C
gcgaggaugcgagccg

SEQ ID NO: 1549515 - RNA, 21 nt, Human adenovirus C
agcugauugccaggggcaggc

SEQ ID NO: 1549516 - RNA, 20 nt, Human adenovirus C
cuaaugcggcaggagggaga

SEQ ID NO: 1549517 - RNA, 21 nt, Human adenovirus C
gagggcuuuaggaucaccuac

SEQ ID NO: 1549518 - RNA, 12 nt, Human adenovirus C
ugcaacccgcgg

SEQ ID NO: 1549519 - RNA, 12 nt, Human adenovirus C
cgcgcuggagca

SEQ ID NO: 1549520 - RNA, 14 nt, Human adenovirus C
gcuguugcccgugc

SEQ ID NO: 1549521 - RNA, 16 nt, Human adenovirus C
gcggcauaaggacaug

SEQ ID NO: 1549522 - RNA, 21 nt, Human adenovirus C
gaucuccugaaucuggcgccu

SEQ ID NO: 1549523 - RNA, 21 nt, Human adenovirus C
cacgguuaacuccuccuccag

SEQ ID NO: 1549524 - RNA, 20 nt, Human adenovirus C
guucaggaauucugcccgcc

SEQ ID NO: 1549525 - RNA, 20 nt, Human adenovirus C
ugggaacucaacuaaugcaa

SEQ ID NO: 1549526 - RNA, 16 nt, Human adenovirus C
uaacaugguucugcag

SEQ ID NO: 1549527 - RNA, 13 nt, Human adenovirus C
gugaaccaggaga

SEQ ID NO: 1549528 - RNA, 22 nt, Human adenovirus C
gcgcacucacagaccugggcca

SEQ ID NO: 1549529 - RNA, 20 nt, Human adenovirus C
cgaucacuuggugcuggccu

SEQ ID NO: 1549530 - RNA, 12 nt, Human adenovirus C
accugugcugcc

SEQ ID NO: 1549531 - RNA, 16 nt, Human adenovirus C
aggacccuggugcugc

SEQ ID NO: 1549532 - RNA, 21 nt, Human adenovirus C
acguccccgguugccucggcg

SEQ ID NO: 1549533 - RNA, 19 nt, Human adenovirus C
ugguccgugugcaccagcc

SEQ ID NO: 1549534 - RNA, 20 nt, Human adenovirus C
acuugcggcuggagcugccc

SEQ ID NO: 1549535 - RNA, 12 nt, Human adenovirus C
ccugcgccgugc

SEQ ID NO: 1549536 - RNA, 15 nt, Human adenovirus C
ggcaaccugggcucc

SEQ ID NO: 1549537 - RNA, 23 nt, Human adenovirus C
gcuucccaaaggcccccauccaa

SEQ ID NO: 1549538 - RNA, 14 nt, Human adenovirus C
augaccaugaagau

SEQ ID NO: 1549539 - RNA, 14 nt, Human adenovirus C
cguaugcgcaggag

SEQ ID NO: 1549540 - RNA, 22 nt, Human adenovirus C
gccuggcggguuuggcuggugg

SEQ ID NO: 1549541 - RNA, 15 nt, Human adenovirus C
ccacgugcgcacgcu

SEQ ID NO: 1549542 - RNA, 15 nt, Human adenovirus C
caccucgaccacugc

SEQ ID NO: 1549543 - RNA, 15 nt, Human adenovirus C
gccuguccucgagcg

SEQ ID NO: 1549544 - RNA, 16 nt, Human adenovirus C
cgcuguaccugccaga

SEQ ID NO: 1549545 - RNA, 19 nt, Human adenovirus C
auuugagucacacuaagau

SEQ ID NO: 1549546 - RNA, 18 nt, Human adenovirus C
cuucauucagccgccgca

SEQ ID NO: 1549547 - RNA, 15 nt, Human adenovirus C
cuagacugcuccuuc

SEQ ID NO: 1549548 - RNA, 19 nt, Human adenovirus C
aguuggcccgcugcccugg

SEQ ID NO: 1549549 - RNA, 13 nt, Human adenovirus C
cgcaaggccuggc

SEQ ID NO: 1549550 - RNA, 16 nt, Human adenovirus C
aacagcgcgcuaccac

SEQ ID NO: 1549551 - RNA, 24 nt, Human adenovirus C
guacucccucucaaaagcgggcau

SEQ ID NO: 1549552 - RNA, 13 nt, Human adenovirus C
gcggcgacagguc

SEQ ID NO: 1549553 - RNA, 21 nt, Human adenovirus C
gaggcguaggagucgcgcagc

SEQ ID NO: 1549554 - RNA, 12 nt, Human adenovirus C
ggaggcagcugg

SEQ ID NO: 1549555 - RNA, 24 nt, Human adenovirus C
cauccacaaggccgugagcgugag

SEQ ID NO: 1549556 - RNA, 23 nt, Human adenovirus C
aauccacagcggcggcagcagca

SEQ ID NO: 1549557 - RNA, 15 nt, Human adenovirus C
cccuauccugccgug

SEQ ID NO: 1549558 - RNA, 22 nt, Human adenovirus C
ccugcgucauuacccagggcca

SEQ ID NO: 1549559 - RNA, 15 nt, Human adenovirus C
cgcaguacuggcagc

SEQ ID NO: 1549560 - RNA, 20 nt, Human adenovirus C
cgcccuacuuccgcagccac

SEQ ID NO: 1549561 - RNA, 12 nt, Human adenovirus C
caagcgcaaaau

SEQ ID NO: 1549562 - RNA, 15 nt, Human adenovirus C
cagaagcugccgccc

SEQ ID NO: 1549563 - RNA, 17 nt, Human adenovirus C
gacugguuccuggugca

SEQ ID NO: 1549564 - RNA, 16 nt, Human adenovirus C
aggcugcuguccaacu

SEQ ID NO: 1549565 - RNA, 9 nt, Human adenovirus C
cccuugccg

SEQ ID NO: 1549566 - RNA, 15 nt, Human adenovirus C
caugucgcuguccag

SEQ ID NO: 1549567 - RNA, 16 nt, Human adenovirus C
ugcgcgagggacaggc

SEQ ID NO: 1549568 - RNA, 23 nt, Human adenovirus C
gcaacuuuccgguggugggcgcc

SEQ ID NO: 1549569 - RNA, 21 nt, Human adenovirus C
cagcugcgacuuaccgcagcc

SEQ ID NO: 1549570 - RNA, 19 nt, Human adenovirus C
gggcgagguauucagcuca

SEQ ID NO: 1549571 - RNA, 11 nt, Human adenovirus C
cuccagagggg

SEQ ID NO: 1549572 - RNA, 15 nt, Human adenovirus C
cuguagucaucgccu

SEQ ID NO: 1549573 - RNA, 24 nt, Human adenovirus C
cuuccacuuggucaggcaguagcu

SEQ ID NO: 1549574 - RNA, 19 nt, Human adenovirus C
acgugcccaucuccauccc

SEQ ID NO: 1549575 - RNA, 16 nt, Human adenovirus C
agcaaugacagcaccu

SEQ ID NO: 1549576 - RNA, 15 nt, Human adenovirus C
aagaugaagaagagg

SEQ ID NO: 1549577 - RNA, 16 nt, Human adenovirus C
gggcuagguccaggug

SEQ ID NO: 1549578 - RNA, 19 nt, Human adenovirus C
aggcggcggguacagugga

SEQ ID NO: 1549579 - RNA, 11 nt, Human adenovirus C
gccacugccac

SEQ ID NO: 1549580 - RNA, 22 nt, Human adenovirus C
agaccgucugaagacaccuuca

SEQ ID NO: 1549581 - RNA, 22 nt, Human adenovirus C
guacuggcagcggugcacgggc

SEQ ID NO: 1549582 - RNA, 20 nt, Human adenovirus C
ccgccagaggagcugcugag

SEQ ID NO: 1549583 - RNA, 24 nt, Human adenovirus C
gauggcgggcgcucgggcuuggga

SEQ ID NO: 1549584 - RNA, 20 nt, Human adenovirus C
ccacagcggcggcagcagca

SEQ ID NO: 1549585 - RNA, 18 nt, Human adenovirus C
ggcagucugcagcgcugc

SEQ ID NO: 1549586 - RNA, 13 nt, Human adenovirus C
guggcuguugaug

SEQ ID NO: 1549587 - RNA, 18 nt, Human adenovirus C
cuugagugcaugcagcgg

SEQ ID NO: 1549588 - RNA, 23 nt, Human adenovirus C
gagcucggcgacagugucgcgca

SEQ ID NO: 1549589 - RNA, 21 nt, Human adenovirus C
ucagcugggaagaaagcaggu

SEQ ID NO: 1549590 - RNA, 17 nt, Human adenovirus C
agcggcagcggcagcaa

SEQ ID NO: 1549591 - RNA, 22 nt, Human adenovirus C
ccaagcaguuccaggcgguccc

SEQ ID NO: 1549592 - RNA, 23 nt, Human adenovirus C
ucccugaccaaaugcgccagaag

SEQ ID NO: 1549593 - RNA, 16 nt, Human adenovirus C
ggagcgggagcggggu

SEQ ID NO: 1549594 - RNA, 13 nt, Human adenovirus C
caaacaacaugga

SEQ ID NO: 1549595 - RNA, 19 nt, Human adenovirus C
ccugcaaagggcccuggcu

SEQ ID NO: 1549596 - RNA, 17 nt, Human adenovirus C
uccauagagcagcugac

SEQ ID NO: 1549597 - RNA, 14 nt, Human adenovirus C
cuugagaggccugu

SEQ ID NO: 1549598 - RNA, 16 nt, Human adenovirus C
ccaguagacaaggccu

SEQ ID NO: 1549599 - RNA, 15 nt, Human adenovirus C
gcggugcaggcggcc

SEQ ID NO: 1549600 - RNA, 16 nt, Human adenovirus C
gcaggauuacaagccc

SEQ ID NO: 1549601 - RNA, 22 nt, Human adenovirus C
cggaccacucugagacgaaggc

SEQ ID NO: 1549602 - RNA, 13 nt, Human adenovirus C
ccccccaggucca

SEQ ID NO: 1549603 - RNA, 13 nt, Human adenovirus C
auacgucacuucc

SEQ ID NO: 1549604 - RNA, 23 nt, Human adenovirus C
ucuuacaugcacaucucgggcca

SEQ ID NO: 1549605 - RNA, 18 nt, Human adenovirus C
caucgcagcuaaaugccg

SEQ ID NO: 1549606 - RNA, 20 nt, Human adenovirus C
auuuaccccccacccuugcc

SEQ ID NO: 1549607 - RNA, 19 nt, Human adenovirus C
gccccgggcuggugcaguu

SEQ ID NO: 1549608 - RNA, 20 nt, Human adenovirus C
cggcgacaggucaggcggga

SEQ ID NO: 1549609 - RNA, 15 nt, Human adenovirus C
acaccgaacagcgcc

SEQ ID NO: 1549610 - RNA, 17 nt, Human adenovirus C
cggcagcagcaggagga

SEQ ID NO: 1549611 - RNA, 21 nt, Human adenovirus C
cgcggugcaggcggccgcugc

SEQ ID NO: 1549612 - RNA, 15 nt, Human adenovirus C
cacagaccugggcca

SEQ ID NO: 1549613 - RNA, 16 nt, Human adenovirus C
uaacuuggacauaaac

SEQ ID NO: 1549614 - RNA, 19 nt, Human adenovirus C
ggcaacccguuugcgcacc

SEQ ID NO: 1549615 - RNA, 11 nt, Human adenovirus C
ggggucacugc

SEQ ID NO: 1549616 - RNA, 14 nt, Human adenovirus C
gugacggcgcggcc

SEQ ID NO: 1549617 - RNA, 11 nt, Human adenovirus C
uccugccaggc

SEQ ID NO: 1549618 - RNA, 23 nt, Human adenovirus C
cccuaacaguggcaaccaccgcu

SEQ ID NO: 1549619 - RNA, 15 nt, Human adenovirus C
uaccgucaucucuac

SEQ ID NO: 1549620 - RNA, 16 nt, Human adenovirus C
aacaaugacuacagcc

SEQ ID NO: 1549621 - RNA, 23 nt, Human adenovirus C
gguaccgcgcggcgggcgguggg

SEQ ID NO: 1549622 - RNA, 20 nt, Human adenovirus C
caccuuuuguuccaccgcuc

SEQ ID NO: 1549623 - RNA, 13 nt, Human adenovirus C
guuggauguggac

SEQ ID NO: 1549624 - RNA, 18 nt, Human adenovirus C
ccuccgcuccucaggcgc

SEQ ID NO: 1549625 - RNA, 15 nt, Human adenovirus C
ucaucccugagcagg

SEQ ID NO: 1549626 - RNA, 21 nt, Human adenovirus C
cagcuggggcucgcuguggag

SEQ ID NO: 1549627 - RNA, 17 nt, Human adenovirus C
ccagcgccugcacugca

SEQ ID NO: 1549628 - RNA, 20 nt, Human adenovirus C
acagaacccacguggccauc

SEQ ID NO: 1549629 - RNA, 22 nt, Human adenovirus C
cgcggcgugcuggacagggggc

SEQ ID NO: 1549630 - RNA, 19 nt, Human adenovirus C
acuggccauuuccuucucc

SEQ ID NO: 1549631 - RNA, 16 nt, Human adenovirus C
ugcgucauuacccagg

SEQ ID NO: 1549632 - RNA, 22 nt, Human adenovirus C
gccaugggcguguggcagcaau

SEQ ID NO: 1549633 - RNA, 12 nt, Human adenovirus C
cugcaaacauca

SEQ ID NO: 1549634 - RNA, 16 nt, Human adenovirus C
ggcgcgcuggucucug

SEQ ID NO: 1549635 - RNA, 19 nt, Human adenovirus C
caggcuuuguuucuccaca

SEQ ID NO: 1549636 - RNA, 16 nt, Human adenovirus C
gucccuccgcacccac

SEQ ID NO: 1549637 - RNA, 23 nt, Human adenovirus C
cugagcgggggguaccugcugga

SEQ ID NO: 1549638 - RNA, 23 nt, Human adenovirus C
augcuauggaucuuaugccaggc

SEQ ID NO: 1549639 - RNA, 22 nt, Human adenovirus C
ucagggcgcgggcuagguccag

SEQ ID NO: 1549640 - RNA, 13 nt, Human adenovirus C
gccgccugcugca

SEQ ID NO: 1549641 - RNA, 16 nt, Human adenovirus C
cugcuugagcaggcca

SEQ ID NO: 1549642 - RNA, 18 nt, Human adenovirus C
ucuaugcccaggcuccuu

SEQ ID NO: 1549643 - RNA, 12 nt, Human adenovirus C
cgaccaggccgu

SEQ ID NO: 1549644 - RNA, 20 nt, Human adenovirus C
gcgaccgcgagcugaugcac

SEQ ID NO: 1549645 - RNA, 21 nt, Human adenovirus C
ggcacccaaaaagaagcugca

SEQ ID NO: 1549646 - RNA, 13 nt, Human adenovirus C
cgcgccgacacgg

SEQ ID NO: 1549647 - RNA, 11 nt, Human adenovirus C
auaccacugca

SEQ ID NO: 1549648 - RNA, 15 nt, Human adenovirus C
cugcgcgaggaggac

SEQ ID NO: 1549649 - RNA, 18 nt, Human adenovirus C
ugccaggaugcggggugg

SEQ ID NO: 1549650 - RNA, 11 nt, Human adenovirus C
ugucagccgcg

SEQ ID NO: 1549651 - RNA, 13 nt, Human adenovirus C
uaacagcacuggc

SEQ ID NO: 1549652 - RNA, 18 nt, Human adenovirus C
cagcgcgagcaggcagag

SEQ ID NO: 1549653 - RNA, 16 nt, Human adenovirus C
gcaucugcagcgccag

SEQ ID NO: 1549654 - RNA, 16 nt, Human adenovirus C
acgcccacgccgccac

SEQ ID NO: 1549655 - RNA, 15 nt, Human adenovirus C
gccccucgccauagc

SEQ ID NO: 1549656 - RNA, 13 nt, Human adenovirus C
aggccggccuggu

SEQ ID NO: 1549657 - RNA, 15 nt, Human adenovirus C
aguaccucuugguuu

SEQ ID NO: 1549658 - RNA, 21 nt, Human adenovirus C
ccacuucuuuuugucacuuga

SEQ ID NO: 1549659 - RNA, 14 nt, Human adenovirus C
uuucaccaaugcca

SEQ ID NO: 1549660 - RNA, 22 nt, Human adenovirus C
cgguagugggucuagcugcguc

SEQ ID NO: 1549661 - RNA, 13 nt, Human adenovirus C
acgcuggccagca

SEQ ID NO: 1549662 - RNA, 15 nt, Human adenovirus C
caccaggugcagacc

SEQ ID NO: 1549663 - RNA, 18 nt, Human adenovirus C
auuggacggucugaaacc

SEQ ID NO: 1549664 - RNA, 18 nt, Human adenovirus C
caguuggggccuccgccc

SEQ ID NO: 1549665 - RNA, 14 nt, Human adenovirus C
caugaagaucugga

SEQ ID NO: 1549666 - RNA, 23 nt, Human adenovirus C
cagcaauaacacaggcuggggcc

SEQ ID NO: 1549667 - RNA, 13 nt, Human adenovirus C
caaagcacacuga

SEQ ID NO: 1549668 - RNA, 19 nt, Human adenovirus C
cagagggcauggagacaca

SEQ ID NO: 1549669 - RNA, 19 nt, Human adenovirus C
cugcagguacgccugcagg

SEQ ID NO: 1549670 - RNA, 18 nt, Human adenovirus C
cuauccugccgugccaac

SEQ ID NO: 1549671 - RNA, 17 nt, Human adenovirus C
ggccuccgacugugguu

SEQ ID NO: 1549672 - RNA, 14 nt, Human adenovirus C
cgccgaaccaccac

SEQ ID NO: 1549673 - RNA, 22 nt, Human adenovirus C
guggacguaaaggcuaaacccu

SEQ ID NO: 1549674 - RNA, 20 nt, Human adenovirus C
gcaagcugauugccaggggc

SEQ ID NO: 1549675 - RNA, 19 nt, Human adenovirus C
ccauucaacuaacauaaac

SEQ ID NO: 1549676 - RNA, 20 nt, Human adenovirus C
uuggaaaaaaugaccgugga

SEQ ID NO: 1549677 - RNA, 21 nt, Human adenovirus C
caccggccgacgggcggccau

SEQ ID NO: 1549678 - RNA, 22 nt, Human adenovirus C
cggugaugccuuugaggguggc

SEQ ID NO: 1549679 - RNA, 22 nt, Human adenovirus C
caggucucugcgcucccucacc

SEQ ID NO: 1549680 - RNA, 23 nt, Human adenovirus C
cauggagucagucgagaaggagg

SEQ ID NO: 1549681 - RNA, 19 nt, Human adenovirus C
cuguggugagcuguuugau

SEQ ID NO: 1549682 - RNA, 19 nt, Human adenovirus C
gccuuuuacugcugcugga

SEQ ID NO: 1549683 - RNA, 22 nt, Human adenovirus C
ccaaucaaucagccucgccccc

SEQ ID NO: 1549684 - RNA, 18 nt, Human adenovirus C
ggcgccuucagcuggggc

SEQ ID NO: 1549685 - RNA, 13 nt, Human adenovirus C
aauauuggcuacc

SEQ ID NO: 1549686 - RNA, 20 nt, Human adenovirus C
caaaccccugacagaggaca

SEQ ID NO: 1549687 - RNA, 20 nt, Human adenovirus C
ggcuaagugggagggguagc

SEQ ID NO: 1549688 - RNA, 20 nt, Human adenovirus C
uacaugagcgcgggacccca

SEQ ID NO: 1549689 - RNA, 11 nt, Human adenovirus C
acgccaagaaa

SEQ ID NO: 1549690 - RNA, 12 nt, Human adenovirus C
cucgcuguggag

SEQ ID NO: 1549691 - RNA, 14 nt, Human adenovirus C
ggacacgggcagcc

SEQ ID NO: 1549692 - RNA, 23 nt, Human adenovirus C
cagcgugagcgcgcgcagcagca

SEQ ID NO: 1549693 - RNA, 15 nt, Human adenovirus C
cgacccggcacugcc

SEQ ID NO: 1549694 - RNA, 13 nt, Human adenovirus C
gcacuacugcccg

SEQ ID NO: 1549695 - RNA, 17 nt, Human adenovirus C
acaaggucaacgcuggu

SEQ ID NO: 1549696 - RNA, 13 nt, Human adenovirus C
ccuuuuacugcug

SEQ ID NO: 1549697 - RNA, 17 nt, Human adenovirus C
auuugaugcucaaacaa

SEQ ID NO: 1549698 - RNA, 18 nt, Human adenovirus C
accaugcgcgagggacag

SEQ ID NO: 1549699 - RNA, 13 nt, Human adenovirus C
aucggcaccagca

SEQ ID NO: 1549700 - RNA, 18 nt, Human adenovirus C
gcaccggcggcagcggca

SEQ ID NO: 1549701 - RNA, 12 nt, Human adenovirus C
agacaugaugca

SEQ ID NO: 1549702 - RNA, 15 nt, Human adenovirus C
uacagagacaggacu

SEQ ID NO: 1549703 - RNA, 13 nt, Human adenovirus C
agccggccuggac

SEQ ID NO: 1549704 - RNA, 14 nt, Human adenovirus C
auuugucacccuua

SEQ ID NO: 1549705 - RNA, 16 nt, Human adenovirus C
gacucgagacgccgcc

SEQ ID NO: 1549706 - RNA, 19 nt, Human adenovirus C
gcaaccuaaaggagcugca

SEQ ID NO: 1549707 - RNA, 22 nt, Human adenovirus C
gacaacgaggcauucagggaug

SEQ ID NO: 1549708 - RNA, 20 nt, Human adenovirus C
gaggcaagcacacagaccau

SEQ ID NO: 1549709 - RNA, 22 nt, Human adenovirus C
aggacgaugaguacgagccaga

SEQ ID NO: 1549710 - RNA, 23 nt, Human adenovirus C
agcgcauccacaaggccgugagc

SEQ ID NO: 1549711 - RNA, 24 nt, Human adenovirus C
cgccaaccgcgguugugcagggug

SEQ ID NO: 1549712 - RNA, 23 nt, Human adenovirus C
agguagcaccacugcagagcuuc

SEQ ID NO: 1549713 - RNA, 20 nt, Human adenovirus C
cugccggucuucgcccugcg

SEQ ID NO: 1549714 - RNA, 14 nt, Human adenovirus C
gucaucucugugcu

SEQ ID NO: 1549715 - RNA, 13 nt, Human adenovirus C
cuuccaaggugaa

SEQ ID NO: 1549716 - RNA, 23 nt, Human adenovirus C
aggaaccagccugugaugcugga

SEQ ID NO: 1549717 - RNA, 22 nt, Human adenovirus C
cccgacgccgaaccaccacugg

SEQ ID NO: 1549718 - RNA, 23 nt, Human adenovirus C
ggcagcagcggaugauccuccag

SEQ ID NO: 1549719 - RNA, 20 nt, Human adenovirus C
ccugaagcgccgacgaugcu

SEQ ID NO: 1549720 - RNA, 18 nt, Human adenovirus C
cccagcacucggcagaaa

SEQ ID NO: 1549721 - RNA, 17 nt, Human adenovirus C
aggcuugggaguguuug

SEQ ID NO: 1549722 - RNA, 19 nt, Human adenovirus C
ugcuuguauuccccuggac

SEQ ID NO: 1549723 - RNA, 17 nt, Human adenovirus C
gcccuggaggcagcugg

SEQ ID NO: 1549724 - RNA, 12 nt, Human adenovirus C
cagcagcuguug

SEQ ID NO: 1549725 - RNA, 12 nt, Human adenovirus C
ccaccaacgugc

SEQ ID NO: 1549726 - RNA, 14 nt, Human adenovirus C
caccgccuccaccg

SEQ ID NO: 1549727 - RNA, 13 nt, Human adenovirus C
cagcacagcaggg

SEQ ID NO: 1549728 - RNA, 13 nt, Human adenovirus C
ccggcggcggugg

SEQ ID NO: 1549729 - RNA, 21 nt, Human adenovirus C
cgggaagaacuggaucucccg

SEQ ID NO: 1549730 - RNA, 20 nt, Human adenovirus C
acuagcuacuguagcugcuu

SEQ ID NO: 1549731 - RNA, 12 nt, Human adenovirus C
gacgguggugcg

SEQ ID NO: 1549732 - RNA, 15 nt, Human adenovirus C
caaccguucccagca

SEQ ID NO: 1549733 - RNA, 17 nt, Human adenovirus C
cugcggcugcuguugcu

SEQ ID NO: 1549734 - RNA, 17 nt, Human adenovirus C
uugauauucaccuggcc

SEQ ID NO: 1549735 - RNA, 18 nt, Human adenovirus C
gcagaugggagcugucca

SEQ ID NO: 1549736 - RNA, 23 nt, Human adenovirus C
gcaaaacgcucgagaucaggcua

SEQ ID NO: 1549737 - RNA, 19 nt, Human adenovirus C
gccaccgagggaccugagc

SEQ ID NO: 1549738 - RNA, 15 nt, Human adenovirus C
aggguggccgcgucc

SEQ ID NO: 1549739 - RNA, 11 nt, Human adenovirus C
acugcugcugg

SEQ ID NO: 1549740 - RNA, 16 nt, Human adenovirus C
gcgucagaaugugaug

SEQ ID NO: 1549741 - RNA, 20 nt, Human adenovirus C
ggccccaaacucccauggau

SEQ ID NO: 1549742 - RNA, 10 nt, Human adenovirus C
cugcagagca

SEQ ID NO: 1549743 - RNA, 16 nt, Human adenovirus C
gccagcacgcucuugu

SEQ ID NO: 1549744 - RNA, 21 nt, Human adenovirus C
ugagcugcagggucccucgcc

SEQ ID NO: 1549745 - RNA, 14 nt, Human adenovirus C
ggagccugggcugg

SEQ ID NO: 1549746 - RNA, 21 nt, Human adenovirus C
gaagaccauucacguagccag

SEQ ID NO: 1549747 - RNA, 16 nt, Human adenovirus C
caccgcggaugcuggc

SEQ ID NO: 1549748 - RNA, 22 nt, Human adenovirus C
cgucgguguuggagaucugcac

SEQ ID NO: 1549749 - RNA, 16 nt, Human adenovirus C
ugugacgagucuucuu

SEQ ID NO: 1549750 - RNA, 22 nt, Human adenovirus C
aucgcuacaaccuccgcuccuc

SEQ ID NO: 1549751 - RNA, 13 nt, Human adenovirus C
cggcggcagcagc

SEQ ID NO: 1549752 - RNA, 18 nt, Human adenovirus C
agcucauggcggggacca

SEQ ID NO: 1549753 - RNA, 21 nt, Human adenovirus C
augucguaaacguagaggggc

SEQ ID NO: 1549754 - RNA, 14 nt, Human adenovirus C
gcaccccgcaccgc

SEQ ID NO: 1549755 - RNA, 22 nt, Human adenovirus C
cacaaccauccgcggcagcucg

SEQ ID NO: 1549756 - RNA, 17 nt, Human adenovirus C
auggccugaaccgcgag

SEQ ID NO: 1549757 - RNA, 16 nt, Human adenovirus C
ugaccgaggagcugag

SEQ ID NO: 1549758 - RNA, 21 nt, Human adenovirus C
acacugcagcaggugcugccc

SEQ ID NO: 1549759 - RNA, 20 nt, Human adenovirus C
cacuagugaauccacagaaa

SEQ ID NO: 1549760 - RNA, 15 nt, Human adenovirus C
gacgugguaaaggug

SEQ ID NO: 1549761 - RNA, 16 nt, Human adenovirus C
gucaucaagacuuugg

SEQ ID NO: 1549762 - RNA, 11 nt, Human adenovirus C
ggcggaggcgc

SEQ ID NO: 1549763 - RNA, 19 nt, Human adenovirus C
accgccuccaccgaugccg

SEQ ID NO: 1549764 - RNA, 16 nt, Human adenovirus C
ucgcguuucagccccc

SEQ ID NO: 1549765 - RNA, 14 nt, Human adenovirus C
ggagggccuacccg

SEQ ID NO: 1549766 - RNA, 16 nt, Human adenovirus C
ccuaaaaaugucuuuc

SEQ ID NO: 1549767 - RNA, 21 nt, Human adenovirus C
cacgaaggaggcguaggaguc

SEQ ID NO: 1549768 - RNA, 19 nt, Human adenovirus C
uaccggagugcugggccag

SEQ ID NO: 1549769 - RNA, 18 nt, Human adenovirus C
cugcagcugccgccgccg

SEQ ID NO: 1549770 - RNA, 20 nt, Human adenovirus C
cucaggcgccgccggcacug

SEQ ID NO: 1549771 - RNA, 20 nt, Human adenovirus C
agauaucggcaccagcaaua

SEQ ID NO: 1549772 - RNA, 21 nt, Human adenovirus C
ugaugcggaagggucccggca

SEQ ID NO: 1549773 - RNA, 19 nt, Human adenovirus C
cgccgucgccagcccgugc

SEQ ID NO: 1549774 - RNA, 12 nt, Human adenovirus C
agcaccaugucc

SEQ ID NO: 1549775 - RNA, 15 nt, Human adenovirus C
uaaaugagacaugau

SEQ ID NO: 1549776 - RNA, 16 nt, Human adenovirus C
caggggccaagaacaa

SEQ ID NO: 1549777 - RNA, 22 nt, Human adenovirus C
ggcacccaaaaagaagcugcag

SEQ ID NO: 1549778 - RNA, 15 nt, Human adenovirus C
ggcuggcgguggcac

SEQ ID NO: 1549779 - RNA, 15 nt, Human adenovirus C
aggagcugcagaagc

SEQ ID NO: 1549780 - RNA, 16 nt, Human adenovirus C
gcaccgggaggcgguc

SEQ ID NO: 1549781 - RNA, 14 nt, Human adenovirus C
accugcgcugggcc

SEQ ID NO: 1549782 - RNA, 15 nt, Human adenovirus C
gcagcgcgaaaagaa

SEQ ID NO: 1549783 - RNA, 20 nt, Human adenovirus C
cuggcgguagaggggccagc

SEQ ID NO: 1549784 - RNA, 15 nt, Human adenovirus C
gaggccgaggcagcg

SEQ ID NO: 1549785 - RNA, 19 nt, Human adenovirus C
cguaggagucgcgcagcuu

SEQ ID NO: 1549786 - RNA, 21 nt, Human adenovirus C
gcgcgcugaggccgaggcagc

SEQ ID NO: 1549787 - RNA, 12 nt, Human adenovirus C
cuaauggcaaug

SEQ ID NO: 1549788 - RNA, 21 nt, Human adenovirus C
cggccaugaacugcucgaucu

SEQ ID NO: 1549789 - RNA, 19 nt, Human adenovirus C
ccuccucagcagcggcaag

SEQ ID NO: 1549790 - RNA, 22 nt, Human adenovirus C
aaauauguggccgggggugcuu

SEQ ID NO: 1549791 - RNA, 18 nt, Human adenovirus C
acgaggaggaggagauga

SEQ ID NO: 1549792 - RNA, 11 nt, Human adenovirus C
gcgccagcacc

SEQ ID NO: 1549793 - RNA, 21 nt, Human adenovirus C
gcaaggccuggaacagcagca

SEQ ID NO: 1549794 - RNA, 19 nt, Human adenovirus C
ucagacaaugcagaaacac

SEQ ID NO: 1549795 - RNA, 17 nt, Human adenovirus C
ugucagccgcgcgcugg

SEQ ID NO: 1549796 - RNA, 21 nt, Human adenovirus C
cacucuguaugcuauauuuca

SEQ ID NO: 1549797 - RNA, 16 nt, Human adenovirus C
ugcuaccucuuugagc

SEQ ID NO: 1549798 - RNA, 15 nt, Human adenovirus C
gcuggcgcgcacgua

SEQ ID NO: 1549799 - RNA, 15 nt, Human adenovirus C
agggucaugucuuuc

SEQ ID NO: 1549800 - RNA, 16 nt, Human adenovirus C
gagcgacgaccugggc

SEQ ID NO: 1549801 - RNA, 16 nt, Human adenovirus C
ccccagguccaggcga

SEQ ID NO: 1549802 - RNA, 20 nt, Human adenovirus C
acucuuccuuuuccucuugc

SEQ ID NO: 1549803 - RNA, 18 nt, Human adenovirus C
uaagcauugcuacuaaag

SEQ ID NO: 1549804 - RNA, 19 nt, Human adenovirus C
ugccgucaucccugagcag

SEQ ID NO: 1549805 - RNA, 22 nt, Human adenovirus C
cguucagauacccaccaccagu

SEQ ID NO: 1549806 - RNA, 23 nt, Human adenovirus C
caguaguauagccccaccaccac

SEQ ID NO: 1549807 - RNA, 14 nt, Human adenovirus C
cagcgaugugcccc

SEQ ID NO: 1549808 - RNA, 18 nt, Human adenovirus C
cacgcccacgccgccacc

SEQ ID NO: 1549809 - RNA, 19 nt, Human adenovirus C
guccggcucaccacccagg

SEQ ID NO: 1549810 - RNA, 16 nt, Human adenovirus C
aggcgcaaggcggcgu

SEQ ID NO: 1549811 - RNA, 13 nt, Human adenovirus C
ccaguggagaggc

SEQ ID NO: 1549812 - RNA, 21 nt, Human adenovirus C
gaagauacagauugagguacu

SEQ ID NO: 1549813 - RNA, 21 nt, Human adenovirus C
agugcaaaauaagauuaacag

SEQ ID NO: 1549814 - RNA, 15 nt, Human adenovirus C
ggccaugagcugcga

SEQ ID NO: 1549815 - RNA, 13 nt, Human adenovirus C
cuucauucagccg

SEQ ID NO: 1549816 - RNA, 20 nt, Human adenovirus C
cuguaacgcuggaccugccu

SEQ ID NO: 1549817 - RNA, 18 nt, Human adenovirus C
augcuaaaaugaagagac

SEQ ID NO: 1549818 - RNA, 17 nt, Human adenovirus C
acuguuacucagccacu

SEQ ID NO: 1549819 - RNA, 19 nt, Human adenovirus C
cugacgcguuccggcagca

SEQ ID NO: 1549820 - RNA, 16 nt, Human adenovirus C
ccggagugcugggcca

SEQ ID NO: 1549821 - RNA, 15 nt, Human adenovirus C
uucuauggguuuaac

SEQ ID NO: 1549822 - RNA, 21 nt, Human adenovirus C
caguuccaggcggucccacag

SEQ ID NO: 1549823 - RNA, 18 nt, Human adenovirus C
ccauagcggaugucagcc

SEQ ID NO: 1549824 - RNA, 22 nt, Human adenovirus C
ggcucuccgcaauucuggaagc

SEQ ID NO: 1549825 - RNA, 15 nt, Human adenovirus C
agccgcgcuccggag

SEQ ID NO: 1549826 - RNA, 16 nt, Human adenovirus C
aucuggagaucuuuca

SEQ ID NO: 1549827 - RNA, 15 nt, Human adenovirus C
cugcgccgugccgcc

SEQ ID NO: 1549828 - RNA, 18 nt, Human adenovirus C
cggucucggucguugagg

SEQ ID NO: 1549829 - RNA, 18 nt, Human adenovirus C
accagacauuacucccau

SEQ ID NO: 1549830 - RNA, 18 nt, Human adenovirus C
gaucuuaugccaggccua

SEQ ID NO: 1549831 - RNA, 13 nt, Human adenovirus C
gggagaggagccc

SEQ ID NO: 1549832 - RNA, 23 nt, Human adenovirus C
uguuaacaugguucugcagagcu

SEQ ID NO: 1549833 - RNA, 18 nt, Human adenovirus C
aaaagaagcaagcaacau

SEQ ID NO: 1549834 - RNA, 22 nt, Human adenovirus C
agcagcagggcaaccugggcuc

SEQ ID NO: 1549835 - RNA, 15 nt, Human adenovirus C
gugcgcuuaccuccc

SEQ ID NO: 1549836 - RNA, 14 nt, Human adenovirus C
gugcccgcugucau

SEQ ID NO: 1549837 - RNA, 23 nt, Human adenovirus C
acuucaggaaggauguuaacaug

SEQ ID NO: 1549838 - RNA, 14 nt, Human adenovirus C
ugcacugcagggaa

SEQ ID NO: 1549839 - RNA, 12 nt, Human adenovirus C
aacuuugccaug

SEQ ID NO: 1549840 - RNA, 19 nt, Human adenovirus C
uggggcuccucccaggcaa

SEQ ID NO: 1549841 - RNA, 19 nt, Human adenovirus C
acgcggguuuggcagggcg

SEQ ID NO: 1549842 - RNA, 19 nt, Human adenovirus C
gaaauuaaccuaaaugcca

SEQ ID NO: 1549843 - RNA, 11 nt, Human adenovirus C
ucaccagcaua

SEQ ID NO: 1549844 - RNA, 14 nt, Human adenovirus C
ggcagccuggaggc

SEQ ID NO: 1549845 - RNA, 20 nt, Human adenovirus C
caacauaaaagaagcaagca

SEQ ID NO: 1549846 - RNA, 22 nt, Human adenovirus C
gcgcuggcaacgucggcggcgu

SEQ ID NO: 1549847 - RNA, 14 nt, Human adenovirus C
gccuguugcugcug

SEQ ID NO: 1549848 - RNA, 21 nt, Human adenovirus C
ccauuuguagcgccacaucuu

SEQ ID NO: 1549849 - RNA, 23 nt, Human adenovirus C
aucugagcgggggguaccugcug

SEQ ID NO: 1549850 - RNA, 15 nt, Human adenovirus C
ucaaacucacagaac

SEQ ID NO: 1549851 - RNA, 18 nt, Human adenovirus C
accuucuuccccauggcc

SEQ ID NO: 1549852 - RNA, 12 nt, Human adenovirus C
ugcggcugcugu

SEQ ID NO: 1549853 - RNA, 21 nt, Human adenovirus C
aagccgcucauggcgcagcug

SEQ ID NO: 1549854 - RNA, 22 nt, Human adenovirus C
gcagcuggggccggaccugggc

SEQ ID NO: 1549855 - RNA, 20 nt, Human adenovirus C
aaugccauagaugccaugaa

SEQ ID NO: 1549856 - RNA, 22 nt, Human adenovirus C
gguaguuaagagagcugcagcu

SEQ ID NO: 1549857 - RNA, 13 nt, Human adenovirus C
guauccugccccu

SEQ ID NO: 1549858 - RNA, 22 nt, Human adenovirus C
cagccuggaggcaacccugaac

SEQ ID NO: 1549859 - RNA, 21 nt, Human adenovirus C
ccgccucgggcaaaacgugcu

SEQ ID NO: 1549860 - RNA, 13 nt, Human adenovirus C
ucgccccaucauc

SEQ ID NO: 1549861 - RNA, 15 nt, Human adenovirus C
acaacagcugccgcc

SEQ ID NO: 1549862 - RNA, 14 nt, Human adenovirus C
agaaacacagagcu

SEQ ID NO: 1549863 - RNA, 19 nt, Human adenovirus C
acugcucgaucucuuccuc

SEQ ID NO: 1549864 - RNA, 17 nt, Human adenovirus C
cgauauuaccauguaca

SEQ ID NO: 1549865 - RNA, 19 nt, Human adenovirus C
aaccccaccaauguggaaa

SEQ ID NO: 1549866 - RNA, 16 nt, Human adenovirus C
ccuugcuucccaggau

SEQ ID NO: 1549867 - RNA, 23 nt, Human adenovirus C
aaacuuuuauguauaaauuucca

SEQ ID NO: 1549868 - RNA, 17 nt, Human adenovirus C
aacuacaccgucaagaa

SEQ ID NO: 1549869 - RNA, 20 nt, Human adenovirus C
cuggcggacauuaucuuccc

SEQ ID NO: 1549870 - RNA, 15 nt, Human adenovirus C
ggcauaagcccgucu

SEQ ID NO: 1549871 - RNA, 15 nt, Human adenovirus C
agagagcugcagcug

SEQ ID NO: 1549872 - RNA, 18 nt, Human adenovirus C
gccccguccugcccgcaa

SEQ ID NO: 1549873 - RNA, 14 nt, Human adenovirus C
gccgccgcagcccu

SEQ ID NO: 1549874 - RNA, 22 nt, Human adenovirus C
ccaggcuuugaguugcacucgc

SEQ ID NO: 1549875 - RNA, 20 nt, Human adenovirus C
gucgcaccggccgacgggcg

SEQ ID NO: 1549876 - RNA, 17 nt, Human adenovirus C
cucguccagacgggcca

SEQ ID NO: 1549877 - RNA, 14 nt, Human adenovirus C
cggcucgcgcccgu

SEQ ID NO: 1549878 - RNA, 17 nt, Human adenovirus C
ccaaacgccaagaaaac

SEQ ID NO: 1549879 - RNA, 19 nt, Human adenovirus C
ccacagcggcggcagcagc

SEQ ID NO: 1549880 - RNA, 13 nt, Human adenovirus C
cgcgcaacuacac

SEQ ID NO: 1549881 - RNA, 18 nt, Human adenovirus C
gcggccuaaagcgcgagu

SEQ ID NO: 1549882 - RNA, 20 nt, Human adenovirus C
gaugugaccgaggagcugag

SEQ ID NO: 1549883 - RNA, 16 nt, Human adenovirus C
cagccgccgcaccgug

SEQ ID NO: 1549884 - RNA, 14 nt, Human adenovirus C
ggaugauccuccag

SEQ ID NO: 1549885 - RNA, 22 nt, Human adenovirus C
gcgcggggaggcggcggcgacg

SEQ ID NO: 1549886 - RNA, 16 nt, Human adenovirus C
gcauagccgggucagg

SEQ ID NO: 1549887 - RNA, 12 nt, Human adenovirus C
gggaggcggcgg

SEQ ID NO: 1549888 - RNA, 19 nt, Human adenovirus C
agcuaaaauacaaccccac

SEQ ID NO: 1549889 - RNA, 12 nt, Human adenovirus C
gccaaguacaga

SEQ ID NO: 1549890 - RNA, 21 nt, Human adenovirus C
cgucauaguuguguuccagga

SEQ ID NO: 1549891 - RNA, 15 nt, Human adenovirus C
gcggcagcggcagcg

SEQ ID NO: 1549892 - RNA, 22 nt, Human adenovirus C
uggcaaccaccgcuccucugau

SEQ ID NO: 1549893 - RNA, 18 nt, Human adenovirus C
cggucguugaggguccug

SEQ ID NO: 1549894 - RNA, 21 nt, Human adenovirus C
ggggcaacaucuccuucgccc

SEQ ID NO: 1549895 - RNA, 23 nt, Human adenovirus C
ggacgucgcgccgcaccgcgucc

SEQ ID NO: 1549896 - RNA, 16 nt, Human adenovirus C
gguggcucccgggcuu

SEQ ID NO: 1549897 - RNA, 17 nt, Human adenovirus C
uccucgaguucuuauau

SEQ ID NO: 1549898 - RNA, 17 nt, Human adenovirus C
ugcgacccggcaccacc

SEQ ID NO: 1549899 - RNA, 16 nt, Human adenovirus C
uuguuucuccacacaa

SEQ ID NO: 1549900 - RNA, 15 nt, Human adenovirus C
ggcaacgugcagacc

SEQ ID NO: 1549901 - RNA, 18 nt, Human adenovirus C
cacgcacgaaggaggcgu

SEQ ID NO: 1549902 - RNA, 14 nt, Human adenovirus C
aacgcaccgccauu

SEQ ID NO: 1549903 - RNA, 19 nt, Human adenovirus C
cgguaccuuugagcugcag

SEQ ID NO: 1549904 - RNA, 17 nt, Human adenovirus C
gcuuuccaagauggcua

SEQ ID NO: 1549905 - RNA, 17 nt, Human adenovirus C
ccguucgcacuggggcg

SEQ ID NO: 1549906 - RNA, 23 nt, Human adenovirus C
uggcagcaaggccuggaacagca

SEQ ID NO: 1549907 - RNA, 18 nt, Human adenovirus C
accuaugacaagcgcuuu

SEQ ID NO: 1549908 - RNA, 23 nt, Human adenovirus C
aguuccucguaggugagcuccuc

SEQ ID NO: 1549909 - RNA, 16 nt, Human adenovirus C
cccgccaacgccacca

SEQ ID NO: 1549910 - RNA, 15 nt, Human adenovirus C
gguggucuucuacuu

SEQ ID NO: 1549911 - RNA, 13 nt, Human adenovirus C
cagccgcaggcca

SEQ ID NO: 1549912 - RNA, 14 nt, Human adenovirus C
aggugcccgagggu

SEQ ID NO: 1549913 - RNA, 23 nt, Human adenovirus C
gcaccuaugacaagcgcuuucca

SEQ ID NO: 1549914 - RNA, 15 nt, Human adenovirus C
guucugcgagucaca

SEQ ID NO: 1549915 - RNA, 20 nt, Human adenovirus C
ggcagcaaugccuggaggag

SEQ ID NO: 1549916 - RNA, 20 nt, Human adenovirus C
cuauguugggucaacaaucu

SEQ ID NO: 1549917 - RNA, 13 nt, Human adenovirus C
caaccgcgcccag

SEQ ID NO: 1549918 - RNA, 16 nt, Human adenovirus C
ggaaagacgguggugc

SEQ ID NO: 1549919 - RNA, 14 nt, Human adenovirus C
agaagcgcuccgac

SEQ ID NO: 1549920 - RNA, 18 nt, Human adenovirus C
ugcucccaaaccucagcg

SEQ ID NO: 1549921 - RNA, 17 nt, Human adenovirus C
gguggucgcgaaagguc

SEQ ID NO: 1549922 - RNA, 18 nt, Human adenovirus C
ggcccacaacacggccuc

SEQ ID NO: 1549923 - RNA, 12 nt, Human adenovirus C
cgucuggcugcu

SEQ ID NO: 1549924 - RNA, 18 nt, Human adenovirus C
cgcugucugcgagggcca

SEQ ID NO: 1549925 - RNA, 15 nt, Human adenovirus C
accaucaaucuugac

SEQ ID NO: 1549926 - RNA, 14 nt, Human adenovirus C
acagcgcgagcagg

SEQ ID NO: 1549927 - RNA, 14 nt, Human adenovirus C
accugcggggcgau

SEQ ID NO: 1549928 - RNA, 16 nt, Human adenovirus C
acugcuccuucagcgc

SEQ ID NO: 1549929 - RNA, 20 nt, Human adenovirus C
gcauggucucggugacggcg

SEQ ID NO: 1549930 - RNA, 14 nt, Human adenovirus C
aaugcaucaaacaa

SEQ ID NO: 1549931 - RNA, 21 nt, Human adenovirus C
uggcaaugggcccacgggcgg

SEQ ID NO: 1549932 - RNA, 22 nt, Human adenovirus C
ugagacccgcaccaggugcaga

SEQ ID NO: 1549933 - RNA, 17 nt, Human adenovirus C
acccuccucaccugccg

SEQ ID NO: 1549934 - RNA, 11 nt, Human adenovirus C
ggcccacgggc

SEQ ID NO: 1549935 - RNA, 17 nt, Human adenovirus C
ucugacaaagcccaaga

SEQ ID NO: 1549936 - RNA, 20 nt, Human adenovirus C
cuuuggggucacugcuaccu

SEQ ID NO: 1549937 - RNA, 22 nt, Human adenovirus C
caacccaauccccccgccgccg

SEQ ID NO: 1549938 - RNA, 18 nt, Human adenovirus C
cucugcagaccucguccu

SEQ ID NO: 1549939 - RNA, 22 nt, Human adenovirus C
gccaugcucagaaaugacacca

SEQ ID NO: 1549940 - RNA, 16 nt, Human adenovirus C
gcccuuggcgcgcagc

SEQ ID NO: 1549941 - RNA, 14 nt, Human adenovirus C
ucacaagccccacu

SEQ ID NO: 1549942 - RNA, 16 nt, Human adenovirus C
uuauacccacaaccuu

SEQ ID NO: 1549943 - RNA, 15 nt, Human adenovirus C
ccugcggggcgauga

SEQ ID NO: 1549944 - RNA, 14 nt, Human adenovirus C
acggccuacuggag

SEQ ID NO: 1549945 - RNA, 16 nt, Human adenovirus C
cgcagaugggagcugu

SEQ ID NO: 1549946 - RNA, 23 nt, Human adenovirus C
auuaccauguacaugagcaaaca

SEQ ID NO: 1549947 - RNA, 22 nt, Human adenovirus C
ccgugugcaccagccgcaccgc

SEQ ID NO: 1549948 - RNA, 22 nt, Human adenovirus C
aggcggucuugagacggcggau

SEQ ID NO: 1549949 - RNA, 15 nt, Human adenovirus C
aguccacaaaaaaca

SEQ ID NO: 1549950 - RNA, 13 nt, Human adenovirus C
ggcucaccaccca

SEQ ID NO: 1549951 - RNA, 20 nt, Human adenovirus C
cauaaguuuggacaccuccg

SEQ ID NO: 1549952 - RNA, 16 nt, Human adenovirus C
caugcucagucugggc

SEQ ID NO: 1549953 - RNA, 10 nt, Human adenovirus C
gaucaggcua

SEQ ID NO: 1549954 - RNA, 21 nt, Human adenovirus C
acccagcacucggcagaaaca

SEQ ID NO: 1549955 - RNA, 13 nt, Human adenovirus C
guacaguggaaag

SEQ ID NO: 1549956 - RNA, 16 nt, Human adenovirus C
gcucgagaucaggcua

SEQ ID NO: 1549957 - RNA, 17 nt, Human adenovirus C
gauggaagacugggaca

SEQ ID NO: 1549958 - RNA, 20 nt, Human adenovirus C
uaggcgcucguugguccagc

SEQ ID NO: 1549959 - RNA, 14 nt, Human adenovirus C
ucaucccugagcag

SEQ ID NO: 1549960 - RNA, 23 nt, Human adenovirus C
ccgcggugaugccuuugagggug

SEQ ID NO: 1549961 - RNA, 17 nt, Human adenovirus C
cccuuucuuaccccucc

SEQ ID NO: 1549962 - RNA, 14 nt, Human adenovirus C
uucuaaagcuaugu

SEQ ID NO: 1549963 - RNA, 19 nt, Human adenovirus C
uuacuuauuucugugcuac

SEQ ID NO: 1549964 - RNA, 15 nt, Human adenovirus C
gagcgcuccacccgc

SEQ ID NO: 1549965 - RNA, 18 nt, Human adenovirus C
gacgcguuccggcagcag

SEQ ID NO: 1549966 - RNA, 23 nt, Human adenovirus C
cagaccguaaaccugagccaggc

SEQ ID NO: 1549967 - RNA, 13 nt, Human adenovirus C
gagcagacgguga

SEQ ID NO: 1549968 - RNA, 21 nt, Human adenovirus C
aucagauccgcguccaggucc

SEQ ID NO: 1549969 - RNA, 14 nt, Human adenovirus C
gagagggggcaggg

SEQ ID NO: 1549970 - RNA, 14 nt, Human adenovirus C
cggagaugcagcgc

SEQ ID NO: 1549971 - RNA, 14 nt, Human adenovirus C
gacaaagcccaaga

SEQ ID NO: 1549972 - RNA, 21 nt, Human adenovirus C
uugcauguuuucccugaccaa

SEQ ID NO: 1549973 - RNA, 19 nt, Human adenovirus C
cauguaugcguccaugucg

SEQ ID NO: 1549974 - RNA, 15 nt, Human adenovirus C
cagcaggugcugccc

SEQ ID NO: 1549975 - RNA, 10 nt, Human adenovirus C
uguccuugga

SEQ ID NO: 1549976 - RNA, 14 nt, Human adenovirus C
auucagauaaugac

SEQ ID NO: 1549977 - RNA, 19 nt, Human adenovirus C
ccgcgcacgucgcaccggc

SEQ ID NO: 1549978 - RNA, 12 nt, Human adenovirus C
augagcgcggga

SEQ ID NO: 1549979 - RNA, 17 nt, Human adenovirus C
ugaugggcuccagcauu

SEQ ID NO: 1549980 - RNA, 19 nt, Human adenovirus C
cgcacgaggggcagugcag

SEQ ID NO: 1549981 - RNA, 17 nt, Human adenovirus C
ucauuuguaauuuacaa

SEQ ID NO: 1549982 - RNA, 17 nt, Human adenovirus C
gaaaccugugcugccag

SEQ ID NO: 1549983 - RNA, 15 nt, Human adenovirus C
acgucuuaaacuggg

SEQ ID NO: 1549984 - RNA, 17 nt, Human adenovirus C
aaaaugugggagucaag

SEQ ID NO: 1549985 - RNA, 23 nt, Human adenovirus C
accagauauuuuucuauguggaa

SEQ ID NO: 1549986 - RNA, 19 nt, Human adenovirus C
cagucaugagcgagcugau

SEQ ID NO: 1549987 - RNA, 21 nt, Human adenovirus C
gagcgcaaccuaaaggagcug

SEQ ID NO: 1549988 - RNA, 12 nt, Human adenovirus C
aaauagcaagcc

SEQ ID NO: 1549989 - RNA, 22 nt, Human adenovirus C
agguggcaccgggacugggcgu

SEQ ID NO: 1549990 - RNA, 15 nt, Human adenovirus C
ugugaguuggaugau

SEQ ID NO: 1549991 - RNA, 15 nt, Human adenovirus C
caccagcauaacaac

SEQ ID NO: 1549992 - RNA, 15 nt, Human adenovirus C
ccucccuugccgugc

SEQ ID NO: 1549993 - RNA, 23 nt, Human adenovirus C
uaguuucgcgcccuuucucaaau

SEQ ID NO: 1549994 - RNA, 16 nt, Human adenovirus C
cucagugcaacaugac

SEQ ID NO: 1549995 - RNA, 23 nt, Human adenovirus C
cgccugacgaaaaguccgcggcu

SEQ ID NO: 1549996 - RNA, 14 nt, Human adenovirus C
gagcuuagaaauag

SEQ ID NO: 1549997 - RNA, 16 nt, Human adenovirus C
ucagccgcugcagcca

SEQ ID NO: 1549998 - RNA, 15 nt, Human adenovirus C
acagcaggaggaagc

SEQ ID NO: 1549999 - RNA, 17 nt, Human adenovirus C
gaaaaguccgcggcucc

SEQ ID NO: 1550000 - RNA, 20 nt, Human adenovirus C
ggcgcaggguccucgucagc

SEQ ID NO: 1550001 - RNA, 17 nt, Human adenovirus C
ucuggaaggugcugagg

SEQ ID NO: 1550002 - RNA, 19 nt, Human adenovirus C
cuccagagcgcccuccacc

SEQ ID NO: 1550003 - RNA, 13 nt, Human adenovirus C
uugaacaaaacuc

SEQ ID NO: 1550004 - RNA, 20 nt, Human adenovirus C
cgggcggcgcugcagagcca

SEQ ID NO: 1550005 - RNA, 16 nt, Human adenovirus C
cgccuguugcugcugc

SEQ ID NO: 1550006 - RNA, 15 nt, Human adenovirus C
caguucauugacugg

SEQ ID NO: 1550007 - RNA, 22 nt, Human adenovirus C
ugggaauuugaagagcuuuuga

SEQ ID NO: 1550008 - RNA, 21 nt, Human adenovirus C
agcagcggaugauccuccagu

SEQ ID NO: 1550009 - RNA, 17 nt, Human adenovirus C
uaaagcaaggccugccc

SEQ ID NO: 1550010 - RNA, 14 nt, Human adenovirus C
gugcccuugaugga

SEQ ID NO: 1550011 - RNA, 20 nt, Human adenovirus C
agcuugccugcuccagagau

SEQ ID NO: 1550012 - RNA, 13 nt, Human adenovirus C
ccaccacuggaac

SEQ ID NO: 1550013 - RNA, 13 nt, Human adenovirus C
gcagggccagcug

SEQ ID NO: 1550014 - RNA, 14 nt, Human adenovirus C
aacucaccugaaaa

SEQ ID NO: 1550015 - RNA, 20 nt, Human adenovirus C
ucugacaaccccaacaccua

SEQ ID NO: 1550016 - RNA, 13 nt, Human adenovirus C
uggggcaggagga

SEQ ID NO: 1550017 - RNA, 18 nt, Human adenovirus C
agacaccguccugagugu

SEQ ID NO: 1550018 - RNA, 20 nt, Human adenovirus C
acgcccggugagcgcuccac

SEQ ID NO: 1550019 - RNA, 21 nt, Human adenovirus C
gcuccuuugucuggagaaaca

SEQ ID NO: 1550020 - RNA, 22 nt, Human adenovirus C
ggccggaaaccucaccucccaa

SEQ ID NO: 1550021 - RNA, 22 nt, Human adenovirus C
ucagccacuuaaaaaaacaaag

SEQ ID NO: 1550022 - RNA, 14 nt, Human adenovirus C
caggcgccgccggc

SEQ ID NO: 1550023 - RNA, 15 nt, Human adenovirus C
acuucacccacagcc

SEQ ID NO: 1550024 - RNA, 22 nt, Human adenovirus C
cgcgcaugcccccaugggccgg

SEQ ID NO: 1550025 - RNA, 23 nt, Human adenovirus C
cugacgccagacgccgcaccugc

SEQ ID NO: 1550026 - RNA, 19 nt, Human adenovirus C
uccuuggccaauugcaagc

SEQ ID NO: 1550027 - RNA, 21 nt, Human adenovirus C
gcaccagcucaaucagucaca

SEQ ID NO: 1550028 - RNA, 20 nt, Human adenovirus C
cagagcgauuugucagaagc

SEQ ID NO: 1550029 - RNA, 16 nt, Human adenovirus C
caguggacgcggccau

SEQ ID NO: 1550030 - RNA, 22 nt, Human adenovirus C
ugccuccgcgguaccugcggcc

SEQ ID NO: 1550031 - RNA, 14 nt, Human adenovirus C
gcgagggccagcug

SEQ ID NO: 1550032 - RNA, 14 nt, Human adenovirus C
uccgcauaccccgc

SEQ ID NO: 1550033 - RNA, 18 nt, Human adenovirus C
uagcaggucgggcgccga

SEQ ID NO: 1550034 - RNA, 17 nt, Human adenovirus C
cuccaccgaugccgcca

SEQ ID NO: 1550035 - RNA, 19 nt, Human adenovirus C
ccuuugaguucgccaccac

SEQ ID NO: 1550036 - RNA, 22 nt, Human adenovirus C
cgcccugcgcgucggccaggua

SEQ ID NO: 1550037 - RNA, 19 nt, Human adenovirus C
cggcugaagcagggccagg

SEQ ID NO: 1550038 - RNA, 16 nt, Human adenovirus C
ucaaauacaaaagcag

SEQ ID NO: 1550039 - RNA, 21 nt, Human adenovirus C
cgcacggcguccggcucacca

SEQ ID NO: 1550040 - RNA, 17 nt, Human adenovirus C
gagaauguuuuaaaaaa

SEQ ID NO: 1550041 - RNA, 15 nt, Human adenovirus C
ccacaacgcgcagcc

SEQ ID NO: 1550042 - RNA, 18 nt, Human adenovirus C
ggcggcaggagcagagcc

SEQ ID NO: 1550043 - RNA, 14 nt, Human adenovirus C
cccacagcucgguc

SEQ ID NO: 1550044 - RNA, 17 nt, Human adenovirus C
uugcgcuaugugcagca

SEQ ID NO: 1550045 - RNA, 16 nt, Human adenovirus C
uccacucgcuccaggg

SEQ ID NO: 1550046 - RNA, 17 nt, Human adenovirus C
gcaacuuguugggcauc

SEQ ID NO: 1550047 - RNA, 23 nt, Human adenovirus C
gccuugccuacgaacgccaccug

SEQ ID NO: 1550048 - RNA, 15 nt, Human adenovirus C
acucacuccggggcu

SEQ ID NO: 1550049 - RNA, 18 nt, Human adenovirus C
cgcucguugguccagcag

SEQ ID NO: 1550050 - RNA, 14 nt, Human adenovirus C
ccaguuggaggagu

SEQ ID NO: 1550051 - RNA, 14 nt, Human adenovirus C
agccggcggcgcga

SEQ ID NO: 1550052 - RNA, 18 nt, Human adenovirus C
ucaaaggcuacaggggcc

SEQ ID NO: 1550053 - RNA, 14 nt, Human adenovirus C
agcgaguccgcauc

SEQ ID NO: 1550054 - RNA, 20 nt, Human adenovirus C
caguggaacgaagcugaugc

SEQ ID NO: 1550055 - RNA, 22 nt, Human adenovirus C
aaccuccuccuccugccaggcu

SEQ ID NO: 1550056 - RNA, 13 nt, Human adenovirus C
gcgguggcacccg

SEQ ID NO: 1550057 - RNA, 18 nt, Human adenovirus C
uccaaacuaagcauugcu

SEQ ID NO: 1550058 - RNA, 21 nt, Human adenovirus C
acgaggaggaauacugggaca

SEQ ID NO: 1550059 - RNA, 20 nt, Human adenovirus C
uccgcguccagguccuccgc

SEQ ID NO: 1550060 - RNA, 15 nt, Human adenovirus C
ugagccccgggcugg

SEQ ID NO: 1550061 - RNA, 21 nt, Human adenovirus C
gcuccuuuuggcuuccuucca

SEQ ID NO: 1550062 - RNA, 15 nt, Human adenovirus C
ucacccgcagcugcc

SEQ ID NO: 1550063 - RNA, 15 nt, Human adenovirus C
cuccuccugccaggc

SEQ ID NO: 1550064 - RNA, 14 nt, Human adenovirus C
agcgcgcuggagca

SEQ ID NO: 1550065 - RNA, 16 nt, Human adenovirus C
acgcgcccuggaggca

SEQ ID NO: 1550066 - RNA, 17 nt, Human adenovirus C
ugagcucaacucccgga

SEQ ID NO: 1550067 - RNA, 19 nt, Human adenovirus C
acacgggaggagcgggaag

SEQ ID NO: 1550068 - RNA, 20 nt, Human adenovirus C
gcagcggcgcggaagagaac

SEQ ID NO: 1550069 - RNA, 15 nt, Human adenovirus C
ggcgcagagacacug

SEQ ID NO: 1550070 - RNA, 19 nt, Human adenovirus C
gcccuuucuuaccccucca

SEQ ID NO: 1550071 - RNA, 18 nt, Human adenovirus C
auucgcaccgcccgcagc

SEQ ID NO: 1550072 - RNA, 17 nt, Human adenovirus C
ugagacgaaggcucgcg

SEQ ID NO: 1550073 - RNA, 22 nt, Human adenovirus C
caggacgccucggaguaccuga

SEQ ID NO: 1550074 - RNA, 11 nt, Human adenovirus C
acccuccccuu

SEQ ID NO: 1550075 - RNA, 16 nt, Human adenovirus C
gccucucagaugcuga

SEQ ID NO: 1550076 - RNA, 17 nt, Human adenovirus C
agcccgagggccgcugg

SEQ ID NO: 1550077 - RNA, 17 nt, Human adenovirus C
ggguaacagacauauuc

SEQ ID NO: 1550078 - RNA, 22 nt, Human adenovirus C
ugagguggaucccauggacgag

SEQ ID NO: 1550079 - RNA, 22 nt, Human adenovirus C
ccguucaugggaaacuggcaag

SEQ ID NO: 1550080 - RNA, 20 nt, Human adenovirus C
auaugguuggacgcuggaag

SEQ ID NO: 1550081 - RNA, 22 nt, Human adenovirus C
cgcuugcaagcagugcagcuuc

SEQ ID NO: 1550082 - RNA, 18 nt, Human adenovirus C
gagcgcagcuugagccug

SEQ ID NO: 1550083 - RNA, 18 nt, Human adenovirus C
agcauacuuuccaggaga

SEQ ID NO: 1550084 - RNA, 23 nt, Human adenovirus C
ucauguucuugucccuccgcacc

SEQ ID NO: 1550085 - RNA, 16 nt, Human adenovirus C
guggcgguguguucug

SEQ ID NO: 1550086 - RNA, 17 nt, Human adenovirus C
gcgcucccucacccgca

SEQ ID NO: 1550087 - RNA, 17 nt, Human adenovirus C
acgggcgggcugcucug

SEQ ID NO: 1550088 - RNA, 16 nt, Human adenovirus C
uccccuuaguaugcag

SEQ ID NO: 1550089 - RNA, 17 nt, Human adenovirus C
ugcugccaggaugcggg

SEQ ID NO: 1550090 - RNA, 19 nt, Human adenovirus C
gcgccagaccccccaucua

SEQ ID NO: 1550091 - RNA, 14 nt, Human adenovirus C
cgcuguggagcggc

SEQ ID NO: 1550092 - RNA, 19 nt, Human adenovirus C
uacacaggguugcagcacu

SEQ ID NO: 1550093 - RNA, 17 nt, Human adenovirus C
gcggccgcacugggcgc

SEQ ID NO: 1550094 - RNA, 20 nt, Human adenovirus C
cgggcccuugcuucccagga

SEQ ID NO: 1550095 - RNA, 11 nt, Human adenovirus C
ucaccucccaa

SEQ ID NO: 1550096 - RNA, 23 nt, Human adenovirus C
gcacccaaaaagaagcugcagcu

SEQ ID NO: 1550097 - RNA, 14 nt, Human adenovirus C
caugucgccgccag

SEQ ID NO: 1550098 - RNA, 19 nt, Human adenovirus C
uuucacuccacaggcugcg

SEQ ID NO: 1550099 - RNA, 22 nt, Human adenovirus C
acccgcccgcgccugcugggcg

SEQ ID NO: 1550100 - RNA, 19 nt, Human adenovirus C
gucugcagcgcugccaaaa

SEQ ID NO: 1550101 - RNA, 18 nt, Human adenovirus C
ucguaaacguagaggggc

SEQ ID NO: 1550102 - RNA, 16 nt, Human adenovirus C
auacacuuccucagga

SEQ ID NO: 1550103 - RNA, 14 nt, Human adenovirus C
ccuucggcaucgcg

SEQ ID NO: 1550104 - RNA, 19 nt, Human adenovirus C
acgcguuccggcagcagcc

SEQ ID NO: 1550105 - RNA, 20 nt, Human adenovirus C
uagauugcaagaaaaaacua

SEQ ID NO: 1550106 - RNA, 22 nt, Human adenovirus C
ucgccagcccgugcuggccccg

SEQ ID NO: 1550107 - RNA, 15 nt, Human adenovirus C
uucaacuaacauaaa

SEQ ID NO: 1550108 - RNA, 15 nt, Human adenovirus C
acagcgcgagcaggc

SEQ ID NO: 1550109 - RNA, 14 nt, Human adenovirus C
aguagcuugaaguu

SEQ ID NO: 1550110 - RNA, 23 nt, Human adenovirus C
agcagagcgugagccuuaaccug

SEQ ID NO: 1550111 - RNA, 16 nt, Human adenovirus C
caccuccgcaccacuu

SEQ ID NO: 1550112 - RNA, 12 nt, Human adenovirus C
acaagcagcugg

SEQ ID NO: 1550113 - RNA, 23 nt, Human adenovirus C
ucccaaaccucagcgccucccaa

SEQ ID NO: 1550114 - RNA, 13 nt, Human adenovirus C
agcaggaggagga

SEQ ID NO: 1550115 - RNA, 18 nt, Human adenovirus C
cagauaaugacugcaaau

SEQ ID NO: 1550116 - RNA, 21 nt, Human adenovirus C
acaauaggaaacaaaaaugau

SEQ ID NO: 1550117 - RNA, 23 nt, Human adenovirus C
uaaccuaaaugccaaccuaugga

SEQ ID NO: 1550118 - RNA, 17 nt, Human adenovirus C
auggccggccacggccu

SEQ ID NO: 1550119 - RNA, 16 nt, Human adenovirus C
ggcgcggcuaggagcg

SEQ ID NO: 1550120 - RNA, 16 nt, Human adenovirus C
guugacggcggccugg

SEQ ID NO: 1550121 - RNA, 16 nt, Human adenovirus C
cuacguccgcgacugc

SEQ ID NO: 1550122 - RNA, 15 nt, Human adenovirus C
cgucggcgccgcgcg

SEQ ID NO: 1550123 - RNA, 13 nt, Human adenovirus C
ugcuggucaggca

SEQ ID NO: 1550124 - RNA, 17 nt, Human adenovirus C
guugaagcaucugcagc

SEQ ID NO: 1550125 - RNA, 15 nt, Human adenovirus C
caccgucacccagca

SEQ ID NO: 1550126 - RNA, 22 nt, Human adenovirus C
accacuuacuggcugcagccag

SEQ ID NO: 1550127 - RNA, 15 nt, Human adenovirus C
acugccacagagggc

SEQ ID NO: 1550128 - RNA, 14 nt, Human adenovirus C
caggucucugcgcu

SEQ ID NO: 1550129 - RNA, 21 nt, Human adenovirus C
agcccgugacacugcagcagg

SEQ ID NO: 1550130 - RNA, 19 nt, Human adenovirus C
gaaccuuuggacaccuccc

SEQ ID NO: 1550131 - RNA, 18 nt, Human adenovirus C
gguagcugccuucccaaa

SEQ ID NO: 1550132 - RNA, 18 nt, Human adenovirus C
ggagcggggggcuucuga

SEQ ID NO: 1550133 - RNA, 13 nt, Human adenovirus C
cccuggcuguggg

SEQ ID NO: 1550134 - RNA, 20 nt, Human adenovirus C
ugccuacgaacgccaccugu

SEQ ID NO: 1550135 - RNA, 21 nt, Human adenovirus C
guaugcguccaugucgccgcc

SEQ ID NO: 1550136 - RNA, 17 nt, Human adenovirus C
ccacgguaaagaccccg

SEQ ID NO: 1550137 - RNA, 23 nt, Human adenovirus C
gcggcgguauccugccccuccuu

SEQ ID NO: 1550138 - RNA, 13 nt, Human adenovirus C
cguguggcagcaa

SEQ ID NO: 1550139 - RNA, 20 nt, Human adenovirus C
gagagcucgguguaccugag

SEQ ID NO: 1550140 - RNA, 15 nt, Human adenovirus C
acuaacauaaacaca

SEQ ID NO: 1550141 - RNA, 20 nt, Human adenovirus C
acagcuuccuggagcgccac

SEQ ID NO: 1550142 - RNA, 21 nt, Human adenovirus C
accguaccuuaaucaaacuca

SEQ ID NO: 1550143 - RNA, 21 nt, Human adenovirus C
ccauucacguagccagccacu

SEQ ID NO: 1550144 - RNA, 12 nt, Human adenovirus C
cugcagcacagc

SEQ ID NO: 1550145 - RNA, 23 nt, Human adenovirus C
uacugcaccggcggcagcggcag

SEQ ID NO: 1550146 - RNA, 19 nt, Human adenovirus C
cagcuugccugcuccagag

SEQ ID NO: 1550147 - RNA, 18 nt, Human adenovirus C
aacgcguuuagcaggucg

SEQ ID NO: 1550148 - RNA, 15 nt, Human adenovirus C
gcugccgccaugggc

SEQ ID NO: 1550149 - RNA, 22 nt, Human adenovirus C
cugcugugcgcuuccuagcgac

SEQ ID NO: 1550150 - RNA, 20 nt, Human adenovirus C
ccgcuccucaggcgccgccg

SEQ ID NO: 1550151 - RNA, 19 nt, Human adenovirus C
caggcggccgcugcggccg

SEQ ID NO: 1550152 - RNA, 21 nt, Human adenovirus C
gcugccggucuucgcccugcg

SEQ ID NO: 1550153 - RNA, 17 nt, Human adenovirus C
agccaugcucagaaaug

SEQ ID NO: 1550154 - RNA, 12 nt, Human adenovirus C
cgccugcugcac

SEQ ID NO: 1550155 - RNA, 13 nt, Human adenovirus C
ccgccucagccgc

SEQ ID NO: 1550156 - RNA, 18 nt, Human adenovirus C
gaucagcuucggcgcacg

SEQ ID NO: 1550157 - RNA, 18 nt, Human adenovirus C
caacccgcggugcuccuc

SEQ ID NO: 1550158 - RNA, 14 nt, Human adenovirus C
uaccaccacaccuc

SEQ ID NO: 1550159 - RNA, 13 nt, Human adenovirus C
aucguuuaaaagc

SEQ ID NO: 1550160 - RNA, 12 nt, Human adenovirus C
cgcccgcgccgu

SEQ ID NO: 1550161 - RNA, 18 nt, Human adenovirus C
ccaggcgacgagcggccg

SEQ ID NO: 1550162 - RNA, 16 nt, Human adenovirus C
cccauuuccaagcuug

SEQ ID NO: 1550163 - RNA, 21 nt, Human adenovirus C
accugcgcugggccccaagcc

SEQ ID NO: 1550164 - RNA, 22 nt, Human adenovirus C
acugcucgaucucuuccuccug

SEQ ID NO: 1550165 - RNA, 17 nt, Human adenovirus C
gcagcuaaaugccgugg

SEQ ID NO: 1550166 - RNA, 18 nt, Human adenovirus C
cagguacagcccacccug

SEQ ID NO: 1550167 - RNA, 17 nt, Human adenovirus C
agaugaagaugaagaag

SEQ ID NO: 1550168 - RNA, 16 nt, Human adenovirus C
agaugcugagggacaa

SEQ ID NO: 1550169 - RNA, 13 nt, Human adenovirus C
cggccgcacuggg

SEQ ID NO: 1550170 - RNA, 21 nt, Human adenovirus C
ugggagcuguccauggucugg

SEQ ID NO: 1550171 - RNA, 21 nt, Human adenovirus C
cuuccaggcgcggcggcugcu

SEQ ID NO: 1550172 - RNA, 21 nt, Human adenovirus C
cgguguuggagaucugcacca

SEQ ID NO: 1550173 - RNA, 19 nt, Human adenovirus C
ggaccucccggccacuacc

SEQ ID NO: 1550174 - RNA, 19 nt, Human adenovirus C
ugcgcgucggccagguagc

SEQ ID NO: 1550175 - RNA, 19 nt, Human adenovirus C
gcggcggucaccagaggcu

SEQ ID NO: 1550176 - RNA, 19 nt, Human adenovirus C
aggugaccgugcccggucu

SEQ ID NO: 1550177 - RNA, 14 nt, Human adenovirus C
agagcgacugcgcc

SEQ ID NO: 1550178 - RNA, 19 nt, Human adenovirus C
cguugguuuucuuguauuc

SEQ ID NO: 1550179 - RNA, 18 nt, Human adenovirus C
uacgagagcguggugagc

SEQ ID NO: 1550180 - RNA, 14 nt, Human adenovirus C
gaucugcuggcgca

SEQ ID NO: 1550181 - RNA, 17 nt, Human adenovirus C
cacugaucgccgcggcg

SEQ ID NO: 1550182 - RNA, 17 nt, Human adenovirus C
gcuccccuggacccgcc

SEQ ID NO: 1550183 - RNA, 23 nt, Human adenovirus C
acugcagguacgccugcaggaau

SEQ ID NO: 1550184 - RNA, 14 nt, Human adenovirus C
ccauccggcccagg

SEQ ID NO: 1550185 - RNA, 20 nt, Human adenovirus C
ccggcgcgcgcaaaccccac

SEQ ID NO: 1550186 - RNA, 23 nt, Human adenovirus C
agcacgaaggaggcuaaguggga

SEQ ID NO: 1550187 - RNA, 15 nt, Human adenovirus C
gauggaagacuggga

SEQ ID NO: 1550188 - RNA, 20 nt, Human adenovirus C
acagcagcggucacacagaa

SEQ ID NO: 1550189 - RNA, 18 nt, Human adenovirus C
ugcaaacggacccgugga

SEQ ID NO: 1550190 - RNA, 16 nt, Human adenovirus C
cagcgcacuacugccc

SEQ ID NO: 1550191 - RNA, 20 nt, Human adenovirus C
aaggugguagauggccuggc

SEQ ID NO: 1550192 - RNA, 17 nt, Human adenovirus C
caaagcaggggccaaga

SEQ ID NO: 1550193 - RNA, 12 nt, Human adenovirus C
caccucugggga

SEQ ID NO: 1550194 - RNA, 20 nt, Human adenovirus C
cuuugguagcugccuuccca

SEQ ID NO: 1550195 - RNA, 22 nt, Human adenovirus C
cauguggaguuaccagccacaa

SEQ ID NO: 1550196 - RNA, 18 nt, Human adenovirus C
ccaggaaccaugacaaaa

SEQ ID NO: 1550197 - RNA, 12 nt, Human adenovirus C
cagucaggcaga

SEQ ID NO: 1550198 - RNA, 15 nt, Human adenovirus C
ccagguacagcccac

SEQ ID NO: 1550199 - RNA, 17 nt, Human adenovirus C
ggcggugcgggcggcgc

SEQ ID NO: 1550200 - RNA, 21 nt, Human adenovirus C
caugaagggcacgagcugcuu

SEQ ID NO: 1550201 - RNA, 17 nt, Human adenovirus C
uuggacaccuccgcacc

SEQ ID NO: 1550202 - RNA, 18 nt, Human adenovirus C
uucaacuaacauaaacac

SEQ ID NO: 1550203 - RNA, 13 nt, Human adenovirus C
accccgcgccacu

SEQ ID NO: 1550204 - RNA, 18 nt, Human adenovirus C
ugacaguauuacccagaa

SEQ ID NO: 1550205 - RNA, 12 nt, Human adenovirus C
ccggcgcacggc

SEQ ID NO: 1550206 - RNA, 21 nt, Human adenovirus C
gcaauucaaguaacucuacaa

SEQ ID NO: 1550207 - RNA, 18 nt, Human adenovirus C
ccgcaggccaagcagcuu

SEQ ID NO: 1550208 - RNA, 20 nt, Human adenovirus C
aacaagcgagugguggcucc

SEQ ID NO: 1550209 - RNA, 15 nt, Human adenovirus C
gagcagcuggcgcgc

SEQ ID NO: 1550210 - RNA, 18 nt, Human adenovirus C
gacuacgguaccgcgcgg

SEQ ID NO: 1550211 - RNA, 20 nt, Human adenovirus C
gcugagguacgaugagaccc

SEQ ID NO: 1550212 - RNA, 13 nt, Human adenovirus C
uugguucuuacaa

SEQ ID NO: 1550213 - RNA, 11 nt, Human adenovirus C
ccguggagaca

SEQ ID NO: 1550214 - RNA, 12 nt, Human adenovirus C
ugggugagcgca

SEQ ID NO: 1550215 - RNA, 21 nt, Human adenovirus C
gcagcuguuggaucugcgcca

SEQ ID NO: 1550216 - RNA, 19 nt, Human adenovirus C
aaagccaccugagccuuug

SEQ ID NO: 1550217 - RNA, 22 nt, Human adenovirus C
agccuauccaaaaacccaaagu

SEQ ID NO: 1550218 - RNA, 17 nt, Human adenovirus C
caggccagaugcugagg

SEQ ID NO: 1550219 - RNA, 18 nt, Human adenovirus C
cggcagacaugcagggca

SEQ ID NO: 1550220 - RNA, 21 nt, Human adenovirus C
ucauugugcucaacccacaca

SEQ ID NO: 1550221 - RNA, 22 nt, Human adenovirus C
augaacuugacgacgaggugga

SEQ ID NO: 1550222 - RNA, 13 nt, Human adenovirus C
caaggccuggaac

SEQ ID NO: 1550223 - RNA, 16 nt, Human adenovirus C
agcgcgcgcagcagca

SEQ ID NO: 1550224 - RNA, 14 nt, Human adenovirus C
aucagccccccucu

SEQ ID NO: 1550225 - RNA, 15 nt, Human adenovirus C
gaaugcgcaggcggu

SEQ ID NO: 1550226 - RNA, 22 nt, Human adenovirus C
cagaaaccugugcugccagggc

SEQ ID NO: 1550227 - RNA, 16 nt, Human adenovirus C
uccauggucuggagcu

SEQ ID NO: 1550228 - RNA, 14 nt, Human adenovirus C
acgccaacuccgcc

SEQ ID NO: 1550229 - RNA, 21 nt, Human adenovirus C
caccgucgcaugcgcggcggu

SEQ ID NO: 1550230 - RNA, 18 nt, Human adenovirus C
cauggugucauaguccag

SEQ ID NO: 1550231 - RNA, 20 nt, Human adenovirus C
agcccaagaaauccacagcg

SEQ ID NO: 1550232 - RNA, 13 nt, Human adenovirus C
uggaggcagcugg

SEQ ID NO: 1550233 - RNA, 13 nt, Human adenovirus C
ccgcgcccaccga

SEQ ID NO: 1550234 - RNA, 18 nt, Human adenovirus C
cgcugaccugcgcugggc

SEQ ID NO: 1550235 - RNA, 20 nt, Human adenovirus C
gaaauccacagcggcggcag

SEQ ID NO: 1550236 - RNA, 13 nt, Human adenovirus C
cuccuaacugcag

SEQ ID NO: 1550237 - RNA, 14 nt, Human adenovirus C
augcgcgggcggca

SEQ ID NO: 1550238 - RNA, 19 nt, Human adenovirus C
gagucaacuuugguagcug

SEQ ID NO: 1550239 - RNA, 14 nt, Human adenovirus C
cgaaugagcuccac

SEQ ID NO: 1550240 - RNA, 19 nt, Human adenovirus C
ccugccaccucccucccaa

SEQ ID NO: 1550241 - RNA, 11 nt, Human adenovirus C
ccguucccacg

SEQ ID NO: 1550242 - RNA, 19 nt, Human adenovirus C
cggugagcgcuccacccgc

SEQ ID NO: 1550243 - RNA, 17 nt, Human adenovirus C
uggcauuagcggggugg

SEQ ID NO: 1550244 - RNA, 12 nt, Human adenovirus C
gcccgccaccug

SEQ ID NO: 1550245 - RNA, 17 nt, Human adenovirus C
cgcgcuggccagggugc

SEQ ID NO: 1550246 - RNA, 21 nt, Human adenovirus C
uacggcaucucgauccagcau

SEQ ID NO: 1550247 - RNA, 13 nt, Human adenovirus C
cagcgccucccaa

SEQ ID NO: 1550248 - RNA, 13 nt, Human adenovirus C
ugcuuauuacagc

SEQ ID NO: 1550249 - RNA, 17 nt, Human adenovirus C
auuacaaaaagcgggcu

SEQ ID NO: 1550250 - RNA, 13 nt, Human adenovirus C
cauccgcggcagc

SEQ ID NO: 1550251 - RNA, 20 nt, Human adenovirus C
gcaccucgcgcucaaaggcu

SEQ ID NO: 1550252 - RNA, 21 nt, Human adenovirus C
cuguuuauucuuauacuagca

SEQ ID NO: 1550253 - RNA, 22 nt, Human adenovirus C
gugacgaaaaggcuguccgugu

SEQ ID NO: 1550254 - RNA, 11 nt, Human adenovirus C
ggcaugacuuc

SEQ ID NO: 1550255 - RNA, 18 nt, Human adenovirus C
acucucgcaaggccuggc

SEQ ID NO: 1550256 - RNA, 14 nt, Human adenovirus C
acuuggaggagcga

SEQ ID NO: 1550257 - RNA, 17 nt, Human adenovirus C
ugccccaaucaaucagc

SEQ ID NO: 1550258 - RNA, 19 nt, Human adenovirus C
ucggcagaaacagagggcu

SEQ ID NO: 1550259 - RNA, 16 nt, Human adenovirus C
gaccgucuggcugcuc

SEQ ID NO: 1550260 - RNA, 19 nt, Human adenovirus C
cugcuuaaaagccaccuga

SEQ ID NO: 1550261 - RNA, 21 nt, Human adenovirus C
aggcagaacgggguucuggaa

SEQ ID NO: 1550262 - RNA, 13 nt, Human adenovirus C
caucccaccuuuc

SEQ ID NO: 1550263 - RNA, 21 nt, Human adenovirus C
gcagacuuuuaagggcguaga

SEQ ID NO: 1550264 - RNA, 23 nt, Human adenovirus C
cuagcuacuguagcugcuuuggc

SEQ ID NO: 1550265 - RNA, 22 nt, Human adenovirus C
cccuuacuacaccuacucuggc

SEQ ID NO: 1550266 - RNA, 22 nt, Human adenovirus C
gacauguuggcguugccgcugg

SEQ ID NO: 1550267 - RNA, 15 nt, Human adenovirus C
gacaugcagggcacc

SEQ ID NO: 1550268 - RNA, 13 nt, Human adenovirus C
aaccugugcugcc

SEQ ID NO: 1550269 - RNA, 14 nt, Human adenovirus C
gcagggccagcuga

SEQ ID NO: 1550270 - RNA, 17 nt, Human adenovirus C
ggcgcggcggcugcugc

SEQ ID NO: 1550271 - RNA, 19 nt, Human adenovirus C
ccguugauguuguggccca

SEQ ID NO: 1550272 - RNA, 15 nt, Human adenovirus C
caauaaaaacuaaaa

SEQ ID NO: 1550273 - RNA, 22 nt, Human adenovirus C
acgaaggaggcguaggagucgc

SEQ ID NO: 1550274 - RNA, 16 nt, Human adenovirus C
uccacccgcaccuaca

SEQ ID NO: 1550275 - RNA, 15 nt, Human adenovirus C
agcgacgaccugggc

SEQ ID NO: 1550276 - RNA, 15 nt, Human adenovirus C
cauucagaccguggu

SEQ ID NO: 1550277 - RNA, 22 nt, Human adenovirus C
ugucccuuuuuuuuccacagcu

SEQ ID NO: 1550278 - RNA, 13 nt, Human adenovirus C
ccagccugugaug

SEQ ID NO: 1550279 - RNA, 11 nt, Human adenovirus C
accgcagaccc

SEQ ID NO: 1550280 - RNA, 12 nt, Human adenovirus C
accccgcaccgc

SEQ ID NO: 1550281 - RNA, 15 nt, Human adenovirus C
uacuggcugcagcca

SEQ ID NO: 1550282 - RNA, 18 nt, Human adenovirus C
ugcacgcuggccagcacg

SEQ ID NO: 1550283 - RNA, 19 nt, Human adenovirus C
cggggauggcgcaggcggc

SEQ ID NO: 1550284 - RNA, 18 nt, Human adenovirus C
aucugggucaccaggcgc

SEQ ID NO: 1550285 - RNA, 19 nt, Human adenovirus C
aaaacccaaagucaaacug

SEQ ID NO: 1550286 - RNA, 15 nt, Human adenovirus C
cugugcuacaccugg

SEQ ID NO: 1550287 - RNA, 19 nt, Human adenovirus C
ucgagaaggaggacagccu

SEQ ID NO: 1550288 - RNA, 19 nt, Human adenovirus C
agcccgagggccgcuggcu

SEQ ID NO: 1550289 - RNA, 18 nt, Human adenovirus C
aauggggcggggcuuaaa

SEQ ID NO: 1550290 - RNA, 22 nt, Human adenovirus C
accggcacuucuucuucuccuu

SEQ ID NO: 1550291 - RNA, 20 nt, Human adenovirus C
gaagaucuggaaggugcuga

SEQ ID NO: 1550292 - RNA, 19 nt, Human adenovirus C
cagcaggaggaagccaggc

SEQ ID NO: 1550293 - RNA, 16 nt, Human adenovirus C
aucccuuuaaccacca

SEQ ID NO: 1550294 - RNA, 17 nt, Human adenovirus C
uccaggccagcacgaag

SEQ ID NO: 1550295 - RNA, 14 nt, Human adenovirus C
ugcauguggaaaaa

SEQ ID NO: 1550296 - RNA, 16 nt, Human adenovirus C
accaaaguugcaggag

SEQ ID NO: 1550297 - RNA, 22 nt, Human adenovirus C
gcagcacaggccagaugcugag

SEQ ID NO: 1550298 - RNA, 18 nt, Human adenovirus C
aucaaagaagagaugcuc

SEQ ID NO: 1550299 - RNA, 20 nt, Human adenovirus C
ggcgcaguaguccaggguuu

SEQ ID NO: 1550300 - RNA, 12 nt, Human adenovirus C
accgcaaaguga

SEQ ID NO: 1550301 - RNA, 19 nt, Human adenovirus C
gucaugcaagaccccgcuu

SEQ ID NO: 1550302 - RNA, 12 nt, Human adenovirus C
augaacugcucg

SEQ ID NO: 1550303 - RNA, 14 nt, Human adenovirus C
cugaucucacuuaa

SEQ ID NO: 1550304 - RNA, 18 nt, Human adenovirus C
guuccuuauagugcagca

SEQ ID NO: 1550305 - RNA, 21 nt, Human adenovirus C
augacaacaucgcgcagaugg

SEQ ID NO: 1550306 - RNA, 23 nt, Human adenovirus C
ccuggcggacauuaucuuccccg

SEQ ID NO: 1550307 - RNA, 23 nt, Human adenovirus C
ucuugcauacggccgccagagcu

SEQ ID NO: 1550308 - RNA, 13 nt, Human adenovirus C
cgccauagucaau

SEQ ID NO: 1550309 - RNA, 15 nt, Human adenovirus C
aguguccacagugga

SEQ ID NO: 1550310 - RNA, 20 nt, Human adenovirus C
cggcugaagcagggccaggu

SEQ ID NO: 1550311 - RNA, 18 nt, Human adenovirus C
cucaggggcgcagcuugc

SEQ ID NO: 1550312 - RNA, 16 nt, Human adenovirus C
cgccaccaccgccucc

SEQ ID NO: 1550313 - RNA, 12 nt, Human adenovirus C
ccaucaccaccg

SEQ ID NO: 1550314 - RNA, 15 nt, Human adenovirus C
cagcagauuaaggau

SEQ ID NO: 1550315 - RNA, 20 nt, Human adenovirus C
ccgccaagaguuucugcuac

SEQ ID NO: 1550316 - RNA, 21 nt, Human adenovirus C
gcccugcgcgcgcgaguugcg

SEQ ID NO: 1550317 - RNA, 14 nt, Human adenovirus C
gcucccaccacugu

SEQ ID NO: 1550318 - RNA, 17 nt, Human adenovirus C
gcgcacccgccccccgc

SEQ ID NO: 1550319 - RNA, 22 nt, Human adenovirus C
gugccgggauuccgaggaagaa

SEQ ID NO: 1550320 - RNA, 18 nt, Human adenovirus C
auuugaagagcuuuugaa

SEQ ID NO: 1550321 - RNA, 13 nt, Human adenovirus C
aggcagcuggggc

SEQ ID NO: 1550322 - RNA, 11 nt, Human adenovirus C
ggaugagcucg

SEQ ID NO: 1550323 - RNA, 15 nt, Human adenovirus C
ugguucuugcagaua

SEQ ID NO: 1550324 - RNA, 15 nt, Human adenovirus C
aaggcuacaggggcc

SEQ ID NO: 1550325 - RNA, 13 nt, Human adenovirus C
acugacgccagac

SEQ ID NO: 1550326 - RNA, 16 nt, Human adenovirus C
gcggccugggcgaaga

SEQ ID NO: 1550327 - RNA, 19 nt, Human adenovirus C
ccguguaccugcgcacgcc

SEQ ID NO: 1550328 - RNA, 14 nt, Human adenovirus C
uacuuuccaggaga

SEQ ID NO: 1550329 - RNA, 15 nt, Human adenovirus C
aucaccuacgaugac

SEQ ID NO: 1550330 - RNA, 14 nt, Human adenovirus C
uggccgcgggcugg

SEQ ID NO: 1550331 - RNA, 22 nt, Human adenovirus C
cagucgagaaggaggacagccu

SEQ ID NO: 1550332 - RNA, 16 nt, Human adenovirus C
cacgaaaaccgccucg

SEQ ID NO: 1550333 - RNA, 16 nt, Human adenovirus C
uggcacuuaggccaga

SEQ ID NO: 1550334 - RNA, 15 nt, Human adenovirus C
aacagagggcugccu

SEQ ID NO: 1550335 - RNA, 19 nt, Human adenovirus C
ccgcggcgugcuggacagg

SEQ ID NO: 1550336 - RNA, 16 nt, Human adenovirus C
aggucugcacggacca

SEQ ID NO: 1550337 - RNA, 22 nt, Human adenovirus C
gcgcauccacaaggccgugagc

SEQ ID NO: 1550338 - RNA, 20 nt, Human adenovirus C
cggcaugcgucgugcgcacc

SEQ ID NO: 1550339 - RNA, 22 nt, Human adenovirus C
ugcugcacgcacguuuguaccu

SEQ ID NO: 1550340 - RNA, 23 nt, Human adenovirus C
aaacuuaccuacgaaaaaaccac

SEQ ID NO: 1550341 - RNA, 21 nt, Human adenovirus C
ggacaccacuggaaccagggc

SEQ ID NO: 1550342 - RNA, 15 nt, Human adenovirus C
cauccgcccugcucc

SEQ ID NO: 1550343 - RNA, 16 nt, Human adenovirus C
acccuuccaggagggc

SEQ ID NO: 1550344 - RNA, 12 nt, Human adenovirus C
cggcgacgggga

SEQ ID NO: 1550345 - RNA, 19 nt, Human adenovirus C
uggccuuuagauguagcau

SEQ ID NO: 1550346 - RNA, 20 nt, Human adenovirus C
agcagguuccugagcagcug

SEQ ID NO: 1550347 - RNA, 13 nt, Human adenovirus C
gccuggcgcggcu

SEQ ID NO: 1550348 - RNA, 22 nt, Human adenovirus C
ggcuugggaguguuuggaagau

SEQ ID NO: 1550349 - RNA, 22 nt, Human adenovirus C
caaugcagaaacacaagcuaaa

SEQ ID NO: 1550350 - RNA, 22 nt, Human adenovirus C
ggcaguugccgaggaugaagaa

SEQ ID NO: 1550351 - RNA, 13 nt, Human adenovirus C
cgcgugcccgugc

SEQ ID NO: 1550352 - RNA, 15 nt, Human adenovirus C
ccgccgcaccgugcg

SEQ ID NO: 1550353 - RNA, 19 nt, Human adenovirus C
cgaugauauccguagaugu

SEQ ID NO: 1550354 - RNA, 18 nt, Human adenovirus C
gaagcuggcgucugugag

SEQ ID NO: 1550355 - RNA, 23 nt, Human adenovirus C
aacucgcgccuguugcugcugcu

SEQ ID NO: 1550356 - RNA, 16 nt, Human adenovirus C
uagcauguagaacugg

SEQ ID NO: 1550357 - RNA, 12 nt, Human adenovirus C
ccaaccgcagcc

SEQ ID NO: 1550358 - RNA, 22 nt, Human adenovirus C
cagaggagguuuuggacgagga

SEQ ID NO: 1550359 - RNA, 21 nt, Human adenovirus C
gcaaagcacacugaacagcau

SEQ ID NO: 1550360 - RNA, 14 nt, Human adenovirus C
gugacugacuuugc

SEQ ID NO: 1550361 - RNA, 18 nt, Human adenovirus C
cauaaguuuggacaccuc

SEQ ID NO: 1550362 - RNA, 18 nt, Human adenovirus C
ccagaacgaccacagcaa

SEQ ID NO: 1550363 - RNA, 17 nt, Human adenovirus C
cucggcagacgacagca

SEQ ID NO: 1550364 - RNA, 15 nt, Human adenovirus C
gcauggucucgguga

SEQ ID NO: 1550365 - RNA, 16 nt, Human adenovirus C
ugcgcgcuggccaggg

SEQ ID NO: 1550366 - RNA, 17 nt, Human adenovirus C
caaauacuaccucuuug

SEQ ID NO: 1550367 - RNA, 20 nt, Human adenovirus C
uuccauaagggccuccccuu

SEQ ID NO: 1550368 - RNA, 20 nt, Human adenovirus C
ccagcugcugagccacaggc

SEQ ID NO: 1550369 - RNA, 13 nt, Human adenovirus C
auucccagcugcu

SEQ ID NO: 1550370 - RNA, 13 nt, Human adenovirus C
gcugggggcaaca

SEQ ID NO: 1550371 - RNA, 21 nt, Human adenovirus C
cgccaaccgcgguugugcagg

SEQ ID NO: 1550372 - RNA, 22 nt, Human adenovirus C
uguucuaauggagaacuccuca

SEQ ID NO: 1550373 - RNA, 16 nt, Human adenovirus C
ggcggcgcugcagagc

SEQ ID NO: 1550374 - RNA, 17 nt, Human adenovirus C
cgaugaguacgagccag

SEQ ID NO: 1550375 - RNA, 21 nt, Human adenovirus C
ggccccgcgacacggcucgcg

SEQ ID NO: 1550376 - RNA, 18 nt, Human adenovirus C
ucggggucaaaaaccagg

SEQ ID NO: 1550377 - RNA, 13 nt, Human adenovirus C
cacugccacagag

SEQ ID NO: 1550378 - RNA, 19 nt, Human adenovirus C
cauucagggaugcgcugcu

SEQ ID NO: 1550379 - RNA, 16 nt, Human adenovirus C
cggcgccgggcccggc

SEQ ID NO: 1550380 - RNA, 13 nt, Human adenovirus C
ggggugggugagc

SEQ ID NO: 1550381 - RNA, 17 nt, Human adenovirus C
agccaggugagcucugg

SEQ ID NO: 1550382 - RNA, 18 nt, Human adenovirus C
ggcagcggugcacgggcu

SEQ ID NO: 1550383 - RNA, 15 nt, Human adenovirus C
gacuugcggcuggag

SEQ ID NO: 1550384 - RNA, 22 nt, Human adenovirus C
gcggguauugucacugugcccc

SEQ ID NO: 1550385 - RNA, 16 nt, Human adenovirus C
uggacgucgcgccgca

SEQ ID NO: 1550386 - RNA, 16 nt, Human adenovirus C
cuccacgccuuugcca

SEQ ID NO: 1550387 - RNA, 18 nt, Human adenovirus C
cgagguccgcgugcggcc

SEQ ID NO: 1550388 - RNA, 12 nt, Human adenovirus C
ugcagcacugga

SEQ ID NO: 1550389 - RNA, 15 nt, Human adenovirus C
guggagaggcagagc

SEQ ID NO: 1550390 - RNA, 14 nt, Human adenovirus C
ggccucuucuucuu

SEQ ID NO: 1550391 - RNA, 23 nt, Human adenovirus C
acaccuacucuggcuccauacca

SEQ ID NO: 1550392 - RNA, 19 nt, Human adenovirus C
ggcaggacccuggugcugc

SEQ ID NO: 1550393 - RNA, 22 nt, Human adenovirus C
ccaucgcgcaacugggcagcau

SEQ ID NO: 1550394 - RNA, 21 nt, Human adenovirus C
ccagaccgucugaagacaccu

SEQ ID NO: 1550395 - RNA, 21 nt, Human adenovirus C
ccagauguccgcgcgcggcgg

SEQ ID NO: 1550396 - RNA, 20 nt, Human adenovirus C
ugcuccucguuuagccaggu

SEQ ID NO: 1550397 - RNA, 19 nt, Human adenovirus C
ccggaaaccucaccuccca

SEQ ID NO: 1550398 - RNA, 17 nt, Human adenovirus C
caccuacgaugaccugg

SEQ ID NO: 1550399 - RNA, 18 nt, Human adenovirus C
auuccucgaguucuuaua

SEQ ID NO: 1550400 - RNA, 17 nt, Human adenovirus C
acgaucuuggccuugcu

SEQ ID NO: 1550401 - RNA, 14 nt, Human adenovirus C
ugguuuccaugagc

SEQ ID NO: 1550402 - RNA, 16 nt, Human adenovirus C
ucgcguccaggccagc

SEQ ID NO: 1550403 - RNA, 21 nt, Human adenovirus C
ggcccuuggcgcgcagcuugc

SEQ ID NO: 1550404 - RNA, 20 nt, Human adenovirus C
auuucaaucacgugcuccuu

SEQ ID NO: 1550405 - RNA, 16 nt, Human adenovirus C
ugcccuuggaggaggc

SEQ ID NO: 1550406 - RNA, 18 nt, Human adenovirus C
gugcccgugcgcacccgc

SEQ ID NO: 1550407 - RNA, 17 nt, Human adenovirus C
cagccgcgcgcuggggc

SEQ ID NO: 1550408 - RNA, 22 nt, Human adenovirus C
agcugccgucaucccugagcag

SEQ ID NO: 1550409 - RNA, 18 nt, Human adenovirus C
agugcgcgugcgcgggca

SEQ ID NO: 1550410 - RNA, 19 nt, Human adenovirus C
ccauggcccacaacacggc

SEQ ID NO: 1550411 - RNA, 20 nt, Human adenovirus C
gccugcugcaccugcgugag

SEQ ID NO: 1550412 - RNA, 14 nt, Human adenovirus C
ccugcgcugggccc

SEQ ID NO: 1550413 - RNA, 19 nt, Human adenovirus C
auggcaguggucuccucag

SEQ ID NO: 1550414 - RNA, 21 nt, Human adenovirus C
cccuugcggcagucugcagcg

SEQ ID NO: 1550415 - RNA, 19 nt, Human adenovirus C
ugaccuccgagauuuucca

SEQ ID NO: 1550416 - RNA, 12 nt, Human adenovirus C
gaccugcuugag

SEQ ID NO: 1550417 - RNA, 14 nt, Human adenovirus C
cggugcgaggaugc

SEQ ID NO: 1550418 - RNA, 16 nt, Human adenovirus C
ccugguaggcgcagca

SEQ ID NO: 1550419 - RNA, 12 nt, Human adenovirus C
ccuccugccagg

SEQ ID NO: 1550420 - RNA, 14 nt, Human adenovirus C
ccagcugcuacaac

SEQ ID NO: 1550421 - RNA, 19 nt, Human adenovirus C
aggugguagauggccuggc

SEQ ID NO: 1550422 - RNA, 21 nt, Human adenovirus C
gugcuuaaaaaaacaacuccc

SEQ ID NO: 1550423 - RNA, 12 nt, Human adenovirus C
ugcgggccauga

SEQ ID NO: 1550424 - RNA, 22 nt, Human adenovirus C
uauaaauuuccauuuuaugaaa

SEQ ID NO: 1550425 - RNA, 24 nt, Human adenovirus C
gugacaaggucaacgcugguggcu

SEQ ID NO: 1550426 - RNA, 21 nt, Human adenovirus C
cgccaccuucuuccccauggc

SEQ ID NO: 1550427 - RNA, 21 nt, Human adenovirus C
cuugaaagugggcaggcagaa

SEQ ID NO: 1550428 - RNA, 15 nt, Human adenovirus C
gcggcggugggggag

SEQ ID NO: 1550429 - RNA, 19 nt, Human adenovirus C
cccuggcuggcacgggcag

SEQ ID NO: 1550430 - RNA, 18 nt, Human adenovirus C
gcggcggugggggagggg

SEQ ID NO: 1550431 - RNA, 17 nt, Human adenovirus C
gcaggaggaagccaggc

SEQ ID NO: 1550432 - RNA, 14 nt, Human adenovirus C
gcagccgcaggcca

SEQ ID NO: 1550433 - RNA, 18 nt, Human adenovirus C
cgaugaugccgcaguggu

SEQ ID NO: 1550434 - RNA, 21 nt, Human adenovirus C
ggugaugccuuugaggguggc

SEQ ID NO: 1550435 - RNA, 22 nt, Human adenovirus C
cuaggggguccacucgcuccag

SEQ ID NO: 1550436 - RNA, 18 nt, Human adenovirus C
ccgaagaaaagcgcggcc

SEQ ID NO: 1550437 - RNA, 23 nt, Human adenovirus C
ucgcggacgcgguuccagauguu

SEQ ID NO: 1550438 - RNA, 22 nt, Human adenovirus C
ccccuucccugggaucaggcua

SEQ ID NO: 1550439 - RNA, 15 nt, Human adenovirus C
gcaacccaacaccua

SEQ ID NO: 1550440 - RNA, 23 nt, Human adenovirus C
cagaccaaagcaaaccucaccuc

SEQ ID NO: 1550441 - RNA, 14 nt, Human adenovirus C
cauaguagagcccg

SEQ ID NO: 1550442 - RNA, 17 nt, Human adenovirus C
acaccuagccuaaagcc

SEQ ID NO: 1550443 - RNA, 17 nt, Human adenovirus C
ccaagaacaagagcuga

SEQ ID NO: 1550444 - RNA, 16 nt, Human adenovirus C
accagaacgaccacag

SEQ ID NO: 1550445 - RNA, 14 nt, Human adenovirus C
ucgggccaggacgc

SEQ ID NO: 1550446 - RNA, 18 nt, Human adenovirus C
gccuuaggguugccgccu

SEQ ID NO: 1550447 - RNA, 19 nt, Human adenovirus C
cuucccugggaucaggcua

SEQ ID NO: 1550448 - RNA, 12 nt, Human adenovirus C
caagaccaggac

SEQ ID NO: 1550449 - RNA, 19 nt, Human adenovirus C
cuggccgaaaacagggcca

SEQ ID NO: 1550450 - RNA, 19 nt, Human adenovirus C
agcucggcggugaccugca

SEQ ID NO: 1550451 - RNA, 15 nt, Human adenovirus C
cauugcguaccucag

SEQ ID NO: 1550452 - RNA, 21 nt, Human adenovirus C
cgagugguggcucccgggcuu

SEQ ID NO: 1550453 - RNA, 16 nt, Human adenovirus C
agagccuaguggacaa

SEQ ID NO: 1550454 - RNA, 15 nt, Human adenovirus C
gacaagcuaaaauac

SEQ ID NO: 1550455 - RNA, 16 nt, Human adenovirus C
acgcccaacucgcgcc

SEQ ID NO: 1550456 - RNA, 13 nt, Human adenovirus C
cgcucccuggucu

SEQ ID NO: 1550457 - RNA, 17 nt, Human adenovirus C
aacaaacagagcgauuu

SEQ ID NO: 1550458 - RNA, 19 nt, Human adenovirus C
cuuccuagcgacuuugugc

SEQ ID NO: 1550459 - RNA, 19 nt, Human adenovirus C
ucgcuacaaccuccgcucc

SEQ ID NO: 1550460 - RNA, 22 nt, Human adenovirus C
ucccagaugcauccggugcugc

SEQ ID NO: 1550461 - RNA, 14 nt, Human adenovirus C
aucaaacccagcuu

SEQ ID NO: 1550462 - RNA, 13 nt, Human adenovirus C
aagaagagcaaaa

SEQ ID NO: 1550463 - RNA, 17 nt, Human adenovirus C
caaagcaaaccucaccu

SEQ ID NO: 1550464 - RNA, 16 nt, Human adenovirus C
cagcagccgcaggcca

SEQ ID NO: 1550465 - RNA, 13 nt, Human adenovirus C
aggcagaggaggu

SEQ ID NO: 1550466 - RNA, 14 nt, Human adenovirus C
cuggaacagcagca

SEQ ID NO: 1550467 - RNA, 17 nt, Human adenovirus C
ucaggcuacuaagaaaa

SEQ ID NO: 1550468 - RNA, 22 nt, Human adenovirus C
ccuuccccgucgaggcaccccc

SEQ ID NO: 1550469 - RNA, 16 nt, Human adenovirus C
cgcaugaccaccugcg

SEQ ID NO: 1550470 - RNA, 20 nt, Human adenovirus C
gugccgcggggacaggagga

SEQ ID NO: 1550471 - RNA, 12 nt, Human adenovirus C
uaacucuacaag

SEQ ID NO: 1550472 - RNA, 17 nt, Human adenovirus C
uucagcaaauacugcgc

SEQ ID NO: 1550473 - RNA, 17 nt, Human adenovirus C
auguagcuuagaaggaa

SEQ ID NO: 1550474 - RNA, 20 nt, Human adenovirus C
caacugcgaggacagggccu

SEQ ID NO: 1550475 - RNA, 14 nt, Human adenovirus C
cagcaggugcugcc

SEQ ID NO: 1550476 - RNA, 21 nt, Human adenovirus C
agcugcaaacuuucuccaaag

SEQ ID NO: 1550477 - RNA, 16 nt, Human adenovirus C
cgaucuuggccuugcu

SEQ ID NO: 1550478 - RNA, 14 nt, Human adenovirus C
ugguggaccuggcc

SEQ ID NO: 1550479 - RNA, 17 nt, Human adenovirus C
aucccacacugcaggga

SEQ ID NO: 1550480 - RNA, 20 nt, Human adenovirus C
auccgcucauggacccuccu

SEQ ID NO: 1550481 - RNA, 21 nt, Human adenovirus C
uacuugaaagugggcaggcag

SEQ ID NO: 1550482 - RNA, 20 nt, Human adenovirus C
ggaggacacgggcagccugg

SEQ ID NO: 1550483 - RNA, 18 nt, Human adenovirus C
ggggguccacucgcucca

SEQ ID NO: 1550484 - RNA, 14 nt, Human adenovirus C
gcauccgcgccgca

SEQ ID NO: 1550485 - RNA, 16 nt, Human adenovirus C
ucaccugaaaaucaga

SEQ ID NO: 1550486 - RNA, 16 nt, Human adenovirus C
agccagaucagcaacu

SEQ ID NO: 1550487 - RNA, 20 nt, Human adenovirus C
uggcuauaggacugaugcau

SEQ ID NO: 1550488 - RNA, 20 nt, Human adenovirus C
cagggcuacgugcgccaggc

SEQ ID NO: 1550489 - RNA, 20 nt, Human adenovirus C
ggcccuggcuggcacgggca

SEQ ID NO: 1550490 - RNA, 12 nt, Human adenovirus C
agcaacagcagc

SEQ ID NO: 1550491 - RNA, 22 nt, Human adenovirus C
uggccgcgauguuuagcugcac

SEQ ID NO: 1550492 - RNA, 16 nt, Human adenovirus C
aaacaauuacaaaaag

SEQ ID NO: 1550493 - RNA, 16 nt, Human adenovirus C
cggccgggcaguugcc

SEQ ID NO: 1550494 - RNA, 18 nt, Human adenovirus C
gcaacccuuccaggaggg

SEQ ID NO: 1550495 - RNA, 13 nt, Human adenovirus C
cguccugagugug

SEQ ID NO: 1550496 - RNA, 18 nt, Human adenovirus C
cucguccagacgggccag

SEQ ID NO: 1550497 - RNA, 12 nt, Human adenovirus C
ggucagcugcaa

SEQ ID NO: 1550498 - RNA, 21 nt, Human adenovirus C
agccuguaagcgggcacucuu

SEQ ID NO: 1550499 - RNA, 21 nt, Human adenovirus C
cgcccugcgcgucggccaggu

SEQ ID NO: 1550500 - RNA, 23 nt, Human adenovirus C
ccgggacugggcgugcagaccgu

SEQ ID NO: 1550501 - RNA, 19 nt, Human adenovirus C
ccauucuccaguaacuuua

SEQ ID NO: 1550502 - RNA, 19 nt, Human adenovirus C
agccuggaggcaacccuga

SEQ ID NO: 1550503 - RNA, 14 nt, Human adenovirus C
cgccgccagaggag

SEQ ID NO: 1550504 - RNA, 22 nt, Human adenovirus C
cugggcauagucucgccgcgcg

SEQ ID NO: 1550505 - RNA, 14 nt, Human adenovirus C
gcucgaaggcuggc

SEQ ID NO: 1550506 - RNA, 16 nt, Human adenovirus C
cucggaguaccugagc

SEQ ID NO: 1550507 - RNA, 12 nt, Human adenovirus C
cacaauguggcc

SEQ ID NO: 1550508 - RNA, 11 nt, Human adenovirus C
uugggcaccua

SEQ ID NO: 1550509 - RNA, 18 nt, Human adenovirus C
uuucgcgcugcuccucuu

SEQ ID NO: 1550510 - RNA, 15 nt, Human adenovirus C
cgcaacaccacugcu

SEQ ID NO: 1550511 - RNA, 21 nt, Human adenovirus C
ggugaaaaucguaaaacuuuu

SEQ ID NO: 1550512 - RNA, 18 nt, Human adenovirus C
ucuauguggaaucaggcu

SEQ ID NO: 1550513 - RNA, 21 nt, Human adenovirus C
agguccaggcgacgagcggcc

SEQ ID NO: 1550514 - RNA, 16 nt, Human adenovirus C
gcaccagccgcaccgc

SEQ ID NO: 1550515 - RNA, 15 nt, Human adenovirus C
gcuugcgggcggcuu

SEQ ID NO: 1550516 - RNA, 21 nt, Human adenovirus C
cucugcgugaagacgacgggc

SEQ ID NO: 1550517 - RNA, 21 nt, Human adenovirus C
acugcucgaucucuuccuccu

SEQ ID NO: 1550518 - RNA, 23 nt, Human adenovirus C
cagcuggggccggaccugggcug

SEQ ID NO: 1550519 - RNA, 15 nt, Human adenovirus C
cgccgccggcacugc

SEQ ID NO: 1550520 - RNA, 20 nt, Human adenovirus C
agggcuacgugcgccaggcc

SEQ ID NO: 1550521 - RNA, 12 nt, Human adenovirus C
ccacgcucggug

SEQ ID NO: 1550522 - RNA, 15 nt, Human adenovirus C
gaucaccucugggga

SEQ ID NO: 1550523 - RNA, 16 nt, Human adenovirus C
cuucggcgcacgcugg

SEQ ID NO: 1550524 - RNA, 14 nt, Human adenovirus C
cugauugccagggg

SEQ ID NO: 1550525 - RNA, 13 nt, Human adenovirus C
aaugagacaugau

SEQ ID NO: 1550526 - RNA, 13 nt, Human adenovirus C
agacagaaacaca

SEQ ID NO: 1550527 - RNA, 17 nt, Human adenovirus C
acgguuaacuccuccuc

SEQ ID NO: 1550528 - RNA, 17 nt, Human adenovirus C
gguggcaccgggacugg

SEQ ID NO: 1550529 - RNA, 21 nt, Human adenovirus C
gagcucggcgacagugucgcg

SEQ ID NO: 1550530 - RNA, 17 nt, Human adenovirus C
cgcgucaugcacgcagc

SEQ ID NO: 1550531 - RNA, 21 nt, Human adenovirus C
caaacagagcgauuugucaga

SEQ ID NO: 1550532 - RNA, 22 nt, Human adenovirus C
cagcgaccgcgagcugaugcac

SEQ ID NO: 1550533 - RNA, 22 nt, Human adenovirus C
cgggguggacuucacccacagc

SEQ ID NO: 1550534 - RNA, 22 nt, Human adenovirus C
ucauagauuggacggucugaaa

SEQ ID NO: 1550535 - RNA, 17 nt, Human adenovirus C
cucgcccuacuuccgca

SEQ ID NO: 1550536 - RNA, 22 nt, Human adenovirus C
uguuaccguggagcuugagugc

SEQ ID NO: 1550537 - RNA, 18 nt, Human adenovirus C
aggugcgggcgugacaaa

SEQ ID NO: 1550538 - RNA, 18 nt, Human adenovirus C
uaugagcgguggcgccuu

SEQ ID NO: 1550539 - RNA, 19 nt, Human adenovirus C
gugaccccgaagccccuca

SEQ ID NO: 1550540 - RNA, 14 nt, Human adenovirus C
gcguguaugaugag

SEQ ID NO: 1550541 - RNA, 12 nt, Human adenovirus C
ggaucagacaau

SEQ ID NO: 1550542 - RNA, 21 nt, Human adenovirus C
aguuucgcgcccuuucucaaa

SEQ ID NO: 1550543 - RNA, 19 nt, Human adenovirus C
cccccgcugacacccagca

SEQ ID NO: 1550544 - RNA, 15 nt, Human adenovirus C
cggcggcagcagcag

SEQ ID NO: 1550545 - RNA, 17 nt, Human adenovirus C
aguccacgccuacaugg

SEQ ID NO: 1550546 - RNA, 16 nt, Human adenovirus C
cgcacgaaggaggcgu

SEQ ID NO: 1550547 - RNA, 14 nt, Human adenovirus C
cgcugacacccagc

SEQ ID NO: 1550548 - RNA, 18 nt, Human adenovirus C
ccacaaccuucaaaucaa

SEQ ID NO: 1550549 - RNA, 19 nt, Human adenovirus C
caaccaggcagugcaaaau

SEQ ID NO: 1550550 - RNA, 18 nt, Human adenovirus C
gaaugagcuccacagguc

SEQ ID NO: 1550551 - RNA, 15 nt, Human adenovirus C
cucagcgccucccaa

SEQ ID NO: 1550552 - RNA, 17 nt, Human adenovirus C
ggccuacuggaguguca

SEQ ID NO: 1550553 - RNA, 16 nt, Human adenovirus C
gacaccuccgcaccac

SEQ ID NO: 1550554 - RNA, 13 nt, Human adenovirus C
cucaaagcaucca

SEQ ID NO: 1550555 - RNA, 14 nt, Human adenovirus C
gaucggcgcgcucc

SEQ ID NO: 1550556 - RNA, 20 nt, Human adenovirus C
cgagcgcauccacaaggccg

SEQ ID NO: 1550557 - RNA, 22 nt, Human adenovirus C
cucuuauaaaaugcaccacaga

SEQ ID NO: 1550558 - RNA, 19 nt, Human adenovirus C
gcacgcaaccgcgcccagg

SEQ ID NO: 1550559 - RNA, 16 nt, Human adenovirus C
acccuggugcugccaa

SEQ ID NO: 1550560 - RNA, 23 nt, Human adenovirus C
gaucuuaugccaggccuacaaau

SEQ ID NO: 1550561 - RNA, 14 nt, Human adenovirus C
cagcagcacaggcc

SEQ ID NO: 1550562 - RNA, 15 nt, Human adenovirus C
cggucaccagaggcu

SEQ ID NO: 1550563 - RNA, 16 nt, Human adenovirus C
ucacccuggcuguggg

SEQ ID NO: 1550564 - RNA, 17 nt, Human adenovirus C
caccugucgucagcgcc

SEQ ID NO: 1550565 - RNA, 14 nt, Human adenovirus C
ggccagggugcgcu

SEQ ID NO: 1550566 - RNA, 18 nt, Human adenovirus C
gccucaacuucuaccccg

SEQ ID NO: 1550567 - RNA, 15 nt, Human adenovirus C
caugccuuugucaau

SEQ ID NO: 1550568 - RNA, 12 nt, Human adenovirus C
ccgccaacgugc

SEQ ID NO: 1550569 - RNA, 22 nt, Human adenovirus C
cagccucgccccccuucuccca

SEQ ID NO: 1550570 - RNA, 11 nt, Human adenovirus C
cgggcagcagc

SEQ ID NO: 1550571 - RNA, 12 nt, Human adenovirus C
ccggcacugccg

SEQ ID NO: 1550572 - RNA, 16 nt, Human adenovirus C
gucagccgcgcgcugg

SEQ ID NO: 1550573 - RNA, 15 nt, Human adenovirus C
accggagugcugggc

SEQ ID NO: 1550574 - RNA, 18 nt, Human adenovirus C
gaccgaggagcugaggcc

SEQ ID NO: 1550575 - RNA, 18 nt, Human adenovirus C
caguggagaggcagagcg

SEQ ID NO: 1550576 - RNA, 17 nt, Human adenovirus C
agcgguguuccgcgguc

SEQ ID NO: 1550577 - RNA, 16 nt, Human adenovirus C
ccagcuguugggguga

SEQ ID NO: 1550578 - RNA, 21 nt, Human adenovirus C
cggggggcugccgugcggcag

SEQ ID NO: 1550579 - RNA, 14 nt, Human adenovirus C
acgacgggcccggu

SEQ ID NO: 1550580 - RNA, 18 nt, Human adenovirus C
cguaauaaccuuaauccc

SEQ ID NO: 1550581 - RNA, 15 nt, Human adenovirus C
guugagugggggacc

SEQ ID NO: 1550582 - RNA, 22 nt, Human adenovirus C
accucagcgccucccaaaagac

SEQ ID NO: 1550583 - RNA, 21 nt, Human adenovirus C
ucccagcaucgcuacaaccuc

SEQ ID NO: 1550584 - RNA, 14 nt, Human adenovirus C
gcuuguagacugcu

SEQ ID NO: 1550585 - RNA, 22 nt, Human adenovirus C
uugcauuuggguaacaggaggg

SEQ ID NO: 1550586 - RNA, 19 nt, Human adenovirus C
gagacugcagccuccgccg

SEQ ID NO: 1550587 - RNA, 17 nt, Human adenovirus C
ggcgggcggugggccgc

SEQ ID NO: 1550588 - RNA, 14 nt, Human adenovirus C
agggccgcuggcug

SEQ ID NO: 1550589 - RNA, 17 nt, Human adenovirus C
acagccccuacugcacc

SEQ ID NO: 1550590 - RNA, 17 nt, Human adenovirus C
uacagucacaagcccca

SEQ ID NO: 1550591 - RNA, 17 nt, Human adenovirus C
gugccccucgccauagc

SEQ ID NO: 1550592 - RNA, 23 nt, Human adenovirus C
ccugcaacagggucugccagacu

SEQ ID NO: 1550593 - RNA, 13 nt, Human adenovirus C
uggccucuggcau

SEQ ID NO: 1550594 - RNA, 19 nt, Human adenovirus C
uaagauugucaguuuccaa

SEQ ID NO: 1550595 - RNA, 15 nt, Human adenovirus C
cgucuggcugcucga

SEQ ID NO: 1550596 - RNA, 17 nt, Human adenovirus C
augcauccggugcugcg

SEQ ID NO: 1550597 - RNA, 13 nt, Human adenovirus C
gacucugacaaag

SEQ ID NO: 1550598 - RNA, 18 nt, Human adenovirus C
ugagcuccucaggggagc

SEQ ID NO: 1550599 - RNA, 18 nt, Human adenovirus C
ucaugggaaacuggcaag

SEQ ID NO: 1550600 - RNA, 14 nt, Human adenovirus C
cacucgugcuggcu

SEQ ID NO: 1550601 - RNA, 21 nt, Human adenovirus C
guuaagagagcugcagcugcc

SEQ ID NO: 1550602 - RNA, 18 nt, Human adenovirus C
acgagucacuccugcgcc

SEQ ID NO: 1550603 - RNA, 12 nt, Human adenovirus C
ggccgggcaguu

SEQ ID NO: 1550604 - RNA, 19 nt, Human adenovirus C
ccuggccaaccaggcagug

SEQ ID NO: 1550605 - RNA, 19 nt, Human adenovirus C
acgucgccaccgccgccga

SEQ ID NO: 1550606 - RNA, 21 nt, Human adenovirus C
agcgccaacucguuugaugga

SEQ ID NO: 1550607 - RNA, 16 nt, Human adenovirus C
cacuagugaauccaca

SEQ ID NO: 1550608 - RNA, 23 nt, Human adenovirus C
cuugggagaggggcgcuucuuuu

SEQ ID NO: 1550609 - RNA, 17 nt, Human adenovirus C
cccucacccgcagcugc

SEQ ID NO: 1550610 - RNA, 21 nt, Human adenovirus C
cccauggacgagcccacccuu

SEQ ID NO: 1550611 - RNA, 22 nt, Human adenovirus C
cuuaggguugccgccugcugca

SEQ ID NO: 1550612 - RNA, 15 nt, Human adenovirus C
ugcuacaacaaacag

SEQ ID NO: 1550613 - RNA, 18 nt, Human adenovirus C
cuggccccgcgacacggc

SEQ ID NO: 1550614 - RNA, 21 nt, Human adenovirus C
ucucacgcucgcuugguccug

SEQ ID NO: 1550615 - RNA, 20 nt, Human adenovirus C
acgggcggcggccugggcga

SEQ ID NO: 1550616 - RNA, 12 nt, Human adenovirus C
aggggccaagaa

SEQ ID NO: 1550617 - RNA, 21 nt, Human adenovirus C
ucucgcaaggccuggccagug

SEQ ID NO: 1550618 - RNA, 19 nt, Human adenovirus C
gcgguucacccuggcugug

SEQ ID NO: 1550619 - RNA, 16 nt, Human adenovirus C
caacccaacaccuagc

SEQ ID NO: 1550620 - RNA, 12 nt, Human adenovirus C
cgguggcaccua

SEQ ID NO: 1550621 - RNA, 12 nt, Human adenovirus C
ugcgcuccgggc

SEQ ID NO: 1550622 - RNA, 18 nt, Human adenovirus C
uuaaacagcgaggaggag

SEQ ID NO: 1550623 - RNA, 20 nt, Human adenovirus C
cuguugauguggugaaagua

SEQ ID NO: 1550624 - RNA, 20 nt, Human adenovirus C
cuaccccguauuugccgugc

SEQ ID NO: 1550625 - RNA, 19 nt, Human adenovirus C
caccgucgcaugcgcggcg

SEQ ID NO: 1550626 - RNA, 23 nt, Human adenovirus C
aaacguagaggggcucucugagu

SEQ ID NO: 1550627 - RNA, 15 nt, Human adenovirus C
cauuuuugcccuagc

SEQ ID NO: 1550628 - RNA, 14 nt, Human adenovirus C
cgcggcgacggcgc

SEQ ID NO: 1550629 - RNA, 18 nt, Human adenovirus C
caccugucgucagcgcca

SEQ ID NO: 1550630 - RNA, 17 nt, Human adenovirus C
ccgccgccacccacgga

SEQ ID NO: 1550631 - RNA, 21 nt, Human adenovirus C
gugacaacgcgcgccuagccg

SEQ ID NO: 1550632 - RNA, 12 nt, Human adenovirus C
acgugcagacca

SEQ ID NO: 1550633 - RNA, 23 nt, Human adenovirus C
ugggccaaaaccuucucuacgcc

SEQ ID NO: 1550634 - RNA, 16 nt, Human adenovirus C
caacgcugguggcuac

SEQ ID NO: 1550635 - RNA, 22 nt, Human adenovirus C
cagugcuuguuaccguggagcu

SEQ ID NO: 1550636 - RNA, 16 nt, Human adenovirus C
gcggcagcaacagcag

SEQ ID NO: 1550637 - RNA, 16 nt, Human adenovirus C
ugcacuacucuuauaa

SEQ ID NO: 1550638 - RNA, 12 nt, Human adenovirus C
gccacagagggc

SEQ ID NO: 1550639 - RNA, 13 nt, Human adenovirus C
aucaggcuacuaa

SEQ ID NO: 1550640 - RNA, 17 nt, Human adenovirus C
ugcgccccccuccucag

SEQ ID NO: 1550641 - RNA, 19 nt, Human adenovirus C
agacguaugcgcaggagca

SEQ ID NO: 1550642 - RNA, 23 nt, Human adenovirus C
guccauccuuauaucgcccagca

SEQ ID NO: 1550643 - RNA, 13 nt, Human adenovirus C
caagggugcagcu

SEQ ID NO: 1550644 - RNA, 13 nt, Human adenovirus C
gacagggaagaaa

SEQ ID NO: 1550645 - RNA, 14 nt, Human adenovirus C
uaacuccagggugc

SEQ ID NO: 1550646 - RNA, 21 nt, Human adenovirus C
gcaccacauuucggccccacc

SEQ ID NO: 1550647 - RNA, 17 nt, Human adenovirus C
ccgggcagcaggcgcgc

SEQ ID NO: 1550648 - RNA, 17 nt, Human adenovirus C
ggaugucaaauuccuca

SEQ ID NO: 1550649 - RNA, 18 nt, Human adenovirus C
acuugcggcuggagcugc

SEQ ID NO: 1550650 - RNA, 14 nt, Human adenovirus C
ccaacacacagagu

SEQ ID NO: 1550651 - RNA, 17 nt, Human adenovirus C
ccacuguuacucagcca

SEQ ID NO: 1550652 - RNA, 18 nt, Human adenovirus C
ggugcugaagcgcugccg

SEQ ID NO: 1550653 - RNA, 24 nt, Human adenovirus C
cuccugcgccguagcgccauugcu

SEQ ID NO: 1550654 - RNA, 17 nt, Human adenovirus C
cacuggaacccgccgcc

SEQ ID NO: 1550655 - RNA, 16 nt, Human adenovirus C
caguuggaggaguggc

SEQ ID NO: 1550656 - RNA, 19 nt, Human adenovirus C
ggcucgcgaaggaggcagg

SEQ ID NO: 1550657 - RNA, 21 nt, Human adenovirus C
cguacacuggauggccuuugc

SEQ ID NO: 1550658 - RNA, 15 nt, Human adenovirus C
cuggugugggaggac

SEQ ID NO: 1550659 - RNA, 19 nt, Human adenovirus C
caacacggccuccacgcug

SEQ ID NO: 1550660 - RNA, 23 nt, Human adenovirus C
acaugcacaucucgggccaggac

SEQ ID NO: 1550661 - RNA, 23 nt, Human adenovirus C
gcugcccugguguaccaggaaag

SEQ ID NO: 1550662 - RNA, 20 nt, Human adenovirus C
ugccgcggggacaggaggac

SEQ ID NO: 1550663 - RNA, 14 nt, Human adenovirus C
ggagugcugggcca

SEQ ID NO: 1550664 - RNA, 19 nt, Human adenovirus C
cacgaaaaccgccucgggc

SEQ ID NO: 1550665 - RNA, 14 nt, Human adenovirus C
aggaagaagaagag

SEQ ID NO: 1550666 - RNA, 16 nt, Human adenovirus C
ccuuccaggcgcggcg

SEQ ID NO: 1550667 - RNA, 14 nt, Human adenovirus C
gacagaaacacaga

SEQ ID NO: 1550668 - RNA, 21 nt, Human adenovirus C
cagaccguaaaccugagccag

SEQ ID NO: 1550669 - RNA, 15 nt, Human adenovirus C
gcacgcuggccagca

SEQ ID NO: 1550670 - RNA, 16 nt, Human adenovirus C
gcggaugcuggcgcgc

SEQ ID NO: 1550671 - RNA, 19 nt, Human adenovirus C
ugacuaccuuuccgccgcc

SEQ ID NO: 1550672 - RNA, 20 nt, Human adenovirus C
gaacgcggguuuggcagggc

SEQ ID NO: 1550673 - RNA, 19 nt, Human adenovirus C
gucccugcgccgugccgcc

SEQ ID NO: 1550674 - RNA, 20 nt, Human adenovirus C
cuggaccggcugguggggga

SEQ ID NO: 1550675 - RNA, 22 nt, Human adenovirus C
agaccugggccaaaaccuucuc

SEQ ID NO: 1550676 - RNA, 18 nt, Human adenovirus C
cugggcuggagcccgagg

SEQ ID NO: 1550677 - RNA, 14 nt, Human adenovirus C
cuccugccaggcuc

SEQ ID NO: 1550678 - RNA, 12 nt, Human adenovirus C
ggcgggcggcag

SEQ ID NO: 1550679 - RNA, 15 nt, Human adenovirus C
cggucguugaggguc

SEQ ID NO: 1550680 - RNA, 16 nt, Human adenovirus C
ggccuuccggagcgag

SEQ ID NO: 1550681 - RNA, 17 nt, Human adenovirus C
ucauaaccagcaugaag

SEQ ID NO: 1550682 - RNA, 21 nt, Human adenovirus C
cuagcuuuuuuggccacuggc

SEQ ID NO: 1550683 - RNA, 15 nt, Human adenovirus C
uccccccgccgccgc

SEQ ID NO: 1550684 - RNA, 16 nt, Human adenovirus C
gucgccgucgccagcc

SEQ ID NO: 1550685 - RNA, 16 nt, Human adenovirus C
aagcucgccugcgcca

SEQ ID NO: 1550686 - RNA, 12 nt, Human adenovirus C
cagcccacccug

SEQ ID NO: 1550687 - RNA, 15 nt, Human adenovirus C
gagagcugcagcugc

SEQ ID NO: 1550688 - RNA, 23 nt, Human adenovirus C
aacggauguggcaucccugaacu

SEQ ID NO: 1550689 - RNA, 14 nt, Human adenovirus C
uccaccggccgugg

SEQ ID NO: 1550690 - RNA, 14 nt, Human adenovirus C
ccgcugcagccacc

SEQ ID NO: 1550691 - RNA, 15 nt, Human adenovirus C
ggcgaggcgcgccgc

SEQ ID NO: 1550692 - RNA, 18 nt, Human adenovirus C
ccaugcccuucucccacg

SEQ ID NO: 1550693 - RNA, 15 nt, Human adenovirus C
aguaccaacagagga

SEQ ID NO: 1550694 - RNA, 20 nt, Human adenovirus C
guggucaagcaggccaaacu

SEQ ID NO: 1550695 - RNA, 16 nt, Human adenovirus C
guucggggcugugccu

SEQ ID NO: 1550696 - RNA, 21 nt, Human adenovirus C
gcugcuggaaggggguggugu

SEQ ID NO: 1550697 - RNA, 22 nt, Human adenovirus C
gggcacagcagcgcacccugau

SEQ ID NO: 1550698 - RNA, 17 nt, Human adenovirus C
gcccacaccuacagccu

SEQ ID NO: 1550699 - RNA, 17 nt, Human adenovirus C
cagcggcggcagcagca

SEQ ID NO: 1550700 - RNA, 13 nt, Human adenovirus C
cuaaagcccguga

SEQ ID NO: 1550701 - RNA, 20 nt, Human adenovirus C
ggaagaaagcagguuccuga

SEQ ID NO: 1550702 - RNA, 23 nt, Human adenovirus C
aaacuacgucaucuccagcggcc

SEQ ID NO: 1550703 - RNA, 13 nt, Human adenovirus C
cacggcggcgacg

SEQ ID NO: 1550704 - RNA, 18 nt, Human adenovirus C
auguuacauuuaaaucag

SEQ ID NO: 1550705 - RNA, 18 nt, Human adenovirus C
cuggccuuaaaaagcauc

SEQ ID NO: 1550706 - RNA, 20 nt, Human adenovirus C
guugaucuccugaaucuggc

SEQ ID NO: 1550707 - RNA, 18 nt, Human adenovirus C
cauccggugcugcggcag

SEQ ID NO: 1550708 - RNA, 19 nt, Human adenovirus C
ccacuggaacccgccgccg

SEQ ID NO: 1550709 - RNA, 16 nt, Human adenovirus C
uggaggcuugggagug

SEQ ID NO: 1550710 - RNA, 22 nt, Human adenovirus C
cagcggcaaaaagugcuccaug

SEQ ID NO: 1550711 - RNA, 14 nt, Human adenovirus C
ggacggcuacgacu

SEQ ID NO: 1550712 - RNA, 15 nt, Human adenovirus C
caggacgacgcagag

SEQ ID NO: 1550713 - RNA, 16 nt, Human adenovirus C
guggacuucacccaca

SEQ ID NO: 1550714 - RNA, 22 nt, Human adenovirus C
auagccgggucagggcgcgggc

SEQ ID NO: 1550715 - RNA, 19 nt, Human adenovirus C
ugggcgugcagaccgugga

SEQ ID NO: 1550716 - RNA, 14 nt, Human adenovirus C
accagccgcaccgc

SEQ ID NO: 1550717 - RNA, 13 nt, Human adenovirus C
ggcagcggcagca

SEQ ID NO: 1550718 - RNA, 18 nt, Human adenovirus C
ggcgcuggguucccccuu

SEQ ID NO: 1550719 - RNA, 13 nt, Human adenovirus C
gcggcggcggcgc

SEQ ID NO: 1550720 - RNA, 15 nt, Human adenovirus C
cauuuuaaaaaaacu

SEQ ID NO: 1550721 - RNA, 16 nt, Human adenovirus C
ucuaagcagccgccgc

SEQ ID NO: 1550722 - RNA, 18 nt, Human adenovirus C
ugacgcggcggcagaugg

SEQ ID NO: 1550723 - RNA, 14 nt, Human adenovirus C
caggucaucgcgcc

SEQ ID NO: 1550724 - RNA, 21 nt, Human adenovirus C
gcagguuccugagcagcugcg

SEQ ID NO: 1550725 - RNA, 20 nt, Human adenovirus C
cagguuggaauucuucacca

SEQ ID NO: 1550726 - RNA, 18 nt, Human adenovirus C
gcggccuuccggagcgag

SEQ ID NO: 1550727 - RNA, 20 nt, Human adenovirus C
guuugagcacaacauacuga

SEQ ID NO: 1550728 - RNA, 19 nt, Human adenovirus C
ugccuacggaaagcggcau

SEQ ID NO: 1550729 - RNA, 16 nt, Human adenovirus C
gagccuguaagcgggc

SEQ ID NO: 1550730 - RNA, 15 nt, Human adenovirus C
caaccuccgcuccuc

SEQ ID NO: 1550731 - RNA, 14 nt, Human adenovirus C
acaaugacuacagc

SEQ ID NO: 1550732 - RNA, 16 nt, Human adenovirus C
agaaggcguugaggcc

SEQ ID NO: 1550733 - RNA, 21 nt, Human adenovirus C
acccugcgucgcaaccaggaa

SEQ ID NO: 1550734 - RNA, 12 nt, Human adenovirus C
ccggaaacaggg

SEQ ID NO: 1550735 - RNA, 15 nt, Human adenovirus C
caaaccccugacaga

SEQ ID NO: 1550736 - RNA, 19 nt, Human adenovirus C
cagucacaagccccacuga

SEQ ID NO: 1550737 - RNA, 22 nt, Human adenovirus C
cugacaaagcccaagaaaucca

SEQ ID NO: 1550738 - RNA, 23 nt, Human adenovirus C
cuggccugcacccgcgcugaguu

SEQ ID NO: 1550739 - RNA, 18 nt, Human adenovirus C
agcaggaggaagccaggc

SEQ ID NO: 1550740 - RNA, 20 nt, Human adenovirus C
cuugcagauauggcccucac

SEQ ID NO: 1550741 - RNA, 23 nt, Human adenovirus C
aaugcaggaaagggucuggaguu

SEQ ID NO: 1550742 - RNA, 16 nt, Human adenovirus C
cucucuucagcaaaua

SEQ ID NO: 1550743 - RNA, 15 nt, Human adenovirus C
ccggcccaggggcgu

SEQ ID NO: 1550744 - RNA, 21 nt, Human adenovirus C
gacuacuugcaucgcgcggcc

SEQ ID NO: 1550745 - RNA, 23 nt, Human adenovirus C
cguaggcgcucguugguccagca

SEQ ID NO: 1550746 - RNA, 15 nt, Human adenovirus C
cugcgagggccagcu

SEQ ID NO: 1550747 - RNA, 12 nt, Human adenovirus C
gaugcaaaauaa

SEQ ID NO: 1550748 - RNA, 23 nt, Human adenovirus C
aauucccacgcccuacaugugga

SEQ ID NO: 1550749 - RNA, 18 nt, Human adenovirus C
cauggccggccacggccu

SEQ ID NO: 1550750 - RNA, 15 nt, Human adenovirus C
gcauccacaaggccg

SEQ ID NO: 1550751 - RNA, 21 nt, Human adenovirus C
gcguccuggauuugggaggga

SEQ ID NO: 1550752 - RNA, 15 nt, Human adenovirus C
uccgccgccaacaug

SEQ ID NO: 1550753 - RNA, 22 nt, Human adenovirus C
gcucggugaaguuuucacucca

SEQ ID NO: 1550754 - RNA, 12 nt, Human adenovirus C
cagccaggugac

SEQ ID NO: 1550755 - RNA, 20 nt, Human adenovirus C
gcaacaucaacaacagcugc

SEQ ID NO: 1550756 - RNA, 20 nt, Human adenovirus C
uuagcggggugguggaccug

SEQ ID NO: 1550757 - RNA, 23 nt, Human adenovirus C
acccuuauccucaucugcagccu

SEQ ID NO: 1550758 - RNA, 15 nt, Human adenovirus C
cgccaacgcgccuac

SEQ ID NO: 1550759 - RNA, 16 nt, Human adenovirus C
guggagaugacugaau

SEQ ID NO: 1550760 - RNA, 21 nt, Human adenovirus C
gagcgcagcuugagccuggcu

SEQ ID NO: 1550761 - RNA, 16 nt, Human adenovirus C
aggagcuggugcugcg

SEQ ID NO: 1550762 - RNA, 12 nt, Human adenovirus C
cuggugcugcca

SEQ ID NO: 1550763 - RNA, 17 nt, Human adenovirus C
ucucagaugcugaccug

SEQ ID NO: 1550764 - RNA, 14 nt, Human adenovirus C
acuuggaggagggc

SEQ ID NO: 1550765 - RNA, 14 nt, Human adenovirus C
ugugcuacaccugg

SEQ ID NO: 1550766 - RNA, 17 nt, Human adenovirus C
aggauggcacccaaaaa

SEQ ID NO: 1550767 - RNA, 21 nt, Human adenovirus C
gcaugucccugacuugcaugu

SEQ ID NO: 1550768 - RNA, 20 nt, Human adenovirus C
cccuucggcaucgcgggcgc

SEQ ID NO: 1550769 - RNA, 16 nt, Human adenovirus C
uggaacauucccagcu

SEQ ID NO: 1550770 - RNA, 15 nt, Human adenovirus C
accccuauccugccg

SEQ ID NO: 1550771 - RNA, 13 nt, Human adenovirus C
ugcugcagcagcg

SEQ ID NO: 1550772 - RNA, 16 nt, Human adenovirus C
auucagguuccucaca

SEQ ID NO: 1550773 - RNA, 13 nt, Human adenovirus C
ccguuuucccacg

SEQ ID NO: 1550774 - RNA, 22 nt, Human adenovirus C
ccugccgugccaaccgcagccg

SEQ ID NO: 1550775 - RNA, 14 nt, Human adenovirus C
agucucgggccggc

SEQ ID NO: 1550776 - RNA, 22 nt, Human adenovirus C
cucggcuaauauggccugcugc

SEQ ID NO: 1550777 - RNA, 19 nt, Human adenovirus C
gugccaaaaaucuuugagg

SEQ ID NO: 1550778 - RNA, 16 nt, Human adenovirus C
cgcauggucucgguga

SEQ ID NO: 1550779 - RNA, 22 nt, Human adenovirus C
acuuuuaagcccuacuccggca

SEQ ID NO: 1550780 - RNA, 19 nt, Human adenovirus C
cgugguacuuguccaucaa

SEQ ID NO: 1550781 - RNA, 13 nt, Human adenovirus C
aucagcacaguaa

SEQ ID NO: 1550782 - RNA, 23 nt, Human adenovirus C
caggagauuacaagugucagccg

SEQ ID NO: 1550783 - RNA, 12 nt, Human adenovirus C
cucgcugcugca

SEQ ID NO: 1550784 - RNA, 14 nt, Human adenovirus C
cucagcgccuccca

SEQ ID NO: 1550785 - RNA, 15 nt, Human adenovirus C
cucgagaucaggcua

SEQ ID NO: 1550786 - RNA, 16 nt, Human adenovirus C
gccugccgacuuggag

SEQ ID NO: 1550787 - RNA, 18 nt, Human adenovirus C
cuucauauuguugcagau

SEQ ID NO: 1550788 - RNA, 21 nt, Human adenovirus C
cugcagcugccgccgccgcca

SEQ ID NO: 1550789 - RNA, 19 nt, Human adenovirus C
cguaugcgcaggagcacag

SEQ ID NO: 1550790 - RNA, 18 nt, Human adenovirus C
caacuuugguagcugccu

SEQ ID NO: 1550791 - RNA, 13 nt, Human adenovirus C
ggccgacgggcgg

SEQ ID NO: 1550792 - RNA, 14 nt, Human adenovirus C
uacugaaaugugug

SEQ ID NO: 1550793 - RNA, 15 nt, Human adenovirus C
cggaccugggcuggc

SEQ ID NO: 1550794 - RNA, 21 nt, Human adenovirus C
ugcagagcauaguggugcagg

SEQ ID NO: 1550795 - RNA, 22 nt, Human adenovirus C
cgcaauggccaaauccgccguc

SEQ ID NO: 1550796 - RNA, 23 nt, Human adenovirus C
aagcagguuccugagcagcugcg

SEQ ID NO: 1550797 - RNA, 16 nt, Human adenovirus C
cucucugaguauucca

SEQ ID NO: 1550798 - RNA, 19 nt, Human adenovirus C
ggcguggcccuuggcgcgc

SEQ ID NO: 1550799 - RNA, 21 nt, Human adenovirus C
ggacaaacagguggagcugaa

SEQ ID NO: 1550800 - RNA, 22 nt, Human adenovirus C
agagaacuccaacgcggcagcc

SEQ ID NO: 1550801 - RNA, 21 nt, Human adenovirus C
gucauuacccagggccacauc

SEQ ID NO: 1550802 - RNA, 18 nt, Human adenovirus C
cggagaucuauggccccc

SEQ ID NO: 1550803 - RNA, 21 nt, Human adenovirus C
aagaacuauggcagcaaggcc

SEQ ID NO: 1550804 - RNA, 13 nt, Human adenovirus C
cgaccacagcaac

SEQ ID NO: 1550805 - RNA, 14 nt, Human adenovirus C
caccacccuccuca

SEQ ID NO: 1550806 - RNA, 13 nt, Human adenovirus C
ggaacaaaccgaa

SEQ ID NO: 1550807 - RNA, 16 nt, Human adenovirus C
cacggacgaggaggaa

SEQ ID NO: 1550808 - RNA, 23 nt, Human adenovirus C
ccgucaagaaaaacaccaccacc

SEQ ID NO: 1550809 - RNA, 15 nt, Human adenovirus C
ugauggaagcauugu

SEQ ID NO: 1550810 - RNA, 22 nt, Human adenovirus C
auguacaugagcaaacaguaca

SEQ ID NO: 1550811 - RNA, 16 nt, Human adenovirus C
gaacagcagcacaggc

SEQ ID NO: 1550812 - RNA, 22 nt, Human adenovirus C
gaacgguuguuaauuaccuggg

SEQ ID NO: 1550813 - RNA, 15 nt, Human adenovirus C
ugagcugcgagaagg

SEQ ID NO: 1550814 - RNA, 22 nt, Human adenovirus C
acauccgcggcgugcuggacag

SEQ ID NO: 1550815 - RNA, 13 nt, Human adenovirus C
cugcgcccacacc

SEQ ID NO: 1550816 - RNA, 21 nt, Human adenovirus C
cacugcagagcuucaugcugc

SEQ ID NO: 1550817 - RNA, 19 nt, Human adenovirus C
gcuaauauggccugcugca

SEQ ID NO: 1550818 - RNA, 14 nt, Human adenovirus C
cacaacgcgcagcc

SEQ ID NO: 1550819 - RNA, 22 nt, Human adenovirus C
agguggagauagauacggagga

SEQ ID NO: 1550820 - RNA, 23 nt, Human adenovirus C
ccggggcgcgcugcggcugcugu

SEQ ID NO: 1550821 - RNA, 13 nt, Human adenovirus C
ugaugccuuugag

SEQ ID NO: 1550822 - RNA, 19 nt, Human adenovirus C
ccaggcggucccacagcuc

SEQ ID NO: 1550823 - RNA, 23 nt, Human adenovirus C
ccucgucagcguagucuggguca

SEQ ID NO: 1550824 - RNA, 23 nt, Human adenovirus C
accaaaagugguuuuguacagug

SEQ ID NO: 1550825 - RNA, 21 nt, Human adenovirus C
uacaaauaggaucagacaaug

SEQ ID NO: 1550826 - RNA, 21 nt, Human adenovirus C
cgcugcaaccuaugcaccccg

SEQ ID NO: 1550827 - RNA, 23 nt, Human adenovirus C
cagcagguuucugcccugaaggc

SEQ ID NO: 1550828 - RNA, 18 nt, Human adenovirus C
ccgcucgaaggcuggccg

SEQ ID NO: 1550829 - RNA, 12 nt, Human adenovirus C
ggagcugaggcc

SEQ ID NO: 1550830 - RNA, 16 nt, Human adenovirus C
gaacugguugacggcc

SEQ ID NO: 1550831 - RNA, 23 nt, Human adenovirus C
auacaaccccaccaauguggaaa

SEQ ID NO: 1550832 - RNA, 12 nt, Human adenovirus C
ggaagccuggac

SEQ ID NO: 1550833 - RNA, 21 nt, Human adenovirus C
caugaccaugaagaucuggaa

SEQ ID NO: 1550834 - RNA, 15 nt, Human adenovirus C
cauggaaauuaaaac

SEQ ID NO: 1550835 - RNA, 19 nt, Human adenovirus C
guucuucagaaacuuccag

SEQ ID NO: 1550836 - RNA, 22 nt, Human adenovirus C
ugcaggggcccaacucggccgc

SEQ ID NO: 1550837 - RNA, 17 nt, Human adenovirus C
cucaggcaccauccgca

SEQ ID NO: 1550838 - RNA, 17 nt, Human adenovirus C
cgcggcggcggcccugc

SEQ ID NO: 1550839 - RNA, 18 nt, Human adenovirus C
gcgaggugugggugagcg

SEQ ID NO: 1550840 - RNA, 18 nt, Human adenovirus C
gguggaggaggcgcgcaa

SEQ ID NO: 1550841 - RNA, 15 nt, Human adenovirus C
cggaaaccucaccuc

SEQ ID NO: 1550842 - RNA, 20 nt, Human adenovirus C
ccagcaccugucgucagcgc

SEQ ID NO: 1550843 - RNA, 21 nt, Human adenovirus C
ggguuguuucuggcggaggug

SEQ ID NO: 1550844 - RNA, 13 nt, Human adenovirus C
cuugcuagacugc

SEQ ID NO: 1550845 - RNA, 19 nt, Human adenovirus C
cgggccgcucgaaggcugg

SEQ ID NO: 1550846 - RNA, 13 nt, Human adenovirus C
ggggccuccgccc

SEQ ID NO: 1550847 - RNA, 15 nt, Human adenovirus C
ggccuugcggcaggg

SEQ ID NO: 1550848 - RNA, 14 nt, Human adenovirus C
gcuugaggaggagg

SEQ ID NO: 1550849 - RNA, 16 nt, Human adenovirus C
ucgcaacaccacugcu

SEQ ID NO: 1550850 - RNA, 23 nt, Human adenovirus C
gcuaugcgccacuggcagggaca

SEQ ID NO: 1550851 - RNA, 18 nt, Human adenovirus C
cacaggcuggggccugcg

SEQ ID NO: 1550852 - RNA, 13 nt, Human adenovirus C
ggcggugaccugc

SEQ ID NO: 1550853 - RNA, 22 nt, Human adenovirus C
uuguaaaaaucugcuccagagc

SEQ ID NO: 1550854 - RNA, 22 nt, Human adenovirus C
ccuuguccuccgggcacagcag

SEQ ID NO: 1550855 - RNA, 22 nt, Human adenovirus C
ggagcucccgcggcgacagguc

SEQ ID NO: 1550856 - RNA, 23 nt, Human adenovirus C
acgaugcuucuaaauagcuaacg

SEQ ID NO: 1550857 - RNA, 15 nt, Human adenovirus C
ggaaggugcugaggu

SEQ ID NO: 1550858 - RNA, 18 nt, Human adenovirus C
ccggaaaccucaccuccc

SEQ ID NO: 1550859 - RNA, 15 nt, Human adenovirus C
cgggcaggagcuggu

SEQ ID NO: 1550860 - RNA, 14 nt, Human adenovirus C
uguggaaaaaucaa

SEQ ID NO: 1550861 - RNA, 14 nt, Human adenovirus C
ccgccucagccgcu

SEQ ID NO: 1550862 - RNA, 16 nt, Human adenovirus C
agagcuugggcgcgag

SEQ ID NO: 1550863 - RNA, 21 nt, Human adenovirus C
caggcuucguuuugacaucgg

SEQ ID NO: 1550864 - RNA, 14 nt, Human adenovirus C
ucagcuacaagcua

SEQ ID NO: 1550865 - RNA, 19 nt, Human adenovirus C
acagcggcggcagcagcag

SEQ ID NO: 1550866 - RNA, 20 nt, Human adenovirus C
cuggaagccaugcucagaaa

SEQ ID NO: 1550867 - RNA, 22 nt, Human adenovirus C
cuccgagauuuuccaugcauuc

SEQ ID NO: 1550868 - RNA, 16 nt, Human adenovirus C
aagucuaagcagccgc

SEQ ID NO: 1550869 - RNA, 15 nt, Human adenovirus C
ugcgauacacagggu

SEQ ID NO: 1550870 - RNA, 13 nt, Human adenovirus C
ugggaaacuggca

SEQ ID NO: 1550871 - RNA, 13 nt, Human adenovirus C
cccaacuccaugc

SEQ ID NO: 1550872 - RNA, 14 nt, Human adenovirus C
guaccgcgaggcca

SEQ ID NO: 1550873 - RNA, 22 nt, Human adenovirus C
gcucuggccggugaggcgugcg

SEQ ID NO: 1550874 - RNA, 18 nt, Human adenovirus C
gcaacaucaacaacagcu

SEQ ID NO: 1550875 - RNA, 16 nt, Human adenovirus C
gacucugacaaagccc

SEQ ID NO: 1550876 - RNA, 20 nt, Human adenovirus C
ucuaacaguaccucuugguu

SEQ ID NO: 1550877 - RNA, 14 nt, Human adenovirus C
cgcuugaggaggag

SEQ ID NO: 1550878 - RNA, 15 nt, Human adenovirus C
cagacgacagcagcg

SEQ ID NO: 1550879 - RNA, 16 nt, Human adenovirus C
uugcuggaacagagcu

SEQ ID NO: 1550880 - RNA, 11 nt, Human adenovirus C
ugguuuccaag

SEQ ID NO: 1550881 - RNA, 14 nt, Human adenovirus C
cggcaccagcaaua

SEQ ID NO: 1550882 - RNA, 23 nt, Human adenovirus C
gcuggccgaaaacagggccaucc

SEQ ID NO: 1550883 - RNA, 17 nt, Human adenovirus C
gcgagugguggcucccg

SEQ ID NO: 1550884 - RNA, 14 nt, Human adenovirus C
gggcccccggaggu

SEQ ID NO: 1550885 - RNA, 20 nt, Human adenovirus C
cgugaccggguguuccugaa

SEQ ID NO: 1550886 - RNA, 23 nt, Human adenovirus C
caggcgauccuaacucugcagac

SEQ ID NO: 1550887 - RNA, 21 nt, Human adenovirus C
cgcccagcguggcgcuggaca

SEQ ID NO: 1550888 - RNA, 14 nt, Human adenovirus C
cggagugcugggcc

SEQ ID NO: 1550889 - RNA, 20 nt, Human adenovirus C
aucaccuacgaugaccugga

SEQ ID NO: 1550890 - RNA, 20 nt, Human adenovirus C
uuaacaauaccuguguggaa

SEQ ID NO: 1550891 - RNA, 17 nt, Human adenovirus C
agcgcgaaaagaaccug

SEQ ID NO: 1550892 - RNA, 16 nt, Human adenovirus C
cagcaggugcugccca

SEQ ID NO: 1550893 - RNA, 18 nt, Human adenovirus C
gcagcacaggccagaugc

SEQ ID NO: 1550894 - RNA, 15 nt, Human adenovirus C
ucuuuaauuaugaaa

SEQ ID NO: 1550895 - RNA, 20 nt, Human adenovirus C
ucugcuuaaaagccaccuga

SEQ ID NO: 1550896 - RNA, 18 nt, Human adenovirus C
ccaagguuaugagcacag

SEQ ID NO: 1550897 - RNA, 13 nt, Human adenovirus C
uccgcaauacaga

SEQ ID NO: 1550898 - RNA, 23 nt, Human adenovirus C
gcagcggcaagagcaagagcagc

SEQ ID NO: 1550899 - RNA, 22 nt, Human adenovirus C
gucauaccacugcaacagguua

SEQ ID NO: 1550900 - RNA, 17 nt, Human adenovirus C
ggaggacuuugagcccg

SEQ ID NO: 1550901 - RNA, 17 nt, Human adenovirus C
cacccuacuuucccagu

SEQ ID NO: 1550902 - RNA, 15 nt, Human adenovirus C
gcagcacagcaggga

SEQ ID NO: 1550903 - RNA, 14 nt, Human adenovirus C
gcaguagucggugc

SEQ ID NO: 1550904 - RNA, 16 nt, Human adenovirus C
cagcacgaaggaggcu

SEQ ID NO: 1550905 - RNA, 12 nt, Human adenovirus C
gcgcgcuggggc

SEQ ID NO: 1550906 - RNA, 19 nt, Human adenovirus C
acuuucuccaaaguuuaaa

SEQ ID NO: 1550907 - RNA, 19 nt, Human adenovirus C
gagugggaauuugagcccc

SEQ ID NO: 1550908 - RNA, 21 nt, Human adenovirus C
aaacaacucgcugcugcagcc

SEQ ID NO: 1550909 - RNA, 22 nt, Human adenovirus C
gcgcuggccgaaaacagggcca

SEQ ID NO: 1550910 - RNA, 15 nt, Human adenovirus C
ccuguaagcgggcac

SEQ ID NO: 1550911 - RNA, 21 nt, Human adenovirus C
uacggaggauaggguggccuu

SEQ ID NO: 1550912 - RNA, 19 nt, Human adenovirus C
guagguggcgcccucuucc

SEQ ID NO: 1550913 - RNA, 14 nt, Human adenovirus C
acgcgcgagccugc

SEQ ID NO: 1550914 - RNA, 15 nt, Human adenovirus C
ccacagaacaugaaa

SEQ ID NO: 1550915 - RNA, 13 nt, Human adenovirus C
agcggacaagcag

SEQ ID NO: 1550916 - RNA, 12 nt, Human adenovirus C
cguccgagcgag

SEQ ID NO: 1550917 - RNA, 14 nt, Human adenovirus C
ccacuguuacucag

SEQ ID NO: 1550918 - RNA, 21 nt, Human adenovirus C
caugucuaccugcggggcgau

SEQ ID NO: 1550919 - RNA, 21 nt, Human adenovirus C
aacgccacaacauaaaagaag

SEQ ID NO: 1550920 - RNA, 13 nt, Human adenovirus C
ugcuucccaggau

SEQ ID NO: 1550921 - RNA, 22 nt, Human adenovirus C
ccucguaggugagcuccucagg

SEQ ID NO: 1550922 - RNA, 22 nt, Human adenovirus C
ugcuuaaaaaaacaacucccau

SEQ ID NO: 1550923 - RNA, 17 nt, Human adenovirus C
agggcguagagcuuggg

SEQ ID NO: 1550924 - RNA, 20 nt, Human adenovirus C
acucugguaucucagccgcc

SEQ ID NO: 1550925 - RNA, 16 nt, Human adenovirus C
ccuccugccaggcuca

SEQ ID NO: 1550926 - RNA, 18 nt, Human adenovirus C
guggccuccgacuguggu

SEQ ID NO: 1550927 - RNA, 16 nt, Human adenovirus C
uaccgcgucaggaggg

SEQ ID NO: 1550928 - RNA, 16 nt, Human adenovirus C
guuccuugcauuuggg

SEQ ID NO: 1550929 - RNA, 13 nt, Human adenovirus C
ugggcuccagcau

SEQ ID NO: 1550930 - RNA, 24 nt, Human adenovirus C
agcagguuccugagcagcugcgac

SEQ ID NO: 1550931 - RNA, 19 nt, Human adenovirus C
gcgaaaagaaccugccucc

SEQ ID NO: 1550932 - RNA, 17 nt, Human adenovirus C
ccaggcuuugaguugca

SEQ ID NO: 1550933 - RNA, 18 nt, Human adenovirus C
cggcugaagcagggccag

SEQ ID NO: 1550934 - RNA, 16 nt, Human adenovirus C
aacaaucuaugccaaa

SEQ ID NO: 1550935 - RNA, 13 nt, Human adenovirus C
ggcagaaacagag

SEQ ID NO: 1550936 - RNA, 22 nt, Human adenovirus C
aagcagguuccugagcagcugc

SEQ ID NO: 1550937 - RNA, 19 nt, Human adenovirus C
ggcuccuuugucuggagaa

SEQ ID NO: 1550938 - RNA, 18 nt, Human adenovirus C
ccacagaccggucccagc

SEQ ID NO: 1550939 - RNA, 12 nt, Human adenovirus C
uccugccccucc

SEQ ID NO: 1550940 - RNA, 16 nt, Human adenovirus C
gccccaggcuggggag

SEQ ID NO: 1550941 - RNA, 17 nt, Human adenovirus C
uggccaaccaggcagug

SEQ ID NO: 1550942 - RNA, 15 nt, Human adenovirus C
gagcgguggcgccuu

SEQ ID NO: 1550943 - RNA, 19 nt, Human adenovirus C
gcggcgguugaucuccuga

SEQ ID NO: 1550944 - RNA, 19 nt, Human adenovirus C
gagggugacaacgcgcgcc

SEQ ID NO: 1550945 - RNA, 16 nt, Human adenovirus C
cgcugcggccgcgucc

SEQ ID NO: 1550946 - RNA, 18 nt, Human adenovirus C
ucgccggcgccccagaaa

SEQ ID NO: 1550947 - RNA, 21 nt, Human adenovirus C
cgcccacaccuacagccugag

SEQ ID NO: 1550948 - RNA, 14 nt, Human adenovirus C
ugcccuugauggag

SEQ ID NO: 1550949 - RNA, 18 nt, Human adenovirus C
auuuccaacguggagcuc

SEQ ID NO: 1550950 - RNA, 20 nt, Human adenovirus C
gauauuuuucuauguggaau

SEQ ID NO: 1550951 - RNA, 12 nt, Human adenovirus C
accaauguggaa

SEQ ID NO: 1550952 - RNA, 18 nt, Human adenovirus C
caagagcaagagcagcgg

SEQ ID NO: 1550953 - RNA, 17 nt, Human adenovirus C
aaaaugaaagucacugu

SEQ ID NO: 1550954 - RNA, 16 nt, Human adenovirus C
acccacccaaagcaga

SEQ ID NO: 1550955 - RNA, 16 nt, Human adenovirus C
ugucgcgcaccucgcg

SEQ ID NO: 1550956 - RNA, 15 nt, Human adenovirus C
gaucaaacccagcuu

SEQ ID NO: 1550957 - RNA, 21 nt, Human adenovirus C
gacuaucgcaacaccacugcu

SEQ ID NO: 1550958 - RNA, 22 nt, Human adenovirus C
guuugcaacuguccuaacccug

SEQ ID NO: 1550959 - RNA, 18 nt, Human adenovirus C
caaacuuucuccaaaguu

SEQ ID NO: 1550960 - RNA, 13 nt, Human adenovirus C
cgagcaggcagag

SEQ ID NO: 1550961 - RNA, 19 nt, Human adenovirus C
cguggcucguuacaacagc

SEQ ID NO: 1550962 - RNA, 20 nt, Human adenovirus C
gcacaguguauccggugcac

SEQ ID NO: 1550963 - RNA, 16 nt, Human adenovirus C
ugcgcgucggccaggu

SEQ ID NO: 1550964 - RNA, 13 nt, Human adenovirus C
aacagcagcacag

SEQ ID NO: 1550965 - RNA, 18 nt, Human adenovirus C
gccuugcaggcgcagaga

SEQ ID NO: 1550966 - RNA, 19 nt, Human adenovirus C
ucaauccguucugguuccg

SEQ ID NO: 1550967 - RNA, 15 nt, Human adenovirus C
auauggccugcugca

SEQ ID NO: 1550968 - RNA, 19 nt, Human adenovirus C
gcguugcaagagcgcagcg

SEQ ID NO: 1550969 - RNA, 15 nt, Human adenovirus C
cagcggcggcggcgc

SEQ ID NO: 1550970 - RNA, 15 nt, Human adenovirus C
aagcgcagacgcgcc

SEQ ID NO: 1550971 - RNA, 18 nt, Human adenovirus C
uaacugacaccuaucaag

SEQ ID NO: 1550972 - RNA, 14 nt, Human adenovirus C
ccugcugcaccugc

SEQ ID NO: 1550973 - RNA, 18 nt, Human adenovirus C
gguacccaacuccaugcu

SEQ ID NO: 1550974 - RNA, 19 nt, Human adenovirus C
acagauaauggcauuugua

SEQ ID NO: 1550975 - RNA, 15 nt, Human adenovirus C
cgaucggcaggcuca

SEQ ID NO: 1550976 - RNA, 22 nt, Human adenovirus C
cagcggucccauccaaggucca

SEQ ID NO: 1550977 - RNA, 13 nt, Human adenovirus C
ccaaagcagacca

SEQ ID NO: 1550978 - RNA, 16 nt, Human adenovirus C
augccgcaguggucuu

SEQ ID NO: 1550979 - RNA, 18 nt, Human adenovirus C
ggacugggcgugcagacc

SEQ ID NO: 1550980 - RNA, 18 nt, Human adenovirus C
aaacaauuacaaaaagcg

SEQ ID NO: 1550981 - RNA, 17 nt, Human adenovirus C
acaugaccaaggacugg

SEQ ID NO: 1550982 - RNA, 20 nt, Human adenovirus C
gugcgccacaauguggccuc

SEQ ID NO: 1550983 - RNA, 15 nt, Human adenovirus C
guaacucuacaagcu

SEQ ID NO: 1550984 - RNA, 19 nt, Human adenovirus C
gcuccacaggucacgggcc

SEQ ID NO: 1550985 - RNA, 14 nt, Human adenovirus C
gcaacaccacugcu

SEQ ID NO: 1550986 - RNA, 15 nt, Human adenovirus C
aagcgugcaggggcc

SEQ ID NO: 1550987 - RNA, 18 nt, Human adenovirus C
cggcaaccgccucagcua

SEQ ID NO: 1550988 - RNA, 24 nt, Human adenovirus C
aacccaccauuuguagcgccacau

SEQ ID NO: 1550989 - RNA, 20 nt, Human adenovirus C
acagccugcaaagggcccug

SEQ ID NO: 1550990 - RNA, 17 nt, Human adenovirus C
cgcaaccgcagacccug

SEQ ID NO: 1550991 - RNA, 18 nt, Human adenovirus C
caugagccgguguccacg

SEQ ID NO: 1550992 - RNA, 15 nt, Human adenovirus C
gccaugcaucugugg

SEQ ID NO: 1550993 - RNA, 15 nt, Human adenovirus C
ccguccugcaggaau

SEQ ID NO: 1550994 - RNA, 16 nt, Human adenovirus C
cagcaaauacugcgcg

SEQ ID NO: 1550995 - RNA, 13 nt, Human adenovirus C
ggcuugcucgccc

SEQ ID NO: 1550996 - RNA, 16 nt, Human adenovirus C
caaggaaauucccacg

SEQ ID NO: 1550997 - RNA, 11 nt, Human adenovirus C
uuagcccaaga

SEQ ID NO: 1550998 - RNA, 19 nt, Human adenovirus C
gguccugcuggugcugaag

SEQ ID NO: 1550999 - RNA, 15 nt, Human adenovirus C
caccggcggcagcgg

SEQ ID NO: 1551000 - RNA, 19 nt, Human adenovirus C
cuccaucccaucgcgcaac

SEQ ID NO: 1551001 - RNA, 17 nt, Human adenovirus C
agcaggagcgcugggcg

SEQ ID NO: 1551002 - RNA, 18 nt, Human adenovirus C
acccaagggugcagcuga

SEQ ID NO: 1551003 - RNA, 12 nt, Human adenovirus C
acucgcugcugc

SEQ ID NO: 1551004 - RNA, 14 nt, Human adenovirus C
aucgcccagcaaua

SEQ ID NO: 1551005 - RNA, 18 nt, Human adenovirus C
cagaugccgcggugcagg

SEQ ID NO: 1551006 - RNA, 20 nt, Human adenovirus C
aaggguugagucgcaggacc

SEQ ID NO: 1551007 - RNA, 15 nt, Human adenovirus C
ccugauuuccagggg

SEQ ID NO: 1551008 - RNA, 19 nt, Human adenovirus C
ggaccuggccaaccaggca

SEQ ID NO: 1551009 - RNA, 14 nt, Human adenovirus C
ucacccgcagcugc

SEQ ID NO: 1551010 - RNA, 15 nt, Human adenovirus C
ucaauaugucucuaa

SEQ ID NO: 1551011 - RNA, 21 nt, Human adenovirus C
ccgcuuuccaagauggcuacc

SEQ ID NO: 1551012 - RNA, 14 nt, Human adenovirus C
aaaaggcaaacugc

SEQ ID NO: 1551013 - RNA, 17 nt, Human adenovirus C
cagcaaggccuggaaca

SEQ ID NO: 1551014 - RNA, 15 nt, Human adenovirus C
gugcuugccaccuau

SEQ ID NO: 1551015 - RNA, 14 nt, Human adenovirus C
cacccgcagcugcc

SEQ ID NO: 1551016 - RNA, 16 nt, Human adenovirus C
ggcgacgaggaccugc

SEQ ID NO: 1551017 - RNA, 21 nt, Human adenovirus C
cuucaaaucaaacuuuccugg

SEQ ID NO: 1551018 - RNA, 16 nt, Human adenovirus C
uguuggcguugccgcu

SEQ ID NO: 1551019 - RNA, 18 nt, Human adenovirus C
ccauggcuaccggagugc

SEQ ID NO: 1551020 - RNA, 15 nt, Human adenovirus C
ggaagaagaagagca

SEQ ID NO: 1551021 - RNA, 15 nt, Human adenovirus C
cccgggcuggugcag

SEQ ID NO: 1551022 - RNA, 17 nt, Human adenovirus C
cgaugagacccgcacca

SEQ ID NO: 1551023 - RNA, 15 nt, Human adenovirus C
ugccaccucccuccc

SEQ ID NO: 1551024 - RNA, 22 nt, Human adenovirus C
cacugugguacuucccagagac

SEQ ID NO: 1551025 - RNA, 22 nt, Human adenovirus C
cgcaucgcuaugcgccacuggc

SEQ ID NO: 1551026 - RNA, 21 nt, Human adenovirus C
gaaggucaucaagacuuugga

SEQ ID NO: 1551027 - RNA, 18 nt, Human adenovirus C
acuuugcuuuccugagcc

SEQ ID NO: 1551028 - RNA, 19 nt, Human adenovirus C
aacaaguugcauguggaaa

SEQ ID NO: 1551029 - RNA, 15 nt, Human adenovirus C
gcgcgcccuggggcg

SEQ ID NO: 1551030 - RNA, 22 nt, Human adenovirus C
ggcggggauggcgcaggcggcg

SEQ ID NO: 1551031 - RNA, 17 nt, Human adenovirus C
aggaaagucccgcuccc

SEQ ID NO: 1551032 - RNA, 13 nt, Human adenovirus C
gauuaaacauggc

SEQ ID NO: 1551033 - RNA, 18 nt, Human adenovirus C
cggcucaaccaucgcgcc

SEQ ID NO: 1551034 - RNA, 20 nt, Human adenovirus C
ccauggacgagcccacccuu

SEQ ID NO: 1551035 - RNA, 14 nt, Human adenovirus C
cggcagaugcgccc

SEQ ID NO: 1551036 - RNA, 12 nt, Human adenovirus C
ccgggcagcagg

SEQ ID NO: 1551037 - RNA, 17 nt, Human adenovirus C
caggacgacgcagaggc

SEQ ID NO: 1551038 - RNA, 21 nt, Human adenovirus C
cuggaugugaccgaggagcug

SEQ ID NO: 1551039 - RNA, 18 nt, Human adenovirus C
ugaccacuuacuggcugc

SEQ ID NO: 1551040 - RNA, 20 nt, Human adenovirus C
accuccuuuccuuccuccca

SEQ ID NO: 1551041 - RNA, 14 nt, Human adenovirus C
gcgguugugcaggg

SEQ ID NO: 1551042 - RNA, 16 nt, Human adenovirus C
gcgcccuucacggaca

SEQ ID NO: 1551043 - RNA, 21 nt, Human adenovirus C
cugucaugguuuuuugcagua

SEQ ID NO: 1551044 - RNA, 12 nt, Human adenovirus C
ugaugacaaacu

SEQ ID NO: 1551045 - RNA, 21 nt, Human adenovirus C
ggcggcgcugcagagccagcc

SEQ ID NO: 1551046 - RNA, 24 nt, Human adenovirus C
cagcgugagcgcgcgcagcagcag

SEQ ID NO: 1551047 - RNA, 17 nt, Human adenovirus C
ugaagaagaggaagaag

SEQ ID NO: 1551048 - RNA, 14 nt, Human adenovirus C
cugggacagccuag

SEQ ID NO: 1551049 - RNA, 23 nt, Human adenovirus C
uagauuugcaagacagaaacaca

SEQ ID NO: 1551050 - RNA, 20 nt, Human adenovirus C
ugguggaggaggcgcgcaac

SEQ ID NO: 1551051 - RNA, 18 nt, Human adenovirus C
cugucccuuuuuuuucca

SEQ ID NO: 1551052 - RNA, 23 nt, Human adenovirus C
cgcuguccacgaucaccucuggg

SEQ ID NO: 1551053 - RNA, 22 nt, Human adenovirus C
cagagcuuccacuuggucaggc

SEQ ID NO: 1551054 - RNA, 16 nt, Human adenovirus C
uccgugcgcuuuuugg

SEQ ID NO: 1551055 - RNA, 15 nt, Human adenovirus C
uggcggcggcgcugg

SEQ ID NO: 1551056 - RNA, 17 nt, Human adenovirus C
cggcugaagcagggcca

SEQ ID NO: 1551057 - RNA, 15 nt, Human adenovirus C
ggcguguggcagcaa

SEQ ID NO: 1551058 - RNA, 15 nt, Human adenovirus C
cugcuuaaccgcgca

SEQ ID NO: 1551059 - RNA, 16 nt, Human adenovirus C
cuggacauaaacauua

SEQ ID NO: 1551060 - RNA, 19 nt, Human adenovirus C
ugucugcgagggccagcug

SEQ ID NO: 1551061 - RNA, 13 nt, Human adenovirus C
cagccgcggccau

SEQ ID NO: 1551062 - RNA, 21 nt, Human adenovirus C
ccaggcgacgagcggccgccg

SEQ ID NO: 1551063 - RNA, 18 nt, Human adenovirus C
aagcuggcgucugugaga

SEQ ID NO: 1551064 - RNA, 13 nt, Human adenovirus C
gcaaaauaaaaaa

SEQ ID NO: 1551065 - RNA, 15 nt, Human adenovirus C
ugaagacgacgggcc

SEQ ID NO: 1551066 - RNA, 17 nt, Human adenovirus C
auuggcuaccagggcuu

SEQ ID NO: 1551067 - RNA, 16 nt, Human adenovirus C
aggcggucccacagcu

SEQ ID NO: 1551068 - RNA, 19 nt, Human adenovirus C
aggggcaacauccgcggcu

SEQ ID NO: 1551069 - RNA, 18 nt, Human adenovirus C
ugagcgcgcgcagcagca

SEQ ID NO: 1551070 - RNA, 22 nt, Human adenovirus C
aaggacugguuccuggugcaga

SEQ ID NO: 1551071 - RNA, 16 nt, Human adenovirus C
gaggaggcgccgcacg

SEQ ID NO: 1551072 - RNA, 14 nt, Human adenovirus C
agcgggcacucuuc

SEQ ID NO: 1551073 - RNA, 15 nt, Human adenovirus C
cacuccacaggcugc

SEQ ID NO: 1551074 - RNA, 19 nt, Human adenovirus C
agaacaugccgcaagacuu

SEQ ID NO: 1551075 - RNA, 12 nt, Human adenovirus C
aaugccaucuug

SEQ ID NO: 1551076 - RNA, 19 nt, Human adenovirus C
cugugccuuuuacugcugc

SEQ ID NO: 1551077 - RNA, 22 nt, Human adenovirus C
uccauagagcagcugaccacuu

SEQ ID NO: 1551078 - RNA, 18 nt, Human adenovirus C
cggcgacccucagaccgg

SEQ ID NO: 1551079 - RNA, 11 nt, Human adenovirus C
ugaugacaaac

SEQ ID NO: 1551080 - RNA, 17 nt, Human adenovirus C
cucccaaaauguaacca

SEQ ID NO: 1551081 - RNA, 23 nt, Human adenovirus C
uauucugcugcauguuucuccac

SEQ ID NO: 1551082 - RNA, 13 nt, Human adenovirus C
ggaggaggagcgc

SEQ ID NO: 1551083 - RNA, 14 nt, Human adenovirus C
gagaaggugcuggc

SEQ ID NO: 1551084 - RNA, 18 nt, Human adenovirus C
ugccaucuugaacccgca

SEQ ID NO: 1551085 - RNA, 19 nt, Human adenovirus C
agacugggguuugacccag

SEQ ID NO: 1551086 - RNA, 18 nt, Human adenovirus C
cggcccgaugaggccggc

SEQ ID NO: 1551087 - RNA, 12 nt, Human adenovirus C
cccacgccgcca

SEQ ID NO: 1551088 - RNA, 14 nt, Human adenovirus C
caugagcgagcuga

SEQ ID NO: 1551089 - RNA, 21 nt, Human adenovirus C
gcaggaggacacgggcagccu

SEQ ID NO: 1551090 - RNA, 21 nt, Human adenovirus C
cuggacaauuuacucuaugug

SEQ ID NO: 1551091 - RNA, 21 nt, Human adenovirus C
cgcgacuacgguaccgcgcgg

SEQ ID NO: 1551092 - RNA, 19 nt, Human adenovirus C
uuggagaugcgggccauga

SEQ ID NO: 1551093 - RNA, 15 nt, Human adenovirus C
gcagcaucgagguca

SEQ ID NO: 1551094 - RNA, 20 nt, Human adenovirus C
aggagaagcgcgcugaggcc

SEQ ID NO: 1551095 - RNA, 21 nt, Human adenovirus C
aaacuuaccuacgaaaaaacc

SEQ ID NO: 1551096 - RNA, 17 nt, Human adenovirus C
ucgcugcugcagccgca

SEQ ID NO: 1551097 - RNA, 19 nt, Human adenovirus C
ggccuggucuacgacgcgc

SEQ ID NO: 1551098 - RNA, 13 nt, Human adenovirus C
cgccagcccgugc

SEQ ID NO: 1551099 - RNA, 19 nt, Human adenovirus C
accaguuggaggaguggcu

SEQ ID NO: 1551100 - RNA, 17 nt, Human adenovirus C
cuuguaauucuguuuau

SEQ ID NO: 1551101 - RNA, 12 nt, Human adenovirus C
agcaugaugcaa

SEQ ID NO: 1551102 - RNA, 20 nt, Human adenovirus C
aggcggccgcccuugcgcga

SEQ ID NO: 1551103 - RNA, 16 nt, Human adenovirus C
cggccuaccgggggga

SEQ ID NO: 1551104 - RNA, 14 nt, Human adenovirus C
caggcgcugaaaga

SEQ ID NO: 1551105 - RNA, 19 nt, Human adenovirus C
gcggcgccaguggcggcgg

SEQ ID NO: 1551106 - RNA, 18 nt, Human adenovirus C
ccagaccgucugaagaca

SEQ ID NO: 1551107 - RNA, 19 nt, Human adenovirus C
acccggcggugcgggcggc

SEQ ID NO: 1551108 - RNA, 15 nt, Human adenovirus C
cugcuccucuucccg

SEQ ID NO: 1551109 - RNA, 18 nt, Human adenovirus C
gcugcgagagcucggugu

SEQ ID NO: 1551110 - RNA, 13 nt, Human adenovirus C
cuccggcacugcc

SEQ ID NO: 1551111 - RNA, 17 nt, Human adenovirus C
gccagcgcacuacugcc

SEQ ID NO: 1551112 - RNA, 17 nt, Human adenovirus C
caggcgcggcggcugcu

SEQ ID NO: 1551113 - RNA, 12 nt, Human adenovirus C
cgcgguggugga

SEQ ID NO: 1551114 - RNA, 19 nt, Human adenovirus C
cacuguuacucagccacuu

SEQ ID NO: 1551115 - RNA, 20 nt, Human adenovirus C
gacaccacuggaaccagggc

SEQ ID NO: 1551116 - RNA, 16 nt, Human adenovirus C
ccuccucaccugccgg

SEQ ID NO: 1551117 - RNA, 21 nt, Human adenovirus C
gaagaugucuuggaaaaaaug

SEQ ID NO: 1551118 - RNA, 12 nt, Human adenovirus C
ggaaacuggcaa

SEQ ID NO: 1551119 - RNA, 19 nt, Human adenovirus C
agacacgaucggcaggcuc

SEQ ID NO: 1551120 - RNA, 16 nt, Human adenovirus C
cgacgccgaaccacca

SEQ ID NO: 1551121 - RNA, 17 nt, Human adenovirus C
cgccaccaguuggagga

SEQ ID NO: 1551122 - RNA, 17 nt, Human adenovirus C
cgggagagggggcaggg

SEQ ID NO: 1551123 - RNA, 13 nt, Human adenovirus C
gaccaugaagauc

SEQ ID NO: 1551124 - RNA, 17 nt, Human adenovirus C
acgcgcgagccugccga

SEQ ID NO: 1551125 - RNA, 18 nt, Human adenovirus C
gcgccaguggcggcggcg

SEQ ID NO: 1551126 - RNA, 16 nt, Human adenovirus C
ugcuugcgcuuaaaau

SEQ ID NO: 1551127 - RNA, 21 nt, Human adenovirus C
cuuagaaauaggauuuuuccc

SEQ ID NO: 1551128 - RNA, 13 nt, Human adenovirus C
uccggggggucug

SEQ ID NO: 1551129 - RNA, 21 nt, Human adenovirus C
gcacccaaaaagaagcugcag

SEQ ID NO: 1551130 - RNA, 17 nt, Human adenovirus C
ucuuggaaaaaaugacc

SEQ ID NO: 1551131 - RNA, 17 nt, Human adenovirus C
gcagcgccagugcgcca

SEQ ID NO: 1551132 - RNA, 22 nt, Human adenovirus C
gcuugaucugcuggcgcagaag

SEQ ID NO: 1551133 - RNA, 14 nt, Human adenovirus C
accauuuuugcccu

SEQ ID NO: 1551134 - RNA, 12 nt, Human adenovirus C
ggcggcgguggg

SEQ ID NO: 1551135 - RNA, 17 nt, Human adenovirus C
cauguacucguucuuca

SEQ ID NO: 1551136 - RNA, 15 nt, Human adenovirus C
gcaggcggccgcugc

SEQ ID NO: 1551137 - RNA, 24 nt, Human adenovirus C
cccuaacaguggcaaccaccgcuc

SEQ ID NO: 1551138 - RNA, 15 nt, Human adenovirus C
caagcaggccaaacu

SEQ ID NO: 1551139 - RNA, 23 nt, Human adenovirus C
cgagcgguugcugcgcgaggagg

SEQ ID NO: 1551140 - RNA, 14 nt, Human adenovirus C
uuuacugcugcugg

SEQ ID NO: 1551141 - RNA, 13 nt, Human adenovirus C
caccgcucugcuu

SEQ ID NO: 1551142 - RNA, 16 nt, Human adenovirus C
cuaaggacaaacaggu

SEQ ID NO: 1551143 - RNA, 19 nt, Human adenovirus C
gccuaccggggggagaaac

SEQ ID NO: 1551144 - RNA, 18 nt, Human adenovirus C
cucguuacaacagcggca

SEQ ID NO: 1551145 - RNA, 14 nt, Human adenovirus C
gcggcaacccuucc

SEQ ID NO: 1551146 - RNA, 13 nt, Human adenovirus C
uuuguaauuuaca

SEQ ID NO: 1551147 - RNA, 17 nt, Human adenovirus C
ccauuaaaaaccuccuc

SEQ ID NO: 1551148 - RNA, 13 nt, Human adenovirus C
aguccacaaaaaa

SEQ ID NO: 1551149 - RNA, 20 nt, Human adenovirus C
gccgggucagggcgcgggcu

SEQ ID NO: 1551150 - RNA, 16 nt, Human adenovirus C
gccgaggaugaagaag

SEQ ID NO: 1551151 - RNA, 18 nt, Human adenovirus C
uccauagagcagcugacc

SEQ ID NO: 1551152 - RNA, 12 nt, Human adenovirus C
aaacauguaaaa

SEQ ID NO: 1551153 - RNA, 16 nt, Human adenovirus C
accuucgccccaggcu

SEQ ID NO: 1551154 - RNA, 22 nt, Human adenovirus C
cuaaugagcuugaucugcuggc

SEQ ID NO: 1551155 - RNA, 15 nt, Human adenovirus C
acuucagacuggggu

SEQ ID NO: 1551156 - RNA, 17 nt, Human adenovirus C
gcaauacagagacagga

SEQ ID NO: 1551157 - RNA, 17 nt, Human adenovirus C
ccugugcuuugcuccca

SEQ ID NO: 1551158 - RNA, 17 nt, Human adenovirus C
cuuaccauuacacuuaa

SEQ ID NO: 1551159 - RNA, 20 nt, Human adenovirus C
gcucuccgcaauucuggaag

SEQ ID NO: 1551160 - RNA, 22 nt, Human adenovirus C
acaucaacuuugcgucucuggc

SEQ ID NO: 1551161 - RNA, 24 nt, Human adenovirus C
cgaugacucggcagacgacagcag

SEQ ID NO: 1551162 - RNA, 20 nt, Human adenovirus C
agcgcagcuugagccuggcu

SEQ ID NO: 1551163 - RNA, 22 nt, Human adenovirus C
acuugcaucgcgcggccgccgu

SEQ ID NO: 1551164 - RNA, 14 nt, Human adenovirus C
ccagacgcggcugu

SEQ ID NO: 1551165 - RNA, 19 nt, Human adenovirus C
cagccgguggaggacauga

SEQ ID NO: 1551166 - RNA, 18 nt, Human adenovirus C
uagggcgcaguaguccag

SEQ ID NO: 1551167 - RNA, 20 nt, Human adenovirus C
ugacggggagggcuacaacg

SEQ ID NO: 1551168 - RNA, 23 nt, Human adenovirus C
uaaaguccacaaaaaacacccag

SEQ ID NO: 1551169 - RNA, 22 nt, Human adenovirus C
acuaucugccugaagauggcau

SEQ ID NO: 1551170 - RNA, 19 nt, Human adenovirus C
gacaagcgcuuuccaggcu

SEQ ID NO: 1551171 - RNA, 21 nt, Human adenovirus C
cugcccguuuucgcucgucac

SEQ ID NO: 1551172 - RNA, 19 nt, Human adenovirus C
accugagccccgggcuggu

SEQ ID NO: 1551173 - RNA, 11 nt, Human adenovirus C
aacgcgcggca

SEQ ID NO: 1551174 - RNA, 13 nt, Human adenovirus C
agcagggccaggu

SEQ ID NO: 1551175 - RNA, 17 nt, Human adenovirus C
cgaugcuccccuggacc

SEQ ID NO: 1551176 - RNA, 14 nt, Human adenovirus C
ucgugcgcaccacc

SEQ ID NO: 1551177 - RNA, 18 nt, Human adenovirus C
gcggacauuaucuucccc

SEQ ID NO: 1551178 - RNA, 13 nt, Human adenovirus C
aguuggaagacgc

SEQ ID NO: 1551179 - RNA, 20 nt, Human adenovirus C
gccaacuaccuugccuacca

SEQ ID NO: 1551180 - RNA, 14 nt, Human adenovirus C
gccgcaggccccgc

SEQ ID NO: 1551181 - RNA, 12 nt, Human adenovirus C
gcugcuggaagg

SEQ ID NO: 1551182 - RNA, 19 nt, Human adenovirus C
cagacaucauuuugcugcc

SEQ ID NO: 1551183 - RNA, 17 nt, Human adenovirus C
cugccgugcggcaggga

SEQ ID NO: 1551184 - RNA, 12 nt, Human adenovirus C
uacgcccagaaa

SEQ ID NO: 1551185 - RNA, 18 nt, Human adenovirus C
guagaccacgcccccuuc

SEQ ID NO: 1551186 - RNA, 19 nt, Human adenovirus C
guaccaguccgggccagac

SEQ ID NO: 1551187 - RNA, 17 nt, Human adenovirus C
gaucuauggccccccga

SEQ ID NO: 1551188 - RNA, 15 nt, Human adenovirus C
gacaacaucgcgcag

SEQ ID NO: 1551189 - RNA, 11 nt, Human adenovirus C
agguccuccuc

SEQ ID NO: 1551190 - RNA, 16 nt, Human adenovirus C
acgagaaacgcgcggc

SEQ ID NO: 1551191 - RNA, 20 nt, Human adenovirus C
cacuacccggaccaguuuau

SEQ ID NO: 1551192 - RNA, 17 nt, Human adenovirus C
ggaaagacgguggugcg

SEQ ID NO: 1551193 - RNA, 16 nt, Human adenovirus C
uugcgcccuaccugug

SEQ ID NO: 1551194 - RNA, 14 nt, Human adenovirus C
guggcuaccucucc

SEQ ID NO: 1551195 - RNA, 21 nt, Human adenovirus C
cgcucgucgggcaccaggugc

SEQ ID NO: 1551196 - RNA, 11 nt, Human adenovirus C
gcgaagaucag

SEQ ID NO: 1551197 - RNA, 15 nt, Human adenovirus C
ccggcggcagcggca

SEQ ID NO: 1551198 - RNA, 18 nt, Human adenovirus C
cacccugcgucgcaacca

SEQ ID NO: 1551199 - RNA, 14 nt, Human adenovirus C
ccgccgggagaggg

SEQ ID NO: 1551200 - RNA, 13 nt, Human adenovirus C
uggaccucccggc

SEQ ID NO: 1551201 - RNA, 18 nt, Human adenovirus C
ugcacaucucgggccagg

SEQ ID NO: 1551202 - RNA, 20 nt, Human adenovirus C
ugcaucaaacaauacuaaaa

SEQ ID NO: 1551203 - RNA, 15 nt, Human adenovirus C
gcagaccaaccugga

SEQ ID NO: 1551204 - RNA, 12 nt, Human adenovirus C
aaccaccagcac

SEQ ID NO: 1551205 - RNA, 23 nt, Human adenovirus C
uugcaggggcuguggggggugcg

SEQ ID NO: 1551206 - RNA, 23 nt, Human adenovirus C
ccagcuucagcuugccugcucca

SEQ ID NO: 1551207 - RNA, 12 nt, Human adenovirus C
aucuccucuucc

SEQ ID NO: 1551208 - RNA, 23 nt, Human adenovirus C
uggcacccaaaaagaagcugcag

SEQ ID NO: 1551209 - RNA, 15 nt, Human adenovirus C
cacagccgccugagc

SEQ ID NO: 1551210 - RNA, 22 nt, Human adenovirus C
cagcacaguguauccggugcac

SEQ ID NO: 1551211 - RNA, 20 nt, Human adenovirus C
aaaauacaaccccaccaaug

SEQ ID NO: 1551212 - RNA, 17 nt, Human adenovirus C
cccguagaggagccucc

SEQ ID NO: 1551213 - RNA, 21 nt, Human adenovirus C
acccuuauccucaucugcagc

SEQ ID NO: 1551214 - RNA, 19 nt, Human adenovirus C
gccgccagcgguccgcgau

SEQ ID NO: 1551215 - RNA, 16 nt, Human adenovirus C
agguuaccucugcaaa

SEQ ID NO: 1551216 - RNA, 19 nt, Human adenovirus C
uggcccuuggcgcgcagcu

SEQ ID NO: 1551217 - RNA, 20 nt, Human adenovirus C
cacaguuuaaacagcgagga

SEQ ID NO: 1551218 - RNA, 15 nt, Human adenovirus C
ggacaagcagcuggc

SEQ ID NO: 1551219 - RNA, 16 nt, Human adenovirus C
ucgcuguggagcggca

SEQ ID NO: 1551220 - RNA, 23 nt, Human adenovirus C
gcugcgcuagcuuuuuuggccac

SEQ ID NO: 1551221 - RNA, 17 nt, Human adenovirus C
ccagcuggccaaaaccu

SEQ ID NO: 1551222 - RNA, 20 nt, Human adenovirus C
cgacacgguuaacuccuccu

SEQ ID NO: 1551223 - RNA, 19 nt, Human adenovirus C
gcagguuccugagcagcug

SEQ ID NO: 1551224 - RNA, 18 nt, Human adenovirus C
gguuguuucuggcggagg

SEQ ID NO: 1551225 - RNA, 13 nt, Human adenovirus C
agucucgggccgg

SEQ ID NO: 1551226 - RNA, 19 nt, Human adenovirus C
ucugcuuaaaagccaccug

SEQ ID NO: 1551227 - RNA, 14 nt, Human adenovirus C
cggcagaaacagag

SEQ ID NO: 1551228 - RNA, 19 nt, Human adenovirus C
caccugaaaaucagagggc

SEQ ID NO: 1551229 - RNA, 21 nt, Human adenovirus C
cugccgcccccgcugcgcaac

SEQ ID NO: 1551230 - RNA, 19 nt, Human adenovirus C
agaguugcaacagcgcgag

SEQ ID NO: 1551231 - RNA, 18 nt, Human adenovirus C
cgccggcgccccagaaau

SEQ ID NO: 1551232 - RNA, 19 nt, Human adenovirus C
cgccgaaccaccacuggaa

SEQ ID NO: 1551233 - RNA, 18 nt, Human adenovirus C
aacaaguugcauguggaa

SEQ ID NO: 1551234 - RNA, 17 nt, Human adenovirus C
guuggagaucugcacca

SEQ ID NO: 1551235 - RNA, 12 nt, Human adenovirus C
ccgcuggcugcu

SEQ ID NO: 1551236 - RNA, 21 nt, Human adenovirus C
ccagggcuucuacauuccaga

SEQ ID NO: 1551237 - RNA, 15 nt, Human adenovirus C
cggcggcggcaggag

SEQ ID NO: 1551238 - RNA, 14 nt, Human adenovirus C
cuacaacaaacaga

SEQ ID NO: 1551239 - RNA, 15 nt, Human adenovirus C
cggacccggcggugc

SEQ ID NO: 1551240 - RNA, 14 nt, Human adenovirus C
gcaggccaagcagc

SEQ ID NO: 1551241 - RNA, 16 nt, Human adenovirus C
uuuacugcugcuggaa

SEQ ID NO: 1551242 - RNA, 13 nt, Human adenovirus C
caggaggacacgg

SEQ ID NO: 1551243 - RNA, 23 nt, Human adenovirus C
caacauacugacccgcuguuccu

SEQ ID NO: 1551244 - RNA, 23 nt, Human adenovirus C
ggcgaucguaaacgcgcuggccg

SEQ ID NO: 1551245 - RNA, 24 nt, Human adenovirus C
ccccgguugccucggcgguggcag

SEQ ID NO: 1551246 - RNA, 13 nt, Human adenovirus C
caagacagaaaca

SEQ ID NO: 1551247 - RNA, 23 nt, Human adenovirus C
ggucucgcauuccacgagccagg

SEQ ID NO: 1551248 - RNA, 20 nt, Human adenovirus C
accuggccaaccaggcagug

SEQ ID NO: 1551249 - RNA, 14 nt, Human adenovirus C
caacucgcugcugc

SEQ ID NO: 1551250 - RNA, 16 nt, Human adenovirus C
cacuuggucaggcagu

SEQ ID NO: 1551251 - RNA, 16 nt, Human adenovirus C
acgucuagggcgcagu

SEQ ID NO: 1551252 - RNA, 12 nt, Human adenovirus C
aauucccacgcc

SEQ ID NO: 1551253 - RNA, 18 nt, Human adenovirus C
cuugaaagugggcaggca

SEQ ID NO: 1551254 - RNA, 14 nt, Human adenovirus C
cagcggcggcagca

SEQ ID NO: 1551255 - RNA, 14 nt, Human adenovirus C
gcggcgcgcaacga

SEQ ID NO: 1551256 - RNA, 14 nt, Human adenovirus C
cgguaccuuugagc

SEQ ID NO: 1551257 - RNA, 17 nt, Human adenovirus C
cagggcuucaauuaaga

SEQ ID NO: 1551258 - RNA, 21 nt, Human adenovirus C
cacuacaccuuucgccagggc

SEQ ID NO: 1551259 - RNA, 20 nt, Human adenovirus C
cuggcuaccgcccccugguu

SEQ ID NO: 1551260 - RNA, 15 nt, Human adenovirus C
acccaacaccuagcc

SEQ ID NO: 1551261 - RNA, 17 nt, Human adenovirus C
ccgagguugcuacgggc

SEQ ID NO: 1551262 - RNA, 13 nt, Human adenovirus C
ucgccugcgccau

SEQ ID NO: 1551263 - RNA, 21 nt, Human adenovirus C
uuugagguacugguauuugaa

SEQ ID NO: 1551264 - RNA, 13 nt, Human adenovirus C
aaaggugaugaaa

SEQ ID NO: 1551265 - RNA, 21 nt, Human adenovirus C
cagcaucguuuaaaagccggu

SEQ ID NO: 1551266 - RNA, 19 nt, Human adenovirus C
gaccauucacguagccagc

SEQ ID NO: 1551267 - RNA, 21 nt, Human adenovirus C
cgacgaggaccugcuugagca

SEQ ID NO: 1551268 - RNA, 22 nt, Human adenovirus C
gguuguuaauuaccugggcggc

SEQ ID NO: 1551269 - RNA, 19 nt, Human adenovirus C
cgcgggcaggagcuggugc

SEQ ID NO: 1551270 - RNA, 23 nt, Human adenovirus C
caaggccggaaaccucaccuccc

SEQ ID NO: 1551271 - RNA, 21 nt, Human adenovirus C
aacagcggcaacgugcagacc

SEQ ID NO: 1551272 - RNA, 19 nt, Human adenovirus C
acgugccgggcgaagacgg

SEQ ID NO: 1551273 - RNA, 23 nt, Human adenovirus C
caccacugugguacuucccagag

SEQ ID NO: 1551274 - RNA, 16 nt, Human adenovirus C
gcgcgcuggucucugg

SEQ ID NO: 1551275 - RNA, 12 nt, Human adenovirus C
caaugggcccac

SEQ ID NO: 1551276 - RNA, 23 nt, Human adenovirus C
cgcgcucaaaggcuacaggggcc

SEQ ID NO: 1551277 - RNA, 19 nt, Human adenovirus C
cucucuacgcgucuccgaa

SEQ ID NO: 1551278 - RNA, 14 nt, Human adenovirus C
gcgaaucucagugg

SEQ ID NO: 1551279 - RNA, 20 nt, Human adenovirus C
aguuguaguauauccacucu

SEQ ID NO: 1551280 - RNA, 18 nt, Human adenovirus C
gaggaggaauacugggac

SEQ ID NO: 1551281 - RNA, 19 nt, Human adenovirus C
gcaacagggucugccagac

SEQ ID NO: 1551282 - RNA, 15 nt, Human adenovirus C
gcauuaacauggaag

SEQ ID NO: 1551283 - RNA, 19 nt, Human adenovirus C
gggcgcacucacagaccug

SEQ ID NO: 1551284 - RNA, 18 nt, Human adenovirus C
cagucaggcagaggaggu

SEQ ID NO: 1551285 - RNA, 20 nt, Human adenovirus C
cgugaggguagacuggaagu

SEQ ID NO: 1551286 - RNA, 16 nt, Human adenovirus C
gaccaaccggcggcag

SEQ ID NO: 1551287 - RNA, 19 nt, Human adenovirus C
ggagcggggggcuucugag

SEQ ID NO: 1551288 - RNA, 15 nt, Human adenovirus C
gaggccguggcgcag

SEQ ID NO: 1551289 - RNA, 20 nt, Human adenovirus C
gcuaaaauacaaccccacca

SEQ ID NO: 1551290 - RNA, 18 nt, Human adenovirus C
cgugcugaaacgcagcau

SEQ ID NO: 1551291 - RNA, 13 nt, Human adenovirus C
agcacagcaccac

SEQ ID NO: 1551292 - RNA, 16 nt, Human adenovirus C
augauggccgcagugc

SEQ ID NO: 1551293 - RNA, 19 nt, Human adenovirus C
cgagaaggaggacagccua

SEQ ID NO: 1551294 - RNA, 14 nt, Human adenovirus C
cauccauguccaca

SEQ ID NO: 1551295 - RNA, 16 nt, Human adenovirus C
ucuugcuggucaggca

SEQ ID NO: 1551296 - RNA, 22 nt, Human adenovirus C
guggcaaccaccgcuccucuga

SEQ ID NO: 1551297 - RNA, 22 nt, Human adenovirus C
gcuacaacguagcucagugcaa

SEQ ID NO: 1551298 - RNA, 15 nt, Human adenovirus C
ccagugagcaggaac

SEQ ID NO: 1551299 - RNA, 13 nt, Human adenovirus C
ccgcgaggccaua

SEQ ID NO: 1551300 - RNA, 21 nt, Human adenovirus C
gcgagaaggcguugaggccuc

SEQ ID NO: 1551301 - RNA, 14 nt, Human adenovirus C
aaccugugcugcca

SEQ ID NO: 1551302 - RNA, 15 nt, Human adenovirus C
aucugcgccagcagg

SEQ ID NO: 1551303 - RNA, 22 nt, Human adenovirus C
uggaagauuuuucugcugugcg

SEQ ID NO: 1551304 - RNA, 21 nt, Human adenovirus C
ccgccgcuuuggggucacugc

SEQ ID NO: 1551305 - RNA, 18 nt, Human adenovirus C
cucuggacuacauggaca

SEQ ID NO: 1551306 - RNA, 14 nt, Human adenovirus C
ucaccugccgccuc

SEQ ID NO: 1551307 - RNA, 16 nt, Human adenovirus C
cagggugacaagguca

SEQ ID NO: 1551308 - RNA, 16 nt, Human adenovirus C
guugcgcuuuucugug

SEQ ID NO: 1551309 - RNA, 19 nt, Human adenovirus C
aagcuaaugauggccgcag

SEQ ID NO: 1551310 - RNA, 13 nt, Human adenovirus C
cggaggaguccag

SEQ ID NO: 1551311 - RNA, 15 nt, Human adenovirus C
caaacugcccucacg

SEQ ID NO: 1551312 - RNA, 15 nt, Human adenovirus C
gucaggaggggcaac

SEQ ID NO: 1551313 - RNA, 15 nt, Human adenovirus C
gcggcggucggagcu

SEQ ID NO: 1551314 - RNA, 22 nt, Human adenovirus C
ccaaccgcgguugugcagggug

SEQ ID NO: 1551315 - RNA, 16 nt, Human adenovirus C
cuugccgucugcgccg

SEQ ID NO: 1551316 - RNA, 16 nt, Human adenovirus C
cgcuaugugcagcaga

SEQ ID NO: 1551317 - RNA, 16 nt, Human adenovirus C
cguaggagucgcgcag

SEQ ID NO: 1551318 - RNA, 23 nt, Human adenovirus C
gucuccuaccuuggaauuuugca

SEQ ID NO: 1551319 - RNA, 14 nt, Human adenovirus C
auacagacuugaga

SEQ ID NO: 1551320 - RNA, 16 nt, Human adenovirus C
auacaaggaguaucag

SEQ ID NO: 1551321 - RNA, 14 nt, Human adenovirus C
ggcguggccuuccc

SEQ ID NO: 1551322 - RNA, 21 nt, Human adenovirus C
agagcgcagcgaugugccccu

SEQ ID NO: 1551323 - RNA, 15 nt, Human adenovirus C
guacagcccacccug

SEQ ID NO: 1551324 - RNA, 13 nt, Human adenovirus C
uaacaugguucug

SEQ ID NO: 1551325 - RNA, 16 nt, Human adenovirus C
ggccugaaccgcgagc

SEQ ID NO: 1551326 - RNA, 20 nt, Human adenovirus C
cgagaccguguaccugcgca

SEQ ID NO: 1551327 - RNA, 17 nt, Human adenovirus C
ugguuccauccggccca

SEQ ID NO: 1551328 - RNA, 14 nt, Human adenovirus C
uggugcugccaaca

SEQ ID NO: 1551329 - RNA, 18 nt, Human adenovirus C
gucaagcaggccaaacuu

SEQ ID NO: 1551330 - RNA, 17 nt, Human adenovirus C
cuuacacguagccugau

SEQ ID NO: 1551331 - RNA, 15 nt, Human adenovirus C
cagcgaugugccccu

SEQ ID NO: 1551332 - RNA, 17 nt, Human adenovirus C
agcccgugacacugcag

SEQ ID NO: 1551333 - RNA, 20 nt, Human adenovirus C
uggcgccuucagcuggggcu

SEQ ID NO: 1551334 - RNA, 17 nt, Human adenovirus C
cucggaccacucugaga

SEQ ID NO: 1551335 - RNA, 18 nt, Human adenovirus C
ggaaaugcguggaagaac

SEQ ID NO: 1551336 - RNA, 21 nt, Human adenovirus C
auguuucuccacgccuuugcc

SEQ ID NO: 1551337 - RNA, 18 nt, Human adenovirus C
cggaccaguuuauuccca

SEQ ID NO: 1551338 - RNA, 23 nt, Human adenovirus C
gcugugccuuuuacugcugcugg

SEQ ID NO: 1551339 - RNA, 14 nt, Human adenovirus C
cauggcgccaucca

SEQ ID NO: 1551340 - RNA, 16 nt, Human adenovirus C
caaucaaucagccucg

SEQ ID NO: 1551341 - RNA, 14 nt, Human adenovirus C
cucuuacaccuucu

SEQ ID NO: 1551342 - RNA, 21 nt, Human adenovirus C
ucugguuccggaugaaaaagg

SEQ ID NO: 1551343 - RNA, 13 nt, Human adenovirus C
ugugcagcagagc

SEQ ID NO: 1551344 - RNA, 18 nt, Human adenovirus C
cuugcagauauggcccuc

SEQ ID NO: 1551345 - RNA, 13 nt, Human adenovirus C
aaagccaaaaaac

SEQ ID NO: 1551346 - RNA, 14 nt, Human adenovirus C
caagagcagcggca

SEQ ID NO: 1551347 - RNA, 21 nt, Human adenovirus C
gacgaugcuucuaaauagcua

SEQ ID NO: 1551348 - RNA, 14 nt, Human adenovirus C
gcuacagaggaggc

SEQ ID NO: 1551349 - RNA, 13 nt, Human adenovirus C
gccuggaggagcg

SEQ ID NO: 1551350 - RNA, 16 nt, Human adenovirus C
ccgccgccgccaccca

SEQ ID NO: 1551351 - RNA, 19 nt, Human adenovirus C
ugaccgaggagcugaggcc

SEQ ID NO: 1551352 - RNA, 18 nt, Human adenovirus C
gggccaggucggcgacaa

SEQ ID NO: 1551353 - RNA, 15 nt, Human adenovirus C
acccgcaacuucaga

SEQ ID NO: 1551354 - RNA, 19 nt, Human adenovirus C
guggugcaggagcgcagcu

SEQ ID NO: 1551355 - RNA, 15 nt, Human adenovirus C
uacgaacgccaccug

SEQ ID NO: 1551356 - RNA, 13 nt, Human adenovirus C
augugcccggccc

SEQ ID NO: 1551357 - RNA, 18 nt, Human adenovirus C
uuggacgcaauggccaaa

SEQ ID NO: 1551358 - RNA, 13 nt, Human adenovirus C
aagcaaugacagc

SEQ ID NO: 1551359 - RNA, 20 nt, Human adenovirus C
ucuuaugccaggccuacaaa

SEQ ID NO: 1551360 - RNA, 23 nt, Human adenovirus C
agccccuacugcaccggcggcag

SEQ ID NO: 1551361 - RNA, 21 nt, Human adenovirus C
cagcccgggggaggcaagcac

SEQ ID NO: 1551362 - RNA, 13 nt, Human adenovirus C
uccauagcgcuua

SEQ ID NO: 1551363 - RNA, 18 nt, Human adenovirus C
ucgcgccgcaccgcgucc

SEQ ID NO: 1551364 - RNA, 20 nt, Human adenovirus C
aaccuucuagccuauccaaa

SEQ ID NO: 1551365 - RNA, 21 nt, Human adenovirus C
acugcaacagguuauugcccc

SEQ ID NO: 1551366 - RNA, 21 nt, Human adenovirus C
cgaucguaaacgcgcuggccg

SEQ ID NO: 1551367 - RNA, 16 nt, Human adenovirus C
ccacauuucggcccca

SEQ ID NO: 1551368 - RNA, 13 nt, Human adenovirus C
ggucccacagcuc

SEQ ID NO: 1551369 - RNA, 22 nt, Human adenovirus C
caaaagugguuuuguacaguga

SEQ ID NO: 1551370 - RNA, 15 nt, Human adenovirus C
ucagcgccucccaaa

SEQ ID NO: 1551371 - RNA, 13 nt, Human adenovirus C
ggagcgaggaggu

SEQ ID NO: 1551372 - RNA, 21 nt, Human adenovirus C
gcugcggccccgcggucagau

SEQ ID NO: 1551373 - RNA, 18 nt, Human adenovirus C
aucgcgcccauggcuacc

SEQ ID NO: 1551374 - RNA, 18 nt, Human adenovirus C
ucaaagggguucugccgc

SEQ ID NO: 1551375 - RNA, 17 nt, Human adenovirus C
agguccgcgugcggcca

SEQ ID NO: 1551376 - RNA, 12 nt, Human adenovirus C
acgaccugggcg

SEQ ID NO: 1551377 - RNA, 14 nt, Human adenovirus C
cgaugagacccgca

SEQ ID NO: 1551378 - RNA, 15 nt, Human adenovirus C
cuagccaacuaccuu

SEQ ID NO: 1551379 - RNA, 14 nt, Human adenovirus C
uugauggagggcaa

SEQ ID NO: 1551380 - RNA, 23 nt, Human adenovirus C
gucuucgcccugcgcgucggcca

SEQ ID NO: 1551381 - RNA, 16 nt, Human adenovirus C
cauugucaaagaucuu

SEQ ID NO: 1551382 - RNA, 21 nt, Human adenovirus C
cuaaaccuaugauacuuacca

SEQ ID NO: 1551383 - RNA, 16 nt, Human adenovirus C
cugugcugccagggcc

SEQ ID NO: 1551384 - RNA, 15 nt, Human adenovirus C
caccaccaguagcac

SEQ ID NO: 1551385 - RNA, 15 nt, Human adenovirus C
agcagcagggcaacc

SEQ ID NO: 1551386 - RNA, 15 nt, Human adenovirus C
caaaucuucacuucc

SEQ ID NO: 1551387 - RNA, 22 nt, Human adenovirus C
gauggcaaugggcccacgggcg

SEQ ID NO: 1551388 - RNA, 20 nt, Human adenovirus C
ucaacaaagcccgccaagag

SEQ ID NO: 1551389 - RNA, 14 nt, Human adenovirus C
gcaggaggaagcca

SEQ ID NO: 1551390 - RNA, 20 nt, Human adenovirus C
ccucuuguccugcaucucuu

SEQ ID NO: 1551391 - RNA, 13 nt, Human adenovirus C
gaccccuggagag

SEQ ID NO: 1551392 - RNA, 20 nt, Human adenovirus C
ggcagccaggugacacuaac

SEQ ID NO: 1551393 - RNA, 19 nt, Human adenovirus C
cuacuuuuaagcccuacuc

SEQ ID NO: 1551394 - RNA, 17 nt, Human adenovirus C
aaagucccccuggaguu

SEQ ID NO: 1551395 - RNA, 20 nt, Human adenovirus C
gacugcagccuccgccgccg

SEQ ID NO: 1551396 - RNA, 20 nt, Human adenovirus C
uggccgcgauguuuagcugc

SEQ ID NO: 1551397 - RNA, 14 nt, Human adenovirus C
ucaugagcgagcug

SEQ ID NO: 1551398 - RNA, 15 nt, Human adenovirus C
ucacugugcccccca

SEQ ID NO: 1551399 - RNA, 20 nt, Human adenovirus C
gaugaaaagaaaaugccuug

SEQ ID NO: 1551400 - RNA, 20 nt, Human adenovirus C
uucccagugcccgcugucau

SEQ ID NO: 1551401 - RNA, 13 nt, Human adenovirus C
agcguccgcggcc

SEQ ID NO: 1551402 - RNA, 17 nt, Human adenovirus C
gcuaccucgcucccacc

SEQ ID NO: 1551403 - RNA, 15 nt, Human adenovirus C
cuauauuucaacaaa

SEQ ID NO: 1551404 - RNA, 19 nt, Human adenovirus C
gacucagggucgcaggggc

SEQ ID NO: 1551405 - RNA, 19 nt, Human adenovirus C
acuugaaaaacauguaaaa

SEQ ID NO: 1551406 - RNA, 11 nt, Human adenovirus C
gagaagaacau

SEQ ID NO: 1551407 - RNA, 22 nt, Human adenovirus C
cccaaaaagaagcugcagcugc

SEQ ID NO: 1551408 - RNA, 16 nt, Human adenovirus C
ugcagauucacucaaa

SEQ ID NO: 1551409 - RNA, 14 nt, Human adenovirus C
cuucagcuugccug

SEQ ID NO: 1551410 - RNA, 17 nt, Human adenovirus C
ucaggaauucugcccgc

SEQ ID NO: 1551411 - RNA, 17 nt, Human adenovirus C
cuggaagccaugcucag

SEQ ID NO: 1551412 - RNA, 14 nt, Human adenovirus C
accgcgcggcgggc

SEQ ID NO: 1551413 - RNA, 14 nt, Human adenovirus C
cgcaacugggcagc

SEQ ID NO: 1551414 - RNA, 13 nt, Human adenovirus C
gcagcagcagggc

SEQ ID NO: 1551415 - RNA, 17 nt, Human adenovirus C
agcugccuucccaaaaa

SEQ ID NO: 1551416 - RNA, 19 nt, Human adenovirus C
gaagucccugcgacgggcc

SEQ ID NO: 1551417 - RNA, 21 nt, Human adenovirus C
gagaacuccucacuuaaaaaa

SEQ ID NO: 1551418 - RNA, 17 nt, Human adenovirus C
cuuugguucuuacaaaa

SEQ ID NO: 1551419 - RNA, 13 nt, Human adenovirus C
ugagacacaagaa

SEQ ID NO: 1551420 - RNA, 21 nt, Human adenovirus C
uugucacccuuauccucaucu

SEQ ID NO: 1551421 - RNA, 22 nt, Human adenovirus C
ugcacaguuuaaacagcgagga

SEQ ID NO: 1551422 - RNA, 21 nt, Human adenovirus C
gaaacuagcgagguaagcacu

SEQ ID NO: 1551423 - RNA, 17 nt, Human adenovirus C
agacugugggggcaaca

SEQ ID NO: 1551424 - RNA, 20 nt, Human adenovirus C
agaucuugguugugggccau

SEQ ID NO: 1551425 - RNA, 23 nt, Human adenovirus C
gcggucuuuccaguacucuugga

SEQ ID NO: 1551426 - RNA, 21 nt, Human adenovirus C
gagcuuccacuuggucaggca

SEQ ID NO: 1551427 - RNA, 21 nt, Human adenovirus C
gugggggaugugcgcgaggcc

SEQ ID NO: 1551428 - RNA, 16 nt, Human adenovirus C
gccaacgcgccuacca

SEQ ID NO: 1551429 - RNA, 12 nt, Human adenovirus C
gcgaccgcgagg

SEQ ID NO: 1551430 - RNA, 20 nt, Human adenovirus C
gaccguggagccugggcugg

SEQ ID NO: 1551431 - RNA, 22 nt, Human adenovirus C
acgguuguuaauuaccugggcg

SEQ ID NO: 1551432 - RNA, 17 nt, Human adenovirus C
auguucuugucccuccg

SEQ ID NO: 1551433 - RNA, 18 nt, Human adenovirus C
ccgggacugggcgugcag

SEQ ID NO: 1551434 - RNA, 18 nt, Human adenovirus C
gacucgguuagcggccug

SEQ ID NO: 1551435 - RNA, 19 nt, Human adenovirus C
agauuauacccacaaccuu

SEQ ID NO: 1551436 - RNA, 18 nt, Human adenovirus C
gcgccaacucguuugaug

SEQ ID NO: 1551437 - RNA, 13 nt, Human adenovirus C
cagccgcaccgcg

SEQ ID NO: 1551438 - RNA, 16 nt, Human adenovirus C
caguggcggcggcgcu

SEQ ID NO: 1551439 - RNA, 17 nt, Human adenovirus C
ccaguggagaggcagag

SEQ ID NO: 1551440 - RNA, 18 nt, Human adenovirus C
uccuuuccuuccucccaa

SEQ ID NO: 1551441 - RNA, 14 nt, Human adenovirus C
gaacagcagcacag

SEQ ID NO: 1551442 - RNA, 14 nt, Human adenovirus C
caccaccacccucc

SEQ ID NO: 1551443 - RNA, 14 nt, Human adenovirus C
gcggggaggcggcg

SEQ ID NO: 1551444 - RNA, 15 nt, Human adenovirus C
ccaguggcaacuggc

SEQ ID NO: 1551445 - RNA, 21 nt, Human adenovirus C
cgugugaccccgaagccccuc

SEQ ID NO: 1551446 - RNA, 14 nt, Human adenovirus C
aagacugggacagc

SEQ ID NO: 1551447 - RNA, 16 nt, Human adenovirus C
cugagacgaaggcucg

SEQ ID NO: 1551448 - RNA, 18 nt, Human adenovirus C
uuccaggaaguacggcac

SEQ ID NO: 1551449 - RNA, 15 nt, Human adenovirus C
gcaaaucuuugucca

SEQ ID NO: 1551450 - RNA, 22 nt, Human adenovirus C
caccagcucaaucagucacagu

SEQ ID NO: 1551451 - RNA, 17 nt, Human adenovirus C
ggaggaauacugggaca

SEQ ID NO: 1551452 - RNA, 19 nt, Human adenovirus C
cgugcgagggagcgaggag

SEQ ID NO: 1551453 - RNA, 23 nt, Human adenovirus C
cuggaaugccauagaugccauga

SEQ ID NO: 1551454 - RNA, 16 nt, Human adenovirus C
cgcugcggcugcuguu

SEQ ID NO: 1551455 - RNA, 18 nt, Human adenovirus C
gcgagguauucagcucaa

SEQ ID NO: 1551456 - RNA, 13 nt, Human adenovirus C
uguaccugcgcac

SEQ ID NO: 1551457 - RNA, 20 nt, Human adenovirus C
gguauuagagaucuuauucc

SEQ ID NO: 1551458 - RNA, 16 nt, Human adenovirus C
cacacacgggaggagc

SEQ ID NO: 1551459 - RNA, 19 nt, Human adenovirus C
ucagagaagaacaugccgc

SEQ ID NO: 1551460 - RNA, 15 nt, Human adenovirus C
uccaagauggcuacc

SEQ ID NO: 1551461 - RNA, 16 nt, Human adenovirus C
accugaggacuaccac

SEQ ID NO: 1551462 - RNA, 19 nt, Human adenovirus C
ggcacccccgcuugaggag

SEQ ID NO: 1551463 - RNA, 20 nt, Human adenovirus C
augauggaagacugggacag

SEQ ID NO: 1551464 - RNA, 16 nt, Human adenovirus C
gaaugcgcaggcgguc

SEQ ID NO: 1551465 - RNA, 15 nt, Human adenovirus C
cuggagugucacugu

SEQ ID NO: 1551466 - RNA, 16 nt, Human adenovirus C
gccgcacgaggggcag

SEQ ID NO: 1551467 - RNA, 23 nt, Human adenovirus C
agccgcgcgcuggggcaggagga

SEQ ID NO: 1551468 - RNA, 19 nt, Human adenovirus C
ucaccgguugcugcgccca

SEQ ID NO: 1551469 - RNA, 18 nt, Human adenovirus C
aauacaaccccaccaaug

SEQ ID NO: 1551470 - RNA, 18 nt, Human adenovirus C
ccuguauauuaaugcauc

SEQ ID NO: 1551471 - RNA, 20 nt, Human adenovirus C
ccaaaaagaagcugcagcug

SEQ ID NO: 1551472 - RNA, 16 nt, Human adenovirus C
cguggccuugcaggcg

SEQ ID NO: 1551473 - RNA, 17 nt, Human adenovirus C
uucuuauauuauugacc

SEQ ID NO: 1551474 - RNA, 16 nt, Human adenovirus C
gcagcuggcgcgcugg

SEQ ID NO: 1551475 - RNA, 16 nt, Human adenovirus C
ugaaggggugcgcucc

SEQ ID NO: 1551476 - RNA, 19 nt, Human adenovirus C
gcccuacuuccgcagccac

SEQ ID NO: 1551477 - RNA, 22 nt, Human adenovirus C
cacuggucuugucaugccuggg

SEQ ID NO: 1551478 - RNA, 23 nt, Human adenovirus C
cgagucuggugacuuggcaccca

SEQ ID NO: 1551479 - RNA, 16 nt, Human adenovirus C
agcauuugcagguggu

SEQ ID NO: 1551480 - RNA, 20 nt, Human adenovirus C
ucaacucccggaacucaggu

SEQ ID NO: 1551481 - RNA, 14 nt, Human adenovirus C
cugugguacuuccc

SEQ ID NO: 1551482 - RNA, 15 nt, Human adenovirus C
cgaggucgagaagcc

SEQ ID NO: 1551483 - RNA, 16 nt, Human adenovirus C
cacuggaaccagggcc

SEQ ID NO: 1551484 - RNA, 14 nt, Human adenovirus C
agcgcuccguggcc

SEQ ID NO: 1551485 - RNA, 19 nt, Human adenovirus C
cucggaguaccugagcccc

SEQ ID NO: 1551486 - RNA, 13 nt, Human adenovirus C
ggggcauggccgg

SEQ ID NO: 1551487 - RNA, 23 nt, Human adenovirus C
ugagcuugaucugcuggcgcaga

SEQ ID NO: 1551488 - RNA, 20 nt, Human adenovirus C
gucucggugacggcgcggcc

SEQ ID NO: 1551489 - RNA, 12 nt, Human adenovirus C
ccuugcaggcgc

SEQ ID NO: 1551490 - RNA, 12 nt, Human adenovirus C
gguuggggcggc

SEQ ID NO: 1551491 - RNA, 21 nt, Human adenovirus C
uggacauguggugguuuucca

SEQ ID NO: 1551492 - RNA, 19 nt, Human adenovirus C
caaacccagcuucagcuug

SEQ ID NO: 1551493 - RNA, 16 nt, Human adenovirus C
uacaaccccaccaaug

SEQ ID NO: 1551494 - RNA, 22 nt, Human adenovirus C
gcuuucaagaacuugcaggggc

SEQ ID NO: 1551495 - RNA, 15 nt, Human adenovirus C
ccaucaacaaagccc

SEQ ID NO: 1551496 - RNA, 16 nt, Human adenovirus C
cagguuucugcccuga

SEQ ID NO: 1551497 - RNA, 15 nt, Human adenovirus C
gcggacaagcagcug

SEQ ID NO: 1551498 - RNA, 22 nt, Human adenovirus C
uguucccagcggucccauccaa

SEQ ID NO: 1551499 - RNA, 14 nt, Human adenovirus C
cguccugcaggaau

SEQ ID NO: 1551500 - RNA, 22 nt, Human adenovirus C
cauggcggggaccacagaaccc

SEQ ID NO: 1551501 - RNA, 19 nt, Human adenovirus C
auuaugaaacggaguguca

SEQ ID NO: 1551502 - RNA, 22 nt, Human adenovirus C
accuccuccuccugccaggcuc

SEQ ID NO: 1551503 - RNA, 20 nt, Human adenovirus C
cggcgaguacuaagcgguga

SEQ ID NO: 1551504 - RNA, 20 nt, Human adenovirus C
gccuggaacagcagcacagg

SEQ ID NO: 1551505 - RNA, 19 nt, Human adenovirus C
aggacgugguaaaggugac

SEQ ID NO: 1551506 - RNA, 23 nt, Human adenovirus C
gcuguccuaucaacucuugcuug

SEQ ID NO: 1551507 - RNA, 15 nt, Human adenovirus C
aggaugggcaggggc

SEQ ID NO: 1551508 - RNA, 17 nt, Human adenovirus C
aggacccuggugcugcc

SEQ ID NO: 1551509 - RNA, 11 nt, Human adenovirus C
gucacccagca

SEQ ID NO: 1551510 - RNA, 13 nt, Human adenovirus C
cuggggcgcgcac

SEQ ID NO: 1551511 - RNA, 13 nt, Human adenovirus C
cagcgccgggugg

SEQ ID NO: 1551512 - RNA, 14 nt, Human adenovirus C
aucucgggccagga

SEQ ID NO: 1551513 - RNA, 17 nt, Human adenovirus C
ggacugggcgugcagac

SEQ ID NO: 1551514 - RNA, 18 nt, Human adenovirus C
cgcaccgucgcaugcgcg

SEQ ID NO: 1551515 - RNA, 15 nt, Human adenovirus C
accaucgcgcccaca

SEQ ID NO: 1551516 - RNA, 14 nt, Human adenovirus C
auagcggccgggca

SEQ ID NO: 1551517 - RNA, 14 nt, Human adenovirus C
accgccuccaccga

SEQ ID NO: 1551518 - RNA, 15 nt, Human adenovirus C
caaagcccaagaaau

SEQ ID NO: 1551519 - RNA, 15 nt, Human adenovirus C
cgcggcgugcuggac

SEQ ID NO: 1551520 - RNA, 13 nt, Human adenovirus C
aucugagcggggg

SEQ ID NO: 1551521 - RNA, 23 nt, Human adenovirus C
accugccuccccccgcugacacc

SEQ ID NO: 1551522 - RNA, 23 nt, Human adenovirus C
gcgccgcgcgcgggcaggagcug

SEQ ID NO: 1551523 - RNA, 20 nt, Human adenovirus C
ccugcgucauuacccagggc

SEQ ID NO: 1551524 - RNA, 11 nt, Human adenovirus C
gugcagaccaa

SEQ ID NO: 1551525 - RNA, 15 nt, Human adenovirus C
cugcacgucuccuga

SEQ ID NO: 1551526 - RNA, 12 nt, Human adenovirus C
cugcaacccgcg

SEQ ID NO: 1551527 - RNA, 15 nt, Human adenovirus C
ccgugauccaugcgg

SEQ ID NO: 1551528 - RNA, 20 nt, Human adenovirus C
ccgggggugcuuggcaugga

SEQ ID NO: 1551529 - RNA, 17 nt, Human adenovirus C
cuuuggacaccucccac

SEQ ID NO: 1551530 - RNA, 16 nt, Human adenovirus C
uaacacaggcuggggc

SEQ ID NO: 1551531 - RNA, 22 nt, Human adenovirus C
gauauggcccucaccugccgcc

SEQ ID NO: 1551532 - RNA, 20 nt, Human adenovirus C
agacaugaugcaagaccccg

SEQ ID NO: 1551533 - RNA, 16 nt, Human adenovirus C
cugaagcagggccagg

SEQ ID NO: 1551534 - RNA, 16 nt, Human adenovirus C
ucauauuuccugaagc

SEQ ID NO: 1551535 - RNA, 14 nt, Human adenovirus C
ggcgauggagcgca

SEQ ID NO: 1551536 - RNA, 14 nt, Human adenovirus C
gcgaacggagucaa

SEQ ID NO: 1551537 - RNA, 15 nt, Human adenovirus C
uauaauaaauacaga

SEQ ID NO: 1551538 - RNA, 23 nt, Human adenovirus C
ggcgcuccauggccucguagaag

SEQ ID NO: 1551539 - RNA, 17 nt, Human adenovirus C
cucacagaccugggcca

SEQ ID NO: 1551540 - RNA, 14 nt, Human adenovirus C
ggccacuacccgga

SEQ ID NO: 1551541 - RNA, 22 nt, Human adenovirus C
auuaaaaaccuccuccuccugc

SEQ ID NO: 1551542 - RNA, 15 nt, Human adenovirus C
aagcccgucucuggg

SEQ ID NO: 1551543 - RNA, 15 nt, Human adenovirus C
gagucggugagcucc

SEQ ID NO: 1551544 - RNA, 17 nt, Human adenovirus C
cuuccauaagggccucc

SEQ ID NO: 1551545 - RNA, 13 nt, Human adenovirus C
gcgggcggagggu

SEQ ID NO: 1551546 - RNA, 18 nt, Human adenovirus C
ccgaggccgaagaggugu

SEQ ID NO: 1551547 - RNA, 12 nt, Human adenovirus C
cagagcuguccu

SEQ ID NO: 1551548 - RNA, 22 nt, Human adenovirus C
cugagcaacuuguugggcaucc

SEQ ID NO: 1551549 - RNA, 15 nt, Human adenovirus C
ccaagggugcagcug

SEQ ID NO: 1551550 - RNA, 18 nt, Human adenovirus C
ccaccgcggaugcuggcg

SEQ ID NO: 1551551 - RNA, 12 nt, Human adenovirus C
cagcaggaggag

SEQ ID NO: 1551552 - RNA, 16 nt, Human adenovirus C
cuuacaaaccuggaaa

SEQ ID NO: 1551553 - RNA, 22 nt, Human adenovirus C
gcgggccuccguuaucgcucca

SEQ ID NO: 1551554 - RNA, 17 nt, Human adenovirus C
cacgagaaggugcuggc

SEQ ID NO: 1551555 - RNA, 14 nt, Human adenovirus C
cgggcuagguccag

SEQ ID NO: 1551556 - RNA, 23 nt, Human adenovirus C
ccgcgguugugcagggugacaag

SEQ ID NO: 1551557 - RNA, 12 nt, Human adenovirus C
gcgccuaccacc

SEQ ID NO: 1551558 - RNA, 14 nt, Human adenovirus C
agggcgaaggugac

SEQ ID NO: 1551559 - RNA, 15 nt, Human adenovirus C
gccauggcaccgagc

SEQ ID NO: 1551560 - RNA, 18 nt, Human adenovirus C
caggaacagcucuacagc

SEQ ID NO: 1551561 - RNA, 19 nt, Human adenovirus C
ugcgcgcuggccagggugc

SEQ ID NO: 1551562 - RNA, 23 nt, Human adenovirus C
ccgccucgggcaaaacgugcuuc

SEQ ID NO: 1551563 - RNA, 20 nt, Human adenovirus C
gcagcggcagaagcugccgc

SEQ ID NO: 1551564 - RNA, 15 nt, Human adenovirus C
guuggacgcuggaag

SEQ ID NO: 1551565 - RNA, 20 nt, Human adenovirus C
uucccccguaacauccugca

SEQ ID NO: 1551566 - RNA, 22 nt, Human adenovirus C
ggccagggugcgcuugaggcug

SEQ ID NO: 1551567 - RNA, 16 nt, Human adenovirus C
cccgcaccaggugcag

SEQ ID NO: 1551568 - RNA, 22 nt, Human adenovirus C
cccgcggcgacaggucaggcgg

SEQ ID NO: 1551569 - RNA, 14 nt, Human adenovirus C
uacaauuaccucag

SEQ ID NO: 1551570 - RNA, 23 nt, Human adenovirus C
ugcugacacuguaccgcgaggcc

SEQ ID NO: 1551571 - RNA, 11 nt, Human adenovirus C
accugcuggau

SEQ ID NO: 1551572 - RNA, 21 nt, Human adenovirus C
ugaggguaacuccagggugcg

SEQ ID NO: 1551573 - RNA, 18 nt, Human adenovirus C
aguucaugucgcugucca

SEQ ID NO: 1551574 - RNA, 21 nt, Human adenovirus C
gaagacguaugcgcaggagca

SEQ ID NO: 1551575 - RNA, 19 nt, Human adenovirus C
agcgggggguaccugcugg

SEQ ID NO: 1551576 - RNA, 17 nt, Human adenovirus C
ggguugaaacucacucc

SEQ ID NO: 1551577 - RNA, 14 nt, Human adenovirus C
augccugcgcggcc

SEQ ID NO: 1551578 - RNA, 23 nt, Human adenovirus C
acaaaggucuuguugcuggugaa

SEQ ID NO: 1551579 - RNA, 11 nt, Human adenovirus C
accagccacaa

SEQ ID NO: 1551580 - RNA, 13 nt, Human adenovirus C
ccuacaccagugu

SEQ ID NO: 1551581 - RNA, 12 nt, Human adenovirus C
ucacccuuaucc

SEQ ID NO: 1551582 - RNA, 15 nt, Human adenovirus C
cagucugcagcgcug

SEQ ID NO: 1551583 - RNA, 18 nt, Human adenovirus C
gaagauuuuucugcugug

SEQ ID NO: 1551584 - RNA, 22 nt, Human adenovirus C
guggacguucagauacccacca

SEQ ID NO: 1551585 - RNA, 15 nt, Human adenovirus C
guauacagacuugag

SEQ ID NO: 1551586 - RNA, 17 nt, Human adenovirus C
caacaaaaggugguaga

SEQ ID NO: 1551587 - RNA, 22 nt, Human adenovirus C
ucccaucgcgcaacugggcagc

SEQ ID NO: 1551588 - RNA, 18 nt, Human adenovirus C
ccaaggccauggcaccga

SEQ ID NO: 1551589 - RNA, 18 nt, Human adenovirus C
aauccacagcggcggcag

SEQ ID NO: 1551590 - RNA, 13 nt, Human adenovirus C
gacggcgcaccgg

SEQ ID NO: 1551591 - RNA, 13 nt, Human adenovirus C
gcugcagccaggg

SEQ ID NO: 1551592 - RNA, 16 nt, Human adenovirus C
gccacaagugcuuugc

SEQ ID NO: 1551593 - RNA, 17 nt, Human adenovirus C
agccacucucgcaaggc

SEQ ID NO: 1551594 - RNA, 17 nt, Human adenovirus C
ggagugcugggccagca

SEQ ID NO: 1551595 - RNA, 13 nt, Human adenovirus C
ggaccugagcgag

SEQ ID NO: 1551596 - RNA, 22 nt, Human adenovirus C
cugaggacuaccacgcccacga

SEQ ID NO: 1551597 - RNA, 18 nt, Human adenovirus C
cgguuuuccuggccaaua

SEQ ID NO: 1551598 - RNA, 12 nt, Human adenovirus C
gcuaaccagcgu

SEQ ID NO: 1551599 - RNA, 15 nt, Human adenovirus C
augcuccccuggacc

SEQ ID NO: 1551600 - RNA, 15 nt, Human adenovirus C
cuuuggggucacugc

SEQ ID NO: 1551601 - RNA, 19 nt, Human adenovirus C
gagccccgggcuggugcag

SEQ ID NO: 1551602 - RNA, 16 nt, Human adenovirus C
cguuggagacugcagc

SEQ ID NO: 1551603 - RNA, 23 nt, Human adenovirus C
cuuaugccaggccuacaaauccu

SEQ ID NO: 1551604 - RNA, 16 nt, Human adenovirus C
caggcgauaauggaga

SEQ ID NO: 1551605 - RNA, 20 nt, Human adenovirus C
ccucagcgaugauucgcacc

SEQ ID NO: 1551606 - RNA, 15 nt, Human adenovirus C
ggcucaccacccagg

SEQ ID NO: 1551607 - RNA, 15 nt, Human adenovirus C
cucccucguacgagg

SEQ ID NO: 1551608 - RNA, 15 nt, Human adenovirus C
cugagacgcauuuua

SEQ ID NO: 1551609 - RNA, 21 nt, Human adenovirus C
ggcaguugccgaggaugaaga

SEQ ID NO: 1551610 - RNA, 13 nt, Human adenovirus C
ggacaagcagcug

SEQ ID NO: 1551611 - RNA, 15 nt, Human adenovirus C
ccaccggccguggag

SEQ ID NO: 1551612 - RNA, 23 nt, Human adenovirus C
aacccccgcggcgccgggcccgg

SEQ ID NO: 1551613 - RNA, 17 nt, Human adenovirus C
uguugggaaacggccgc

SEQ ID NO: 1551614 - RNA, 17 nt, Human adenovirus C
gcugaccugcgcugggc

SEQ ID NO: 1551615 - RNA, 22 nt, Human adenovirus C
cgcguucguccucacucucuuc

SEQ ID NO: 1551616 - RNA, 13 nt, Human adenovirus C
gcgggcaggagcu

SEQ ID NO: 1551617 - RNA, 23 nt, Human adenovirus C
gaacuauggcagcaaggccugga

SEQ ID NO: 1551618 - RNA, 19 nt, Human adenovirus C
uuggcgcgcagcuugcccu

SEQ ID NO: 1551619 - RNA, 17 nt, Human adenovirus C
cggcucaccacccaggu

SEQ ID NO: 1551620 - RNA, 13 nt, Human adenovirus C
gugguggaccugg

SEQ ID NO: 1551621 - RNA, 13 nt, Human adenovirus C
guacagcccaccc

SEQ ID NO: 1551622 - RNA, 23 nt, Human adenovirus C
cagauccuuccuaucaaccagaa

SEQ ID NO: 1551623 - RNA, 21 nt, Human adenovirus C
cgaaccuuuggacaccuccca

SEQ ID NO: 1551624 - RNA, 12 nt, Human adenovirus C
gcugcgcaaccc

SEQ ID NO: 1551625 - RNA, 13 nt, Human adenovirus C
gcgaggagcucaa

SEQ ID NO: 1551626 - RNA, 13 nt, Human adenovirus C
ccaacgcgcggcg

SEQ ID NO: 1551627 - RNA, 15 nt, Human adenovirus C
uacuuuaucucaaau

SEQ ID NO: 1551628 - RNA, 24 nt, Human adenovirus C
agccacuuaaaaaaacaaagucaa

SEQ ID NO: 1551629 - RNA, 13 nt, Human adenovirus C
ccuccgcaccacu

SEQ ID NO: 1551630 - RNA, 17 nt, Human adenovirus C
gaccugccuccccccgc

SEQ ID NO: 1551631 - RNA, 18 nt, Human adenovirus C
gcgccugauuucugccag

SEQ ID NO: 1551632 - RNA, 11 nt, Human adenovirus C
accaccacccu

SEQ ID NO: 1551633 - RNA, 23 nt, Human adenovirus C
cuagccaacuaccuugccuacca

SEQ ID NO: 1551634 - RNA, 17 nt, Human adenovirus C
gaagaccaaucccgccc

SEQ ID NO: 1551635 - RNA, 14 nt, Human adenovirus C
auauuguucaaaau

SEQ ID NO: 1551636 - RNA, 15 nt, Human adenovirus C
agccccaccaccaca

SEQ ID NO: 1551637 - RNA, 15 nt, Human adenovirus C
agugcugggccagca

SEQ ID NO: 1551638 - RNA, 20 nt, Human adenovirus C
cuucgaucucagcgcagcgg

SEQ ID NO: 1551639 - RNA, 18 nt, Human adenovirus C
cagcgccucccaaaagac

SEQ ID NO: 1551640 - RNA, 17 nt, Human adenovirus C
caugucuaugcccaggc

SEQ ID NO: 1551641 - RNA, 17 nt, Human adenovirus C
ccuccgcccugcgcgcg

SEQ ID NO: 1551642 - RNA, 20 nt, Human adenovirus C
ggccagcuguuggggugagu

SEQ ID NO: 1551643 - RNA, 13 nt, Human adenovirus C
gccgagcuguugc

SEQ ID NO: 1551644 - RNA, 16 nt, Human adenovirus C
guaggugagcuccuca

SEQ ID NO: 1551645 - RNA, 12 nt, Human adenovirus C
cucaucugcagc

SEQ ID NO: 1551646 - RNA, 13 nt, Human adenovirus C
accgccgccgacc

SEQ ID NO: 1551647 - RNA, 16 nt, Human adenovirus C
cugggccagcacacac

SEQ ID NO: 1551648 - RNA, 14 nt, Human adenovirus C
cauacugacccgcu

SEQ ID NO: 1551649 - RNA, 19 nt, Human adenovirus C
gcgcuccuuuuggcuuccu

SEQ ID NO: 1551650 - RNA, 23 nt, Human adenovirus C
ccaugaaccacccuacuuuccca

SEQ ID NO: 1551651 - RNA, 13 nt, Human adenovirus C
ccugagcagcugc

SEQ ID NO: 1551652 - RNA, 21 nt, Human adenovirus C
gcccgcugucauaccacugca

SEQ ID NO: 1551653 - RNA, 22 nt, Human adenovirus C
guuggcggggggcugccgugcg

SEQ ID NO: 1551654 - RNA, 17 nt, Human adenovirus C
ccagucguagcaggagc

SEQ ID NO: 1551655 - RNA, 20 nt, Human adenovirus C
acaacaguggcagcggcgcg

SEQ ID NO: 1551656 - RNA, 13 nt, Human adenovirus C
ugggcgaggagga

SEQ ID NO: 1551657 - RNA, 13 nt, Human adenovirus C
acggcaccgccag

SEQ ID NO: 1551658 - RNA, 17 nt, Human adenovirus C
agcaggaggaggagcgc

SEQ ID NO: 1551659 - RNA, 12 nt, Human adenovirus C
ucagccuugccu

SEQ ID NO: 1551660 - RNA, 21 nt, Human adenovirus C
uacgccaucaucucugucaug

SEQ ID NO: 1551661 - RNA, 19 nt, Human adenovirus C
cagaugaaacgcgccagac

SEQ ID NO: 1551662 - RNA, 16 nt, Human adenovirus C
gaggaauacugggaca

SEQ ID NO: 1551663 - RNA, 22 nt, Human adenovirus C
ccuguaagcgggcacucuuccg

SEQ ID NO: 1551664 - RNA, 15 nt, Human adenovirus C
gcaaggccuggccag

SEQ ID NO: 1551665 - RNA, 13 nt, Human adenovirus C
cuggugaagguca

SEQ ID NO: 1551666 - RNA, 15 nt, Human adenovirus C
gucgggcaccaggug

SEQ ID NO: 1551667 - RNA, 18 nt, Human adenovirus C
acuacaauauuggcuacc

SEQ ID NO: 1551668 - RNA, 20 nt, Human adenovirus C
gacugggggcguacacugga

SEQ ID NO: 1551669 - RNA, 23 nt, Human adenovirus C
guuccaggaaguacggcaccgcc

SEQ ID NO: 1551670 - RNA, 15 nt, Human adenovirus C
ccucgaacaggcggc

SEQ ID NO: 1551671 - RNA, 15 nt, Human adenovirus C
gccgugcggcaggga

SEQ ID NO: 1551672 - RNA, 20 nt, Human adenovirus C
cucaaaggcuacaggggccu

SEQ ID NO: 1551673 - RNA, 19 nt, Human adenovirus C
gacgcaaauagaugagccu

SEQ ID NO: 1551674 - RNA, 13 nt, Human adenovirus C
agaggaggcuagg

SEQ ID NO: 1551675 - RNA, 21 nt, Human adenovirus C
ucccccaugcuuuuugaugcg

SEQ ID NO: 1551676 - RNA, 18 nt, Human adenovirus C
ggucuccguccggacggg

SEQ ID NO: 1551677 - RNA, 16 nt, Human adenovirus C
guggcucccgggcuug

SEQ ID NO: 1551678 - RNA, 17 nt, Human adenovirus C
gccacccacggacgagg

SEQ ID NO: 1551679 - RNA, 21 nt, Human adenovirus C
aagauguugcacaauggcuuc

SEQ ID NO: 1551680 - RNA, 14 nt, Human adenovirus C
cagccucgcccccc

SEQ ID NO: 1551681 - RNA, 21 nt, Human adenovirus C
uggacauaaacuauaacagag

SEQ ID NO: 1551682 - RNA, 15 nt, Human adenovirus C
ccacccaaagcagac

SEQ ID NO: 1551683 - RNA, 14 nt, Human adenovirus C
ucacagauuugcau

SEQ ID NO: 1551684 - RNA, 15 nt, Human adenovirus C
ggcgucgaugacuug

SEQ ID NO: 1551685 - RNA, 13 nt, Human adenovirus C
ccaagaagcgcgg

SEQ ID NO: 1551686 - RNA, 15 nt, Human adenovirus C
gcgcgcgcugcccgu

SEQ ID NO: 1551687 - RNA, 17 nt, Human adenovirus C
gcggcuggagcugccca

SEQ ID NO: 1551688 - RNA, 18 nt, Human adenovirus C
gcuaccggagugcugggc

SEQ ID NO: 1551689 - RNA, 18 nt, Human adenovirus C
cugcggcuaauggugacu

SEQ ID NO: 1551690 - RNA, 16 nt, Human adenovirus C
gagcaaaauuuccaac

SEQ ID NO: 1551691 - RNA, 19 nt, Human adenovirus C
cagcuugagccuggcugac

SEQ ID NO: 1551692 - RNA, 19 nt, Human adenovirus C
cggaaaccucaccucccaa

SEQ ID NO: 1551693 - RNA, 19 nt, Human adenovirus C
gaacuauggcagcaaggcc

SEQ ID NO: 1551694 - RNA, 19 nt, Human adenovirus C
ugacaucggcgcaggucuu

SEQ ID NO: 1551695 - RNA, 13 nt, Human adenovirus C
caacuggccccaa

SEQ ID NO: 1551696 - RNA, 14 nt, Human adenovirus C
caaauuugaucaaa

SEQ ID NO: 1551697 - RNA, 20 nt, Human adenovirus C
agacucugacaaagcccaag

SEQ ID NO: 1551698 - RNA, 23 nt, Human adenovirus C
agagcaaaauuuccaacaaaagg

SEQ ID NO: 1551699 - RNA, 20 nt, Human adenovirus C
cagcgcgagcaggcagaggc

SEQ ID NO: 1551700 - RNA, 12 nt, Human adenovirus C
ggcaggacccug

SEQ ID NO: 1551701 - RNA, 16 nt, Human adenovirus C
cuguccauggucugga

SEQ ID NO: 1551702 - RNA, 15 nt, Human adenovirus C
guucgcacuggggcg

SEQ ID NO: 1551703 - RNA, 17 nt, Human adenovirus C
guaugcgcaggagcaca

SEQ ID NO: 1551704 - RNA, 17 nt, Human adenovirus C
ccccaccaauguggaaa

SEQ ID NO: 1551705 - RNA, 22 nt, Human adenovirus C
ccuccgacugugguugcuucau

SEQ ID NO: 1551706 - RNA, 18 nt, Human adenovirus C
caagggugcagcugaagc

SEQ ID NO: 1551707 - RNA, 14 nt, Human adenovirus C
cuuggaugaugcau

SEQ ID NO: 1551708 - RNA, 13 nt, Human adenovirus C
cagcccgugggcu

SEQ ID NO: 1551709 - RNA, 22 nt, Human adenovirus C
gggcgccgagcuguugcccgug

SEQ ID NO: 1551710 - RNA, 18 nt, Human adenovirus C
uggcgguggcacccgcgc

SEQ ID NO: 1551711 - RNA, 21 nt, Human adenovirus C
aacgaagccuuccauccagac

SEQ ID NO: 1551712 - RNA, 20 nt, Human adenovirus C
augcgagccgaucgggaaga

SEQ ID NO: 1551713 - RNA, 13 nt, Human adenovirus C
uccaagagcuucu

SEQ ID NO: 1551714 - RNA, 22 nt, Human adenovirus C
gacugaaugaccaguggagagg

SEQ ID NO: 1551715 - RNA, 13 nt, Human adenovirus C
cagccccccggcg

SEQ ID NO: 1551716 - RNA, 15 nt, Human adenovirus C
ccgacccggcacugc

SEQ ID NO: 1551717 - RNA, 15 nt, Human adenovirus C
gcaccggcggcagcg

SEQ ID NO: 1551718 - RNA, 15 nt, Human adenovirus C
cagacaugcagggca

SEQ ID NO: 1551719 - RNA, 13 nt, Human adenovirus C
uaaguuugccaca

SEQ ID NO: 1551720 - RNA, 17 nt, Human adenovirus C
accguggagccugggcu

SEQ ID NO: 1551721 - RNA, 24 nt, Human adenovirus C
cguggcccuuggcgcgcagcuugc

SEQ ID NO: 1551722 - RNA, 16 nt, Human adenovirus C
ccucuuugagcccuuu

SEQ ID NO: 1551723 - RNA, 17 nt, Human adenovirus C
uaccgugaaugcccucc

SEQ ID NO: 1551724 - RNA, 20 nt, Human adenovirus C
acuaaacuuugauaauacug

SEQ ID NO: 1551725 - RNA, 15 nt, Human adenovirus C
cugugcugccagggc

SEQ ID NO: 1551726 - RNA, 11 nt, Human adenovirus C
cuacaagcgcg

SEQ ID NO: 1551727 - RNA, 15 nt, Human adenovirus C
cacugcuaccggacu

SEQ ID NO: 1551728 - RNA, 15 nt, Human adenovirus C
ccaaaagcagggcuu

SEQ ID NO: 1551729 - RNA, 13 nt, Human adenovirus C
agguacugaaaug

SEQ ID NO: 1551730 - RNA, 20 nt, Human adenovirus C
ggccgcucgaaggcuggccg

SEQ ID NO: 1551731 - RNA, 18 nt, Human adenovirus C
caggguauaacucaccug

SEQ ID NO: 1551732 - RNA, 19 nt, Human adenovirus C
auggaucuuaugccaggcc

SEQ ID NO: 1551733 - RNA, 14 nt, Human adenovirus C
gugagcgcuccacc

SEQ ID NO: 1551734 - RNA, 18 nt, Human adenovirus C
auuuuaaaaaaacuacaa

SEQ ID NO: 1551735 - RNA, 15 nt, Human adenovirus C
uaaaagagguaucuu

SEQ ID NO: 1551736 - RNA, 12 nt, Human adenovirus C
gcgagggccugg

SEQ ID NO: 1551737 - RNA, 15 nt, Human adenovirus C
ggugucauaguccag

SEQ ID NO: 1551738 - RNA, 14 nt, Human adenovirus C
gcccucuccugagc

SEQ ID NO: 1551739 - RNA, 21 nt, Human adenovirus C
cuggagaucuuucauccauga

SEQ ID NO: 1551740 - RNA, 14 nt, Human adenovirus C
aagagaugcuccag

SEQ ID NO: 1551741 - RNA, 16 nt, Human adenovirus C
ggcagcggugcacggg

SEQ ID NO: 1551742 - RNA, 14 nt, Human adenovirus C
cgagcgguguuccg

SEQ ID NO: 1551743 - RNA, 16 nt, Human adenovirus C
cucccacccccacuga

SEQ ID NO: 1551744 - RNA, 19 nt, Human adenovirus C
agcuuauuauucgccacaa

SEQ ID NO: 1551745 - RNA, 12 nt, Human adenovirus C
cagggugcgcca

SEQ ID NO: 1551746 - RNA, 22 nt, Human adenovirus C
acggccuucaacgagcgcuccg

SEQ ID NO: 1551747 - RNA, 13 nt, Human adenovirus C
cuccacaggcugc

SEQ ID NO: 1551748 - RNA, 20 nt, Human adenovirus C
aagcgcgcuggagcaaaacc

SEQ ID NO: 1551749 - RNA, 19 nt, Human adenovirus C
ccccgcugacacccagcag

SEQ ID NO: 1551750 - RNA, 13 nt, Human adenovirus C
ccucagcgccucc

SEQ ID NO: 1551751 - RNA, 20 nt, Human adenovirus C
caguaugauuaaaugagaca

SEQ ID NO: 1551752 - RNA, 13 nt, Human adenovirus C
cagucugcaagau

SEQ ID NO: 1551753 - RNA, 22 nt, Human adenovirus C
cgaggaccugcuugagcaggcc

SEQ ID NO: 1551754 - RNA, 15 nt, Human adenovirus C
guccagacgggccag

SEQ ID NO: 1551755 - RNA, 24 nt, Human adenovirus C
gccagcaccugucgucagcgccau

SEQ ID NO: 1551756 - RNA, 19 nt, Human adenovirus C
cugguguuuagugcuccac

SEQ ID NO: 1551757 - RNA, 14 nt, Human adenovirus C
ugccuaaccuucua

SEQ ID NO: 1551758 - RNA, 19 nt, Human adenovirus C
acuuugcuuuccugagccc

SEQ ID NO: 1551759 - RNA, 12 nt, Human adenovirus C
ggcaggagcaga

SEQ ID NO: 1551760 - RNA, 16 nt, Human adenovirus C
agauguuuggcggggc

SEQ ID NO: 1551761 - RNA, 13 nt, Human adenovirus C
uacgaugaccugg

SEQ ID NO: 1551762 - RNA, 16 nt, Human adenovirus C
agcaccugucgucagc

SEQ ID NO: 1551763 - RNA, 23 nt, Human adenovirus C
caggcggcggcggcggcaggagc

SEQ ID NO: 1551764 - RNA, 22 nt, Human adenovirus C
agcggcggcagcagcaggagga

SEQ ID NO: 1551765 - RNA, 15 nt, Human adenovirus C
gccccaggcugggga

SEQ ID NO: 1551766 - RNA, 16 nt, Human adenovirus C
cuagccgugcugaaac

SEQ ID NO: 1551767 - RNA, 22 nt, Human adenovirus C
uaaagcccgugacacugcagca

SEQ ID NO: 1551768 - RNA, 16 nt, Human adenovirus C
gugggcucguggugcu

SEQ ID NO: 1551769 - RNA, 16 nt, Human adenovirus C
agcccuaucagcagcc

SEQ ID NO: 1551770 - RNA, 19 nt, Human adenovirus C
ugagcagcuggcgcgcugg

SEQ ID NO: 1551771 - RNA, 23 nt, Human adenovirus C
uucgcccugcgcgucggccaggu

SEQ ID NO: 1551772 - RNA, 12 nt, Human adenovirus C
aagcagggcuuc

SEQ ID NO: 1551773 - RNA, 12 nt, Human adenovirus C
ggcagcgggugg

SEQ ID NO: 1551774 - RNA, 15 nt, Human adenovirus C
aagcaggccaaacuu

SEQ ID NO: 1551775 - RNA, 15 nt, Human adenovirus C
cgagaaggaggacag

SEQ ID NO: 1551776 - RNA, 14 nt, Human adenovirus C
aggcaggacccugg

SEQ ID NO: 1551777 - RNA, 19 nt, Human adenovirus C
cgcacugggcgcaccaccg

SEQ ID NO: 1551778 - RNA, 14 nt, Human adenovirus C
ugagccccgggcug

SEQ ID NO: 1551779 - RNA, 22 nt, Human adenovirus C
acagucuuccaaggugaaaauc

SEQ ID NO: 1551780 - RNA, 17 nt, Human adenovirus C
cuucaaccccuuuucug

SEQ ID NO: 1551781 - RNA, 20 nt, Human adenovirus C
ccgugugcaccagccgcacc

SEQ ID NO: 1551782 - RNA, 21 nt, Human adenovirus C
ggcggguacaguggaaagguc

SEQ ID NO: 1551783 - RNA, 13 nt, Human adenovirus C
gcccaggcggcgg

SEQ ID NO: 1551784 - RNA, 21 nt, Human adenovirus C
gccacaacauaaaagaagcaa

SEQ ID NO: 1551785 - RNA, 17 nt, Human adenovirus C
gcuuaacaguccccagg

SEQ ID NO: 1551786 - RNA, 22 nt, Human adenovirus C
cagcuggggccggaccugggcu

SEQ ID NO: 1551787 - RNA, 21 nt, Human adenovirus C
auuaaccuuggggcgcgcugg

SEQ ID NO: 1551788 - RNA, 21 nt, Human adenovirus C
guuucgcgcugcuccucuucc

SEQ ID NO: 1551789 - RNA, 17 nt, Human adenovirus C
accccaaguucaugccu

SEQ ID NO: 1551790 - RNA, 14 nt, Human adenovirus C
gacccggcugcgag

SEQ ID NO: 1551791 - RNA, 16 nt, Human adenovirus C
gcuugaucugcuggcg

SEQ ID NO: 1551792 - RNA, 13 nt, Human adenovirus C
gccuuugccaacu

SEQ ID NO: 1551793 - RNA, 18 nt, Human adenovirus C
gcgcucguugguccagca

SEQ ID NO: 1551794 - RNA, 12 nt, Human adenovirus C
cggacaggccgc

SEQ ID NO: 1551795 - RNA, 18 nt, Human adenovirus C
ggcacugccuguucgccg

SEQ ID NO: 1551796 - RNA, 14 nt, Human adenovirus C
gcuaccaccccagc

SEQ ID NO: 1551797 - RNA, 14 nt, Human adenovirus C
ccaugcgcgaggga

SEQ ID NO: 1551798 - RNA, 17 nt, Human adenovirus C
ggccaucauaccacaag

SEQ ID NO: 1551799 - RNA, 16 nt, Human adenovirus C
gggacgcucuggccgg

SEQ ID NO: 1551800 - RNA, 16 nt, Human adenovirus C
uccagacgggccaggg

SEQ ID NO: 1551801 - RNA, 21 nt, Human adenovirus C
aauaauuuucaucucgccacc

SEQ ID NO: 1551802 - RNA, 16 nt, Human adenovirus C
ccuacuuccgcagcca

SEQ ID NO: 1551803 - RNA, 18 nt, Human adenovirus C
ggcggucccacagcucgg

SEQ ID NO: 1551804 - RNA, 14 nt, Human adenovirus C
ccuccgcccugcgc

SEQ ID NO: 1551805 - RNA, 15 nt, Human adenovirus C
cguggagccugggcu

SEQ ID NO: 1551806 - RNA, 22 nt, Human adenovirus C
cucaucagugauauuaauaaac

SEQ ID NO: 1551807 - RNA, 20 nt, Human adenovirus C
gaaacucggaccacucugag

SEQ ID NO: 1551808 - RNA, 19 nt, Human adenovirus C
gaacccuaguauucaaccu

SEQ ID NO: 1551809 - RNA, 11 nt, Human adenovirus C
gguuccagaug

SEQ ID NO: 1551810 - RNA, 13 nt, Human adenovirus C
gcgcccuggggcg

SEQ ID NO: 1551811 - RNA, 19 nt, Human adenovirus C
gccgugcgcccgcuuucca

SEQ ID NO: 1551812 - RNA, 13 nt, Human adenovirus C
gaugugcccggcc

SEQ ID NO: 1551813 - RNA, 11 nt, Human adenovirus C
ugggcgcacca

SEQ ID NO: 1551814 - RNA, 13 nt, Human adenovirus C
gcccgugcuggcc

SEQ ID NO: 1551815 - RNA, 23 nt, Human adenovirus C
ugcgauacacaggguugcagcac

SEQ ID NO: 1551816 - RNA, 16 nt, Human adenovirus C
guaaaccugagccagg

SEQ ID NO: 1551817 - RNA, 14 nt, Human adenovirus C
guugaaagagcaaa

SEQ ID NO: 1551818 - RNA, 17 nt, Human adenovirus C
gugggucugggggugca

SEQ ID NO: 1551819 - RNA, 15 nt, Human adenovirus C
ucgccccaggcuggg

SEQ ID NO: 1551820 - RNA, 15 nt, Human adenovirus C
acgugccgcggcaga

SEQ ID NO: 1551821 - RNA, 16 nt, Human adenovirus C
gucgcuguccagcugc

SEQ ID NO: 1551822 - RNA, 23 nt, Human adenovirus C
auuugucuuuacgccaccuucuu

SEQ ID NO: 1551823 - RNA, 17 nt, Human adenovirus C
aagcagguuccugagca

SEQ ID NO: 1551824 - RNA, 18 nt, Human adenovirus C
ggcagcaacagcagcggu

SEQ ID NO: 1551825 - RNA, 23 nt, Human adenovirus C
accagacauuacucccauuuuuc

SEQ ID NO: 1551826 - RNA, 21 nt, Human adenovirus C
acaaggccggaaaccucaccu

SEQ ID NO: 1551827 - RNA, 22 nt, Human adenovirus C
ucccguagaggagccuccaccg

SEQ ID NO: 1551828 - RNA, 14 nt, Human adenovirus C
cauccggugcugcg

SEQ ID NO: 1551829 - RNA, 13 nt, Human adenovirus C
caguaacugcagc

SEQ ID NO: 1551830 - RNA, 13 nt, Human adenovirus C
caccuacagccug

SEQ ID NO: 1551831 - RNA, 15 nt, Human adenovirus C
gcagguacgccugca

SEQ ID NO: 1551832 - RNA, 16 nt, Human adenovirus C
ggccguggagacagug

SEQ ID NO: 1551833 - RNA, 13 nt, Human adenovirus C
aaaccaugcuaug

SEQ ID NO: 1551834 - RNA, 15 nt, Human adenovirus C
guaugcgcaggagca

SEQ ID NO: 1551835 - RNA, 21 nt, Human adenovirus C
gacugcuacauuaaccuuggg

SEQ ID NO: 1551836 - RNA, 13 nt, Human adenovirus C
acacagcccgcca

SEQ ID NO: 1551837 - RNA, 13 nt, Human adenovirus C
gccggccacggcc

SEQ ID NO: 1551838 - RNA, 14 nt, Human adenovirus C
gaccugcgcugggc

SEQ ID NO: 1551839 - RNA, 19 nt, Human adenovirus C
cugacacccagcagaaacc

SEQ ID NO: 1551840 - RNA, 12 nt, Human adenovirus C
cuugaggaggag

SEQ ID NO: 1551841 - RNA, 21 nt, Human adenovirus C
accuccuccuccugccaggcu

SEQ ID NO: 1551842 - RNA, 17 nt, Human adenovirus C
ccgcgcccaggcggcgg

SEQ ID NO: 1551843 - RNA, 13 nt, Human adenovirus C
ggagcgcaggguu

SEQ ID NO: 1551844 - RNA, 14 nt, Human adenovirus C
cgucgcaaccagga

SEQ ID NO: 1551845 - RNA, 11 nt, Human adenovirus C
gggccagcaca

SEQ ID NO: 1551846 - RNA, 15 nt, Human adenovirus C
gcuggguucccccuu

SEQ ID NO: 1551847 - RNA, 18 nt, Human adenovirus C
cuuaccccuccauuuguu

SEQ ID NO: 1551848 - RNA, 15 nt, Human adenovirus C
ggggcauggccggcc

SEQ ID NO: 1551849 - RNA, 16 nt, Human adenovirus C
uacaugagcaaacagu

SEQ ID NO: 1551850 - RNA, 13 nt, Human adenovirus C
cuggagaucuccg

SEQ ID NO: 1551851 - RNA, 21 nt, Human adenovirus C
acccagcagaaaccugugcug

SEQ ID NO: 1551852 - RNA, 14 nt, Human adenovirus C
ccaggcggucccac

SEQ ID NO: 1551853 - RNA, 18 nt, Human adenovirus C
uucagagaagaacaugcc

SEQ ID NO: 1551854 - RNA, 22 nt, Human adenovirus C
gagcagacggugaaccaggaga

SEQ ID NO: 1551855 - RNA, 15 nt, Human adenovirus C
cuacuccggcacugc

SEQ ID NO: 1551856 - RNA, 21 nt, Human adenovirus C
acuggaacaaugacaguggag

SEQ ID NO: 1551857 - RNA, 22 nt, Human adenovirus C
ggauuugucacccuuauccuca

SEQ ID NO: 1551858 - RNA, 16 nt, Human adenovirus C
gcgcagaugggagcug

SEQ ID NO: 1551859 - RNA, 21 nt, Human adenovirus C
accuacgacuacaugaacaag

SEQ ID NO: 1551860 - RNA, 23 nt, Human adenovirus C
ugagcccgacgcgcggaccggga

SEQ ID NO: 1551861 - RNA, 22 nt, Human adenovirus C
cgacacccaagggugcagcuga

SEQ ID NO: 1551862 - RNA, 15 nt, Human adenovirus C
aggcaguagcuugaa

SEQ ID NO: 1551863 - RNA, 20 nt, Human adenovirus C
aaccugagccaggcuuucaa

SEQ ID NO: 1551864 - RNA, 19 nt, Human adenovirus C
cgcgccuaccaccuucccc

SEQ ID NO: 1551865 - RNA, 17 nt, Human adenovirus C
uuaagcccuacuccggc

SEQ ID NO: 1551866 - RNA, 12 nt, Human adenovirus C
uaucacaucuuu

SEQ ID NO: 1551867 - RNA, 14 nt, Human adenovirus C
acaugaccaaggac

SEQ ID NO: 1551868 - RNA, 13 nt, Human adenovirus C
ccagcuuauucag

SEQ ID NO: 1551869 - RNA, 12 nt, Human adenovirus C
cugagcagcugc

SEQ ID NO: 1551870 - RNA, 13 nt, Human adenovirus C
ccguguauccaua

SEQ ID NO: 1551871 - RNA, 18 nt, Human adenovirus C
cacaacuuccucaaaucu

SEQ ID NO: 1551872 - RNA, 16 nt, Human adenovirus C
agaugagguacaugau

SEQ ID NO: 1551873 - RNA, 23 nt, Human adenovirus C
uaaacguagaggggcucucugag

SEQ ID NO: 1551874 - RNA, 20 nt, Human adenovirus C
cucgccuucgaucucagcgc

SEQ ID NO: 1551875 - RNA, 16 nt, Human adenovirus C
gcacucacagaccugg

SEQ ID NO: 1551876 - RNA, 19 nt, Human adenovirus C
gugaagacgacgggcccgg

SEQ ID NO: 1551877 - RNA, 23 nt, Human adenovirus C
ugagcgcgcgcagcagcagggca

SEQ ID NO: 1551878 - RNA, 22 nt, Human adenovirus C
cgacaggucaggcgggagcucc

SEQ ID NO: 1551879 - RNA, 21 nt, Human adenovirus C
ugcuuaacaguccccagguac

SEQ ID NO: 1551880 - RNA, 23 nt, Human adenovirus C
ggccuugcggcagggcgcuguca

SEQ ID NO: 1551881 - RNA, 20 nt, Human adenovirus C
ugaaucuccucuauaaacau

SEQ ID NO: 1551882 - RNA, 21 nt, Human adenovirus C
cgagaccgugucuggaacgcc

SEQ ID NO: 1551883 - RNA, 23 nt, Human adenovirus C
uccacgguaaagaccccgggcag

SEQ ID NO: 1551884 - RNA, 23 nt, Human adenovirus C
aggagcgcaaccuaaaggagcug

SEQ ID NO: 1551885 - RNA, 17 nt, Human adenovirus C
cugggacagucaggcag

SEQ ID NO: 1551886 - RNA, 16 nt, Human adenovirus C
cagccgcaggccaacc

SEQ ID NO: 1551887 - RNA, 13 nt, Human adenovirus C
aucaaucagccuc

SEQ ID NO: 1551888 - RNA, 17 nt, Human adenovirus C
ucagauacccaccacca

SEQ ID NO: 1551889 - RNA, 16 nt, Human adenovirus C
gcgcagcggcaaaaag

SEQ ID NO: 1551890 - RNA, 15 nt, Human adenovirus C
acauucaggugcccc

SEQ ID NO: 1551891 - RNA, 20 nt, Human adenovirus C
guguaggccacgugaccggg

SEQ ID NO: 1551892 - RNA, 13 nt, Human adenovirus C
agagcccgagggc

SEQ ID NO: 1551893 - RNA, 16 nt, Human adenovirus C
cgcuucacuggacucu

SEQ ID NO: 1551894 - RNA, 22 nt, Human adenovirus C
uaccuguguggaagccuggacc

SEQ ID NO: 1551895 - RNA, 13 nt, Human adenovirus C
cuccugccaggcu

SEQ ID NO: 1551896 - RNA, 15 nt, Human adenovirus C
caggugcacgcgcca

SEQ ID NO: 1551897 - RNA, 20 nt, Human adenovirus C
gaugccggcggcgguggugg

SEQ ID NO: 1551898 - RNA, 21 nt, Human adenovirus C
aguucgccaccaccgccucca

SEQ ID NO: 1551899 - RNA, 13 nt, Human adenovirus C
gcgcccgcccacc

SEQ ID NO: 1551900 - RNA, 22 nt, Human adenovirus C
ccagcggccacacccggcgcca

SEQ ID NO: 1551901 - RNA, 16 nt, Human adenovirus C
aaagcuuccgcaggcc

SEQ ID NO: 1551902 - RNA, 23 nt, Human adenovirus C
aguguaaaaagggccaaguacag

SEQ ID NO: 1551903 - RNA, 13 nt, Human adenovirus C
cuaaaccagcugg

SEQ ID NO: 1551904 - RNA, 23 nt, Human adenovirus C
ucagggcgcgggcuagguccagg

SEQ ID NO: 1551905 - RNA, 13 nt, Human adenovirus C
ggcgauggagcgc

SEQ ID NO: 1551906 - RNA, 14 nt, Human adenovirus C
cacaguggacgcgg

SEQ ID NO: 1551907 - RNA, 16 nt, Human adenovirus C
cccgcgccugcugggc

SEQ ID NO: 1551908 - RNA, 18 nt, Human adenovirus C
cggccugguaggcgcagc

SEQ ID NO: 1551909 - RNA, 23 nt, Human adenovirus C
guuggagaugcgggccaugagcu

SEQ ID NO: 1551910 - RNA, 18 nt, Human adenovirus C
ccgagagccggccuggac

SEQ ID NO: 1551911 - RNA, 14 nt, Human adenovirus C
accugugcugccag

SEQ ID NO: 1551912 - RNA, 13 nt, Human adenovirus C
guuugugccuccg

SEQ ID NO: 1551913 - RNA, 19 nt, Human adenovirus C
cgcucguugguccagcaga

SEQ ID NO: 1551914 - RNA, 14 nt, Human adenovirus C
ccuccgcacccacu

SEQ ID NO: 1551915 - RNA, 17 nt, Human adenovirus C
agcgguuaagcugggau

SEQ ID NO: 1551916 - RNA, 16 nt, Human adenovirus C
gcagacgacagcagcg

SEQ ID NO: 1551917 - RNA, 14 nt, Human adenovirus C
cugggaagaaagca

SEQ ID NO: 1551918 - RNA, 19 nt, Human adenovirus C
gagcccgaggagaugcggg

SEQ ID NO: 1551919 - RNA, 19 nt, Human adenovirus C
cgagauuagguucuacgaa

SEQ ID NO: 1551920 - RNA, 18 nt, Human adenovirus C
aggcgcaaggcggcgucc

SEQ ID NO: 1551921 - RNA, 17 nt, Human adenovirus C
gcgguucacccuggcug

SEQ ID NO: 1551922 - RNA, 13 nt, Human adenovirus C
uuacugcugcugg

SEQ ID NO: 1551923 - RNA, 23 nt, Human adenovirus C
ccaggaaguacggcaccgccagc

SEQ ID NO: 1551924 - RNA, 23 nt, Human adenovirus C
gcuaccucuccgcguaggcgcuc

SEQ ID NO: 1551925 - RNA, 18 nt, Human adenovirus C
gccggacugcggcgaacg

SEQ ID NO: 1551926 - RNA, 19 nt, Human adenovirus C
gcugccgucaucccugagc

SEQ ID NO: 1551927 - RNA, 21 nt, Human adenovirus C
cugcagccuccgccgccgcuu

SEQ ID NO: 1551928 - RNA, 17 nt, Human adenovirus C
gacacagaaaccgggcc

SEQ ID NO: 1551929 - RNA, 20 nt, Human adenovirus C
cuacgugcccuuucacauuc

SEQ ID NO: 1551930 - RNA, 22 nt, Human adenovirus C
gacgcggaggcucucuucagca

SEQ ID NO: 1551931 - RNA, 17 nt, Human adenovirus C
cggcagaaacagagggc

SEQ ID NO: 1551932 - RNA, 13 nt, Human adenovirus C
ccuaccaccuucc

SEQ ID NO: 1551933 - RNA, 19 nt, Human adenovirus C
aagaaacccaucugagcgg

SEQ ID NO: 1551934 - RNA, 21 nt, Human adenovirus C
ggugacgcgggcgggcccccg

SEQ ID NO: 1551935 - RNA, 14 nt, Human adenovirus C
auguuacauuuaaa

SEQ ID NO: 1551936 - RNA, 18 nt, Human adenovirus C
ucccaugaaaccaugcua

SEQ ID NO: 1551937 - RNA, 11 nt, Human adenovirus C
ggcggcagcag

SEQ ID NO: 1551938 - RNA, 16 nt, Human adenovirus C
ggccggacaggccgcg

SEQ ID NO: 1551939 - RNA, 15 nt, Human adenovirus C
gauacgucacuuccc

SEQ ID NO: 1551940 - RNA, 17 nt, Human adenovirus C
cugcgcgucggccaggu

SEQ ID NO: 1551941 - RNA, 19 nt, Human adenovirus C
acggccugguaggcgcagc

SEQ ID NO: 1551942 - RNA, 18 nt, Human adenovirus C
uggcggaggugcugcuga

SEQ ID NO: 1551943 - RNA, 20 nt, Human adenovirus C
guuaacaugguucugcagag

SEQ ID NO: 1551944 - RNA, 13 nt, Human adenovirus C
uauaacagaggcc

SEQ ID NO: 1551945 - RNA, 22 nt, Human adenovirus C
acauauuuccugcagauucacu

SEQ ID NO: 1551946 - RNA, 21 nt, Human adenovirus C
cacagccugcaaagggcccug

SEQ ID NO: 1551947 - RNA, 22 nt, Human adenovirus C
uugcugcgcccacaccuacagc

SEQ ID NO: 1551948 - RNA, 12 nt, Human adenovirus C
ccuuccaggcgc

SEQ ID NO: 1551949 - RNA, 16 nt, Human adenovirus C
cagacaaugcagaaac

SEQ ID NO: 1551950 - RNA, 18 nt, Human adenovirus C
ggcccgcugcccuggugu

SEQ ID NO: 1551951 - RNA, 23 nt, Human adenovirus C
uucagauacccaccaccaguagc

SEQ ID NO: 1551952 - RNA, 22 nt, Human adenovirus C
guguagacacuuaagcucgccu

SEQ ID NO: 1551953 - RNA, 14 nt, Human adenovirus C
acaagcgcagguag

SEQ ID NO: 1551954 - RNA, 14 nt, Human adenovirus C
cagcccuaucagca

SEQ ID NO: 1551955 - RNA, 15 nt, Human adenovirus C
agcggcauaaggaca

SEQ ID NO: 1551956 - RNA, 16 nt, Human adenovirus C
aagauggcaugugagu

SEQ ID NO: 1551957 - RNA, 20 nt, Human adenovirus C
cuaccgcgucaggaggggca

SEQ ID NO: 1551958 - RNA, 14 nt, Human adenovirus C
ugccagacaagcua

SEQ ID NO: 1551959 - RNA, 22 nt, Human adenovirus C
ugacagcgacacccuuacugua

SEQ ID NO: 1551960 - RNA, 18 nt, Human adenovirus C
aacgcagcaucgagguca

SEQ ID NO: 1551961 - RNA, 15 nt, Human adenovirus C
ucaaaaucccacagu

SEQ ID NO: 1551962 - RNA, 12 nt, Human adenovirus C
gccucagccgcu

SEQ ID NO: 1551963 - RNA, 20 nt, Human adenovirus C
uccaggcuuuguuucuccac

SEQ ID NO: 1551964 - RNA, 17 nt, Human adenovirus C
cagaugcugagggacaa

SEQ ID NO: 1551965 - RNA, 20 nt, Human adenovirus C
guccggcucaccacccaggu

SEQ ID NO: 1551966 - RNA, 19 nt, Human adenovirus C
gaacgcggguuuggcaggg

SEQ ID NO: 1551967 - RNA, 23 nt, Human adenovirus C
cagcugaccacuuacuggcugca

SEQ ID NO: 1551968 - RNA, 20 nt, Human adenovirus C
acaucauuuugcugccagga

SEQ ID NO: 1551969 - RNA, 22 nt, Human adenovirus C
agugcuuaaaaaaacaacuccc

SEQ ID NO: 1551970 - RNA, 17 nt, Human adenovirus C
ccguuuuuacccaccca

SEQ ID NO: 1551971 - RNA, 24 nt, Human adenovirus C
cccagaugcauccggugcugcggc

SEQ ID NO: 1551972 - RNA, 14 nt, Human adenovirus C
uuauaaaaugcacc

SEQ ID NO: 1551973 - RNA, 12 nt, Human adenovirus C
uucugcugugcg

SEQ ID NO: 1551974 - RNA, 14 nt, Human adenovirus C
ucccacggcaugcu

SEQ ID NO: 1551975 - RNA, 14 nt, Human adenovirus C
uccguccugcagga

SEQ ID NO: 1551976 - RNA, 17 nt, Human adenovirus C
caucgcgcaacugggca

SEQ ID NO: 1551977 - RNA, 16 nt, Human adenovirus C
ggcaucucgauccagc

SEQ ID NO: 1551978 - RNA, 18 nt, Human adenovirus C
guauacgcagauccuucc

SEQ ID NO: 1551979 - RNA, 16 nt, Human adenovirus C
ugggcguguggcagca

SEQ ID NO: 1551980 - RNA, 19 nt, Human adenovirus C
acgcucaagggcgaggcgc

SEQ ID NO: 1551981 - RNA, 13 nt, Human adenovirus C
cgcuggggcagga

SEQ ID NO: 1551982 - RNA, 15 nt, Human adenovirus C
gccaccuucuucccc

SEQ ID NO: 1551983 - RNA, 12 nt, Human adenovirus C
gcgagggccagc

SEQ ID NO: 1551984 - RNA, 13 nt, Human adenovirus C
cacaagcucgccu

SEQ ID NO: 1551985 - RNA, 13 nt, Human adenovirus C
gcaaugacagcac

SEQ ID NO: 1551986 - RNA, 14 nt, Human adenovirus C
ugggaaacggccgc

SEQ ID NO: 1551987 - RNA, 16 nt, Human adenovirus C
ugcccgcggcuccggu

SEQ ID NO: 1551988 - RNA, 14 nt, Human adenovirus C
ggcacuuaggccag

SEQ ID NO: 1551989 - RNA, 19 nt, Human adenovirus C
ccucaggcgccgccggcac

SEQ ID NO: 1551990 - RNA, 17 nt, Human adenovirus C
ccagcggccacacccgg

SEQ ID NO: 1551991 - RNA, 19 nt, Human adenovirus C
acgugcgccaggccugcaa

SEQ ID NO: 1551992 - RNA, 17 nt, Human adenovirus C
aaagcaggggccaagaa

SEQ ID NO: 1551993 - RNA, 23 nt, Human adenovirus C
uuccaugagccgguguccacgcu

SEQ ID NO: 1551994 - RNA, 18 nt, Human adenovirus C
gccgcucauggcgcagcu

SEQ ID NO: 1551995 - RNA, 18 nt, Human adenovirus C
cugcagauucacucaaau

SEQ ID NO: 1551996 - RNA, 18 nt, Human adenovirus C
acaaggccugcagaccgu

SEQ ID NO: 1551997 - RNA, 11 nt, Human adenovirus C
gauacgucacu

SEQ ID NO: 1551998 - RNA, 18 nt, Human adenovirus C
aacuggccccaaacuccc

SEQ ID NO: 1551999 - RNA, 20 nt, Human adenovirus C
cacucgcccuacuuccgcag

SEQ ID NO: 1552000 - RNA, 23 nt, Human adenovirus C
cagcagcgcgcgaauaaacugcu

SEQ ID NO: 1552001 - RNA, 19 nt, Human adenovirus C
gcauugcguaccucaggca

SEQ ID NO: 1552002 - RNA, 18 nt, Human adenovirus C
ucagcagcggcaagagca

SEQ ID NO: 1552003 - RNA, 15 nt, Human adenovirus C
cuguuuugcagcagc

SEQ ID NO: 1552004 - RNA, 20 nt, Human adenovirus C
cgugcuguugaagcaucugc

SEQ ID NO: 1552005 - RNA, 23 nt, Human adenovirus C
ggcggcagcggcagcggcagcaa

SEQ ID NO: 1552006 - RNA, 15 nt, Human adenovirus C
gcggcagcggcagca

SEQ ID NO: 1552007 - RNA, 14 nt, Human adenovirus C
cgcguuccggcagc

SEQ ID NO: 1552008 - RNA, 21 nt, Human adenovirus C
cguggccuugcaggcgcagag

SEQ ID NO: 1552009 - RNA, 18 nt, Human adenovirus C
cccgccgggagagggggc

SEQ ID NO: 1552010 - RNA, 21 nt, Human adenovirus C
caggcacaaccauccgcggca

SEQ ID NO: 1552011 - RNA, 16 nt, Human adenovirus C
cuaacgaugcaucuca

SEQ ID NO: 1552012 - RNA, 17 nt, Human adenovirus C
cacccaccgugcagcug

SEQ ID NO: 1552013 - RNA, 14 nt, Human adenovirus C
ugccgugccagagg

SEQ ID NO: 1552014 - RNA, 15 nt, Human adenovirus C
aagcucgccugcgcc

SEQ ID NO: 1552015 - RNA, 13 nt, Human adenovirus C
guccagcagaggc

SEQ ID NO: 1552016 - RNA, 14 nt, Human adenovirus C
cuaugcgccacugg

SEQ ID NO: 1552017 - RNA, 13 nt, Human adenovirus C
gcauuccacgagc

SEQ ID NO: 1552018 - RNA, 22 nt, Human adenovirus C
cccaggcaaaguuagucugcag

SEQ ID NO: 1552019 - RNA, 13 nt, Human adenovirus C
gaugaccuggagg

SEQ ID NO: 1552020 - RNA, 14 nt, Human adenovirus C
gcaugaagggcacg

SEQ ID NO: 1552021 - RNA, 21 nt, Human adenovirus C
ccgaacagcgccuacuagaaa

SEQ ID NO: 1552022 - RNA, 21 nt, Human adenovirus C
guauguauccagcggcggcgg

SEQ ID NO: 1552023 - RNA, 14 nt, Human adenovirus C
ugcuccucuucccg

SEQ ID NO: 1552024 - RNA, 21 nt, Human adenovirus C
aaaaugaugacaaacuuaccc

SEQ ID NO: 1552025 - RNA, 22 nt, Human adenovirus C
cugccgucaucccugagcaggg

SEQ ID NO: 1552026 - RNA, 13 nt, Human adenovirus C
cccagcgccaaaa

SEQ ID NO: 1552027 - RNA, 17 nt, Human adenovirus C
cggcggucggagcuuga

SEQ ID NO: 1552028 - RNA, 12 nt, Human adenovirus C
cguggcgcagcg

SEQ ID NO: 1552029 - RNA, 15 nt, Human adenovirus C
cugcagcgccagugc

SEQ ID NO: 1552030 - RNA, 22 nt, Human adenovirus C
ggcaccagcucaaucagucaca

SEQ ID NO: 1552031 - RNA, 20 nt, Human adenovirus C
uauugaucaccguaccuuaa

SEQ ID NO: 1552032 - RNA, 23 nt, Human adenovirus C
gucgugcgcaccaccggcggcgg

SEQ ID NO: 1552033 - RNA, 13 nt, Human adenovirus C
ccccgcggcgccg

SEQ ID NO: 1552034 - RNA, 21 nt, Human adenovirus C
gcggcaagagcaagagcagcg

SEQ ID NO: 1552035 - RNA, 18 nt, Human adenovirus C
ccgagcuguugcccgugc

SEQ ID NO: 1552036 - RNA, 20 nt, Human adenovirus C
cagacuauuuuuuccagacc

SEQ ID NO: 1552037 - RNA, 21 nt, Human adenovirus C
ccagacaagcuaaaauacaac

SEQ ID NO: 1552038 - RNA, 18 nt, Human adenovirus C
uggccguagguggcgccc

SEQ ID NO: 1552039 - RNA, 15 nt, Human adenovirus C
caacucgcugcugca

SEQ ID NO: 1552040 - RNA, 13 nt, Human adenovirus C
ccacccagcgcca

SEQ ID NO: 1552041 - RNA, 20 nt, Human adenovirus C
cagccgccuuuuagcugcaa

SEQ ID NO: 1552042 - RNA, 15 nt, Human adenovirus C
cgggccaugagcugc

SEQ ID NO: 1552043 - RNA, 13 nt, Human adenovirus C
cuacaugagcgcg

SEQ ID NO: 1552044 - RNA, 17 nt, Human adenovirus C
cugcgagagcucggugu

SEQ ID NO: 1552045 - RNA, 22 nt, Human adenovirus C
gaagugauuaucgagcaggacc

SEQ ID NO: 1552046 - RNA, 13 nt, Human adenovirus C
gucgccgccagag

SEQ ID NO: 1552047 - RNA, 23 nt, Human adenovirus C
gugccuuuuacugcugcuggaag

SEQ ID NO: 1552048 - RNA, 16 nt, Human adenovirus C
aagacugugggggcaa

SEQ ID NO: 1552049 - RNA, 22 nt, Human adenovirus C
ugcgccagcagguuucugcccu

SEQ ID NO: 1552050 - RNA, 13 nt, Human adenovirus C
cuggcagggacac

SEQ ID NO: 1552051 - RNA, 19 nt, Human adenovirus C
gcuauggaucuuaugccag

SEQ ID NO: 1552052 - RNA, 13 nt, Human adenovirus C
agccgcgcgcugg

SEQ ID NO: 1552053 - RNA, 23 nt, Human adenovirus C
gucugaagacaccuucaaccccg

SEQ ID NO: 1552054 - RNA, 10 nt, Human adenovirus C
acugcugcug

SEQ ID NO: 1552055 - RNA, 16 nt, Human adenovirus C
ccucaucggcugaagc

SEQ ID NO: 1552056 - RNA, 18 nt, Human adenovirus C
acaagaaguugaagacau

SEQ ID NO: 1552057 - RNA, 19 nt, Human adenovirus C
cagcccgugcuggccccga

SEQ ID NO: 1552058 - RNA, 16 nt, Human adenovirus C
ccucacccgcagcugc

SEQ ID NO: 1552059 - RNA, 17 nt, Human adenovirus C
augcuucuaaauagcua

SEQ ID NO: 1552060 - RNA, 23 nt, Human adenovirus C
cucagccgccuuuuagcugcaaa

SEQ ID NO: 1552061 - RNA, 19 nt, Human adenovirus C
acucacguugugcauuguc

SEQ ID NO: 1552062 - RNA, 14 nt, Human adenovirus C
ccgccgcaccgugc

SEQ ID NO: 1552063 - RNA, 22 nt, Human adenovirus C
aucgcuuucccgagaaccagau

SEQ ID NO: 1552064 - RNA, 15 nt, Human adenovirus C
ccugcugcaccugcg

SEQ ID NO: 1552065 - RNA, 13 nt, Human adenovirus C
agggcaaccuggg

SEQ ID NO: 1552066 - RNA, 20 nt, Human adenovirus C
accgggguacccaacuccau

SEQ ID NO: 1552067 - RNA, 17 nt, Human adenovirus C
gggacccgccgggagag

SEQ ID NO: 1552068 - RNA, 20 nt, Human adenovirus C
ccaguggagaggcagagcga

SEQ ID NO: 1552069 - RNA, 15 nt, Human adenovirus C
cgccccaggcugggg

SEQ ID NO: 1552070 - RNA, 18 nt, Human adenovirus C
uggacuuggaggagggcg

SEQ ID NO: 1552071 - RNA, 13 nt, Human adenovirus C
cucaccaaggcca

SEQ ID NO: 1552072 - RNA, 22 nt, Human adenovirus C
aucccugagcaggggggccacu

SEQ ID NO: 1552073 - RNA, 20 nt, Human adenovirus C
aaaaucagucagcaaaucuu

SEQ ID NO: 1552074 - RNA, 13 nt, Human adenovirus C
augagcaaggaaa

SEQ ID NO: 1552075 - RNA, 13 nt, Human adenovirus C
aagauuauccaaa

SEQ ID NO: 1552076 - RNA, 18 nt, Human adenovirus C
gcuucagccgcugcagcc

SEQ ID NO: 1552077 - RNA, 22 nt, Human adenovirus C
gagaaggucaucaagacuuugg

SEQ ID NO: 1552078 - RNA, 14 nt, Human adenovirus C
cccagcugcuacaa

SEQ ID NO: 1552079 - RNA, 17 nt, Human adenovirus C
caggagcuggugcugcg

SEQ ID NO: 1552080 - RNA, 16 nt, Human adenovirus C
cagccgcaccgcggcg

SEQ ID NO: 1552081 - RNA, 21 nt, Human adenovirus C
agaugacuaacucaggggcgc

SEQ ID NO: 1552082 - RNA, 13 nt, Human adenovirus C
ggaccaccacgcc

SEQ ID NO: 1552083 - RNA, 13 nt, Human adenovirus C
agugcaaaauaag

SEQ ID NO: 1552084 - RNA, 20 nt, Human adenovirus C
cucacuuaaaucagcacagu

SEQ ID NO: 1552085 - RNA, 19 nt, Human adenovirus C
cugcagagcucucugggaa

SEQ ID NO: 1552086 - RNA, 18 nt, Human adenovirus C
agucugcagcgcugccaa

SEQ ID NO: 1552087 - RNA, 15 nt, Human adenovirus C
gcgacgucagacaac

SEQ ID NO: 1552088 - RNA, 22 nt, Human adenovirus C
aggucguuggagaugcgggcca

SEQ ID NO: 1552089 - RNA, 13 nt, Human adenovirus C
gggcgaggcgcgc

SEQ ID NO: 1552090 - RNA, 17 nt, Human adenovirus C
ccgugcacgaccccugg

SEQ ID NO: 1552091 - RNA, 22 nt, Human adenovirus C
aaccgcgguugugcagggugac

SEQ ID NO: 1552092 - RNA, 16 nt, Human adenovirus C
agcguggcgcuggaca

SEQ ID NO: 1552093 - RNA, 20 nt, Human adenovirus C
gcgcaacauggaaccgggca

SEQ ID NO: 1552094 - RNA, 13 nt, Human adenovirus C
ggcugcuuguccu

SEQ ID NO: 1552095 - RNA, 13 nt, Human adenovirus C
ucgcguccaggcc

SEQ ID NO: 1552096 - RNA, 14 nt, Human adenovirus C
acagucaggcagag

SEQ ID NO: 1552097 - RNA, 14 nt, Human adenovirus C
cuggcacgggcagc

SEQ ID NO: 1552098 - RNA, 14 nt, Human adenovirus C
gccuugcaggcgca

SEQ ID NO: 1552099 - RNA, 23 nt, Human adenovirus C
cgagcugcuucccaaaggccccc

SEQ ID NO: 1552100 - RNA, 19 nt, Human adenovirus C
accuaugauacuuaccauu

SEQ ID NO: 1552101 - RNA, 16 nt, Human adenovirus C
gcagccaccgcccgcg

SEQ ID NO: 1552102 - RNA, 18 nt, Human adenovirus C
cucccgccaccaguugga

SEQ ID NO: 1552103 - RNA, 18 nt, Human adenovirus C
gugacucuggauguucag

SEQ ID NO: 1552104 - RNA, 13 nt, Human adenovirus C
gcgcccauggcua

SEQ ID NO: 1552105 - RNA, 21 nt, Human adenovirus C
acuaccgcgcgcccuggggcg

SEQ ID NO: 1552106 - RNA, 16 nt, Human adenovirus C
gaacauucccagcugc

SEQ ID NO: 1552107 - RNA, 19 nt, Human adenovirus C
cuacaccuaccgccccaga

SEQ ID NO: 1552108 - RNA, 21 nt, Human adenovirus C
ugcucguccagacgggccagg

SEQ ID NO: 1552109 - RNA, 13 nt, Human adenovirus C
gccgccgcaccgu

SEQ ID NO: 1552110 - RNA, 14 nt, Human adenovirus C
caggcgacgagcgg

SEQ ID NO: 1552111 - RNA, 15 nt, Human adenovirus C
ugaguacgagccaga

SEQ ID NO: 1552112 - RNA, 14 nt, Human adenovirus C
caggggccucuucu

SEQ ID NO: 1552113 - RNA, 21 nt, Human adenovirus C
ccuaucaccgucacccagcac

SEQ ID NO: 1552114 - RNA, 20 nt, Human adenovirus C
ggcguccggcucaccaccca

SEQ ID NO: 1552115 - RNA, 15 nt, Human adenovirus C
ccagcugcugagcca

SEQ ID NO: 1552116 - RNA, 19 nt, Human adenovirus C
cugccaaaaagguugaguu

SEQ ID NO: 1552117 - RNA, 14 nt, Human adenovirus C
acuccacaggcugc

SEQ ID NO: 1552118 - RNA, 15 nt, Human adenovirus C
cugucuuacaaaccu

SEQ ID NO: 1552119 - RNA, 14 nt, Human adenovirus C
aagagcugaaaaua

SEQ ID NO: 1552120 - RNA, 19 nt, Human adenovirus C
ccugcugaaugcgcaggcg

SEQ ID NO: 1552121 - RNA, 18 nt, Human adenovirus C
accaguuggaggaguggc

SEQ ID NO: 1552122 - RNA, 21 nt, Human adenovirus C
acuuggcacccaccgugcagc

SEQ ID NO: 1552123 - RNA, 21 nt, Human adenovirus C
uccucagcgaugauucgcacc

SEQ ID NO: 1552124 - RNA, 20 nt, Human adenovirus C
gcgcugaccugcgcugggcc

SEQ ID NO: 1552125 - RNA, 18 nt, Human adenovirus C
acugcagcaggugcugcc

SEQ ID NO: 1552126 - RNA, 18 nt, Human adenovirus C
ucagucgagaaggaggac

SEQ ID NO: 1552127 - RNA, 18 nt, Human adenovirus C
gcucuagcgaugaagaua

SEQ ID NO: 1552128 - RNA, 18 nt, Human adenovirus C
gugucagacgaaacaccg

SEQ ID NO: 1552129 - RNA, 13 nt, Human adenovirus C
uccuccugccagg

SEQ ID NO: 1552130 - RNA, 16 nt, Human adenovirus C
gauaucggcaccagca

SEQ ID NO: 1552131 - RNA, 16 nt, Human adenovirus C
gcugggccagcacaca

SEQ ID NO: 1552132 - RNA, 12 nt, Human adenovirus C
cugggacagccu

SEQ ID NO: 1552133 - RNA, 12 nt, Human adenovirus C
gcggcugcugcg

SEQ ID NO: 1552134 - RNA, 20 nt, Human adenovirus C
cugccuccccccgcugacac

SEQ ID NO: 1552135 - RNA, 16 nt, Human adenovirus C
cacaggcugcgcacca

SEQ ID NO: 1552136 - RNA, 13 nt, Human adenovirus C
gaagucuuugacg

SEQ ID NO: 1552137 - RNA, 17 nt, Human adenovirus C
acugcagcacagcacca

SEQ ID NO: 1552138 - RNA, 17 nt, Human adenovirus C
ucccaggauggcaccca

SEQ ID NO: 1552139 - RNA, 20 nt, Human adenovirus C
caggcgcggcggcugcugcg

SEQ ID NO: 1552140 - RNA, 17 nt, Human adenovirus C
auaacagcacuggcaac

SEQ ID NO: 1552141 - RNA, 20 nt, Human adenovirus C
cccgcuugcaaauuccuccg

SEQ ID NO: 1552142 - RNA, 21 nt, Human adenovirus C
cagacacgaucggcaggcuca

SEQ ID NO: 1552143 - RNA, 18 nt, Human adenovirus C
uaggggagaucagcuggg

SEQ ID NO: 1552144 - RNA, 15 nt, Human adenovirus C
gccgccggcacugcc

SEQ ID NO: 1552145 - RNA, 22 nt, Human adenovirus C
cauggaccgcaucaugucgcug

SEQ ID NO: 1552146 - RNA, 14 nt, Human adenovirus C
cuccuccuccugcc

SEQ ID NO: 1552147 - RNA, 21 nt, Human adenovirus C
agaaccagauauuuuucuaug

SEQ ID NO: 1552148 - RNA, 21 nt, Human adenovirus C
ccgcguccggcucgcuccacg

SEQ ID NO: 1552149 - RNA, 17 nt, Human adenovirus C
cuccauggucgggacgc

SEQ ID NO: 1552150 - RNA, 20 nt, Human adenovirus C
ggugagcuccucaggggagc

SEQ ID NO: 1552151 - RNA, 20 nt, Human adenovirus C
ucaacuacaccgucaagaaa

SEQ ID NO: 1552152 - RNA, 18 nt, Human adenovirus C
caugcgcgagggacaggc

SEQ ID NO: 1552153 - RNA, 18 nt, Human adenovirus C
cacugugguacuucccag

SEQ ID NO: 1552154 - RNA, 23 nt, Human adenovirus C
cucccaccacugugguacuuccc

SEQ ID NO: 1552155 - RNA, 20 nt, Human adenovirus C
ugaccaguggagaggcagag

SEQ ID NO: 1552156 - RNA, 20 nt, Human adenovirus C
ccaauccccccgccgccgca

SEQ ID NO: 1552157 - RNA, 21 nt, Human adenovirus C
ccuaacuccugugagugggaa

SEQ ID NO: 1552158 - RNA, 12 nt, Human adenovirus C
ggacaccuccca

SEQ ID NO: 1552159 - RNA, 21 nt, Human adenovirus C
aauccaguggacuaaacuuug

SEQ ID NO: 1552160 - RNA, 15 nt, Human adenovirus C
ccaccaccacauagc

SEQ ID NO: 1552161 - RNA, 15 nt, Human adenovirus C
caguauuacccagaa

SEQ ID NO: 1552162 - RNA, 16 nt, Human adenovirus C
cauaaauaaaaaccag

SEQ ID NO: 1552163 - RNA, 14 nt, Human adenovirus C
cgcgcugcuccucu

SEQ ID NO: 1552164 - RNA, 21 nt, Human adenovirus C
ccgcagcccuaucagcagccg

SEQ ID NO: 1552165 - RNA, 21 nt, Human adenovirus C
ccaugcgcgagggacaggcuu

SEQ ID NO: 1552166 - RNA, 22 nt, Human adenovirus C
cgcgcaaaccccacgcacgaga

SEQ ID NO: 1552167 - RNA, 17 nt, Human adenovirus C
ggccgcgggcugggugu

SEQ ID NO: 1552168 - RNA, 15 nt, Human adenovirus C
uaagcacuuacucua

SEQ ID NO: 1552169 - RNA, 23 nt, Human adenovirus C
accggagugcugggccagcacac

SEQ ID NO: 1552170 - RNA, 20 nt, Human adenovirus C
caaccguagaugggacacca

SEQ ID NO: 1552171 - RNA, 12 nt, Human adenovirus C
aaaacaaaguca

SEQ ID NO: 1552172 - RNA, 20 nt, Human adenovirus C
cagcaauaacacaggcuggg

SEQ ID NO: 1552173 - RNA, 14 nt, Human adenovirus C
ccucacccgcagcu

SEQ ID NO: 1552174 - RNA, 16 nt, Human adenovirus C
accccugacagaggac

SEQ ID NO: 1552175 - RNA, 22 nt, Human adenovirus C
agcaugaagggcacgagcugcu

SEQ ID NO: 1552176 - RNA, 15 nt, Human adenovirus C
gguggugggcgccga

SEQ ID NO: 1552177 - RNA, 16 nt, Human adenovirus C
cucgucgggcaccagg

SEQ ID NO: 1552178 - RNA, 17 nt, Human adenovirus C
aagaugaagaagaggaa

SEQ ID NO: 1552179 - RNA, 15 nt, Human adenovirus C
cucacccgcagcugc

SEQ ID NO: 1552180 - RNA, 15 nt, Human adenovirus C
gggguaccugcugga

SEQ ID NO: 1552181 - RNA, 14 nt, Human adenovirus C
gcagaccguggacg

SEQ ID NO: 1552182 - RNA, 16 nt, Human adenovirus C
caagcuugguggcaaa

SEQ ID NO: 1552183 - RNA, 14 nt, Human adenovirus C
gguuuuccuggcca

SEQ ID NO: 1552184 - RNA, 16 nt, Human adenovirus C
guugucaagcuuggug

SEQ ID NO: 1552185 - RNA, 24 nt, Human adenovirus C
cagcggcaagagcaagagcagcgg

SEQ ID NO: 1552186 - RNA, 23 nt, Human adenovirus C
cccaccauuuguagcgccacauc

SEQ ID NO: 1552187 - RNA, 18 nt, Human adenovirus C
acuggucguugccagaca

SEQ ID NO: 1552188 - RNA, 19 nt, Human adenovirus C
agcgcgcgcucguaugggu

SEQ ID NO: 1552189 - RNA, 12 nt, Human adenovirus C
uuuccaggcuuu

SEQ ID NO: 1552190 - RNA, 11 nt, Human adenovirus C
ggagugcuggg

SEQ ID NO: 1552191 - RNA, 16 nt, Human adenovirus C
agaauggaagacauca

SEQ ID NO: 1552192 - RNA, 20 nt, Human adenovirus C
ccuuggaggaggcgccgcac

SEQ ID NO: 1552193 - RNA, 20 nt, Human adenovirus C
acacccagaaaaccgcacgc

SEQ ID NO: 1552194 - RNA, 17 nt, Human adenovirus C
ugaccguggagccuggg

SEQ ID NO: 1552195 - RNA, 16 nt, Human adenovirus C
cugggggcaacaucca

SEQ ID NO: 1552196 - RNA, 19 nt, Human adenovirus C
uuuaggcuugcucgcccuu

SEQ ID NO: 1552197 - RNA, 23 nt, Human adenovirus C
aaaccuucucuacgccaacuccg

SEQ ID NO: 1552198 - RNA, 19 nt, Human adenovirus C
caaucuccucuuccauaag

SEQ ID NO: 1552199 - RNA, 19 nt, Human adenovirus C
ugucuuuccacgggcgcag

SEQ ID NO: 1552200 - RNA, 21 nt, Human adenovirus C
uaucucaaauacaaaagcaga

SEQ ID NO: 1552201 - RNA, 22 nt, Human adenovirus C
ggccaaucaagcagguggcacc

SEQ ID NO: 1552202 - RNA, 16 nt, Human adenovirus C
cuuaacaguccccagg

SEQ ID NO: 1552203 - RNA, 15 nt, Human adenovirus C
cgccgcagcagccgc

SEQ ID NO: 1552204 - RNA, 14 nt, Human adenovirus C
ugcgcagcggcaaa

SEQ ID NO: 1552205 - RNA, 18 nt, Human adenovirus C
gcuggacgagggcaaccc

SEQ ID NO: 1552206 - RNA, 23 nt, Human adenovirus C
cgccgggagagggggcaggggca

SEQ ID NO: 1552207 - RNA, 16 nt, Human adenovirus C
aacucaccugaaaauc

SEQ ID NO: 1552208 - RNA, 23 nt, Human adenovirus C
gaggaccugcuugagcaggccaa

SEQ ID NO: 1552209 - RNA, 19 nt, Human adenovirus C
uaaugagcuugaucugcug

SEQ ID NO: 1552210 - RNA, 22 nt, Human adenovirus C
auauaaaccucugauuaaacau

SEQ ID NO: 1552211 - RNA, 11 nt, Human adenovirus C
aggcuggggcc

SEQ ID NO: 1552212 - RNA, 13 nt, Human adenovirus C
uaccugcugacca

SEQ ID NO: 1552213 - RNA, 14 nt, Human adenovirus C
gcugcagagccagc

SEQ ID NO: 1552214 - RNA, 16 nt, Human adenovirus C
cucgagaucaggcuac

SEQ ID NO: 1552215 - RNA, 15 nt, Human adenovirus C
ucguccagacgggcc

SEQ ID NO: 1552216 - RNA, 23 nt, Human adenovirus C
gcucgcuguggagcggcauuaaa

SEQ ID NO: 1552217 - RNA, 14 nt, Human adenovirus C
aggguccucgucag

SEQ ID NO: 1552218 - RNA, 19 nt, Human adenovirus C
auagugcagcacagcaggg

SEQ ID NO: 1552219 - RNA, 15 nt, Human adenovirus C
cgcguugcucagggc

SEQ ID NO: 1552220 - RNA, 18 nt, Human adenovirus C
aagaaagucccccuggag

SEQ ID NO: 1552221 - RNA, 20 nt, Human adenovirus C
cagagcauaguggugcagga

SEQ ID NO: 1552222 - RNA, 23 nt, Human adenovirus C
acuuuaacggcucuucauuugua

SEQ ID NO: 1552223 - RNA, 22 nt, Human adenovirus C
gccuugcaggcgcagagacacu

SEQ ID NO: 1552224 - RNA, 20 nt, Human adenovirus C
gccaccucccucccaacaca

SEQ ID NO: 1552225 - RNA, 14 nt, Human adenovirus C
aguggcggcggcgc

SEQ ID NO: 1552226 - RNA, 18 nt, Human adenovirus C
ccggcaaggcaaugcuac

SEQ ID NO: 1552227 - RNA, 18 nt, Human adenovirus C
cgugguccgugugcacca

SEQ ID NO: 1552228 - RNA, 14 nt, Human adenovirus C
aacgcugggggcaa

SEQ ID NO: 1552229 - RNA, 19 nt, Human adenovirus C
agcgaagaaacccaucuga

SEQ ID NO: 1552230 - RNA, 13 nt, Human adenovirus C
cagccgccugagc

SEQ ID NO: 1552231 - RNA, 20 nt, Human adenovirus C
cgcccagcaauaacacaggc

SEQ ID NO: 1552232 - RNA, 16 nt, Human adenovirus C
acgaacccccgcggcg

SEQ ID NO: 1552233 - RNA, 17 nt, Human adenovirus C
gaggccucccucguucc

SEQ ID NO: 1552234 - RNA, 13 nt, Human adenovirus C
cucagcgcagcgg

SEQ ID NO: 1552235 - RNA, 17 nt, Human adenovirus C
agcgcggcgccaguggc

SEQ ID NO: 1552236 - RNA, 17 nt, Human adenovirus C
gcgcaggguggcucgcg

SEQ ID NO: 1552237 - RNA, 20 nt, Human adenovirus C
ucaccagcauaacaacucag

SEQ ID NO: 1552238 - RNA, 22 nt, Human adenovirus C
ccuuucacauucaggugcccca

SEQ ID NO: 1552239 - RNA, 12 nt, Human adenovirus C
uccugaaggggg

SEQ ID NO: 1552240 - RNA, 18 nt, Human adenovirus C
caagccccgaaagcuaaa

SEQ ID NO: 1552241 - RNA, 15 nt, Human adenovirus C
ugucugcgagggcca

SEQ ID NO: 1552242 - RNA, 23 nt, Human adenovirus C
caagcgcaaaaucaaagaagaga

SEQ ID NO: 1552243 - RNA, 15 nt, Human adenovirus C
cgcgcuggucucugg

SEQ ID NO: 1552244 - RNA, 19 nt, Human adenovirus C
cugcaccacauuucggccc

SEQ ID NO: 1552245 - RNA, 19 nt, Human adenovirus C
cuucgaugcuccccuggac

SEQ ID NO: 1552246 - RNA, 21 nt, Human adenovirus C
acuacgucaucuccagcggcc

SEQ ID NO: 1552247 - RNA, 16 nt, Human adenovirus C
gccugggcuggagccc

SEQ ID NO: 1552248 - RNA, 19 nt, Human adenovirus C
cgugcagaccaaccuggac

SEQ ID NO: 1552249 - RNA, 22 nt, Human adenovirus C
ggcaaugcagccgguggaggac

SEQ ID NO: 1552250 - RNA, 20 nt, Human adenovirus C
gaucucuuccuccuggagau

SEQ ID NO: 1552251 - RNA, 15 nt, Human adenovirus C
gcgagucuggugacu

SEQ ID NO: 1552252 - RNA, 22 nt, Human adenovirus C
cacgguaaagaccccgggcagc

SEQ ID NO: 1552253 - RNA, 21 nt, Human adenovirus C
ccgaagaggugucagacgaaa

SEQ ID NO: 1552254 - RNA, 19 nt, Human adenovirus C
gcacuucuucuucuccuuc

SEQ ID NO: 1552255 - RNA, 17 nt, Human adenovirus C
cgcgcggcgggcggugg

SEQ ID NO: 1552256 - RNA, 15 nt, Human adenovirus C
gcaccaggugcagac

SEQ ID NO: 1552257 - RNA, 14 nt, Human adenovirus C
agaacuauggcagc

SEQ ID NO: 1552258 - RNA, 18 nt, Human adenovirus C
caacuguccuaacccugg

SEQ ID NO: 1552259 - RNA, 23 nt, Human adenovirus C
cugcgcucccucacccgcagcug

SEQ ID NO: 1552260 - RNA, 14 nt, Human adenovirus C
cgaggcagcggcag

SEQ ID NO: 1552261 - RNA, 20 nt, Human adenovirus C
accgcucccuggucugcaau

SEQ ID NO: 1552262 - RNA, 17 nt, Human adenovirus C
ccuccucagcagcggca

SEQ ID NO: 1552263 - RNA, 16 nt, Human adenovirus C
ugcaagcagugcagcu

SEQ ID NO: 1552264 - RNA, 16 nt, Human adenovirus C
auccccccgccgccgc

SEQ ID NO: 1552265 - RNA, 22 nt, Human adenovirus C
ccuacacgguguaagcuucuau

SEQ ID NO: 1552266 - RNA, 20 nt, Human adenovirus C
caacccgaggucgagaagcc

SEQ ID NO: 1552267 - RNA, 13 nt, Human adenovirus C
gcucugcaaccug

SEQ ID NO: 1552268 - RNA, 23 nt, Human adenovirus C
uucgugcgagggagcgaggaggu

SEQ ID NO: 1552269 - RNA, 14 nt, Human adenovirus C
gggagcuccugcag

SEQ ID NO: 1552270 - RNA, 16 nt, Human adenovirus C
caugcgcgagggacag

SEQ ID NO: 1552271 - RNA, 18 nt, Human adenovirus C
gguagcgcguaugccugc

SEQ ID NO: 1552272 - RNA, 17 nt, Human adenovirus C
acgcccuacauguggag

SEQ ID NO: 1552273 - RNA, 19 nt, Human adenovirus C
caacucggccgccugugga

SEQ ID NO: 1552274 - RNA, 23 nt, Human adenovirus C
gacaugcagggcacccuccccuu

SEQ ID NO: 1552275 - RNA, 15 nt, Human adenovirus C
agagcugcagcugcc

SEQ ID NO: 1552276 - RNA, 19 nt, Human adenovirus C
gacgagguggaacugcugc

SEQ ID NO: 1552277 - RNA, 20 nt, Human adenovirus C
uaaacacgcuggacauaaac

SEQ ID NO: 1552278 - RNA, 14 nt, Human adenovirus C
acacguccuccaug

SEQ ID NO: 1552279 - RNA, 17 nt, Human adenovirus C
cuuggguccggccugcu

SEQ ID NO: 1552280 - RNA, 14 nt, Human adenovirus C
acuggccccaaacu

SEQ ID NO: 1552281 - RNA, 18 nt, Human adenovirus C
cgcgagcgguugcugcgc

SEQ ID NO: 1552282 - RNA, 18 nt, Human adenovirus C
ugaggcuacagaggaggc

SEQ ID NO: 1552283 - RNA, 14 nt, Human adenovirus C
cauggcauggggug

SEQ ID NO: 1552284 - RNA, 17 nt, Human adenovirus C
aggcauccgcgccgcag

SEQ ID NO: 1552285 - RNA, 20 nt, Human adenovirus C
cugcgccgugccgccagcgg

SEQ ID NO: 1552286 - RNA, 23 nt, Human adenovirus C
gcuaaugagcuugaucugcuggc

SEQ ID NO: 1552287 - RNA, 19 nt, Human adenovirus C
guuaacaugguucugcaga

SEQ ID NO: 1552288 - RNA, 14 nt, Human adenovirus C
cacccaccgugcag

SEQ ID NO: 1552289 - RNA, 19 nt, Human adenovirus C
gugggugagcgcaaaggug

SEQ ID NO: 1552290 - RNA, 22 nt, Human adenovirus C
caucuugcgcuaugugcagcag

SEQ ID NO: 1552291 - RNA, 21 nt, Human adenovirus C
aaacuccgauacacuaacagu

SEQ ID NO: 1552292 - RNA, 15 nt, Human adenovirus C
gaagaugucuuggaa

SEQ ID NO: 1552293 - RNA, 20 nt, Human adenovirus C
caagucuagcgccugcugcc

SEQ ID NO: 1552294 - RNA, 15 nt, Human adenovirus C
cacaucucgggccag

SEQ ID NO: 1552295 - RNA, 16 nt, Human adenovirus C
cgacccgcgagcuuag

SEQ ID NO: 1552296 - RNA, 23 nt, Human adenovirus C
acuccugcgccguagcgccauug

SEQ ID NO: 1552297 - RNA, 20 nt, Human adenovirus C
gcggagguugcuggcgaacg

SEQ ID NO: 1552298 - RNA, 21 nt, Human adenovirus C
uaggcgcagcaucccuuuucu

SEQ ID NO: 1552299 - RNA, 15 nt, Human adenovirus C
aucuuaugccaggcc

SEQ ID NO: 1552300 - RNA, 13 nt, Human adenovirus C
gcgcgcgcagccu

SEQ ID NO: 1552301 - RNA, 23 nt, Human adenovirus C
ugcgcgacucgguuagcggccug

SEQ ID NO: 1552302 - RNA, 14 nt, Human adenovirus C
gcagcaggaggagg

SEQ ID NO: 1552303 - RNA, 16 nt, Human adenovirus C
ccuguauauuaaugca

SEQ ID NO: 1552304 - RNA, 21 nt, Human adenovirus C
ccccaguccggcgaggagcuc

SEQ ID NO: 1552305 - RNA, 16 nt, Human adenovirus C
guaaaggugacucugg

SEQ ID NO: 1552306 - RNA, 15 nt, Human adenovirus C
accuuuccgccgcca

SEQ ID NO: 1552307 - RNA, 16 nt, Human adenovirus C
ccuggacccucgggaa

SEQ ID NO: 1552308 - RNA, 20 nt, Human adenovirus C
ugcgcccacaccuacagccu

SEQ ID NO: 1552309 - RNA, 13 nt, Human adenovirus C
caggugagcucug

SEQ ID NO: 1552310 - RNA, 22 nt, Human adenovirus C
acgucauaguuguguuccagga

SEQ ID NO: 1552311 - RNA, 19 nt, Human adenovirus C
cuacuugcaucgcgcggcc

SEQ ID NO: 1552312 - RNA, 22 nt, Human adenovirus C
cagcggcagacaugcagggcac

SEQ ID NO: 1552313 - RNA, 16 nt, Human adenovirus C
ugaaacucacuccggg

SEQ ID NO: 1552314 - RNA, 21 nt, Human adenovirus C
gccagcagguuucugcccuga

SEQ ID NO: 1552315 - RNA, 15 nt, Human adenovirus C
caacuucagacuggg

SEQ ID NO: 1552316 - RNA, 13 nt, Human adenovirus C
cgggcaggagcug

SEQ ID NO: 1552317 - RNA, 13 nt, Human adenovirus C
ccaccacaccucg

SEQ ID NO: 1552318 - RNA, 20 nt, Human adenovirus C
ugcaccguaggaggggcaug

SEQ ID NO: 1552319 - RNA, 21 nt, Human adenovirus C
uaacucaggggcgcagcuugc

SEQ ID NO: 1552320 - RNA, 16 nt, Human adenovirus C
caucagccccccucuc

SEQ ID NO: 1552321 - RNA, 21 nt, Human adenovirus C
ggcccgaugaggccggccugg

SEQ ID NO: 1552322 - RNA, 20 nt, Human adenovirus C
cugccaugcgcgggcggcaa

SEQ ID NO: 1552323 - RNA, 19 nt, Human adenovirus C
ggaccugcuugagcaggcc

SEQ ID NO: 1552324 - RNA, 15 nt, Human adenovirus C
ugugcaccagccgca

SEQ ID NO: 1552325 - RNA, 16 nt, Human adenovirus C
augucgcuguccagcu

SEQ ID NO: 1552326 - RNA, 13 nt, Human adenovirus C
cucgccugcgcca

SEQ ID NO: 1552327 - RNA, 19 nt, Human adenovirus C
gcauccgcccugcucccag

SEQ ID NO: 1552328 - RNA, 24 nt, Human adenovirus C
caacagcugccgccaugggcucca

SEQ ID NO: 1552329 - RNA, 16 nt, Human adenovirus C
ucuuggaaaaaaugac

SEQ ID NO: 1552330 - RNA, 16 nt, Human adenovirus C
cuaccugugcuuugcu

SEQ ID NO: 1552331 - RNA, 13 nt, Human adenovirus C
caugagccggugu

SEQ ID NO: 1552332 - RNA, 17 nt, Human adenovirus C
agcuacccacccagcgc

SEQ ID NO: 1552333 - RNA, 17 nt, Human adenovirus C
gggcagccuggaggcaa

SEQ ID NO: 1552334 - RNA, 20 nt, Human adenovirus C
gcaugaagggcacgagcugc

SEQ ID NO: 1552335 - RNA, 16 nt, Human adenovirus C
cgggcacagcagcgca

SEQ ID NO: 1552336 - RNA, 16 nt, Human adenovirus C
guuaacuccuccucca

SEQ ID NO: 1552337 - RNA, 21 nt, Human adenovirus C
cgcaguggucuuacaugcaca

SEQ ID NO: 1552338 - RNA, 23 nt, Human adenovirus C
caacuuugguagcugccuuccca

SEQ ID NO: 1552339 - RNA, 12 nt, Human adenovirus C
ugugcgcgaggc

SEQ ID NO: 1552340 - RNA, 15 nt, Human adenovirus C
aacaguggcaaccac

SEQ ID NO: 1552341 - RNA, 14 nt, Human adenovirus C
uguuuugcugauuu

SEQ ID NO: 1552342 - RNA, 15 nt, Human adenovirus C
cagcaaauacugcgc

SEQ ID NO: 1552343 - RNA, 20 nt, Human adenovirus C
uacccacccaaagcagacca

SEQ ID NO: 1552344 - RNA, 15 nt, Human adenovirus C
gaccccgggcagcag

SEQ ID NO: 1552345 - RNA, 22 nt, Human adenovirus C
ccagcucggcggugaccugcac

SEQ ID NO: 1552346 - RNA, 14 nt, Human adenovirus C
aagacucggcggac

SEQ ID NO: 1552347 - RNA, 18 nt, Human adenovirus C
aggcgccgcacgaggggc

SEQ ID NO: 1552348 - RNA, 15 nt, Human adenovirus C
ccccauggcccacaa

SEQ ID NO: 1552349 - RNA, 19 nt, Human adenovirus C
cagaaaccgggccuccaac

SEQ ID NO: 1552350 - RNA, 20 nt, Human adenovirus C
gcgcccauggcuaccggagu

SEQ ID NO: 1552351 - RNA, 20 nt, Human adenovirus C
gcaacuuucuaaccacgguc

SEQ ID NO: 1552352 - RNA, 13 nt, Human adenovirus C
cuugagaggccug

SEQ ID NO: 1552353 - RNA, 13 nt, Human adenovirus C
cuaacucugcaga

SEQ ID NO: 1552354 - RNA, 16 nt, Human adenovirus C
auggcccucaccugcc

SEQ ID NO: 1552355 - RNA, 17 nt, Human adenovirus C
cacuuaaaaaaacaaag

SEQ ID NO: 1552356 - RNA, 14 nt, Human adenovirus C
ucccaaaagacaua

SEQ ID NO: 1552357 - RNA, 18 nt, Human adenovirus C
uuaccaagcgcccccugc

SEQ ID NO: 1552358 - RNA, 19 nt, Human adenovirus C
caguggagaggcagagcga

SEQ ID NO: 1552359 - RNA, 15 nt, Human adenovirus C
aggauaggguggccu

SEQ ID NO: 1552360 - RNA, 19 nt, Human adenovirus C
cgacccggcacugccgccc

SEQ ID NO: 1552361 - RNA, 21 nt, Human adenovirus C
cuacaugagcgcgggacccca

SEQ ID NO: 1552362 - RNA, 15 nt, Human adenovirus C
uuguuguaacccgcc

SEQ ID NO: 1552363 - RNA, 14 nt, Human adenovirus C
gucucuggccccgc

SEQ ID NO: 1552364 - RNA, 13 nt, Human adenovirus C
aaugcaccacaga

SEQ ID NO: 1552365 - RNA, 16 nt, Human adenovirus C
uuuccauuuuaugaaa

SEQ ID NO: 1552366 - RNA, 23 nt, Human adenovirus C
guagcaagcugauugccaggggc

SEQ ID NO: 1552367 - RNA, 14 nt, Human adenovirus C
cucagaaaugacac

SEQ ID NO: 1552368 - RNA, 19 nt, Human adenovirus C
cggacuaucgcaacaccac

SEQ ID NO: 1552369 - RNA, 23 nt, Human adenovirus C
ccaauccccccgccgccgcagcc

SEQ ID NO: 1552370 - RNA, 22 nt, Human adenovirus C
cagcugaugguacccaagcgcc

SEQ ID NO: 1552371 - RNA, 15 nt, Human adenovirus C
cgcaggcggcggcaa

SEQ ID NO: 1552372 - RNA, 15 nt, Human adenovirus C
cggcagcggcagcaa

SEQ ID NO: 1552373 - RNA, 13 nt, Human adenovirus C
guaggugagcucc

SEQ ID NO: 1552374 - RNA, 15 nt, Human adenovirus C
ggccguggagacagu

SEQ ID NO: 1552375 - RNA, 14 nt, Human adenovirus C
augacuaacucagg

SEQ ID NO: 1552376 - RNA, 17 nt, Human adenovirus C
aaggcucgcguccaggc

SEQ ID NO: 1552377 - RNA, 14 nt, Human adenovirus C
acgcggcagccgcg

SEQ ID NO: 1552378 - RNA, 18 nt, Human adenovirus C
caguggcaaccaccgcuc

SEQ ID NO: 1552379 - RNA, 16 nt, Human adenovirus C
cagcgcgagcaggcag

SEQ ID NO: 1552380 - RNA, 14 nt, Human adenovirus C
ccacgagccaggug

SEQ ID NO: 1552381 - RNA, 20 nt, Human adenovirus C
cacugcuaccuucugcagcu

SEQ ID NO: 1552382 - RNA, 15 nt, Human adenovirus C
gcgucauuacccagg

SEQ ID NO: 1552383 - RNA, 17 nt, Human adenovirus C
gguccugcuggugcuga

SEQ ID NO: 1552384 - RNA, 22 nt, Human adenovirus C
agaaaagcgcggccuaaagcgc

SEQ ID NO: 1552385 - RNA, 10 nt, Human adenovirus C
acaaccccaa

SEQ ID NO: 1552386 - RNA, 15 nt, Human adenovirus C
gcagagcgugagccu

SEQ ID NO: 1552387 - RNA, 22 nt, Human adenovirus C
cuaauguauuauaacagcacug

SEQ ID NO: 1552388 - RNA, 23 nt, Human adenovirus C
cacguacuuugacauccgcggcg

SEQ ID NO: 1552389 - RNA, 15 nt, Human adenovirus C
gccgaggaugaagaa

SEQ ID NO: 1552390 - RNA, 13 nt, Human adenovirus C
caugucgccgcca

SEQ ID NO: 1552391 - RNA, 16 nt, Human adenovirus C
caaagggguucugccg

SEQ ID NO: 1552392 - RNA, 21 nt, Human adenovirus C
ucugacaaagcccaagaaauc

SEQ ID NO: 1552393 - RNA, 18 nt, Human adenovirus C
gcguagcacgucgccacc

SEQ ID NO: 1552394 - RNA, 13 nt, Human adenovirus C
cgaaguaaguuug

SEQ ID NO: 1552395 - RNA, 21 nt, Human adenovirus C
acuacaccuuucgccagggcu

SEQ ID NO: 1552396 - RNA, 15 nt, Human adenovirus C
cccaggcuggggaga

SEQ ID NO: 1552397 - RNA, 19 nt, Human adenovirus C
ugagguggaucccauggac

SEQ ID NO: 1552398 - RNA, 20 nt, Human adenovirus C
cuagcuuuuuuggccacugg

SEQ ID NO: 1552399 - RNA, 17 nt, Human adenovirus C
guggagccugggcugga

SEQ ID NO: 1552400 - RNA, 22 nt, Human adenovirus C
gcgagauugagcuccacgugcc

SEQ ID NO: 1552401 - RNA, 14 nt, Human adenovirus C
ggccgaagaggugu

SEQ ID NO: 1552402 - RNA, 17 nt, Human adenovirus C
cgcaccuacaagcgcgu

SEQ ID NO: 1552403 - RNA, 16 nt, Human adenovirus C
uggugcaggagcgcag

SEQ ID NO: 1552404 - RNA, 13 nt, Human adenovirus C
ugcaucccaccuu

SEQ ID NO: 1552405 - RNA, 22 nt, Human adenovirus C
ggugcaugcccaggcuuugagu

SEQ ID NO: 1552406 - RNA, 15 nt, Human adenovirus C
uuggacaccucccac

SEQ ID NO: 1552407 - RNA, 16 nt, Human adenovirus C
cagggcgaaggugaca

SEQ ID NO: 1552408 - RNA, 19 nt, Human adenovirus C
auaugagaugcaucuugga

SEQ ID NO: 1552409 - RNA, 23 nt, Human adenovirus C
ugccuuugucaaugacugggcga

SEQ ID NO: 1552410 - RNA, 13 nt, Human adenovirus C
cgggcagcaggcg

SEQ ID NO: 1552411 - RNA, 12 nt, Human adenovirus C
ccaggccagcac

SEQ ID NO: 1552412 - RNA, 14 nt, Human adenovirus C
uaccuggaccccca

SEQ ID NO: 1552413 - RNA, 23 nt, Human adenovirus C
ggcgcacggcguccggcucacca

SEQ ID NO: 1552414 - RNA, 20 nt, Human adenovirus C
gagggcaacccaacaccuag

SEQ ID NO: 1552415 - RNA, 16 nt, Human adenovirus C
cagcgcgcuaccaccc

SEQ ID NO: 1552416 - RNA, 18 nt, Human adenovirus C
auccucaucugcagccuc

SEQ ID NO: 1552417 - RNA, 17 nt, Human adenovirus C
uugcugcgcgaggagga

SEQ ID NO: 1552418 - RNA, 20 nt, Human adenovirus C
cuuacuggcugcagccaggg

SEQ ID NO: 1552419 - RNA, 14 nt, Human adenovirus C
ccuucucccacccc

SEQ ID NO: 1552420 - RNA, 13 nt, Human adenovirus C
agccgccugagca

SEQ ID NO: 1552421 - RNA, 16 nt, Human adenovirus C
gucucgcgcggcgguc

SEQ ID NO: 1552422 - RNA, 20 nt, Human adenovirus C
cuugugacgagucuucuucg

SEQ ID NO: 1552423 - RNA, 17 nt, Human adenovirus C
aaaauuuccaacgugga

SEQ ID NO: 1552424 - RNA, 23 nt, Human adenovirus C
cagaaggcgcucgccgcccagcg

SEQ ID NO: 1552425 - RNA, 21 nt, Human adenovirus C
cuacuugcaucgcgcggccgc

SEQ ID NO: 1552426 - RNA, 15 nt, Human adenovirus C
caguggcagcggcgc

SEQ ID NO: 1552427 - RNA, 22 nt, Human adenovirus C
uggggcucgcuguggagcggca

SEQ ID NO: 1552428 - RNA, 16 nt, Human adenovirus C
cgguuaacuccuccuc

SEQ ID NO: 1552429 - RNA, 17 nt, Human adenovirus C
cagcagcaggaggagga

SEQ ID NO: 1552430 - RNA, 22 nt, Human adenovirus C
gcccguguucugacagggccca

SEQ ID NO: 1552431 - RNA, 23 nt, Human adenovirus C
gggccgcucgaaggcuggccgcg

SEQ ID NO: 1552432 - RNA, 13 nt, Human adenovirus C
gagggacaaguug

SEQ ID NO: 1552433 - RNA, 15 nt, Human adenovirus C
ggcagccuggaggca

SEQ ID NO: 1552434 - RNA, 16 nt, Human adenovirus C
gcuucagccgcugcag

SEQ ID NO: 1552435 - RNA, 14 nt, Human adenovirus C
ggcgcgcugcggcu

SEQ ID NO: 1552436 - RNA, 22 nt, Human adenovirus C
gucacccuuauccucaucugca

SEQ ID NO: 1552437 - RNA, 13 nt, Human adenovirus C
uccacagaaacua

SEQ ID NO: 1552438 - RNA, 22 nt, Human adenovirus C
uaaagcaaggccugcccaccac

SEQ ID NO: 1552439 - RNA, 17 nt, Human adenovirus C
gugguggaccuggccaa

SEQ ID NO: 1552440 - RNA, 13 nt, Human adenovirus C
gccgcaggccaac

SEQ ID NO: 1552441 - RNA, 18 nt, Human adenovirus C
cugcaaagggcccuggcu

SEQ ID NO: 1552442 - RNA, 17 nt, Human adenovirus C
uuucauucaguaguaua

SEQ ID NO: 1552443 - RNA, 23 nt, Human adenovirus C
ugacggccugguaggcgcagcau

SEQ ID NO: 1552444 - RNA, 16 nt, Human adenovirus C
acggccuacuggagug

SEQ ID NO: 1552445 - RNA, 15 nt, Human adenovirus C
cuggccgcucuucau

SEQ ID NO: 1552446 - RNA, 18 nt, Human adenovirus C
gaaagcuuccgcaggcca

SEQ ID NO: 1552447 - RNA, 17 nt, Human adenovirus C
ccagcccgugcuggccc

SEQ ID NO: 1552448 - RNA, 16 nt, Human adenovirus C
caugcacgcagcaccu

SEQ ID NO: 1552449 - RNA, 21 nt, Human adenovirus C
ucaggcgccgccggcacugcc

SEQ ID NO: 1552450 - RNA, 23 nt, Human adenovirus C
auacgcagauccuuccuaucaac

SEQ ID NO: 1552451 - RNA, 17 nt, Human adenovirus C
acuuugcgucucuggcc

SEQ ID NO: 1552452 - RNA, 19 nt, Human adenovirus C
acugcccucacguccaagu

SEQ ID NO: 1552453 - RNA, 17 nt, Human adenovirus C
cgucagcggggucuggu

SEQ ID NO: 1552454 - RNA, 15 nt, Human adenovirus C
aauguacuaggagac

SEQ ID NO: 1552455 - RNA, 21 nt, Human adenovirus C
auuuuuucuggggugaugcag

SEQ ID NO: 1552456 - RNA, 22 nt, Human adenovirus C
aagcgcucgaucaucuccccgc

SEQ ID NO: 1552457 - RNA, 23 nt, Human adenovirus C
augcuggaugugaccgaggagcu

SEQ ID NO: 1552458 - RNA, 22 nt, Human adenovirus C
ugccagaggugcuugccaccua

SEQ ID NO: 1552459 - RNA, 16 nt, Human adenovirus C
caggcgcggcggcugc

SEQ ID NO: 1552460 - RNA, 17 nt, Human adenovirus C
guaccuuaccugguacu

SEQ ID NO: 1552461 - RNA, 19 nt, Human adenovirus C
cuacaagcuacccacccag

SEQ ID NO: 1552462 - RNA, 14 nt, Human adenovirus C
ggcagccgcggcaa

SEQ ID NO: 1552463 - RNA, 19 nt, Human adenovirus C
uggcggguuuggcuggugg

SEQ ID NO: 1552464 - RNA, 23 nt, Human adenovirus C
cgggccaugagcugcgagaaggc

SEQ ID NO: 1552465 - RNA, 20 nt, Human adenovirus C
cagugcaacaugaccaagga

SEQ ID NO: 1552466 - RNA, 13 nt, Human adenovirus C
ggaugggugcaua

SEQ ID NO: 1552467 - RNA, 18 nt, Human adenovirus C
ugaugggcuccagcauug

SEQ ID NO: 1552468 - RNA, 15 nt, Human adenovirus C
aauacuaaaaaacug

SEQ ID NO: 1552469 - RNA, 21 nt, Human adenovirus C
caaggccuggaacagcagcac

SEQ ID NO: 1552470 - RNA, 16 nt, Human adenovirus C
gcagguuccugagcag

SEQ ID NO: 1552471 - RNA, 13 nt, Human adenovirus C
ucugcccgccacc

SEQ ID NO: 1552472 - RNA, 18 nt, Human adenovirus C
cacgcuggaagccaugcu

SEQ ID NO: 1552473 - RNA, 18 nt, Human adenovirus C
uacgccaccuucuucccc

SEQ ID NO: 1552474 - RNA, 22 nt, Human adenovirus C
aacauugucagucaaguuuacu

SEQ ID NO: 1552475 - RNA, 16 nt, Human adenovirus C
uucccagcaucgcuac

SEQ ID NO: 1552476 - RNA, 15 nt, Human adenovirus C
cugcauaccaacaug

SEQ ID NO: 1552477 - RNA, 19 nt, Human adenovirus C
caggaggugagcucaacuc

SEQ ID NO: 1552478 - RNA, 20 nt, Human adenovirus C
guauucaaccugccaccucc

SEQ ID NO: 1552479 - RNA, 22 nt, Human adenovirus C
cucaguggaacgaagcugaugc

SEQ ID NO: 1552480 - RNA, 14 nt, Human adenovirus C
cuuggcgcgcagcu

SEQ ID NO: 1552481 - RNA, 14 nt, Human adenovirus C
acggacgaggagga

SEQ ID NO: 1552482 - RNA, 13 nt, Human adenovirus C
accugugcugcca

SEQ ID NO: 1552483 - RNA, 14 nt, Human adenovirus C
caaacauaaguuug

SEQ ID NO: 1552484 - RNA, 12 nt, Human adenovirus C
gcagcugccugu

SEQ ID NO: 1552485 - RNA, 20 nt, Human adenovirus C
cucgcauuccacgagccagg

SEQ ID NO: 1552486 - RNA, 19 nt, Human adenovirus C
cccgcccgcgccugcuggg

SEQ ID NO: 1552487 - RNA, 21 nt, Human adenovirus C
uacaugcacaucucgggccag

SEQ ID NO: 1552488 - RNA, 13 nt, Human adenovirus C
gggagaggggcgc

SEQ ID NO: 1552489 - RNA, 17 nt, Human adenovirus C
uuccagaaagcuacaag

SEQ ID NO: 1552490 - RNA, 14 nt, Human adenovirus C
cgcgcgcggcgguc

SEQ ID NO: 1552491 - RNA, 12 nt, Human adenovirus C
augccgcagugg

SEQ ID NO: 1552492 - RNA, 21 nt, Human adenovirus C
uccguggccuugcaggcgcag

SEQ ID NO: 1552493 - RNA, 19 nt, Human adenovirus C
ugaugggcuccagcauuga

SEQ ID NO: 1552494 - RNA, 17 nt, Human adenovirus C
ccgcggcgauuggcgcc

SEQ ID NO: 1552495 - RNA, 13 nt, Human adenovirus C
gcugcaaacuuuc

SEQ ID NO: 1552496 - RNA, 18 nt, Human adenovirus C
ggggcgcgcuggucucug

SEQ ID NO: 1552497 - RNA, 22 nt, Human adenovirus C
ggaguugcgcgccgacacgguu

SEQ ID NO: 1552498 - RNA, 13 nt, Human adenovirus C
cacaacacggccu

SEQ ID NO: 1552499 - RNA, 15 nt, Human adenovirus C
uaugagcaauucaag

SEQ ID NO: 1552500 - RNA, 20 nt, Human adenovirus C
gcaagccgcucauggcgcag

SEQ ID NO: 1552501 - RNA, 19 nt, Human adenovirus C
gggcauccgcaagcggcaa

SEQ ID NO: 1552502 - RNA, 13 nt, Human adenovirus C
ccauagagcagcu

SEQ ID NO: 1552503 - RNA, 16 nt, Human adenovirus C
ucacaagccccacuga

SEQ ID NO: 1552504 - RNA, 21 nt, Human adenovirus C
cggcgccaguggcggcggcgc

SEQ ID NO: 1552505 - RNA, 21 nt, Human adenovirus C
ggagcuggugcugcgcgcgga

SEQ ID NO: 1552506 - RNA, 22 nt, Human adenovirus C
ugcaaguccgcaccagguacug

SEQ ID NO: 1552507 - RNA, 15 nt, Human adenovirus C
caacuugcgguugcu

SEQ ID NO: 1552508 - RNA, 16 nt, Human adenovirus C
agguuucuguggggcu

SEQ ID NO: 1552509 - RNA, 15 nt, Human adenovirus C
gcauggccggccacg

SEQ ID NO: 1552510 - RNA, 15 nt, Human adenovirus C
guugcauguggaaaa

SEQ ID NO: 1552511 - RNA, 21 nt, Human adenovirus C
gggagaucagcugggaagaaa

SEQ ID NO: 1552512 - RNA, 16 nt, Human adenovirus C
gcccuacuuccgcagc

SEQ ID NO: 1552513 - RNA, 14 nt, Human adenovirus C
uaugcacugcaggg

SEQ ID NO: 1552514 - RNA, 21 nt, Human adenovirus C
acccauuugaugcucaaacaa

SEQ ID NO: 1552515 - RNA, 14 nt, Human adenovirus C
ggugguggaccugg

SEQ ID NO: 1552516 - RNA, 17 nt, Human adenovirus C
ggaggacacgggcagcc

SEQ ID NO: 1552517 - RNA, 17 nt, Human adenovirus C
uacucugaguuggcacc

SEQ ID NO: 1552518 - RNA, 18 nt, Human adenovirus C
auaaaaugcaccacagaa

SEQ ID NO: 1552519 - RNA, 17 nt, Human adenovirus C
acgaggaggcacuaaag

SEQ ID NO: 1552520 - RNA, 20 nt, Human adenovirus C
ggccgccgugaaccccgagu

SEQ ID NO: 1552521 - RNA, 24 nt, Human adenovirus C
gacggccugguaggcgcagcaucc

SEQ ID NO: 1552522 - RNA, 17 nt, Human adenovirus C
ggcuggcacgggcagcg

SEQ ID NO: 1552523 - RNA, 16 nt, Human adenovirus C
cugagcaggggggcca

SEQ ID NO: 1552524 - RNA, 12 nt, Human adenovirus C
cggaaagcggca

SEQ ID NO: 1552525 - RNA, 14 nt, Human adenovirus C
acgcgcccuggagg

SEQ ID NO: 1552526 - RNA, 14 nt, Human adenovirus C
ccgcccugcuccca

SEQ ID NO: 1552527 - RNA, 19 nt, Human adenovirus C
agcgaccgcgagcugaugc

SEQ ID NO: 1552528 - RNA, 15 nt, Human adenovirus C
ucccacacugcaggg

SEQ ID NO: 1552529 - RNA, 18 nt, Human adenovirus C
agcccuacuccggcacug

SEQ ID NO: 1552530 - RNA, 14 nt, Human adenovirus C
cccggagguagggg

SEQ ID NO: 1552531 - RNA, 15 nt, Human adenovirus C
acuggcagcggugca

SEQ ID NO: 1552532 - RNA, 17 nt, Human adenovirus C
ugcagguuuaccucgca

SEQ ID NO: 1552533 - RNA, 19 nt, Human adenovirus C
cgcgccuguugcugcugcu

SEQ ID NO: 1552534 - RNA, 20 nt, Human adenovirus C
ggcgaccggauagcaagacu

SEQ ID NO: 1552535 - RNA, 15 nt, Human adenovirus C
ucuggggugaugcag

SEQ ID NO: 1552536 - RNA, 16 nt, Human adenovirus C
ccacucgcccuacuuc

SEQ ID NO: 1552537 - RNA, 16 nt, Human adenovirus C
agacacuuaagcucgc

SEQ ID NO: 1552538 - RNA, 16 nt, Human adenovirus C
cucugcucggaagacu

SEQ ID NO: 1552539 - RNA, 17 nt, Human adenovirus C
cucugauuaaacauggc

SEQ ID NO: 1552540 - RNA, 22 nt, Human adenovirus C
acacugcagcaggugcugccca

SEQ ID NO: 1552541 - RNA, 18 nt, Human adenovirus C
acacuaacaguaguuacu

SEQ ID NO: 1552542 - RNA, 20 nt, Human adenovirus C
uccuuuaaugacuaccuuuc

SEQ ID NO: 1552543 - RNA, 14 nt, Human adenovirus C
gaaagugggcaggc

SEQ ID NO: 1552544 - RNA, 20 nt, Human adenovirus C
gugcacgaccccuggagagg

SEQ ID NO: 1552545 - RNA, 20 nt, Human adenovirus C
gauucaucaaacaacaugga

SEQ ID NO: 1552546 - RNA, 19 nt, Human adenovirus C
ccugagcaggggggccacu

SEQ ID NO: 1552547 - RNA, 20 nt, Human adenovirus C
cuacacgcccacgccgccac

SEQ ID NO: 1552548 - RNA, 17 nt, Human adenovirus C
cuauaaaugcaggaaag

SEQ ID NO: 1552549 - RNA, 19 nt, Human adenovirus C
ccgccuuuuagcugcaaac

SEQ ID NO: 1552550 - RNA, 17 nt, Human adenovirus C
gccugcaaagggcccug

SEQ ID NO: 1552551 - RNA, 21 nt, Human adenovirus C
ucuucucaaauacuaccucuu

SEQ ID NO: 1552552 - RNA, 20 nt, Human adenovirus C
agcaugauaaauauguggcc

SEQ ID NO: 1552553 - RNA, 23 nt, Human adenovirus C
uugaguuuaaggaaccagcuugc

SEQ ID NO: 1552554 - RNA, 22 nt, Human adenovirus C
uggacuguauuuuuagguuggc

SEQ ID NO: 1552555 - RNA, 12 nt, Human adenovirus C
cuacaccagugu

SEQ ID NO: 1552556 - RNA, 21 nt, Human adenovirus C
ggaauuugaagagcuuuugaa

SEQ ID NO: 1552557 - RNA, 21 nt, Human adenovirus C
agggcccggcgcacggcgucc

SEQ ID NO: 1552558 - RNA, 22 nt, Human adenovirus C
ucggaagacuaucugccugaag

SEQ ID NO: 1552559 - RNA, 12 nt, Human adenovirus C
accugagccuuu

SEQ ID NO: 1552560 - RNA, 23 nt, Human adenovirus C
auuagcggggugguggaccuggc

SEQ ID NO: 1552561 - RNA, 22 nt, Human adenovirus C
cgcgcccuggaggcagcugggg

SEQ ID NO: 1552562 - RNA, 14 nt, Human adenovirus C
cugacagggcccag

SEQ ID NO: 1552563 - RNA, 16 nt, Human adenovirus C
gcagcggugcagccac

SEQ ID NO: 1552564 - RNA, 21 nt, Human adenovirus C
uccagaggaccucugcacucu

SEQ ID NO: 1552565 - RNA, 15 nt, Human adenovirus C
aggcaaugcuacuaa

SEQ ID NO: 1552566 - RNA, 14 nt, Human adenovirus C
accaguccgggcca

SEQ ID NO: 1552567 - RNA, 16 nt, Human adenovirus C
cgggccaugagcugcg

SEQ ID NO: 1552568 - RNA, 19 nt, Human adenovirus C
gcacucacagaccugggcc

SEQ ID NO: 1552569 - RNA, 16 nt, Human adenovirus C
cuagacgaagcuuccg

SEQ ID NO: 1552570 - RNA, 19 nt, Human adenovirus C
ggccgaacacucgugcugg

SEQ ID NO: 1552571 - RNA, 14 nt, Human adenovirus C
acuugcggcuggag

SEQ ID NO: 1552572 - RNA, 14 nt, Human adenovirus C
aggccaagcagcuu

SEQ ID NO: 1552573 - RNA, 22 nt, Human adenovirus C
cauagaugccaugaaccacccu

SEQ ID NO: 1552574 - RNA, 15 nt, Human adenovirus C
gccaucaucucuguc

SEQ ID NO: 1552575 - RNA, 22 nt, Human adenovirus C
cugcagaccguaaaccugagcc

SEQ ID NO: 1552576 - RNA, 14 nt, Human adenovirus C
ccgcgcgcgggcag

SEQ ID NO: 1552577 - RNA, 14 nt, Human adenovirus C
ugccuuugagggug

SEQ ID NO: 1552578 - RNA, 13 nt, Human adenovirus C
accuucuccuaca

SEQ ID NO: 1552579 - RNA, 13 nt, Human adenovirus C
auggcgcagcugu

SEQ ID NO: 1552580 - RNA, 18 nt, Human adenovirus C
cuaaugcggcaggaggga

SEQ ID NO: 1552581 - RNA, 17 nt, Human adenovirus C
caugaagaucuggaagg

SEQ ID NO: 1552582 - RNA, 20 nt, Human adenovirus C
cgcgcacgucgcaccggccg

SEQ ID NO: 1552583 - RNA, 18 nt, Human adenovirus C
uggaggaguggcuguuga

SEQ ID NO: 1552584 - RNA, 15 nt, Human adenovirus C
cgguuuuccuggcca

SEQ ID NO: 1552585 - RNA, 20 nt, Human adenovirus C
uccaagaugagguacaugau

SEQ ID NO: 1552586 - RNA, 13 nt, Human adenovirus C
caggcagaggcgg

SEQ ID NO: 1552587 - RNA, 20 nt, Human adenovirus C
cgcucgucgggcaccaggug

SEQ ID NO: 1552588 - RNA, 18 nt, Human adenovirus C
ccgugcacgaccccugga

SEQ ID NO: 1552589 - RNA, 22 nt, Human adenovirus C
gggcccacgggcggcggccugg

SEQ ID NO: 1552590 - RNA, 19 nt, Human adenovirus C
caccacugaaacuuuugcu

SEQ ID NO: 1552591 - RNA, 18 nt, Human adenovirus C
accuggccaaccaggcag

SEQ ID NO: 1552592 - RNA, 15 nt, Human adenovirus C
cagaugggagcuguc

SEQ ID NO: 1552593 - RNA, 22 nt, Human adenovirus C
caaaauuggcaaguaugcugua

SEQ ID NO: 1552594 - RNA, 17 nt, Human adenovirus C
cacccgcaacuucagac

SEQ ID NO: 1552595 - RNA, 19 nt, Human adenovirus C
cccguguucugacagggcc

SEQ ID NO: 1552596 - RNA, 13 nt, Human adenovirus C
agcagugcagcuu

SEQ ID NO: 1552597 - RNA, 14 nt, Human adenovirus C
cuugccugcuccag

SEQ ID NO: 1552598 - RNA, 19 nt, Human adenovirus C
gggcaggggcuaaaggggg

SEQ ID NO: 1552599 - RNA, 21 nt, Human adenovirus C
gcuaggucucgcgcggcgguc

SEQ ID NO: 1552600 - RNA, 13 nt, Human adenovirus C
gcugccuucccaa

SEQ ID NO: 1552601 - RNA, 13 nt, Human adenovirus C
caccggcggcagc

SEQ ID NO: 1552602 - RNA, 22 nt, Human adenovirus C
ggguguucuugcuggucaggca

SEQ ID NO: 1552603 - RNA, 20 nt, Human adenovirus C
acagcggcaacgugcagacc

SEQ ID NO: 1552604 - RNA, 11 nt, Human adenovirus C
cucagcagcug

SEQ ID NO: 1552605 - RNA, 15 nt, Human adenovirus C
ggcgcgggcacaaga

SEQ ID NO: 1552606 - RNA, 13 nt, Human adenovirus C
ucaccacccaggu

SEQ ID NO: 1552607 - RNA, 15 nt, Human adenovirus C
gccgcauccccgcgg

SEQ ID NO: 1552608 - RNA, 13 nt, Human adenovirus C
ggugugggugagc

SEQ ID NO: 1552609 - RNA, 15 nt, Human adenovirus C
auagccgggucaggg

SEQ ID NO: 1552610 - RNA, 15 nt, Human adenovirus C
guccagcuuauucag

SEQ ID NO: 1552611 - RNA, 17 nt, Human adenovirus C
cuuagaguugacggggc

SEQ ID NO: 1552612 - RNA, 13 nt, Human adenovirus C
ugauaaauaugug

SEQ ID NO: 1552613 - RNA, 15 nt, Human adenovirus C
cuauuaaaaaacacc

SEQ ID NO: 1552614 - RNA, 16 nt, Human adenovirus C
ccgagggccgcuggcu

SEQ ID NO: 1552615 - RNA, 14 nt, Human adenovirus C
cgcgcaccuggcgg

SEQ ID NO: 1552616 - RNA, 21 nt, Human adenovirus C
cgcggcaaacgcucugcaaca

SEQ ID NO: 1552617 - RNA, 18 nt, Human adenovirus C
gcggaugucagccuugcc

SEQ ID NO: 1552618 - RNA, 17 nt, Human adenovirus C
aguccacaaaaaacacc

SEQ ID NO: 1552619 - RNA, 18 nt, Human adenovirus C
ccaagccgacgcgcccug

SEQ ID NO: 1552620 - RNA, 13 nt, Human adenovirus C
aggggccaagaac

SEQ ID NO: 1552621 - RNA, 19 nt, Human adenovirus C
cgcuugcaaauuccuccgg

SEQ ID NO: 1552622 - RNA, 14 nt, Human adenovirus C
uugagccccucgcc

SEQ ID NO: 1552623 - RNA, 11 nt, Human adenovirus C
gcgccucccaa

SEQ ID NO: 1552624 - RNA, 22 nt, Human adenovirus C
gcuccacuuaaacucaggcaca

SEQ ID NO: 1552625 - RNA, 15 nt, Human adenovirus C
cgcaccugccccuac

SEQ ID NO: 1552626 - RNA, 17 nt, Human adenovirus C
guaccugaggacuacca

SEQ ID NO: 1552627 - RNA, 20 nt, Human adenovirus C
ccaggcggcggcggcggcag

SEQ ID NO: 1552628 - RNA, 17 nt, Human adenovirus C
aacuaaaauuggcucug

SEQ ID NO: 1552629 - RNA, 14 nt, Human adenovirus C
cagcaucaccuccu

SEQ ID NO: 1552630 - RNA, 14 nt, Human adenovirus C
cgcggcggcggccc

SEQ ID NO: 1552631 - RNA, 16 nt, Human adenovirus C
aaggcuaauggcaaug

SEQ ID NO: 1552632 - RNA, 19 nt, Human adenovirus C
ggcgugcuggacagggggc

SEQ ID NO: 1552633 - RNA, 19 nt, Human adenovirus C
cacuaguauugccacugcc

SEQ ID NO: 1552634 - RNA, 17 nt, Human adenovirus C
uuccuaucaaccagaac

SEQ ID NO: 1552635 - RNA, 19 nt, Human adenovirus C
accagcaauaugagcggug

SEQ ID NO: 1552636 - RNA, 23 nt, Human adenovirus C
cuggggcgcgcacaaacgcggcc

SEQ ID NO: 1552637 - RNA, 23 nt, Human adenovirus C
ccagcauugauggucgccccguc

SEQ ID NO: 1552638 - RNA, 20 nt, Human adenovirus C
gguucgagucucgggccggc

SEQ ID NO: 1552639 - RNA, 17 nt, Human adenovirus C
cagcgcgagcaggcaga

SEQ ID NO: 1552640 - RNA, 21 nt, Human adenovirus C
aacagcgcgcuaccaccccag

SEQ ID NO: 1552641 - RNA, 17 nt, Human adenovirus C
ggaagacuaucugccug

SEQ ID NO: 1552642 - RNA, 20 nt, Human adenovirus C
agccgcucauggcgcagcug

SEQ ID NO: 1552643 - RNA, 14 nt, Human adenovirus C
gauguuguggccca

SEQ ID NO: 1552644 - RNA, 13 nt, Human adenovirus C
ggcggcggcgcug

SEQ ID NO: 1552645 - RNA, 13 nt, Human adenovirus C
gaacaggcggcua

SEQ ID NO: 1552646 - RNA, 14 nt, Human adenovirus C
aagacauauuuccu

SEQ ID NO: 1552647 - RNA, 15 nt, Human adenovirus C
ccuugcuucccagga

SEQ ID NO: 1552648 - RNA, 16 nt, Human adenovirus C
ccgaggaagaaugcac

SEQ ID NO: 1552649 - RNA, 16 nt, Human adenovirus C
accccaacaccuacga

SEQ ID NO: 1552650 - RNA, 16 nt, Human adenovirus C
cuugaacccgcacugg

SEQ ID NO: 1552651 - RNA, 20 nt, Human adenovirus C
aaagguggcacuuaggccag

SEQ ID NO: 1552652 - RNA, 20 nt, Human adenovirus C
accugcuuuacggauuuguc

SEQ ID NO: 1552653 - RNA, 16 nt, Human adenovirus C
caacuggcaaagcaca

SEQ ID NO: 1552654 - RNA, 14 nt, Human adenovirus C
gccauugcuucuuc

SEQ ID NO: 1552655 - RNA, 21 nt, Human adenovirus C
gcaccguggcgggcggcagcg

SEQ ID NO: 1552656 - RNA, 21 nt, Human adenovirus C
gaaauuagaaucuacuggggc

SEQ ID NO: 1552657 - RNA, 18 nt, Human adenovirus C
cuugcuggaacagagcuc

SEQ ID NO: 1552658 - RNA, 15 nt, Human adenovirus C
gcgcugcggcugcug

SEQ ID NO: 1552659 - RNA, 19 nt, Human adenovirus C
agcggcaacgugcagacca

SEQ ID NO: 1552660 - RNA, 18 nt, Human adenovirus C
cggugguggaggaggcgc

SEQ ID NO: 1552661 - RNA, 16 nt, Human adenovirus C
ccaucauaccacaagc

SEQ ID NO: 1552662 - RNA, 21 nt, Human adenovirus C
cuacuuccgcagccacagugc

SEQ ID NO: 1552663 - RNA, 23 nt, Human adenovirus C
cuuccaggcgcggcggcugcugc

SEQ ID NO: 1552664 - RNA, 16 nt, Human adenovirus C
aguagcacaaaacucc

SEQ ID NO: 1552665 - RNA, 14 nt, Human adenovirus C
gugcgcggagcccg

SEQ ID NO: 1552666 - RNA, 21 nt, Human adenovirus C
cugcgguucaucccuguggac

SEQ ID NO: 1552667 - RNA, 12 nt, Human adenovirus C
agcaggacccag

SEQ ID NO: 1552668 - RNA, 19 nt, Human adenovirus C
ggcgaaucucaguggaacg

SEQ ID NO: 1552669 - RNA, 22 nt, Human adenovirus C
ggugcgggcggcgcugcagagc

SEQ ID NO: 1552670 - RNA, 13 nt, Human adenovirus C
guugcgcuuuucu

SEQ ID NO: 1552671 - RNA, 13 nt, Human adenovirus C
gcaagaccaggac

SEQ ID NO: 1552672 - RNA, 19 nt, Human adenovirus C
gcaagccaucaacaaagcc

SEQ ID NO: 1552673 - RNA, 23 nt, Human adenovirus C
cuccaccggccguggagacagug

SEQ ID NO: 1552674 - RNA, 17 nt, Human adenovirus C
cuaccggagugcugggc

SEQ ID NO: 1552675 - RNA, 17 nt, Human adenovirus C
gcucccuggucugcaau

SEQ ID NO: 1552676 - RNA, 15 nt, Human adenovirus C
cugguuuccaugagc

SEQ ID NO: 1552677 - RNA, 17 nt, Human adenovirus C
caccgucacccagcacu

SEQ ID NO: 1552678 - RNA, 15 nt, Human adenovirus C
cagccacuuaaaaaa

SEQ ID NO: 1552679 - RNA, 17 nt, Human adenovirus C
ccgaggucgagaagccu

SEQ ID NO: 1552680 - RNA, 17 nt, Human adenovirus C
gugccccccagguccag

SEQ ID NO: 1552681 - RNA, 20 nt, Human adenovirus C
cgcggcggucaccagaggcu

SEQ ID NO: 1552682 - RNA, 23 nt, Human adenovirus C
ccgagguugcuacgggcgggcug

SEQ ID NO: 1552683 - RNA, 21 nt, Human adenovirus C
gcaacgugcagaccaaccugg

SEQ ID NO: 1552684 - RNA, 16 nt, Human adenovirus C
ccuucugcagcuagcc

SEQ ID NO: 1552685 - RNA, 22 nt, Human adenovirus C
agcugaaauaugagugggugga

SEQ ID NO: 1552686 - RNA, 14 nt, Human adenovirus C
gcaccaggugcacg

SEQ ID NO: 1552687 - RNA, 16 nt, Human adenovirus C
caaauacaaaagcaga

SEQ ID NO: 1552688 - RNA, 23 nt, Human adenovirus C
cguagccugauucgggaguuuac

SEQ ID NO: 1552689 - RNA, 14 nt, Human adenovirus C
caggacccuggugc

SEQ ID NO: 1552690 - RNA, 22 nt, Human adenovirus C
agagcguggugagcgcggcgcc

SEQ ID NO: 1552691 - RNA, 20 nt, Human adenovirus C
ugacgcguuccggcagcagc

SEQ ID NO: 1552692 - RNA, 16 nt, Human adenovirus C
gucugcgagggccagc

SEQ ID NO: 1552693 - RNA, 22 nt, Human adenovirus C
acuuuccuggacguuagcgccu

SEQ ID NO: 1552694 - RNA, 12 nt, Human adenovirus C
ucucagcagcug

SEQ ID NO: 1552695 - RNA, 17 nt, Human adenovirus C
ucccugggaucaggcua

SEQ ID NO: 1552696 - RNA, 18 nt, Human adenovirus C
gcgcugcgaaaggaaagc

SEQ ID NO: 1552697 - RNA, 18 nt, Human adenovirus C
cagguacgccugcaggaa

SEQ ID NO: 1552698 - RNA, 13 nt, Human adenovirus C
cagccgccgcacc

SEQ ID NO: 1552699 - RNA, 18 nt, Human adenovirus C
ugcccggaauugcauccg

SEQ ID NO: 1552700 - RNA, 13 nt, Human adenovirus C
gacgccgccucag

SEQ ID NO: 1552701 - RNA, 17 nt, Human adenovirus C
gauacacuaacaguagu

SEQ ID NO: 1552702 - RNA, 22 nt, Human adenovirus C
uggcgaugagcagcuggcgcgc

SEQ ID NO: 1552703 - RNA, 19 nt, Human adenovirus C
gccaaccaggcagugcaaa

SEQ ID NO: 1552704 - RNA, 18 nt, Human adenovirus C
agcuccucaggggagcug

SEQ ID NO: 1552705 - RNA, 15 nt, Human adenovirus C
guacuucccagagac

SEQ ID NO: 1552706 - RNA, 19 nt, Human adenovirus C
agggccuccccuucuucuu

SEQ ID NO: 1552707 - RNA, 14 nt, Human adenovirus C
cagcuucagcuugc

SEQ ID NO: 1552708 - RNA, 16 nt, Human adenovirus C
gaaacuuccagcccau

SEQ ID NO: 1552709 - RNA, 14 nt, Human adenovirus C
aggacagggccucu

SEQ ID NO: 1552710 - RNA, 20 nt, Human adenovirus C
acccgcccgcgccugcuggg

SEQ ID NO: 1552711 - RNA, 17 nt, Human adenovirus C
gagccccuuuuuugcuu

SEQ ID NO: 1552712 - RNA, 18 nt, Human adenovirus C
ugcgggcgugacaaacag

SEQ ID NO: 1552713 - RNA, 14 nt, Human adenovirus C
acuacaugaacaag

SEQ ID NO: 1552714 - RNA, 13 nt, Human adenovirus C
ugcacgcagcacc

SEQ ID NO: 1552715 - RNA, 17 nt, Human adenovirus C
agccccccucucuggca

SEQ ID NO: 1552716 - RNA, 21 nt, Human adenovirus C
cauccauuucaaucacgugcu

SEQ ID NO: 1552717 - RNA, 15 nt, Human adenovirus C
ggcauggagacacaa

SEQ ID NO: 1552718 - RNA, 22 nt, Human adenovirus C
auugaaaaccauggaacugagg

SEQ ID NO: 1552719 - RNA, 14 nt, Human adenovirus C
gagcugcagcugcc

SEQ ID NO: 1552720 - RNA, 18 nt, Human adenovirus C
agacgacgugcuguugaa

SEQ ID NO: 1552721 - RNA, 15 nt, Human adenovirus C
uuaagggugggaaag

SEQ ID NO: 1552722 - RNA, 20 nt, Human adenovirus C
agccaaaaaacccacaacuu

SEQ ID NO: 1552723 - RNA, 11 nt, Human adenovirus C
ucagcugcaac

SEQ ID NO: 1552724 - RNA, 17 nt, Human adenovirus C
uauacccacaaccuuca

SEQ ID NO: 1552725 - RNA, 19 nt, Human adenovirus C
gauguggcaucccugaacu

SEQ ID NO: 1552726 - RNA, 13 nt, Human adenovirus C
ccuggccucuggc

SEQ ID NO: 1552727 - RNA, 22 nt, Human adenovirus C
uucaacuacaccgucaagaaaa

SEQ ID NO: 1552728 - RNA, 14 nt, Human adenovirus C
cauggugauaaaac

SEQ ID NO: 1552729 - RNA, 15 nt, Human adenovirus C
ccaccgugcagcuga

SEQ ID NO: 1552730 - RNA, 13 nt, Human adenovirus C
uucaccuggcccg

SEQ ID NO: 1552731 - RNA, 20 nt, Human adenovirus C
acccgcaccaggugcagacc

SEQ ID NO: 1552732 - RNA, 18 nt, Human adenovirus C
ucacuuggugcuggccug

SEQ ID NO: 1552733 - RNA, 17 nt, Human adenovirus C
cuaucauugugcucaac

SEQ ID NO: 1552734 - RNA, 19 nt, Human adenovirus C
ccagcaauaugagcggugg

SEQ ID NO: 1552735 - RNA, 14 nt, Human adenovirus C
accauuaagaacua

SEQ ID NO: 1552736 - RNA, 18 nt, Human adenovirus C
cuggaaaaguccacccaa

SEQ ID NO: 1552737 - RNA, 17 nt, Human adenovirus C
aggcaucgcagcuaaau

SEQ ID NO: 1552738 - RNA, 12 nt, Human adenovirus C
cauuaacaugga

SEQ ID NO: 1552739 - RNA, 21 nt, Human adenovirus C
acuacuugaaagugggcaggc

SEQ ID NO: 1552740 - RNA, 22 nt, Human adenovirus C
ccaauugcaagccaucaacaaa

SEQ ID NO: 1552741 - RNA, 17 nt, Human adenovirus C
guagaugauccagucgu

SEQ ID NO: 1552742 - RNA, 18 nt, Human adenovirus C
ugucauacuuauccuguc

SEQ ID NO: 1552743 - RNA, 17 nt, Human adenovirus C
caccuuucgccagggcu

SEQ ID NO: 1552744 - RNA, 19 nt, Human adenovirus C
ccccaaaaguuuuuugcca

SEQ ID NO: 1552745 - RNA, 14 nt, Human adenovirus C
cagauauggcccuc

SEQ ID NO: 1552746 - RNA, 13 nt, Human adenovirus C
aaaccgggccucc

SEQ ID NO: 1552747 - RNA, 18 nt, Human adenovirus C
gaugacgccauugacgcg

SEQ ID NO: 1552748 - RNA, 12 nt, Human adenovirus C
gucgccagcccg

SEQ ID NO: 1552749 - RNA, 13 nt, Human adenovirus C
cggcggcagaaga

SEQ ID NO: 1552750 - RNA, 21 nt, Human adenovirus C
acaugcuaccucuuugagccc

SEQ ID NO: 1552751 - RNA, 15 nt, Human adenovirus C
uacauugcccaggaa

SEQ ID NO: 1552752 - RNA, 16 nt, Human adenovirus C
acccaccgugcagcug

SEQ ID NO: 1552753 - RNA, 16 nt, Human adenovirus C
acagucaggcagagga

SEQ ID NO: 1552754 - RNA, 19 nt, Human adenovirus C
gaagauuuuucugcugugc

SEQ ID NO: 1552755 - RNA, 20 nt, Human adenovirus C
agcgccugcaugaaagccuu

SEQ ID NO: 1552756 - RNA, 21 nt, Human adenovirus C
acuucuucuucuccuuccucu

SEQ ID NO: 1552757 - RNA, 22 nt, Human adenovirus C
gugcacgaccccuggagaggga

SEQ ID NO: 1552758 - RNA, 16 nt, Human adenovirus C
aggaugaagaagagga

SEQ ID NO: 1552759 - RNA, 20 nt, Human adenovirus C
accucaggcgcccuaacagu

SEQ ID NO: 1552760 - RNA, 18 nt, Human adenovirus C
auggccuggccucuggca

SEQ ID NO: 1552761 - RNA, 12 nt, Human adenovirus C
ccuggcgcggcu

SEQ ID NO: 1552762 - RNA, 15 nt, Human adenovirus C
gagauugagcuccac

SEQ ID NO: 1552763 - RNA, 17 nt, Human adenovirus C
ggccuccccuucuucuu

SEQ ID NO: 1552764 - RNA, 16 nt, Human adenovirus C
cuuuccaagauggcua

SEQ ID NO: 1552765 - RNA, 20 nt, Human adenovirus C
gccuccgcgguaccugcggc

SEQ ID NO: 1552766 - RNA, 15 nt, Human adenovirus C
agcaugauaaauaug

SEQ ID NO: 1552767 - RNA, 22 nt, Human adenovirus C
uccgggcugcgcgcuggccagg

SEQ ID NO: 1552768 - RNA, 13 nt, Human adenovirus C
gcagcacaggcca

SEQ ID NO: 1552769 - RNA, 13 nt, Human adenovirus C
ccuccucccuccu

SEQ ID NO: 1552770 - RNA, 22 nt, Human adenovirus C
cugugguugcuucaugcuagug

SEQ ID NO: 1552771 - RNA, 16 nt, Human adenovirus C
cccaggauggcaccca

SEQ ID NO: 1552772 - RNA, 15 nt, Human adenovirus C
cacuuggugcuggcc

SEQ ID NO: 1552773 - RNA, 20 nt, Human adenovirus C
cggcuauuaccaccacaccu

SEQ ID NO: 1552774 - RNA, 15 nt, Human adenovirus C
ggcccgcggugaugc

SEQ ID NO: 1552775 - RNA, 13 nt, Human adenovirus C
cgcguccaggcca

SEQ ID NO: 1552776 - RNA, 14 nt, Human adenovirus C
gguguaagcuucua

SEQ ID NO: 1552777 - RNA, 13 nt, Human adenovirus C
ggcgcgcccgcca

SEQ ID NO: 1552778 - RNA, 17 nt, Human adenovirus C
augcgagccgaucggga

SEQ ID NO: 1552779 - RNA, 20 nt, Human adenovirus C
ugagcgugagccggcggcgc

SEQ ID NO: 1552780 - RNA, 14 nt, Human adenovirus C
caagaaaaacacca

SEQ ID NO: 1552781 - RNA, 23 nt, Human adenovirus C
cuaauggagaacuccucacuuaa

SEQ ID NO: 1552782 - RNA, 14 nt, Human adenovirus C
cgcguccaggccag

SEQ ID NO: 1552783 - RNA, 16 nt, Human adenovirus C
cgagauugagcuccac

SEQ ID NO: 1552784 - RNA, 18 nt, Human adenovirus C
uugcugcgcccacaccua

SEQ ID NO: 1552785 - RNA, 21 nt, Human adenovirus C
uggcgaaaagcguccgcggcc

SEQ ID NO: 1552786 - RNA, 13 nt, Human adenovirus C
caaaggugucccu

SEQ ID NO: 1552787 - RNA, 18 nt, Human adenovirus C
gucccagcguuugacgcu

SEQ ID NO: 1552788 - RNA, 16 nt, Human adenovirus C
aggcuacagaggaggc

SEQ ID NO: 1552789 - RNA, 21 nt, Human adenovirus C
uuccuccggaaacagggacga

SEQ ID NO: 1552790 - RNA, 20 nt, Human adenovirus C
aauuaaguauaugagcaauu

SEQ ID NO: 1552791 - RNA, 22 nt, Human adenovirus C
gcaaccuaaaggagcugcagaa

SEQ ID NO: 1552792 - RNA, 17 nt, Human adenovirus C
guuccugagcagcugcg

SEQ ID NO: 1552793 - RNA, 16 nt, Human adenovirus C
ugccuuuuacugcugc

SEQ ID NO: 1552794 - RNA, 21 nt, Human adenovirus C
aucagcuucggcgcacgcugg

SEQ ID NO: 1552795 - RNA, 11 nt, Human adenovirus C
gagaggccugu

SEQ ID NO: 1552796 - RNA, 16 nt, Human adenovirus C
aacaaagucaaacaua

SEQ ID NO: 1552797 - RNA, 16 nt, Human adenovirus C
cuacaacguagcucag

SEQ ID NO: 1552798 - RNA, 14 nt, Human adenovirus C
caccgcccgcagca

SEQ ID NO: 1552799 - RNA, 14 nt, Human adenovirus C
caaacagaucugcg

SEQ ID NO: 1552800 - RNA, 13 nt, Human adenovirus C
gucgccaccgccg

SEQ ID NO: 1552801 - RNA, 19 nt, Human adenovirus C
cugcgcgagauugagcucc

SEQ ID NO: 1552802 - RNA, 14 nt, Human adenovirus C
gaaucuggcgccuc

SEQ ID NO: 1552803 - RNA, 15 nt, Human adenovirus C
gacguacuucagccu

SEQ ID NO: 1552804 - RNA, 14 nt, Human adenovirus C
cuggugcugccaac

SEQ ID NO: 1552805 - RNA, 20 nt, Human adenovirus C
cuccacgcuggaagccaugc

SEQ ID NO: 1552806 - RNA, 15 nt, Human adenovirus C
gcggcugcuguugcu

SEQ ID NO: 1552807 - RNA, 20 nt, Human adenovirus C
aagagguaguugaggguggu

SEQ ID NO: 1552808 - RNA, 18 nt, Human adenovirus C
uggagaugcgggccauga

SEQ ID NO: 1552809 - RNA, 20 nt, Human adenovirus C
gguagcaccacugcagagcu

SEQ ID NO: 1552810 - RNA, 15 nt, Human adenovirus C
gagggcgagggccug

SEQ ID NO: 1552811 - RNA, 15 nt, Human adenovirus C
cgcggcguaagcggu

SEQ ID NO: 1552812 - RNA, 18 nt, Human adenovirus C
ugcaacaagaaaacagcg

SEQ ID NO: 1552813 - RNA, 17 nt, Human adenovirus C
cccuguggaccgcgagg

SEQ ID NO: 1552814 - RNA, 14 nt, Human adenovirus C
guugccgcuggacg

SEQ ID NO: 1552815 - RNA, 13 nt, Human adenovirus C
cagucaggcagag

SEQ ID NO: 1552816 - RNA, 21 nt, Human adenovirus C
ugacugacuuugcuuuccuga

SEQ ID NO: 1552817 - RNA, 18 nt, Human adenovirus C
guugucaagcuugguggc

SEQ ID NO: 1552818 - RNA, 16 nt, Human adenovirus C
gcgcaaaaucaaagaa

SEQ ID NO: 1552819 - RNA, 19 nt, Human adenovirus C
cggaagacuaucugccuga

SEQ ID NO: 1552820 - RNA, 13 nt, Human adenovirus C
aacagguggagcu

SEQ ID NO: 1552821 - RNA, 19 nt, Human adenovirus C
acacccggcgccagcaccu

SEQ ID NO: 1552822 - RNA, 20 nt, Human adenovirus C
cgcgggcacuaccgcgcgcc

SEQ ID NO: 1552823 - RNA, 18 nt, Human adenovirus C
caaagggcccuggcuggc

SEQ ID NO: 1552824 - RNA, 13 nt, Human adenovirus C
ggcgcgcggaaag

SEQ ID NO: 1552825 - RNA, 17 nt, Human adenovirus C
acucggcagacgacagc

SEQ ID NO: 1552826 - RNA, 17 nt, Human adenovirus C
acgugcccaucuccauc

SEQ ID NO: 1552827 - RNA, 13 nt, Human adenovirus C
agcgagugguggc

SEQ ID NO: 1552828 - RNA, 17 nt, Human adenovirus C
aggccgugagcgugagc

SEQ ID NO: 1552829 - RNA, 17 nt, Human adenovirus C
cucgcguccaggccagc

SEQ ID NO: 1552830 - RNA, 19 nt, Human adenovirus C
ucaauguuggcacaacaca

SEQ ID NO: 1552831 - RNA, 13 nt, Human adenovirus C
gaggacuaccacg

SEQ ID NO: 1552832 - RNA, 15 nt, Human adenovirus C
ccacucgacacggca

SEQ ID NO: 1552833 - RNA, 15 nt, Human adenovirus C
ggcgggagcuccugc

SEQ ID NO: 1552834 - RNA, 23 nt, Human adenovirus C
aggcuaauggcaauggcucaggc

SEQ ID NO: 1552835 - RNA, 20 nt, Human adenovirus C
acaauauuggcuaccagggc

SEQ ID NO: 1552836 - RNA, 18 nt, Human adenovirus C
uugcaauguuacauuuaa

SEQ ID NO: 1552837 - RNA, 19 nt, Human adenovirus C
cuaggucacuugcugacac

SEQ ID NO: 1552838 - RNA, 17 nt, Human adenovirus C
cgccagcccccaccauc

SEQ ID NO: 1552839 - RNA, 16 nt, Human adenovirus C
guuuaaggaaccagcu

SEQ ID NO: 1552840 - RNA, 15 nt, Human adenovirus C
auccucaucugcagc

SEQ ID NO: 1552841 - RNA, 15 nt, Human adenovirus C
ggugagcuccucagg

SEQ ID NO: 1552842 - RNA, 11 nt, Human adenovirus C
aucacaaaagc

SEQ ID NO: 1552843 - RNA, 15 nt, Human adenovirus C
cgacuggcgccaggu

SEQ ID NO: 1552844 - RNA, 18 nt, Human adenovirus C
ggccugcgcgugcccgug

SEQ ID NO: 1552845 - RNA, 17 nt, Human adenovirus C
ucgaugacuugcaagag

SEQ ID NO: 1552846 - RNA, 17 nt, Human adenovirus C
ucuggugacuuggcacc

SEQ ID NO: 1552847 - RNA, 16 nt, Human adenovirus C
gcaugcccccaugggc

SEQ ID NO: 1552848 - RNA, 20 nt, Human adenovirus C
ccguggagcuugagugcaug

SEQ ID NO: 1552849 - RNA, 13 nt, Human adenovirus C
uggccuuugccug

SEQ ID NO: 1552850 - RNA, 22 nt, Human adenovirus C
agcgaggaggagcgcaucuugc

SEQ ID NO: 1552851 - RNA, 23 nt, Human adenovirus C
uccgccgaacuucauaaccagca

SEQ ID NO: 1552852 - RNA, 21 nt, Human adenovirus C
guaguagucuugcaugagccu

SEQ ID NO: 1552853 - RNA, 16 nt, Human adenovirus C
cggcggugcgggcggc

SEQ ID NO: 1552854 - RNA, 15 nt, Human adenovirus C
gagcaggucuacugg

SEQ ID NO: 1552855 - RNA, 15 nt, Human adenovirus C
cagcagccgcaggcc

SEQ ID NO: 1552856 - RNA, 13 nt, Human adenovirus C
ggcacuaccugga

SEQ ID NO: 1552857 - RNA, 13 nt, Human adenovirus C
ugccgaggaugaa

SEQ ID NO: 1552858 - RNA, 21 nt, Human adenovirus C
gacagggcccagucugcaaga

SEQ ID NO: 1552859 - RNA, 16 nt, Human adenovirus C
ucgcuuacuaaggaca

SEQ ID NO: 1552860 - RNA, 16 nt, Human adenovirus C
uggagccugggcugga

SEQ ID NO: 1552861 - RNA, 14 nt, Human adenovirus C
ugaggguccugugu

SEQ ID NO: 1552862 - RNA, 17 nt, Human adenovirus C
gagaguucgacagaauc

SEQ ID NO: 1552863 - RNA, 13 nt, Human adenovirus C
ccagaggugcuug

SEQ ID NO: 1552864 - RNA, 19 nt, Human adenovirus C
caauucuucucaaauacua

SEQ ID NO: 1552865 - RNA, 20 nt, Human adenovirus C
auggaucuuaugccaggccu

SEQ ID NO: 1552866 - RNA, 23 nt, Human adenovirus C
cuccugcgccguagcgccauugc

SEQ ID NO: 1552867 - RNA, 14 nt, Human adenovirus C
cugcagccuccgcc

SEQ ID NO: 1552868 - RNA, 16 nt, Human adenovirus C
accagcaugaagggca

SEQ ID NO: 1552869 - RNA, 19 nt, Human adenovirus C
cugcaccugcgugagggua

SEQ ID NO: 1552870 - RNA, 15 nt, Human adenovirus C
guggugcugcagcag

SEQ ID NO: 1552871 - RNA, 15 nt, Human adenovirus C
gcugaagcgcugccg

SEQ ID NO: 1552872 - RNA, 22 nt, Human adenovirus C
agcccgcuugcaagcagugcag

SEQ ID NO: 1552873 - RNA, 12 nt, Human adenovirus C
caugggcgcacu

SEQ ID NO: 1552874 - RNA, 14 nt, Human adenovirus C
gcacgucgcaccgg

SEQ ID NO: 1552875 - RNA, 19 nt, Human adenovirus C
ggcgcgcugcggcugcugu

SEQ ID NO: 1552876 - RNA, 12 nt, Human adenovirus C
cuggcagugaca

SEQ ID NO: 1552877 - RNA, 21 nt, Human adenovirus C
accuggaaaaggugaugaaaa

SEQ ID NO: 1552878 - RNA, 18 nt, Human adenovirus C
ucaggcacaaccauccgc

SEQ ID NO: 1552879 - RNA, 14 nt, Human adenovirus C
ggcgcguucguccu

SEQ ID NO: 1552880 - RNA, 16 nt, Human adenovirus C
ugguuauuaugaaugu

SEQ ID NO: 1552881 - RNA, 14 nt, Human adenovirus C
acgagccagaggac

SEQ ID NO: 1552882 - RNA, 15 nt, Human adenovirus C
ggucaggcgggagcu

SEQ ID NO: 1552883 - RNA, 19 nt, Human adenovirus C
gcgcgugcccgugcgcacc

SEQ ID NO: 1552884 - RNA, 14 nt, Human adenovirus C
cagcggcagcaaca

SEQ ID NO: 1552885 - RNA, 15 nt, Human adenovirus C
ucacccuggcugugg

SEQ ID NO: 1552886 - RNA, 17 nt, Human adenovirus C
ccuuaguaugcagcgcg

SEQ ID NO: 1552887 - RNA, 21 nt, Human adenovirus C
gguacuucccagagacgccca

SEQ ID NO: 1552888 - RNA, 18 nt, Human adenovirus C
ugggauuuuuuaauuaag

SEQ ID NO: 1552889 - RNA, 22 nt, Human adenovirus C
uaaguuccucguaggugagcuc

SEQ ID NO: 1552890 - RNA, 15 nt, Human adenovirus C
ucaggcgggagcucc

SEQ ID NO: 1552891 - RNA, 18 nt, Human adenovirus C
cugagacaccgcaaagug

SEQ ID NO: 1552892 - RNA, 13 nt, Human adenovirus C
ugcaccacagaac

SEQ ID NO: 1552893 - RNA, 14 nt, Human adenovirus C
cggcgcugcagagc

SEQ ID NO: 1552894 - RNA, 19 nt, Human adenovirus C
gcuacaacguagcucagug

SEQ ID NO: 1552895 - RNA, 19 nt, Human adenovirus C
agcgcacccugaucucacu

SEQ ID NO: 1552896 - RNA, 13 nt, Human adenovirus C
gcagcaggaggag

SEQ ID NO: 1552897 - RNA, 13 nt, Human adenovirus C
uccggcagcagcc

SEQ ID NO: 1552898 - RNA, 21 nt, Human adenovirus C
gccugcuuaaaacccugcaac

SEQ ID NO: 1552899 - RNA, 15 nt, Human adenovirus C
aaagaaaaugccuug

SEQ ID NO: 1552900 - RNA, 14 nt, Human adenovirus C
cagccggugggccc

SEQ ID NO: 1552901 - RNA, 19 nt, Human adenovirus C
auguccacaaagcgguggu

SEQ ID NO: 1552902 - RNA, 13 nt, Human adenovirus C
ccugaauaacaag

SEQ ID NO: 1552903 - RNA, 14 nt, Human adenovirus C
agaucagcugggaa

SEQ ID NO: 1552904 - RNA, 23 nt, Human adenovirus C
gcccccuuugaguucgccaccac

SEQ ID NO: 1552905 - RNA, 13 nt, Human adenovirus C
cgacugcgccuga

SEQ ID NO: 1552906 - RNA, 21 nt, Human adenovirus C
ugcgcgaggccguggcgcagc

SEQ ID NO: 1552907 - RNA, 16 nt, Human adenovirus C
aggaauacugggacag

SEQ ID NO: 1552908 - RNA, 22 nt, Human adenovirus C
cugcaagaugaggguuggaagc

SEQ ID NO: 1552909 - RNA, 12 nt, Human adenovirus C
agugcggcggcg

SEQ ID NO: 1552910 - RNA, 14 nt, Human adenovirus C
gccagaaggcgcuc

SEQ ID NO: 1552911 - RNA, 16 nt, Human adenovirus C
caaaaagaagcugcag

SEQ ID NO: 1552912 - RNA, 19 nt, Human adenovirus C
ugcugccgccgccgcuccg

SEQ ID NO: 1552913 - RNA, 21 nt, Human adenovirus C
gcuucagcuugccugcuccag

SEQ ID NO: 1552914 - RNA, 20 nt, Human adenovirus C
ucaaaaugaagaucuauuaa

SEQ ID NO: 1552915 - RNA, 16 nt, Human adenovirus C
gaggcugguccugcug

SEQ ID NO: 1552916 - RNA, 13 nt, Human adenovirus C
uggacauaaacau

SEQ ID NO: 1552917 - RNA, 17 nt, Human adenovirus C
cuacuccggcacugccu

SEQ ID NO: 1552918 - RNA, 16 nt, Human adenovirus C
cggcgauuggcgccgu

SEQ ID NO: 1552919 - RNA, 19 nt, Human adenovirus C
acgagguggaacugcugca

SEQ ID NO: 1552920 - RNA, 15 nt, Human adenovirus C
ucuccgcguccggcu

SEQ ID NO: 1552921 - RNA, 13 nt, Human adenovirus C
gcaccaggugcac

SEQ ID NO: 1552922 - RNA, 17 nt, Human adenovirus C
ugaaaaguaucuuuccc

SEQ ID NO: 1552923 - RNA, 18 nt, Human adenovirus C
cgaucggcaggcucagcg

SEQ ID NO: 1552924 - RNA, 13 nt, Human adenovirus C
cauucccagcugc

SEQ ID NO: 1552925 - RNA, 16 nt, Human adenovirus C
gcccuuuggcuuuucu

SEQ ID NO: 1552926 - RNA, 19 nt, Human adenovirus C
ccggcccgaugaggccggc

SEQ ID NO: 1552927 - RNA, 20 nt, Human adenovirus C
cauauauccauaccuugaca

SEQ ID NO: 1552928 - RNA, 14 nt, Human adenovirus C
aggaggagcgcugc

SEQ ID NO: 1552929 - RNA, 16 nt, Human adenovirus C
acugggacagucaggc

SEQ ID NO: 1552930 - RNA, 23 nt, Human adenovirus C
aagaucuuuguugucaucucugu

SEQ ID NO: 1552931 - RNA, 15 nt, Human adenovirus C
uacauuccagaaagc

SEQ ID NO: 1552932 - RNA, 13 nt, Human adenovirus C
gcgcugcuccucu

SEQ ID NO: 1552933 - RNA, 23 nt, Human adenovirus C
gcagaccguaaaccugagccagg

SEQ ID NO: 1552934 - RNA, 17 nt, Human adenovirus C
gagggcauggagacaca

SEQ ID NO: 1552935 - RNA, 21 nt, Human adenovirus C
cgccucggaguaccugagccc

SEQ ID NO: 1552936 - RNA, 17 nt, Human adenovirus C
ugcagguacgccugcag

SEQ ID NO: 1552937 - RNA, 18 nt, Human adenovirus C
aacucccuuagaaccaaa

SEQ ID NO: 1552938 - RNA, 13 nt, Human adenovirus C
ugaaguuugccuu

SEQ ID NO: 1552939 - RNA, 20 nt, Human adenovirus C
ccaggcgcggcggcugcugc

SEQ ID NO: 1552940 - RNA, 20 nt, Human adenovirus C
cccucgccggcgccccagaa

SEQ ID NO: 1552941 - RNA, 21 nt, Human adenovirus C
cgccugcgucauuacccaggg

SEQ ID NO: 1552942 - RNA, 15 nt, Human adenovirus C
gccaguggcaacugg

SEQ ID NO: 1552943 - RNA, 14 nt, Human adenovirus C
cagccuaaccgccc

SEQ ID NO: 1552944 - RNA, 13 nt, Human adenovirus C
aaccuacgucacc

SEQ ID NO: 1552945 - RNA, 21 nt, Human adenovirus C
gccacacgggcggaggagaag

SEQ ID NO: 1552946 - RNA, 16 nt, Human adenovirus C
guacggcgacgaggac

SEQ ID NO: 1552947 - RNA, 21 nt, Human adenovirus C
cccuauguaagcuuguugcau

SEQ ID NO: 1552948 - RNA, 16 nt, Human adenovirus C
gccacuggcagggaca

SEQ ID NO: 1552949 - RNA, 16 nt, Human adenovirus C
gaccggcaaggcaaug

SEQ ID NO: 1552950 - RNA, 18 nt, Human adenovirus C
cccggccacuacccggac

SEQ ID NO: 1552951 - RNA, 14 nt, Human adenovirus C
agagcagcugacca

SEQ ID NO: 1552952 - RNA, 15 nt, Human adenovirus C
cauuccagcaccuuc

SEQ ID NO: 1552953 - RNA, 21 nt, Human adenovirus C
gacaccacccguguguaccuu

SEQ ID NO: 1552954 - RNA, 20 nt, Human adenovirus C
ucagccugaauaacaaguuu

SEQ ID NO: 1552955 - RNA, 22 nt, Human adenovirus C
ucauugugcucaacccacacaa

SEQ ID NO: 1552956 - RNA, 20 nt, Human adenovirus C
guuuucacuccacaggcugc

SEQ ID NO: 1552957 - RNA, 15 nt, Human adenovirus C
accaccacuggaacc

SEQ ID NO: 1552958 - RNA, 15 nt, Human adenovirus C
cuaccucgcucccac

SEQ ID NO: 1552959 - RNA, 18 nt, Human adenovirus C
ccgucuacucccagcuca

SEQ ID NO: 1552960 - RNA, 14 nt, Human adenovirus C
cuaugugcagcaga

SEQ ID NO: 1552961 - RNA, 18 nt, Human adenovirus C
gcuccuaacuccugugag

SEQ ID NO: 1552962 - RNA, 21 nt, Human adenovirus C
cagccugagcguaaccagaca

SEQ ID NO: 1552963 - RNA, 17 nt, Human adenovirus C
uuugucacuugaaaaac

SEQ ID NO: 1552964 - RNA, 14 nt, Human adenovirus C
gcaggagcgcagcu

SEQ ID NO: 1552965 - RNA, 15 nt, Human adenovirus C
caaacuuucuccaaa

SEQ ID NO: 1552966 - RNA, 20 nt, Human adenovirus C
cugacgcguuccggcagcag

SEQ ID NO: 1552967 - RNA, 22 nt, Human adenovirus C
caccgccgccgacccggcacug

SEQ ID NO: 1552968 - RNA, 13 nt, Human adenovirus C
ugcaucuguggga

SEQ ID NO: 1552969 - RNA, 14 nt, Human adenovirus C
gacgaaggcucgcg

SEQ ID NO: 1552970 - RNA, 18 nt, Human adenovirus C
accguucgcacuggggcg

SEQ ID NO: 1552971 - RNA, 12 nt, Human adenovirus C
cguggcggccgc

SEQ ID NO: 1552972 - RNA, 16 nt, Human adenovirus C
cccgccaacgugccgc

SEQ ID NO: 1552973 - RNA, 16 nt, Human adenovirus C
uacaagcuacccaccc

SEQ ID NO: 1552974 - RNA, 15 nt, Human adenovirus C
ggggccggaccuggg

SEQ ID NO: 1552975 - RNA, 22 nt, Human adenovirus C
agagcugaaaauaaaaaacagg

SEQ ID NO: 1552976 - RNA, 14 nt, Human adenovirus C
ccagacgccgcacc

SEQ ID NO: 1552977 - RNA, 15 nt, Human adenovirus C
ccaacgcggcagccg

SEQ ID NO: 1552978 - RNA, 18 nt, Human adenovirus C
cuugaucugcuggcgcag

SEQ ID NO: 1552979 - RNA, 19 nt, Human adenovirus C
aacaacgggauagagagcc

SEQ ID NO: 1552980 - RNA, 15 nt, Human adenovirus C
ccgaggagcugaggc

SEQ ID NO: 1552981 - RNA, 18 nt, Human adenovirus C
ccccgggcuggugcaguu

SEQ ID NO: 1552982 - RNA, 17 nt, Human adenovirus C
cgcccgcgccugcuggg

SEQ ID NO: 1552983 - RNA, 22 nt, Human adenovirus C
cugucgccauccugugaacgcc

SEQ ID NO: 1552984 - RNA, 14 nt, Human adenovirus C
cuauggccccccga

SEQ ID NO: 1552985 - RNA, 19 nt, Human adenovirus C
caugucgcuguccagcugc

SEQ ID NO: 1552986 - RNA, 14 nt, Human adenovirus C
agcgacgaccuggg

SEQ ID NO: 1552987 - RNA, 14 nt, Human adenovirus C
cccagggccacauc

SEQ ID NO: 1552988 - RNA, 20 nt, Human adenovirus C
aggcgcgcaacuacacgccc

SEQ ID NO: 1552989 - RNA, 17 nt, Human adenovirus C
auggagaacuccucacu

SEQ ID NO: 1552990 - RNA, 23 nt, Human adenovirus C
cucuaugugggauaugcuccagg

SEQ ID NO: 1552991 - RNA, 21 nt, Human adenovirus C
cagcggguuuaucaccgugcu

SEQ ID NO: 1552992 - RNA, 16 nt, Human adenovirus C
ggcaacgucggcggcg

SEQ ID NO: 1552993 - RNA, 18 nt, Human adenovirus C
ccagccugugaugcugga

SEQ ID NO: 1552994 - RNA, 15 nt, Human adenovirus C
gagccugggcuggag

SEQ ID NO: 1552995 - RNA, 23 nt, Human adenovirus C
acgaggaggaauacugggacagu

SEQ ID NO: 1552996 - RNA, 16 nt, Human adenovirus C
cgugacacugcagcag

SEQ ID NO: 1552997 - RNA, 18 nt, Human adenovirus C
auugaggaguucgugccu

SEQ ID NO: 1552998 - RNA, 12 nt, Human adenovirus C
cagguuccugag

SEQ ID NO: 1552999 - RNA, 16 nt, Human adenovirus C
accauccuaaaccagc

SEQ ID NO: 1553000 - RNA, 20 nt, Human adenovirus C
aaagagggagcggggggcuu

SEQ ID NO: 1553001 - RNA, 20 nt, Human adenovirus C
gcaacuagauugcaagaaaa

SEQ ID NO: 1553002 - RNA, 18 nt, Human adenovirus C
ucuuuacgccaccuucuu

SEQ ID NO: 1553003 - RNA, 22 nt, Human adenovirus C
aacucaggucaaaaaagcauuu

SEQ ID NO: 1553004 - RNA, 17 nt, Human adenovirus C
gacgugguccgugugca

SEQ ID NO: 1553005 - RNA, 12 nt, Human adenovirus C
cgagggccuggc

SEQ ID NO: 1553006 - RNA, 15 nt, Human adenovirus C
cggcgccgggcccgg

SEQ ID NO: 1553007 - RNA, 17 nt, Human adenovirus C
cuggauuuucuggccau

SEQ ID NO: 1553008 - RNA, 17 nt, Human adenovirus C
cauaguccagccccucc

SEQ ID NO: 1553009 - RNA, 18 nt, Human adenovirus C
cagcguagucugggucac

SEQ ID NO: 1553010 - RNA, 14 nt, Human adenovirus C
gggcggugggccgc

SEQ ID NO: 1553011 - RNA, 22 nt, Human adenovirus C
cagcgaaaaugaaagucacugu

SEQ ID NO: 1553012 - RNA, 23 nt, Human adenovirus C
augggcgcacucacagaccuggg

SEQ ID NO: 1553013 - RNA, 15 nt, Human adenovirus C
aacaaagucaaacau

SEQ ID NO: 1553014 - RNA, 18 nt, Human adenovirus C
cucacuuaaaaaacauua

SEQ ID NO: 1553015 - RNA, 16 nt, Human adenovirus C
acauucccagcugcua

SEQ ID NO: 1553016 - RNA, 20 nt, Human adenovirus C
aaacaauacuaaaaaacugg

SEQ ID NO: 1553017 - RNA, 22 nt, Human adenovirus C
gagggccagcuguuggggugag

SEQ ID NO: 1553018 - RNA, 17 nt, Human adenovirus C
cauacggccgccagagc

SEQ ID NO: 1553019 - RNA, 16 nt, Human adenovirus C
gaggacuaccacgccc

SEQ ID NO: 1553020 - RNA, 13 nt, Human adenovirus C
auacaaaagcaga

SEQ ID NO: 1553021 - RNA, 17 nt, Human adenovirus C
cccgggcuggugcaguu

SEQ ID NO: 1553022 - RNA, 14 nt, Human adenovirus C
ccuaaaccagcugg

SEQ ID NO: 1553023 - RNA, 22 nt, Human adenovirus C
cguucaggaauucugcccgcca

SEQ ID NO: 1553024 - RNA, 21 nt, Human adenovirus C
ccguucgcacuggggcggcga

SEQ ID NO: 1553025 - RNA, 13 nt, Human adenovirus C
cggccuggcgcaa

SEQ ID NO: 1553026 - RNA, 17 nt, Human adenovirus C
cagugagcaggaacuga

SEQ ID NO: 1553027 - RNA, 19 nt, Human adenovirus C
gcuccacuuaaacucaggc

SEQ ID NO: 1553028 - RNA, 17 nt, Human adenovirus C
gaccgauguaaggguuc

SEQ ID NO: 1553029 - RNA, 15 nt, Human adenovirus C
uucaggaauucugcc

SEQ ID NO: 1553030 - RNA, 15 nt, Human adenovirus C
acacaggcuggggcc

SEQ ID NO: 1553031 - RNA, 17 nt, Human adenovirus C
ggcuggagcccgagguc

SEQ ID NO: 1553032 - RNA, 15 nt, Human adenovirus C
uggcgauggagcgca

SEQ ID NO: 1553033 - RNA, 23 nt, Human adenovirus C
gcucccucacccgcagcugccug

SEQ ID NO: 1553034 - RNA, 16 nt, Human adenovirus C
uacuaagaaaacacau

SEQ ID NO: 1553035 - RNA, 13 nt, Human adenovirus C
gaggccucccucg

SEQ ID NO: 1553036 - RNA, 22 nt, Human adenovirus C
gacugacuuugcuuuccugagc

SEQ ID NO: 1553037 - RNA, 20 nt, Human adenovirus C
ucgagaaggaggacagccua

SEQ ID NO: 1553038 - RNA, 13 nt, Human adenovirus C
uaucccuccgggg

SEQ ID NO: 1553039 - RNA, 13 nt, Human adenovirus C
uaaugaaauagga

SEQ ID NO: 1553040 - RNA, 12 nt, Human adenovirus C
aggcccugggca

SEQ ID NO: 1553041 - RNA, 17 nt, Human adenovirus C
cgggauagagagccuag

SEQ ID NO: 1553042 - RNA, 16 nt, Human adenovirus C
ccaguccgggccagac

SEQ ID NO: 1553043 - RNA, 17 nt, Human adenovirus C
ugcaccggcggcagcgg

SEQ ID NO: 1553044 - RNA, 12 nt, Human adenovirus C
gcuggggccugc

SEQ ID NO: 1553045 - RNA, 12 nt, Human adenovirus C
aaccccuucccu

SEQ ID NO: 1553046 - RNA, 21 nt, Human adenovirus C
agccugcaaagggcccuggcu

SEQ ID NO: 1553047 - RNA, 16 nt, Human adenovirus C
gcgcacaaacgcggcc

SEQ ID NO: 1553048 - RNA, 19 nt, Human adenovirus C
aggguauaacucaccugaa

SEQ ID NO: 1553049 - RNA, 15 nt, Human adenovirus C
agcuugaucugcugg

SEQ ID NO: 1553050 - RNA, 18 nt, Human adenovirus C
gaccaguuaacggucugg

SEQ ID NO: 1553051 - RNA, 17 nt, Human adenovirus C
guccagccccuccgcgg

SEQ ID NO: 1553052 - RNA, 23 nt, Human adenovirus C
gcugggaagaaagcagguuccug

SEQ ID NO: 1553053 - RNA, 22 nt, Human adenovirus C
cagcaauaacacaggcuggggc

SEQ ID NO: 1553054 - RNA, 14 nt, Human adenovirus C
cucagcuacaagcu

SEQ ID NO: 1553055 - RNA, 17 nt, Human adenovirus C
gcauccgcccugcuccc

SEQ ID NO: 1553056 - RNA, 23 nt, Human adenovirus C
caucaaacaauacuaaaaaacug

SEQ ID NO: 1553057 - RNA, 20 nt, Human adenovirus C
aacucaccaaggccauggca

SEQ ID NO: 1553058 - RNA, 17 nt, Human adenovirus C
ccauuucaaucacgugc

SEQ ID NO: 1553059 - RNA, 15 nt, Human adenovirus C
ugaguucgccaccac

SEQ ID NO: 1553060 - RNA, 12 nt, Human adenovirus C
guagacuggaag

SEQ ID NO: 1553061 - RNA, 15 nt, Human adenovirus C
gaggagcucaaccca

SEQ ID NO: 1553062 - RNA, 17 nt, Human adenovirus C
ccugcugugcgcuuccu

SEQ ID NO: 1553063 - RNA, 23 nt, Human adenovirus C
gcaccuucgccccaggcugggga

SEQ ID NO: 1553064 - RNA, 19 nt, Human adenovirus C
ggaggagcaacagcaggag

SEQ ID NO: 1553065 - RNA, 16 nt, Human adenovirus C
caggaggaagccaggc

SEQ ID NO: 1553066 - RNA, 17 nt, Human adenovirus C
ggcagcagccgcaggcc

SEQ ID NO: 1553067 - RNA, 16 nt, Human adenovirus C
gcagauguuggccaac

SEQ ID NO: 1553068 - RNA, 16 nt, Human adenovirus C
cuggccgcgcgcggcg

SEQ ID NO: 1553069 - RNA, 15 nt, Human adenovirus C
acacaauaaauuacu

SEQ ID NO: 1553070 - RNA, 23 nt, Human adenovirus C
ccagcuuauucagcaucaccucc

SEQ ID NO: 1553071 - RNA, 20 nt, Human adenovirus C
uggaagcgacgaaugagcuc

SEQ ID NO: 1553072 - RNA, 19 nt, Human adenovirus C
gugucgaacccaggugugc

SEQ ID NO: 1553073 - RNA, 16 nt, Human adenovirus C
cacuaaagcaaggccu

SEQ ID NO: 1553074 - RNA, 17 nt, Human adenovirus C
gcuuccgcaggccaagc

SEQ ID NO: 1553075 - RNA, 20 nt, Human adenovirus C
cgggacgcuaccgcugcgca

SEQ ID NO: 1553076 - RNA, 14 nt, Human adenovirus C
ggcgcggcggcugc

SEQ ID NO: 1553077 - RNA, 21 nt, Human adenovirus C
ugacaaagagacgcucggugc

SEQ ID NO: 1553078 - RNA, 14 nt, Human adenovirus C
cguggagccugggc

SEQ ID NO: 1553079 - RNA, 16 nt, Human adenovirus C
gacaaugcagaaacac

SEQ ID NO: 1553080 - RNA, 17 nt, Human adenovirus C
aaaccgaauucuccucg

SEQ ID NO: 1553081 - RNA, 15 nt, Human adenovirus C
cagaaacuuccagcc

SEQ ID NO: 1553082 - RNA, 21 nt, Human adenovirus C
aggccguggcgcagcgugagc

SEQ ID NO: 1553083 - RNA, 18 nt, Human adenovirus C
cugcugggcgaggaggag

SEQ ID NO: 1553084 - RNA, 23 nt, Human adenovirus C
ggcacuaccuggacuuggaggag

SEQ ID NO: 1553085 - RNA, 18 nt, Human adenovirus C
ugcagggcacccuccccu

SEQ ID NO: 1553086 - RNA, 20 nt, Human adenovirus C
cucgacgaagugccaaaaau

SEQ ID NO: 1553087 - RNA, 18 nt, Human adenovirus C
uccguagauguaccugga

SEQ ID NO: 1553088 - RNA, 22 nt, Human adenovirus C
cgcgaggaggacuuugagcccg

SEQ ID NO: 1553089 - RNA, 18 nt, Human adenovirus C
cgugugcaccagccgcac

SEQ ID NO: 1553090 - RNA, 12 nt, Human adenovirus C
ccuuuugguggu

SEQ ID NO: 1553091 - RNA, 15 nt, Human adenovirus C
ccacaauguggccuc

SEQ ID NO: 1553092 - RNA, 15 nt, Human adenovirus C
cgaaaaggcuguccg

SEQ ID NO: 1553093 - RNA, 18 nt, Human adenovirus C
cucgguuagcggccugcg

SEQ ID NO: 1553094 - RNA, 17 nt, Human adenovirus C
ugcuaccuucugcagcu

SEQ ID NO: 1553095 - RNA, 14 nt, Human adenovirus C
aggcgccgccggca

SEQ ID NO: 1553096 - RNA, 23 nt, Human adenovirus C
aaaggugguagauggccuggccu

SEQ ID NO: 1553097 - RNA, 21 nt, Human adenovirus C
aggugagcuccucaggggagc

SEQ ID NO: 1553098 - RNA, 20 nt, Human adenovirus C
acugguuccuggugcagaug

SEQ ID NO: 1553099 - RNA, 12 nt, Human adenovirus C
augagcagcugg

SEQ ID NO: 1553100 - RNA, 13 nt, Human adenovirus C
gacggaugagcuc

SEQ ID NO: 1553101 - RNA, 21 nt, Human adenovirus C
agcacucggcagaaacagagg

SEQ ID NO: 1553102 - RNA, 18 nt, Human adenovirus C
cgcgcagaugggagcugu

SEQ ID NO: 1553103 - RNA, 18 nt, Human adenovirus C
cacagcggcggcagcagc

SEQ ID NO: 1553104 - RNA, 19 nt, Human adenovirus C
agcggucccauccaagguc

SEQ ID NO: 1553105 - RNA, 21 nt, Human adenovirus C
uaaguaccuuaccugguacuu

SEQ ID NO: 1553106 - RNA, 22 nt, Human adenovirus C
ggcaggggcacgucggcgccgc

SEQ ID NO: 1553107 - RNA, 17 nt, Human adenovirus C
acgccaccaacgugccc

SEQ ID NO: 1553108 - RNA, 17 nt, Human adenovirus C
ggccgucuacucccagc

SEQ ID NO: 1553109 - RNA, 17 nt, Human adenovirus C
ucuccuucgcccgccgc

SEQ ID NO: 1553110 - RNA, 18 nt, Human adenovirus C
caggcuggggccugcgcu

SEQ ID NO: 1553111 - RNA, 20 nt, Human adenovirus C
ccauuaagaacuauggcagc

SEQ ID NO: 1553112 - RNA, 15 nt, Human adenovirus C
cgcgagacugggggc

SEQ ID NO: 1553113 - RNA, 13 nt, Human adenovirus C
cauuuuaaaaaaa

SEQ ID NO: 1553114 - RNA, 19 nt, Human adenovirus C
accuguguggaagccugga

SEQ ID NO: 1553115 - RNA, 18 nt, Human adenovirus C
ugcuggaugugaccgagg

SEQ ID NO: 1553116 - RNA, 21 nt, Human adenovirus C
acuugcauggugauaaaacua

SEQ ID NO: 1553117 - RNA, 20 nt, Human adenovirus C
ucaggcgauccuaacucugc

SEQ ID NO: 1553118 - RNA, 14 nt, Human adenovirus C
ugagacgcgcgagc

SEQ ID NO: 1553119 - RNA, 15 nt, Human adenovirus C
cccucguuccagacg

SEQ ID NO: 1553120 - RNA, 20 nt, Human adenovirus C
ggcaacccuuccaggagggc

SEQ ID NO: 1553121 - RNA, 15 nt, Human adenovirus C
aucacuuggugcugg

SEQ ID NO: 1553122 - RNA, 22 nt, Human adenovirus C
gaagcgacgaaugagcuccaca

SEQ ID NO: 1553123 - RNA, 22 nt, Human adenovirus C
aaugaauguuguacagguggcu

SEQ ID NO: 1553124 - RNA, 13 nt, Human adenovirus C
agcugcugagccg

SEQ ID NO: 1553125 - RNA, 13 nt, Human adenovirus C
acauucccagcug

SEQ ID NO: 1553126 - RNA, 13 nt, Human adenovirus C
ucgcgcugcuccu

SEQ ID NO: 1553127 - RNA, 18 nt, Human adenovirus C
aacccaauccccccgccg

SEQ ID NO: 1553128 - RNA, 23 nt, Human adenovirus C
agcagguuccugagcagcugcga

SEQ ID NO: 1553129 - RNA, 15 nt, Human adenovirus C
gcggcgcggaagaga

SEQ ID NO: 1553130 - RNA, 12 nt, Human adenovirus C
uacuaccucuuu

SEQ ID NO: 1553131 - RNA, 12 nt, Human adenovirus C
gccggccuggac

SEQ ID NO: 1553132 - RNA, 19 nt, Human adenovirus C
gcgacgaaugagcuccaca

SEQ ID NO: 1553133 - RNA, 13 nt, Human adenovirus C
ggcucgcucccug

SEQ ID NO: 1553134 - RNA, 17 nt, Human adenovirus C
cuccuucagcgcgcgcu

SEQ ID NO: 1553135 - RNA, 16 nt, Human adenovirus C
ccgggccuccaacugu

SEQ ID NO: 1553136 - RNA, 15 nt, Human adenovirus C
ccuaucgagccgcac

SEQ ID NO: 1553137 - RNA, 17 nt, Human adenovirus C
cagguuggaauucuuca

SEQ ID NO: 1553138 - RNA, 21 nt, Human adenovirus C
ccgcguacgagcagacgguga

SEQ ID NO: 1553139 - RNA, 13 nt, Human adenovirus C
ccucgcucccacc

SEQ ID NO: 1553140 - RNA, 11 nt, Human adenovirus C
ugcccaggcuc

SEQ ID NO: 1553141 - RNA, 22 nt, Human adenovirus C
ucuacggcaucucgauccagca

SEQ ID NO: 1553142 - RNA, 19 nt, Human adenovirus C
aagaaagcagguuccugag

SEQ ID NO: 1553143 - RNA, 15 nt, Human adenovirus C
gucugcagcgcugcc

SEQ ID NO: 1553144 - RNA, 16 nt, Human adenovirus C
gaaugagcuccacagg

SEQ ID NO: 1553145 - RNA, 14 nt, Human adenovirus C
gcuguacauccugc

SEQ ID NO: 1553146 - RNA, 17 nt, Human adenovirus C
cgucaucccugagcagg

SEQ ID NO: 1553147 - RNA, 20 nt, Human adenovirus C
ccgcaauacagagacaggac

SEQ ID NO: 1553148 - RNA, 20 nt, Human adenovirus C
gagcucuggccguucggggu

SEQ ID NO: 1553149 - RNA, 14 nt, Human adenovirus C
caugaaaccaugcu

SEQ ID NO: 1553150 - RNA, 19 nt, Human adenovirus C
ugcggccaaucaagcaggu

SEQ ID NO: 1553151 - RNA, 20 nt, Human adenovirus C
caccgggacugggcgugcag

SEQ ID NO: 1553152 - RNA, 14 nt, Human adenovirus C
cagcggccacaccc

SEQ ID NO: 1553153 - RNA, 15 nt, Human adenovirus C
ccgugagcgugagcc

SEQ ID NO: 1553154 - RNA, 13 nt, Human adenovirus C
aggugaugaaaau

SEQ ID NO: 1553155 - RNA, 15 nt, Human adenovirus C
cucaccaaggccaug

SEQ ID NO: 1553156 - RNA, 17 nt, Human adenovirus C
ccgcauaccccgcgcca

SEQ ID NO: 1553157 - RNA, 18 nt, Human adenovirus C
aggcgacgagcggccgcc

SEQ ID NO: 1553158 - RNA, 17 nt, Human adenovirus C
cucugguaucucagccg

SEQ ID NO: 1553159 - RNA, 21 nt, Human adenovirus C
cugcgucauuacccagggcca

SEQ ID NO: 1553160 - RNA, 15 nt, Human adenovirus C
aaacacaugucuaug

SEQ ID NO: 1553161 - RNA, 21 nt, Human adenovirus C
aggguggcucgcgaaggaggc

SEQ ID NO: 1553162 - RNA, 18 nt, Human adenovirus C
gacacugcagcaggugcu

SEQ ID NO: 1553163 - RNA, 22 nt, Human adenovirus C
gacugugguugcuucaugcuag

SEQ ID NO: 1553164 - RNA, 14 nt, Human adenovirus C
agucuaagcagccg

SEQ ID NO: 1553165 - RNA, 13 nt, Human adenovirus C
uuagcauuugcag

SEQ ID NO: 1553166 - RNA, 13 nt, Human adenovirus C
uccacacaagcuc

SEQ ID NO: 1553167 - RNA, 17 nt, Human adenovirus C
gcccuugauggagggca

SEQ ID NO: 1553168 - RNA, 23 nt, Human adenovirus C
agcuacuuuaauuugacaggugg

SEQ ID NO: 1553169 - RNA, 17 nt, Human adenovirus C
cguacgugccgcggcag

SEQ ID NO: 1553170 - RNA, 14 nt, Human adenovirus C
cuuuaauuaugaaa

SEQ ID NO: 1553171 - RNA, 14 nt, Human adenovirus C
gggcccggcgcacg

SEQ ID NO: 1553172 - RNA, 15 nt, Human adenovirus C
ugauuaucgagcagg

SEQ ID NO: 1553173 - RNA, 16 nt, Human adenovirus C
cucgcugcugcagccg

SEQ ID NO: 1553174 - RNA, 13 nt, Human adenovirus C
ugcccuccgccgc

SEQ ID NO: 1553175 - RNA, 14 nt, Human adenovirus C
aucagaugaugcaa

SEQ ID NO: 1553176 - RNA, 22 nt, Human adenovirus C
aggaaccagccugugaugcugg

SEQ ID NO: 1553177 - RNA, 18 nt, Human adenovirus C
ugccauuaaaaaccuccu

SEQ ID NO: 1553178 - RNA, 15 nt, Human adenovirus C
aagaacaagagcuga

SEQ ID NO: 1553179 - RNA, 15 nt, Human adenovirus C
caccaccgccuccac

SEQ ID NO: 1553180 - RNA, 22 nt, Human adenovirus C
acggcguccggcucaccaccca

SEQ ID NO: 1553181 - RNA, 19 nt, Human adenovirus C
cagacaaugcagaaacaca

SEQ ID NO: 1553182 - RNA, 21 nt, Human adenovirus C
aaaaagaagcugcagcugccg

SEQ ID NO: 1553183 - RNA, 16 nt, Human adenovirus C
gaauggcgguaguggg

SEQ ID NO: 1553184 - RNA, 15 nt, Human adenovirus C
ggcagcaaggccugg

SEQ ID NO: 1553185 - RNA, 21 nt, Human adenovirus C
aagaaucgugaaccuguugca

SEQ ID NO: 1553186 - RNA, 21 nt, Human adenovirus C
cgccagaggagcugcugagcc

SEQ ID NO: 1553187 - RNA, 19 nt, Human adenovirus C
caguccccagguacagccc

SEQ ID NO: 1553188 - RNA, 14 nt, Human adenovirus C
ggccugacgggcgg

SEQ ID NO: 1553189 - RNA, 14 nt, Human adenovirus C
caaccguucccagc

SEQ ID NO: 1553190 - RNA, 14 nt, Human adenovirus C
caagcagguggcac

SEQ ID NO: 1553191 - RNA, 22 nt, Human adenovirus C
ugcucgaucucuuccuccugga

SEQ ID NO: 1553192 - RNA, 21 nt, Human adenovirus C
ugcgcuuuuuggaacgcgggu

SEQ ID NO: 1553193 - RNA, 20 nt, Human adenovirus C
ggcggcggaguuuggccgua

SEQ ID NO: 1553194 - RNA, 21 nt, Human adenovirus C
gaaaccgggccuccaacugug

SEQ ID NO: 1553195 - RNA, 18 nt, Human adenovirus C
aaacccaaauagcaagcc

SEQ ID NO: 1553196 - RNA, 21 nt, Human adenovirus C
agcgcaaccuaaaggagcugc

SEQ ID NO: 1553197 - RNA, 23 nt, Human adenovirus C
acgcgccaaccgcgguugugcag

SEQ ID NO: 1553198 - RNA, 21 nt, Human adenovirus C
cagcacuggaacacuaucagc

SEQ ID NO: 1553199 - RNA, 19 nt, Human adenovirus C
ugaacgcgcuccccuccgg

SEQ ID NO: 1553200 - RNA, 20 nt, Human adenovirus C
cucgaucucuuccuccugga

SEQ ID NO: 1553201 - RNA, 14 nt, Human adenovirus C
acugcuaccuucug

SEQ ID NO: 1553202 - RNA, 21 nt, Human adenovirus C
ggcgaugagcagcuggcgcgc

SEQ ID NO: 1553203 - RNA, 17 nt, Human adenovirus C
acaucucgggccaggac

SEQ ID NO: 1553204 - RNA, 13 nt, Human adenovirus C
cagaggcggcgcu

SEQ ID NO: 1553205 - RNA, 17 nt, Human adenovirus C
ggcgacgagcggccgcc

SEQ ID NO: 1553206 - RNA, 22 nt, Human adenovirus C
cacuguuggauguggacgccua

SEQ ID NO: 1553207 - RNA, 14 nt, Human adenovirus C
acgaccccuggaga

SEQ ID NO: 1553208 - RNA, 16 nt, Human adenovirus C
ggacguuagcgccuga

SEQ ID NO: 1553209 - RNA, 14 nt, Human adenovirus C
gggugguggcggug

SEQ ID NO: 1553210 - RNA, 15 nt, Human adenovirus C
uugcaagcagugcag

SEQ ID NO: 1553211 - RNA, 15 nt, Human adenovirus C
gccaagcagcuuguc

SEQ ID NO: 1553212 - RNA, 14 nt, Human adenovirus C
cucaacuaaugcaa

SEQ ID NO: 1553213 - RNA, 21 nt, Human adenovirus C
ccaguggcggcggcgcugggu

SEQ ID NO: 1553214 - RNA, 23 nt, Human adenovirus C
gcuugagacgcgcgagccugccg

SEQ ID NO: 1553215 - RNA, 17 nt, Human adenovirus C
gcagaccguaaaccuga

SEQ ID NO: 1553216 - RNA, 13 nt, Human adenovirus C
ugagcgcgggacc

SEQ ID NO: 1553217 - RNA, 14 nt, Human adenovirus C
cuuucacaguuuac

SEQ ID NO: 1553218 - RNA, 11 nt, Human adenovirus C
caggcugggga

SEQ ID NO: 1553219 - RNA, 14 nt, Human adenovirus C
agcaucgcuacaac

SEQ ID NO: 1553220 - RNA, 19 nt, Human adenovirus C
cuugcggcuggagcugccc

SEQ ID NO: 1553221 - RNA, 19 nt, Human adenovirus C
cggugcaggcggccgcugc

SEQ ID NO: 1553222 - RNA, 14 nt, Human adenovirus C
caguacuggcagcg

SEQ ID NO: 1553223 - RNA, 13 nt, Human adenovirus C
ccgccucagcuac

SEQ ID NO: 1553224 - RNA, 15 nt, Human adenovirus C
cuccagcggccacac

SEQ ID NO: 1553225 - RNA, 13 nt, Human adenovirus C
cacuaccuggacu

SEQ ID NO: 1553226 - RNA, 17 nt, Human adenovirus C
gguaccuuugagcugca

SEQ ID NO: 1553227 - RNA, 23 nt, Human adenovirus C
cacuaccggcaaccgccucagcu

SEQ ID NO: 1553228 - RNA, 17 nt, Human adenovirus C
auuuaccccccacccuu

SEQ ID NO: 1553229 - RNA, 17 nt, Human adenovirus C
caaagcccgccaagagu

SEQ ID NO: 1553230 - RNA, 21 nt, Human adenovirus C
aggaggcuaagugggaggggu

SEQ ID NO: 1553231 - RNA, 22 nt, Human adenovirus C
ggggccagcguaggguggccgg

SEQ ID NO: 1553232 - RNA, 13 nt, Human adenovirus C
cguggcugugauu

SEQ ID NO: 1553233 - RNA, 19 nt, Human adenovirus C
cgggaguuuaccaagcgcc

SEQ ID NO: 1553234 - RNA, 16 nt, Human adenovirus C
cagucaggcagaggag

SEQ ID NO: 1553235 - RNA, 13 nt, Human adenovirus C
aguaccugagccc

SEQ ID NO: 1553236 - RNA, 23 nt, Human adenovirus C
gugauugguuuauagguguaggc

SEQ ID NO: 1553237 - RNA, 21 nt, Human adenovirus C
cugucugcgagggccagcugu

SEQ ID NO: 1553238 - RNA, 13 nt, Human adenovirus C
ccacccuucuuua

SEQ ID NO: 1553239 - RNA, 14 nt, Human adenovirus C
guaggagucgcgca

SEQ ID NO: 1553240 - RNA, 14 nt, Human adenovirus C
uuagcgaaagucaa

SEQ ID NO: 1553241 - RNA, 13 nt, Human adenovirus C
acuggcugcagcc

SEQ ID NO: 1553242 - RNA, 16 nt, Human adenovirus C
caauaaaaacuaaaau

SEQ ID NO: 1553243 - RNA, 13 nt, Human adenovirus C
ucauaccacaagc

SEQ ID NO: 1553244 - RNA, 16 nt, Human adenovirus C
cucugcgugaagacga

SEQ ID NO: 1553245 - RNA, 21 nt, Human adenovirus C
uacuccggcacugccuacaac

SEQ ID NO: 1553246 - RNA, 18 nt, Human adenovirus C
uaugcuauuuggcagcca

SEQ ID NO: 1553247 - RNA, 18 nt, Human adenovirus C
uugccaggggcaggcccu

SEQ ID NO: 1553248 - RNA, 22 nt, Human adenovirus C
cgcagcgaugugccccucgcca

SEQ ID NO: 1553249 - RNA, 14 nt, Human adenovirus C
uccuggagaucucc

SEQ ID NO: 1553250 - RNA, 20 nt, Human adenovirus C
acucugacaaagcccaagaa

SEQ ID NO: 1553251 - RNA, 20 nt, Human adenovirus C
aguugccgaggaugaagaag

SEQ ID NO: 1553252 - RNA, 18 nt, Human adenovirus C
gaauuugaagagcuuuug

SEQ ID NO: 1553253 - RNA, 18 nt, Human adenovirus C
aucuccagcggccacacc

SEQ ID NO: 1553254 - RNA, 23 nt, Human adenovirus C
ccgcugcccugguguaccaggaa

SEQ ID NO: 1553255 - RNA, 15 nt, Human adenovirus C
gcggcggcugcugcg

SEQ ID NO: 1553256 - RNA, 15 nt, Human adenovirus C
ucuuccauaagggcc

SEQ ID NO: 1553257 - RNA, 17 nt, Human adenovirus C
uccugaagcaaaaccag

SEQ ID NO: 1553258 - RNA, 20 nt, Human adenovirus C
aguucgugccuucgguuuac

SEQ ID NO: 1553259 - RNA, 19 nt, Human adenovirus C
guagagggcguuggacagc

SEQ ID NO: 1553260 - RNA, 15 nt, Human adenovirus C
cagaaggcgcucgcc

SEQ ID NO: 1553261 - RNA, 20 nt, Human adenovirus C
uggcgcgcccgccagccccc

SEQ ID NO: 1553262 - RNA, 14 nt, Human adenovirus C
aggcacuaaagcaa

SEQ ID NO: 1553263 - RNA, 14 nt, Human adenovirus C
cucacucucuuccg

SEQ ID NO: 1553264 - RNA, 17 nt, Human adenovirus C
uggaucugcgccagcag

SEQ ID NO: 1553265 - RNA, 19 nt, Human adenovirus C
uacaaggaguaucagcagg

SEQ ID NO: 1553266 - RNA, 23 nt, Human adenovirus C
cagcuguuccuuauagugcagca

SEQ ID NO: 1553267 - RNA, 19 nt, Human adenovirus C
cacccaguaccgcagcugg

SEQ ID NO: 1553268 - RNA, 15 nt, Human adenovirus C
agcgcggggugcccu

SEQ ID NO: 1553269 - RNA, 18 nt, Human adenovirus C
cucugguaucucagccgc

SEQ ID NO: 1553270 - RNA, 12 nt, Human adenovirus C
aaacuacaugag

SEQ ID NO: 1553271 - RNA, 18 nt, Human adenovirus C
gcccuaucagcagccgcg

SEQ ID NO: 1553272 - RNA, 24 nt, Human adenovirus C
cuugagcaggccaacgagcgccuc

SEQ ID NO: 1553273 - RNA, 16 nt, Human adenovirus C
uaggagucgcgcagcu

SEQ ID NO: 1553274 - RNA, 17 nt, Human adenovirus C
cuggaccggcugguggg

SEQ ID NO: 1553275 - RNA, 21 nt, Human adenovirus C
cgccuucgaucucagcgcagc

SEQ ID NO: 1553276 - RNA, 13 nt, Human adenovirus C
uacaucugaccuc

SEQ ID NO: 1553277 - RNA, 19 nt, Human adenovirus C
ccagucguagcaggagcgc

SEQ ID NO: 1553278 - RNA, 20 nt, Human adenovirus C
agcaccgguggguugcugaa

SEQ ID NO: 1553279 - RNA, 23 nt, Human adenovirus C
cuccgcaauucuggaagcggugg

SEQ ID NO: 1553280 - RNA, 21 nt, Human adenovirus C
ccagaccaguagacaaggccu

SEQ ID NO: 1553281 - RNA, 22 nt, Human adenovirus C
ccaguagcacuaguauugccac

SEQ ID NO: 1553282 - RNA, 20 nt, Human adenovirus C
ugcgcuugaggcugguccug

SEQ ID NO: 1553283 - RNA, 13 nt, Human adenovirus C
aaacccaaaguca

SEQ ID NO: 1553284 - RNA, 20 nt, Human adenovirus C
cugccagcgccugcacugca

SEQ ID NO: 1553285 - RNA, 15 nt, Human adenovirus C
cagaugccgcggugc

SEQ ID NO: 1553286 - RNA, 18 nt, Human adenovirus C
cuggcgguagaggggcca

SEQ ID NO: 1553287 - RNA, 20 nt, Human adenovirus C
cucguccagacgggccaggg

SEQ ID NO: 1553288 - RNA, 17 nt, Human adenovirus C
acgggcgcaggguccuc

SEQ ID NO: 1553289 - RNA, 13 nt, Human adenovirus C
ucgccggcgcccc

SEQ ID NO: 1553290 - RNA, 23 nt, Human adenovirus C
uucuuaccucugguuuccaugag

SEQ ID NO: 1553291 - RNA, 15 nt, Human adenovirus C
aauuuccaacgugga

SEQ ID NO: 1553292 - RNA, 12 nt, Human adenovirus C
aagcagcuggcc

SEQ ID NO: 1553293 - RNA, 19 nt, Human adenovirus C
caccguuuuuacccaccca

SEQ ID NO: 1553294 - RNA, 16 nt, Human adenovirus C
gcagccucgucacugu

SEQ ID NO: 1553295 - RNA, 15 nt, Human adenovirus C
aggccgaggcagcgg

SEQ ID NO: 1553296 - RNA, 21 nt, Human adenovirus C
ugacggccugguaggcgcagc

SEQ ID NO: 1553297 - RNA, 16 nt, Human adenovirus C
gccagcgccugcacug

SEQ ID NO: 1553298 - RNA, 21 nt, Human adenovirus C
uucaucaaacaacauggaaau

SEQ ID NO: 1553299 - RNA, 22 nt, Human adenovirus C
ccuuucuaccggcacuucuucu

SEQ ID NO: 1553300 - RNA, 21 nt, Human adenovirus C
gcccaggcggcggguacagug

SEQ ID NO: 1553301 - RNA, 12 nt, Human adenovirus C
uacgucaucucc

SEQ ID NO: 1553302 - RNA, 20 nt, Human adenovirus C
accugccaccucccucccaa

SEQ ID NO: 1553303 - RNA, 22 nt, Human adenovirus C
cugcacgucuagggcgcaguag

SEQ ID NO: 1553304 - RNA, 14 nt, Human adenovirus C
agcaaugacagcac

SEQ ID NO: 1553305 - RNA, 14 nt, Human adenovirus C
gcagguggcaccgg
